United States Patent 9,061,059 (MODIFIED POLYNUCLEOTIDES FOR TREATING PROTEIN DEFICIENCY) - sequence listing, part 107

SEQ ID NO: 208500 - DNA, 2082 bp, Artificial Sequence
  Description of Artificial Sequence: Synthetic coding sequence
atggcccagggcagccaccagatcgacttccaggtgctgcacgacctgcggcaaaaatttcctgaggtcccagaagtggtagtcagcagatgcatgctgcagaataataataaccttgacgcttgctgcgctgttctcagtcaggagtctactagatatttatacggggaaggcgacctcaacttttccgatgactcgggtatctcaggcctgcgcaaccatatgacaagtctcaatttagacctgcagagtcagaacatatatcaccacggacgggagggtagccggatgaatgggtctagaacccttacacacagtatttcggacggtcagctgcagggaggacagagcaattcggagctattccaacaagagcctcagacagcaccagcccaggtcccccaggggtttaacgtgtttggaatgtcaagttccagcggcgcttctaatagtgccccacacctgggtttccacctgggaagcaagggtaccagttccctctcccagcaaacaccgagatttaacccgattatggtgacccttgccccaaatatccagaccggtcggaatacacctacaagcctgcacattcacggagtgcccccacccgtgctaaattcaccgcaggggaattccatctacataaggccgtatattaccactccaggtggcaccacccgccagacacaacagcattcaggctgggtctcccagttcaaccccatgaatccccagcaggtgtaccagccctcacagcccgggccctggaccacgtgcccagcaagtaacccattgagccataccagtagccagcagccaaaccagcaggggcatcagacgtcacatgtgtacatgccaatctcctcccccactaccagtcaaccccccaccattcatagtagcgggtcctcacagtctagcgctcactctcaatacaatattcagaacatctcaactgggccacgtaaaaatcagatcgagataaagctggaaccgccacagagaaataacagctccaaattgcggtccagcggtccccgcacaagttcaacaagttcctcagtcaacagccagacacttaacaggaaccagccgacagtatacattgcagcatctcctcccaacaccgacgagcttatgagtcgctcccagccaaaggtgtacatcagtgccaatgcagcaactggcgacgagcaggtgatgcgtaatcagcctaccttgttcatttctacgaatagcggggcatcagccgcctcccgcaacatgagtgggcaagtgtccatgggaccagcatttatccaccaccatccaccaaagagccgggccattgggaataatagcgctacctccccccgtgtagtggtgacccagccaaacaccaaatatacatttaagattactgtcagtccaaataaacctccagccgtgagcccaggcgtggtgtcacctacttttgaactgactaacctgttaaatcaccccgaccattacgtggagacagagaatattcagcacctcacagatcctaccctcgctcatgtggaccgtatcagtgaaaccagaaaactcagtatggggtctgacgacgcagcctacacacaggccctgctcgtccaccagaaagcaagaatggagagactacagagagaactcgagattcagaagaaaaagctggacaagctgaagtcagaagtgaatgagatggaaaataacctaactcggaggaggttgaaaagatccaactctatcagccagattccctctctggaggaaatgcagcagctgcgttcctgcaaccggcagctgcaaatcgacattgactgcctcaccaaggagatcgacctgtttcaggcaagagggcctcattttaaccctagcgctatccataacttttacgataacattgggtttgtgggaccagtgcctcccaaacccaaggaccagcgctctatcatcaaaacacccaagacacaggacaccgaggatgatgaaggggctcagtggaattgcactgcctgtacgttcctcaaccacccggcgctcattcggtgcgagcaatgtgagatgcctcgccacttttag

SEQ ID NO: 208501 - DNA, 714 bp, Artificial Sequence
  Description of Artificial Sequence: Synthetic coding sequence
atgagcgacagcgacctgggcgaggacgagggcctgctgagcctggcagggaagcgcaagagaaggggcaacctccccaaagagtccgttaagattctccgtgactggctctaccttcatcggtacaatgcatacccatcagagcaggaaaagctgtcgctatcaggacagacaaatttgtctgtgctgcagatttgcaactggtttattaatgctcgccggcgactgttgcccgacatgctccgcaaggatggaaaggatcctaaccaattcacaatatcaaggcgtggagggaaagccagcgacgtcgccctaccgcggggttcctccccttccgtcttggcagtctcagtacccgcccctaccaacgtgctgtcattgtctgtctgtagtatgcccctgcattccggtcaaggtgaaaagcccgcggcaccttttccgagaggagagctggagtccccgaaaccattggtaacccctggtagtacgttaacgctattgacaagggccgaggccggctctcctaccggaggcctgttcaatacccccccaccaacacctcctgagcaggataaagaagacttcagctcgttccagcttctggttgaggtggccctccagagagctgccgagatggaactgcagaaacagcaggacccgagtctgccactgctccacaccccgattcccctagtgtccgagaatccccaatag

SEQ ID NO: 208502 - DNA, 714 bp, Artificial Sequence
  Description of Artificial Sequence: Synthetic coding sequence
atgagcgacagcgacctgggcgaggacgagggcctgctgagcctggccgggaagcgaaagcggcgaggcaaccttcccaaggaaagtgtgaaaatccttcgcgattggttgtatctgcaccgatataatgcatacccaagtgagcaggaaaagctcagtctcagtggacaaactaacctgtcagtgctgcagatctgcaactggttcattaatgccagaaggagacttctgccagacatgttgcgtaaggatggcaaggaccctaatcagttcacgatctctcggagaggaggaaaggccagcgatgtggcacttccaaggggcagctcacctagcgtccttgccgtcagcgtacccgctcccacaaacgtgttgtctctcagtgtgtgtagtatgcctttgcacagtgggcagggggagaaaccagccgccccttttcccagaggcgaactcgaatctccaaagcctctggttacccctgggtcgacccttaccctgctgacacgggccgaagctggctccccgacgggcggcctcttcaataccccaccgcctaccccacccgaacaggacaaagaggacttcagttctttccagctactcgtggaggttgctctgcagcgggcggcagagatggaacttcagaaacagcaggatccatcgctaccactgttgcatactccaattcccctcgtgagcgagaacccccagtag

SEQ ID NO: 208503 - DNA, 525 bp, Artificial Sequence
  Description of Artificial Sequence: Synthetic coding sequence
atgagcgacagcgacctgggcgaggacgagggcctgctgagcctggctggaaagagaaaacgtagaggtaatctgcctaaggagagcgtaaaaattttgcgagattggttatacctccaccggtacaatgcctacccctcggaacaggagaagctgtcactgtccgggcaaacaaatctgtcagtactgcaaatctgcaattggttcatcaacgcccgccgcagactgctcccggacatgttgagaaaggatggcaaagaccccaaccagttcactattagccgccggggtgggaaagcgagcgacgttgcactgcctcgtggctccagtccttcagtccttgctgtgtccgttcctgcacccacaaatgttttgagtttgagcgtgtgctcgatgcctctgcacagcggccagggagaaaaacccgcagcgccgttccctcgaggcgagcttgagtccccgaaacccctcgtgacaccaggatccaccttgacattacttacaagagctgaagctggctcttag

SEQ ID NO: 208504 - DNA, 714 bp, Artificial Sequence
  Description of Artificial Sequence: Synthetic coding sequence
atgagcgacagcgacctgggcgaggacgagggcctgctgagcctggcaggaaaacgcaagcgtcggggcaatcttccgaaagagtctgtgaaaattctaagagactggctctacttacacaggtacaatgcataccctagtgaacaagagaagttaagcctcagtggtcagacgaacctaagtgtcctgcagatctgcaattggttcataaacgcccggcggagactccttcccgacatgttacgcaaagatgggaaagacccaaaccagttcactattagccggagaggcggtaaagctagtgacgtggccctgccacgaggaagttcccccagcgtgttagccgtgtctgtccctgctcctaccaacgtgctcagtctcagtgtttgtagcatgccccttcattccggccaaggagagaagcctgcagccccattcccaaggggggagctagaatctccaaagcctctggttacaccaggttcaactctgactctgctcacaagagccgaggctgggtcccccaccgggggactgtttaacaccccccctcccaccccccctgagcaggataaggaagacttctcctcatttcaacttctggtggaagtcgccttacaaagagccgctgagatggagctgcaaaaacaacaagaccctagcttgcccctgctgcatacaccaatcccccttgtatcagagaatccacagtag

SEQ ID NO: 208505 - DNA, 726 bp, Artificial Sequence
  Description of Artificial Sequence: Synthetic coding sequence
atggaggccgccgccgacggccccgccgagacccagagccccgtggagaaagattcccccgccaaaacacagtcccccgcacaggacacatcaataatgtcacggaataacgccgatactgggagagtgctggctctacctgaacacaagaaaaagaggaagggtaacttgcccgcggagtcggtcaagatattaagggactggatgtataagcatcgcttcaaggcgtatcctagcgaagaggaaaagcagatgctgtctgagaagacaaacctgagcctcctgcagataagcaattggtttattaacgctcgaaggaggattcttcccgatatgttgcaacaacggcggaacgatcctattattggccataaaactggaaaggatgctcacgcgacacatctacagtccacggaggcttccgtaccggccaaatccggcccctcgggcccagacaacgtgcagtctctgccactttggcctctccctaaggggcagatgtcacgcgaaaagcagcctgaccctgaaagtgctcctagccagaagctcacaggcatagcccagcccaagaagaaggttaaggtgtcagttaccagtccttcgagcccggagcttgtctccccagaagaacatgcagatttttcgagcttcttgctgcttgtggatgccgccgttcagcgagcggctgagctcgagctcgagaagaagcaggagcctaacccgtag

SEQ ID NO: 208506 - DNA, 726 bp, Artificial Sequence
  Description of Artificial Sequence: Synthetic coding sequence
atggaggccgccgccgacggccccgccgagacccagagccccgtggagaaggacagcccagccaaaacacagtcaccagcacaggatacaagcatcatgtcccgtaacaacgctgacacgggaagggttcttgctcttccagagcataaaaagaagagaaaaggaaatctccctgctgagagcgtgaagatcctcagagattggatgtacaagcaccgattcaaggcctatccctctgaggaagagaaacaaatgctgtcagagaagacaaatttatcattgttgcagattagcaattggttcattaacgctcggagaagaatcctgcccgacatgctgcagcagagacggaatgaccctatcatcggacataagacaggtaaagatgcccatgctacacatcttcagtcgacagaggcttctgtccccgcaaaatctgggccgtccggccctgacaatgtgcagagcctgcccctttggccgctacccaaggggcagatgagccgagaaaagcaacccgatcctgagagcgctcccagccagaaactgaccggaatagctcagcccaagaagaaggtgaaagtgtccgtgacctcccctagtagccccgaactggtctcacccgaagaacacgccgactttagctccttcttgctgctggtagatgccgctgtgcagcgagccgctgagctggagcttgaaaagaagcaggagccgaatccatag

SEQ ID NO: 208507 - DNA, 558 bp, Artificial Sequence
  Description of Artificial Sequence: Synthetic coding sequence
atggaggccgccgccgacggccccgccgagacccagagccccgtggaaaaggatagtcctgccaagactcaaagccctgctcaggatactagcatcatgtctcggaataatgcagacaccggacgtgtactggctctccccgaacataagaaaaagagaaaggggaacttgcccgctgagagcgtgaagattctgagagattggatgtacaagcaccggtttaaagcataccccagcgaagaggaaaagcaaatgctgtcagagaaaacaaatttaagcttgctgcgcattagtaactggttcatcaacgctcggaggaggattctgcccgatatgttacagcaaaggagaaacgaccccattattggccacaaaacaggaaaagacgcccacgccacacatctgcagagtaccgaagccagcgttcctgctaaatctggtcccgtagtgcaaaccatgtacaaggcctgcccatgtggaccttgtcagagggcacgttgtcaagagaggagcaaccagattcggtcgcgtccactcgcccgcagctctcccgagtag

SEQ ID NO: 208508 - DNA, 558 bp, Artificial Sequence
  Description of Artificial Sequence: Synthetic coding sequence
atggaggccgccgccgacggccccgccgagacccagagccccgtggagaaggactccccggcaaaaacccagtcacctgcccaggacactagcatcatgagcaggaataatgccgacaccggtcgagtgctcgctctgcccgagcataaaaaaaagcggaagggaaatttgcccgcggagagtgtgaaaattctgcgggattggatgtataagcaccgcttcaaagcttacccatcagaagaagaaaaacagatgttgtctgagaagacaaatctcagtcttctccgtatctcaaactggtttattaacgcacggcgaagaattctgccagatatgctccaacaaagacgcaacgatcccataattggacataaaacaggtaaggacgcccacgccacccacctccagtcgacggaagcctcagttccagcaaagagtggccctgtcgtccagaccatgtacaaggcctgcccctgtggcccctgtcagcgcgctcgatgccaggaacgctcaaatcagatacggagcaggcccttggcgagatccagtccagagtag

SEQ ID NO: 208509 - DNA, 1773 bp, Artificial Sequence
  Description of Artificial Sequence: Synthetic coding sequence
atggccggcgccgtgcccggcgccatcatggacgaggactactacggatccgccgctgagtggggggacgaagcggacggcggtcaacaggaggatgacagcggcgagggcgaggatgatgccgaagtccagcaggaatgcctgcataaattcagtacaagagattatataatggagccatccatttttaatactctcaaacgatattttcaggccggcggctctcccgagaatgtgatccagcttcttagtgagaattataccgcagttgcccagaccgtgaatctcctggcagagtggcttatccaaaccggcgttgagcccgttcaagtgcaggagactgtcgagaatcacctcaaatctctgttgattaagcactttgaccctaggaaggctgatagcattttcacagaggaaggcgagacccccgcttggttggagcaaatgattgcccacacaacctggcgcgaccttttttataagttggctgaagcccaccctgactgtcttatgctgaattttactgttaagctgattagtgatgcgggctatcagggggagatcacctctgtgtccactgcttgtcaacagttagaagtattcagtagggtcctccggactagcctagccacaattctggatggaggcgaggagaatctggagaagaacctgcccgaattcgcaaagatggtttgccacggagagcatacttacctctttgctcaagctatgatgtccgtcctggcccaagaagaacaaggcggctcagctgtgagacgcatcgcacaggaggtgcagcgattcgctcaggaaaagggacatgacgccagccagatcacactggcacttggaacagccgctagctacccgcgtgcttgtcaggccctgggagctatgctgtccaagggtgcacttaatcctgccgacatcactgtgctcttcaaaatgttcacatcaatggacccacccccagtagagctcatccgcgttccggccttcttagatctctttatgcagagcctctttaagccgggcgccaggatcaatcaggatcacaaacacaagtacatccatattcttgcctacgctgcctccgtggttgagacgtggaaaaaaaataaaagggtctcaatcaataaggacgagttgaagagcacgtcaaaggccgtggaaacagtgcacaatttatgttgtaatgaaaacaaaggggcatccgagttggtggcagaactgtccaccttgtatcagtgtataagatttccagtcgttgccatgggcgtcctgaaatgggttgattggacagtgagcgagcctaggtattttcagctccagacggatcatacgcctgtacatctcgctctcctggacgagatttccacgtgccatcagcttcttcatcctcaggtcctccagttgctggtaaagttattcgaaaccgagcattcacagctcgatgtcatggaacaattggagctcaaaaagacgcttctcgatagaatggtccaccttctctctcgcggatatgttcttcccgtggtgagctatatcagaaaatgcctagagaagttggacacagacatttccttgatacggtattttgtcacagaggttttggatgtgattgcacccccatatacctctgactttgtgcaattgtttcttccaattctcgagaacgactccatagctggcaccattaaaactgaaggcgaacacgaccctgttaccgaatttatcgctcactgcaaaagtaatttcatcatggtcaattag

SEQ ID NO: 208510 - DNA, 1773 bp, Artificial Sequence
  Description of Artificial Sequence: Synthetic coding sequence
atggccggcgccgtgcccggcgccatcatggacgaggactactacggctccgctgcagaatggggggacgaagctgacggggggcagcaggaggacgactccggtgaaggtgaggatgacgcagaagtgcagcaagagtgcctgcataagttctccactagggattatattatggagcccagcatatttaacaccctgaagagatacttccaggctggcggctctcctgagaacgtgatccagctactatcagaaaattatacggcagtggcccagaccgttaatttactagcagagtggctgatccagaccggcgtggaacctgtacaggtgcaagagactgtcgaaaatcacctcaaaagtctgctgattaaacacttcgacccacggaaggccgacagtatctttaccgaggaaggagaaacacccgcatggctggagcagatgattgcgcatactacctggcgggacctattctataaactcgctgaagcgcaccctgattgtctgatgctaaatttcacggtcaagctgataagcgacgccggatatcagggcgagatcaccagcgtgagcactgcatgccagcagctcgaagtgttttcacgggtgctgagaacctccctggcaaccattttggatgggggcgaggagaacctagaaaaaaatctgccggagtttgccaagatggtatgccacggcgagcatacatacctgtttgcccaggccatgatgtcggttctcgcccaagaagagcaaggtggtagtgctgtgagaagaatagcccaggaggtgcagaggtttgcccaggagaaaggacatgatgctagccagatcactctcgcccttggcaccgccgcctcctacccacgggcatgccaggcactgggggcaatgctctctaagggtgctctgaatcccgccgacatcactgtcctgttcaagatgtttacatctatggatccaccaccagtggaattgatccgcgtgccagcctttctggaccttttcatgcagtccctgttcaagcccggcgcgagaattaaccaggatcacaaacataaatacatccacatcctggcttacgctgcctcagtggtagagacttggaaaaaaaataagagggtatcaatcaacaaagatgagctgaagtccactagcaaggcagttgagacagtccataacctgtgctgcaacgaaaacaagggcgcctccgaactggtagccgaacttagtacactgtaccagtgtattcggttccccgtagtggccatgggcgtgctcaagtgggtggattggaccgtgtcggagccacgctacttccagttgcagacagaccacactcccgtgcacctggctttgttggatgagattagcacttgtcatcagctgctacacccacaggtgctccagctccttgtaaaactctttgagacagagcactctcagctggacgtcatggagcagcttgagttgaagaaaactctgttggatagaatggtgcacctcctgagccgaggatatgtactgccagtggtgtcttatattagaaaatgcctggaaaagttggatacagacattagtttgattcggtacttcgttaccgaagtgcttgatgtgattgcccccccatatactagtgatttcgtgcagctattcctcccaattttagaaaacgatagtatagccgggactataaaaacagagggtgagcacgaccccgtaaccgaatttattgcacactgtaagtccaattttattatggtgaactag

SEQ ID NO: 208511 - DNA, 774 bp, Artificial Sequence
  Description of Artificial Sequence: Synthetic coding sequence
atgcccgcccggtgcgtggccgcccactgcggcaacaccaccaagagcggaaaaagcctgtttcgcttccccaaggaccgcgccgttcgactgctctgggaccgatttgtgcgggggtgccgggctgactggtacggagggaatgacagatctgtaatctgtagcgaccattttgctccagcctgctttgacgtaagttccgtgattcagaagaacctgagattttcacaacgcttaaggctggttgccggagctgttccaaccctccacagagtgccggccccggctcccaaaagaggggaggaaggggaccaggcgggtcggctcgacactcgcggagaactgcaggctgctaggcacagtgaggctgccccagggcctgtgtcctgtaccaggcccagagccggcaagcaggccgccgccagtcagataacatgcgaaaatgagctggtgcaaacacaaccacatgccgacaatccttcaaacaccgtgacaagcgttccgacgcactgtgaggaaggacccgtgcataagtcaactcaaatcagcttgaagagacccagacaccgctccgtaggcattcaggccaaagtgaaagcttttgggaagcggctgtgcaatgctaccactcagaccgaagagctctggtctcgcacatcctcccttttcgatatatacagcagcgacagcgagacagataccgattgggacattaagtcagagcaatccgatctgtcctatatggcagttcaagtgaaggaggaaacctgttag

SEQ ID NO: 208512 - DNA, 498 bp, Artificial Sequence
  Description of Artificial Sequence: Synthetic coding sequence
atggagccccccaagatgaaccccgtggtggagcccctgagctggatgttgggtacttggcttagcgatcccccgggggccggcacctaccctacgctgcagccttttcaatacttagaggaagtgcacatttcccacgtaggtcaacccatgctgaactttagtttcaacagctttcatccagacacccgaaagccaatgcatagagagtgcggctttatccgcttaaagcccgatacaaacaaggtggcttttgtgtccgctcagaatacaggcgtcgtagaagtggaggaaggcgaagtcaacgggcaggaactgtgtattgcttcgcactccatcgctaggataagcttcgccaaggagccacacgtagaacagataacaagaaagttccgtctcaactccgaggggaagctggagcagacggtaagtatggccacaacaactcagcccatgacccagcacctacacgtgacctataagaaagtgacaccgtag

SEQ ID NO: 208513 - DNA, 1734 bp, Artificial Sequence
  Description of Artificial Sequence: Synthetic coding sequence
atggtgatctgctgcgccgccgtgaactgcagcaaccggcagggcaagggagagaaacgcgctgtgagctttcatcggtttcctctcaaagactccaagaggctcattcagtggctcaaggctgtgcagcgagacaattggacaccaaccaagtatagttttctctgttcggagcactttactaaggattccttcagcaagcggctggaggatcagcatcggctcctgaaaccaaccgcagttccgtctatttttcacctcacagagaaaaaaagaggggcaggaggacacggccggacacgaagaaaagacgcctccaaagcgactgggggtgtgagagggcattccagtgctgccactagccgaggagctgccgggtggtcgccgagttccagtggcaacccaatggcaaagcccgaatcccggcggctaaagcaggccgccttacagggggaagcaaccccgcgggcagcacaggaggcagccagccaggaacaggcacagcaggcactggagcgcacaccgggggatgggcttgccaccatggttgccggctcccaggggaaggccgaggccagcgccaccgatgccggcgacgagagcgccaccagcagcattgaaggcggcgtgaccgataagagcgggatctctatggacgattttacaccccccggttctggcgcttgcaagttcattgggtccctgcacagctatagtttctcgtcaaagcacactcgcgagaggccctctgttccgcgggaacccatcgataggaagcggctcaagaaagacgttgaaccgtcttgctccgggagttccctgggacccgataaaggtcttgctcaatcccccccttcttccagcctcacagcaacgcctcaaaaaccgagccagagccccagcgccccccctgccgacgtcactcctaaaccagcaacagaagctgtacagagcgagcacagtgacgcatcacctatgtcaataaatgaggtgatcctctcagcatctggggcctgcaagctcatcgactcccttcacagctattgttttagtagcagacagaataaaagccaggtgtgttgtctgcgtgagcaggtcgagaagaagaacggggagctgaagagccttcggcagagagtgtcccggagcgactctcaggtccgtaagcttcaagagaagctggacgagctgcgccgggtgagcgtaccttatccctcatcactcctcagccccagcagggagcctccaaagatgaatcctgtcgtcgagcccttgtcttggatgctgggcacatggctgtcggaccctccgggagccggcacttatccaacactgcagccctttcagtacctggaagaggtgcacatctcccacgtcggtcagccaatgctcaactttagcttcaattcttttcaccctgatacccgtaagcccatgcaccgtgaatgtggcttcatccggttaaagcctgatactaataaggtcgcttttgtcagcgctcaaaacacaggggtcgtggaagtagaagagggcgaggtcaatggccaggaactgtgtattgccagtcactccatcgcccggatctcatttgccaaagagcctcacgtcgaacagattactcgtaagttccggctgaatagcgagggcaagctcgaacagacagtgtcaatggccacgacaacacagcctatgacccagcacctgcatgttacttacaaaaaagtaactccttag

SEQ ID NO: 208514 - DNA, 510 bp, Artificial Sequence
  Description of Artificial Sequence: Synthetic coding sequence
atgagcatcaacgaggtgatcctgagcgccagcggcgcctgcaagctcatagactcattacacagttattgtttctcttctaggcagaacaagagtcaagtatgctgtttgcgcgagcaggtggagaaaaagaacggtgagttaaagtccctgcgccagagggtcagtaggagcgacagtcaagtcaggaagctccaggaaaagctggatgaactgcggcgggtcagtgtgccatatcccagtagtctgctctccccttcacgggagccacccaaaatgaaccccgtggtggagccactgtcttggatgctgggaacttggcttagtgatcccccaggcgccggcacctatccgaccctccagccctttcagtacctcgaggaagttcatatttctcatgtcggacagccaatgctgaacttcagcttcaattccttccaccccgatacgaggaaacccatgcatagagaatgtggcttcatccggctgaagcccggtagttccggatag

SEQ ID NO: 208515 - DNA, 1062 bp, Artificial Sequence
  Description of Artificial Sequence: Synthetic coding sequence
atgaagcgggacagctgggtgcccagcaagtaccagttcctgtgcagcgatcatttcacgcctgacagcctcgatattcgctggggcatacgatacctaaagcagacagcagttcctacaatattctccctccctgaagacaatcagggcaaggatccttctaagaaaaaaagccaaaagaaaaacctggaggatgagaaggaagtctgcccaaaggccaagtccgaggaatcctttgtactgaacgagacaaagaaaaacatcgtgaacacagacgtgccacaccagcacccagagctactacatagctcctcgctagtcaagccgcccgcgccaaagacggggtctatacagaacaatatgctgactctcaatctcgtcaagcagcatacaggaaaacctgaaagtacactggagacgtcagtgaaccaggatacagggcgcggagggtttcacacctgctttgagaacttgaactccactaccatcactctaaccacaagtaattcagaatccatacatcagtctctggaaactcaagaggtgctggaggtcacaacctcccaccttgctaacccaaatttcaccagtaactctatggaaattaagagcgctcaggagaatccattcctcttcagcactatcaatcaaacagtagaagaactcaatacaaacaaggagtccgtcatcgccatatttgtgccggcggagaactctaaaccaagtgtcaattccttcatctccgcgcagaaggagaccacagaaatggaagatacggacatcgaagacagcctctataaggatgtagactacggtaccgaagtgttacaaattgagcattcctattgcaggcaggatattaataaagagcacctttggcagaaggtgtccaaactgcattcaaagattactctgcttgaactaaaagaacagcagacactcggccgccttaaaagcctggaggccctgatcaggcagctaaaacaggaaaattggctgagcgaagagaatgtcaaaatcatcgagaatcactttactacctacgaagtgaccatgatttag

SEQ ID NO: 208516 - DNA, 1188 bp, Artificial Sequence
  Description of Artificial Sequence: Synthetic coding sequence
atgccccggtactgcgccgccatctgctgcaagaaccggcggggcaggaataataaagacagaaaactgtcattttacccatttcctctacacgacaaagaacgcttggaaaagtggttaaagaacatgaaaagggatagttgggtcccctcaaaatatcaatttctgtgctccgaccactttacacccgattctcttgatatccggtggggaatacggtatctgaaacaaactgcagttcctacgattttttccctcccagaagataatcagggaaaggacccctccaagaagaagagtcaaaaaaaaaaccttgaagacgaaaaggaggtttgtccaaaggcgaaatcggaagaatctttcgtgctgaatgagactaagaagaatattgtgaatactgacgtgcctcaccagcaccccgagctgctccactcctcatctctcgtgaagccacctgcccccaagaccgggtctatccagaacaacatgctcacgctcaacctggtgaagcaacatacaggaaagccagaatcaaccctggagacttccgttaaccaggacactggccgtggagggttccacacctgctttgaaaatctgaatagtacgacaataactcttacaacctcaaacagtgagagtattcaccagtccctcgagacccaggaggtgctggaggtgaccacctctcatctggccaatcccaactttacatcaaacagcatggagatcaagtccgctcaggaaaacccattcctgttctccactataaaccagaccgtggaggaactaaatacaaataaggaaagcgttatcgccattttcgtgcctgccgagaactctaaaccctctgtgaatagtttcatctccgcccagaaagagacaaccgagatggaggataccgatatcgaagacagtttatataaagacgttgactacggaaccgaggtgctgcagatagagcatagttactgcaggcaggatataaacaaagagcacctgtggcagaaagtatccaagctgcacagtaagataactctactggaacttaaagagcaacagacactcgggaggctgaagagcctggaagcccttatacgacagctaaagcaggaaaactggctgtccgaggaaaatgtgaaaatcattgagaaccactttacaacttacgaggtgactatgatatag

SEQ ID NO: 208517 - DNA, 669 bp, Artificial Sequence
  Description of Artificial Sequence: Synthetic coding sequence
atggtgaagtgctgcagcgccatcggctgcgccagccggtgcctgcccaatagtaagctaaaaggcttgacattccacgtgttcccaaccgacgaaaacatcaaaaggaaatgggtattggcaatgaaacgactggatgtcaatgccgccgggatctgggagccgaagaaaggcgacgtgctctgttctcgccattttaagaagaccgattttgacaggagcgccccgaacatcaaattgaagcccggagtgattcctagcatctttgactccccttatcatctgcaaggcaagcgggagaagctgcactgccgaaaaaattttacacttaaaactgtgccagctactaattataatcaccacctcgtgggcgcaagcagttgtatcgaagagtttcagtctcagttcatttttgagcactcctattcagtgatggacagccctaagaaactgaaacataaactggatcacgtgattggagaactggaggatactaaggagtctctccggaacgtgcttgaccgggagaagagattccagaaatccctgaggaagacaatcagagagttgaaagacgagtgtctcatatcgcaggagacagctaatagactggatactttctgctgggactgttgccaggagtccattgagcaggattacatctcgtag

SEQ ID NO: 208518 - DNA, 99 bp, Artificial Sequence
  Description of Artificial Sequence: Synthetic coding sequence
atggtgaagtgctgcagcgccatcggctgcgccagccggtgcctgccgaacagcaagcttaagggacttacattccacgtattccctacagacgagtag

SEQ ID NO: 208519 - DNA, 243 bp, Artificial Sequence
  Description of Artificial Sequence: Synthetic coding sequence
atggtgaagtgctgcagcgccatcggctgcgccagccggtgcctgccgaattctaaactgaaagggttaacctttcatgtgtttccaacagatgaaaatatcaagcggaaatgggtgcttgccatgaaacgcctcgacgtcaacgctgcaggcatctgggagcctaagaaaggcgatgtgctgtgctctcgtcactttaaaaagaccgacttcgataggagcgcgcctaatattaaactgtag

SEQ ID NO: 208520 - DNA, 669 bp, Artificial Sequence
  Description of Artificial Sequence: Synthetic coding sequence
atggtgaagtgctgcagcgccatcggctgcgccagccggtgcctgcctaactcaaagcttaaagggctgacgttccacgtattccccacggatgagaacattaagcggaaatgggtgctggcaatgaagcgcctggatgttaatgcagccgggatatgggagccaaagaaaggagacgtgttatgtagcagacacttcaagaaaaccgatttcgaccgttcagcccccaacataaagctaaagcccggagtgattcccagtatttttgactcaccctatcacctgcagggcaaacgggaaaaactgcactgtaggaagaacttcaccctcaagaccgtcccagcaaccaactataatcaccacctcgttggggccagctcatgcattgaagagttccaatcacagtttatcttcgaacacagctattcagtaatggactccccaaaaaagttgaagcacaaactggatcatgtcataggcgagctggaagacactaaggagtccctgaggaacgtgttagacagagagaaacggtttcagaagagcctgcggaaaacgattagagagctgaaggacgagtgcctgatttctcaggagaccgctaaccgacttgacaccttctgctgggattgttgtcaggagtccatcgaacaggattacatctcgtag

SEQ ID NO: 208521 - DNA, 825 bp, Artificial Sequence
  Description of Artificial Sequence: Synthetic coding sequence
atgcccaagtactgccgggcccccaactgcagcaacaccgccggccgccttggtgccgataatcgtcccgttagcttctacaaatttccgctgaaggacggcccacgactccaggcttggcttcagcatatgggttgtgaacactgggtgccatcgtgccaccagcacctatgctccgaacacttcactccctcatgcttccagtggcgatggggtgtgcggtaccttagacccgatgcagtcccgtctatcttctcaagaggtccccctgctaaatcccaaagacgaacaaggagcactcaaaagcccgtaagcccccctccacccctccaaaaaaacactccattgccccagtcacccgctatccccgtgagtggccccgtaaggctggtggtcttggggcccacatctggaagccccaagactgtggctactatgttgttaacacccttggctcccgcccctacccccgaaaggtcccagcccgaggtgccagcccagcaagcgcagacaggcttgggacctgtgcttggcgccttacagcggcgagttagacgcctccagcgctgccaggaaagacaccaggcccagctccaggccctggagcgcctggcacagcaacttcacggagagtcactattggcgagagcacgaagagggttgcaaagactgactacagcacaaacattgggtccagaagagtcacagacgttcacaattatatgtggcggccccgacattgccatggtattagcccaggatccagccccggcaaccgtagacgctaaacctgaactgctcgatactcgcattccttccgcttag

SEQ ID NO: 208522 - DNA, 825 bp, Artificial Sequence
  Description of Artificial Sequence: Synthetic coding sequence
atgcccaagtactgccgggcccccaactgcagcaacaccgccggcagactgggagccgacaatcgacccgtgtccttctacaaatttccactgaaggacggccccaggcttcaagcatggctgcagcatatggggtgtgagcattgggtacccagctgtcaccaacacttatgttctgaacactttacaccttcctgttttcaatggcgttggggcgtgcgttatctccgtccagatgccgtgccaagcatcttttctagaggacccccggcaaaaagccaacggaggactagatctacccagaaaccagtttctcctccacctccgctacaaaaaaacacacccctcccacagtctcccgcaattcctgtctctgggcctgtccgactggtcgttctcgggcctacctccggtagtcctaaaaccgtcgccactatgctcctgacgcccctcgcacctgcgcccacaccagagcgtagtcagccagaggtgcctgcccaacaagcgcagaccggcctcggccctgtactcggggctctccagcgtcgagtaagaagactgcagaggtgccaagaaaggcatcaggcccagctgcaggcacttgagcgcctggcgcaacagctacacggtgaaagcctcctggctagagccaggcggggacttcaaaggctgaccactgcacagacattgggcccagaggagtcccaaaccttcacgattatctgcggaggtcctgatatcgccatggtactggcccaggaccctgccccagcgaccgtggatgcaaagcccgaacttctggacactaggattccatctgcctag

SEQ ID NO: 208523 - DNA, 390 bp, Artificial Sequence
  Description of Artificial Sequence: Synthetic coding sequence
atgctgctgacccccctggcccccgcccccacccccgagcggagccagcctgaagtgccggcacaacaggcccagacgggactgggtcccgtgttgggcgcactgcaaaggagggtgcgccgcctgcagcgttgtcaggagcgacaccaggcgcagctccaggcactggagaggctggcgcaacagctacatggggagagcttattggcccgcgcccggcgtggactgcagagacttacaacggctcagaccctgggtccagaggagtctcagacatttaccattatttgcgggggccccgacattgcaatggtcctggcccaggacccagctcctgcgactgtggatgctaaacccgaattgcttgatacaagaatacccagcgcttag

SEQ ID NO: 208524 - DNA, 2712 bp, Artificial Sequence
  Description of Artificial Sequence: Synthetic coding sequence
atgacccggagctgcagcgccgtgggctgcagcacccgggacaccgttctgagcagagagcgtggcctctcttttcatcagttcccaacagacacaatccagcgctccaagtggatacgtgcagttaatagggtcgaccctcgctcaaaaaagatttggatccctgggccaggggccattttgtgcagcaagcacttccaagaatcggatttcgagtcctatggaataaggaggaaactcaagaaaggagctgtgccctcagtttcactgtataaaataccacagggtgtgcatttgaagggaaaggcacggcagaaaatcctgaagcagcccttacctgataatagccaggaggtagcaaccgaggatcataactactccttaaagaccccacttacgattggagccgagaagcttgctgaggtccaacagatgctgcaggtaagtaagaagagacttatctcagttaagaactaccggatgatcaagaaaagaaaaggcctcaggctaatcgacgcgttagttgaggagaaactgctctcagaggagacagaatgtctactgcgagcccaattctccgactttaaatgggaactgtacaactggagggaaaccgatgagtacagcgccgaaatgaaacagtttgcttgtactctgtacttatgttcgagtaaggtctacgactatgttcgtaaaatcctgaaactgccacacagctctattctcagaacttggctgagtaagtgtcagccctcacccgggtttaatagtaacatattctcattcctgcagaggcgagtggagaacggcgatcagctgtaccaatactgcagcctgctgatcaagagtatgccactcaaacaacaactgcagtgggacccaagtagccactcgctccaaggctttatggacttcggcctggggaagctggatgccgatgagacaccgcttgccagcgagacagtccttttgatggccgtgggcatctttgggcattggaggactccgctcggatatttttttgtgaatcgcgcctccggctacctacaggcccagctccttcgcctgacgattggtaaactttccgacatcgggatcacagtactcgcagtgaccagcgacgcaacagcacactctgtgcaaatggccaaggccctcggaatccatatcgatggagacgatatgaaatgcacgttccagcatccatcaagttcatctcagcagattgcttacttttttgattcctgtcacctgctacgactcattaggaacgcattccagaattttcagagcatacaatttatcaatgggatagctcactggcagcatctggtagaactggtcgccctggaggaacaggagctgagtaatatggaacggatcccgagcaccctcgccaacctgaaaaaccacgtactaaaggtgaactcggcaacgcaactcttttctgagtctgtggcctccgccctagagtacctgctctctctggacttgcccccgtttcaaaattgtattggcacgatacactttcttagactaattaacaatctgttcgacattttcaacagccgtaactgttatggtaaaggcctcaaaggaccactgcttccagaaacctactcaaagatcaatcatgtgttgattgaggcgaaaactatcttcgttaccctctctgatacatccaataaccagattatcaagggcaaacagaagctggggttccttgggtttctccttaatgcagaatcattaaagtggctgtatcaaaactacgtgttcccaaaggtgatgcctttcccctatctgctgacctataaatttagccatgatcacctggaattgttcctaaagatgcttagacaggtccttgtaacaagtagctcccccacatgtatggcatttcagaaggcttactataacctcgagacgagatataaatttcaggatgaggtgttcctgtccaaggtctccattttcgacatctctattgccaggagaaaagatctcgcattatggaccgtgcagcggcagtatggggtttccgtcaccaagacggtttttcacgaggaggggatatgtcaggattggtctcattgctcactgagtgaggccctcctggatctgtccgatcataggaggaatttaatttgttacgcaggatacgtcgctaataagctctcagctctccttacttgcgaagattgcatcacagccctctacgcgtctgatctcaaagccagcaagattggcagcttgctgtttgtgaagaagaagaacggcttacactttccttccgagtcactctgccgcgtcattaatatctgtgaacgcgtggtaaggacacactctcggatggccatctttgaactggtgtcaaaacaacgcgagctgtaccttcagcagaaaattctatgcgagctgagtggccatatcaatctcttcgtcgatgtgaacaagcacctgtttgacggggaagtatgcgcaataaatcatttcgtgaagttgctgaaagacattatcatctgcttcttgaacatccgcgcaaagaatgtagcccaaaatcctctgaagcatcacagcgaaaggacagacatgaagacactaagccgtaagcactggagctccgtccaggactacaaatgttcctccttcgctaacacatctagcaagtttcggcaccttctctcaaatgatggctaccctttcaaatag

SEQ ID NO: 208525 - DNA, 2712 bp, Artificial Sequence
  Description of Artificial Sequence: Synthetic coding sequence
atgacccggagctgcagcgccgtgggctgcagcacccgggacaccgttttgagccgtgagcgtggactaagcttccaccagtttcctacggatactattcagagatcgaagtggatcagagctgtgaacagggttgatcctcggagcaagaagatatggatacctggacccggggcaatcctatgttctaagcacttccaggagagcgattttgagagctacgggatccgcaggaagttaaaaaagggggcagtgccatcggtgtcactgtacaagatcccacagggggtgcacctaaagggaaaagcaaggcagaagattctgaagcagccactcccagacaattcacaagaagtggcgacggaagatcataactatagcttaaaaacacctctgacaattggggccgaaaagttagctgaagttcaacagatgctgcaggtgtctaagaaacggttgatctccgtgaaaaactataggatgataaagaagcggaagggacttcgcctgattgatgcactcgttgaggagaaactgctgagcgaggaaactgagtgtctcttacgcgcgcagtttagtgattttaagtgggagttgtacaattggcgagagacagacgaatattcggcagagatgaagcagtttgcttgcacgttgtacctttgttcctctaaggtttacgactacgtccgcaagatcctgaagctgccacatagcagtatcttgcggacgtggctgtcgaagtgccaaccgagccctggatttaatagtaacatcttctccttcctccagagacgcgtggagaacggcgaccaactgtaccaatattgtagccttctgatcaagtccatgcctctgaagcagcaactgcagtgggacccatcgagccacagtctgcaaggctttatggatttcggacttggtaaactcgacgctgacgaaacccctctggcaagtgaaactgtcttattaatggcggtcggcatttttggacattggagaacccctcttggatacttctttgtaaaccgcgcctcgggatacctccaggcacagttattgcggcttacgatcggcaaactaagcgacatcggaattactgttctggccgtgacctcagacgcaactgcccattctgtgcagatggcgaaagcacttggtatacatatcgacggggacgacatgaagtgcactttccagcacccctcatccagctcgcagcagatcgcttatttcttcgactcttgccacctgttgagactgatcaggaacgcttttcagaacttccagtccatacagttcatcaacgggattgctcactggcagcacctcgtcgagctggtcgctctggaggagcaggaattgtcgaatatggaacggatcccgagcacacttgccaatctcaaaaaccacgtgttgaaggtgaactcggccacacagctgtttagcgaatctgttgcctctgccctggaatacctgttgtccttggaccttccccccttccagaactgcataggcactatacactttctgcgattaataaacaacctattcgacattttcaacagccgaaattgctatggtaagggcctgaaaggaccactcctgccagagacttactccaaaattaatcacgtgctcatagaagcaaaaaccatctttgttaccctgagcgatacatcaaataaccagatcattaagggaaaacaaaagttaggatttctcgggtttttgctaaacgccgaatctttaaaatggctatatcaaaactatgtgtttcctaaggttatgccatttccttacctgctcacgtacaagttcagccatgatcatctggaattgtttctcaaaatgcttaggcaagtgctcgtgacaagtagcagcccaacttgtatggccttccagaaggcttactacaatctcgagacgcggtataagtttcaggatgaagtgtttcttagcaaggtaagcattttcgatatctccatcgccaggcgtaaggacctcgcattgtggaccgtccagcgtcagtatggggtctccgtcaccaagacagttttccatgaggaaggcatctgccaagactggtcccattgctctctcagtgaagccctcttagacctctcagatcaccgcagaaacttgatctgttacgcgggttacgtggcaaataaactgagtgctttacttacctgcgaggactgtattaccgccctgtatgcgtcggacctgaaagccagtaaaatcggctccttgttattcgtcaaaaagaaaaatggtctccactttcctagcgaaagcctttgccgggtcattaatatctgtgaacgagtggtacgcacccacagtcgaatggccatcttcgaactggtcagtaagcagcgtgagctgtacctgcagcagaaaattctttgtgagctatcaggtcacatcaatctctttgtcgacgtgaataagcacctattcgacggagaggtgtgcgcaattaaccactttgttaaactcctgaaggatattataatttgttttttaaatattagagcaaagaatgttgcccagaaccccctgaaacatcactcagaacgtactgatatgaagacgctcagcaggaagcattggagttccgtgcaagattataagtgttccagcttcgctaatacctcatctaagttccggcacctgctcagcaatgacggctacccctttaaatag

SEQ ID NO: 208526 - DNA, 642 bp, Artificial Sequence
  Description of Artificial Sequence: Synthetic coding sequence
atggtgcagagctgcagcgcctacggctgcaagaaccggtacgacaaagataagccggtgagctttcacaagtttccacttacccggccatcattgtgtaaggaatgggaggcagctgtgagaaggaagaatttcaaacctaccaaatatagcagcatctgctccgagcatttcaccccagactgcttcaaaagggagtgtaataataagctgctgaaagaaaacgcggtgccgacaatcttcctgtgtacagagccccacgacaagaaggaagacctcctcgagccccaggagcagttgcctcccccccccttgcctccccccgttagtcaagtcgacgccgccattggtttgcttatgccaccactccagacaccggtaaatctttctgtcttttgtgaccataattataccgtggaggataccatgcatcaaagaaagcgcatccatcaactcgaacagcaggtggagaagttgcgtaagaaactaaaaaccgcccagcagaggtgcagacgccaggaacgacagctggagaagcttaaggaagtggtgcatttccaaaaggaaaaagatgacgtgtctgagagaggatatgtgattctccccaatgactactttgaaatcgtggaagtaccggcttag

SEQ ID NO: 208527 - DNA, 162 bp, Artificial Sequence
  Description of Artificial Sequence: Synthetic coding sequence
atggtgcagagctgcagcgcctacggctgcaagaaccggtacgacaaggataaaccagtatcctttcacaagaaaaaaatcttctggtcgcaccgtaattcatttccccatctcttgtacaggttgctgttcccacggttaatgctgctgctcgattactag

SEQ ID NO: 208528 - DNA, 687 bp, Artificial Sequence
  Description of Artificial Sequence: Synthetic coding sequence
atgcccaccaactgcgccgccgccggctgcgccaccacctacaacaagcatatcaacatcagttttcacagattcccgcttgacccaaaaaggaggaaagagtgggttagactcgtgagacgcaaaaattttgtgccaggcaagcacacattcctctgttccaagcactttgaagccagttgcttcgatctaacgggccagacccgaaggttgaaaatggacgccgtgcctacaatcttcgacttttgtacacatatcaagtccatgaaacttaaaagtagaaacttgttaaaaaagaacaacagttgcagcccagccggccctagtaatctgaagtcgaacattagttctcagcaggtcctcctggagcattcctacgcctttcggaaccctatggaggccaaaaagaggatcataaaactggaaaaggaaatcgcttctttaagacgcaagatgaaaacctgcctgcaaaaagagcggcgtgccactcgccggtggattaaagcaacctgtctggtgaaaaatctggaggccaactccgtgctgccaaaaggcacctcagaacacatgctgcctacagctctgtcaagcctccctctagaggactttaaaatccttgaacaggaccaacaggacaaaacgctgttgagcctgaatctgaagcagaccaagagcacattcatttag

SEQ ID NO: 208529 - DNA, 720 bp, Artificial Sequence
  Description of Artificial Sequence: Synthetic coding sequence
atgcccaagagctgcgccgcccggcagtgctgcaaccggtacagctcgcgcagaaaacagctgacattccatcgtttcccgttcagcagacctgagctgctgaaagaatgggtactcaacattgggcgggggaatttcaaaccaaagcagcacactgtcatatgctcagagcattttcgcccagaatgcttctctgcatttggcaatcggaaaaatctaaagcataacgccgtgccaacagttttcgccttccaggatcccacacaacaggtccgggagaacactgaccctgcgagcgaaaggggaaacgcctcatctagccagaaagagaaggtactgcccgaggccggcgcaggagaagacagccctggaaggaatatggacacggctctcgaggagcttcagctgcctcccaatgccgaaggacacgtcaagcaggtgtcgcccaggcgacctcaagccactgaggccgtcggtcgcccaactggccccgccgggctgagacgtacccccaataaacagccatctgaccactcctacgctctgctcgacctagacagtctcaagaaaaaacttttcctcactctgaaagagaacgagaagctcagaaagcgcttgcaggcacagcgattagtgatgcgtaggatgtcttcaaggcttagagcttgtaagggtcatcagggactgcaggcacggctcgggcctgagcagcaatcctag

SEQ ID NO: 208530 - DNA, 717 bp, Artificial Sequence
  Description of Artificial Sequence: Synthetic coding sequence
atgcccaagagctgcgccgcccggcagtgctgcaaccggtacagctcacgccggaagcagctaacatttcacagatttcccttttcaagaccagagctgttgaaggaatgggtgctcaatatcggcaggggtaactttaagcccaaacagcacacagtcatttgctctgagcacttccgcccagagtgtttctccgccttcggcaaccgcaaaaatctgaagcataatgccgtgccaacggtcttcgcctttcaggaccccactcaggttagggagaatactgaccccgcaagcgaaagaggcaacgcctctagctctcagaaggaaaaagtattgcctgaggcaggtgccggagaggattctcccggcagaaacatggacactgccctggaggaactccaactccctccgaacgcagaggggcatgtgaagcaagtcagtcctaggcggccccaggcgacagaggcagtgggcagaccaaccgggcccgcagggttaagacggacccctaataaacagccttccgaccatagctacgcactgcttgatttagattcgctgaagaagaaactgttcctgaccctgaaagagaatgagaagcttcgaaagcgactccaggcccagagactggtgatgagaagaatgtctagtcgcctgagagcttgcaagggacatcagggactgcaggccagactgggaccagagcagcaaagctag

SEQ ID NO: 208531 - DNA, 528 bp, Artificial Sequence
  Description of Artificial Sequence: Synthetic coding sequence
atgcccaagagctgcgccgcccggcagtgctgcaaccggtacagctcgcgtcgaaagcagctaacctttcaccgctttccgttcagtcggcccgagctgctcaaagagtgggtgctaaacatcgggcgaggaaatttcaaacccaaacagcacacggtcatttgcagcgaacactttagacctgaatgttttagtgcgtttggaaataggaagaacctgaaacacaatgctgtccctacggtgtttgcctttcaagaccccacacagcaggtgagagagaataccgatccggcatccgagcggggtaatgcatcgtccagccagaaggaaaaaacaagcccctgcaggagtcaggtgctccccgaggccggagcaggtgaagacagtccagggcgcaatatggataccgccttggaagaactccagctccctcccaacgccgaaggccatgtcaagcaggccatgttattcaacgtggaaaacggcacgcccgcttctcgagaggcattgtggctgtcggaagaatag

SEQ ID NO: 208532 - DNA, 732 bp, Artificial Sequence
  Description of Artificial Sequence: Synthetic coding sequence
atggagcacgccttcacccccctggagcccctgctgagcaccggcaacctgaaatactgcttggtgatcctgaatcagcccttggacaactatttcaggcacctttggaacaaagctctcctgcgagcatgcgcagacggaggcgcaaaccggctgtatgatattacagaaggagagcgggaaagcttcttgcccgagttcatcaacggggacttcgatagcattcgaccagaggttcgagaatattatgctaccaaggggtgcgagctgataagcactcccgatcaggaccacaccgacttcactaagtgtttaaagatgttacagaagaaaatagaggaaaaagatctgaaggtcgatgtcatagtgactctaggggggctggctggtagattcgatcaaattatggcgtcagtcaatactctgtttcaggctactcacattacaccattcccaatcattattatacaagaagaaagcttgatttacttactgcagccgggaaagcaccggctccacgtggacacgggtatggaaggcgactggtgtgggctgattccggtcggtcagccctgcatgcaagtcaccacaacaggcctcaagtggaatcttacaaatgacgtcttggcttttgggacacttgtgtcaacttccaacacatacgacggcagcggcgtcgttactgtagagaccgaccatcctctcttgtggacaatggccattaagtcatag

SEQ ID NO: 208533 - DNA, 585 bp, Artificial Sequence
  Description of Artificial Sequence: Synthetic coding sequence
atggagcacgccttcacccccctggagcccctgctgagcaccggcaatctgaagtactgtctagtgatcttaaatcaacccttggacaactatttcagacacctttggaataaagccctgctccgggcctgcgccgacgggggggcaaacagactttatgatataactgaaggtgagcgtgaatcctttcttccagaattcattaacggtgacttcgactcaatccgtcccgaggtccgggagtattacgccacaaagggctgtgaactaatcagtactccagatcaggaccacactgatttcaccaaatgtcttaagatgttacaaaaaaaaatcgaggaaaaggacctgaaaggaaagcatagactgcacgttgacactggaatggaaggcgattggtgcggcttgattccagttggacagccctgtatgcaggtgaccaccactgggctgaagtggaatctgacaaacgacgtcctggctttcggtacattggttagcactagcaacacgtatgatggatccggcgtcgttaccgttgagactgaccatcctcttttatggacaatggcgatcaagtcctag

SEQ ID NO: 208534 - DNA, 375 bp, Artificial Sequence
  Description of Artificial Sequence: Synthetic coding sequence
atggtggacgtgatcgtgaccctgggcggcctggccggccggttcgatcagattatggccagcgtgaataccctgttccaggccacacacatcaccccgttccccatcataatcatacaagaggaaagccttatctacttactgcagcctggcaagcatcgcctgcacgtggacactggtatggaaggcgattggtgtggcctgatcccagtggggcagccttgcatgcaagttaccacaacagggctgaagtggaacttaagaacttgcgattacactaggactacctggatcgccaaggataaccctgtcccacgtctgatccggctgattcgactgaaccacatatgcaaggttccgctggcaatcaagtag

SEQ ID NO: 208535 - DNA, 504 bp, Artificial Sequence
  Description of Artificial Sequence: Synthetic coding sequence
atggagcacgccttcacccccctggagcccctgctgagcaccggcaatctaaaatactgtctggttatcctcaaccagccactggataattactttaggcacctgtggaataaggcgctgctgagagcttgtgcagacgggggtgcaaaccgcttatacgatattacggagggggagagggaatccttcctcccagagtttattaatggcgattttgacagcatccgtcccgaagtgagggagtattatgccacaaagggttgtgagctgattagcaccccagaccaggatcacaccgattttacgaagtgtttaaaaatgttacagaagaagatagaggagaaggatctgaaggttgatgttatcgtaactttaggtggcttggccggaaggttcgaccaaattatggcctccgtgaatacactctttcaggccacccacatcactccgttccctattatcattatacaggaagagagtctgatatacttgcttcaaccatag

SEQ ID NO: 208536 - DNA, 693 bp, Artificial Sequence
  Description of Artificial Sequence: Synthetic coding sequence
atggcccagggcctgatcgaggtggagcggaagttcctgcccggccccggaaccgaggagcgcctgcaagaactcggaggaacactcgaatacagggttacctttcgggacacctactatgatacacccgagctgtcgttgatgcaggctgaccattggttacgtagaagggaggatagtggatgggagctgaagtgccccggcgctgcgggcgttctgggacctcatacagagtacaaagaactaacagctgaaccaaccatagtagctcaactctgtaaagtgctgcgggctgacgggcttggtgccggtgatgtggcagcagttctcggccctttagggctgcaggaagtggccagttttgtcactaagaggagcgcctggaagctagtgctcctgggagcagacgaagaagaaccgcagctgcgggtggatcttgacacagcagacttcgggtatgcagtaggcgaggtggaggcactcgtgcacgaggaggctgaggttccaaccgctctggagaaaattcaccgcttaagctccatgcttggggtgcctgcccaggagaccgcccccgccaagctaattgtttatcttcagagattccgaccgcaggactatcaaaggcttttggaagtgaactcctctcgcgagagaccccaggagaccgaggacccagatcactgcctgggatag

SEQ ID NO: 208537 - DNA, 693 bp, Artificial Sequence
  Description of Artificial Sequence: Synthetic coding sequence
atggcccagggcctgatcgaggtggagcggaagttcctgcccggccctggcacggaggagaggctgcaggagctgggaggcaccctcgagtatcgagtgacctttagagacacctactacgacacgccagaactgtctctgatgcaagcggatcactggctgagaagacgcgaggatagtggatgggagctgaaatgtccaggggcagcgggagtccttggccctcacaccgagtataaggagttaacagcggaaccaaccattgttgcccagttatgtaaagtccttagagccgacggactgggagcgggagatgtggctgccgttctgggccctttaggcctccaagaagtggccagttttgtcacaaaacgcagtgcctggaaattggtgttgctcggagcagacgaagaggagccccaactaagagtagacctggacaccgccgatttcggatatgccgtgggcgaagttgaagccctggtgcacgaagaggccgaggtgcccactgcgcttgaaaagatacaccgccttagttccatgctgggagtgcccgctcaagagacagcccctgcaaagctgatcgtgtacctgcaacgatttcgcccacaggattaccagaggttacttgaagtgaatagctcccgggaacgccctcaagagaccgaggatccagaccactgtctaggctag

SEQ ID NO: 208538 - DNA, 372 bp, Artificial Sequence
  Description of Artificial Sequence: Synthetic coding sequence
atggcccagggcctgatcgaggtggagcggaagttcctgcccggcccagggactgaggaacgcttacaggaactggggggaacgctggagtaccgcgtgacctttcgcgacacgtactacgacacccctgagctgagtctcatgcaggctgaccattggctgcggcgtagagaagatagtgggtgggaattgaagtgtcccggcgccgccggagtcttaggcccgcatacagaatacaaagaactaactgcagagccaacaatcgtcgctcaactttgtaaggtgcttagggcggacggccttggcgcaggtgacgttgctgctgtattgggcccactcggtctccaggaggtggcaagttttgtgacttag

SEQ ID NO: 208539 - DNA, 2070 bp, Artificial Sequence
  Description of Artificial Sequence: Synthetic coding sequence
atgaagccccccgccgcctgcgccggcgacatggccgacgccgccagtccatgttcagtggtaaacgacctgcgctgggacctgagcgcccaacaaattgaggagagaacgagggagctgatcgagcagaccaagagagtgtacgaccaggtgggtacacaagagttcgaagacgtctcttacgaaagtacactgaaggccctggccgacgtggaagttacttacactgtgcagaggaatattttggatttcccccagcacgtctctcccagtaaggacattcggacggcgagtacagaagccgacaagaagctcagtgagtttgacgtagagatgagcatgcgagaggacgtataccagaggattgtgtggctgcaggaaaaggtgcagaaagactctctcagaccggaagccgctcgttaccttgagcgactgataaaacttggcagacgaaatgggctgcacctgcctcgcgaaactcaggagaatataaagcgcatcaaaaagaagttatccttgctgtgtattgactttaacaagaatctgaacgaagataccacattcttgccattcactctacaggagttagggggactccctgaggactttctcaacagtctcgagaagatggaagatggcaaactcaaagttacattaaagtatccacactatttccccttgctgaaaaagtgccacgtgcctgaaacccgacgtaaagtggaggaagccttcaactgtaggtgtaaagaggaaaactgcgccattctcaaggaactggtgaccctacgagcacagaaatctcggcttctcggctttcatacccatgcagactatgtgttagagatgaatatggccaagacttcacaaaccgttgcaacatttcttgacgaacttgcgcagaaactcaagccgctcggtgagcaggagagggctgtgatactcgagctgaaacgcgcagagtgcgaacgcaggggtctaccctttgacggccgcattcgcgcttgggatatgcggtattacatgaatcaagttgaagagactagatactgcgtagatcaaaaccttctgaaggaatatttccccgtccaggtggtcactcacggtctcttaggcatctatcaggaacttctagggctggctttccatcatgaagagggcgcgagcgcctggcacgaggacgtgagactgtacaccgccagggatgcggctagcggcgaggtggttggaaagttttacctggatttatatcctcgggagggaaagtatgggcacgcagcatgctttgggttacaaccaggatgtctgcggcaagatggatcacggcagatcgctattgctgccatggtggccaactttactaaaccaactgccgacgcccctagtctcctgcagcatgacgaagtggaaacttacttccatgagttcgggcacgtaatgcatcagctttgctcacaggcagaattcgctatgttttcgggcacccatgtggagcgggattttgtcgaggctccctctcagatgctggaaaattgggtgtgggagcaggagccactactcagaatgtcacgccactaccggaccggctcagccgtgcctagagagttgctggagaagcttattgagtccaggcaagcgaacaccggcctatttaatctgcgacaaatagtcctcgctaaggtggatcaggctctccatacacagacagacgccgaccctgccgaggagtatgctaggctctgtcaggaaattctgggcgtgcctgctactcctggtactaacatgccagctaccttcgggcatctggcaggcggctatgatgcccaatattacgggtatctctggagtgaggtgtattctatggacatgtttcacactaggtttaagcaggaaggggtgctcaacagtaaggtagggatggactaccggtcctgtattctgcggccaggcggatccgaggatgcgtcagccatgctccgtaggtttctcgggcgcgaccctaagcaagatgctttccttctctctaagggactgcaagtgggtggatgtgagccagagccgcaagtctgttag

SEQ ID NO: 208540 - DNA, 777 bp, Artificial Sequence
  Description of Artificial Sequence: Synthetic coding sequence
atgttcagcggcacccacgtggagcgggacttcgtggaggccccctcccagatgctcgaaaattgggtgtgggaacaggaacccctgctcaggatgtcgagacattatcgcactggatccgccgtgccacgagaactccttgagaagctgatagaatcccgtcaagctaacactggcctttttaacctgcggcaaatcgtgcttgcaaaggtggaccaggctctgcatacccagactgacgctgacccagcagaggagtatgccagactttgccaagaaattcttggcgtcccggcaactccaggcaccaatatgccagctacattcggacatttggccggaggctacgacgcacagtattatggctacctctggagcgaagtgtacagtatggatatgttccacacgagattcaaacaagaaggtgtgttaaattctaaattcccgcattatgaggtgcgtcctctaaggcacgtgtccctctgcctcccgctgacctggtgcgatccgggatccggtcaaccgcctgagagtctcaccaggaaccgctggttgcccgcactgcgggctgggcctgccctgccgggatgcaacatcgcccttggatcactgcaggtagggatggactacagatcatgcatcttgcgacctggaggatccgaggacgcatccgcgatgctacgccgcttccttggcagagacccaaagcaggatgccttcctcctctcgaaaggactccaggtcgggggatgtgagccagagccacaggtctgttag

SEQ ID NO: 208541 - DNA, 738 bp, Artificial Sequence
  Description of Artificial Sequence: Synthetic coding sequence
atggacggcacccggaccagcctggacatcgaggagtacagcgacaccgaagtgcagaaaaatcaagtcctcaccttggaggagtggcaggataaatgggttaacggaaagactgcgtttcaccaagagcagggacaccaattgctgaagaagcatctggacacatttctcaaggggaagtcaggactgagagtttttttccctctttgcgggaaagccgtcgagatgaaatggttcgctgatagaggccactctgtggtaggagtggaaatctctgaactcggaattcaggagttcttcactgaacagaacctgtcttattctgaagagcccatcacggaaatccccggcacaaaggtgttcaaaagctccagcggaaacatctccctgtactgctgctcaatttttgacctgccccgtacaaatatcggcaagtttgacatgatttgggatcggggggctctcgttgcaatcaatccgggcgacagaaagtgttatgcagataccatgttctctctcttgggtaaaaagtttcagtatctgctgtgtgtcctttcctatgatcctactaaacaccctggacctcctttctatgtcccacatgccgaaatcgagcgcctcttcggaaaaatctgtaatattcggtgtctggagaaagtggatgcctttgaagagagacataagagctggggaattgactgtttgttcgagaagctctacctactgactgagaaatag

SEQ ID NO: 208542 - DNA, 519 bp, Artificial Sequence
  Description of Artificial Sequence: Synthetic coding sequence
atggagacccggccccggctgggcgccacctgcctgctgggcttctcatttctcctcctcgtcatcagctccgatggtcataacggcctagggaagggatttggtgaccacatacactggagaactctagaggacggcaagaaggaggctgcagcgtctggccttccgctcatggtgatcatccataagagttggtgtggcgcctgcaaggccctcaaacctaaatttgctgaatccaccgaaatctccgagctctctcataattttgtcatggtgaacctcgaggatgaggaggagccaaaggacgaagatttttctccggacgggggatatattcctaggatcttgttcctggatcctagcggaaaggtccaccctgagatcatcaacgaaaacggtaaccctagctataagtacttttacgtgtctgccgaacaggtggttcagggcatgaaggaggctcaagaacgcctgactggcgatgccttcaggaagaagcacttagaggatgaactctag

SEQ ID NO: 208543 - DNA, 1767 bp, Artificial Sequence
  Description of Artificial Sequence: Synthetic coding sequence
atggccagcaagaagcgggaggtgcagctgcagaccgtgatcaacaaccagtccctttgggacgagatgctgcagaataaaggcctcacagtgattgacgtataccaggcttggtgcggcccgtgtcgcgccatgcagcctctctttcgaaagttgaagaatgagctgaacgaggacgagatcttgcacttcgcagtcgcagaggcagataacatagtgaccctgcaaccgtttcgcgacaagtgcgaacctgtgttcctgttcagtgtcaacggcaaaatcattgaaaagatacagggcgccaacgcacctttggtcaacaagaaggttatcaatctgatcgatgaggaacgaaaaattgctgccggtgagatggctcggccacagtatccggagattccattggtggattctgattcagaagtgagcgaggagagtccatgtgagagcgtgcaggaactctactcaatcgcaattataaagccagatgctgtgatatccaagaaagtcctagagataaaaaggaaaattaccaaggctgggttcattatcgaggctgagcacaaaactgtactgaccgaggagcaggtcgtaaacttctactctcgtatcgcagaccagtgtgacttcgaagaatttgtgtcttttatgacctctggtctgtcttacatcctggtggtttctcagggaagtaagcacaacccaccttctgaagaaaccgagccacagaccgatacagagccaaacgagagaagtgaggatcaacctgaggtagaagctcaggtgacccctgggatgatgaagaacaagcaagactcgctgcaagagtacctcgagcgtcaacacttggcacaattatgcgatattgaagaagatgctgcgaacgtcgctaaattcatggacgcctttttccctgactttaaaaaaatgaaatccatgaagctggagaaaaccctggctctgctcagacctaacttatttcacgagcgcaaagacgacgtcctgcgcatcattaaagacgaggatttcaaaatcctcgagcagcgccaagtagtgttgtccgaaaaagaggcacaggcgctgtgtaaggaatacgaaaatgaggactactttaataagttgatcgagaatatgacttctggcccctcactggcccttgtgttactgagggacaacggactgcaatattggaaacagctgctgggccctcggaccgtggaagaggccatcgaatacttccctgaatccctgtgcgcacagttcgccatggacagtctccccgtgaatcaattatacgggagcgatagcctggaaacagctgaacgtgaaatccagcatttcttccctcttcagtccacactaggactcatcaagccgcacgccaccagcgaacagcgtgaacagatcctcaaaatcgtgaaagaggctggttttgatctaacacaggtgaagaagatgtttttgacaccagagcagatcgagaagatctaccccaaggtgaccggaaaggatttttacaaagacctgctggaaatgttgtcggtgggaccatcgatggtgatgatattgaccaaatggaatgcagttgcggagtggagacggttgatgggacctacggacccagaagaggccaagttattgtcacctgactcaatccgcgcacaattcggcatcagcaagcttaagaatatagtgcatggcgcatctaatgcatacgaggccaaagaagtcgtgaatagactgtttgaggatccggaggaaaattag

SEQ ID NO: 208544 - DNA, 1767 bp, Artificial Sequence
  Description of Artificial Sequence: Synthetic coding sequence
atggccagcaagaagcgggaggtgcagctgcagaccgtgatcaacaaccaatcactgtgggacgaaatgcttcagaataaaggcctaacggtcatcgacgtctaccaggcttggtgcggtccttgtagagccatgcagccgctgttccggaaactcaaaaacgaactgaatgaggatgaaattctgcacttcgctgtggctgaggcggacaatatagtaactctgcagccgttccgtgacaaatgtgagcccgtattcctattctccgtgaacggaaaaatcatcgagaaaatacaaggcgctaacgctccgctggtgaataaaaaagtcattaaccttattgacgaggagagaaagatcgccgcaggagagatggcacgacctcagtaccctgagatcccattggtcgactccgattccgaggtctccgaggaatctccatgcgagtcggtgcaggagttgtattccattgctattatcaaacctgatgcagtaatctcaaagaaggtgctggagattaaaagaaagatcaccaaagcaggctttatcatagaagcagaacacaagacggtcctgactgaggagcaagtcgtaaatttctattcgcgaattgccgatcagtgcgactttgaggaatttgtatctttcatgacctcaggtcttagttacattctggtcgtgagtcagggttctaagcataaccctccaagtgaagagaccgagccccagaccgacacagaacccaacgagagatccgaggaccagcccgaggtggaagctcaggttactcccgggatgatgaagaataagcaggactccctgcaggagtacctggagcgacagcatctggcccaattatgtgatatagaggaggacgcagccaacgttgcaaagttcatggatgcattttttcctgacttcaaaaaaatgaaatcaatgaaactcgagaagacgctcgcgttactacggccaaatcttttccatgagaggaaggatgacgtgttacgcatcatcaaagacgaggactttaaaatactggaacagaggcaggtggtgctgtccgagaaagaggctcaggctctgtgcaaagaatatgagaacgaagattattttaacaaactgatagagaacatgacttcgggtccgtctctcgcactggtcttactcagagataatggactgcagtattggaagcagctactgggccctagaaccgtggaggaggcaatcgagtacttccccgagtccttgtgcgctcagtttgctatggacagcctgcctgtgaaccagttatatggtagcgattcattggaaacagcagagagggagatccagcacttctttcctctgcaatctactctcggtttgatcaagccacatgcgaccagcgaacagcgcgaacaaatactcaaaattgtgaaagaggccggctttgacttgacccaggtcaagaagatgttcttgactcctgaacagattgagaaaatatacccaaaggtaacagggaaagacttttacaaagatctgctggagatgctgagcgttggaccctcaatggtgatgattttaacgaagtggaatgcagtcgctgagtggcgacgactgatgggtcccaccgaccctgaggaagccaaactcctgagccccgactctattagagcgcaatttggtatttctaaactgaagaacattgtccatggcgcaagcaacgcttatgaggcgaaagaggtggtaaacagattgtttgaggatccagaggaaaattag

SEQ ID NO: 208545 - DNA, 681 bp, Artificial Sequence
  Description of Artificial Sequence: Synthetic coding sequence
atggaggccgacgccagcgtggacatgttcagcaaggtgctggagcaccaactgctgcaaactaccaagctggtggaagagcaccttgattccgagattcagaaactcgaccagatggacgaagatgaactggaacgtcttaaagaaaaacggctccaagcactgcgaaaggctcagcagcagaaacaggagtggctctctaagggacacggagagtacagggaaattccttccgagcgggatttcttccaggaggtgaaggaaagcgaaaacgtcgtgtgccacttctacagggattccacatttcggtgcaaaatcttggaccgtcacctcgccatcctgtccaaaaagcatttggagacgaaatttctgaaattaaatgtagaaaaggccccgtttctctgcgagcgcctgcacatcaaagtgattccaaccttggctttactcaaggatggaaagacgcaagactacgttgtcgggttcactgatctggggaacaccgatgactttaccacagaaactttagagtggcggttggggagttctgacatactgaactacagcggcaacctaatggagcctccttttcaaaatcagaaaaagtttggcaccaattttactaagctcgagaaaaagactataaggggcaagaaatatgattccgactctgatgatgactag

SEQ ID NO: 208546 - DNA, 408 bp, Artificial Sequence
  Description of Artificial Sequence: Synthetic coding sequence
atggaggccgacgccagcgtggacatgttcagcaaggtgctggagcatcagctgctccagacaactaaactagtagaggaacacctcgattctgagatccaaaaactggaccagatggatgaagacgaattagagcgactgaaagagaagaggcttcaggctctccggaaggctcaacagcagaagcaggagtggctctccaaaggccatggagagtatcgcgagatcccatccgaacgcgacttctttcaggaggtcaaggagtctgagaacgtggtgtgccacttctatagagactctaccttccgctgtaaaatcttggatcggcaccttgccatccttagtaagaagcatctggagactaaattcctgaagctgaatgtggaaaaggcaccgttcctttgctag

SEQ ID NO: 208547 - DNA, 627 bp, Artificial Sequence
  Description of Artificial Sequence: Synthetic coding sequence
atgagccagaagagcctggccccccggctgaacagcgtgcccttcggacgtatggaggctgatgcaagcgtagacatgttttccaaggtgttggaacaccaactcttgcaaaccactaaactggtcgaggaacacctagactccgagatccaaaagctggatcaaatggatgaggacgagctggaaagacttaaggagaagaggctccaagcactcaggaaggctcaacagcagaaacaggaatggctgtcaaagggacacggggaatacagagagatcccgtctgaacgcgatttttttcaggaagtgaaggagtctgaaaacgtggtctgtcatttttaccgagactctacttttcgctgtaagatcctggacagacaccttgccatactctcgaagaagcacttagagacaaagtttctcaagctgaacgtcgagaaagcaccattcctgtgtgaacgtctgcatataaaggtgattcccaccctggcgttactgaaggacgggaagactcaagattacgtggtagggtttaccgacctgggaaacacagacgacttcaccaccgagacgctggaatggagactgggctcatctgatatccttaactatcggtggtggccgtag

SEQ ID NO: 208548 - DNA, 1017 bp, Artificial Sequence
  Description of Artificial Sequence: Synthetic coding sequence
atggccgccatggccgtggccctgcggggcctgggcggccggttccggtggaggacccaggctgtagcagggggggtccgtggcgctgcaagaggagcagcagcaggtcagcgggattacgaccttctggttgtcggggggggctctgggggactggcctgtgccaaagaggcagctcagctcggaagaaaggtcgctgtagtggattacgttgaaccttctccgcaaggcacacgatgggggctaggtgggacatgtgtaaatgttgggtgcatacccaagaagctaatgcatcaggccgcactcctaggaggactgatccaggatgctcccaattacggttgggaggtggcccagcctgtgccccacgattggcggaagatggctgaggccgtgcagaaccacgtgaaaagtctgaactggggccacagggtccagttgcaggaccgcaaggttaaatacttcaatataaaagcatctttcgtcgacgaacacactgtctgcggcgtagcaaaaggagggaaagaaattctcctttcagccgaccatattatcatcgcaaccggcggacgcccacggtatccgacccatatcgagggggctctcgaatacggaataacttccgatgacatcttctggttgaaggaaagccccggaaaaaccctggtggtcggagcctcatatgtggccctcgagtgcgccgggtttcttaccggtatcggattggacaccaccatcatgatgaggtcaatcccgctgcgagggtttgaccagcagatgagttcgatggtcatagagcatatggcctcccacgggacgagattccttaggggttgcgccccaagtcgtgtccgcagacttcccgacgggcaactgcaggtgacctgggaagacagtacaactggcaaggaagacacgggcacctttgacactgtgctttgggctatagcaccttgcatctccgcttgccttcccaccactgttggtcatgccgggaagaaccaacgtagggattag

SEQ ID NO: 208549 - DNA, 1485 bp, Artificial Sequence
  Description of Artificial Sequence: Synthetic coding sequence
  Description of Combined DNA/RNA Molecule: Synthetic coding sequence
atggaggaccaggccggccagcgggactacgacctgctggtggtgggcggcggcagcggaggcctcgcctgtgccaaggaagctgcacaactcggtcgaaaggtggccgtcgtggactacgttgagcctagtccacagggtactagatggggattgggaggaacctgcgtcaacgtaggatgtatccctaagaaactgatgcaccaagccgccttactgggcggactcatccaggacgctccaaattatggttgggaggtcgcacagccagtccctcatgattggcgcaagatggccgaggccgtgcaaaaccacgtcaagagcctaaactggggtcaccgggtccaactgcaggatcgcaaagtgaaatattttaacatcaaggcaagcttcgtagacgaacataccgtctgtggagtcgcaaagggtggaaaggaaattttacttagcgcagaccacattattatcgcaacaggcggccggccacgataccctacacatattgagggtgctctggagtatggcatcacttccgatgatattttctggcttaaagaaagtccagggaaaaccctagtggtaggggctagctatgtggctctggagtgcgcagggttcttgacaggcatcggcctggatacaacgattatgatgagaagcatcccgctgcgcggattcgaccaacagatgagttcaatggtgattgagcatatggcgtcccatggaacccgcttcctgcgaggatgtgccccatctcgagtgcgacgcctgccagacggccagctacaggtgacttgggaagactccactaccgggaaagaagacacgggaacttttgacactgtcctctgggccatcggacgggttcctgatactcgttcgctcaacctggaaaaagcaggcgtcgatacctcaccagatactcagaagatccttgtggactccagggaagcaacgtcagtcccccacatttacgccatcggtgatgtagtcgagggccggcccgagttaactcccattgctattatggccggacgactgctcgtgcaaagattgtttggcggctcaagtgatctgatggactatgataatgtacctacaacagtgttcacccctctggagtacggctgcgttgggcttagtgaggaggaagctgtcgccaggcatggtcaggagcatgttgaggtctatcacgcccactataagcccctcgaattcaccgtggctggaagggacgcctcccagtgctatgtgaagatggtgtgcctgcgggaacccccgcaactggttcttggtctgcactttctcggccctaatgcaggggaagtgacgcaggggtttgccctcgggatcaagtgcggtgcctcatacgcacaggtcatgcgcaccgtaggaattcacccaacatgctctgaggaggttgtgaaactgagaataagcaagcgatctggattggacccaaccgtgaccgggtgcugaggatag

SEQ ID NO: 208550 - DNA, 1575 bp, Artificial Sequence
  Description of Artificial Sequence: Synthetic coding sequence
  Description of Combined DNA/RNA Molecule: Synthetic coding sequence
atggccgccatggccgtggccctgcggggcctgggcggccggttcagatggcggactcaggccgtggcgggtggagtgaggggagccgcgcggggagcggcagccggccagcgcgactacgacctcctggtggtgggcgggggctcagggggactcgcatgcgccaaagaagccgctcagcttggaagaaaagtcgccgtggtcgattacgttgagcccagtccacaagggacacgttggggtctgggaggcacatgcgtgaacgttggatgtatccctaaaaagttgatgcaccaggccgcgctcctgggaggcttgatccaggacgcccctaactacggatgggaagttgcccagcccgtaccccatgattggcgcaagatggctgaagcagttcagaatcacgtcaaatctctgaactggggacaccgagtccaactgcaagataggaaagtcaaatacttcaatatcaaagcatccttcgttgatgagcataccgtttgtggcgtggctaaggggggcaaagaaatactgctctccgctgatcatatcattatcgccacaggaggtcggccaagataccccacccatatcgagggcgcactagagtacggaatcactagcgacgatatattttggttaaaagaatctccaggcaaaactctggttgtgggagcttcatacgtcgctctggagtgtgctggcttcttaaccggtatcggattggacacaaccattatgatgagatctattccattgagaggtttcgaccagcagatgagtagcatggttatcgaacatatggcctcccacggtacaaggtttctccgggggtgtgctcccagccgcgtgagaaggctcccagatgggcagctgcaagtgacatgggaggattcgactactggaaaagaggatactgggacctttgacactgtgctgtgggctattggacgtgtacctgataccaggtctcttaacttggagaaagcaggggttgatacttcccccgatacacagaaaatcctggttgacagtcgagaggccacttcagtgcctcatatttacgccatcggggatgtggttgaaggaaggcccgagttgactccgatagccattatggccggcaggttgcttgttcaaaggctgtttggcggttcctctgacctcatggactacgataatgtcccaactacagtgttcaccccattagaatatggatgtgtcggcctgtctgaagaggaagctgttgcccggcatggccaggagcacgttgaggtgtaccacgctcactacaagccactcgagtttactgtggcaggtagggatgctagccaatgctatgtgaaaatggtgtgccttcgggagcccccacagctcgtcctggggcttcacttcctggggcccaatgcaggggaggtaactcaaggctttgcgcttggtattaagtgtggtgcctcctacgctcaggtaatgaggactgtgggtatccacccaacatgctcagaggaagtggtaaaactccgaatcagtaagcgatctggcctggatcctacggtcacaggctgcugagggtag

SEQ ID NO: 208551 - DNA, 1566 bp, Artificial Sequence
  Description of Artificial Sequence: Synthetic coding sequence
atggccgccatggccgtggccctgcggggcctgggcggccggttccgatggcgaactcaggctgtggccgggggggtccgtggagctgctcggggcgcagccggacagcgagactatgacctcttagttgttgggggcggaagtgggggactagcgtgcgcaaaagaggccgctcaattgggaaggaaagtggcagttgtggattacgtggaaccgtcccctcagggtacccgttggggtttaggggggacctgtgtgaatgttggatgcattcctaagaagcttatgcatcaagcggcactgctcggtggactcatccaggatgctccaaactatggttgggaagtggctcagcccgtgccccacgactggcggaaaatggctgaggcagtgcagaaccacgtgaaatctctgaactgggggcaccgtgtgcaactgcaggatagaaaggtcaaatacttcaacatcaaggcttcattcgttgacgaacatacagtgtgtggtgtggccaaagggggtaaagaaattctcttatctgctgaccacatcatcattgcaaccggtggtaggccccgatatccgacccacattgaaggagcgctcgagtatggaatcaccagcgatgacattttttggttgaaggagagccccggaaagacacttgttgttggggcgagctatgttgccctggaatgtgctggttttttgacggggattgggctcgatactactattatgatgaggagcattcccttaagaggatttgaccaacagatgtcctctatggtcatagagcacatggctagtcatgggacaaggtttctcagggggtgcgctccgagcagagtgcgccgcctacccgacgggcagctgcaggtaacctgggaagacagtactaccggcaaggaggacacaggcacgtttgacacagtgttgtgggctataggccgggtccccgatacgcgatctctgaacttggagaaagctggggtagacactagcccggacacacagaagatcctggtcgacagccgagaggccacctccgtaccacatatttacgctattggcgacgtggtggaggggagacctgagctaacccctatcgctataatggctggacgccttctggtacagaggctgtttgggggaagttccgatctcatggactatgacaatgtcccaacaaccgtattcacaccccttgagtatggttgtgtcggactcagcgaggaggaagccgtggctcggcatggccaggagcatgtggaagtgtaccacgctcactataagccacttgagtttaccgtggccggccgggatgcttcccaatgctatgtgaaaatggtgtgccttcgcgaacctccccagctggtgctcgggctgcattttctggggcctaacgcaggcgaagttacacagggcttcgccttgggaatcaagtgtggagcctcttacgcacaggttatgcggaccgtgggaattcatcctacgtgtagtgaagaagtcgtgaagctgaggatcagcaagaggagcggtctggatcccaccgtgaccgggtgctag

SEQ ID NO: 208552 - DNA, 1569 bp, Artificial Sequence
  Description of Artificial Sequence: Synthetic coding sequence
atggccgccatggccgtggccctgcggggcctgggcggccggttccgctggcgcacgcaggcagttgcagggggcgtgcgtggggcagccagaggcgccgccgcggggcagcgcgactacgacctgctggtcgtgggtggtgggagcggaggacttgcgtgcgccaaggaggctgcacaactcgggaggaaggtggctgtggtcgattacgtggaaccttctccacagggcacccgctggggactgggaggtacgtgcgtcaacgtgggatgcatccccaagaaactgatgcaccaggcagcattacttgggggcttgatccaggatgcaccaaattatggctgggaggttgcccaacccgtgccccacgactggagaaaaatggcagaggccgtacagaatcatgtcaaatctctaaactgggggcaccgcgtgcaacttcaagaccgcaaggtcaaatacttcaacatcaaggcctcgtttgttgacgagcacacggtctgtggcgtcgcgaagggaggaaaagagatactgctctccgctgatcacatcatcattgcgacaggcgggagaccccggtatcccacccacatcgaaggagctcttgagtacggaatcacctcagatgatatcttttggctgaaggagagtcccggaaagacattgcccgtgagcgtcagctatgttgccctggagtgtgccggattcctgaccgggatcggactggataccaccatcatgatgcggtctataccattgaggggctttgaccaacaaatgtccagtatggtcattgaacacatggcaagccatggtacgagatttctgagggggtgcgctcctagcagggtgcgtcgcctccctgatgggcagttgcaggtgacttgggaggactccacgaccggcaaggaggatacagggacctttgataccgtcctttgggctattgggcgggtcccagatactaggtcgttaaacttggagaaggctggtgtggacactagccctgatactcagaagatactggtcgacagtagagaggccacttctgtacctcacatctacgcaattggtgacgtcgtggaggggagacccgagctcacccccatcgccatcatggcagggcgactgcttgtgcagcggctgtttggagggtctagcgacctgatggattatgataacgtgcctacgaccgtgttcacccctctggagtatggatgtgtgggacttagcgaggaggaagcagtggcaaggcatggacaggagcacgtggaagtgtatcatgcccattacaaaccactggaattcacggtcgccgggcgggacgccagccagtgctatgttaaaatggtttgcctgcgggaacctccacagctggtactgggtctgcactttctggggcccaacgcaggtgaagtgacgcaagggttcgctctcggtatcaagtgcggcgccagctatgctcaggtgatgcgcacagtgggcatacaccccacgtgctcagaggaggtggtcaagctgagaatctcaaagaggagcggacttgacccaacagtgacaggctgctag

SEQ ID NO: 208553 - DNA, 1281 bp, Artificial Sequence
  Description of Artificial Sequence: Synthetic coding sequence
atgcaccaggccgccctgctgggcggcctgatccaggacgcccccaactatggctgggaggtggctcagcccgtgcctcacgactggcgcaaaatggctgaggcagtccagaaccacgttaagagtctgaactgggggcacagagtacagttgcaggaccgcaaagtgaagtactttaacatcaaggcaagcttcgtcgacgagcatactgtgtgcggtgtggccaagggaggcaaagagatcctgctgagtgctgatcacattattatcgctaccggcgggcgcccacgctatccaacccacattgagggagcattggagtacggcatcacttccgatgatattttctggttaaaggagtcacccggcaagacatgtgttgtagctcacgcttatgtggctttagagtgcgcagggttcctgaccggcatcgggcttgatacaactattatgatgaggtccatcccactccgcggctttgatcagcaaatgtcgtccatggtcatcgaacacatggccagtcatggtacccgatttttgaggggctgtgctcctagcagagttcgccgtcttcccgacggtcagctgcaggtgacttgggaggattcaacgacgggcaaagaggatactggaaccttcgatactgttttgtgggcaatcggccgcgtaccagatacacggagtctaaacctcgagaaggctggcgtcgatacttctcctgacacgcagaagatcctcgtggactcccgcgaagcgacaagcgttccccacatatatgcaatcggtgatgtggtggaaggaaggccagagctcacacctattgccatcatggccggcagactgctcgtgcagagactattcggggggtcttcagatctgatggattacgacaacgtgccaaccactgtcttcacgcctctcgaatacggttgtgtaggactgtctgaagaggaggccgtggctaggcacggacaggaacacgtagaggtgtatcatgcccactacaaacccctcgagtttacagttgctggtcgagatgcaagccagtgctacgtcaaaatggtgtgtctgcgcgagccgcctcagcttgtcctcggcctccactttctcggcccaaatgccggcgaggtcacacagggtttcgctctggggattaagtgtggtgccagctatgcacaagtaatgaggactgtaggcatccatcctacttgctctgaggaggtggtaaagctgagaatctctaagcggagcggtctggatccgactgttacaggctgttag

SEQ ID NO: 208554 - DNA, 1479 bp, Artificial Sequence
  Description of Artificial Sequence: Synthetic coding sequence
atggaggaccaggccggccagcgggactacgacctgctggtggtgggaggggggtccggtgggctggcgtgcgcaaaagaggcagcccagctgggtaggaaagtggcagttgtcgactacgtggaacctagtcctcaagggactcgctggggcttgggcggcacctgcgtgaacgtgggttgcattccaaagaagctcatgcatcaagcggctttgctgggtgggctaattcaggatgcacctaactatggctgggaagtcgcacagcctgtcccgcacgattggcgtaaaatggctgaagctgtgcagaatcatgtgaagtcattgaactgggggcaccgggtgcagctacaggatcgaaaggttaaatattttaacattaaggcctcctttgtcgatgagcataccgtgtgtggggtggcgaaggggggaaaagagatcctgctgtcggcagaccacattattatcgctacaggcggccgacccagatatccaacgcatatagagggcgccttggagtatggaattacgtccgacgacatattctggctgaaggaatcaccgggaaaaacgctggtcgtgggcgcatcgtatgtggccctggagtgcgccggattcctgacaggaattgggctggacactaccatcatgatgaggagtattcctctgcgagggtttgaccagcagatgtcgagcatggtgatcgaacatatggccagccacggaactaggttcttgcggggctgtgctccgtctagagttagacgcttgccagatgggcagctgcaagtgacctgggaagatagtaccacaggcaaagaggatacgggtacctttgacacagtcttgtgggcaatcggacgggtgccagacactcgatcactgaatcttgaaaaagccggagtggacactagtcccgatactcaaaagattcttgtagactccagagaagcaacatcggttccacacatctatgccataggcgatgtcgtggaaggtcggcccgagctcaccccaattgccattatggcaggaaggctgctcgtacagaggctgttcggaggaagttctgacttaatggactacgacaacgtgcctaccaccgtgttcacacccctcgagtacggatgtgtgggactgagcgaggaagaggcagtagcaagacacggacaggaacatgtagaagtttatcatgcccactacaagccactggaattcacagttgccggaagagatgctagccagtgttatgttaaaatggtgtgcctcagggaacccccacagttagtactgggcctgcattttttagggccgaatgccggcgaagtgacccagggtttcgcacttggcattaaatgcggagcttcgtacgctcaggtgatgagaactgtgggcatccaccccacctgctccgaggaggtggtgaaattacgaataagcaaaagatccgggttggatcccaccgtgaccggctgctag

SEQ ID NO: 208555 - DNA, 429 bp, Artificial Sequence
  Description of Artificial Sequence: Synthetic coding sequence
atgagctacatgctgccccacctgcacaacggctggcaggtggaccaagccatcttgtcagaggaggacagggtggtcgtcatccggttcggccacgactgggaccccacttgcatgaaaatggatgaggtgctttacagtatcgcagagaaggtcaaaaacttcgcagtcatctatctagtcgacataacagaggttccagactttaacaaaatgtatgagctctacgacccttgtacagtgatgttcttcttccgcaacaaacacattatgatcgacctgggtacaggaaataataataagataaactgggctatggaggataagcaggagatggtcgacatcattgagactgtttatcgcggggctcgcaaggggaggggcctagtggtgagccctaaggactactccacgaagtacaggtattag

SEQ ID NO: 208556 - DNA, 276 bp, Artificial Sequence
  Description of Artificial Sequence: Synthetic coding sequence
atgagctacatgctgccccacctgcacaacggctggcaggtggaccaggctatactgtccgaggaggacagagtagttgtaattcgattcggccatgattgggatccaacttgtatgaagatggacgaagtgctctactctatcgctgagaaggtgaagaatttcgccgttatctacctggtagacatcaccgaagtgcccgattttaataagatgtacgagctgtacgacccctgtaccgttatgttcttcttttcataccatcgcgggtggtag

SEQ ID NO: 208557 - DNA, 894 bp, Artificial Sequence
  Description of Artificial Sequence: Synthetic coding sequence
atggtgcaccaggtgctgtaccgggccctggtgagcaccaagtggctcgccgagagcatacggaccggaaagctcggaccaggactccgcgtactcgacgcatcttggtactcacccggtacccgcgaggcccggaaggagtacctcgagcgccacgtccctggagcctccttttttgacatagaggagtgtagggatacagcctcgccatatgagatgatgctgcccagcgaagccggattcgccgagtacgtcggccgacttggtatctctaatcacacccacgtcgtggtttacgacggcgagcaccttgggagcttctatgccccaagagtttggtggatgtttcgcgtgtttggccatcgcaccgtcagtgtgctgaatggaggatttcggaactggctgaaagaagggcaccctgtgaccagcgagccatcacggcctgaaccagctgtctttaaagcaactctggaccggtcactcctcaaaacatatgagcaggtgcttgagaaccttgaatctaaacgcttccagctcgttgactcacggagtcagggtagattcctggggactgaaccagaacctgacgctgtcgggctagattcggggcacatacggggggctgtgaacatgccatttatggatttcctgaccgaggacggtttcgaaaaaggcccggaggagctgcgggcactgttccagaccaaaaaagtcgacttgtcacaaccactcatagctacctgcagaaagggcgtcaccgcctgccacgtggccctcgctgcttacctgtgtggcaaaccagacgttgcagtatacgacgggtcttggtccgagtggttcagaagggcaccgccagagagcagagtgtctcaagggaaatctgaaaaggcctag

SEQ ID NO: 208558 - DNA, 894 bp, Artificial Sequence
  Description of Artificial Sequence: Synthetic coding sequence
atggtgcaccaggtgctgtaccgggccctggtgagcaccaagtggctcgcggagtctattcggacggggaaactgggacctgggctcagagtcttggacgcatcatggtattcgccgggcactcgcgaagccagaaaggagtaccttgaaaggcacgtgcccggagcctcattttttgacatcgaagagtgtcgcgataccgcttccccatatgaaatgatgcttccctccgaggctggttttgcagagtacgtggggcggctggggatttctaatcatacacatgtcgtagtctatgacggcgaacacctgggtagcttctatgcccccagagtatggtggatgtttcgtgtgtttggacatcgcacagttagtgtcctcaatgggggctttcgcaactggctcaaggaaggacatcccgtaacatctgaaccaagccgccccgagccagcagttttcaaggccaccctagatagaagtctcctgaagacatatgagcaggttcttgagaatcttgaatcaaagaggttccagcttgtggattcccgttcccagggacgcttcttgggtaccgaacctgagcctgacgctgtggggcttgactctggccacatccgtggtgctgtgaacatgccctttatggacttcctcaccgaggacggattcgagaaggggcccgaagaactccgggctctgttccagacaaaaaaggtagacctgagtcagcctctaatcgctacatgtaggaaaggcgtgacagcgtgccatgtcgcccttgcagcatatctttgcgggaagcccgatgtggctgtgtacgacggttcttggtccgaatggtttcgccgggctccgcctgagtctcgcgtcagccaagggaaaagtgaaaaagcatag

SEQ ID NO: 208559 - DNA, 735 bp, Artificial Sequence
  Description of Artificial Sequence: Synthetic coding sequence
atggtgcaccaggtgctgtaccgggccctggtgagcaccaagtggctggccgaaagtatccggaccgggaagctggggccaggcctccgcgtacttgacgccagctggtactcaccgggtacccgcgaggcacgcaaggagtacctggaaagacatgttcctggagcttctttctttgatatcgaggagtgtcgcgataccgcctctccgtacgagatgatgctgccttcagaggccggcttcgcagaatacgtcggccggctagggatctccaatcatactcatgtggtggtttatgacggagaacatctcggctccttttacgccccccgcgtgtggtggatgtttagggtttttggtcatcgaacggttagtgtactgaacggcggcttccgtaattggttgaaggaaggtcacccagtcacctctgagcctagtagacccgaaccagcagtgttcaaggcaacactagatcggtcccttctgaaaacttacgaacaggtactggagaacttagagagcaagcgcttccagctggtggacagccgtagccagggccgtttcctggggaccgaaccggagcccgacgctgtgggacttgattccggccacattcggggagcagtgaacatgccgtttatggactttttgacagaggacggcagctggagcgaatggttccgccgggccccgccagagtctagagtgtcccagggcaaatctgaaaaagcttag

SEQ ID NO: 208560 - DNA, 375 bp, Artificial Sequence
  Description of Artificial Sequence: Synthetic coding sequence
atggtgcaccaggtgctgtaccgggccctggtgagcaccaagtggctcgccgagtcaattcgaacaggcaagctaggacctggcctgcgcgtattagacgcatcctggtacagccctggcacacgagaagcaagaaaagagtatttagagcgacatgtcccaggagcaagttttttcgacatcgaagagtgtcgtgacacagcaagcccatatgagatgatgttgccttccgaggctgggtttgccgagtacgtcggacgcctggggattagtaatcacacacacgtggtggtttatgatggagagcacttggggtctttttacgccccacgcgtttggtggatgtttagggtcttcggacataggactgtgtag

SEQ ID NO: 208561 - DNA, 1974 bp, Artificial Sequence
  Description of Artificial Sequence: Synthetic coding sequence
atgagccccaccccccccctgttcagcctgcccgaggcccggaccaggttcactaaatccacacgggaagctttaaataacaagaacattaaaccccttctatctacattctcccaggtacctgggtccgagaacgagaagaagtgcactctcgaccaggctttcaggggcatcctggaagaagaaatcatcaaccactcaagttgcgaaaatgtcttggctataatcagtctcgctatcggcggggtaacagaaggaatctgcacagctagcacgcccttcgttctacttggggatgtactggattgcctccccctggaccaatgcgacacgatcttcacctttgtcgaaaagaacgttgctacttggaaatccaacacgttctacagcgccggcaaaaactatctactacgaatgtgtaatgacctgttacgtagactgagcaaaagtcagaacacagtcttctgtggaaggatccagctgtttcttgccaggctgtttcccctgtcagagaaaagcggcttgaacctccaatctcagtttaacttggagaatgttacagttttcaatactaatgagcaggagtcaaccttagggcagaaacacacagaggatcgggaagaagggatggatgtcgaagagggagaaatgggagacgaggaagctcccaccacttgctcaataccaattgattacaatctgtaccgcaaattttggagtttacaagactacttcaggaatcccgttcagtgctatgaaaagattagttggaagacatttctgaagtattcagaggaagttctggctgtgttcaaatcctacaagcttgatgatacgcaagcctcacgaaagaagatggaggagctgaaaactggtggagagcatgtctactttgcgaagttcctcacgagcgagaaactcatggatctccaactgtcagatagcaacttccgccgtcatatcctgttgcagtatctgatcctcttccagtacctgaaggggcaagtcaagtttaaaagtagcaattatgtattaactgacgaacagagcctgtggattgaagacacaacaaagagcgtttatcagttgctgtcggaaaatcccccagacggcgagcgttttagtaaaatggtggagcacatcctgaacaccgaagagaactggaattcttggaagaatgagggctgcccctcgttcgttaaagagcgcacgtcagataccaaaccaacaaggatcatccggaagcgcactgctcctgaagacttcttaggaaaagggcccactaagaagatccttatggggaacgaagaactgacgcggctttggaacctgtgccccgataacatggaagcgtgtaaaagcgaaaccagggagcacatgcctacgttagaggaattcttcgaggaggccatcgagcaggccgaccccgagaacatggtcgaaaacgaatacaaggccgtgaacaatagcaattatggctggcgggcattacggctgctcgcccggcgctcaccgcatttttttcaacctactaatcagcagttcaagtctctgcctgagtacctcgaaaacatggtaatcaagctcgccaaggaactcccaccaccgagcgaggaaattaagaccggcgaagatgaggatgaggaggataacgatgctctgttgaaggaaaatgagagccctgatgtccggcgcgacaaaccggtgactggagagcagattgaagtgttcgccaacaagcttggtgaacaatggaagattcttgccccctaccttgagatgaaggattctgagattcggcagatcgaatgcgacagcgaggacatgaaaatgcgagccaaacagctgctcgttgcttggcaggatcaggagggcgttcatgccactcctgagaatctgatcaacgcactgaataagtctggtctttcggatcttgccgaatcccttactaacgataacgagacaaatagctag

SEQ ID NO: 208562 - DNA, 4782 bp, Artificial Sequence
  Description of Artificial Sequence: Synthetic coding sequence
atggccgccgccgccgtggtggtgcccgccgagtggatcaagaactgggagaaatcaggacgtggcgagttccttcacctctgccgaatcttgtctgagaacaagtcacatgactcaagtacctacagagatttccagcaggctctctatgagctctcctatcacgtcattaaaggcaaccttaagcatgaacaagccagcaatgtgttgtccgatatttctgagttccgcgaagacatgccgtcaatacttgctgacgtattttgtattctcgatatagaaacaaattgtctggaggaaaagagtaagcgggactatttcacccagttagtgctcgcatgtctgtaccttgtgtcagacaccgtgctgaaggaacgactggaccccgaaactctggaaagtctgggtctgattaagcaaagtcagcagttcaatcagaaatcagtgaaaatcaagacaaagcttttctacaagcagcaaaagtttaacttgctaagagaagagaacgagggttatgctaaactgatcgcagagctaggacaggatctcagcggctccattaccagtgatctgatacttgaaaatatcaaatctctgattggctgctttaacttagacccaaacagagtacttgacgtaattttggaagtgttcgaatgccgccccgaacacgacgatttcttcatttccttgctggaatcctacatgtcgatgtgtgagccccaaaccttatgtcatatccttggatttaagtttaagttctaccaagagccaaatggcgagactccgtcaagtctttacagggtagccgcagttcttctgcagttcaacctgattgacttagatgatctctatgtccacctgcttccagccgacaactgtataatggatgagcataagagagaaattgccgaagcaaagcagatcgtgaggaagttaaccatggtcgtattgagtagcgaaaaaatggacgaacgcgagaaggagaaggagaaggaggaagagaaggtggagaagccacctgataatcaaaaactaggactgctggaggctctcctcaagatcggcgattggcaacacgcccagaacattatggaccagatgccaccctactacgccgccagccacaagttaatcgctctggcgatttgcaaacttattcatatcactattgagcctctgtacaggcgtgttggagtccccaaaggcgccaaaggctcaccagttaacgcactgcagaacaaaagagcccccaagcaggccgaaagtttcgaggacctcagaagggatgtatttaacatgttctgctacctgggccctcatctgtctcacgatcccattctcttcgcaaaagtagtccgcattggcaaaagctttatgaaggagttccaatcagatgggagtaaacaagaggacaaggagaaaacagaagtgattctcagctgcctgctgagcattactgatcaggtgctcctgcctagcctctctctaatggactgcaacgcatgtatgagcgaggaactgtggggtatgttcaaaaccttcccctaccaacaccggtatcgcttgtacgggcagtggaagaatgaaacgtataactctcatcccctgctggtaaaagtcaaggcccagactattgatcgggccaagtatattatgaagcgtcttacaaaggagaatgttaagcccagtgggcggcagattggcaaactgtcgcatagcaaccctacaatcttgttcgattacattctgtctcagatccaaaagtatgacaacctcatcacacccgtcgtcgattcactaaaatatcttactagtctgaactatgatgtcttggcatattgtatcattgaagcactcgccaacccggagaaggaaagaatgaaacatgacgatactaccataagctcgtggctccagtctctcgcgtcgttctgtggtgccgtgttcaggaaatacccaattgatttggccggtctgctgcagtacgtggcgaatcagctaaaggctggcaagagtttcgatctactgatactcaaggaggtggtccagaagatggccgggatagaaattacggaggaaatgaccatggagcagctcgaagccatgactgggggtgaacagctgaaggctgagggtggatacttcggccagatccgcaatactaaaaaaagctctcaacgcctaaaagatgctctgctggatcatgaccttgccttgccgttatgccttttaatggcgcaacagaggaacggcgtgatcttccaggaggggggcgagaaacatttaaaactcgtcgggaagctgtacgaccaatgtcacgataccctggtgcaattcgggggctttcttgctagcaacctgagcacggaggattatatcaaaagggttccctctatagacgtgttatgcaatgagttccacactcctcacgatgctgccttttttctttctcggccaatgtacgcacaccatatctcatccaagtatgacgagctcaaaaagtctgaaaagggctccaagcagcagcacaaggtccacaagtacattacctcctgcgagatggtgatggctcctgtacacgaggcggtggtgagcctgcatgtgtcaaaggtctgggacgacatcagtccgcaattttacgctaccttttggagccttacaatgtacgacctggcagtaccccatacatcttatgagcgagaagtcaacaaacttaaggttcagatgaaggctatcgacgataatcaggagatgcctcccaataagaagaagaaggaaaaggaacgatgtactgccctgcaagacaagctgctggaggaggaaaagaaacagatggaacatgtgcagagggtgctacaacggctcaagttggagaaggataactggctgctcgccaaatccactaaaaacgaaacaataactaaatttttacagttgtgcattttcccgaggtgtatcttcagtgccattgacgcagtctactgcgcaagattcgtcgagctggtacaccaacagaaaactccaaactttagcacattgttatgctatgatcgagtcttttcagatatcatttacactgttgcgtcatgcacggagaacgaggcctcccgctacggcagatttctgtgctgtatgctagaaaccgttacgcgttggcattccgatagagcaacttacgaaaaggagtgtggcaactaccctggcttcctgacaatcctgcgtgctacgggatttgatgggggcaacaaagcggatcagctggattatgaaaactttaggcacgtggtccataaatggcactataagttgaccaaggcttcagtccattgtctggagactggcgaatacacacatatccggaatatactaattgtgctcacaaaaatacttccatggtaccccaaggtgttgaacctgggccaggcactagaacggcgggtacataagatttgtcaagaagagaaggaaaaaagacctgacttgtacgccctcgctatgggatactcgggtcagctgaaatcacggaaaagctacatgatccccgaaaacgagtttcaccacaaagaccccccacctcgcaacgcggtcgcctctgtccaaaacggccctggtggaggtcctagctcctcttctatcggtagtgcttcaaaaagcgacgaatctagcactgaagagaccgacaaaagcagagagcgaagccagtgtggtgtgaaagccgtcaataaagcttcctctacaaccccaaaaggaaacagctctaatggcaattctggcagtaatagcaacaaggccgtaaaggagaacgacaaggaaaaaggcaaggagaaagagaaagagaaaaaggaaaaaaccccggcaacaactcccgaagcccgtgtcctgggcaaggacgggaaggagaagccgaaggaagagcgaccgaataaggatgagaaagctagagagactaaagaacggactccaaaaagtgataaagagaaggaaaagttcaaaaaggaggagaaggcaaaagacgagaagtttaagactacggtaccgaacgccgaaagtaagtcgactcaggaaagggagcgggagaaagagcctagtagagagcgtgatatcgccaaagagatgaagtcgaaggaaaatgtgaagggtggcgaaaagacccccgtgagtggaagcctaaaaagccccgtgcctagaagcgatatccccgaacctgaaagggagcagaagagacggaagatagacacccacccttccccaagtcattcaagtacagtaaaggacagtttgatcgaattgaaagaatcaagtgcaaaactgtatatcaatcacaccccacccccactttccaagagcaaagagagagaaatggataagaaggacttggacaaaagcagagaaagatcccgggaacgcgagaaaaaggacgagaaggaccgcaaagaacggaagagggaccactctaataacgatagggaggtgccgcccgacttgactaagagacgcaaggaagaaaacggcaccatgggggtcagtaaacacaagtcggaatcaccgtgcgaatcaccttatccaaatgaaaaggataaggagaagaacaaatccaagtcatcaggtaaggaaaagggctctgactcatttaaaagcgagaagatggacaaaatctccagcgggggaaaaaaagagtcccgacacgataaagaaaagatagaaaagaaagaaaagagagacagctctgggggaaaagaagagaagaagcaccataaaagctctgacaagcataggtag

SEQ ID NO: 208563 - DNA, 4782 bp, Artificial Sequence
  Description of Artificial Sequence: Synthetic coding sequence
atggccgccgccgccgtggtggtgcccgccgagtggatcaagaactgggagaaaagcgggcgaggagagtttttgcatctgtgtcgcatcctgtccgagaacaagtcacacgatagcagtacctaccgtgactttcagcaggcgttgtacgaactgagctaccacgttatcaagggcaacttaaaacacgaacaggcctctaatgtgttgtcagacatctcggaatttagagaggatatgccctccatcctggccgacgttttctgcattttggatatagaaaccaactgtctggaggagaagtcaaagagggattacttcactcaactggtcctggcctgcctgtatcttgtcagcgacacggtgttgaaggaaaggctcgaccccgaaactctcgaaagcctggggctgataaagcagtcccaacaattcaaccagaagtctgtaaagattaagactaagctgttctacaaacagcagaagtttaacctcctccgagaagaaaatgagggttatgcaaagcttattgccgaattgggccaggatttaagtgggagcattacatccgatctgatccttgaaaacatcaagagtctgattggctgtttcaatcttgaccctaacagggtgctcgatgtgattctcgaggtgtttgagtgtagaccagagcacgatgacttcttcatttccctgttagaatcttatatgtcaatgtgcgagccacagaccctttgtcatattcttggattcaagtttaaattctaccaggaaccaaatggcgagacccccagctcattgtaccgcgtggcagccgtacttcttcagttcaacttgatcgatcttgacgacttatatgtccatttgctgccagctgataattgtataatggatgagcacaaaagggagatagctgaggccaaacaaattgtgagaaaactcaccatggtagtgctatctagtgaaaaaatggacgaacgcgagaaggagaaagaaaaggaagaggaaaaggttgaaaagcctcccgacaatcagaagctgggactattagaggccttgctgaagattggtgactggcagcatgctcagaatatcatggatcagatgcccccctactatgcagcttctcacaagttaattgccctggcaatctgtaagttgattcacatcaccatagagccactgtaccgaagggtgggcgtgcctaagggagcaaaaggttccccagtaaatgcactacaaaataagagggctccaaagcaggccgaatcttttgaggacctgaggcgagacgtgttcaatatgttttgctatcttgggccgcacctgagtcatgatcctattctcttcgccaaagtcgttaggatcggaaagtccttcatgaaagaatttcagtccgacggatcgaaacaggaggataaggaaaagactgaggtcatcctgtcttgtcttcttagtataacggaccaagtgctgcttcccagtctgagcctgatggactgtaacgcctgcatgtccgaagaactctggggcatgtttaaaacattcccctaccagcaccgctaccggctttatggccagtggaagaacgaaacctacaatagtcacccgctgctggttaaggtcaaggcacaaaccatagaccgcgctaaatacattatgaagcggctcactaaggagaacgtaaaaccgagtggtaggcaaatcgggaagttgagccatagtaatcctacaattttattcgactatatactgagccagatacagaaatatgacaacctgatcacccctgtcgtggattctctgaagtatctgacatccctgaattacgacgtgctggcctactgcattatcgaagccctggcaaatccggagaaagaacggatgaaacatgatgataccacaatttccagctggctccagtctctcgcctcattctgtggcgcagtttttcgtaaatatcctatcgacctcgctggtctgctgcagtatgtcgctaaccagctgaaggctggtaagagttttgatctgttgattctcaaagaagtggtgcaaaaaatggcggggatcgaaatcaccgaggaaatgacaatggagcaactggaagccatgactggaggggaacagcttaaggcagagggagggtatttcggccagatccgaaatactaaaaaatccagccagcgactcaaagatgcgctacttgatcatgatctagctctgcctctgtgccttcttatggcccagcagcgtaacggggtgatcttccaggaaggaggagaaaagcatcttaagctagtgggaaagctgtacgatcagtgtcatgatactctcgtgcagttcggcggattccttgcttcaaacttatcaaccgaagattacatcaaaagggttccatctatcgatgtactgtgtaacgaattccatacaccccatgatgcggctttttttttgtcaaggccaatgtatgcacaccacatttcaagcaagtacgacgagctgaagaagtccgagaaagggagcaagcaacagcataaggtgcacaagtatatcacctcatgcgagatggtcatggcccctgtgcatgaagccgttgttagcctccacgtgtccaaggtctgggatgatatttccccacagttttacgctactttctggtcattgaccatgtacgacctcgcagttccccacacatcctacgagcgagaggtcaataagctcaaggtccagatgaaagccattgatgacaatcaggagatgcctcccaataaaaagaagaaggagaaggagagatgcactgccctgcaggataaactgctggaggaggagaaaaagcagatggagcatgtgcagagagtgttgcagcggttgaagctggagaaggacaactggctgctggctaagtctacgaagaatgaaaccatcaccaagttcttgcagctgtgtatatttccacggtgtatttttagcgcaattgacgctgtttactgtgcgaggttcgttgagctcgtgcatcaacaaaagacacccaatttcagcaccctcctgtgttatgaccgcgtgttttctgacatcatctacactgttgcttcatgcacagaaaacgaagcaagtaggtacggaaggttcctgtgttgtatgcttgaaactgtcacacgatggcactcagacagagctacgtacgaaaaagagtgcgggaattaccccggattcttaactattttgcgggccacgggatttgacggaggaaataaggccgaccagttggactacgagaattttaggcacgtcgttcataagtggcactataagctgaccaaggccagcgtacactgtctggagaccggggagtacactcacatccggaacatcttaattgtgcttactaagatcctcccatggtatccgaaagtgttaaatctcggccaagccctcgagcgccgagtacataagatttgtcaggaggagaaagaaaaacgaccagacctgtatgccctggctatgggctatagcggccaattaaagagtaggaagtcatacatgatcccagagaatgaatttcaccataaggaccctccgccgcgtaatgcggttgcctccgttcagaacggcccggggggtggtccctccagtagcagcattggctctgcaagcaagtccgacgaatcaagcactgaggagacagataaaagtcgcgagaggagccagtgcggcgttaaggccgtaaataaggcctctagcactaccccaaagggtaacagtagcaatggcaattcaggtagcaactctaacaaagctgttaaggaaaatgacaaagaaaaaggcaaagagaaagagaaggaaaagaaagagaaaacacccgcaactacacctgaggccagggtgttgggaaaagacggtaaggagaaacctaaggaggagaggccgaacaaagacgaaaaagctagagagacaaaggagcggacgcccaagtccgacaaggagaaggagaagtttaagaaagaagagaaggcaaaggacgaaaaattcaagacaacagtgcccaatgctgagtctaagtccacacaggagcgagagagggagaaagagccaagtcgcgaacgagacatagctaaagagatgaagtcaaaggagaatgtgaagggaggagaaaagactccggtaagtggatcgctgaagtcaccagtgccacgctccgacatcccggaacccgagcgggagcaaaaacgccggaagatcgatactcacccatccccatctcactcttcaaccgtcaaggacagcctcattgagttaaaagagtcctcagccaagctctatataaaccacaccccccccccgctgtcaaagtctaaggagagagagatggacaagaaagacctcgataagagtagagaaagaagtcgagagagggaaaagaaggacgagaaggaccggaaagagcgcaaaagggaccattccaataacgaccgagaggtccctcccgatctgaccaaacgccggaaggaggaaaacggcacaatgggtgtgagcaagcacaagagtgaatctccatgtgaatccccgtatcctaatgaaaaggataaggagaagaacaagagcaagtcatctgggaaagaaaaaggaagtgacagctttaagtctgagaaaatggacaaaattagctccggaggaaaaaaggaaagccggcacgataaggagaaaatcgagaagaaggagaagagagattcctcaggggggaaagaggagaaaaagcatcacaaatcctcagacaagcaccgctag

SEQ ID NO: 208564 - DNA, 2547 bp, Artificial Sequence
  Description of Artificial Sequence: Synthetic coding sequence
atgcccagcatcctggccgacgtgttctgcatcctggacatcgagaccaattgtctagaggagaagtctaaacgcgattattttacacagttagtactcgcctgtctgtatctcgtgagtgacaccgtgttgaaagagaggctggatccagaaacattagaaagccttggcttaattaagcaaagccagcagtttaatcagaagtcagtgaagattaagacgaagctgttttacaaacaacagaagttcaatttgttgcgtgaagagaacgagggatatgctaaactcattgctgagttaggacaggacttatctgggagtatcacatcagaccttatcctggagaacataaaatcattgattggctgctttaacctcgatcctaaccgggtgctagatgtgattctggaagtgtttgagtgtagaccagagcacgacgatttcttcatatccctgctggagtcttacatgagtatgtgtgagccccagaccttatgtcatatactggggtttaaattcaagttttatcaggagcctaacggtgagacgccctccagcctctaccgggtcgcggcagtgcttcttcagttcaatctgatcgatctggatgacttatacgttcatttactgccagctgacaattgcattatggacgagcataagcgggagattgcagaagccaagcagatcgtcagaaagctgactatggtggtgctgtcctcggagaaaatggatgaacgcgaaaaagagaaagagaaggaggaggagaaagtcgagaagccccctgataatcaaaagctagggcttttggaagcccttttaaaaatcggggattggcagcatgcccagaatattatggaccaaatgccaccctattatgccgcctcacataagctgattgcactcgcgatttgcaagctgatacacattacaatcgagccactgtataggcgcgtaggcgtaccgaagggagctaaggggtctcctgtgaatgctctccaaaataaaagggcaccgaagcaagccgagtcctttgaggatctccggcgcgacgtattcaacatgttttgctatctggggccccacctttcccacgaccctatattatttgccaaggttgttagaatcggtaaatctttcatgaaagagttccaatcagacggcagcaagcaggaagacaaagaaaagacagaagtgatactgtcatgcctactctctatcactgatcaagtgctgctgccttccctgtccctgatggactgtaacgcttgtatgtccgaggagctgtggggaatgttcaagaccttcccatatcagcatcgttataggctttacggccaatggaagaacgaaacgtataatagtcatcccttattggtgaaggtgaaggcccaaaccattgatcgcgccaaatatatcatgaagcgtctgacaaaggaaaatgtcaaacccagtggacgccaaattggaaaactgtcccactccaatcctacaattctgttcgactacgtctgtttcgagatcctgagccaaatccagaagtatgacaacctcatcacccccgttgtcgactcattgaaatacctgactagcctgaattacgacgtgctcgcttattgtattattgaagccttggccaatccagaaaaggaacgaatgaagcacgatgataccactatctctagctggctccagtctctggcatcattttgtggtgcagtgtttcgcaaatacccgatcgatctggccggcctactacaatatgtggccaaccagctgaaagccggtaagagcttcgatctgcttattctcaaagaagtcgttcagaaaatggcgggcattgagataacggaggaaatgaccatggaacagctggaagccatgactggcggggaacagttaaaagccgagggggggtattttggtcagatccgcaacaccaagaagtcctctcagcggttaaaagacgctcttctggaccatgatctggcgctcccgctttgtctcctgatggcgcagcagcgcaacggcgtcatatttcaggagggaggggagaagcatctcaagttggtgggaaagctttatgatcagtgccatgacactctggttcagttcgggggatttctagcttccaacttgtcaaccgaagactatattaagagagtcccatctatcgacgtactgtgcaatgagttccacacccctcacgacgccgctttctttctgtccaggccaatgtacgcccaccatatttcctcgaaatacgacgagctgaagaagtcagaaaaagggagtaagcagcagcataaggttcataaatatattacaagctgcgagatggtaatggcaccggtccacgaggctgtggttagcctgcacgtaagcaaagtatgggacgacatttcccctcagttctatgctactttctggtctttgaccatgtatgacctggccgtaccccatacatcttacgaacgggaggtcaacaagctcaaggtgcagatgaaagcaatcgatgacaaccaggaaatgatccccccgcagtag

SEQ ID NO: 208565 - DNA, 570 bp, Artificial Sequence
  Description of Artificial Sequence: Synthetic coding sequence
tgagagcagaagcggcggaagatcgacacccaccccagccccagccatagttccaccgtaaaggattctctgatcgagctgaaggagtcttcggccaagctgtatattaaccacacccccccacctttgagtaagtctaaggagagggaaatggacaaaaaagaccttgacaaaagcagggagcgaagtagggaaagagaaaaaaaagatgagaaagatcgaaaggagagaaagcgagatcactccaacaacgatcgggaggtgcctcccgaccttacaaaaaggaggaaggaagaaaacggaaccatgggcgtcagcaagcataaatctgagtcgccttgtgaaagtccatatccaaacgaaaaggataaggaaaagaacaaaagcaaatcgtcgggcaaagaaaagggttccgacagctttaagagtgagaagatggacaagatcagcagcggaggcaaaaaggagtctcgccacgataaggagaaaatcgagaagaaggagaaacgagattctagcggcggcaaggaggagaaaaaacaccacaaatcatccgacaaacatcggtag

SEQ ID NO: 208566 - DNA, 1056 bp, Artificial Sequence
  Description of Artificial Sequence: Synthetic coding sequence
atggccgtgcccgccgccgccatgggccccagcgccctgggccagagcggccctggttccatggctccctggtgctccgtcagcagtggtcccagcaggtatgtgcttgggatgcaggagctgtttcgggggcatagcaaaacgcgggagttcctggcgcactcagcaaaggtgcattcagtggcctggtcctgtgatgggcggcgactggccagcggttcattcgacaaaaccgcatcagtgttcctgctggagaaggaccggctggtcaaggaaaataattatcggggccacggtgactctgttgatcagctgtgctggcacccctctaaccccgatctctttgtaacagcaagtggggacaagacgattagaatttgggatgtgcgaacaacgaaatgcattgccacagttaatacaaagggcgagaacataaacatctgttggagtcctgacggacagaccatagctgttggcaataaggatgacgtagttaccttcattgacgctaagacccatagatctaaggctgaggagcaatttaagttcgaggtgaatgaaatctcgtggaacaacgataacaacatgttcttcctgaccaatggaaatgggtgcatcaatatcttgtcttacccagaactaaagcctgtgcagtctatcaacgcgcacccatcaaactgcatctgcataaagttcgatccgatgggaaaatatttcgccacaggttccgccgatgccctggtgtctctctgggacgtggacgaattagtgtgcgttcggtgcttctcgaggttagactggcctgtgcgcacactaagcttttcgcacgatggaaaaatgctggcgtcagcttcagaggatcactttattgacatcgcagaggtcgagactggcgacaagttgtgggaagtccagtgcgagtctcccaccttcacagtggcctggcaccctaagaggcctctgttagcctttgcgtgtgacgataaggatggaaagtacgactcttcaagggaggccggcaccgtgaagttgttcggtctgccaaatgactcatag

SEQ ID NO: 208567 - DNA, 2052 bp, Artificial Sequence
  Description of Artificial Sequence: Synthetic coding sequence
atgagcagcgagagcagcaagaagcggaagcccaaggtgatccggagcgacggtgcccccgcagagggcaaacggaacagatccgacaccgaacaagaagggaagtactatagcgaagaggcagaagtggacctgcgcgacccggggagggactatgagctctacaagtacacatgtcaggaactgcagagacttatggctgagattcaggacttaaagtcccgcgggggtaaggacgtagccattgagatagaggaaaggaggatccaatcttgcgtccatttcatgactcttaaaaaactgaatcggctggcccatatcaggttgaagaaaggaagggatcagacccatgaggcaaagcagaaggtggatgcttaccacctgcagttgcagaatcttctgtatgaggtgatgcacctgcagaaagagatcaccaaatgcctcgagttcaaatcaaaacacgaggagattgacttagtgagcctggaggaattttataaagaagcccctcccgacatctcaaaagcggaagttacaatgggagaccctcatcagcagaccctagcccggctggactgggaactggaacagcggaagaggctagctgaaaagtaccgggaatgcttgagcaataaagagaaaattctgaaagagattgaggtgaaaaaagagtacttaagctcattgcagcccagactgaattctatcatgcaggcctcactccctgtccaagaatacctgtttatgccatttgaccaggctcacaaacagtatgagactgctcggcacctccctccacccctgtacgtcctgtttgtgcaagcgacagcctacggccaggcatgtgataaaactctgagtgtagccatagaaggcagcgtcgacgaggctaaggctttgtttaaaccgccagaggacagccaggacgacgaatccgattcagacgcagaggaggagcaaactacaaagagaagacggccgactctcggcgtacagctggacgacaagcggaaagagatgttgaaacggcacccactgagcgtgatgctggacttaaagtgcaaagatgatagcgtcctgcacctgaccttttattatttaatgaacctgaacatcatgacggtgaaggcgaaggtgactaccgcaatggagttaattactcctataagcgctggggatttgctgtctccagactcagtactttcttgcctttatcccggcgatcatggtaaaaaaacccccaatcccgcgaatcagtatcagttcgacaaggtcggcatccttactctgagcgattatgtgctagagctgggccacccctacctctgggtacagaagctgggtggactgcacttccccaaagaacagcctcagcagactgtgatcgctgaccacagtttgtccgcaagccatatggaaactaccatgaagctgctgaagacccgcgtgcagagccgcctcgctctccacaaacagttcgcttccctcgagcacggaattgtacccgtgaccagtgattgccagtatttgtttccagcgaaggtggtttctcgcctggtgaagtgggtcactgtggcccacgaggactacatggagctacactttactaaagatattgttgacgctgggctagctggggatacaaacctgtactacatggctctgatagagcggggaaccgctaaactgcaagcggccgtggtacttaatcctgggtacagttcgatcccccctgtgttccagctctgtctcaactggaaaggagaaaagacgaacagtaatgatgataatatcagagcaatggaaggggaagtgaacgtctgttacaaagagctctgcgggccttggcccagccatcagctcctcaccaatcaattgcagagactctgtgtcctgttagacgtgtacctcgagaccgagtcccacgatgacagtgtggaaggccctaaggaatttcctcaggagaagatgtgtctgagactgttccgggggccatctcggatgaaaccatttaagtataatcacccccagggtttcttcagtcacagatag

SEQ ID NO: 208568 - DNA, 2052 bp, Artificial Sequence
  Description of Artificial Sequence: Synthetic coding sequence
atgagcagcgagagcagcaagaagcggaagcccaaggtgatccggtccgatggcgcccccgccgaaggtaagcgtaaccgtagcgacactgagcaggagggcaagtactactcagaggaggccgaggtggatttgcgggatcctggcagggactacgagctgtacaaatatacatgccaggagctgcagaggctcatggcagagattcaggacttgaagtctcgtggaggcaaagacgtggccatcgagatcgaggagagaagaatccagtcttgcgtccatttcatgacattgaagaagttaaacagactggctcatattagactgaagaagggccgtgaccagacacatgaagctaagcagaaggtcgacgcttatcatctccagctgcaaaacctgctctacgaggtgatgcatctccaaaaagagattactaagtgtcttgaattcaagagcaagcatgaagaaatcgatctggtttctttagaggaattctataaggaagcgcctcctgatatctcgaaggcggaggttactatgggcgatcctcaccaacaaacactggccagattggattgggaactcgagcagcgcaaaaggcttgctgagaagtatagggagtgcttatctaataaggagaagattctaaaggaaattgaggttaagaaggagtatctgtcctcactgcagccgcgtctgaactccataatgcaagcgtccttgcccgttcaagagtatctgtttatgcctttcgaccaggcccacaaacagtacgagacagctcgtcatcttccaccgcccctctatgttcttttcgtgcaggcaacagcctatggtcaggcttgcgataaaaccctgtccgtcgctatagaagggtccgtggacgaggccaaagctttgttcaagcctccggaagactcccaggacgatgaaagcgactccgacgccgaagaggagcaaactacgaaacgacggcggcccaccctcggagtgcagctcgatgacaagagaaaggaaatgctgaagagacaccctctgagcgttatgctagatctcaagtgcaaagatgacagtgtgcttcatctcacattttactatctcatgaaccttaacatcatgaccgtgaaagcaaaagtgacaaccgctatggagctcataaccccgatctctgcaggcgacctcctctcacctgattccgtcctttcctgtctttatccgggcgatcacggtaaaaaaacaccaaatcccgcaaaccagtaccaatttgataaggtgggaatcctgaccctgtccgactacgtgctggaacttggtcatccttacttatgggtacagaagctgggaggtctgcatttccccaaggagcagccccaacaaaccgttatcgccgatcacagcctgtccgcatcacacatggagacaacaatgaaactgctgaagaccagagtgcagtctagattagcacttcacaaacaattcgccagcttggagcacgggatcgtgccagtgacatctgactgtcagtacctgtttccagccaaggtggtgagcagactggtgaagtgggtgacggtggcccatgaggattatatggaactgcacttcaccaaggacatcgtggacgcaggactagctggcgataccaatctgtattacatggccctgatcgagagagggacagctaaactccaggccgcggttgtcctgaaccctggctattcctcgatcccccccgttttccaactgtgtctaaactggaaaggcgaaaagaccaactccaatgacgacaatattcgcgctatggaaggcgaggtcaacgtgtgctataaagaactgtgtggaccctggccatcgcaccaattgttgaccaatcagctccaacggttatgcgtactgcttgacgtatatctggaaaccgaatcacatgacgatagtgtagaaggccccaaggagtttccccaggaaaaaatgtgcctgagactgttcaggggccccagcagaatgaagcctttcaagtacaatcaccctcagggctttttttctcatagatag

SEQ ID NO: 208569 - DNA, 2052 bp, Artificial Sequence
  Description of Artificial Sequence: Synthetic coding sequence
atgagcagcgagagcagcaagaagcggaagcccaaggtgatccggtccgacggggccccagctgaggggaagcggaatcggtctgacaccgaacaggagggcaaatactacagtgaggaagccgaggtggatctgcgcgatccaggccgcgattatgaactgtataaatatacttgtcaggaactgcagcggctgatggcggagattcaggacctcaaaagcaggggcggtaaagacgtcgcaatcgaaatcgaagagaggcggatccaaagttgcgtccattttatgacactcaagaagctcaaccggttggcccatatcaggttaaagaaaggtagagatcagacacacgaggcgaaacaaaaagtagatgcctatcatctgcagctgcagaatctgctttatgaagttatgcacttgcaaaaagaaattaccaagtgtctggagttcaaatcaaagcacgaggagatcgacctggtgtctctcgaagaattttataaagaggccccccccgatatctccaaagctgaagtgacaatgggagacccccaccagcagacactggccagactggactgggaactggaacagcggaaaagactggcggaaaagtatcgagaatgtctgagcaataaggaaaaaatattaaaggagatcgaggtgaaaaaggaatacctttccagtctccaacccaggctcaattcaataatgcaggcgtcgctgccagttcaggaatatctgttcatgccatttgaccaagcgcataagcagtacgaaacggcccgtcatttgcctccaccgctttatgtgttgtttgtgcaggctactgcctacggacaggcttgcgataagacattgagtgtcgccatcgaagggtccgtggacgaggcgaaagctctcttcaaaccccctgaggattcacaagatgacgaaagtgattccgatgcagaggaagaacaaaccactaaaagacggaggcctactttaggagttcagctcgacgacaaaaggaaggagatgttgaagagacaccctctgtccgtaatgctggacctcaaatgcaaggacgatagcgtgttacatcttacattttactacctcatgaacctgaacattatgactgtgaaggctaaggtaactacagccatggagctgattacacccatcagtgctggcgacctgttgtccccagactctgtgctttcctgtctgtatcccggcgaccatgggaagaagacaccaaatccagccaaccagtatcagtttgacaaggtaggcatccttacactgagtgattacgtcctagagctgggacatccatatctctgggtccagaagctagggggtctgcattttccaaaggaacagcctcagcagacagttatcgccgatcactccttgagcgcgtctcacatggagactacaatgaagcttttaaagacaagagtacaatcgagactggcactgcacaaacagtttgcttctctggaacatggcatcgtgcccgtgacctccgactgtcagtatctgtttccggctaaggtggttagtagattagtgaagtgggtgacggtggctcacgaagattacatggagctacacttcaccaaggatatcgtggacgctggcctggccggagataccaatctttattatatggcactgattgagcgtggcacggccaagctccaggctgcagttgttctcaatcctggatattctagcatcccccctgtgtttcaactgtgcttaaactggaagggcgaaaagaccaattcaaacgacgataacattagagcaatggaaggcgaagtgaacgtatgctacaaggaactgtgcggtccatggccttcacaccagcttctgacaaaccagttacagcgtctctgtgtcctcttggatgtctacctcgagacggagtcgcatgacgattctgtggaggggccaaaggaattccctcaggaaaaaatgtgtctgagactgttccgaggacccagcagaatgaaaccgtttaagtacaatcacccacagggatttttctcacaccgatag

SEQ ID NO: 208570 - DNA, 282 bp, Artificial Sequence
  Description of Artificial Sequence: Synthetic coding sequence
atgagcagcgagagcagcaagaagcggaagcccaaggtgatccggtcagacggagcacctgcagagggcaaaagaaaccgctctgacaccgaacaggaaggcaaatattacagcgaagaggcggaggtggatctgagagaccccgggcgggactacgagctgtacaagtacacctgtcaggagctgcagagattgatggctgagatacaggacttgaaatcgcgggggggcaaggacgtggctatcgaaatagaagagcggcgaatccaatcctgcgtgtag

SEQ ID NO: 208571 - DNA, 486 bp, Artificial Sequence
  Description of Artificial Sequence: Synthetic coding sequence
atgagcagcgagagcagcaagaagcggaagcccaaggtgatccggtctgatggcgcacctgcagaagggaagcggaatcgcagcgatactgagcaggaaggtaaatattattccgaagaggcagaagtggacctgagagatccaggccgcgattacgaactgtacaagtacacgtgtcaagagctgcaacggctgatggccgaaatccaggatctgaagtccaggggagggaaagatgtcgctatcgagattgaagagaggcggatccagtcttgtgtccactttatgacccttaaaaaactgaatcgcttagcccatattcgcctgaaaaaggggagggatcagactcatgaagctaaacagaaggtcgacgcataccatttacagcttcagaacttattgtacgaggtgatgcacttacaaaaagaaattacaaaatgcctggagtttaagagtaagcacgaagaaattgatctggtgtcctag

SEQ ID NO: 208572 - DNA, 672 bp, Artificial Sequence
  Description of Artificial Sequence: Synthetic coding sequence
atgagcagcgagagcagcaagaagcggaagcccaaggtgatccggtccgacggagcacccgcagaaggaaagcgcaacaggtctgacacagaacaggagggcaagtattattccgaggaggccgaggtcgatctgcgggaccctggtcgcgactatgaactgtacaagtatacttgccaggagctgcagcgccttatggccgagatccaagatctgaaaagtagaggtgggaaagacgtcgctattgaaattgaggagaggcggattcagtcatgcgtgcacttcatgacattaaagaagttgaatagactagctcacatccgcctgaagaaaggaagggaccaaacccatgaagcaaagcaaaaggtcgatgcttaccatctgcagcttcaaaatctgctctatgaagttatgcacctacagaaggagatcactaagtgtctggaatttaagtcgaagcatgaagagatcgatttagtgagccttgaggagttctacaaggaagcgcctcccgacatcagtaaggcagaggtgaccatgggagatccacaccaacagacccttgctcgattagactgggagctggaacagaggaaaagactggcagagaagtatcgagagtgcctgagcaataaagaaaaaattttgaaagaaatagaggtaaagaaatag

SEQ ID NO: 208573 - DNA, 2052 bp, Artificial Sequence
  Description of Artificial Sequence: Synthetic coding sequence
atgagcagcgagagcagcaagaagcggaagcccaaggtgatccggtcggacggggcgccagcggagggaaagagaaatcggagcgacaccgaacaggagggtaagtattatagcgaggaagctgaggtggatttaagagaccccggacgcgactatgaactatacaagtacacatgtcaggagctgcagaggctcatggcggagatccaagacctcaaatctcgaggaggaaaagatgtggccatcgagattgaggaacgcaggattcagtcctgtgtgcacttcatgacgctgaagaagttaaatagactagcacacatccgattgaagaagggcagggaccagacccacgaagcaaagcagaaggtagatgcgtatcatctgcagctgcagaatctgttatacgaggtgatgcatttgcagaaggagataacgaaatgcctcgagttcaaatctaagcacgaggagatagacttggtttccttagaagagttctataaagaggctccccccgacatctctaaagctgaagtcacaatgggtgatccacaccagcagacactggctcgtctggactgggaacttgaacagcggaaacgcctcgccgagaaataccgagaatgtctaagcaataaggaaaagatcctcaaagagattgaagtgaagaaggagtaccttagttccctccagcctagattgaatagcattatgcaggcctctctcccggtgcaggaatatctttttatgcccttcgatcaagcccataaacagtatgagactgccaggcacctgccacccccgctttacgtgctgtttgtccaggctaccgcatacggccaagcttgtgacaaaaccttatcggtcgcgattgaaggaagcgttgacgaggccaaggctttatttaagccccccgaggactcccaggatgacgagagtgattccgacgcagaggaagagcagacaactaagaggcggcgccctacacttggcgtccagcttgacgataaaagaaaggaaatgctgaaaaggcaccctctgagcgttatgctcgatctcaagtgcaaagatgactccgtacttcacctaacattctactacctgatgaatctgaacatcatgaccgtcaaggcaaaagtcaccaccgccatggaactgatcacaccaatttctgcgggggatctactgtctccggattctgtgctttcctgtttgtacccaggagatcacggtaaaaagacacccaacccggctaatcagtaccagttcgataaggtggggattctgaccctatctgattacgttcttgaactcggtcatccctacctgtgggtgcagaaactggggggtttacacttccctaaagaacagccccagcagaccgtgattgcagaccactctcttagcgcatcccatatggagactacaatgaaactgctcaagactcgggttcaatcgcgcttagccctgcacaaacagttcgcaagcttggagcacggtatagttccagtgacatccgactgtcaatatctttttccggcaaaggtagtatcccgtttagtgaaatgggtaacggttgcccacgaagattacatggaattgcatttcacaaaggatatcgttgatgccggtctcgccggggacaccaatctgtactacatggctctgatcgagcgcggtaccgcaaaactgcaggccgccgtagtgctcaatcccggctatagcagcatccccccggtattccagctgtgtcttaattggaaaggggaaaagaccaatagcaatgacgataatatcagggctatggagggtgaagtgaacgtgtgctataaggagttgtgcggaccatggccaagccaccagctgctcaccaatcaactccaaaggttgtgcgtgctgcttgatgtttacctcgagactgaatctcacgatgacagcgtggaggggcctaaagagtttccccaagagaagatgtgtcttagactgttcagaggcccatccaggatgaagcccttcaagtacaatcacccccaaggattctttagtcaccgatag

SEQ ID NO: 208574 - DNA, 615 bp, Artificial Sequence
  Description of Artificial Sequence: Synthetic coding sequence
atgggcgccgtgaccgacgacgaggtgatccggaagcggctgctgatcgacggcgacggcgccggtgatgacaggcggatcaacctgctcgttaagtcttttattaaatggtgcaactctggaagtcaggaagagggctacagccaatatcaacgcatgctcagcaccctttcacaatgtgagttcagtatgggtaagactctcctcgtttatgacatgaatctaagggagatggagaattatgagaagatttataaggagatcgaatgttctatcgcaggcgcccatgaaaaaatcgccgaatgtaaaaaacagatcctgcaggctaagaggattaggaagaatagacaggagtatgatgcactggccaaggtaatccagcaccatcccgatcggcatgaaactctcaaagaactggaggctctaggtaaggaattagagcacttaagccacattaaagaaagcgtggaagacaaactcgaactgcgcaggaagcagttccacgtcttgctctctactattcatgagctccaacagactctcgagaatgacgagaagctctcggaggtggaggaagcccaggaggcttcaatggaaactgaccccaagccctag

SEQ ID NO: 208575 - DNA, 711 bp, Artificial Sequence
  Description of Artificial Sequence: Synthetic coding sequence
atgagcgaggccccccgggccgagaccttcgtgttcctggacctggaagccacaggactaccttccgtcgaaccagagatagcggaattgagcctattcgccgtccaccgcagcagtctcgaaaaccctgaacacgatgagagcggtgcattagtactcccacgggtactcgataaactgaccctctgtatgtgcccagaaagaccctttaccgcaaaggcttctgagatcaccggcttgagtagcgagggtctggcgcggtgcaggaaggccggtttcgacggagccgttgtgcgaaccctgcaggcctttttatctaggcaggccggcccaatttgtctggtcgcccacaacgggtttgattacgactttcccctgctttgcgcggaactcaggcgcttaggtgccaggcttcctagggatactgtgtgccttgatacgctcccagcacttagagggctggatcgcgcccatagtcatggcactagagcccgagggcgccaggggtattcattaggctctctgttccatcggtacttccgagctgaaccctcggctgcccacagcgccgagggggacgtccatactctgctcctgatctttctacaccgcgctgcggaattactggcatgggccgatgagcaggcacgaggctgggcccacattgagccgatgtatttgcctcccgatgaccccagcttggaggcatag

SEQ ID NO: 208576 - DNA, 840 bp, Artificial Sequence
  Description of Artificial Sequence: Synthetic coding sequence
atgggccgggccggcagccccctgccccggagcagctggccccggatggacgattgcgggagtagatctcgctgttccccaacactctgctcaagtttgaggacctgttaccctcgaggcaacattacaatgtcggaggctcctcgcgccgagacctttgtgttccttgacctcgaggcgacagggctgcccagcgttgagcctgagattgctgaactgagcctgtttgccgtccatcgcagcagtctcgagaaccccgaacacgacgaaagcggcgcactggtgttgccaagggtgctggataagcttaccctgtgtatgtgtccagaaaggccattcactgcaaaggcgagcgagatcacaggtctctcctccgaaggcttggcaaggtgtaggaaggcaggcttcgatggcgccgtggtccgcactctacaggcattcctctccaggcaagcgggacctatctgtcttgtggcacataacgggttcgactacgattttcctctgctctgtgcagaactcaggcgactgggagcccgactgccaagggacaccgtatgcctcgacacactgcctgccctgaggggacttgaccgggcgcactctcacggaacccgggctcggggccgacagggttactccttgggcagcctgttccatcggtactttcgagctgaacccagtgccgctcattctgccgagggcgatgtacacactctacttttgatttttctgcaccgggcagcagagctgctggcatgggccgatgagcaggctcgcggttgggcacacatcgaaccaatgtatctgccacccgacgacccttctctggaggcttag

SEQ ID NO: 208577 - DNA, 711 bp, Artificial Sequence
  Description of Artificial Sequence: Synthetic coding sequence
atgagcgaggccccccgggccgagaccttcgtgttcctggacctggaggcaactggccttccaagcgtggagccggagatagcagagctctcattatttgccgtgcatagatctagtcttgagaatccagaacacgatgaaagcggagctcttgtcctcccacgggtactcgacaaattgactctctgtatgtgtccagagaggccttttactgcaaaggcatccgagatcactggcctcagttccgaagggttagccaggtgtaggaaagcgggcttcgatggagccgtagtccggaccctgcaggcctttctttctagacaggccggcccgatttgcctcgttgcgcataacggattcgattacgatttcccactgctgtgtgccgaactacggcgtctgggcgcccgcctgccccgggataccgtgtgtttggacactctgcctgcccttcgcggcctcgaccgcgctcattcgcacgggacgagagcccgcggccgccaaggctacagcctgggatcactgtttcatagatattttcgagccgagccatccgctgcccactccgccgaaggggacgtgcatacactacttctgatctttctgcatagagccgccgagctgctggcatgggctgatgaacaggccaggggatgggcacacatcgagcccatgtatctgccccctgatgaccccagcctggaagcctag

SEQ ID NO: 208578 - DNA, 711 bp, Artificial Sequence
  Description of Artificial Sequence: Synthetic coding sequence
atgagcgaggccccccgggccgagaccttcgtgttcctggacctggaggcaacgggcctgccttctgtcgaaccagaaattgcagagctctctctgttcgcagtgcacaggagtagcctcgaaaaccctgagcatgatgaatctggggcactcgtcctacctcgggtgcttgacaaactgacactctgcatgtgtccagaacggccctttacggcaaaggcgtcggagattaccgggttaagctcggagggactggcacgctgcagaaaagctgggttcgacggcgccgtggtgcggacattacaggctttcctgagccggcaggctggacctatttgtctggtggcacataacggctttgattacgactttcctctgctgtgcgctgagctgagacggcttggggcaaggctgccccgcgacaccgtttgcctagatacactcccagcgctcagaggcttggaccgtgcccatagtcacggcaccagagctaggggaaggcagggatactcccttggttctctttttcatcggtacttccgagcagaacccagcgctgctcacagcgccgagggagacgtccatacactgcttctcatctttctgcaccgcgcggcagaactcctggcatgggccgacgagcaggctagagggtgggcacacatagagcccatgtaccttccgccggacgacccaagccttgaggcctag

SEQ ID NO: 208579 - DNA, 840 bp, Artificial Sequence
  Description of Artificial Sequence: Synthetic coding sequence
atgggccgggccggcagccccctgccccggagcagctggccccggatggacgactgtggaagtaggtcgcgctgcagcccaacgctctgctcaagcttacgcacctgttacccccggggcaacatcaccatgtccgaggctccgcgggccgaaacttttgtgttcctggacctcgaggcaacgggtttgccatctgttgaacccgagattgctgagctgagcctgttcgctgtccaccgcagtagtcttgagaatcctgaacacgatgaaagtggtgccctcgtgttgccaagagtactggataagctcacattgtgtatgtgtccagagagaccattcacagctaaggcttcggagattacaggcttgtcctccgagggcctggctcgatgcagaaaagctggtttcgatggggccgtggtgcgcaccctgcaggcatttctgtcccggcaagctggccccatttgtcttgtcgctcataatggcttcgattacgactttcctctcctttgcgccgaattaagacggctgggcgcccgcctgccacgagacaccgtgtgcctggatactctcccggcattgagaggcttggatcgggcacactctcatgggacccgagcccggggtagacaaggctattccctcggaagtctgttccacagatatttccgcgccgaaccgtcagcagcacatagcgcagaaggtgacgtccataccctccttctgatattccttcaccgggctgctgaactgctggcatgggccgacgaacaagcccgtgggtgggctcatattgagccgatgtacctgccgccggacgacccctcactcgaagcctag

SEQ ID NO: 208580 - DNA, 711 bp, Artificial Sequence
  Description of Artificial Sequence: Synthetic coding sequence
atgagcgaggccccccgggccgagaccttcgtgttcctggacctggaagcaacaggcttacctagcgtggagccggaaattgccgaactgtccctttttgccgtacacagatccagcttggagaacccagagcacgacgagagcggagccttagtattgccgcgtgtcttggataaactgaccctctgcatgtgcccagaaaggcctttcacggccaaagcatctgaaatcaccggattgtcatctgaggggcttgctcgctgcaggaaggcaggcttcgatggggccgtggtcagaacgctgcaggctttcctttctcgacaggcaggccccatatgtctcgtggcacacaatggcttcgactacgatttcccactgctgtgcgcagaattgcggcggctcggcgcgaggcttccgcgggacacagtgtgcctggacaccttacccgcccttagaggactggatagggcccattctcatggaactagagcacgcggccgccagggttactcactcggtagtctgttccacaggtacttccgggctgaaccctcggctgctcatagtgcagaaggcgacgttcacacactactgctaatcttcctccatcgcgccgccgagctgctagcatgggctgacgaacaggcccgggggtgggcccacatcgagcctatgtatctgccacccgacgatccaagcctggaggcttag

SEQ ID NO: 208581 - DNA, 840 bp, Artificial Sequence
  Description of Artificial Sequence: Synthetic coding sequence
atgggccgggccggcagccccctgccccggagcagctggccccggatggacgactgcggatctagaagtagatgctcaccaaccctgtgttcctcgcttcgtacatgctacccacgggggaacatcacaatgtccgaggcccctagagcagaaaccttcgttttcctggatctggaggccactggcctccctagcgttgaacccgagattgccgaacttagcctgttcgctgtccaccgcagcagtcttgaaaatcctgaacatgatgagagtggtgccctcgtcttacctcgagtgctggataagctcaccctctgcatgtgccctgaacgcccttttaccgccaaagcctctgaaatcaccggcttgagctctgaggggctggccaggtgtcgcaaggccggcttcgatggtgcggttgtgcgcaccctccaggccttcctctcccgccaggcaggacccatctgtcttgtcgcacataatggctttgattacgattttccactcctctgtgccgaactacgaaggctgggtgcaaggctgccgcgggataccgtgtgcctcgacacacttccagctttacgcgggctggatcgtgcccatagccacggaacgcgcgccagaggacggcaagggtacagcctgggaagtctctttcaccggtattttcgagccgaaccctcagccgcgcactcagctgaaggtgacgtgcacacactgttgctgatcttcctgcaccgggcagcagagctgctcgcatgggccgatgagcaggcccgaggctgggcacacattgaaccgatgtacctgccacctgacgatccatccctcgaggcttag

SEQ ID NO: 208582 - DNA, 837 bp, Artificial Sequence
  Description of Artificial Sequence: Synthetic coding sequence
atgatcgtggccgccgaggccgtggccgccccccggtgcgccctggtcggagatcggagtggagcggacgcaccgagagccaaaggccattcactgaggacatgttaccctcgaggcaacatcactatgtctgaggcgcctagggcggagacttttgtgtttctcgacttggaagcaacaggcctgccaagcgttgagcccgaaattgctgagctttcgctgtttgcagtccacaggagctctctggagaatccagagcacgatgagagtggggcactcgtactgccccgggtcctggacaaactgaccctgtgtatgtgtcctgagcggccctttacggccaaggctagtgagattacagggctctcgtccgaaggcctggccaggtgtcgtaaggctgggtttgacggagccgtcgtgcgtaccctacaagccttccttagcaggcaagccggaccgatttgtctcgtcgcacacaatgggtttgactatgatttccccctgctctgtgctgagcttaggaggctgggggcaaggctgcctcgtgacaccgtctgcctcgatacactgcctgcacttagaggcctggacagggcgcactctcacggaacacgcgcccgggggcgccaggggtattcactgggctctctgttccatcggtacttcagggcagagcctagcgccgcacactctgctgaaggggacgtgcatacactgttgctgatcttcctgcacagggctgccgagttactcgcatgggctgatgagcaggctagaggatgggctcacattgagcctatgtatctccccccagatgatcccagcttggaagcatag

SEQ ID NO: 208583 - DNA, 2172 bp, Artificial Sequence
  Description of Artificial Sequence: Synthetic coding sequence
atgttcgaggagaaggccagcagccccagcggcaagatgggcggcgaggagaaacctattggcgccggagaagagaagcaaaaagagggcggcaaaaaaaagaacaaggaaggaagcggggatgggggtagggccgaattaaacccatggcccgagtatatctacaccagacttgagatgtacaacatcttaaaagcggaacacgattcgatcctggctgagaaagcggagaaagactctaagccaatcaaagtgaccctccccgatgggaagcaggtggatgctgaatcatggaagacgaccccataccagatcgcgtgcggaatctcacaggggctggcggacaacactgtgattgcaaaggtcaacaatgtcgtatgggatctcgaccgccctctggaggaggactgtactctcgaattgctcaaatttgaagatgaggaggcccaggccgtttattggcactcttctgcgcatattatgggtgaggctatggagcgtgtgtacggaggctgcctttgctacggcccacctatagagaacggtttttactacgacatgtacctcgaagaggggggagtgtctagcaacgatttctcaagcctcgaggctctgtgcaagaagataattaaagagaagcaggcctttgaacgcctggaggtgaaaaaagaaacactgctcgctatgtttaaatacaacaagtttaaatgcagaatccttaacgagaaggtgaatacccctaccactaccgtttacaggtgtgggcctctgatagacctgtgtcgaggcccccacgtccggcacactggcaagatcaaagccctgaagatccataagaattcttccacctattgggagggtaaggcggacatggagactctgcagcggatctacgggatatctttccctgaccctaagatgctgaaggagtgggaaaagttccaagaggaagcaaaaaaccgagatcacaggaaaatcgggcgggaccaggagctttactttttccacgaactgagtcccggttcatgtttctttctacctaaaggagcttatatctacaacgctctgatagaatttatccggagcgaatacagaaagcgtgggtttcaggaagttgtgacacccaatattttcaattcccgcctgtggatgaccagcggccactggcaacactattctgaaaatatgttctctttcgaagttgaaaaagaacttttcgcacttaagcccatgaactgccctggacactgcctcatgttcgaccacaggccaagatcttggcgagagcttccgctgcgcctcgctgactttggtgttctccaccgaaatgagctgtcaggggccctcacgggactgaccagggttagaaggtttcaacaagacgatgcgcatatcttttgtgccatggaacaaattgaggacgagatcaagggatgtctggacttcctgaggaccgtgtatagtgtcttcggcttcagtttcaaattgaacctctctacaagacctgaaaagttcttaggcgacatcgaggtgtgggaccaagccgagaagcagcttgaaaattcgctgaacgagttcggggaaaaatgggagctgaacagtggggacggcgctttttacggacctaaaatcgacatacagatcaaggacgctataggccgatatcaccaatgcgctacaatccagctagatttccagctgccgataagattcaacctaacatatgtgtctcatgacggagacgataagaaacgacctgtgatagtgcatagagctatcctgggtagcgtcgagcggatgattgcaatcctcaccgagaactacggaggaaagtggcctttttggctgtcaccgagacaggtgatggtggtccccgtcggaccaacgtgcgacgagtacgcccaaaaggtgcgacagcagttccacgacgccaagtttatggcggatattgacctcgaccccggctgcaccctgaacaaaaaaattcggaacgctcagcttgcacagtataactttatcttagtggtgggcgaaaaagagaagatctcagggacggtgaacattcggaccagagacaacaaggtccacggagagaggaccatcagcgagaccatcgagcgcctccagcaattaaaggaatttcggagtaagcaagccgaagaagaattttag

SEQ ID NO: 208584 - DNA, 1809 bp, Artificial Sequence
  Description of Artificial Sequence: Synthetic coding sequence
atgatccccttctggcagaagcggcagaagaagatcgccagccagctaaagagtctgtgcctgatggttaacagattaatgcgaaatctggggaagctccaccatattaaactgcctgtggaactggccatggaacgcgtgtacggcgggtgcctgtgttacggcccacctattgagaacggattttactacgacatgtatctggaagaggggggggtttcatctaacgatttttcaagtctggaggcactgtgtaagaaaatcattaaagagaaacaggccttcgagagactggaggtgaaaaaggagactctgctggccatgttcaagtataacaaatttaaatgcaggatattgaacgagaaggtcaacacgcctacgacaacggtctaccgatgtggtcctttgatcgatctctgtaggggcccacatgtgcgtcacacgggcaaaatcaaggctctgaaaatccataaaaactcctccacttactgggaggggaaggctgacatggagaccttgcaacggatctatgggatttccttccccgacccgaagatgctgaaagagtgggaaaagttccaagaagaggctaaaaacagggaccataggaagataggaagagatcaagagctgtatttcttccacgaattgtcccctggtagttgctttttcttacccaagggagcctacatctataatgcccttattgaatttattcgaagcgaatatagaaaacggggttttcaggaagtggtgacacctaatatatttaatagccgcctatggatgacgtccggacactggcagcattacagcgaaaatatgttctcctttgaggtcgagaaggagctttttgcactcaagccaatgaactgtcctggacactgccttatgttcgatcaccgtcctcgcagctggagagagctgcccttgcgcctcgcagattttggagtcctgcatcggaacgagctgtctggggcattaaccggactgacgcgcgtgcggcgtttccagcaggatgacgctcatatattttgcgctatggagcagatcgaagatgagatcaaggggtgtctggatttcttgcgaaccgtgtattccgtgtttggattttcctttaaattgaacctgtctaccagacccgaaaaatttcttggcgatattgaggtctgggatcaggctgagaagcaattggagaacagcctgaacgagtttggcgaaaagtgggagctcaatagcggtgatggggccttctatggccctaagatcgatattcagatcaaagacgccattggccgctatcatcagtgcgcgactatacagctggacttccagctgcctatcaggttcaacctgacatatgtgtcacatgatggagacgacaaaaaacggcctgtaattgtgcaccgcgcgatattgggctctgtggagagaatgatcgcaatccttacagagaattacggcgggaagtggcctttttggctcagtcctaggcaggtgatggtggtacctgtcggtcctacgtgtgacgagtatgcacaaaaggtacgtcagcagttccacgatgcaaaattcatggctgacatcgacctcgatcctggttgtaccctcaacaaaaagattagaaacgcacaactcgctcaatataactttatcctagtggtgggggaaaaggaaaagatttccggtactgtcaacatccgtactcgggataacaaagttcatggcgagagaaccatatccgagactatcgaaagactgcagcagcttaaagagttccggtcaaagcaggccgaggaggagttctag

SEQ ID NO: 208585 - DNA, 2271 bp, Artificial Sequence
  Description of Artificial Sequence: Synthetic coding sequence
atgttcgaggagaaggccagcagccccagcggcaagatgggcggcgaagaaaagccaattggcgccggcgaagagaaacagaaagagggaggaaagaaaaagaacaaagagggttccggcgatgggggacgtgccgaacttaatccctggcctgagtatatatatacaagactagagatgtacaacattctgaaagcggagcacgacagcattctggcagagaaagctgagaaggacagtaaacccattaaggtgaccctccccgatggcaaacaagtcgacgccgagtcctggaagaccactccatatcagatcgcttgtggaatctcgcacaccgcctcttgcaagaacctgtctagtctcgcatctctgctggcttccgtcgcgattccatccagtggaatgccgtggccccccctgttttttctgcaagggctcgctgataacacggttattgctaaggtcaacaacgtggtctgggacctcgatcgccctttggaagaggactgtaccctggagttactgaagtttgaagatgaagaggcccaggccgtgtattggcacagttctgcccatattatgggcgaagccatggaacgggtgtacgggggctgcctatgttacggcccaccaattgagaatggtttttactacgatatgtacctggaggaaggaggtgtgagcagcaatgacttcagtagtctggaggctctttgcaaaaaaataattaaagaaaagcaagctttcgagcggctagaggttaagaaggagaccctcctcgctatgtttaaatacaacaagttcaagtgtcggatactgaatgaaaaagtgaatactcctaccactaccgtgtacagatgcggcccactcatcgatctttgccggggccctcatgtgcgacatacaggaaagattaaggctctaaaaattcacaaaaacagctctacgtactgggaaggtaaggccgatatggagactctacagaggatatatggcattagcttccccgaccccaagatgctgaaagaatgggaaaaattccaagaggaggcaaagaatcgggaccataggaagatcgggcgggaccaggagctgtactttttccatgaactttcccccgggtcgtgcttttttctgccaaaaggagcttatatttataacgcgctgatcgagttcattaggtccgaatatcgtaagagagggtttcaggaggttgtgaccccaaacattttcaattcccggctatggatgacaagtgggcattggcagcactattccgaaaacatgttctcatttgaagtcgaaaaagaacttttcgctctgaaacctatgaactgtccaggacattgtttaatgttcgatcatcgccctcgaagttggagggagcttccactgaggctcgccgacttcggtgtgctgcatcgcaatgaattgagcggtgcattaacaggcctcacaagggtgagacggttccagcaggacgacgctcatatattctgcgccatggaacagattgaggatgagattaagggatgcctagatttcctacgaaccgtgtatagcgtttttggtttctcgttcaagctgaatttgtccacgaggcccgagaaatttctaggcgatatagaagtttgggaccaggccgaaaagcagctcgagaacagcctgaatgagtttggggagaagtgggagttgaactcaggtgacggagcattttatgggccaaaaattgacatacagataaaggatgccattgggcggtaccatcaatgtgcgaccattcagctcgacttccagttgccaatacgctttaatttgacctacgtctctcacgacggggacgataaaaagagaccagtaatcgtgcatcgggccatcctgggaagcgttgagaggatgatcgccatactgactgagaactacggaggcaagtggccattctggctgtcaccacgccaggtgatggttgttcccgtgggtcctacatgcgatgagtatgcccaaaaagtgcggcagcaatttcacgatgctaagtttatggcagatatcgacttggatcctggttgtacgctcaataagaagatccgtaatgcacaactagctcaatacaactttatcctcgtggtgggcgaaaaggagaagatctctgggaccgtaaatatcagaaccagagacaacaaggtccacggggagcggacaatttccgaaacaatcgaaagattacagcagcttaaggaattccgaagcaagcaagccgaggaagagttttag

SEQ ID NO: 208586 - DNA, 2172 bp, Artificial Sequence
  Description of Artificial Sequence: Synthetic coding sequence
atgttcgaggagaaggccagcagccccagcggcaagatgggcggcgaggaaaagcccattggagctggtgaagagaagcaaaaggaaggtgggaagaagaagaacaaggaaggcagcggtgacggtggcagggccgaattgaatccctggcctgagtacatttacacccggctagaaatgtataacattctgaaggctgaacatgattcaattctggccgagaaggccgaaaaagactccaaacctatcaaagtgactcttcctgatgggaagcaggtggacgctgaaagttggaagaccaccccctatcagatcgcctgcggcatttcccagggcctggctgacaacacagtgattgctaaagtgaataacgttgtgtgggacctcgaccgacctctagaagaggactgtacactagaattgctcaagtttgaagatgaagaagctcaagcagtctactggcatagctccgcacacatcatgggggaggctatggagcgcgtttacggagggtgcctatgttacggcccccctattgagaacggcttctactacgacatgtacttagaggaaggaggagtatcttcgaatgatttctcttctcttgaagccttgtgtaagaagatcatcaaagaaaagcaggcctttgaaaggctcgaagtgaaaaaagagacactcctggccatgttcaagtataacaagttcaaatgcaggatcctgaacgaaaaggtgaataccccgaccaccaccgtctaccgttgcggccctctgatcgatctgtgcagagggccacacgtgcgccacacggggaagatcaaggcactgaagatccacaagaattcgtctacctattgggagggcaaggctgacatggagactctgcaaaggatttatggaataagcttccctgatcctaaaatgctgaaggaatgggaaaaattccaagaagaggccaaaaatcgcgaccacaggaaaataggtcgtgaccaagagctctacttctttcacgagctctcccctggtagttgcttcttcctacctaagggggcgtacatttacaatgcgttgattgagtttatcaggtcagagtataggaaacggggcttccaggaggtcgtcacgcccaatatatttaattcgcgactctggatgacaagtgggcactggcagcactacagtgagaacatgttcagttttgaggttgaaaaagaactttttgcactgaaacccatgaattgtcctggccactgtcttatgtttgatcacagaccccggagttggagggaactgccactaaggctcgccgactttggggtcctccatagaaatgaactatctggggcactcaccgggctaacgcgggtgcggcggttccagcaagacgacgcgcacattttttgcgccatggagcagatcgaggatgagattaaggggtgcctggacttccttaggacagtttactctgtgttcggcttcagcttcaagctgaacctatccacaagaccagagaaattcctgggcgacatcgaagtgtgggaccaggcagagaagcagcttgagaattcactcaatgagtttggtgaaaagtgggagcttaactctggggatggagcattttacgggcctaagatcgatattcagattaaggatgcgattggtcgctaccaccagtgtgccaccatacagctggatttccaattacctatcagatttaatctgacttacgtgagtcacgatggcgacgataaaaagcgcccggtaatcgtgcaccgtgctatcctcggaagcgtcgagcgcatgattgccatactcaccgagaactacgggggcaagtggcccttctggttgtcccctcgacaagtaatggtagtgccagttggtcctacttgtgatgagtatgcccaaaaggtccggcaacaattccatgatgctaagtttatggccgatatcgacttagaccctgggtgcactttaaataagaagatccgcaacgcccagctggcgcagtacaatttcatattagtagtgggtgaaaaagagaaaatttccggaacagttaatatcagaactcgggacaacaaggtacatggcgaacggacaatctccgaaacgatagagcgcctccaacagcttaaggaatttcgttctaagcaggcagaagaggagttttag

SEQ ID NO: 208587 - DNA, 390 bp, Artificial Sequence
  Description of Artificial Sequence: Synthetic coding sequence
atgttcgaggagaaggccagcagccccagcggcaagatgggcggcgaggagaaacctataggggcaggagaggaaaagcagaaggagggcggaaagaaaaaaaataaagaggggagtggcgatggagggagggccgagttgaatccgtggccagagtatatatacacacggcttgaaatgtacaacatcctcaaggctgagcacgatagcatcctcgcggaaaaggccgagaaggactccaaacccatcaaggttaccctgcccgacgggaagcaagtggacgccgaatcttggaaaaccaccccctatcagatcgcatgcggaatatcgcagggcttagccgataacaccgttattgccaaggtgaataacgtcgtgtgggacctgtag

SEQ ID NO: 208588 - DNA, 1860 bp, Artificial Sequence
  Description of Artificial Sequence: Synthetic coding sequence
atggaggtggagctgagccagggcctggccgacaacaccgtgatcgcaaaagtcaacaatgtcgtgtgggatctggatcggccgctggaagaggactgtaccctcgagctgcttaagttcgaggacgaggaagctcaggcagtttactggcactctagtgcgcacatcatgggagaggccatggagcgagtctacggagggtgcctctgttacggccctcccattgagaatgggttttactacgatatgtatctggaggagggcggtgtgagcagcaacgacttctcctctcttgaggcattgtgcaaaaagataattaaggagaaacaagcattcgaaagactggaggtgaagaaagagactctgctggctatgttcaaatataacaagttcaagtgtagaattctgaacgagaaagtgaacactccaaccaccaccgtgtaccggtgtggtccattgatagatctgtgcaggggcccacatgtgcgccatactgggaagatcaaagcactcaaaatccataaaaatagtagtacgtattgggagggaaaagccgatatggaaacgttgcagagaatctacggaatctcctttcccgaccctaagatgctgaaagagtgggaaaagttccaggaggaggccaagaacagagaccatagaaaaatcggacgggaccaagaactgtatttctttcacgagctgtccccaggatcttgtttttttctgcccaagggcgcatatatatacaacgcacttatcgagttcattagaagcgaatacaggaagaggggcttccaggaggtagtgaccccaaatatttttaattctaggttatggatgacatctggtcattggcaacactattcagagaatatgttctcctttgaggtcgaaaaggaactatttgcactgaaacctatgaattgccccggccattgtctgatgttcgatcacagaccccgcagttggcgcgagcttcccttaagattggccgatttcggggttctgcaccgaaacgaattatccggcgctctaacaggccttaccagggtacgccgattccagcaggacgatgctcacattttttgcgcgatggaacaaatagaagacgaaattaagggctgtcttgactttctgagaaccgtgtactctgtctttggattttcgtttaagcttaatctcagcaccaggcctgagaaatttctgggggatatcgaagtgtgggaccaagctgaaaagcaactggagaattcgctgaacgaattcggggagaaatgggagctgaattccggagacggagcgttctatgggcctaaaatcgacatccaaatcaaggatgcaataggccggtaccatcagtgcgccaccattcagttggatttccagctccctataaggttcaacctgacctatgttagccacgatggcgatgacaagaagaggcctgtaatagttcaccgggccatactggggagtgttgagcggatgatcgctatcttaacagaaaattatggcggaaagtggcccttttggctgtccccccgacaggtgatggtggtgccagtggggccaacctgtgatgagtatgcccagaaggtgcgccagcagttccacgatgccaaattcatggctgatattgacctcgatccaggttgtaccttgaataagaagatacggaacgcccagcttgcgcagtataacttcatactggtagtgggagaaaaagaaaagatctccggaacagtgaatattcggaccagggacaataaagtgcatggcgagagaaccattagcgaaacaattgaacggttacagcagttaaaggagttcagaagcaagcaagctgaggaagagttctag

SEQ ID NO: 208589 - DNA, 1332 bp, Artificial Sequence
  Description of Artificial Sequence: Synthetic coding sequence
atggagcacaaccccctgcccaccagccccgccgaccagttcaacactgggcggtattgctctggaccctcgacagaatatgggttttatcacgatttctttcttggaaaagagcgctgtgggactctcgtggacctatgtcagggcccccatttgaggcataccggtcaaattggcggcctgaaactcttgtccgctgagtacgcccataggggattctccgaggttaagacaccaactctgttcagcactaaactttgggagcagagtgggcactgggaacactatcaagaggacatgttcgccgtccagccgccgggatctgataggcctccctcaagtcagtccgacgatagcactagacacatcactgatacattggcactcaagccaatgaattgcccggcccactgcctgatgtttgcgcaccggccaagaagctggcgagagctgccactgaggttagccgactttggcgctctgcacagggcggaagccagcgggggcttaggcggcttaaccagacttagatgtttccaacaggacgatgcccatatcttctgcacgaccgaccagcttgaagccgaaatccagagctgcctggacttcctgcggagcgtgtatgccgtccttggcttctctttccggctggcactttccacacgacctagcggctttttaggcgacccatgcctttgggaccaggccgaacaggtactgaagcaagcactcaaagaattcggcgaaccctgggacttaaacagcggagatggggcattttatggacccaaaattgatgtgcaccttcatgacgccctggggagaccgcatcagtgcgggacaatccagctcgatttccaattgcccctccgattcgacctccaatataaaggacaggctggggcactggagcgccctgttctcatccatcgggctgtgctgggtagcgtagaaagacttttgggagttctggcagagtcctgtgggggcaaatggcctctgtggctgagtccattccaagtcgtggtcattcccgtcgggtccgaacaagaggaatacgccaaagaggctcagcaaagccttcgggccgccggactagtgagcgatctggacgctgactccgggctcaccctctccagacgcatccgccgagcccagttagctcactataacttccagttcgtcgtcggtcaaaaggagcaaagtaaacgtacagtgaatatcaggactcgcgacaataggagactgggagagtgggacctgcctgaagctgtacagaggctggttgagctccagaatacacgggtccccaacgccgaggaaatcttctag

SEQ ID NO: 208590 - DNA, 1332 bp, Artificial Sequence
  Description of Artificial Sequence: Synthetic coding sequence
atggagcacaaccccctgcccaccagccccgccgaccagttcaacactggtaggtactgcagaggcccaagtacagagtacggcttctatcacgacttctttctgggcaaagaaaggtgcggaacgctcgtagacctgtgtcaggggccccatctgcgccacacggggcaaatcggagggctaaaactgctttcagcggaatacgcccacaggggtttctctgaggttaagacccctactctcttctcaaccaaactgtgggagcaatctgggcattgggagcactatcaggaggacatgttcgccgtccagccaccaggcagcgatagaccaccctccagccagtctgatgattcgactcgacacatcactgacacactggccctgaagccgatgaactgtccggctcattgtctgatgttcgctcaccgtccacgcagctggcgggaacttccactccgccttgctgatttcggagcactccatcgcgcggaggcgtcgggtggtctgggtggactcaccagactacgctgcttccagcaggatgatgctcacattttctgcactaccgaccaattagaagctgagatccagagctgcctggatttcttacgctctgtgtatgcagtgctgggctttagttttcgcctcgccttatccacccgcccatcaggcttcctgggggatccctgtctgtgggatcaggcagaacaggtcttgaagcaggccctgaaagagttcggtgaaccctgggacttaaactccggcgacggcgctttctacggcccaaagattgatgtacacctgcacgacgccctagggcgacctcaccagtgcgggacgatacagcttgattttcagttgcctttgcggttcgacctgcagtataagggccaggccggggccttggagagaccggttctcatacatcgagccgttttgggaagcgtagagagactgctgggggttttggcagagagttgcggaggaaaatggccgctgtggctttccccatttcaggttgttgtgatacccgtgggatcagaacaggaagagtacgccaaagaggcacagcagtccctgcgcgccgcaggactcgtgagcgacctcgacgccgatagcggcctaacgttgagtcgaagaattagaagagcacagctggcacattataatttccagttcgttgtgggacagaaagagcagtcaaaaaggactgtgaacataaggacaagggacaaccggcggctgggagaatgggacctcccagaggccgttcagcggctcgttgagctccaaaacacacgagtccccaacgctgaagagattttttag

SEQ ID NO: 208591 - DNA, 537 bp, Artificial Sequence
  Description of Artificial Sequence: Synthetic coding sequence
atggccctgtaccagcggtggcggtgcctgcggctgcagggcctgcaggcctgtcgcctgcacaccgctgttgtgagcaccccaccccggtggctcgcggagaggcttggcttattcgaggagctgtgggctgcccaggtgaaacggctcgctagcatggcacagaaggagccaaggacaatcaaaattagcctgccggggggacaaaaaatcgacgcagtagcttggaacacgacaccctaccagcttgcgaggcagatatcatcaaccctagctgacacagccgttgccgcccaggtgaatggtgaaccatatgacctggaacggcccctggagacagattctgacctgagattcttgacctttgacagccctgaaggaaaggccgtctcattttttcttatcaggaataccgtcacgactaaacctcgtgatattgaggcggggaatagtaacatcctgtttttctgccggtcctttagtatttgttcgtgggaaggcgacttgcctcagaccgttctcacaatcagcggttag

SEQ ID NO: 208592 - DNA, 1767 bp, Artificial Sequence
  Description of Artificial Sequence: Synthetic coding sequence
atggccctgtaccagcggtggcggtgcctgcggctgcagggcctgcaggcctgtagactgcatactgcagtcgtttccactccgccccgctggttggccgaacggttagggctttttgaggagctgtgggcagcacaggtgaaacgcctcgcatccatggcacagaaagaaccgagaacgataaaaattagtctgcctggtggacaaaagattgacgccgtcgcttggaataccacaccatatcagctggccagacagatctccagcacattagcagacacagcggttgccgcccaagtgaatggtgaaccctacgacctggaaagacctctggaaactgattccgacctgcggttcctaacctttgacagtcctgagggaaaggcagtgttttggcacagcagcacacatgtgttgggagcggcagccgaacagtttctgggcgccgtactgtgtcgcggcccatcgaccgaatacgggttctaccatgacttttttctcgggaaagaacgtaccattagaggatctgaacttcctgtcttggagcgaatttgtcaggagttgactgcggctgctcgtccattccggcgcctcgaggccagtagggatcaactgcggcagctgttcaaggccgagtacgctcaccgaggctttagcgaggtcaagactccaactctgttcagcactaagttgtgggagcagagcggccactgggaacactaccaggaagacatgttcgccgtgcagccccctggtagcgacagacctccctcctctcagtccgatgacagcaccaggcatattacagatacactagcattgaaacctatgaactgtccagcccactgcttgatgttcgcccaccggccccgtagctggcgcgagcttccactaagactcgcagactttggtgccctgcatagggcagaagcctccggaggcctaggaggcctgacccggctacgttgttttcaacaggatgacgcccatatcttctgtactacggaccagcttgaggcggagatccagtcatgtctcgacttcctaaggagtgtgtatgctgtgctgggtttctcattcaggttagcccttagcacacgaccctcaggattccttggcgatccgtgcctgtgggaccaggcagaacaggtgcttaagcaggctctcaaggaattcggagagccctgggatctcaactcaggggacggcgccttttacggcccaaagattgacgtgcacctacacgacgctttaggccgccctcaccagtgtggcaccatccagcttgatttccaactacccttgaggtttgacctgcagtacaaggggcaggccggcgcccttgaaagaccggtgctgattcaccgggctgttcttgggtccgtggaaagactgctgggtgtcctggctgagagctgtggtgggaaatggccactctggctgtctccctttcaggtcgtggtaattcccgtcgggtcggaacaggaagaatatgccaaagaagctcaacagagtttgagagcagctggcttggtgtctgacctcgatgccgacagcggcctgacgctgtcccgtagaatcaggagggcccagctggcccactataactttcaattcgtggtgggccaaaaagagcaatcaaaacgaacggtcaacattagaactagggataatagacggctcggcgagtgggacctccctgaggccgtacagaggctggtggagttgcagaatacacgggtgcccaacgcagaagaaattttctag

SEQ ID NO: 208593 - DNA, 2157 bp, Artificial Sequence
  Description of Artificial Sequence: Synthetic coding sequence
atggccctgtaccagcggtggcggtgcctgcggctgcagggcctgcaggcgtgcaggctccataccgctgtggtgtccacgcctcctagatggctcgcagaaagactgggtcttttcgaggagctttgggccgcacaggtaaagcgcttagctagtatggctcagaaggagcccagaacgattaagatatcgttgccgggcgggcagaaaattgacgctgtggcttggaatactactccgtatcagcttgctaggcagatctcatcaacactcgccgatacagcagttgcggcccaagtgaatggcgagccctacgatctagaaagacccttagagaccgactcagacctccggtttttgacgttcgactcaccggaaggtaaggcagttttttggcattcgtctacccacgttttgggagcggcagcagagcaattcttgggtgcggtcctctgccgcggcccgtccactgaatacggattttaccatgacttttttctgggcaaagaacggacgatcagagggtctgagctgcctgtgctggagagaatctgtcaggaactcacagccgccgcccggccttttcgccgcctggaagctagccgcgaccaactgagacagctgtttaaagataacccatttaagctgcacctcatcgaagaaaaggtcaccggccctacagcaaccgtgtacggctgcggaactttggttgacctgtgtcaaggacctcacctgagacacactggacaaatcggtggtttaaagctgctgagcaattcatcatcgctgtggaggagctccggagcgccggagactcttcaacgggtctcaggtattagctttcctacgaccgaactcctgcgggtgtgggaagcatggagagaagaggctgaactgcgggaccacaggcggatcggcaaggaacaggagctgttcttctttcatgagctgtcccctggatcgtgttttttcctgcccaggggaacccgcgtgtataacgcgctagtcgcattcatccgtgcggaatacgcccacagaggattctcagaagtcaaaactcctacccttttctcaaccaagctctgggagcagtcaggccattgggagcactaccaggaggatatgtttgcagtgcaaccgcctggcagcgatcgccccccctctagtcagagcgacgatagtacgagacatattaccgacacactggcgctcaagccaatgaactgccctgctcattgtctgatgttcgcccataggcccaggtcatggcgggagctccctcttcggctggcagactttggggcacttcaccgggccgaagctagtggggggctgggcggcctgactaggctccgatgtttccagcaagacgacgcccacatattctgtacaaccgatcagcttgaggccgaaattcagtcgtgtctggacttccttcgcagtgtttacgccgttctcgggttttctttccgtctggcactgtcaacacggccctcagggtttctgggcgacccttgtctctgggatcaggccgaacaggtgctgaaacaggctttgaaagagtttggcgaaccatgggatttgaactctggggacggagccttttatgggcctaagatcgatgtgcacttacacgacgccctgggcagaccccaccagtgcggcactattcaactcgactttcaactgccgctcagattcgatctacagtacaaaggccaggcaggagcccttgagaggcctgtgctgattcatagggctgtcctgggatctgtggaaagactgctcggagtcctggccgaaagctgtgggggaaagtggcccctatggctgtccccttttcaagtggtggttatcccagtgggctcagaacaggaagaatacgctaaagaggcccaacaatccctacgggctgctggactggtgagcgatctggacgcagattccggcctgacactgtcccgccggatcaggagggcccagctagcccactataactttcagttcgtggtcggccaaaaagagcagagtaagcgtaccgttaacatacgaacaagggataatagaaggctgggagagtgggatttaccagaggcagtgcagagactggtcgagctgcaaaacacaagagtccctaatgcagaagagattttctag

SEQ ID NO: 208594 - DNA, 510 bp, Artificial Sequence
  Description of Artificial Sequence: Synthetic coding sequence
atggccctgtaccagcggtggcggtgcctgcggctgcagggcctgcaggcctgtaggctgcacaccgccgttgtttctacgcctccccgctggctggccgaacgactggggctcttcgaagagctgtgggcagctcaagtcaagagacttgccagcatggcacagaaagagcctcggaccatcaagatcagtttgccaggcgggcagaagattgatgccgttgcgtggaacacaaccccttatcagctggcacgccagattagctctactttggccgatactgccgtcgcagcccaggttaatggcgagccatatgacctcgaacgtccgttggagaccgactccgatctcagattcttaacctttgactctcccgaggggaaggctgacaatcccggactgcgggctgcctgtttcggcgcagacctccccggtacatatagctgttgttcgaccttgccagaagcgcgggggtttacgggctctgcgagtccagtggtgcaggggtag

SEQ ID NO: 208595 - DNA, 4974 bp, Artificial Sequence
  Description of Artificial Sequence: Synthetic coding sequence
atgggcctgcaggcccggcggtgggccagcggcagccggggcgccgccgggcctcgcagaggagtcttgcaactccttcccctgccattgcccctaccgctcctgctgctgctcttgttaagacctggggccgggcgggctgctgctcagggagaagccgaagccccgaccctctacctttggaaaaccggaccatggggcagatgtatgggcgacgaatgtgggccaggcggtattcagacacgcgccgtgtggtgtgcacacgtagagggttggacgaccctgcataccaactgtaagcaagctgagcgtcccaataatcaacagaattgctttaaagtctgcgattggcataaggagctttacgattggcgcctgggtccatggaatcagtgtcaacctgtaataagcaagagccttgagaaaccacttgagtgtattaaaggggaggagggcatccaagtgcgggagattgcttgcatccagaaggacaaggatatccccgccgaggacatcatttgtgagtatttcgaaccgaagccactcctcgaacaggcatgcctgattccttgtcaacaggactgtatcgtctcagagttctctgcatggagcgaatgttccaagacgtgcgggtcgggcttacagcacaggacccggcatgtggtcgcccccccgcagtttggtgggtctggctgtcctaatctcaccgaatttcaggtctgtcagagcagcccttgtgaggccgaagagctccgttactctctgcacgttggcccatggtcgacgtgctccatgccccatagccgccaggtgcgacaagcccgcagacggggcaaaaataaagagagggaaaaggatcgcagtaaaggcgttaaagatcctgaagcgagagaattaataaagaagaagcgtaatcggaataggcagaaccggcaagaaaataagtactgggatatacaaatcggctaccagactcgggaagtaatgtgtatcaataaaaccggtaaggctgcggatctatcgttttgtcagcaggagaaactgcccatgaccttccagagctgcgtaataacaaaagaatgtcaggtttccgaatggtctgaatggtctccctgctctaaaacctgccatgacatggtgagcccggccggcacacgtgtgcgaacacggaccattagacaatttcccataggatcggaaaaggagtgccccgaattcgaggagaaggagccgtgtttatcccaaggcgatggcgtggtgccttgtgccacatacggttggcgtacaacggagtggactgaatgtagggtggaccccttgttgagccagcaggataagagaagaggaaatcaaactgccctgtgcggagggggaattcagaccagagaggtctactgcgtgcaggccaacgagaatttacttagccaactctctacccataagaataaggaggcaagcaagcccatggaccttaagctgtgcactggaccaattccgaatactacccagctatgtcacatcccgtgcccaacagaatgcgaggtgtcaccatggagtgcgtgggggccctgtacatatgagaactgcaatgaccaacagggcaagaaaggattcaaactgcgcaaacggagaatcactaacgagccgacgggaggctctggggtcactgggaactgtcctcacctgcttgaggcgatcccttgtgaggaacccgcatgttatgattggaaggccgtgcgcctgggtaattgtgagcctgacaatggtaaggaatgcgggcctggtacccaagtgcaggaggttgtgtgcattaactcagatggggaggaggtggacaggcaactctgtcgggatgccatcttcccgatccctgtcgcctgcgatgccccctgccccaaggattgcgttctgtcaacctggtctacatggtccagctgttctcacacctgttcagggaagaccaccgagggcaaacagatcagagcgcgctcgattcttgcgtacgctggggaagagggagggatccgctgcccaaactcgtccgccctgcaggaagtgaggtcctgcaacgagcacccatgcaccgtgtaccactggcaaacagggccctggggccagtgtatagaagataccagcgtttcttccttcaacaccacaaccacatggaatggtgaggcttcttgttcggtgggcatgcaaacaaggaaagtcatctgcgtgcgcgtcaatgtgggccaggtagggcccaaaaagtgtcccgagtctctcaggcctgagacagttaggccttgcttgttgccctgtaaaaaggattgcatcgtcaccccttactcggactggaccagttgcccatcctcctgcaaagaaggcgactcatctataagaaaacagagccgccacagggttataattcagctacctgctaacggtggacgtgattgtaccgacccattatatgaggagaaggcttgtgaagccccccaggcatgccagagttacaggtggaaaactcacaagtggcggcgatgccagctggtgccttggagtgtgcaacaggacagcccgggcgctcaggagggctgcggtcccggtagacaggcgagagctattacatgcaggaagcaagacggtgggcaggccgggatccatgaatgtttgcaatacgctgggccagtgccagcgctaacccaggcctgccaaattccctgtcaggatgactgccaactgacttcctggtctaaattctcctcctgtaacggtgactgcggtgccgtaaggacacgaaagaggacactggttggtaaatctaagaagaaggagaagtgcaaaaattcacacctttatccactcattgagacacagtactgtccctgcgataagtacaacgctcagcctgtaggcaattggagtgattgtatactgccagaggggaaggtagaagtgttactaggaatgaaggtgcagggagacatcaaggagtgtgggcaaggctatcgttaccaagccatggcttgctatgaccagaacgggaggcttgtggaaaccagtcgttgtaactctcatgggtacatagaggaggcatgcataatcccttgcccatctgattgtaagctatcagagtggtcaaattggagtaggtgtagtaagagctgcgggtccggtgtcaaagtgcgatccaagtggctcagagagaagccgtacaacggcggaagaccctgccccaagctggaccacgtgaaccaatttcaggtgtacgaggtagttccgtgccactctgactgtaaccagtatctgtgggttaccgagccttggtccatttgcaaggtgacctttgtgaatatgcgtgaaaattgtggcgagggcgtgcagacaaggaaggtgagatgcatgcaaaatacggctgatggcccatcagaacatgtcgaggactatctctgcgatcctgaggaaatgccactgggatcccgagtgtgcaaactgccttgtccagaagattgtgtaatctccgagtgggggccatggacacaatgcgtgctgccctgcaaccaaagctcttttcggcagcgttctgccgatcccataagacagcccgctgacgagggccgcagttgtcccaatgccgtcgaaaaggagccttgtaaccttaacaaaaactgttatcactatgattacaatgtgactgattggtctacttgtcaactgtcagagaaggcagtgtgcggaaatggaataaagactagaatgctggactgtgtccgatccgacgggaagtctgtcgacctcaagtattgtgaagcacttggcctcgagaagaactggcagatgaacaccagttgtatggtcgaatgccccgtcaactgtcagctgtcagactggagcccttggtccgagtgctcccagacctgtggtctgaccggcaagatgatacgtaggcgcacggtaacacaaccattccagggagacggtcgaccctgtccttcactgatggatcagagcaagccatgccctgtcaaaccatgttatcgctggcagtacggccagtggagcccatgtcaggtgcaggaagcccagtgcggcgaaggaactaggactcgtaatatcagctgcgtggtctccgacggtagtgccgacgattttagtaaggtggtggatgaggagttctgcgccgacatcgagctgatcatcgacggaaataagaatatggtgcttgaggaaagttgtagtcaaccctgcccaggcgattgctacttgaaagattggtcctcttggtcactgtgtcaacttacttgtgtaaatggagaggacctcggttttggaggcattcaggtaaggtccaggcccgttattatacaggagttggaaaaccagcatctctgtcctgagcagatgctagagactaaatcttgctatgatggtcagtgctatgaatacaagtggatggcttctgcttggaaaggctcgagcaggaccgtttggtgtcagcggagcgacggcattaacgtcaccggggggtgtctcgtgatgagccagcctgacgcggaccggtcgtgcaaccctccgtgcagtcagccccactcatactgctccgagaccaagacatgccactgtgaggaaggatatactgaggtgatgagttctaacagcactttggagcagtgtaccttgattcccgttgtggtgctgcctactatggaggataaaaggggcgatgtcaagaccagtcgggctgtccatcccactcagccatcttctaatccagccggccgaggcagaacttggtttctgcagcccttcggccccgacggccgactgaagacatgggtgtacggtgttgccgccggggcgtttgtgcttcttatttttattgtatccatgatttacctggcatgtaaaaagcccaagaagccccaacggcgtcaaaacaaccgattgaagccgctgaccctggcctatgacggggacgccgacatgtag

SEQ ID NO: 208596 - DNA, 4974 bp, Artificial Sequence
  Description of Artificial Sequence: Synthetic coding sequence
atgggcctgcaggcccggcggtgggccagcggcagccggggcgccgccggcccgcggcgcggcgtcctgcaattgcttccactaccactacctctgccgctcctgctcttattgctgctgagacctggtgctggcagagccgcagcgcaaggcgaagcagaggcaccaacactttacctttggaagacgggaccctggggtaggtgcatgggagacgagtgtggccctggcggaatccagacacgagcagtatggtgtgctcatgtggagggatggacaacattgcatacaaattgcaagcaagccgagaggcccaataatcagcaaaattgcttcaaggtgtgcgactggcacaaagagttatatgactggcggttgggcccttggaaccaatgtcaacccgtgatctcaaagtctttagagaaaccgttagagtgcatcaagggcgaggaaggcatccaggttcgtgaaattgcatgtatccaaaaagataaagacatcccagccgaggatatcatctgtgaatactttgagccaaagccactcctcgagcaagcgtgcttaataccatgccaacaggactgcatcgtttctgaattttccgcgtggtctgagtgctctaagacatgtggctcgggacttcagcatcgcaccaggcacgttgtcgcccctcctcagttcggcggctcaggctgccccaacctcactgaattccaagtgtgtcagagtagcccatgtgaggctgaggagcttagatactccctccatgtcgggccatggtccacctgcagcatgcctcactctcggcaggtccgacaagcaagaaggagggggaagaataaagagagggagaaagatcgatccaagggggtaaaagatcctgaggcccgagagcttattaaaaaaaaacggaaccggaacagacagaacagacaagaaaacaagtactgggacatccagatcgggtaccagacgcgagaggtgatgtgcattaataaaaccggcaaggctgcagatctatctttctgtcaacaggagaagcttcctatgactttccaatcctgcgtcataacaaaggagtgccaggtgtcggagtggagcgagtggtccccctgttctaaaacatgtcacgatatggtgtctcctgctgggaccagggtgcggactaggaccatccgccaattccctattggatccgagaaagaatgtcctgagttcgaagaaaaggagccgtgcctgtctcagggggacggcgtcgtcccctgtgccacctacggctggaggacaacagagtggaccgagtgccgggttgatcctttgctgagccagcaagataagcgtcgtggtaatcagaccgctttgtgcggtggtggtattcaaactcgggaagtgtactgcgtgcaggctaatgagaatttactgtctcaactctctactcacaaaaacaaggaggcttccaagccaatggacctaaagttgtgcactggccctattccaaacacgacccagctatgccacatcccatgtcccacagagtgcgaggtctctccgtggtcagcttggggcccgtgcacatatgaaaactgcaacgatcagcaagggaagaaagggtttaagctccgaaaacgccggatcacaaacgaacctacaggaggatccggcgtgacaggtaactgtcctcatctgctggaagcaatcccttgtgaagagccggcatgctacgactggaaagcggtgaggctaggtaattgcgagcctgataatggcaaagaatgtggccctggaacacaggtacaggaggtagtgtgtatcaattccgatggcgaggaagtggatcgtcagctgtgccgggacgcaattttccctatccctgtggcatgtgacgccccatgtcccaaggactgtgtactctcgacttggtcaacctggagttcctgtagtcacacatgctcaggcaaaactaccgaaggaaagcagatccgagccagaagtatcctcgcgtatgcgggggaggagggaggtattcggtgtcctaatagctcggcactacaggaggtaaggtcatgtaacgaacacccatgtaccgtatatcactggcaaactggtccttggggccagtgtatcgaagataccagtgtctccagtttcaatacgaccactacttggaatggcgaggcaagctgcagtgtgggaatgcagacccgaaaggtcatctgtgtaagagtaaacgttggccaagtcggtccgaaaaagtgccccgaatcattacgtccagaaacagtccggccgtgtttgctgccttgcaaaaaagactgcattgtaacaccatattccgactggacgagctgtcccagcagctgtaaggagggggatagttccatccgaaaacaaagtcggcaccgcgtgattattcagctgccagccaacggcggtagagactgcacggatccgttgtatgaggagaaggcttgtgaggccccgcaggcttgccaaagttatcgctggaagacccacaagtggagaaggtgccagttagtaccttggagcgtgcagcaggacagtcccggagcacaagaaggctgcggccccggtagacaggctagagcaattacttgtcgcaaacaagatggaggccaggccggtattcatgagtgcctgcagtatgcaggcccggtgccagccttaactcaggcatgccaaattccttgtcaagacgactgtcaattgaccagttggagcaaattttcatcctgcaacggcgactgtggtgccgtgcgcacccggaaaagaaccttagtgggaaagagtaaaaagaaggaaaaatgtaagaactcacatctctatccactgatcgaaacacagtactgtccctgcgataagtacaacgcccagcccgtcggcaactggtccgactgtatcctaccggagggcaaggtagaggtgctactcggaatgaaggtccagggtgatataaaagagtgtggtcaagggtatagataccaggccatggcgtgctacgatcaaaacggccggctggtcgagacatccagatgcaatagtcacgggtacatagaagaagcttgcattattccgtgcccctcagactgtaaattaagtgagtggtctaattggagtagatgctccaagagttgcggatctggcgtcaaggtacggagtaaatggctgcgggaaaagccatacaacggcggccgaccgtgccctaagctggaccacgtgaaccaggcccaggtgtatgaggtcgttccatgtcattccgactgcaaccagtatctgtgggtgactgagccctggagcatatgcaaagttacgttcgtgaacatgcgggagaactgtggggagggtgtgcaaacaagaaaggttcgttgcatgcaaaatactgccgacggcccttcggagcacgttgaggattatctgtgtgatccagaggaaatgccccttggaagcagggtctgcaaactgccctgtcctgaagactgtgtgatcagcgagtgggggccttggactcagtgtgtgctaccctgtaatcagtcctcctttcgccagcggagcgctgaccccatcagacagccggccgacgaaggaaggagctgcccaaatgccgtggagaaggagccctgcaatctgaacaaaaattgctaccactatgactataatgtcaccgactggtctacctgtcagttgtctgagaaggccgtgtgcggtaacggcattaagacaaggatgctggattgtgtgagatcggacggaaaaagtgttgacctcaaatattgcgaggccctagggctggagaaaaattggcaaatgaatacttcctgtatggtcgaatgtccagtcaattgtcaactgtcagactggtctccctggtctgaatgctcacaaacttgcggactcacaggaaaaatgatccgacggcgtaccgtgactcaaccctttcagggtgatgggcggccctgccccagcttgatggatcagagcaagccttgtcccgtgaagccatgttaccggtggcagtacgggcagtggtctccttgtcaggtgcaggaagcccagtgcggagaggggacgagaacaaggaacatctcctgcgtcgtcagtgatggttccgccgacgatttcagtaaagtggttgatgaggaattttgcgccgacatagagctcatcattgacggaaacaagaatatggtgctggaggaaagctgttcccagccgtgcccaggtgactgctatctgaaggactggagctcctggtccttgtgccaactgacgtgcgtcaatggagaggacttagggttcggcgggattcaggtccgttcacggcccgtcatcattcaggaactcgagaaccagcatctgtgtccagaacaaatgctggaaacgaaaagttgctacgatgggcagtgttacgaatataaatggatggcgagcgcctggaaagggtcatcaaggacagtctggtgccagcgaagcgacggtataaacgtgaccggtggctgcctagtgatgagtcagcctgacgctgatagatcctgcaacccgccatgtagccaacctcattcctactgctctgaaactaagacttgtcattgtgaagaagggtacactgaggttatgtccagtaactctacattggagcaatgcactttgatcccagtggtggttctcccgactatggaagacaaacgcggtgacgtaaaaacgtccagggctgtgcatcctacacagccctccagcaaccctgcaggaaggggtcggacatggtttctgcaaccatttggaccggacggaaggctaaaaacttgggtgtacggagtcgcggccggcgcctttgttctgctgatttttatcgtgtctatgatttacctggcttgcaagaagccgaaaaagcctcagaggcgtcagaataacaggctgaagcctctgacactggcctatgatggcgacgccgatatgtag

SEQ ID NO: 208597 - DNA, 2010 bp, Artificial Sequence
  Description of Artificial Sequence: Synthetic coding sequence
atgagcgccctgctgagcctgtgcttcgtgctgcccctggccgcccctggtcacgggacacagggttgggaaccatgcactgacctgcgccccttggatatcctagctgaagtggttcctagcgacggcgcaacgagtggaatccgcatcgtgcaggtgcacggagctagagggctgcagctctctgtggctgcaccccgcaccatgtctttccccgcctcaaggattttcagccagtgcgatttattccctgaggagttcagcattgtcgtgactctgagagtgccaaaccttcctccgaagcggaatgaatacctcctgacggtggtggcggaagaatcggacctgttacttttaggtctccggctgagccccgcgcagttgcattttctatttttgagggaagacaccgccggcgcgtggcagactagagtgagctttaggtcccccgcattggtggatggtagatggcataccctagttctggcggtgtcagccggagtgttctcactcaccaccgactgcggtctccccgtcgatattatggccgacgtacccttccccgccacattaagtgtaaaaggagcaagattctttgtcggcagcagaaggcgcgctaaaggcctgttcatgggtctcgtcagacagctggtgctgctgccgggtagtgacgctaccccgagactgtgccccagcaggaatgcccccctggccgtgctatctattccacgagtacttcaagccttaactggcaagcccgaggataacgaagtgctgaaatatccatatgagacaaatattcgcgtcactttaggaccgcagcccccgtgtacggaggttgaggatgcccagttctggtttgacgcttctcggaaaggactgtatctttgtgtgggcaatgaatgggtgagtgtgcttgctgccaaggagcgcctggactacgtcgaagagcaccaaaatctgtcaaccaattccgagacactagggatcgaggtgtttcgtatcccccaggtcggcttgtttgtagcaaccgccaataggaaggctactagcgcagtctacaagtggacagaggagaaattcgtgtcatatcagaatatccctacacaccaggcccaggcctggcgacattttactattgggaaaaaaatttttcttgccgtggccaactttgagcccgacgagaaaggccaggagttttccgtcatatacaagtggtcacatcgcaagttgaaattcaccccctatcaaagtatcgctactcactccgctcgagactgggaagcctttgaagttgacggcgaacacttccttgccgtggccaatcatcgcgaaggcgataaccacaatatcgactcagtcatctacaagtggaaccccgcgacgcggcttttcgaggccaatcagacaattgctacctctggtgcatacgactgggagtttttcagtgtggggccttactcatttttggtggtggccaatactttcaacggcacctccactaaagtgcactctcacctatacattcgcctgttgggttcattccagctttttcagagtttcccgactttcggtgctgctgattgggaggtgttccagataggcgagcgtatctttttggctgttgccaacagccactcatacgacgtggaaatgcaagtgcagaacgactcatacgtcatcaacagcgtaatttacgaactcaacgttactgcacaagcattcgtgaagtttcaggatatactaacctgctccgctctggattgggaatttttttccgtcggcgaagactacttcctggttgtggctaacagctttgatggacggacctttagtgttaacagcatcatatatcgatggcagggctacgagggtttcgtggccgtccattctcttcctacagtgggttgcagagactgggaggctttcagtacaaccgcaggtgcatatctcatatatagctccgcgaaagagcctctttctagggtcctgcgtctcaggacgaggtag

SEQ ID NO: 208598 - DNA, 1800 bp, Artificial Sequence
  Description of Artificial Sequence: Synthetic coding sequence
atgagcgccctgctgagcctgtgcttcgtgctgcccctggccgcccccggacatggaacccaggggtgggagccctgcaccgatttgcgccccttggatattctagccgaggtcgtccccagcgacggagccacttcaggtatccgcattgtgcaagtgcacggagcgcgtggcttgcaactaagcgtagctgcaccaagaacgatgtccttccccgcctctcggattttctcgcagtgtgatctttttccagaagagttcagcatcgtcgttacactgagggttccaaatctcccccctaaacgcaacgaatatctgctcacagtcgtggccgaggagtcggatctgctgctgcttgggctgcgactatccccggcacaattacacttcttgtttcttagggaggatactgccggggcgtggcaaaccagagtctccttccgctcccctgcattggtggacgggcgttggcacacactagtccttgctgtgagcgctggtgtctttagtctgacaaccgactgcggcctgcctgttgacataatggccgacgtgcccttcccagctaccctttccgtcaaaggggcacgcttcttcgtgggcagcaggagacgagctaaaggcctttttatgggcctggtgagacaactcgttctcctgcctggtagcgatgctactccgcgactctgccctagccgtaacgccccactggctgtcctcagtattccccgggtcctccaggccctgacgggtaagcccgaggacaacgaagttctaaagtatccatacgaaactaacataagggtgaccctcggcccacagcccccatgcactgaagtcgaggatgcccagttttggttcgatgcaagccgtaaggggctctacctctgtgttgggaacgagtgggtcagcgtgctagccgaagccaaggaacgcctcgattatgtggaggagcatcagaacctgagtactaatagcgagactctggggattgaggtgttcaggattccacaggtagggttgttcgtagctaccgcaaacagaaaggcaaccagtgcagtctacaagtggaccgaagagaagttcgtaagttaccagaatattcccactcaccaggcccaggcatggcggcacttcacgatcgggaagaagatcttcttagctgtggcaaatttcgaaccagatgagaaaggtcaggagttctcggtgatttataaatggtcacatcggaaactcaagtttaccccatatcaaagtattgctacccactccgcgagagactgggaggctttcgaagtggacggggaacacttcctggctgtggcaaaccaccgagaaggagacaatcacaacatcgattccgtgatctataagtggaatccagctacgagactgttcgaggcgaaccagaccattgctactagtggagcttacgattgggagttcttttctgtggggccttacagttttctggtggtcgccaatacgttcaacggcactagcacgaaagtgcactctcatctctatatccgccttctaggcagcttccagctgtttcagagcttccccacgtttggagctgccgattgggaggtcttccaaataggcgagagaatttttttggcagtggctaactcacattcttacgacgtggaaatgcaggtccagaatgacagttacgtgatcaacagtgtgatctacgagttaaatgtcacagcccaggcttttgtaaagtttcaggacatcttgacatgtagtggggggaggcgcgggttacacgctaggcgtgcggagggatag

SEQ ID NO: 208599 - DNA, 1569 bp, Artificial Sequence
  Description of Artificial Sequence: Synthetic coding sequence
atgagcgccctgctgagcctgtgcttcgtgctgcccctggccgcccctggtcacggaacccagggatgggaaccctgcacagacctgagacctctggacattttagctgaagtagttccgtctgacggggcgaccagcgggattaggatcgtgcaggtgcatggcgctagaggcttgcagctatccgtcgccgccccccggaccatgtcgttcccagcaagcagaattttcagtcagtgtgacctgtttccagaggagtttagtattgtggtgaccctcagagtgcctaacctgcctcccaagaggaatgagtacctcctgacagttgtcgccgaggaatccgatttgctgcttttaggcctccggctctctcctgcccagcctccatgcaccgaggtcgaagacgcccagttctggtttgacgcttccaggaaggggctgtacctgtgcgtgggcaatgagtgggtgtctgtgctggctgctaaagaaaggctcgattatgtggaggagcaccagaatctgtcaactaacagcgagacactgggcatagaagtgttcagaataccccaggttggcctgtttgtggctaccgcaaatcggaaggctacgtcggccgtatataagtggactgaggagaagtttgtgtcatatcaaaatatacctacccaccaggcccaagcctggcggcactttaccatcggtaaaaagatttttcttgccgttgctaactttgagcctgacgaaaaggggcaagaattctccgtgatctataagtggtctcaccgcaagttgaagtttacaccttatcagagcatcgccacacatagcgctcgcgattgggaagctttcgaagtggacggtgaacacttcctggccgttgctaaccatcgggaaggggacaatcacaatattgattccgttatatacaagtggaaccccgccacccgcctatttgaagctaatcagactatagcgacaagcggagcttacgactgggaatttttcagcgtaggtccttacagtttcctggttgtggcgaacacatttaacgggacttctactaaggttcactcccatctatacatccggcttctcggttcctttcagctattccagtcattccccacatttggagcagcggattgggaagtgtttcaaatcggggagcgcatattcctggccgtcgccaacagccattcctatgatgttgagatgcaggtgcagaatgactcgtacgtgattaattctgtgatatacgagttgaacgtaacggcacaagcatttgtcaagtttcaggatatactgacttgctcagctctggattgggagtttttttcagtgggcgaggattattttctggttgtggctaattcattcgacggtagaacattttctgtcaactcaattatctatcgctggcaggggtatgaaggattcgtggcggtgcactctctgcctactgtggggtgtcgcgactgggaggcgttctccactactgcaggcgcctatctgatttatagtagtgcaaaagaacctctcagtagggtgctccgactgagaactagatag

SEQ ID NO: 208600 - DNA, 1605 bp, Artificial Sequence
  Description of Artificial Sequence: Synthetic coding sequence
atgatggaggccctgggcttcctgaagctggaggtgaacggccccatggtgacagttgcactgtctgtcgcacttcttgctttactgaagtggtatagcacttctgccttcagccggctcgaaaagttagggctccgccaccccaagccctccccctttattggcaacttaaccttttttcgccagggattctgggaaagccaaatggagctcaggaaactctacggcccgctgtgcggatactacctgggaagacggatgttcatcgtgatatcagaaccggatatgatcaagcaggtgctggtcgaaaatttcagtaactttacaaaccgaatggcaagtggacttgagttcaaatctgttgctgactccgtcctgttcctgcgcgacaagaggtgggaggaggtcaggggggcactcatgagtgctttctccccagagaaactgaacgaaatggtccccctgatcagtcaggcatgcgagctgttactagctcatcttaagagatatgcggagtctggcgacgctttcgacatccagcgttgctactgcaactatactacagatgtcgtggcctccgtcgccttcggaacccccgtggatagctggcaggcacctgaagatccatttgtaaagcactgtaagagatttttcgagttttgcatcccgcggcccatacttgtcctgctgctcagctttccaagtataatggttcccttggcacgcattctgcccaataagaatagagatgagctgaatggctttttcaataaactgattagaaacgttattgccctgcgcgatcagcaggccgcagaggagaggaggagagattttctccagatggtgttagatgctagacattccgcgtctcctatgggcgtccaggactttgacattgtcagagatgtcttttccagtacgggttgcaagccaaatccttctcgacagcaccagccgagccctatggcccgcccgctgactgtagacgagatagtagggcaggcctttatctttcttatagcaggctatgaaatcatcaccaacactctgagttttgccacatacctgctggctaccaacccagattgccaagagaaactgctgcgggaagtggatgtcttcaaggaaaaacatatggccccagaattttgctccctggaggaaggcctaccttatttggatatggtcattgccgagaccctaagaatgtatcctcctgcgtttcggtttacaagggaagctgcgcaggattgtgaggttctgggtcagagaattcctgctggggccgtgctggaaatggctgtcggtgcactgcaccacgatcccgaacattggccctccccagagacttttaatccagagagattcactgccgaggctaggcagcagcacagacctttcacttacctgcccttcggcgccggtccaagatcgtgtctcggagtgcggctggggctgctggaggtgaaactaaccctcctacacgtgcttcacaaattcagatttcaggcctgccctgagacccaggtgccacttcagctggagtctaagtcagcgctcgggcctaagaatggagtctatatcaagatcgtcagtcggtag

SEQ ID NO: 208601 - DNA, 1602 bp, Artificial Sequence
  Description of Artificial Sequence: Synthetic coding sequence
atggaggccctgggcttcctgaagctggaggtgaacggccccatggtcacagtcgctctatccgtcgcactgcttgctctgctcaagtggtatagtactagcgctttctccaggctcgagaagctcggcttacgccaccctaaaccttctcccttcattggtaatcttacgttttttcgccagggattttgggagagccagatggaactccgcaagctgtatggacccctgtgcggatactatcttggtcgacggatgttcatagtaatctctgagcccgacatgataaagcaggttttagtcgaaaattttagcaatttcactaacaggatggccagcggtctagagtttaagagtgtggccgattcagtgttatttttgagagataagcgatgggaggaggtgcgaggcgcgctcatgtcagctttttcccccgagaagttgaatgagatggtccctctgatcagccaggcctgtgaactgcttctggctcatctcaagaggtatgccgaatctggtgatgcattcgatatacagcggtgctattgtaattataccactgacgttgtggcgtccgtggcctttggaacgcccgtggacagctggcaggctccagaggaccccttcgtgaagcattgcaagcggttcttcgagttttgcatcccaagacctatcctcgtgttgctgcttagtttcccatctattatggtgcccctggcccgaattctgcctaataagaaccgcgacgagttgaacggatttttcaacaagctgatccgcaatgtaatagccctacgtgatcagcaggccgccgaggagaggcgtagagacttcctgcagatggtcttagatgcccggcatagtgctagtcccatgggggtgcaggacttcgatatcgtgcgcgatgttttctccagcacaggttgcaaaccaaatccatctagacagcaccagcccagtccaatggcccgacctctgaccgtggatgagattgttggacaggcctttatatttctcatcgccggctatgaaatcattactaacaccttatctttcgccacgtatctgctagccactaatcccgattgtcaggagaaactgttgcgcgaggttgacgtgttcaaggaaaagcacatggcacctgagttctgcagtctggaggaaggactcccttatttagatatggtgatcgccgagaccctgcgtatgtatccccctgccttccgatttaccagagaggccgctcaggactgtgaggtcctgggacaacggatccccgcaggagcagttttagagatggccgtcggggcccttcaccatgacccagagcactggccaagccctgaaacctttaaccctgagcgtttcacagccgaggcccggcagcagcatcgtcctttcacttacctaccattcggggcaggaccacggagttgtctcggcgttcggcttggcctcttggaggtgaagttaactctactacacgttctccacaaattccggttccaggcatgtcctgaaacgcaggtccccctgcagctggagagcaagagcgcgctgggccctaaaaatggggtttatataaaaatcgttagcagatag

SEQ ID NO: 208602 - DNA, 1380 bp, Artificial Sequence
  Description of Artificial Sequence: Synthetic coding sequence
atggaggccctgggcttcctgaagctggaggtgaacggccccatggttacagtggcactctccgtcgccctgctcgcgctgctaaaatggtacagcacatccgcgttttcccgactagaaaagctaggtcttagacacccaaaaccatccccattcattggaaatctaacattctttcggcaggggttttgggagtcccaaatggagttgcggaaactgtacggccccctgtgcggttactatttggggcgccgcatgttcatcgtgatcagtgagccagacatgataaagcaggtcctcgtggaaaacttctcaaatttcacgaatagaatggcctctgggctggagtttaaaagcgttgcagactccgtattgtttttgcgggataaaagatgggaggaagtcagaggtgctctgatgtccgctttcagcccggagaagttaaacgagatggtgcccctaatctctcaagcttgcgagctcctgctggcccatctgaagagatacgccgagtcaggggacgcctttgatattcagaggtgctactgtaattacactacggacgtagtggcctctgtggcctttgggaccccagtagactcttggcaggccccagaggacccattcgtgaaacactgcaagcgattcttcgaattttgcataccaagaccgatcctggtgctgctgctgtccttcccctcgataatggtgcccctagcccgtattctgcctaacaagaacagagatgagttaaatggctttttcaataagctgatcaggaacgtcatcgcgttaagggatcagcaggccgcggaggagcgccgaagagacttcctacagatggtgctggatgccagacactccgcctccccgatgggcgtgcaggattttgatatcgtgagggacgtgttctcttccacaggatgtaagccaaacccttcaaggcaacaccagcctagtcccatggcccgacccctgactgtggacgaaattgtcggacaagcttttatattcttgattgctgggtatgagataataactaataccctgtctttcgcgacctatttgcttgctactaacccagattgtcaggaaaagctgcttcgcgaagtggacgtgttcaaagagaaacacatggcaccagagttctgcagtctcgaagagggcttgccctaccttgacatggtcatcgccgaaacgttacggatgtatccacccgctttccgatttacaagagaggccgcgcaggattgtgaagtactgggccagagaataccagccggggccgtcctagagatggcggtgggcgccctccaccacgacccggaacattggccttcccctgaaaccttcaatccggagcgataccgctgttcttag

SEQ ID NO: 208603 - DNA, 1383 bp, Artificial Sequence
  Description of Artificial Sequence: Synthetic coding sequence
atgatggaggccctgggcttcctgaagctggaggtgaacggccccatggtcaccgtggctctgagcgtggctcttctggccctgctaaagtggtattccacatccgcctttagcagactggagaagctgggcttgcgtcatcctaagccatccccatttatcggcaatttgactttctttaggcagggtttctgggagtcccagatggagcttcgcaagctgtatgggcctctgtgtgggtactacctcggccgccggatgtttatagtaatcagcgagcccgatatgattaagcaggtcctggtggagaactttagcaacttcacaaatcgaatggccagcggactagagttcaagagtgtggcggacagcgtgcttttcctgcgcgacaaacgatgggaggaagttagaggcgcgctgatgtctgcgttctcacccgaaaaattaaatgagatggtacccctgatatcacaggcatgtgaactgctgttagctcatcttaaaaggtacgctgagagtggcgacgcgtttgatattcagagatgctattgcaattatactacagatgttgtagcgtccgtagcttttggcacccctgtcgatagttggcaggcacccgaggaccccttcgttaagcattgtaaaagattttttgagttttgtattccaagacctattctggtgttgcttttgtcattcccttctattatggtgccactggcaaggatcttacccaataaaaaccgagatgagctcaacggtttttttaataaactgatccgaaatgtgattgccctcagggatcaacaggcggcagaggaacgaaggagggactttctccagatggtacttgacgcccgccatagtgctagtcccatgggagtccaagacttcgacatagttcgagatgtgttcagctccacagggtgtaagcctaatcccagccggcagcatcagccaagcccgatggctagacctttaaccgttgatgaaatcgtgggccaggcgttcatcttcctaattgcaggctatgagattattacgaatacgctctcctttgccacctacctgctcgcaactaacccagattgccaggaaaagctcttaagggaggtagatgtttttaaagagaagcacatggcccccgaattctgttcgctggaggaaggtctgccctatcttgatatggtgatcgctgagaccttgaggatgtaccctcccgctttcaggttcaccagagaggctgcccaggattgcgaggttttaggacagagaatccccgcgggggctgttctagaaatggctgtcggcgccttgcatcatgacccagaacattggcccagccctgagacgttcaatcctgaacgatatcggtgttcatag

SEQ ID NO: 208604 - DNA, 1743 bp, Artificial Sequence
  Description of Artificial Sequence: Synthetic coding sequence
atgatggaggccctgggcttcctgaagctggaggtgaacggccccatggtaactgtggcactgagcgttgccctgctcgccttgcttaagtggtactcaacatctgccttcagtaggctggagaagctgggccttaggcatccgaaaccaagcccgtttattggtaatctgacgtttttcagacaggggttctgggagagccagatggagttgcggaagctgtatggaccactgtgtggttactatctgggaaggcgaatgtttattgttatctcggagccagacatgataaagcaggtgctggttgagaacttctccaactttacgaataggatggcgtcaggcttagagtttaagagcgtggctgactctgtactgtttcttagagacaagcgttgggaggaggtaaggggggcccttatgtcagctttttccccggagaagctgaatgaactgggtcttctcatcatgcaggagaggattaaggggcacatgggaggacagcaggccccacagcgcattcctccgactcggctatctaagcccagtggcatctacgtgaatttacactacgccactctacctttttgcatggtgcctttaatttcacaggcctgcgagctattgctggcgcacctcaagaggtatgcagagtcaggcgacgctttcgacatacagcggtgctattgtaattatacgaccgatgtggtggcatccgtggccttcggaacacctgtggactcttggcaagctcccgaggacccgttcgttaaacactgtaagcgcttttttgagttctgtattcctagacctatccttgtcctgcttctaagttttccttccatcatggtccctctcgcacgtatactcccgaacaagaacagagacgaactcaatggtttttttaacaagctcatccgaaatgtcatcgccctgcgcgatcaacaggcagcagaagaacgccgtcgtgacttcctccagatggtgctcgatgccaggcattctgcttcccccatgggtgtgcaagatttcgacatagtccgcgacgtgttctctagcaccggctgcaagcccaaccctagccgccagcaccagccctcgccaatggccaggcctctgactgttgatgagattgtcgggcaggctttcatatttttgattgctggctacgagatcataaccaataccctcagcttcgctacctaccttctggcgaccaatcctgactgccaagagaaacttctaagggaagtggatgtgttcaaggaaaagcacatggccccggagttttgctctctagaagagggtctaccttacctggatatggtgatcgcagaaacactgcgtatgtaccctcccgctttccgcttcactagagaggcggctcaggattgtgaagtcctggggcagcggatccccgctggcgccgtcttagaaatggctgtaggcgcacttcaccacgacccagaacactggccatctccggagacattcaacccagagagatttaccgcagaagctcgtcaacagcatcgcccattcacctatcttcctttcggggctgggccccgctcctgtttaggagtacgcctgggtctgctggaggtgaagctgaccctgctccacgtgctccataagttcagattccaagcttgtccggaaactcaggtgccgttgcagctcgaaagtaaatccgcattgggccctaagaacggcgtgtacattaagatcgtcagccgatag

SEQ ID NO: 208605 - DNA, 1605 bp, Artificial Sequence
  Description of Artificial Sequence: Synthetic coding sequence
atgatggaggccctgggcttcctgaagctggaggtgaacggccccatggtgacagttgctctcagcgtcgccctattagccctgcttaagtggtattcaaccagcgccttttcacggcttgagaagctgggtcttagacatcctaagccaagtccctttattggcaacctgacgtttttccgacagggcttttgggaatcccagatggagttgaggaagctgtatggacccctttgtgggtattacctagggcggagaatgttcattgtgatttctgagcccgacatgataaaacaggtgctcgtggaaaactttagcaattttactaaccggatggccagcgggctggagtttaaaagtgtggccgactccgtcttattcctgcgggataaacgctgggaggaggtgagaggtgccttgatgagcgccttttcccctgaaaaactgaacgagatggttccgctcatcagtcaagcatgcgagttactgctcgctcatctaaagcggtatgctgaatctggcgacgcgtttgacatccagcgttgctattgcaattacacaacggacgtggtggcatccgtcgcttttggtactccagtagactcatggcaggcccctgaagaccctttcgtcaagcattgcaagaggtttttcgaattctgtatcccaagacccatcctcgttctactgctcagtttccccagcatcatggtgccactagccagaatcctgccgaacaagaacagggatgaacttaatggtttttttaacaagctgatccgcaatgtcattgctctgagggaccaacaggcagccgaggagcgaagacgggatttcttgcagatggtcctggacgctcgccactccgcttccccaatgggcgttcaggatttcgatatcgtccgggacgtgttttcctctaccggctgcaaacccaatccatccaggcagcatcagccttcgccaatggctaggcctttgaccgtcgacgagatcgtgggacaggctttcatctttctcattgcaggttatgagattataactaataccttgtcctttgcaacataccttcttgccactaaccccgactgtcaggagaagctcctgcgcgaggtggacgttttcaaagagaagcacatggctccagagttctgtagcctggaagaaggtttgccctacttagatatggtgatagcagagacccttcggatgtatccgcctgctttccgtttcacccgggaagctgcacaggattgtgaggtgttaggacagcggatccccgcaggagcagtgctagagatggccgtgggagccctgcaccatgatccagagcactggccatctccggaaacattcaatccagagcgcttcacggctgaagcccggcagcagcacaggccatttacgtatttgccattcggtgctggaccgagatcatgcctgggcgtgaggctaggcttactcgaagtgaagctgaccttactgcatgtgctgcacaagttccggttccaggcgtgccctgagacacaggtgcccctacagctggagtcaaaatccgctcttgggcctaaaaacggtgtctatatcaagatcgtaagcaggtag

SEQ ID NO: 208606 - DNA, 453 bp, Artificial Sequence
  Description of Artificial Sequence: Synthetic coding sequence
atggaggccctgggcttcctgaagctggaggtgaacggccccatggtaacggtggctctgagcgttgcactgctggcactactgaaatggtacagcacttccgctttctcgagactggagaaactcggactgcgacaccccaagccttccccctttatcggaaacctgacattctttaggcaagggttctgggaatcacagatggagctcaggaagctctatggccctctgtgcggctactacctcggcagacgtatgttcatcgtaatctctgagccagatatgattaaacaggtgcttgtcgagaacttctccaactttacgaataggatggcatccggcctggagttcaaatcggtggctgattccgtgctattcctgcgcgataaacggtgggaagaagttcgtggagccttaatgtcggctttttcaccagagaaactcaatgagtag

SEQ ID NO: 208607 - DNA, 1602 bp, Artificial Sequence
  Description of Artificial Sequence: Synthetic coding sequence
atggaggccctgggcttcctgaagctggaggtgaacggccccatggtgaccgttgcgctcagtgtagccctcctggcccttcttaagtggtattctactagcgccttcagtagattagagaaactcggtctgagacaccccaaaccaagccctttcattgggaatcttacatttttcaggcaagggttttgggagtctcagatggaactccggaaactgtacggccccctttgtggctattacctgggaagaaggatgttcatcgtcataagcgagcctgacatgattaaacaagtgctggttgaaaattttagcaacttcactaacagaatggccagcgggctggaattcaaatcagtggctgatagcgtcctattcttgcgggataagagatgggaagaagtgcggggagccttgatgagcgccttttcacctgaaaaactgaatgaaatggtgccccttatctctcaggcttgcgagcttctgctagcccatcttaaacgctacgctgagtcgggagatgcctttgacatccagcggtgctactgtaactatacaactgacgtagtggcaagtgtggccttcggaactccagtggatagctggcaggcgcccgaggatccttttgtgaaacactgtaagagatttttcgaattctgcatacctcgaccaatcctggttctgctcctgtcattcccttccatcatggtgcctctagcaaggatacttcctaataagaaccgtgacgaactgaatggattttttaataaattgatccggaacgtgatcgctctgagggaccaacaggctgctgaagaaagaagaagagactttctgcagatggtgcttgacgccaggcacagtgcttctcctatgggagtccaggactttgacatcgtgagagacgtattcagttccaccggatgcaaacctaatccaagtcgtcagcatcaaccatcgccgatggctcgtcccctgaccgttgacgaaatagttggtcaggccttcatcttcttaatcgccggatacgagatcatcaccaatactctaagttttgctacctatctgcttgccacaaacccagattgccaggagaaactactgcgcgaagtggatgtctttaaagagaagcatatggcgcccgaattttgcagtcttgaggagggtctgccatacttggacatggtcatcgccgaaacgctccggatgtatccaccggcattcagatttactcgggaggcggctcaggattgcgaagtcctcgggcagagaatccctgccggcgctgtgttggaaatggccgtgggggctcttcaccatgaccccgagcactggcctagtccagaaacgtttaaccccgagcgcttcaccgcagaagcccgtcagcagcatagaccatttacatacctgccatttggcgccgggccacgcagttgcctgggagtgcgtctcggcctcctggaagtgaagctcaccttgctacacgtgctccacaaattccgatttcaggcttgccccgagacccaggttccactgcaattggaaagcaagagcgctcttggtcctaagaacggggtgtacattaaaattgtatcccgatag

SEQ ID NO: 208608 - DNA, 459 bp, Artificial Sequence
  Description of Artificial Sequence: Synthetic coding sequence
atgatggaggccctgggcttcctgaagctggaggtgaacggccccatggttacagtggcactgtccgtggccctgctagcccttctgaagtggtattcaacaagtgcgttttccaggctcgaaaagctaggcctacggcaccccaagccttcgccttttatagggaatctcacctttttccgtcaaggcttctgggaatcccagatggagctgcggaaactctatgggcccctgtgtggctattacctgggccggagaatgtttatcgttattagtgagccagacatgatcaaacaggtcttggtggaaaacttcagtaactttacaaaccgcatgccccagtcaattatgcctaattcacgccaccacgttgcaagtcggggaatgtggcctggaggtaggaggttggcatgctacctgcatcctttccggatggctgagggcattgcagaggtgtag

SEQ ID NO: 208609 - DNA, 1401 bp, Artificial Sequence
  Description of Artificial Sequence: Synthetic coding sequence
atggagctgcggaagctgtacggccccctgtgcggctactacctgggtcgtcgtatgttcatcgtgatttcggagcccgacatgataaaacaggtccttgtggagaatttctctaacttcaccaaccgaatggcctcgggcttagagttcaagagtgtcgccgactccgttcttttcctccgggataagcggtgggaagaggtgcgcggcgcgctgatgtccgcattcagtcccgaaaaattgaatgaaatggtacccttgatcagtcaggcctgtgaactgttgttggcccacctgaaaaggtatgcggagtcgggggacgccttcgatatccaacgttgctattgtaactatacgacagacgtcgtagccagcgttgcttttgggactccagttgactcatggcaggcaccggaagaccccttcgtcaagcactgtaaacgcttttttgagttctgcattccccgtccgattcttgtgttactcctgagctttcctagtatcatggtgccgctggccagaatcctaccaaataagaacagagacgaattgaatggcttttttaataagttgattaggaatgtcatcgcgttgcgggatcaacaggccgctgaagaaaggcgcagggacttcctgcagatggtcctggatgcaaggcacagtgcctcccccatgggagtgcaggacttcgatatcgtgcgcgacgtgttctcctctacaggctgcaaacctaatccctcacgccagcatcagccaagtcctatggcacggccgctcactgtcgacgagattgtcggccaggccttcatcttcctcatcgccggctatgaaatcatcactaataccctgtcctttgccacctacttgttggccacaaaccccgactgccaggagaaactgctccgagaagtggacgtatttaaggaaaagcacatggccccggaattctgtagtttagaagagggattgccgtacctggacatggttattgctgagactttgcggatgtacccacctgcctttcggttcactagagaagcagctcaggactgtgaagttctaggccagcgcatacctgctggggctgtcctggaaatggccgtcggcgctctccaccacgaccccgagcactggccgagccccgagacgttcaatccagaaagattcaccgctgaggctaggcaacagcatcgacccttcacctatttgccgttcggagcaggtcccaggagttgtctgggagtaaggttgggcctcctggaggttaaattaactctgctgcacgtactgcataagtttaggtttcaggcctgtcctgagacgcaagtgccactacagttggaatctaagagtgctttaggcccaaagaatggagtctacatcaaaatcgtgtcccgctag

SEQ ID NO: 208610 - DNA, 1032 bp, Artificial Sequence
  Description of Artificial Sequence: Synthetic coding sequence
atgtggcccaacggcagcagcctgggcccctgcttccggcccaccaatatcacactggaggagcgacggttaattgcctccccctggttcgctgcatccttctgtgtggtgggcctggcttctaaccttcttgccttgtcagtcctcgcaggggcccggcagggcggatctcatactcgatcctcgtttctcactttcctgtgcggcttggtactcaccgacttcctcggtctgcttgttaccggtaccatcgtggtctcccagcacgctgctctgtttgagtggcatgctgttgatcctggctgtcggctctgtaggtttatgggggtggtaatgatcttcttcggcctgtcccccctcctcctgggcgccgctatggcgtctgaacgatacctagggatcacacgcccgttcagtcgaccagctgtggcttcacagagaagagcctgggcaacagtggggttagtgtgggccgccgctttggcgctggggctcctgcctctgctgggcgtcggcagatacaccgtgcagtatcctggctcctggtgcttcctaacgctgggggctgaatctggggatgtcgctttcggactgctattcagcatgctcgggggactgtcagtgggcctgagcttcctgctgaatactgtctcagtggcaactctgtgtcacgtgtatcatggtcaagaagcagcacaacagcgtcctagagattcagaggtcgagatgatggcacagttgctcggcataatggtcgtcgcatcagtgtgctggctgcccctgttagtgttcattgctcaaacagtgcttcggaatccacctgctatgtcacccgccgggcagctatctcggacaaccgagaaagagctcctgatttatctgagagtcgctacatggaaccaaatcttggatccttgggtgtatatcctgttccggcgcgcagtcctcaggcgtctgcaacccaggctgtccactcgccctagatcactcagcctccagccccagctgacacaaaggagcggccttcaatag

SEQ ID NO: 208611 - DNA, 1224 bp, Artificial Sequence
  Description of Artificial Sequence: Synthetic coding sequence
atgtggcccaacggcagcagcctgggcccctgcttccggcccaccaatattaccctggaagagcgccgtctgattgcatcgccctggttcgccgcttcgttctgtgtcgtgggccttgcttccaaccttctggcccttagcgtgcttgccggagccagacagggaggaagtcacacacggagcagtttcctgacattcttatgcgggctagtactcaccgacttcctgggtctcctggtgaccgggacaatcgtggtgagccaacacgcggcacttttcgagtggcatgccgttgatcccggatgtagattatgccgcttcatgggagtggtaatgattttcttcgggttgtccccactcttactgggagctgcgatggccagtgagaggtatttaggtattacccggcctttttcccgccctgccgtggcctcccagcggcgggcttgggccaccgtgggccttgtgtgggctgccgccctggcactaggtctccttcctcttctgggggtcggccgatacacggtccagtaccctgggagttggtgctttctgactttgggggcagagtctggggatgttgcattcggcctcctgttctctatgctcggagggttgtcagtcgggctgtcatttctcctcaatactgtcagcgtggcgaccctgtgccacgtataccacggccaggaagctgctcagcagaggcctcgggatagcgaagtggagatgatggctcagctgctaggaattatggtcgtcgccagcgtctgttggctcccattactagtgtttatcgcacagaccgttctccggaatccacccgccatgagcccagctggacagctgtcaagaacaaccgagaaagagctattgatttatttaagagttgctacctggaaccaaattctggacccttgggtttacattctattcagacgggcagttttacgaagactacagcctagactgtcaacccggccaagacgctcactcactctctggcccagtctagagtacagtggcaccatctcagctcactgcaatctgcggcttccaggctcctcagactcacgggccagcgccagccgggccgcggggatcaccggcgtttctcattgcgcacgaccctgcatgctgttcgacccagaatttgatctcctcgctggagtacagctgcttccttttgagcctcccaccggcaaagcactgtcgcgaaaggattag

SEQ ID NO: 208612 - DNA, 1422 bp, Artificial Sequence
  Description of Artificial Sequence: Synthetic coding sequence
atgcgggaggtgcgggcccggctggccgccacccaggtggagtacatcagcggcaaggtgttcttcaccacgtgtagcgacctgaatatgctgaaaaagctaaagtccgcggaacgcctgtttctgttgatcaaaaaacagtttcccctcatcatttcttccgtgtctaaagggaagatcttcaatgagatgcagagactgatcaatgaagacccaggttcttggttaaacgcaattagcatatggaagaacctcctggaactggacgcgaagaaggagaagctttcccagcgtgacgataaccaactaaagcggaaagttggcgagaatgaaatcattgccaagaagttgaaaatcgaacagatgcagaaaatcgaggagaacagagattgccaactggaaaagcagataaaggaagaaacactcgagcagcgcgactttacaacaaaatcagagaagttccaagaagaagagtttcagaacgatattgaaaaggccatcgacacgcacaaccagaatgatttgacattccgcgtgtcttgccggtgttctggcacaattgggaaggcatttaccgcacaagaggtgggaaaggtcatcggcattgccattatgaagcacttcggatggaaggcagacttgaggaacccgcagttggagatattcatccatctgaacgatatctatagcgtagttgggatccccgtgttccgcgtttcactggcttctagggcatatattaagacagccggcctgcgtagcacaattgcgtgggccatggcttcgctggcggacataaaagctggagccttcgtgttggaccctatgtgcggattggggaccattctcctggaggcagccaaagagtggcccgatgtttattacgtgggcgccgatgtgtcagatagtcaactcctggggacctgggacaatcttaaagcagcggggcttgaggacaagatcgagcttcttaaaattagcgtcatcgaactgcctctcccatccgagagtgtggacattatcatttcagacattcctttcggaaaaaagtttaagctcggaaaagatattaaatcgattctgcaggagatggagcgggtactccatgtcggtggtaccatagtgttgctgctgtccgaggaccaccacaggcggctgacagattgcaaggagtctaatatcccttttaactcaaaggattcacacaccgacgaaccgggcattaagaagtgccttaaccctgaggaaaaaacgggggcatttaaaactgcgtcaacatcatttgaggcctctaatcataaattccttgatagaatgtctcctttcggttcgcttgtgcctgtagagtgctataaggtgtccctcgggaagacagatgcttttatttgtaaatataaaaaaagccacagttcaggtttgtag

SEQ ID NO: 208613 - DNA, 873 bp, Artificial Sequence
  Description of Artificial Sequence: Synthetic coding sequence
atgcgggaggtgcgggcccggctggccgccacccaggtggagtacatcagcggaaaagtttttttcaccacttgtagcgatctcaatatgctaaagaaacttaagagcgccgaacgcctcttcttattgattaaaaaacagtttccactgattataagcagcgtgtccaagggcaaaatcttcaatgaaatgcagaggttaattaacgaggacccaggttcatggttgaacgccatctccatctggaagaacttgctcgagttagacgccaagaaggagaagttgtcccagcgagatgacaaccagttgaagagaaaagtgggtgagaacgagatcattgctaaaaagctgaagattgaacaaatgcagaagatagaggagaaccgtgactgtcaattggagaagcagattaaagaggagaccttggagcagcgcgattttacgacaaagagcgagaaatttcaggaggaagagtttcagaatgacatagagaaggcaattgatacccacaatcagaatgacctgactttcagggtgtcctgccggtgctccggaacaatcggcaaggcatttacggcccaggtcctttacatgggtctgagccctggtcctcgcttacagatgcatatgaggtcccagcaatgtagagaggaaaggactccgcagaccgtggctatcacgaggcctcaccagctcgccctgaccaagttctcggatgtgaagggtcactggagcgagtatttcataaacctaaaaatatcccagactctcaaagggggacgcaagtcgaactggaactgctactatgagacattgtggatggaatcgcgtctcgaagagtctacaatccgtgacttgtacacgtctaaatag

SEQ ID NO: 208614 - DNA, 1512 bp, Artificial Sequence
  Description of Artificial Sequence: Synthetic coding sequence
atgagcgaggcccggggcgagcccggcagcggccccgaggccggcgcacgcttcttctgtacagcgggacgcggcctggaacctttcgttatgcgggaggtgcgggctcgcttggcggccacacaggtggaatatatttcggggaaagttttcttcactacctgctccgacttgaatatgctgaagaaactaaagtcagcagagcgattgttcttactgatcaagaagcagtttccgctgatcatctcatccgtgtccaaaggaaaaattttcaatgaaatgcagaggttgattaacgaggacccggggtcctggctgaacgcgatatcaatttggaagaatctcctggaactcgatgctaagaaggaaaaattgagccagagggacgacaaccaattgaaaagaaaggttggcgaaaacgagatcatcgcaaagaagctgaagatcgagcaaatgcagaaaatagaagagaacagggattgtcaactcgagaaacagattaaagaagagacccttgagcagcgcgatttcactactaaatcagagaagtttcaggaggaagaattccaaaacgacatcgaaaaagcaattgacacgcataaccagaatgatctcactttccgggttagctgcaggtgcagcggaactatcggcaaggcgttcacagcccaagaagtgggaaaggtgatcggcattgccatcatgaaacattttgggtggaaggctgacctgagaaatccacaactcgagatattcatacacttaaatgatatttactcggtcgtgggtattcctgtgtttcgggtgagcctggcctcacgagcttatattaaaacagcaggtctacggagcactatcgcctgggctatggcaagtttggctgacattaaggccggcgcattcgtgctcgacccaatgtgtggcctgggcactatcttgttggaagccgcaaaggagtggcccgacgtgtactacgtgggtgcagacgtgagcgatagccagctgctgggtacctgggataacttgaaagccgctggactggaggacaaaatcgaactcttaaagatctccgtcatcgagctgccactgcccagcgagtccgtggacatcattatatcggacattccgtttggcaaaaagtttaaactggggaaagacatcaagtcgattcttcaggagatggagagagtactgcacgtcggaggcaccattgttctcttactgagtgaagaccatcacagaaggcttactgattgcaaggagagcaatatcccgttcaatagtaaggacagccacaccgatgaacctgggatcaaaaaatgtctgaaccctgaagagaaaactggcgccttcaagactgcctctacaagcttcgaggccagtaaccacaaatttctggataggatgtccccctttgggagcctagtacctgtcgagtgttataaagtaagtctgggcaagacagatgccttcatatgtaaatataaaaagagccactcctcagggctgtag

SEQ ID NO: 208615 - DNA, 486 bp, Artificial Sequence
  Description of Artificial Sequence: Synthetic coding sequence
atgaacctggccatcagcatcgccctgctgctgaccgtgctgcaggtcagtagaggacagaaagttacctctcttacagcttgtctggttgaccagagcttaaggctcgactgtcgccatgagaatacctcttcatcccccatccagtatgaatttagcttaactcgcgagaccaaaaaacatgttctgtttggcaccgtgggggtaccagagcacacataccgctcaagaacgaatttcacctccaaatacaacatgaaggtcctgtatctgtcggccttcaccagtaaggacgagggcacctacacatgtgctctgcatcattccggtcactcccctcctatctcatcccagaacgtcacggtgttaagggataagctagtcaagtgtgaaggcatttcactgctggcacagaatacctcctggctcctgctgctgctcctttcactgagtctgctacaggccaccgacttcatgagtctgtag

SEQ ID NO: 208616 - DNA, 486 bp, Artificial Sequence
  Description of Artificial Sequence: Synthetic coding sequence
atgaacctggccatcagcatcgccctgctgctgaccgtgctgcaggtctctcgcggtcagaaggtgactagcctcacagcttgcctggttgaccagtcactcagactcgattgtcgccacgagaacacgtcctcaagccccatccagtacgaattttcattgacgagggagacaaaaaaacacgtgctgtttggaacagttggggtgcccgaacacacatatagaagtcgcaccaattttacttcgaagtacaatatgaaggttctgtacctctctgcatttacttcaaaagatgaaggaacctatacgtgtgctctgcaccatagtggccatagtcccccaattagtagccaaaacgttacggtcctgcgggacaaactggtgaagtgtgaaggaatcagtctcctagcacagaatacaagttggctgctgttactcctcctgtctctgagcctcttacaggccaccgatttcatgtctctttag

SEQ ID NO: 208617 - DNA, 480 bp, Artificial Sequence
  Description of Artificial Sequence: Synthetic coding sequence
atgttccccttcgccctgctgtacgtgctgagcgtgagcttccggaagatcttcattttgcagctagttggacttgtcctgacttacgactttacaaactgcgatttcgaaaagatcaaggctgcctacctgtccaccatttctaaagatttgattacttacatgagcggcactaagtctaccgaattcaataacactgtgtcctgttccaacagaccccactgcctgacagagattcagagcttaacttttaatcctacagccgggtgcgcttccctagctaaagagatgtttgcaatgaaaaccaaggccgctctggccatttggtgccccggttatagtgaaacccaaattaacgctacccaagcgatgaagaaacgtcgcaaaaggaaggtgaccaccaacaagtgtctcgagcaggtgagccagctgcagggactctggaggcgatttaacaggccactcctcaaacagcagtag

SEQ ID NO: 208618 - DNA, 192 bp, Artificial Sequence
  Description of Artificial Sequence: Synthetic coding sequence
atgttcgccatgaagaccaaggccgccctggccatctggtgccccggctactccgagacacagattaacgcgactcaagcaatgaagaagaggagaaagcgaaaggtgaccaccaacaagtgcctcgaacaggtgagccaattacagggcttgtggagacggtttaatcgcccattgcttaaacagcagtag

SEQ ID NO: 208619 - DNA, 705 bp, Artificial Sequence
  Description of Artificial Sequence: Synthetic coding sequence
atgagctgcatcaacctgcccaccgtgctgcccggcagccccagcaaaacaagaggacagatccaggtgatcctcgggcccatgtttagtgggaaaagtaccgagctcatgagaagagttagacgttttcagatagctcagtataagtgccttgtcatcaagtatgctaaagatacgcgctactcttctagtttttgcacacacgatcggaataccatggaggcgcttccggcttgccttttgcgcgatgtcgcgcaggaggcacttggcgtggccgtgattgggattgacgagggtcaattcttcccggacatcgttgaattctgtgaggccatggctaacgccgggaagactgtaattgttgctgcgctcgacggcacctttcaacgaaaacctttcggcgccatcctcaacctcgtgcctctcgccgaaagcgttgtgaagctgacggccgtgtgtatggagtgtttcagggaagctgcctacaccaaacggttaggcacagaaaaagaagtggaagtgatcggaggtgccgacaaatatcattccgtttgccggctctgttattttaaaaaggcctccggtcagcccgcgggccctgacaataaggagaactgccccgtcccggggaagcctggggaggccgtggccgcacggaaactcttcgctccgcagcagatccttcagtgttctccagcaaattag

SEQ ID NO: 208620 - DNA, 705 bp, Artificial Sequence
  Description of Artificial Sequence: Synthetic coding sequence
atgagctgcatcaacctgcccaccgtgctgcccggcagccccagcaaaacaagaggacagatacaggtgattttggggcccatgttctccggcaagtctaccgagctgatgcgtagggtgaggaggtttcagatcgcacagtacaagtgcctcgttatcaaatatgccaaggatacaagatactccagctccttttgcactcatgaccgcaacacaatggaagccttacctgcttgcctgttaagggatgtcgcgcaggaggcacttggcgtagcagtgatcggcatcgatgagggacaattcttccctgacatcgtcgaattctgtgaggccatggctaacgctggcaaaacagtgatcgttgcggccctggacgggacattccagcgcaaacccttcggggccatccttaatctggtcccactggctgaaagtgtcgtgaaactgaccgcagtgtgtatggagtgtttccgtgaagctgcttacaccaagaggcttggcacggagaaagaggtggaggtgattggcggagctgataaatatcacagcgtgtgccgactctgctacttcaaaaaggcgagtgggcaacccgctggacctgacaacaaggagaactgccccgtgccagggaagcctggcgaggccgttgccgcccgcaaattatttgcccctcaacagatcctccaatgctctcccgctaattag

SEQ ID NO: 208621 - DNA, 924 bp, Artificial Sequence
  Description of Artificial Sequence: Synthetic coding sequence
atgcggcccggcctgttcaagggccaggcccccggcagccggcggaggcctactgcagggctcgccgtcgtccgggctgacagccataaaaaggagccgcgggcctccggttccgcgagacctgctatgcttctgtggcctctacgtgggtgggccgctagggcactgcgatgctttgggccaggttccagaggctctccggcctccggacccgggcctcgacgtgtccagcggcgcgcatggcctcctgacaaagaacaagaaaaagaaaaaaagagtgtgatttgcgtcgagggcaacattgcttccggcaagaccacatgtttggaatttttttccaatgcgacagacgtcgaagttcttactgaaccagtgagcaagtggaggaatgtgcgaggacacaatcccctggggctgatgtatcacgatgcatctcggtggggcctgactctgcagacatatgtgcagcttacaatgctcgaccggcacacccgtccccaggtgtcctccgtgaggcttatggaacggagtatccactctgcccgctacatattcgtggaaaacttgtatagatccggcaagatgccagaagtcgactacgtggtattgagcgaatggtttgactggatactgcggaacatggatgtttctgtggatttgatcgtctacctgcggaccaaccccgagacctgctaccaacgcttgaagaaaaggtgtagagaggaagagaaagtgataccattggagtacctagaggccattcatcacctgcatgaagaatggttgattaaaggaagtctgttcccaatggccgctccggtgttggttatcgaggctgaccatcacatggaacggatgctggaactttttgagcagaaccgtgatcgcatactaacaccagaaaacaggaagcattgtccatag

SEQ ID NO: 208622 - DNA, 744 bp, Artificial Sequence
  Description of Artificial Sequence: Synthetic coding sequence
atgctgctgtggcccctgcggggctgggccgcccgggccctgcggtgtttcggcccaggatccaggggaagccctgccagtggcccagggccaagacgcgttcaaaggcgagcctggcctcccgataaagagcaagaaaaagaaaaaaagtcggtgatatgcgtggaaggtaacattgccagcggcaagacgacatgtctggagtttttctcaaacgctaccgacgttgaaggccttatgtatcacgatgcatcccgatgggggttgacccttcagacttacgtccagctaaccatgctggatcggcatacccgccctcaggtttcatctgtgcggctgatggaaagatcaattcactctgcccggtacatctttgtggaaaatctataccggtccggaaaaatgcctgaagtcgattacgtagtgctgagtgaatggttcgattggatcctgagaaatatggacgtctccgtagatttgatagtgtatcttagaactaatcccgagacctgctaccaaagacttaagaagcgatgccgggaagaagagaaagtcattcctctcgaatatctcgaagccatccatcacttgcatgaggagtggctgatcaagggaagcctattccctatggctgctccggtactcgttatagaggccgaccatcatatggagcggatgctcgagctgttcgagcaaaatagagataggattctgacccccgaaaacagaaagcattgtccgtag

SEQ ID NO: 208623 - DNA, 798 bp, Artificial Sequence
  Description of Artificial Sequence: Synthetic coding sequence
atgctgctgtggcccctgcggggctgggccgcccgggccctgcggtgttttgggccagggtcacgtgggtccccagcctcaggcccagggccgaggagggtacaacgtcgggcgtggccccctgacaaagagcaggaaaaagagaagaaatccgtgatctgcgtggagggtaatatcgcaagcgggaagaccacatgcctggaattcttttctaacgccactgacgtggaggttttgactgaaccggtgtccaagtggcggaatgtgaggggtcataatccactgggactcatgtaccatgacgcctctcggtgggggctgaccctgcaaacttacgtgcaacttaccatgttggaccggcatacacggcctcaggtatcctcagttaggttaatggaacggagcatccattctgccagatacatatttgtcgagaatctgtatagaagcgggaagatgccagaggtcgactatgtcgtgttgagtgagtggtttgactggatattaagaaacatggatgtttctgtagatctgattgtgtatttgaggacgaaccctgaaacctgctaccagagattgaagaaacgttgccgcgaggaggagaaagtaattcctttagaatatctggaagctatccatcatctacatgaagaatggcttatcaaaggaagtctcttccctatggctgcacctgttctcgtcattgaagcggaccatcacatggagagaatgttagagttgttcgagcagaaccgcgaccggatcctgacccctgagaatcgtaaacactgtccgtag

SEQ ID NO: 208624 - DNA, 507 bp, Artificial Sequence
  Description of Artificial Sequence: Synthetic coding sequence
atgtaccacgacgccagccggtggggcctgaccctgcagacctacgtccaactgactatgttggaccgtcacacccgtccccaggtgtcctccgtaaggctgatggaacgaagcatccattctgctaggtacatctttgtagaaaacctgtacaggtccggaaagatgccagaggtggattatgtggtgctgagcgagtggttcgactggatccttcgaaatatggacgttagcgttgacctgattgtgtatctcagaactaaccccgagacctgctaccagcggttgaagaaacgctgcagggaggaagaaaaggttatccctctggagtacttggaagcgattcaccatctccacgaggagtggctcataaaaggctcgctctttccgatggctgcacctgtcttggtcatcgaagctgaccaccatatggagaggatgctcgagctcttcgagcagaaccgcgaccgcatcctgactccagagaatcggaagcactgcccttag

SEQ ID NO: 208625 - DNA, 705 bp, Artificial Sequence
  Description of Artificial Sequence: Synthetic coding sequence
atgggcgccttctgccagcggcccagcagcgacaaggagcaggagaaggagaaaaaatcagtgatatgcgtggagggcaacatcgcgagtggaaagacgacatgtctggagtttttctctaatgcaactgatgtagaagtgcttacagagcctgtttcgaaatggagaaacgtgaggggacataaccctttaggcctgatgtaccacgacgcaagtagatggggcctgacactgcaaacgtacgtgcaattgaccatgctggatagacacactaggccacaggtctcctccgtacgattgatggagcggagcattcactctgcaagatacatttttgtcgagaatctctatagatctgggaaaatgcctgaggtagattatgttgtgctctctgagtggttcgattggattctccgtaatatggacgtctcagtggatctgatcgtatacttgcgaaccaatccagaaacttgctaccagcgcctgaagaagcgctgtagggaggaggagaaggtgattcctcttgaatatttagaggcaattcaccacctacacgaggaatggttgataaaaggcagcctgttccctatggccgcccctgtactggtgatagaggccgatcaccatatggagcgcatgttggagttgttcgaacaaaatcgggatcggattctcacaccagaaaacagaaagcactgcccctag

SEQ ID NO: 208626 - DNA, 507 bp, Artificial Sequence
  Description of Artificial Sequence: Synthetic coding sequence
atgtaccacgacgccagccggtggggcctgaccctgcagacctacgtgcagctgacaatgttggatcggcacaccagaccgcaggtgtcctcagtgcggttgatggagcgttcgatccactctgccaggtacatcttcgtagagaatttgtacaggagcggcaagatgcccgaggtggactatgtggtgctgtccgaatggtttgactggatcctgcggaacatggatgtgagtgtggacctgatcgtttatctgaggactaatcccgagacctgttatcagaggctgaagaagagatgtcgtgaagaggaaaaagtaatcccccttgaatatctggaggcaattcaccatctgcacgaagaatggctgattaaagggtccctatttcctatggctgcaccggttttagtgatcgaggcggaccaccacatggaaagaatgttggaactgtttgagcaaaacagggacagaatcctaacccctgaaaatagaaaacactgtccatag

SEQ ID NO: 208627 - DNA, 651 bp, Artificial Sequence
  Description of Artificial Sequence: Synthetic coding sequence
atgaccagcatctgcgtggagggcaacatcgccagcggcaagaccacttgcctggaattcttttccaacgccactgatgtcgaggtcctgaccgaacccgtatccaagtggcgaaacgtccgcggacataatcctctcgggttgatgtaccatgacgcaagtaggtggggtctaacactccagacttacgttcagctgactatgctcgaccggcacaccaggccgcaggtctcctcagtgcgtctgatggagcgctctatccatagtgccagatatatttttgttgaaaatctgtaccggagcggtaagatgccagaggtggactacgttgttctctctgaatggtttgactggatattaaggaacatggatgtgagtgtggatctgatagtgtacctgcgtaccaatccagagacttgctaccagcgcctcaaaaaaaggtgtagggaagaagagaaggtcattcccttggagtatctggaggcaatacatcaccttcacgaagaatggctgataaaaggcagcctctttccaatggctgcaccagtattggttatcgaggccgatcatcacatggaacgtatgctggaactgtttgagcagaaccgtgatcgcatcctcactcctgagaacaggaaacattgtccttag

SEQ ID NO: 208628 - DNA, 723 bp, Artificial Sequence
  Description of Artificial Sequence: Synthetic coding sequence
atgctgctgtggcccctgcggggctgggccgcccgggccctgcggtgctttggcccaggatcccgcggcagccccgcaagcggccctggcccaagacgagtgcaaagacgggcctggccccctgacaaggaacaagagaaggaaaagaaaagtgtcgtacttaccgagcctgttagtaagtggaggaacgtccggggtcacaaccccctcggtctgatgtaccacgatgccagtcgttggggcctcactctgcagacatatgtgcagctgacaatgctcgaccggcacactcgcccccaggtctccagtgtgcgcttaatggaacgctctattcatagcgctcgttatatttttgtagagaatttgtaccggtccggcaaaatgcctgaggtggactacgtggttttgtcagagtggtttgattggatcctgcgcaatatggacgtatcagtcgatctcatcgtctatctaaggacaaacccggagacgtgctaccagagactcaaaaaacgttgccgcgaggaggaaaaggtgatcccgctggaatatctcgaggcgatccatcatcttcatgaagagtggttgattaagggttcgctgttcccgatggctgctcctgtcctggttatagaagctgatcatcatatggagcgaatgctcgagctgtttgaacagaaccgtgaccgaattttgacgccagagaacagaaaacattgtccatag

SEQ ID NO: 208629 - DNA, 840 bp, Artificial Sequence
  Description of Artificial Sequence: Synthetic coding sequence
atgcccgtggccggcagcgagctgccccggcggcccctgccccccgcagcacaggaaagagatgccgagcctcgtccgccacacggtgagctgcaatatctgggtcaaatccagcacatcctgcgctgtggagtccgcaaagacgaccgcacaggcaccggaactctgagtgttttcgggatgcaagctaggtactctctgcgagatgaattccctcttctgacaacaaaaagagtattttggaaaggtgttcttgaggagctgctgtggttcattaaaggaagcacaaacgctaaggaattgagctcaaaaggtgtaaagatttgggacgctaacggatccagagatttcctagactccctcggcttctcaacgcgtgaggagggcgatcttggtcctgtgtacggcttccagtggcgacacttcggcgctgagtatcgcgacatggagagtgacctgcccttgatggccctcccgccctgtcacgccctgtgtcagttctatgtggtcaacagcgagttgtcctgccagctatatcagaggagcggagacatgggactgggggtgccgtttaacattgctagctatgcccttctgacgtatatgattgcgcacattactggtctgaaaccgggcgactttatccacactctgggtgatgcgcatatctaccttaatcacatagagccattaaaaattcaattgcaacgtgaaccaagaccatttcctaaactccgcattttgcgcaaggtcgagaagattgacgacttcaaggcagaagactttcagattgaggggtacaacccgcatcctacaataaaaatggagatggccgtgtag

SEQ ID NO: 208630 - DNA, 693 bp, Artificial Sequence
  Description of Artificial Sequence: Synthetic coding sequence
atgcccgtggccggcagcgagctgccccggcggcccctgccccccgcagcccaggagcgggatgcagaacctcgccctccgcatggtgaactgcaatatctcggccagattcagcatattctgcggtgtggagtgaggaaagatgaccgaacaggcactggtactcttagcgtgttcgggatgcaggcaagatattctctgagggactactctggacagggcgtggaccagctccaacgcgtaatcgacactatcaagaccaatcctgatgacaggcgtataatcatgtgcgcatggaacccgcgggatctccccctgatggccctccccccttgccatgctttgtgccagttctacgtggttaacagcgagctcagttgccagctgtaccagaggagcggtgacatggggctaggagtgcccttcaatatcgcctcgtacgctctgctaacgtatatgattgctcatattaccggactcaaaccgggcgattttatccatacactaggggacgcccatatctatctaaaccacattgagcctctgaagatccagcttcagcgggagccccggccattccctaagctgcgtatcttgaggaaagttgagaaaattgatgacttcaaggctgaagatttccaaatagaaggttacaacccccaccccacaattaagatggaaatggcagtctag

SEQ ID NO: 208631 - DNA, 942 bp, Artificial Sequence
  Description of Artificial Sequence: Synthetic coding sequence
atgcccgtggccggcagcgagctgccccggcggcccctgccccccgccgcccaggagagggacgccgagcccaggcctccacacggggagctgcagtacctcgggcaaatccagcacatcctaaggtgtggagtgagaaaggatgacagaaccggaaccggcaccctctctgtctttggtatgcaggcccgctacagtttgagagacgagtttccactgctcacaaccaaaagggtgttctggaagggcgttctggaggagctgctctggtttataaaaggaagcacaaacgcaaaggagttgtccagtaagggagtgaagatttgggatgctaacgggagccgagactttttggattctctaggattctcaacccgcgaggagggtgacctcggccccgtgtatggttttcagtggcgacatttcggcgcggaataccgggatatggagagcgattactcaggacagggggtggaccagctgcaacgggtgatagatactattaaaacgaatcctgacgacaggcgtattattatgtgcgcttggaatccacgcgacctcccgctgatggccctccctccgtgtcacgccttgtgccagttttatgtcgtcaactcagagttgtcttgccaactctaccagcgttctggggacatgggccttggagttcccttcaacatcgcgagttatgcattgctgacctacatgatcgcccacattactggcctgaaacctggagatttcatccatacccttggcgacgctcacatttacctgaatcacatcgagccccttaagatccaactgcagagagagccaagaccttttccaaagttgcgaatcttgcgtaaagtggagaaaatagatgatttcaaggctgaggactttcaaattgaaggttacaatccccaccccactatcaagatggagatggcagtgtag

SEQ ID NO: 208632 - DNA, 678 bp, Artificial Sequence
  Description of Artificial Sequence: Synthetic coding sequence
atgagccggccccggaagcggctggccggcaccagcggcagcgacaaagggctaagtggcaaacggaccaaaacggagaattcgggggaggctcttgctaaagtggaggactcaaaccctcagaagacctcagccacgaaaaattgcctgaagaatctcagcagccattggcttatgaaatccgagcctgaaagcaggctggaaaaaggggtggacgtcaagtttagtattgaggacctgaaggcccaacccaagcaaaccacatgctgggatggagtcagaaattaccaggctaggaactttctacgcgcaatgaagctcggggaggaggctttcttttaccattctaattgcaaagaacctggcatcgcaggactgatgaagattgttaaagaggcttatccggaccatacccagttcgagaagaataatccacactatgacccatcctccaaggaagacaacccaaaatggagtatggtggacgtgcaatttgtaaggatgatgaaaaggttcatcccactcgccgaattaaaatcctaccaccaggcacacaaagccacaggcggccccctcaaaaatatggtattgttcacccgtcagagactgagtatacagcctcttacccaggaggaattcgactttgtcctgtcactcgaagaaaaagaaccatcctag

SEQ ID NO: 208633 - DNA, 501 bp, Artificial Sequence
  Description of Artificial Sequence: Synthetic coding sequence
atgagccggccccggaagcggctggccggcaccagcggcagcgacaaggggctgtctggcaaaagaacaaaaacggaaaactctggtgaagcgctagcaaaggtggaggactctaacccccaaaagacgtccgcaaccaaaaattgtctaaagaacctgagtagccattggttgatgaagtcagaacccgaatcccgattagagaaaggggtggatgttaaattttcaatcgaagatcttaaagcccagcccaagcagaccacttgctgggatggtgtgaggaattatcaggcccgtaattttctgagggcaatgaagctgggcgaagaagcttttttctaccattccaactgcaaagaaccgggaatcgccgggttgatgaaaatcgtgaaggaggcctatccagatcacacacagtttgaaaagaataacccacactatgaccctagtagcaaagaagacaaccccaagtggtctatgaagagccttatcctgttttag

SEQ ID NO: 208634 - DNA, 678 bp, Artificial Sequence
  Description of Artificial Sequence: Synthetic coding sequence
atgagccggccccggaagcggctggccggcaccagcggcagcgacaaaggcctgtctgggaaaaggactaagaccgagaactcgggggaggcactggcgaaagttgaggactccaatcctcaaaaaacctcggccactaaaaactgccttaaaaacctgagcagccactggctgatgaagtccgagcctgagagtcgacttgagaaaggggtggacgttaaatttagcatcgaggatctgaaggctcagcctaagcagaccacttgttgggacggagtgcggaactatcaggctaggaattttctccgggccatgaaactgggtgaggaggcttttttttaccatagtaattgtaaagaacccggcattgcaggactcatgaagattgtcaaggaggcttaccctgaccacactcagtttgagaagaacaaccctcactacgaccctagcagcaaggaggataacccgaagtggtccatggtagacgtgcagtttgttcggatgatgaaaagatttatacccttagccgagttgaaatcatatcaccaggcccataaggcgacaggaggtccactaaaaaacatggtgctctttacccggcagagactgagcatccagccgctgactcaggaggagttcgacttcgtactctccctggaagaaaaagagccctcctag

SEQ ID NO: 208635 - DNA, 678 bp, Artificial Sequence
  Description of Artificial Sequence: Synthetic coding sequence
atgagccggccccggaagcggctggccggcaccagcggcagcgacaagggactttctggaaaacgaactaaaactgagaacagcggcgaggcgttggccaaggtggaggatagcaaccctcagaagaccagcgcgaccaaaaattgtctgaagaacctgtcatctcactggctgatgaaatcagaacccgagagcagattggaaaagggcgttgatgtaaaattttctatcgaagacctgaaggctcagccgaagcagactacctgctgggacggtgtgagaaactaccaggccagaaatttcctaagagcaatgaagttaggcgaggaagcattcttttaccatagcaattgcaaggagccaggcatcgccggcttgatgaaaatcgttaaggaggcttaccctgaccatactcaattcgagaagaacaacccccattacgatccaagcagtaaggaggataaccccaagtggtctatggtggatgttcagtttgtgagaatgatgaagaggtttataccactcgcggagctgaagtcataccaccaggcccacaaagcgacaggcggtcccctgaagaacatggttctctttacacgtcagagactctccattcagccactgacccaagaggaattcgactttgtgttgtccctcgaggagaaagagcctagttag

SEQ ID NO: 208636 - DNA, 1926 bp, Artificial Sequence
  Description of Artificial Sequence: Synthetic coding sequence
atggccctgagcctggaggagttcgtgcacagcctggacctgcggaccttaccaagggtcctcgagatccaggccgggatctacctggagggatcaatctacgaaatgtttggaaatgagtgttgtttctccaccggtgaggtgatcaaaatcacgggccttaaggtgaagaaaatcatcgctgagatttgcgaacagattgagggctgtgagagcctgcagccctttgagctgccgatgaatttcccgggtcttttcaagatcgtcgcagacaaaactccctatctgacaatggaggaaataaccaggacaattcacattggaccaagcaggctcggtcacccctgtttttaccatcagaaggatataaaactcgaaaatttgattatcaagcaaggagagcagatcatgttaaactccgtcgaggaaatcgatggtgagattatggtgtcttgcgctgttgcccgcaatcatcagacccacagcttcaatcttcccttgtcccaggagggcgagttctacgagtgtgaggacgagcgaatttacaccctgaaggaaattgtagagtggaaaatcccgaagaaccggacgaggaccgtgaatctaacagatttctccaacaagtgggattccacaaaccccttccccaaggacttttacggaaccctgatcttaaaacctgtgtacgaaatccagggggtgatgaagtttagaaaagacatcatccgcattctcccctctctggatgtggaggtgaaagatataacagattcttatgacgcaaattggttcctgcagctgctttcaaccgaggacctgttcgagatgacttccaaggagttccccatagttaccgaggtgatcgaggcaccggagggcaatcatcttccccagagtattcttcagcccggtaaaactatcgttattcacaagaaataccaggcatccagaatactggcctctgaaattaggtcaaactttcccaaacggcactttttgataccaacctcttacaaaggtaagtttaagagacgcccgagagagtttccgacagcatacgatctggaaatcgccaagtccgaaaaagagcccctgcatgttgtcgctacaaaggcctttcactcaccacatgataaactttccagcgtctctgtgggcgaccagttcttggttcaccagagtgaaactacagaggtcctgtgcgaaggcatcaaaaaggtcgttaatgtgctggcgtgtgagaaaatactgaagaaaagctatgaggccgccctgctccccttatatatggaaggggggttcgtggaagtaatccacgataaaaagcagtaccccatttctgaactctgcaaacagtttcgactccccttcaatgttaaagtgtctgtccgggatctgagcatcgaggaggacgttctagcagccactcccggactccagctcgaggaggacattacagactcttatttgctcattagcgatttcgcgaacccaactgaatgctgggagatcccggtgggccgccttaatatgaccgtgcaacttgtgtctaacttctctcgggacgcggaaccatttctggtgcgcactttggtcgaggaaataacggaagaacagtattacatgatgaggcggtatgagagttctgcttcacatccacctcctagacctcccaagcacccctccgtagaagagacaaagctgacattgctgacactcgctgaggaaaggaccgtagatcttccaaagagccccaagcggcaccacgttgacataaccaaaaaattgcaccccaatcaagcgggactggactcgaaggttttaatcggttctcagaacgatttagtggacgaagagaaagagcggagcaatcggggcgctacagcaatcgccgagacatttaaaaatgagaaacatcagaagtag

SEQ ID NO: 208637 - DNA, 1689 bp, Artificial Sequence
  Description of Artificial Sequence: Synthetic coding sequence
atgaacttccccggcctgttcaagatcgtggccgacaagaccccctacctgacaatggaggaaattactcggacaatccacattggtccctcacgtctgggtcatccttgcttctaccaccaaaaagacattaaactggagaatctgattatcaaacagggcgagcagattatgttgaattctgtggaagagattgacggcgagattatggtgtcttgcgccgtcgccaggaaccaccagactcacagctttaatcttccactcagtcaagaaggtgaattttacgagtgtgaggacgagagaatttacactctgaaggaaatagttgagtggaaaatccccaaaaaccgtacaaggacagttaaccttacagatttcagcaacaagtgggattcaaccaacccgttccctaaagacttctatggtacactgattttaaagcctgtctacgaaattcagggggtgatgaaatttcgcaaggatatcatcagaatcttaccatcactagacgtggaagtgaaagacatcacggatagttatgacgcaaattggttcttacaattactgagcaccgaagacctgtttgaaatgacgagcaaggaatttcccatcgttactgaggtcatcgaggcccccgaggggaatcatctcccacaaagtattttgcagccgggaaaaaccatcgtcattcacaagaaataccaggcctcacgtattttagcatcagagatccgctctaactttcctaaaaggcattttcttatccccacttcctacaaaggcaagtttaagaggcgtccacgggaatttcccacggcgtatgacctggaaatcgcaaagtccgagaaggaacctttgcacgttgtggccactaaagcctttcactcccctcatgataagcttagctctgtttctgttggggatcagttcctggttcaccaaagtgaaactacagaagtcttgtgcgaagggattaagaaagttgtaaacgtcttggcatgtgaaaaaatcctaaaaaaaagctatgaagccgccctcttacccctttacatggaaggcgggtttgtggaagtgatccacgacaagaaacagtacccaatatctgagctatgcaagcaattccgactgccgtttaacgtgaaggtgtcagtgcgcgacttatcaattgaagaggatgtcttggccgccacaccaggcttgcaattagaggaagatattactgatagctatctcctcataagcgacttcgcgaatcccaccgagtgctgggagatcccagtgggcaggctaaacatgacggtgcagttggtgtcgaatttttcgcgagacgctgaaccctttctcgtacgcaccttggtcgaggagatcacagaggaacaatactacatgatgcgacgctatgaatcgtccgcttctcacccacctccacgaccaccaaaacacccatccgtggaggaaaccaagcttacactgctcaccctggctgaggaaaggactgtggacctacctaaatccccaaagcgtcatcatgtggacatcaccaagaagttgcatccaaatcaggccggcttggactcgaaagtgttaatcggctcacagaatgacctggtagacgaggagaaagaacgatccaatcgcggtgccacagccattgctgagacctttaagaacgaaaagcatcaaaagtag

SEQ ID NO: 208638 - DNA, 372 bp, Artificial Sequence
  Description of Artificial Sequence: Synthetic coding sequence
atgaacttccccgtgcggaaggacatcatccggatcctgcccagcttagatgtggaagtcaaggacataacagattcatatgatgcaaattggttcctccagctgctatctacagaggacctgtttgagatgaccagtaaagagttcccaatcgtgacagaagttattgaggcaccagaaggcaaccacctacctcaatctattctccaaccaggcaagaccattgtgatccacaagaaatatcaagcctcgaggatcctggcttccgagatcaggtccaatttcccaaagagacacttcctcattcccacaagctataagggtaaattcaaaaggcgaccacgtgagttcccaaccgcctacgacctgtag

SEQ ID NO: 208639 - DNA, 1821 bp, Artificial Sequence
  Description of Artificial Sequence: Synthetic coding sequence
atgttcggcaacgagtgctgcttcagcaccggcgaggtgatcaagatcacgggacttaaagtcaagaaaattattgccgaaatatgcgagcaaatcgaaggatgtgaatctttgcaaccattcgaattgcctatgaacttcccaggcctgtttaaaatagttgctgataaaactccatatctcaccatggaggaaattactaggactatccatattggccccagccggctaggacacccgtgtttctaccatcaaaaggatataaaactcgaaaacttgattattaaacagggcgagcagattatgctcaacagtgtagaagagatcgatggcgagatcatggtctcctgtgcagtggcgagaaatcatcagacgcacagttttaacctacctttgagccaagagggtgagttttacgagtgtgaagatgagcgtatttacacactcaaggagattgtggaatggaagattcctaaaaatcgaacccgtacagtgaacctcacagatttttcaaacaagtgggatagcaccaatccttttccaaaggatttttatggcaccctcatactcaagccagtctatgaaatccaaggagtgatgaagttccgcaaggatatcattagaattctgccaagcctggatgtggaggtgaaggacattacggatagttacgacgcaaactggttcctgcaactgctgtctacagaagacctgtttgagatgacatcaaaggaattcccgattgtcacagaggtgatagaggccccagagggcaaccatttgccgcagagtattttgcaaccgggaaagactattgttatccacaaaaaatatcaggccagtagaatcctggcctccgagattaggtcgaattttcccaagcgtcacttcctaatcccgacaagctataaggggaaattcaaacgcaggccaagagaattccccaccgcctacgatttggaaattgcgaaatcagagaaggagcctctccacgtcgtggcgaccaaagcatttcactccccccatgataagctgtcgagcgtgtccgtgggagaccagtttctggttcaccaatccgaaaccactgaagtcttgtgtgagggaatcaagaaggtggtcaatgtgctggcctgcgaaaaaattctaaaaaagagctacgaggctgctctactgccgctctacatggagggcgggttcgtggaagtgatccatgacaagaagcagtatccgatatctgaactatgcaagcagtttaggctgccctttaatgtgaaggtgtctgtacgcgatctgagcatcgaagaggacgtgctggcagccactcctggtcttcaactagaagaagatattactgattcttacctgctaatttccgacttcgccaatcccaccgaatgttgggagattcccgtggggcgacttaatatgacagtgcaattagtgtctaactttagtcgggatgcagaaccgtttcttgtgaggaccctcgtggaggagatcacggaagaacagtattatatgatgcggagatatgaaagctctgctagccacccccctcccaggccgcccaaacatccttcagtagaggagacaaagctgaccttactcactttggccgaagagcgcacagtggaccttccgaagtccccaaagcggcaccacgtggacatcactaaaaagctgcaccccaatcaggccggattagacagtaaggtgctcattgggagccagaacgacctagtcgatgaagagaaagagagatctaaccgcggggccaccgctattgccgaaacgttcaaaaacgaaaagcatcagaagtag

SEQ ID NO: 208640 - DNA, 2043 bp, Artificial Sequence
  Description of Artificial Sequence: Synthetic coding sequence
atggccctgagcctggaggagttcgtgcacagcctggacctgcggaccttaccacgcgtgcttgagatccaggccggcatttacctggaggggtccatttacgaaatgtttggaaatgagtgctgtttttccaccggagaagttattaagatcacgggtctgaaggtgaaaaaaatcattgccgagatctgcgagcagatcgaagggtgtgagagtcttcaaccctttgaattacctatgaattttcctggacttttcaaaatcgtggcagataaaacaccctacctgacgatggaggagatcacacgaacaattcatattggaccgtctagacttggtcacccatgtttttatcatcaaaaggatattaagctagagaacctgataattaaacagggtgaacagattatgctgaacagtgtggaggagatcgacggagagatcatggtgtcctgtgctgtcgctcgcaatcaccagacccattcatttaatctgcccttatcacaggagggtgagttctatgaatgcgaggatgagaggatttacacgcttaaggaaatcgtggaatggaaaattccgaagaacaggacccgtacagttaatttaaccgacttcagcaacaagtgggatagcacaaatcccttcccaaaggatttttatggcacactcatcctgaaacctgtctacgagatacaaggcgtcatgaagttcaggaaggacattattagaattctgccatcattggatgtggaagtgaaggacatcactgactcttatgatgccaattggtttctgcaactgctctccaccgaagatctgtttgagatgacctcaaaggaatttcccatcgtgacagaggtgatagaagctcctgaaggcaatcatctgccacaaagcattctacaacccggaaaaacgatcgtcatccataagaagtaccaggcctccagaatcctcgcctctgaaattcgtagtaactttcccaagagacacttcctaatacctacttcgtataagggaaagtttaaacggaggccgagagagtttcccacagcatatgacctggaaattgctaaaagcgaaaaggagcccttgcacgtggtggcgaccaaggcctttcattcaccgcacgataaactctctagcgtgagcgtcggtgaccaattcctcgtgcaccagagcgagactactgaggtactgtgtgaggggataaagaaggtcgtcaacgtactcgcttgtgagaagattttaaagaagagttacgaggcagcattgttgccactgtacatggaaggaggtttcgtagaagttatccatgataaaaaacaataccctattagcgagctgtgcaaacagttcaggcttccattcaatgtaaaagtgtccgtgcgtgacctgagcattgaggaggacgttctggctgcaacccctggacttcagctggaagaagacatcaccgatagctaccttctgattagcgattttgctaacccaacagagtgctgggaaatcccagtcgggcgtctgaacatgaccgtgcagttagtttctaatttttcgcgggatgctgagccatttctagtgaggactctcgttgaagagatcaccgaagaacagtattacatgatgcgcaggtacgagtcatccgcctctcacccccccccccgccccccgaagcacccatcagtcgaagaaaccaagctcaccctcctgactctcgctgaggaacggactgtggacctgcccaaatctcctaaagccggagtccagtggagggaccttggatcgctccaacctctgccccctggatttaagcaattcagcgcctcagcatctcatgtggccgggattactggaaccccccaccacgtccaacgccatcatgtggatattaccaaaaagctgcaccctaaccaggcaggcttagacagtaaggtacttataggaagtcagaatgacctggtggatgaggaaaaagagaggagtaatcgaggagccaccgcaatcgccgagacttttaagaacgaaaagcatcaaaaatag

SEQ ID NO: 208641 - DNA, 1581 bp, Artificial Sequence
  Description of Artificial Sequence: Synthetic coding sequence
atggacgtgcggttctaccccccccccgcccagcccgccgccgccccagatgcgccttgcctgggcccttcaccttgcctagacccctattactgtaacaagtttgatggcgagaacatgtatatgtcaatgactgagccctcacaggactacgttcctgccagccaatcttatcctgggccttctcttgagagcgaggatttcaacattcctccaatcacacccccttctttgcctgatcactctctggttcacctgaatgaagtggagagtgggtaccacagcctctgtcaccctatgaatcataatgggttgttaccctttcaccctcagaatatggatctgcccgagatcactgtgtctaatatgctcggacaggatggaactctgttgtccaacagcatctcagtgatgccggatattcgtaaccctgaaggtacccaatattcaagccatccccagatggcggctatgcgccctaggggccagcccgccgatattcgtcagcagcctggcatgatgccacatggacagctcaccacaattaaccagagtcaactctccgcccagctcggtctcaacatgggtggctccaatgtgcctcataactctcccagcccaccaggttccaaatctgcgactcccagcccttctagttctgtccacgaagatgaaggcgacgatacttctaagataaatggtggcgaaaagcgaccggcatccgacatgggcaagaagccgaagacaccaaaaaagaagaaaaaaaaagatccgaacgaacctcagaaacccgtatctgcgtacgccctttttttccgagacactcaagccgccatcaaaggccagaaccctaacgcaaccttcggcgaggtcagcaaaatagtggcaagcatgtgggatgggctgggggaggagcaaaaacaggtgtataagaaaaaaacggaagctgccaagaaggagtacctcaagcagttggccgcataccgggcctctctggtctccaaatcttattccgagcctgtagacgttaagacctctcagcctccacagttaattaattccaagccatcagtgttccacggaccttcacaagcccattccgcactctacttgtcctcacactaccatcagcagccaggcatgaacccacacctcacggctatgcacccatctttaccacgaaacatcgctccaaaacctaataatcagatgcctgtaaccgtgtctatagccaacatggccgtgagtccaccgcccccgttgcagataagcccccccctgcatcaacaccttaatatgcagcaacatcagcccctgacgatgcagcagcctctaggcaaccaactcccaatgcaggtgcaatccgccctgcattctcctacgatgcagcaaggcttcaccctgcagcctgattatcaaactatcataaaccccactagtaccgcagcacaggtcgtgacacaggcaatggaatacgtccgctccggctgtcgcaacccaccaccccaaccggtcgactggaacaatgactattgcagcagcgggggcatgcagcgtgacaaagctctgtaccttacatag

SEQ ID NO: 208642 - DNA, 831 bp, Artificial Sequence
  Description of Artificial Sequence: Synthetic coding sequence
atgggcaagaagcccaagacccccaagaagaagaagaagaaggaccctaacgagcctcagaagcccgtctccgcttatgctctgttctttcgggacactcaagccgccattaagggccagaaccctaatgccacgtttggcgaagttagcaagatcgtcgcaagcatgtgggacgggcttggagaagagcagaagcaggtctataagaagaaaactgaagcagccaagaaggagtatcttaagcaactggccgcctatcgggcaagtctggtgagcaagagttactccgagcccgtggatgtgaaaacgagccagcccccccagctgatcaattcaaaaccatccgtgttccacggccccagtcaggcacactatcaccaacagccgggaatgaatccccacctaaccgcaatgcatccatcactgccaaggaatattgctcccaaaccaaacaaccagatgccagttactgtatctatagccaacatggcagtctccccgccacctcccttacaaatatcacccccccttcaccagcacttgaacatgcagcaacatcagccactcaccatgcaacagcctttaggaaaccagctgcctatgcaggtgcagtccgcactacattcccccacaatgcaacagggcttcactttacagcccgattatcagactattattaacccaacatcaactgctgcacaggtggtaacgcaggccatggaatatgtgcggtccggttgcaggaaccctcctccgcagcccgtcgattggaataacgattattgtagctccggcggcatgcaacgcgacaaagccttgtaccttacttag

SEQ ID NO: 208643 - DNA, 747 bp, Artificial Sequence
  Description of Artificial Sequence: Synthetic coding sequence
atgcccgagttcctggaggaccccagcgtgctgaccaaggacaagttgaagtctgagctggtcgcgaataacgtgactctgcctgctggagagcagcggaaagatgtgtatgtacaactgtatttacagcatctgacagcacggaatcgacccccactccccgccggaacaaattctaagggccctcccgacttcagtagtgatgaagaacgtgaaccaacaccagttctgggatcgggcgctgctgctgccggaagatcccgtgcggcagttggccgcaaggctaccaaaaagacagacaaacctcggcaggaagataaggacgatcttgacgtgacagaattaactaacgaggatctgctggatcagctggttaagtacggggtcaaccctgggccaatagttggcactacacggaaactctacgaaaagaaactcctgaagctgcgcgaacaaggcactgaatctagatcctcaacaccactgcctaccatcagctcctccgctgaaaatactcgccagaatggttccaacgacagtgatcggtattcggacaacgaggaggattctaagatagagctgaagctggagaaacgcgaaccgctgaaaggaagggctaagacgccggtcactctgaagcaaagaagagtggaacacaatcaggtaagtctcgtactcctaccaccatgtacgggaataaataacctgctcactaccctaatccatgtgttagcatttaacggatag

SEQ ID NO: 208644 - DNA, 2085 bp, Artificial Sequence
  Description of Artificial Sequence: Synthetic coding sequence
atgcccgagttcctggaggaccccagcgtgctgaccaaggacaagttgaaatcagagcttgtggcaaacaatgtaaccttgcccgccggtgagcagcggaaagacgtctacgtacagttatatcttcagcacctgaccgctcgtaatagacctccactccctgctgggaccaacagtaagggtccccctgacttcagttccgacgaagagagagagcccacacccgtactcggatctggcgccgcagctgccggtcggagtagggccgcagtcggccgtaaggctacaaaaaaaaccgataaaccgcgtcaggaagacaaagacgatctcgatgtgactgagcttacaaatgaggacctgctggaccagttggtgaagtacggagtgaacccaggaccaatagtgggaacaacgcgaaagctctatgagaagaaacttctgaagctgagagagcagggtacggaatcgcgaagcagcacccccttgcccacaatcagttccagcgcggagaatacccgacaaaatggaagcaacgactccgaccgctacagtgacaatgaagaggggaagaagaaggaacataaaaaggtgaaaagcacccgcgacattgtacccttttctgagctggggacaactccctcgggcggaggatttttccagggcatatcctttcctgagatttcgactcggcctccactcgggagcacggagctccaagccgccaagaaggtgcacacttctaaaggtgacctccccagagaaccactggttgccacaaacctcccaggacgcggtcagttacaaaagctggccagcgagaggaatctctttattagctgtaagagcagccacgacaggtgcctcgagaagtcatctagctcctcctcacaacccgagcactctgccatgttagtgtctacagcggcttctccctccctgattaaagagactacgacgggatactataaagacattgtggagaacatctgcgggcgggagaagtctggcatacagcctttatgtcccgagcgatcgcacatctccgatcaatctcctctaagtagcaaacgaaaggctctagaagagagtgagtcttcacagttgatttcacctcctcttgctcaggctatccgcgactacgtcaactctttactcgttcagggcggagtgggaagtttgccaggcacctctaattccatgccaccattagacgtggagaatatccaaaaacggatcgatcaaagcaagtttcaggagacggagtttctgagcccccctcgtaaagtgcctagactatctgagaaatctgttgaggagagagatagcgggtccttcgtggcattccagaacatcccagggtcagaactaatgagtagcttcgccaaaactgtcgtcagccactctctgacaaccctcgggctagaggtagctaagcagagtcagcacgacaaaattgatgccagcgagctgtccttcccatttcacgagagcatactgaaagttattgaagaagagtggcagcaggttgacaggcaattgcccagtctggcttgtaaatacccggtcagcagccgagaagcaactcagattctatctgtgcccaaagttgatgacgagatcctgggttttattagcgaggctactcccttgggaggcatacaagccgccagcacagagtcgtgtaaccagcagcttgaccttgctctttgccgggcctatgaggccgccgcatcagccctccagatcgcgacacacactgcttttgtagcaaaggccatgcaggcagatatttctcaggcggcacagattctaagcagcgatcccagtcggacccatcaggccctcggaatcttgtcaaagacctacgacgcggcaagctacatttgtgaagccgcatttgatgaagtgaaaatggcagcccataccatggggaacgcaaccgtaggacggcgctatttgtggcttaaagactgcaaaattaatctagcctctaaaaacaagctagcatccactccgtttaagggcgggaccctgttcgggggtgaagtgtgcaaggttatcaagaagagggggaacaagcactag

SEQ ID NO: 208645 - DNA, 1245 bp, Artificial Sequence
  Description of Artificial Sequence: Synthetic coding sequence
atgcccgagttcctggaggaccccagcgtgctgaccaaggacaagctgaagtctgaactagttgcaaacaacgtgaccctcccggccggtgagcaacgaaaagatgtgtacgtccaactctacttgcagcacctgaccgcccggaataggcctcctctcccagctggcactaacagtaaagggccccccgacttctccagcgatgaggagcgtgagcctactccagtgcttgggagtggagctgctgctgcaggaagatccagggccgccgtcggaaggaaagccacaaagaaaaccgacaaacctcggcaagaagacaaggacgacctggacgtgaccgaactgacaaatgaggatttgctggaccaacttgtaaagtacggcgtaaatccgggccccatcgttgggacgacaaggaagctttacgagaagaaactcttaaaactccgcgaacaaggcacggagtcaagaagcagtactccgctcccaaccattagtagtagcgccgagaacacccgacagaacggatctaacgatagtgacaggtactccgataacgaagaggacagtaaaattgagttgaagcttgaaaagagagagccactaaaggggagagctaagacgcctgtgactcttaaacaaagacgggttgaacataatcaggtggagacgagcgagcactttagaatagatggccctgtaatcagcgagtcaacacccatcgctgaaacgattatggcctcatcaaatgagtcgctcgtggtgaatcgcgtaacgggtaatttcaagcacgcatcgccaattctgcccatcaccgagttcagtgatattccacgccgagcccccaaaaaacccctgacacgagcggaggtcggtgaaaaaacagaggagcgccgagtggaaagagatatcctgaaggaaatgtttccatatgaggctagcacccctactggaatcagtgccagttgccggagaccaatcaagggcgcagccgggcgtcctcttgaactatccgatttcagaatggaagagtcattctcatcaaaatacgtcccaaagtacgtgcctctagccgacgtcaagagcgagaagaccaaaaaagggcgtagcattcctgtatggattaagatacttctgttcgtagtcgtggctgtttttctgttcctggtctatcaggcaatggagaccaaccaggttaatcccttttctaacttcttgcatgtcgacccaaggaagtctaactag

SEQ ID NO: 208646 - DNA, 1038 bp, Artificial Sequence
  Description of Artificial Sequence: Synthetic coding sequence
atgcccgagttcctggaggaccccagcgtgctgaccaaggacaagctgaagagtgagctcgtagcgaataacgtgacgctgccagccggggaacagcgcaaggatgtgtacgttcaattatatctgcagcatctgactgccaggaatcgaccaccgctccccgcaggtaccaactccaaaggccctccagactttagtagtgacgaggagagggaaccaacccccgtcttgggttctggtgctgccgctgctgggaggagtagagctgccgtgggccgtaaagcaaccaagaagaccgataagcccaggcaggaggataaagatgacctcgacgtcaccgagctgacaaacgaggatctccttgatcagctagtgaaatacggagtgaatcccggacctattgtgggcaccaccaggaaactttacgagaagaagctgctcaagttgagggagcagggcaccgaatcccggtcatcgacacctctgccgactatttccagttctgcggaaaacacaaggcagaatggcagtaacgatagtgaccgctatagcgataatgaagaggacagcaaaattgagctgaagctcgagaagcgggaaccattaaagggccgagccaaaacacctgtgactctcaagcagaggagggtcgaacacaaccaggtcggtgagaaaactgaggagcggcgcgtggagagggatattctgaaagagatgttcccatatgaagcttccacccccactggaatttctgcttcctgccgtaggcctatcaagggggctgccgggcgccctctggaactctccgatttcaggatggaagagtcctttagtagtaaatatgttcccaagtacgtgcccctggctgacgttaagagcgagaaaacaaaaaagggccgtagcatccctgtgtggatcaagatcctgcttttcgtcgtagtggcagtgttcctatttctagtgtatcaagccatggaaacaaaccaagtgaatcccttctcgaacttcttgcatgtggaccctagaaagagcaactag

SEQ ID NO: 208647 - DNA, 1365 bp, Artificial Sequence
  Description of Artificial Sequence: Synthetic coding sequence
atgcccgagttcctggaggaccccagcgtgctgaccaaggacaagctgaagagcgaactggttgccaacaacgttacacttccagctggagagcagaggaaggacgtatacgtgcagctttacttacaacacctgactgcccgaaaccgccctcctctgccagcggggaccaactctaaagggcctccagacttttcttccgatgaggagcgggagcctactcccgtgcttgggtcaggagcagctgccgctggcaggtctagagccgccgttgggcgtaaggctactaaaaagacagacaaaccccgccaggaagacaaggatgatctggacgtcaccgaactgaccaacgaggatctgctcgatcagcttgtcaaatacggcgtgaaccctggccctatcgtggggaccacgcgaaaactatacgagaagaaactactgaaactgagggaacaggggaccgagtctcgaagttctacacccttgccaaccatttcttcctcagccgagaacactcgccaaaatgggtcaaatgattcagacaggtactccgataatgaggaagattccaagatagaattaaagcttgagaagcgtgagcccctgaagggacgcgccaaaacccccgtgactctgaagcaacggagagtcgagcacaaccagtcgtactctcaggccgggatcaccgagacagaatggaccagcggatcgtccaagggggggcccctccaggctctcacaagggaatcaactagaggttccagacggacgccgcgaaaaagagtggagaccagcgaacattttcgcatcgacggacccgtgatctccgagtcaacgccgattgcggaaaccataatggcttcgtccaatgagagcttggtggtcaaccgggtgacaggaaatttcaaacatgctagcccaatcttgcctatcactgaattcagcgacattccgagacgggcccctaaaaagcccctgacacgtgctgaggttggggagaagactgaagaaaggagggtcgagagagatatactgaaggagatgtttccatatgaggcaagtacccccacaggaatctctgctagttgcaggcggccgatcaagggcgctgccggccgccccctggagctgagcgacttcaggatggaagagagcttctcgagcaaatacgtgcctaagtatgtcccgctcgcggacgttaaaagcgagaagaccaaaaaaggacgctcgattcccgtctggattaaaatcctgctgttcgtggtcgttgctgtctttctgtttctggtctatcaggccatggagacaaaccaggtgaacccattcagtaacttcttgcacgtcgaccctcgcaagagtaactag

SEQ ID NO: 208648 - DNA, 135 bp, Artificial Sequence
  Description of Artificial Sequence: Synthetic coding sequence
atgagcgacaagcccgacatggccgagatcgagaagttcgacaagagtaaactgaaaaagactgaaacgcaggagaaaaaccctcttccctccaaagaaaccatcgagcaggagaagcaggccggcgagtcttag

SEQ ID NO: 208649 - DNA, 135 bp, Artificial Sequence
  Description of Artificial Sequence: Synthetic coding sequence
atgagcgacaagcccgacatggccgagatcgagaagttcgacaagagcaagctcaaaaaaactgagacacaagagaaaaatcctctcccctcgaaagagacgatcgaacaagagaaacaagcaggcgagtcctag

SEQ ID NO: 208650 - DNA, 135 bp, Artificial Sequence
  Description of Artificial Sequence: Synthetic coding sequence
atgagcgacaagcccgacatggccgagatcgagaagttcgacaagagcaaactcaagaagacggagacacaagaaaagaatcccctaccatcaaaggaaaccattgaacaggagaaacaagctggcgagtcatag

SEQ ID NO: 208651 - DNA, 135 bp, Artificial Sequence
  Description of Artificial Sequence: Synthetic coding sequence
atgagcgacaagcccgacatggccgagatcgagaagttcgacaagagcaaactaaagaaaactgaaacgcaggagaagaatccccttccatcaaaggagacaattgagcaggagaagcaagccggcgagtcctag

SEQ ID NO: 208652 - DNA, 135 bp, Artificial Sequence
  Description of Artificial Sequence: Synthetic coding sequence
atgagcgacaagcccggcatggccgagatcgagaagttcgacaagtctaagttgaaaaaaacagaaacccaagagaagaaccccctcagctcaaaagaaaccattgagcaggagcgccaggccggggaatcatag

SEQ ID NO: 208653 - DNA, 1299 bp, Artificial Sequence
  Description of Artificial Sequence: Synthetic coding sequence
atgggccccgccggcagcctgctgggcagcggccagatgcagatcaccctgtggggctccctcgccgccgttgctatcttctttgtcattacattcctgatctttctttgctcgagctgcgatcgagagaaaaaacccagacagcactcaggcgaccatgagaacctgatgaacgttccctctgataaagagatgttttctaggagtgtgacgagcctcgccaccgatgctcctgccagcagcgagcaaaatggagctctgaccaatggggatattctaagtgaggactcaacgctaacctgtatgcaacactatgaagaagtgcaaacttctgctagcgatctccttgattcgcaggattcaacgggcaagccaaagtgccaccagtccagagaactgccccgcattccacccgaatcagccgttgacaccatgttgactgcgcgttctgtcgacggcgaccaggggcttggtatggagggcccttatgaagtgctcaaagacagcagctcccaagagaatatggtcgaggattgtctgtacgaaacggtgaaggagattaaggaggtcgcagccgccgcccacctcgagaaggggcattccgggaaagctaaaagcacgtctgcctctaaagaactgcccggcccccagaccgagggcaaagctgaatttgccgaatacgcctctgtggaccgaaataagaagtgccgtcagtcagtgaacgtggaatctatactggggaattcttgcgatcccgaggaagaggctccccctcctgtgcccgtgaaactactggatgagaatgagaacctgcaggaaaaagaaggcggtgaggcggaggagtcggccacggacaccacatctgagaccaataaacgcttttccagcctctcctataagtccagggaggaagaccctactctgaccgaagaagaaataagtgctatgtacagctccgttaacaaaccaggccagctcgtaaataagtccggtcaaagcttgaccgtgccagagtctacatatacgtctatacagggcgacccccagcgcagcccaagtagctgcaacgatctatatgccacagttaaggatttcgagaaaactcccaacagcacccttcccccagctggtcgccctagcgaggaaccagagcccgattacgaagctatacagacgctaaatagggaggaggaaaaggctaccctgggtactaatgggcatcatgggctggtgcctaaggaaaatgactatgaaagtatcagtgaccttcaacagggccgggatatcacccgtctctag

SEQ ID NO: 208654 - DNA, 8136 bp, Artificial Sequence
  Description of Artificial Sequence: Synthetic coding sequence
atggccctggtgctggagatcttcaccctgctggccagcatctgctgggtatcagctaatatatttgaatatcaagttgacgcccaaccactgagaccttgtgagcttcaaagggaaactgctttcctcaagcaggctgattacgtccctcaatgcgcagaggatggtagtttccagaccgtgcagtgtcagaacgatggccgatcatgctggtgtgtgggggctaatggaagcgaggtgttgggctcccgacaacccggtagaccagtggcgtgtttgtccttctgtcagctccaaaaacagcaaatactcctgtctggatatattaactccacggacacatcctacctgccccagtgccaggatagcggggattatgcaccagtgcagtgtgacgtgcaacaggtgcaatgttggtgcgttgacgctgaaggaatggaagtttacggcacccgccagctgggaagaccgaaaaggtgcccccgatcttgcgagattcggaatcgtcgtttactgcacggagtaggcgacaaaagtcccccacagtgttccgccgagggagaattcatgcccgtgcaatgcaagtttgtcaacacaactgacatgatgatcttcgacttagtccactcttacaatcggttccccgacgcatttgtgacattttcgagctttcaaaggaggttccccgaagtgagtggttactgtcattgtgccgactcccaagggagggagctggccgaaacaggactagagctcctgctcgatgagatatatgataccattttcgcgggcctcgatctgccctctaccttcacagagacaacactgtaccgaatcctgcagaggaggttcctggctgtgcaaagcgtgatctctggtcgcttccggtgccctaccaagtgtgaggtggagagatttaccgccaccagttttgggcacccgtatgtaccctcatgtagacggaatggagactaccaggcagtacaatgccagaccgagggaccctgttggtgtgttgacgctcaaggtaaagaaatgcacgggacccgacaacaaggtgagcctccaagctgtgccgaaggtcagtcatgtgccagtgaacggcagcaggccctctcacgtctttacttcgggacatccgggtacttctctcagcatgacctgtttagctcaccagagaagcgttgggcttcgcccagagtcgcacgcttcgcaacctcctgtcctcctaccatcaaagaactgtttgtggactcaggcctactgagacctatggtggaaggacaatcgcaacaatttagcgtgagcgagaacttgttgaaggaagctatacgcgccatctttccctcacgaggactcgccagacttgctttacagtttacaactaatccaaagaggttacagcagaacctgttcggtggaaaatttctggtgaatgtgggacagttcaatctctccggtgccctgggtacccggggcacctttaacttttctcagttctttcagcagctgggtcttgcatcgtttctcaatgggggccggcaggaggaccttgctaagcccctatccgttgggctcgactctaactcaagcacaggcacacccgaagcagcgaagaaagacgggaccatgaataagcccacggtggggagctttggtttcgaaattaacctgcaagaaaaccagaatgcactgaagttcttggcctccctactagagttgccggagttcctgctcttcctgcagcacgctataagtgtccctgaagacgtggcacgagacctgggggatgtgatggagactgttttgagttcacagacgtgtgaacaaactccagagcggctcttcgtacctagttgcacaacagagggcagttacgaagacgtgcagtgttttagcggggagtgctggtgtgtgaactcctggggcaaagagctcccggggtcacgcgtgcggggaggccagccacggtgccctaccgattgtgaaaaacaaagggcccggatgcagagcctgatgggttctcaaccagccgggtcaaccctgtttgtgcctgcttgcacgtcagagggacatttcttgcctgtgcaatgctttaactcggagtgttattgcgtagatgccgaggggcaggcgatccccgggacgcggagcgccattggcaagccaaagaagtgtcccactccctgccagctgcagagcgaacaagcttttcttcgaacagtccaggctctgctttccaacagctcaatgttgccaactctcagcgatacatacatcccacagtgttcgaccgacggacagtggaggcaggtacaatgtaatggccctcccgagcaggtgtttgaactctaccagcgttgggaggctcagaacaagggccaggacctgacgcctgccaagctattggtcaagataatgtcatacagagaagcagcctctggcaacttttcactgttcattcagtctttgtatgaggccgggcagcaagacgtattccccgtcctgtctcagtatcctagcctccaggacgtcccgctcgcggccctggaggggaagagaccccagccacgcgagaatatcctgcttgagccctacctgttctggcagattctgaatgggcagctctctcaataccctggctcctactctgatttctccactcctctggcacacttcgacctcagaaattgctggtgtgtggacgaagccggacaggaacttgagggcatgcgctctgaaccttcgaagcttccgacatgcccggggagctgtgaagaggcaaaacttcgcgtgttgcagttcatccgcgaaaccgaggagatcgtgagcgctagtaattcatcaaggtttcctctcggtgagtcgttcttggttgccaaaggtattcggctgaggaatgaagatcttggcctgcctcctctgtttcctcccagagaagcattcgccgagcaatttcttcggggttcagactacgctattaggctggcagcacagagtacgctttccttttatcagcgccggaggttctcacccgacgatagcgccggagcctccgcgctgctacggtcaggcccctacatgccacagtgcgacgcctttggctcctgggagccagtacagtgccatgcaggcactggacattgttggtgtgtcgatgagaaaggcggctttatcccggggagcttgaccgctcgatcactgcagatcccacagtgcccgacgacgtgtgagaaaagccgcacctccgggctcctgagttcgtggaagcaggcccgaagccaggagaaccccagccctaaggatctgttcgtgccggcttgtttagagacaggcgagtacgcacggcttcaggcgagcggcgcaggaacatggtgcgtggatcccgccagtggcgaagaactgaggccaggctcatcttcaagcgctcagtgcccctcactctgcaacgtactgaagtcaggcgtgctttctagaagggtctccccaggctatgttcccgcctgccgcgctgaggatggcggtttttctcctgttcaatgtgatcaggcccagggtagttgttggtgtgtcatggactctggggaggaggtcccaggcacccgcgtaaccggtggtcaacctgcgtgcgaatcccctaggtgtcctctccccttcaatgcaagcgaggtagtgggcggaactatcttgtgtgaaaccatctcgggacctaccggctctgccatgcagcaatgccagctgctttgccgccagggctcctggagtgtgtttcccccaggtccactaatctgctcactcgagagtgggcggtgggagtcccaactcccacagcctagggcttgtcaaaggccgcagttgtggcaaaccatccagacgcagggtcacttccagctccagctgccccctgggaaaatgtgctcggccgactatgctgatttgctccagacgtttcaggtgtttattctggatgaattgacagcccggggtttttgtcagatccaggtgaagacgttcggaactttggtgtctattcccgtctgcaataacagtagcgtccaggtcggatgcttgacccgcgagagattgggcgtgaacgtgacctggaagagcaggcttgaggacattcccgtggcatccttgccagacctccacgacatcgagcgggctttagtgggtaaggatttgctcggccgctttacggacctcatccaatccgggagcttccaacttcatctggacagcaaaacttttcctgctgagacaatccgcttcctgcagggtgaccattttgggacatcaccacgtacctggtttgggtgctctgagggattttatcaggtgctaacctctgaggcctcccaggacgggcttgggtgtgtgaagtgtccggaaggatcatactctcaggacgaggagtgcattccctgccccgtgggcttctaccaagaacaggccggatcactcgcctgtgtgccctgccccgtagggcgcacgacgatttcagccggcgcttttagtcagacccacctgatgcagaaattcgagaaggttcctgaaagcaaggtgatatttgatgcgaacgcacctgtcgcagttagatcgaaggtgcccgacagcgaatttcctgttatgcagtgcctcacagattgcactgaagacgaagcctgttctttttttacagtgagcacaaccgagccagagattagttgcgacttttacgcctggacaagcgacaatgtcgcttgcatgacaagcgatcaaaaacgcgacgcccttggaaactccaaagccacgagtttcggcagtctccgttgccaggtgaaagtgagaagccacggacaggattcccccgctgtctacctgaagaagggacagggttctacaactacgctccagaaaagattcgagcccaccggcttccagaacatgctgagtgggctctacaatcccatagtatttagcgcttccggtgccaacctaaccgatgcccatcttttttgcttgcttgcttgtgatagggatttgtgctgcgacgggtttgtcctcacacaggtgcaagggggagctataatttgcggcctcctctccagtccatccgtgctactctgcaatgtgaaagattggatggacccgtctgaggcctgggctaacgctacctgtcccggtgtcacctatgaccaagagtctcaccaggtgatccttcgcctgggcgatcaagagtttataaaatctcttactccgctggaggggactcaggacacgtttactaatttccaacaggtgtatctgtggaaagactccgacatgggtagtagacctgagagtatgggatgtaggaaggatacagttcctcggccagccagcccgactgaggcaggtcttacaaccgaacttttctccccagtggatcttaatcaagtcatagtgaacggaaatcagagtttgagttcacagaaacactggctcttcaagcacttgttctcggcccaacaggcaaatctctggtgcctgtctcgttgtgtgcaggagcatagcttctgtcagctcgcagagatcacggaatcagcttcactgtacttcacatgcacactctacccggaagcccaggtgtgcgacgatattatggaaagcaatgcccagggctgccgcttgattcttccccaaatgcctaaagctctgttcagaaagaaggtgatcctcgaagacaaggttaagaacttttataccaggctgccatttcagaagctgatgggaatcagtatccggaacaaggtgcccatgtcggagaaatccattagcaacgggttcttcgaatgtgagcgtaggtgtgatgctgacccttgctgtactggcttcggctttcttaacgtttcacagctgaaggggggagaagtcacctgtctcacattaaactctctaggaattcaaatgtgctccgaggagaatgggggcgcgtggcgtatcctcgattgtggcagccctgacattgaagtgcatacttacccctttggctggtatcagaagcccatcgcccaaaacaatgcaccaagcttttgtcctctggtcgttcttccctccttgactgagaaagtcagcttggatagctggcagtctctggcattgtcctccgtggtggtggatccatcgatcagacactttgacgtcgctcatgtgtcaacagccgctacatcgaacttttctgcggtgcgtgatctgtgtttaagcgagtgttcacagcacgaggcgtgcctcattaccaccctccagactcaaccaggagccgtgaggtgcatgttctacgccgatacacagagctgcacccacagtctccagggacaaaactgtcggctgctgctcagggaagaggccacccacatctacagaaagcccggcattagcctattgtcttatgaagccagtgtcccttcagtccctatctctacacacggcagattactcggccgttctcaagctatacaagtggggaccagttggaaacaggtggaccagttcctgggcgtgccttacgccgcccctccacttgccgagagacggtttcaggccccagagcccttgaattggactggctcatgggatgcttctaagccacgcgccagctgttggcagccagggacccggacctccactagtccaggagtatctgaagactgcctttaccttaatgtgttcatcccccagaatgtggcccctaacgcgagcgttctggtgtttttccacaacacaatggatagggaagagagcgagggatggccagcgatcgatggcagtttccttgcggcggtaggcaacttgattgtggtaacggcaagttacagggtgggcgtctttgggttcctgtcatcggggtcaggcgaggtatcaggaaactggggtctcctggaccaagtggccgcgttgacttgggttcaaacccatatcaggggattcggcggtgacccccggagagtgtcacttgcagcggaccgtgggggtgctgatgtggccagcatccaccttctcaccgcccgggcgactaatagccagttgtttcggagggcagtcctgatgggagggagcgccctgtcacccgccgctgtgatatcccacgagcgcgcccaacagcaagctatcgccctggctaaagaggtctcttgccctatgtctagttcccaagaggttgtttcatgcttaagacaaaaacccgctaacgtgctcaatgacgcccaaactaagctccttgccgtgtctggaccatttcattattggggccctgttatcgacggccactttctcagggaaccgcccgcgcgcgccctcaaacggagcctgtgggtggaggttgatcttcttattgggtcttctcaggacgatggcttgattaatcgcgctaaggcagttaaacagtttgaggagagtcggggcaggacatcttcgaagactgccttctaccaggcactacaaaactcactcggtggggaggactcggatgcacgagtggaggctgccgctacatggtactatagcctggaacatagcacagacgattacgcaagcttttctagagctctcgagaatgcaaccagagattactttattatttgccccatcatcgacatggccagcgcctgggcaaaacgggctcggggaaatgtttttatgtaccacgcccccgagaattatggacacggcagcctggagttactcgcagatgtgcagtttgcactcggtttaccattctatccagcatatgagggccagtttagtttagaagaaaagtcactgtcactcaagatcatgcagtatttctcacactttatcagatctgggaaccccaactatccatatgagttcagcaggaaggtgcccacgttcgctaccccctggcctgatttcgtcccacgcgcgggcggggaaaactacaaagagtttagtgagttgcttcctaatagacaaggtctgaagaaagcagattgctctttctggagcaagtacatatctagcctgaaaacatccgctgatggcgccaaaggagggcaatcggccgagtcagaagaagaggaactgacggctggatctggactgagggaggacctcctgagcttacaagaacccggcagcaagacctactccaagtag

SEQ ID NO: 208655 - DNA, 2664 bp, Artificial Sequence
  Description of Artificial Sequence: Synthetic coding sequence
atggccctggtgctggagatcttcaccctgctggccagcatctgctgggtgagcgccaacatctttgagtatcaagtggatgcccagcctctgaggccctgcgagcttcaaagggagacggcctttctgaagcaggccgactacgtgccccaatgtgccgaggacggaagtttccagaccgtacagtgccagaatgacggtcgcagttgttggtgcgttggcgccaacgggagcgaggtgttaggctctaggcagcccggtcgccctgtagcctgcctgtccttctgtcaacttcagaaacagcagatactgctcagtggctatattaactctacagacacttcgtatttgcctcagtgtcaggattccggcgactatgccccagtgcaatgtgacgtgcaacaagtgcaatgctggtgcgtggacgcagaaggaatggaagtgtacggtactcggcagcttggtcggccaaagagatgtcctcgctcgtgtgaaatccggaaccggagactgctccacggggtgggcgataaatccccgcctcagtgctccgcagagggagagtttatgcccgtgcagtgcaagttcgtcaacacaactgacatgatgatcttcgacctggtacatagttataacaggttccccgatgcgtttgttacgttttcttcgtttcaaagaagattcccagaggtaagtgggtactgtcactgtgccgattcgcaggggcgggaactggccgagacaggcctggaactgctgctcgatgagatctacgataccatctttgctggcctcgatctcccatctacctttaccgagaccactctttataggatattacagcgcaggttcctggcggtccagtctgtgatctctgggaggttccggtgccctacaaagtgtgaggtggagcgctttaccgcaacctccttcgggcatccctatgtaccatcatgtagaagaaacggggactatcaagcagtccagtgtcaaaccgagggcccatgctggtgtgtggacgcacaaggcaaggagatgcacggcactaggcagcagggtgagccacccagctgcgctgaagggcagtcctgtgccagcgaaagacagcaggccctgagtcggttgtacttcgggacaagcggttacttttcgcagcacgatctcttcagctcacccgagaaaagatgggcgtctcctcgagtcgctagattcgcaactagctgcccccccacgattaaagaactttttgtcgattccggtttgctgaggcccatggtagaaggccagtcacagcaatttagcgtgagcgagaacttactaaaggaggccattcgggcgatcttccccagccggggactcgccaggctcgcgctgcagtttaccacgaaccccaagcgactgcagcagaatctctttgggggaaaatttttagtgaatgtcggacagtttaacctgagtggtgcactcggaactagaggcacattcaatttctcccaattcttccagcaactgggtctggccagcttcctaaatggcggccggcaagaagatctcgcgaaaccattaagtgtgggtctggatagcaactcaagcaccggcacccccgaggccgccaaaaaagatggcacgatgaacaaacccaccgttgggtcattcggattcgagatcaatctacaggagaatcagaacgccttgaagttccttgcttccctgcttgagcttcctgagtttctccttttccttcagcatgccatcagtgtacctgaggacgttgcacgagacctgggggatgttatggagaccgtactatcttctcagacctgcgagcagacacctgagcggctgtttgtccctagttgcaccacggagggctcgtacgaagatgtgcagtgcttttctggcgagtgttggtgcgtaaactcctgggggaaggaactcccagggagtagggtacgaggcggacagccgcggtgtccaacagactgcgaaaaacagcgggcccggatgcaatcccttatgggatctcagccagccggcagcactctgtttgtgcccgcctgtacaagcgaggggcatttcctgcccgtgcagtgctttaactccgagtgttattgcgtggacgcagaagggcaagctatcccgggtacgaggtcagctattgggaagcctaagaagtgtccaacaccctgccagctgcaaagcgagcaggcttttctgaggactgtacaggccctcctgtccaactcatcgatgctccctacactgtctgatacctacgaagggcaatttagcctggaagagaagagcctcagcctcaaaatcatgcagtacttttcacacttcataagaagcgggaatcccaattatccgtacgagttctccagaaaggtcccaaccttcgccaccccctggcccgattttgtaccaagggccggcggcgagaactataaggaattttccgaacttctgccaaacaggcagggcctgaagaaagccgattgtagcttctggtcgaagtacatctccagccttaaaacatctgccgacggcgccaagggcggccaatccgccgagtccgaggaggaggagcttactgctggctccgggttgcgtgaagaccttctttctctccaggaaccgggatcaaagacctactccaagtag

SEQ ID NO: 208656 - DNA, 3417 bp, Artificial Sequence
  Description of Artificial Sequence: Synthetic coding sequence
atgatgcagaagttcgagaaggtgcccgagagcaaggtgatcttcgacgccaatgccccagtggccgttcggtctaaagtacccgactctgaatttccagtgatgcagtgtcttactgactgcaccgaagatgaagcatgctcattttttaccgtgtcaaccacggagcctgagatttcatgtgacttttacgcttggacgtcggacaatgtcgcctgcatgacatccgatcagaagagggacgctctgggcaatagcaaagccaccagctttggatcattgagatgtcaggtaaaggtccgatctcacgggcaagacagcccagctgtttatctaaagaagggagccatcatatgcggtcttttgtcatccccaagcgtgttactctgtaatgtcaaggactggatggatccttctgaggcatgggccaatgcgacatgtcccggtgtgacctacgaccaggaaagtcaccaggtgatcctgagactaggagaccaggagttcatcaagagcctgacccctctggagggaactcaggacacatttactaactttcaacaggtgtatctgtggaaagattcagatatgggctcacgacctgaatccatggggtgccgaaaggacactgtccctcgccctgcctccccaactgaagcaggcctcactacagagctcttttcacctgtagatctgaatcaggtcattgtaaacgggaaccaatcactttcgtcccaaaaacattggttgtttaaacatctgttttccgcgcagcaagctaatctgtggtgcctctctcgctgcgtacaggagcacagcttttgccagttggcagagataacagaatctgctagtctttactttacttgtaccctttacccagaggctcaggtatgcgacgacatcatggaaagcaatgcacagggctgtcgcttaatcctcccacagatgccgaaagcccttttcagaaagaaggtgatcctcgaggacaaagtgaagaatttttacacccgcctccccttccaaaagttaatggggatttctatacgcaataaggtccctatgagtgagaaatctattagcaacggattcttcgagtgcgaacgcagatgcgatgccgacccatgttgcactggcttcggcttcctcaatgtgtcacagctaaaagggggggaggtaacatgtctcaccctgaatagtcttggtatccagatgtgctccgaagaaaacggcggcgcttggaggattctggactgtgggtcacccgacatcgaggttcatacctatccctttgggtggtaccaaaagcccatagctcagaacaacgcgcctagcttctgccccctcgtggtgctccctagcctcaccgagaaggttagcctggactcttggcaatctctcgctctgagctctgtagtagtggacccctctatcagacactttgacgtagcgcatgtctctacagcagccactagcaatttttccgctgtgagagatttgtgtctgtctgagtgctcacagcacgaggcgtgtctcatcacaaccttgcaaactcagcctggagccgtgcggtgtatgttttacgccgacacccaatcttgtacacacagtctgcagggccagaactgccgcctcctgcttagggaggaggcgacccacatctaccggaaacccgggatctctctgctcagttacgaagcctcggtccctagcgtgcctatttctactcacggccgcttactaggtaggagtcaggcaattcaggttggcacctcctggaagcaggtggaccagttcctgggcgtgccgtacgcagccccccctctcgctgagcgccggttccaggctcctgagccattgaactggacaggttcctgggacgcaagtaagccgcgtgcaagctgctggcagcctggcacccgcacctcaacttctcctggggtgagcgaggactgtctgtatcttaatgtgtttattccccaaaatgtggccccaaatgcatctgtgctcgttttctttcataataccatggacagagaagagtcggagggatggcccgcaatcgacggctcattcctggccgccgtcggaaaccttatcgtggtaacggcctcctaccgcgtgggcgtgttcggttttcttagcagcgggagcggagaagtgtcaggtaattggggcctgcttgatcaggttgccgcactcacatgggtacaaacccatatcaggggttttggaggtgatcctagacgcgtgtctctggcagcggatcggggcggggccgatgtggcctccattcatctgcttacagctagggccacaaactcccagctcttccggagggcagtgttaatggggggttctgccctttcacccgcagctgttatttctcacgaacgggcacagcaacaagctatcgccctggccaaagaggtctcatgtcctatgtcaagctcacaggaggttgttagctgtctgagacagaagccagccaatgtcttaaacgatgcacagacaaagttgctggccgtcagcggcccgtttcactactggggcccagtaattgacgggcacttcctaagagagccccctgcacgggcgctcaagagatcactgtgggtggaggtagatctgctgatcggatcttcccaggacgatgggctaattaaccgcgctaaagcagttaagcagtttgaagagtctcgaggaaggacatcaagcaagaccgctttctatcaagccctccagaatagtttgggaggggaagattcggatgcacgtgttgaagcggccgcaacctggtactactccttggagcattccaccgatgactacgcctccttttcacgtgctctagagaacgctacacgggactatttcatcatttgccccataatagacatggcatcagcctgggcaaagcgagctcgggggaatgtatttatgtaccacgctcctgagaattatggccatggcagtctggaactcctcgccgacgtgcagtttgcactcggactgcctttttaccccgcttacgaaggacaattttctctcgaggaaaaatcgttgagtcttaagattatgcaatactttagtcactttatacggagtggaaatcctaactacccctatgagttctcgcgcaaggtgcccacgttcgcaacaccctggcctgattttgttcctcgagccggcggcgagaattataaggaattttcagagctgctgccaaatcggcaaggtctcaagaaagccgactgtagcttctggtcaaagtacatctccagcttgaagacttctgctgatggtgctaaaggaggacagtccgcagagagcgaggaggaggagctgaccgctggcagtgggctccgcgaggatctgctctctttacaggaacctggttctaaaacgtacagtaaatag

SEQ ID NO: 208657 - DNA, 4725 bp, Artificial Sequence
  Description of Artificial Sequence: Synthetic coding sequence
atcccccggaagcccatcagcaagcggcccgtgcggcccagcctgccaagatctccgcggtgtcctctgcctttcaacgcttcggaagtcgtgggcggtaccatcctttgcgagaccatctcagggcctacagggtcagcaatgcagcagtgtcagctactctgtaggcagggatcctggtccgtgtttccccctgggcccctcatctgcagcctcgaaagcggccggtgggaaagccagctgccacagccgcgagcttgccaaagaccccagctttggcaaaccatccagacacaggggcacttccagctccagctgccacccggaaaaatgtgttcggccgattacgccgacctgttacagacgtttcaagtcttcatactggacgagcttacggctagaggattttgtcaaatccaggtcaaaacttttgggaccttagtgtccataccagtgtgcaataatagctccgtccaggtcggatgcttgactcgggagcgccttggggtcaatgtgacctggaaaagtaggctggaggatattcccgtcgcctctttgccagatctgcatgatatcgagcgggctctggtgggaaaagatctactgggacgtttcacggaccttattcagagcgggtcctttcagctgcatttggacagcaagacctttcccgccgaaacaattcggttcctacagggagaccacttcgggacctctccacgaacatggtttggatgtagtgaagggttttatcaggtgctgacctcagaggcctcgcaagacggactggggtgcgtcaagtgtcctgagggatcttattcacaggacgaggagtgtatcccatgtccagtcggattttaccaggagcaggctggctcactcgcatgcgtcccatgccctgtaggaagaaccaccattagcgctggtgcatttagccagacgcactgcgtgacagactgtcagagaaatgaggctggactccagtgtgaccagaatggtcagtatagggcttctcagaaggatagaggatccggcaaggcgttctgcgtcgacggggaaggcaggcgcctaccctggtgggagacagaagctcctctggaagatagccaatgtctaatgatgcagaagtttgaaaaagtccccgagagcaaagtaattttcgacgctaatgctcccgtggccgtgcgctcgaaagtgcctgattcagagtttcccgtaatgcagtgcctgaccgattgtacggaggacgaagcttgctcgttttttactgtatccactaccgagccagaaatctcctgtgacttttatgcatggacatcagacaatgtcgcttgtatgaccagtgatcagaagcgggatgccctgggaaattcaaaggccacttccttcggaagcctccgctgtcaagtgaaggtgcgcagtcatggacaggattcaccagcagtgtacttgaaaaaaggccagggctcaaccaccaccctccagaagcgattcgagccaaccggcttccagaacatgttgagcggactgtacaaccctattgttttcagcgcatcaggcgcaaatttgaccgacgcacacctgttttgtctgttagcttgtgatagagatctttgctgcgatggatttgtgcttacccaggttcaaggaggggctattatctgcggcctgctatctagtccatctgtgctgctgtgtaacgtaaaagactggatggatccttcagaggcttgggccaatgcgacctgcccaggagtgacttatgatcaagagagtcatcaagtcatcttgaggctcggggaccaggaattcatcaagtccctgactcctttagagggtactcaggatacctttactaatttccaacaggtgtacctttggaaagattcagatatgggcagccgccccgaaagtatgggttgccgcaaggacactgtgcctcgacctgcctcaccaactgaagcgggattgaccaccgaactgttctctccggttgatttaaaccaagtgatcgtgaatggcaaccagagcctgtcttcccagaaacactggcttttcaaacatctcttttccgctcagcaggccaatctttggtgtctgtcacgttgcgtacaggagcactccttttgtcagcttgcagagatcaccgagtcagcttctctgtacttcacctgtaccttataccctgaagcccaggtttgcgacgatatcatggagagcaacgcccagggctgtagactgatattacctcaaatgccgaaggccttattccggaaaaaggtcatcctcgaagacaaggtaaagaatttttacaccaggcttcccttccaaaagcttatgggaatctctatccgtaataaggtgccaatgtctgaaaagtcaatatcgaatggctttttcgaatgtgagagaaggtgtgatgctgatccttgctgcactggcttcggtttcttaaacgtgagtcagctcaaggggggggaagtgacctgtcttactctgaacagcctcggaattcagatgtgttcggaggaaaacggtggcgcctggcgaatcctagattgcggatcacccgacatcgaggttcacacatacccgtttggttggtatcaaaagccaatcgcccagaacaacgcaccatccttctgtccacttgtggtcctgcctagtctgaccgagaaagtcagtctggacagctggcagtcgctggcgctctcatccgtggtggttgatccttccattcggcatttcgacgtagcccatgtgagcaccgccgccacctcaaacttctctgccgtacgtgacctgtgcctttccgagtgctcccagcacgaggcctgccttatcacaaccttacagacacaacctggggctgtgagatgtatgttttatgcggacacacagagctgcactcacagcctgcaaggacagaactgccgactgcttctccgagaagaggcgactcatatatacagaaaaccggggatctctcttctctcttacgaagctagcgtaccttctgttcccatctccacgcacggccgactgctgggccgctcacaggccatccaggtggggactagctggaaacaggtcgaccaatttctcggggtgccatacgcggctccacccttggccgagcgccggtttcaagcacctgaacctctgaattggactggttcatgggacgcgtcaaaaccccgtgcgtcatgttggcagcccggcacccgtaccagcacctccccaggtgtgtccgaggattgtctttatttgaatgtattcatccctcagaacgtcgctcctaacgcttctgttctcgttttttttcataacacgatggatagggaggagagtgagggctggccagcgatagacggctcatttctggcagccgtgggcaatcttatagttgtgaccgcctcatatcgcgtcggcgttttcggcttccttagttcaggaagcggcgaggttagcggcaattgggggctcctcgatcaggtagctgcgttaacctgggtccaaacacatatccgcggattcggcggggatccccgccgcgtatccctcgccgctgaccgtggcggcgcggatgtcgcctccatccatctgttgaccgcccgggcaacaaacagccaattgttccgtagggccgtcttgatggggggcagcgctttgtcccccgccgcggtgatctctcacgagcgcgctcaacagcaggctattgcgctggcaaaagaagtgagctgtcccatgtcgtccagccaggaagtggtttcgtgtttgcggcagaagccagccaatgtattgaatgacgcccagactaaactcctggccgtgtcggggccatttcactactggggacctgtcatcgacggccacttccttcgggagccccccgcccgcgccctgaaacgttctctgtgggtggaggtagatctcttaatcgggtcctcacaagatgacgggctgatcaatcgagccaaagccgtcaagcagttcgaggagtccaggggcagaacttcatccaagaccgccttctaccaggctctgcaaaacagtttgggcggtgaggactctgacgccagagttgaagcagcagcaacttggtactattctctcgagcacagtactgacgactacgcctccttttcacgggccctggagaatgccacaagggattatttcatcatctgtcccataatcgatatggcctcagcctgggccaagagggcccgcgggaatgtgttcatgtaccacgcacccgagaactacggtcacggcagcctggagcttctcgctgacgtacagttcgcactgggtcttccattttatccggcctacgaaggacagttcagcttagaagagaaatcactttccctgaaaattatgcagtattttagccacttcatacggtctggaaatccaaactacccatacgaattttctcggaaggtccccaccttcgcaacgccgtggcccgattttgtgccacgtgcgggaggagaaaactataaagaattcagcgagttgttacccaatcgacaggggttgaaaaaggctgactgctcgttctggtccaagtatatatccagcctcaaaacatccgccgacggtgcgaaggggggtcagagcgcagagtctgaggaggaggaactcactgcaggatccggtcttcgggaggacctgctgagtctgcaggagcctggctcaaaaacttattcaaagtag

SEQ ID NO: 208658 - DNA, 1356 bp, Artificial Sequence
  Description of Artificial Sequence: Synthetic coding sequence
atggagcagaagcccagcaaggtggagtgcggcagcgaccccgaggaaaactctgctaggtcccccgatggaaaaagaaagagaaagaacggacagtgcagcctcaagacgtccatgagtggttatattccaagttaccttgacaaggacgaacagtgcgtagtgtgcggcgacaaagcaaccggctaccactataggtgcataacatgcgagggctgtaaggggttcttccgacggactatccagaagaatctgcacccaacatacagctgcaagtacgactcttgctgtgtgatagacaagattacacgcaatcagtgtcaattatgccggtttaagaagtgtatcgccgtggggatggccatggacttggtgctggacgatagcaagagagtggccaagaggaagctgatagagcaaaatcgggaaagacgcagaaaagaagagatgatcaggtccctgcagcagaggcccgagcctacccccgaggaatgggacctcatccacattgccaccgaggctcacaggtcaaccaacgctcagggctctcattggaagcagcggagaaagtttctcccagacgatatagggcagagccctattgtatcaatgcccgatggggataaagtcgatctggaagcattctcagagtttacaaagatcatcacccccgctatcacccgggtagtagattttgctaaaaagctccccatgttctctgagttaccatgtgaggaccaaatcattctcctaaagggatgctgtatggagataatgtccctgagggcagccgttaggtacgatcctgagagtgacacattgacactctccggagagatggccgtgaagcgggaacagctcaaaaacgggggattgggagtggtgtccgacgccatctttgagctgggaaagagcttatccgcgtttaatcttgacgatacggaggtcgcattgctgcaagctgtgctgcttatgagtaccgaccgttctggactgctctgtgtcgacaaaatcgagaagagtcaggaggcctatctgttggcatttgaacattatgtgaatcacaggaaacacaacattccccatttctggccaaagctgctcatgaaagggcctcaagtgagacagcttgaacagcagctgggagaggccgggtcgttacagggcccagtcctgcaacatcagagtccaaagagcccccagcagcggttactggagctattacatcggagcgggattctgcatgcccgcgcagtgtgcggggaggatgatagttcagaggccgactctccgagctcatccgaagaggagcccgaggtttgcgaggatctcgcagggaacgcagcaagtccgtag

SEQ ID NO: 208659 - DNA, 5940 bp, Artificial Sequence
  Description of Artificial Sequence: Synthetic coding sequence
atgagcagctggctgggcggcctgggcagcggcctgggccagagcctgggtcaagtgggaggcagcctggcaagtctcactggccagatcagcaattttacaaaggacatgctgatggagggaactgaagaggtggaggccgaattgcctgactctcgcacaaaggagatagaggccatccacgccatcctgcgatcggagaacgaaagattaaagaaactctgtactgacttggaggagaagcacgaggcttccgagattcagatcaagcagcagagcacgagctataggaatcagctacagcagaaagaggtcgaaatttcccatctgaaggcccggcagatagccttgcaggaccaactgctaaagctccagtcagccgcgcagtctgttcccagtggcgctggagttcctgcgacaacagcttcgtctagttttgcatacgggatatcacaccacccaagtgcctttcacgacgatgacatggacttcggcgacatcatttcgtctcagcaggaaatcaatcggctgtccaacgaggtgtctaggttggagtccgaagtcggtcactggcgtcacattgcccaaacctctaaagcccaagggacggacaacagtgaccaatccgagatttgcaagttacagaatattatcaaggagctgaagcagaaccggtctcaggaaattgacgatcatcagcatgagatgagtgtcttacagaatgcccaccagcaaaaattaacagagatctccagacgtcacagagaagagctgagtgattatgaggaaaggattgaggagctcgagaacctgctgcagcaaggaggctccggagtgattgaaacagacctgtccaaaatttatgaaatgcagaagacgatacaggtgttgcagattgaaaaggtagaatccacgaagaagatggaacagcttgaagacaaaataaaagatatcaacaagaaactgtccagtgcagagaacgatcgcgacatcttgagacgggaacaggaacagctgaacgtggaaaagagacagattatggaggagtgcgaaaacctcaaactcgagtgtagcaaactgcagccaagcgcagttaagcaaagcgatactatgaccgaaaaagaaagaatattagcacagagcgcatctgttgaggaggtgtttaggctccagcaagccttgtccgacgccgagaatgagatcatgcggcttagtagcttgaaccaggataactctctagccgaggataatttaaagctaaaaatgcggatagaggtgctcgaaaaagagaaatccctgctgagtcaggagaaagaagagttacagatgtccctgctgaagttgaataacgaatacgaggttattaaatccactgccacccgagacatttccttggatagcgagctccacgacctgagattgaaccttgaagctaaggagcaagagctgaaccagtctatatcggaaaaggaaaccctgatcgctgagattgaagagcttgaccggcagaaccaggaggcgacaaaacatatgatcctcattaaagatcagctgtctaaacagcagaatgagggggatagtattatttctaaactgaaacaggacctgaacgatgagaagaaaagagtccatcaattggaagatgataaaatggatattacaaaagaattggacgtccagaaggagaaactcatccagtctgaagtggcactgaacgaccttcatctgacgaagcagaagcttgaagacaaagtggagaacctggtcgatcagcttaataaatctcaggagtccaatgtgtctatccagaaagagaatctggagctaaaagagcacatacggcaaaatgaggaagagttgtcccgcatccggaacgaattaatgcaatccctgaaccaggatagcaattccaattttaaggataccctgcttaaggagagggaagcggaagttcgaaacctgaaacaaaacctaagtgagctcgagcaactgaatgagaatctcaagaaagttgcttttgacgtgaaaatggaaaatgagaagttggtcctcgcatgtgaggatgtgcgccaccagctggaggaatgcctggccggcaacaatcagcttagcctggagaaaaacacaattgtggaaacacttaagatggagaaaggcgaaatcgaagctgagctgtgctgggctaagaaaaggttattggaggaagctaacaaatacgagaaaactattgaagagctgagcaacgccaggaacctgaatacgtctgccctccagcttgagcatgaacatctcattaaactgaaccagaagaaagacatggaaatagccgagttaaaaaaaaacatcgagcagatggacacagaccacaaggagacaaaggacgtcttgagctcctctctggaagaacagaaacaactcacccagttgattaataaaaaggaaatctttatagagaagctgaaagagcggagttccaaacttcaagaagaactcgataagtacagccaagctctgagaaaaaatgagatacttcggcagactatcgaagagaaggaccgctctctcggcagtatgaaggaggagaataatcacctgcaggaggagttagagcggttgcgtgaggaacaatctcgtaccgcgccggtagcagacccaaaaacactcgatagcgtcaccgagctagcctccgaggtgtcccagctgaacacgatcaaggaacatcttgaagaagagatcaagcaccaccagaagatcatcgaggaccaaaaccagagtaagatgcaattattgcaaagcttgcaggagcagaagaaggagatggacgaattcaggtaccagcacgaacagatgaacgccacacatacacagctttttctggaaaaggatgaggagataaagtccctgcaaaagacaattgagcagatcaaaactcagctgcatgaggagcggcaagacatccagacagacaactccgacatcttccaggagactaaggtgcaaagcctcaatattgaaaatgggagtgaaaagcacgatctgtccaaggccgaaaccgagcggctggtgaagggaattaaggaacgggaactggaaataaagctgctaaatgagaagaacattagcctgaccaaacagatcgatcaactgagtaaggatgaagttggtaagctcacacagataattcagcagaaagatctggagatccaggcactgcacgctcggattagtagtacaagccacacccaggatgttgtgtatctgcaacagcagttacaggcctatgctatggagcgtgagaaagttttcgctgtgctgaacgaaaaaaccagagaaaacagtcacctcaagactgaatatcacaagatgatggatatcgtagctgcaaaagaagctgctcttatcaagctgcaagacgagaataagaaactgtctacgagattcgaaagctccgggcaggatatgttcagagaaaccattcagaaccttagtagaatcatcagggagaaggatattgaaatcgatgcattatcccaaaaatgccagaccctacttgctgtccttcaaacctctagcacaggcaatgaagctgggggagttaattctaaccaatttgaggaactgctgcaggaacgcgataagcttaaacagcaggtcaagaagatggaggaatggaagcagcaggttatgaccacagtgcaaaacatgcagcacgaaagtgcccagctccaagaagaactgcatcaattgcaggctcaggtgctcgtcgatagtgataacaattctaagcttcaggtggattacacaggccttatccaaagctacgagcaaaacgaaacaaaactcaagaactttgggcaggaacttgcacaggtgcagcattccattggacagctgtgtaacactaaagatctactcctcggcaagctcgatataatttccccacagctgtcttcggcatctttactcacaccccaatcagccgaatgcctgagagcaagcaaatccgaggtgctctccgagtctagtgaattgctgcagcaagagttggaagagttgaggaaaagtctgcaagagaaggatgcaaccatcaggaccctccaggagaacaaccaccgccttagcgactcaattgcagcaacgagcgagctggaaagaaaggaacacgagcagaccgatagcgagattaagcagctcaaagagaagcaggacgtactacagaagctgttgaaggagaaggaccttctaatcaaagcaaaaagtgaccaactgttaagtagcaacgagaatttcactaacaaggtgaacgaaaacgaactgcttcgccaagccgtcaccaacctgaaagaacgtatcctgattttagagatggatattggcaagctgaagggagagaatgagaaaatcgtggagacttataggggcaaagagactgagtaccaggcattgcaggaaaccaatatgaaattcagcatgatgttgagggagaaggaattcgaatgccactcaatgaaggaaaaggctctcgcgtttgagcaactcctaaaggaaaaggagcagggaaaaaccggagagctgaaccaactgttgaatgccgtgaaatccatgcaggagaaaaccgttgtttttcagcaagaacgcgatcaggtaatgcttgctctcaagcaaaagcagatggaaaacaccgcactccaaaacgaggtgcaaaggttgagagacaaggagttccgatccaatcaggaattagagaggctacgcaaccacctcctggaaagtgaggatagctacactcgagaggcattggctgccgaagatcgggaagccaagctcaggaagaaggtgactgttcttgaggagaagctcgtttcctctagtaatgctatggaaaatgcgagccatcaagcgagtgtgcaggtcgagtccctgcaggagcagctgaatgtggtgagcaagcagagagatgagactgccctgcagcttagcgtctcacaagaacaagtgaagcagtacgccttgtccttagctaatctgcaaatggtgctggaacacttccaacaggaagagaaggctatgtactcagccgaactagagaaacagaaacaactgattgccgagtggaagaaaaatgcagagaatctggagggaaaagttatttcgctgcaggagtgtctggatgaggccaacgccgcccttgatagcgcttctaggttgaccgagcagctggacgtcaaagaagaacagatcgaggagctcaaaagacaaaatgaacttcgtcaggagatgctggatgatgttcaaaagaaactgatgtctctagccaactcaagtgaaggaaaggtggacaaggtactgatgagaaatctgttcattggacattttcatactcccaaaaaccagcgccatgaagtgctaagactgatgggctccattctcggtgtcaggagggaagaaatggagcagctgtttcatgacgatcaggggggggtgactcgctggatgactggctggctcggcggtggctcaaagtccgtgcctaatacgcccttgcggccaaaccagcagtcagtggtcaatagttctttctccgaactgtttgtaaagtttctcgagacggagagccacccctcgattcccccgccaaagcttagcgtgcatgatatgaaacctctcgacagtccaggacggagaaaaagagacacaaatgctccagaaagctttaaggacaccgcagaaagcagaagcggtcgccgcactgatgtaaacccctttctggcgccaaggtcagctgctgtgcccctgattaatccggctggcctaggcccaggcggtccaggccacctgctcttaaaaccaattagtgacgtgctgccaactttcaccccactgccagccctgcctgacaattctgcaggggttgtactcaaggatctgttgaaacaatag

SEQ ID NO: 208660 - DNA, 5148 bp, Artificial Sequence
  Description of Artificial Sequence: Synthetic coding sequence
atgagcgtgctgcagaacgcccaccagcagaagctgaccgagatcagcaggagacatagggaggagttgagcgactatgaggagcggattgaggaattggagaacttactgcagcagggggggagcggtgttatcgagactgacctgagtaagatatacgaaatgcagaagaccatccaggtgctgcaaatcgaaaaagtggaaagcacgaagaagatggaacaattggaagataagattaaagacattaataaaaagctctcttctgccgagaacgacagagatatccttcgacgcgagcaggagcagttaaacgttgagaagaggcagattatggaggaatgcgagaacctgaaattggagtgctctaaactgcagccgagcgcagttaaacaatcagatactatgaccgagaaggagcgcatcctggcacagtctgccagcgtggaagaggtattccgccttcagcaggccttaagcgacgcggagaacgaaatcatgcgcctgagttccctgaaccaagaagaactgcagatgagcttgctcaaactgaataatgagtatgaagtgatcaaaagcacagctacaagagatataagcctggattccgagctccatgatcttcgcctgaaccttgaggctaaagagcaggagctgaaccagtccatctcagaaaaggaaacgttgatagctgaaattgaggaactggatcgccagaaccaggaagctaccaaacacatgatactaatcaaagatcaactcagcaaacagcagaatgaaggggacagcatcatttccaaacttaagcaggacctgaatgacgagaaaaaacgcgttcatcagctagaggacgacaagatggatattactaaagagctggacgtgcagaaggaaaaattaatccagtccgaagtagccttgaacgatctgcaccttaccaagcagaagctcgaggacaaggttgagaacctcgttgatcagctgaataaatctcaggagagcaacgtctcgatccagaaagaaaatctggagctgaaggagcacatacgccagaacgaggaggaactgtctcggattcgcaatgagctcatgcagtctctgaatcaggatagtaatagcaacttcaaggacacactgctcaaggaacgggaggccgaggttaggaacctgaaacaaaacctgagcgaactagagcagctgaacgagaacttaaaaaaggtggcatttgatgtgaagatggagaatgagaaacttgtgctggcttgcgaggacgtacgacaccagctggaagaatgccttgccgggaataaccaacttagcctcgagaagaacaccattgtggaaacacttaaaatggaaaagggcgaaatagaagccgagctgtgctgggccaaaaaaagactgctggaggaagctaacaaatacgaaaagacaatcgaggagttgagcaacgcccgaaacctcaacaccagcgcactccagttagagcacgaacacctgattaaactgaatcagaagaaggacatggagattgccgaactgaagaaaaatattgaacagatggataccgatcacaaagaaacaaaagatgtattgtctagttccctggaggagcagaaacaattgactcagcttattaacaaaaaggagatctttatagagaaactcaaagagcggtcctccaagctgcaggaggagctggacaagtattcccaggcacttaggaagaacgagatcctccgccagacgatagaggagaaggaccgcagcttaggcagcatgaaggaggagaataaccacttgcaggaggaactggagaggttaagagaggagcagtcaaggaccgcgcctgtcgccgacccgaaaactctggatagcgttacggagctagcttccgaggtgagccagctgaacaccataaaagagcacttggaggaagaaattaaacaccaccagaaaattattgaagatcagaaccagtctaagatgcagctgctgcaaagtctgcaggaacagaaaaaggaaatggatgaattccgatatcagcacgaacaaatgaacgctacacacacccagttatttttggaaaaggacgaggagataaaatcattacagaaaaccattgaacagattaagacccaactccacgaggaacggcaggacatccaaacagacaactcagatatattccaagaaaccaaagtccagtcgctcaatattgagaacggctccgagaagcatgacttgagtaaggctgaaactgagcgtctcgttaagggtataaaagagcgggagcttgaaatcaaacttctcaacgagaagaatatatctctgacaaagcagattgaccagctctcaaaggatgaagtgggaaaactgacacagattattcagcagaaggacttggaaattcaggctctgcacgccaggatttcgagcacctctcacactcaggatgtggtgtacctgcaacagcaactgcaggcgtacgcaatggaaagagaaaaagtattcgccgtcctcaacgaaaaaactcgtgaaaactcccacctcaagaccgagtaccataaaatgatggacattgtggctgccaaggaagctgccttaataaaactgcaggacgagaataagaagcttagtacgaggtttgagtcgagtggccaggacatgtttcgcgaaacgattcagaacttgtcacgcattatccgggagaaggacatagaaattgatgccctgagtcagaagtgccaaacccttcttgctgtcctgcaaacaagctccacggggaacgaggctggtggagtaaactccaaccagtttgaagaactgctgcaggagagagacaagctcaagcaacaagtaaagaaaatggaggaatggaaacagcaagtcatgacaaccgtccagaacatgcaacatgaatcggcacagctgcaagaagaactgcaccagctgcaggcccaggtattggtggacagtgacaataacagcaagcttcaagtggattatactgggttgatccagtcctacgagcagaacgagacaaagctaaagaacttcggccaggagttggctcaggtccagcacagcatcggacagttatgcaataccaaggatcttctgctggggaagctggacatcatcagcccccagctctcatctgcatccctcctgactccacagtcggccgaatgtctccgagccagcaaaagtgaggtcttgagtgagtcatcggagctgctgcagcaagaactggaggagctccgcaagagcttgcaagaaaaagacgcaacgatcagaactttacaggagaataaccacagactgtcggactctatagccgccactagcgaactggagcgaaaagaacacgaacagacggactcagaaataaaacagttgaaggaaaaacaggatgtacttcagaagttgctgaaggaaaaggacctgcttatcaaggccaagtctgatcaactcctcagttccaatgagaatttcacaaataaggtgaatgaaaatgagctgcttcgacaggccgtaaccaatttaaaggagaggatcctgatcctggagatggacattggcaaactcaagggtgagaacgagaaaatagttgagacctaccgaggcaaggaaacggagtaccaggccctgcaggagaccaatatgaagttctcaatgatgctcagagagaaggagtttgagtgtcatagtatgaaggagaaggctttggctttcgagcaattgctaaaggagaaggagcagggaaagacaggggaattgaaccagttactcaacgccgtcaagtccatgcaagaaaaaacagtggtgttccaacaggagcgagaccaggtcatgctcgcccttaagcagaagcagatggagaatacagcgcttcagaatgaggtgcaaagactgagggacaaagagtttagaagtaatcaggaactagagcggctgagaaaccacctgctagagtcagaagattcttatacaagagaagcactagctgccgaagaccgggaagccaagctccggaaaaaggtgaccgtcctcgaagagaagctggtctcatctagcaatgccatggagaatgccagccaccaggcctctgttcaggtcgagagcctccaggagcaactaaacgtcgtaagcaagcagagagacgagactgccttacaactgtctgtgagtcaggaacaggtgaaacagtacgcactctcactggctaacctacaaatggttctcgagcacttccagcaggaggagaaggccatgtatagcgccgagctcgaaaagcaaaagcagttaatcgccgaatggaaaaaaaatgctgagaatctggagggcaaggttataagccttcaggaatgtcttgacgaggccaatgccgcattggacagcgcaagccggctcaccgagcagttggatgtgaaggaggaacagattgaggagcttaaaaggcaaaacgagctgcgacaagaaatgctagacgacgtgcaaaagaaattgatgtccttagcgaatagcagtgagggaaaggttgataaagtcctaatgagaaaccttttcatcgggcactttcacaccccgaaaaaccaacggcacgaggtcctcaggctcatggggtctattttaggcgtgcgacgagaagagatggaacagctctttcacgacgatcagggtggagtgaccaggtggatgaccgggtggcttggtggaggatccaaatctgtgcccaacacccccctgcgcccaaaccagcaatctgttgttaacagcagctttagtgagctgttcgtcaaatttctggaaacagaatcacatccgtccattcctcccccgaaattatctgtgcacgatatgaagcctttagattcccctggtcgtagaaagcgggatactaatgcaccagagagtttcaaggacacagctgagagcagatctggccgacggactgacgtcaatccttttctggcccccaggagtgccgctgtgcccctgattaaccccgcgggtctcggtcccggtggcccagggcacttgcttctcaagcctatctcagatgtgctgcccacatttacccctttgccagccctgcccgacaatagcgctggtgtggtcttgaaagatttgctgaagcagtag

SEQ ID NO: 208661 - DNA, 5979 bp, Artificial Sequence
  Description of Artificial Sequence: Synthetic coding sequence
atgagcaaccggcccaacaacaaccccggcggcagcctgcggcggagccagcgcaacactgccggagcccaaccccaggacgattccatcggcggtaggtcctgctcgtcttcctcagccgtgatcgtacctcaacctgaggacccagatagagccaataccagtgaaagacagaaaaccggccaggttcctaagaaggacaattcgcggggagttaagaggtctgcttctccagactacaatcgtactaatagtccctctagcgctaagaaacctaaagccctgcagcacactgaaagcccaagcgagacgaataaaccccactccaaatctaagaaacggcacctcgatcaggaacaacaactcaagagcgcgcagtccccgtccacatccaaggcccatactagaaagagcggggccacagggggtagtcggagccagaagaggaaacgaacggagtcatcttgtgttaagtcgggatccggctcagaaagcacaggagccgaggagcgctccgccaaaccaacaaagttagccagcaaatccgccacttctgctaaagcaggctgtagcaccattactgattcgtcttccgctgcctctacctcgtctagcagctcagccgtggcttccgcaagtagcacagtgcctccaggcgcaagagtcaaacagggcaaggatcagaacaaggcccggagaagtcggtcagccagtagcccgagcccgcgtagaagtagccgcgagaaggaacagagtaaaacaggtggctcaagcaagttcgattgggctgcccgcttcagcccgaaggttagtctccctaagaccaaactatctctccctggctcctcaaagtctgagacctccaagccaggacccagcggtctgcaggccaaactggctagtctgagaaaatccacaaagaagagatcagagtcaccaccagcagaactgccctcattgagacggtccacccgacagaagaccaccggtagttgtgcaagtacctcgcggcgcgggagcgggctgggaaagagaggtgcagctgaggcccgaaggcaggaaaagatggcagacccagagtcaaaccaggaagccgtgaacagctctgcagcccgcactgatgaagcaccccagggcgccgctggggcggtcggtatgacaacctcgggagaatccgagtcagatgattccgagatgggccgactacaggcgctccttgaagctagggggctgccgccacacctctttgggcctctgggccctcgcatgtcgcagctgtttcataggaccattggatccggtgcctcttctaaggcccaacagctgctacaggggttgcaggctagtgacgagtctcagcagcttcaggctgtgattgagatgtgtcagcttttagtgatggggaatgaagaaaccctgggaggcttccccgtcaagtcagtcgtacctgctctgattacgctgctacagatggagcacaactttgacattatgaaccatgcatgccgcgcgctgacatacatgatggaggcccttccccggtcctcagcagtggttgtggatgccattccagtgttcctggagaagctacaggtcatccagtgcatcgatgtggctgagcaagctctcactgctctggagatgctgtccaggcgacatagcaaggcgatactgcaagccggcgggctggccgattgtcttctatatcttgagttcttcagcatcaacgcccagcgcaatgctttggccatcgccgccaactgctgtcaatccatcaccccggacgaatttcacttcgtggccgacagtctgcctctgcttacgcaacgtcttacacaccaagacaaaaaatccgtcgagagtacatgcttatgttttgctcgcctcgtggacaactttcagcacgaagagaacctgctccagcaggtggcttctaaggacctgctgacaaatgttcaacaacttctggtcgttacacccccaattttaagctcagggatgtttattatggtggtgagaatgttctctctgatgtgctcaaactgccccaccctggccgttcagctgatgaagcagaacattgcagagaccctccactttctgctgtgcggggccagcaacggaagctgtcaggagcagattgatttggtacctcgtagcccgcaggagttgtacgagctcacgagtctcatctgtgagctgatgccttgcttgcccaaggaaggtattttcgctgtagacactatgttaaagaagggaaacgcccagaacacagatggcgctatttggcagtggcgcgacgaccgtggtctgtggcatccgtataatcgtatcgacagtaggattatcgaacagattaatgaagatactggaacagcccgggccatacaaaggaagcctaacccactggcgaattcaaacacctccggctactccgagagtaaaaaagacgacgctagagcacaactcatgaaggaggacccagaattggcaaaaagcttcataaaaacactcttcggcgtgttgtatgaggtgtattcaagcagcgctggtccagccgtgcgccacaagtgtctgagggctattctgcgcattatctatttcgctgatgccgaactcctgaaagacgtcctcaaaaatcacgctgtctcttctcacattgcatccatgctttccagtcaagatttgaaaatagtggtgggagcactccagatggccgagatcctcatgcaaaaattacctgatatcttcagcgtctattttaggcgcgagggagtgatgcatcaagtgaagcacctcgccgaaagcgagtctctccttacctctcctccgaaagcctgtacgaacggctcagggtccatgggcagcaccaccagtgtgagcagcggcaccgcaactgctgcgacgcacgcagccgccgatctgggcagccctagcttgcagcacagtcgggacgattctctggatctaagccctcaggggcggctctcagatgtgctgaaacgcaagagactgcctaaacgcgggccaaggcggccgaagtacagcccaccacgagacgatgataaggttgacaatcaagcgaagtcacctaccaccacacaatccccaaaatccagctttctggcaagcttgaaccccaaaacatggggtcgccttagtactcagagtaattccaataacatcgagcctgcacgaacagctggcggttccggtctggctagggccgctagtaaagacacaataagtaataacagggagaagataaaggggtggatcaaggaacaggctcataaatttgtggagcgatacttctcttcagagaacatggacggatctaatccagctctgaacgtacttcagcgcctgtgtgcggctacagaacagcttaatttgcaggtagacggaggcgctgaatgcttggtggaaatacgtagcattgtttcagaaagcgatgtaagcagttttgaaatacagcatagcggattcgtgaagcagctgctattgtacctgaccagcaaaagtgagaaagacgcagtgtctcgagagatccggctgaaaagatttctgcacgtctttttctcttcaccgttaccaggcgaggaaccaattggccgcgtagagcctgtgggcaacgcgcccctgctggccttggtgcacaagatgaacaattgtctgtcccagatggaacaatttcctgtgaaagttcacgatttcccatctggtaatggtactggaggaagcttttcgctaaacaggggcagccaggccctgaagttctttaacacccatcagctcaagtgccaacttcagcgacacccagattgtgcgaacgtcaaacagtggaaaggtggacctgtgaagatagacccactagcgcttgtccaagctatcgagaggtacctggttgttcgcggctatggccgcgttagggaagacgatgaggactccgacgatgatggttccgacgaggaaatcgacgagagtcttgctgctcagttccttaatagtggcaatgtgcgtcaccgcctgcaattctacattggagagcacctattgccctacaatatgacagtgtatcaggccgtgcgacagttttctatccaggccgaagacgaacgggaatccacggacgacgagtcaaaccccctgggcagggcgggtatctggaccaaaacccacactatttggtataagcccgtaagagaggacgaggaatcaaacaaggattgcgtgggtggaaaacgagggcgggcccagacagcgcccaccaaaacgtctcctcgcaatgccaagaaacacgacgaactctggcacgatggcgtgtgtccgtccgtgtccaatcctttggaggtataccttattccgacccccccagaaaacatcaccttcgaagatcccagtctggacgtaattctgctgctccgcgtgctccacgctatatctcggtactggtactatctttacgataacgcgatgtgcaaggagattattcccacttctgaattcatcaatagtaagctgacggcgaaggcgaatcggcaattgcaggacccccttgtaataatgacagggaatattcctacctggctgaccgagttgggcaaaacctgcccattcttctttcctttcgatactagacagatgctgttttacgttacagcgtttgatagagaccgggctatgcagagactgcttgacaccaatcccgagattaaccagtctgactctcaggattctcgcgtggctcccaggctagatagaaagaaaaggaccgtgaacagggaagaacttctgaagcaggctgagtcggttatgcaggatctcggatcctcgcgagccatgctggagatacagtatgagaatgaggtcggcaccgggcttggcccaaccctagaattctacgccctggtgagccaagaactccagcgcgccgacctaggcctgtggcgaggggaggaagtgacactcagtaatccaaaaggctcccaggaaggcacaaagtacatccagaacttgcaggggctctttgctctgcctttcggcagaacagcaaagccagctcacatcgccaaagtgaagatgaaattccggttcctggggaagcttatggctaaggctattatggacttccggcttgtggatctgcctttgggactccccttttacaagtggatgctgagacaagaaacctcactgactagtcatgacctgtttgatattgacccggtcgtggccagatcagtgtaccacctggaggatatcgtcagacagaagaagaggttagagcaagataaatcccagacaaaggaatcgctgcagtacgctctcgagacactcacaatgaatggctgttccgtggaagacctcggactagacttcaccttaccagggttccctaatatagaactaaaaaagggtggcaaagacatccctgttacaatacataatctcgaagaatatctgcgactggttatcttttgggcacttaatgagggagtgtcccgccagttcgactccttcagagatggcttcgaatccgttttcccactgagtcaccttcagtacttctatccagaggaacttgaccaattgctatgcggaagcaaggccgatacttgggatgctaagacactcatggagtgttgcagaccagatcacggctacactcatgactcacgggctgtcaaattcctgttcgagattctatcatcattcgataacgaacagcagcgtctcttcttacagttcgtcactgggagcccccgcctccccgtaggggggttccggtccctgaacccgccgctgaccattgtccgtaagacattcgagtctactgagaatcctgatgacttcctgccgtcggtgatgacgtgtgtgaactatctcaaacttcccgattattcctctattgagattatgcgagaaaaattgctgattgccgccagggaagggcagcagagctttcatctgtcctag

SEQ ID NO: 208662 - DNA, 300 bp, Artificial Sequence
  Description of Artificial Sequence: Synthetic coding sequence
atgagcaaccggcccaacaacaaccccggcggcagcctgcggcggtcacagaggaatactgctggggcccaaccccaggacgactctatcggcgggagaagctgttcctcgtcgagcgccgttatcgttccacagccagaggatcccgatcgggccaatactagcgagaggcagaagaccggacaggtcccaaaaaaagacaactccaggggtgtgaaaagaagcgccagccctgactataaccgtacaaatagtcctagctctgccaagaagcctaaagctctgcagcatactgagtag

SEQ ID NO: 208663 - DNA, 6123 bp, Artificial Sequence
  Description of Artificial Sequence: Synthetic coding sequence
atgagcaaccggcccaacaacaaccccggcggcagcctgcggcggagccaaagaaacacagctggcgctcagccccaggacgacagcatcggtggcagatcccacctggggcaggctaaacacaagggctactcaccgcccgagtccagaaaatccaacagcaaggcccctaaagtgcagtccaatactacgagcgagcttagcaggggccacttgagcaagcgttcatgttcaagttcctcagccgtgattgtgccacagcctgaggaccccgaccgcgccaacacgtctgaaaggcagaagacaggacaggttcctaaaaaagacaacagccgcggggtcaagcggtctgcttccccggactacaatcgcacgaactccccgtcttccgccaaaaaaccaaaggctctgcagcacaccgagtccccttcagaaacaaacaaaccacactccaagtccaagaaacgccatctggatcaggagcagcagttaaagtccgcacagtccccatccacctctaaggcacatacgagaaaaagcggtgctaccgggggtagccggagtcaaaagaggaagaggaccgagtcatcctgcgtgaagtctgggagtggctccgagtccacgggtgccgaagaacggagcgccaaaccaaccaagctggcatctaaaagtgccacaagcgcgaaggctgggtgctccactatcacagatagttcctccgccgccagcaccagtagtagctcatctgcagtcgcatctgcctcttccaccgtcccccccggggcccgggtgaaacagggaaaggaccagaataaggcccgcaggtccaggagcgcatcgagtcccagtcccagacggtcatcaagagagaaagagcagtctaaaaccggcggaagtagcaagttcgactgggctgcccgctttagtcccaaagtctcactaccgaagacaaaactctccctgcccgggtcaagcaagagtgaaacatctaagcctggcccctccggactccaagcaaaactcgcatctttgcggaaatccactaaaaagcgcagcgagtctccccccgccgaacttcccagccttcgccggagtacccgacaaaaaacaaccggttcttgcgcctcaactagtaggcggggcagcggtctgggtaagcgaggcgcagccgaagcaaggaggcaggagaaaatggccgatcccgagtcaaatcaggaggcagttaactcctctgctgctaggaccgatgaggcccctcagggtgcggccgcttcatcttctgtggctggcgcagtcgggatgacaaccagcggggagtcagagtcagatgacagcgaaatgggacgactgcaggctctgctggaagccagggggctccctccacacctatttggaccactcggcccgagaatgtcccagctgtttcatagaacaattgggtctggagcatcctcgaaggcacaacaactgctacagggtttgcaggcatcggatgagagtcagcagttgcaggctgtgattgaaatgtgtcagctcttggtgatgggtaacgaagagactcttggtggattcccagtcaaatccgtggtgcctgcgctgataaccctgctgcagatggagcacaattttgacatcatgaatcacgcatgccgagctctcacatatatgatggaggccctccctaggagttccgccgttgtagtggacgctattccggtgtttctggagaagctgcaagtcatccaatgtatcgacgttgctgaacaggccctcaccgcactggaaatgctgagccgccgtcatagtaaggctattctgcaggcgggcggcttagccgactgtctgctctacctggagttctttagcatcaatgcgcaacgtaatgccctggccatcgctgccaattgctgtcaatccatcactccagacgagttccatttcgttgcggacagcctcccgctgttaacccagaggctgacccatcaggataagaagagcgtcgagtccacctgcctttgttttgctcggttggtagacaacttccaacatgaggagaacttgctgcagcaagtggcttctaaagatctgcttactaatgtccagcagctgctggtagtcactcctcctatccttagctcaggtatgttcatcatggtggtgcgcatgttctccctgatgtgctccaattgtccaacacttgccgtgcagttgatgaagcagaatattgccgagaccttacatttcctgctctgtggcgcttctaacgggagctgtcaagaacaaatcgacttggtgccgcggagccctcaggaactctatgagttgacgtctctgatttgcgaacttatgccttgcctgccaaaggaaggcatctttgcagtggacacaatgctcaagaagggtaacgctcaaaatactgatggggcgatctggcagtggagagacgacaggggtctgtggcatccttacaacaggatcgactctagaatcattgagcagatcaatgaggataccggaacagcgcgtgcaatccaaaggaagccaaacccgctggcaaattcaaacaccagcgggtactctgagtccaagaaagatgacgcccgagcccaactgatgaaagaggacccagaacttgccaaaagctttatcaagacactgtttggagtgctgtacgaggtgtactcttcatcggcgggccctgcggtcaggcataagtgcttacgagctatattacgtattatatactttgccgacgcagaacttttgaaagatgtgctgaagaaccatgccgttagcagccacatcgccagcatgctgagcagccaagacctgaagatagtagtgggagccctccaaatggcagagatcctcatgcaaaaattacccgacattttttcggtctactttaggcgcgagggagtgatgcaccaggtcaagcatctcgctgaaagcgaatctcttctgacctcccctcctaaagcctgtactaatggctctggttccatgggaagtacaacttctgtgtcttccgggacagctactgctgctacccatgccgctgctgacttagggagcccttcgctgcagcattcacgcgacgattccttagacctcagcccacagggcaggttgtcagatgttctcaagcgtaagaggctacctaagcgaggcccccgcaggcccaagtattcccccccgcgcgacgacgacaaggtggacaaccaggccaagtcaccgactacgacacagtcgccgaagtctagctttctggcttctttgaacccaaaaacatgggggcgcctcagcactcagagcaattccaataacattgaacccgcaagaaccgcgggcggctcaggcctggcaagagcagcctctaaagatactataagcaacaacagggaaaaaataaaggggtggatcaaagaacaggctcacaagttcgtagagagatatttttcatccgagaacatggatggaagcaatcctgccttgaacgtgctgcagcgcctgtgtgccgctaccgaacaactgaatcttcaggttgatggcggagccgaatgcctcgtggaaattagatctatcgtcagtgaatccgatgtctcaagctttgagatccagcatagtggcttcgtaaagcaactcctgctctacttgacttctaagagcgaaaaggatgccgtcagtcgcgagatccgtttaaagcgattcctccatgtgttctttagcagtcctctacccggggaggagcctatcggaagggtagagccagtgggtaacgctcccctgttggctctggtgcacaagatgaataactgtctcagccagatggaacaatttcctgttaaagtgcatgacttccctagtggcaatggcaccggggggtccttctctcttaacaggggcagccaagccttaaagttctttaacacccatcagctgaaatgccaactgcagaggcatcccgactgtgcgaacgtgaagcagtggaaggggggccctgtcaaaatagaccccttggctctggtacaggctatcgagaggtacctggtagtgcgaggctatggacgcgttcgcgaggatgatgaggattcagatgatgatggatcagatgaagagatcgatgagtccctcgcagcccaattcctcaattccggcaatgttagacatcggcttcagttttatatcggggagcatcttctgccatacaacatgactgtgtatcaggctgttagacagtttagtattcaagccgaggatgagagggagtcaacagacgatgaatccaacccgctggggcgagccggaatttggaccaagacacacacaatttggtacaaacctgtccgcgaagacgaagaaagcaacaaggattgcgttggcggaaaaagaggcagagcccagacagcacctacaaagacatccccgaggaacgccaagaaacatgacgagctgtggcacgatggagtctgtccctccgtttctaaccctcttgaggtttatctcattccgacacctccagaaaacatcacttttgaagatccttccctggacgtgatcctgctgttgcgagtgcttcatgccatttctagatattggtactacctttacgacaatgcaatgtgcaaagaaatcattcccactagcgaatttataaactcaaaacttactgccaaggccaaccggcagctgcaggatcccctggttatcatgaccggcaacattcctacatggttgaccgagttgggaaagacctgcccgtttttttttccatttgacacgcggcagatgctgttttacgtcaccgcatttgatcgtgaccgcgctatgcagagacttctagacacgaatcccgagatcaaccagtcggatagtcaggacagccgcgttgcacctcgattggaccggaagaagcgcaccgtcaatcgcgaagagcttctcaaacaggctgaatcggtaatgcaggacctgggctcatccagagcgatgctggaaattcaatacgagaacgaggtaggcactggcctgggcccaactttggagttctacgctctggtcagccaggagttgcaaagagccgatttgggtctatggcgaggcgaagaggtaactctgtcaaatcctaaaggttctcaggagggtacgaagtatatccagaaccttcagggccttttcgcactgcccttcggccgtactgccaagcctgctcacatcgcgaaagtgaagatgaagttcagatttctgggaaaattaatggccaaagctattatggattttagattagtcgatctgccactggggctccctttctacaagtggatgctccgccaggagactagtcttacgtctcacgacctctttgacatcgatcctgtggttgctcgatcagtctaccatctggaggatattgttcggcagaaaaagcgcctggagcaagacaaaagtcaaacaaaagagtccttgcagtatgcccttgaaacccttacaatgaatgggtgtagcgtggaggatcttggattggattttacactgcccggattccctaatatcgagcttaaaaaagggggcaaagatatcccggtgacaattcacaatttagaagaatatcttcggctggttatcttctgggccctgaacgagggagttagccgccagttcgactcattccgagatggattcgaatcagtcttccccctgtcccatttgcagtatttctaccccgaagaactcgaccaattgttatgcgggtccaaggccgatacctgggacgctaagactctgatggaatgctgtcggccggatcacggctatactcacgactcaagggccgtgaaattcctgttcgaaattttgtcatctttcgacaatgaacagcagaggctgtttctgcagttcgttacaggttcccctaggctgcccgttgggggatttcggagcctgaacccaccattgaccatcgtccggaaaacatttgaatctacagaaaatcccgatgatttcctcccctcagttatgacctgcgtgaattacctaaaactgccggactattcaagcatcgaaattatgagggaaaaactgctgatcgccgccagggaaggtcagcagagcttccacttgtcttag

SEQ ID NO: 208664 - DNA, 5169 bp, Artificial Sequence
  Description of Artificial Sequence: Synthetic coding sequence
atgagcaaccggcccaacaacaaccccggcggcagcctgcggcggagtcaacggaacactgctggcgcacaaccgcaggatgattccatcggaggcagccgccgcggaagcggccttggtaagagaggcgctgcagaggccagaagacaggagaagatggccgacccagaatcgaatcaggaggcagtgaactcttctgccgcccggacagatgaggccccccaaggcgctgctgcctcttccagtgttgccggagccgtgggaatgaccaccagtggggaaagcgagtcagatgatagcgaaatgggtcgcctccaggccctcttggaggctagagggttgcctccccatctttttggcccactcggcccaagaatgtctcagctgttccatcggaccataggtagtggtgcttcttcaaaggcacagcagctgctgcagggcctgcaggcctccgatgagagtcaacagttacaggcggtaatagaaatgtgtcagctgctggtgatgggaaacgaagagaccctgggaggattccccgtgaagagcgttgtcccagccctgattactctgctgcagatggagcataatttcgacatcatgaatcatgcatgtcgcgctcttacttacatgatggaagcactgccgaggtccagtgctgtggttgtcgacgcaattccagtcttcctggaaaagctgcaagtgattcagtgtatcgatgtggcagagcaggctctcacagccctggaaatgttaagcagaaggcattctaaggcgatcctacaggctggcggtctcgccgactgcctgctgtacctcgaatttttctccattaacgcacagaggaatgccctcgcaatcgccgcaaattgttgccagagtatcacacccgacgaattccacttcgtcgctgactccctgccattgttgacccagagacttactcatcaggacaagaagtccgtggagtccacttgcttgtgctttgcgcgcctggtggataattttcagcatgaggaaaacctcctgcagcaggtggcctctaaagacctgctgacgaacgtgcagcaacttttagtggtgacgcccccaatattatcgtccggtatgtttatcatggtcgtaaggatgttcagcctgatgtgctctaactgtccgaccctggctgtgcagctgatgaagcagaacatcgctgaaacccttcactttctgctgtgcggggcaagcaatggctcctgtcaggagcagattgatctcgtccctcggtcaccccaggagctttatgagcttacttcactgatatgtgaactaatgccatgcctccctaaggaaggtatcttcgccgtggacaccatgctgaagaagggtaatgcacagaacacggatggcgccatctggcagtggagggatgacagaggtctatggcacccatacaataggattgatagcagaatcattgaggcggctcaccaggtgggcgaggatgagatcagcctcagcactttaggcagagtttacaccattgacttcaattccatgcagcaaataaacgaagacaccgggacggccagggccattcagagaaagcccaatcctcttgcgaattccaacacatccggctactctgagtcaaagaaggatgatgcacgcgcacagcttatgaaagaggatcctgaactggcgaagtcttttataaagacactgtttggtgtgctgtatgaagtgtatagcagttccgctgggcctgccgtcaggcacaaatgcttaagggccatcctccggatcatatacttcgctgatgcagaattacttaaggacgtgctcaagaatcacgctgtgtctagtcacatagcatcaatgcttagcagtcaggatctgaagatagtggtgggcgctttgcagatggcagagattctaatgcagaagctgcctgacattttcagtgtgtattttcggcgcgagggcgtaatgcatcaagttaagcacctggccgagagcgagagcctcctaacatcccccccaaaagcctgtacgaatggctctggctctatgggttccaccacatcagtatcctccggaaccgccactgcggcaacacacgcggctgccgacctgggctctccctcgctgcagcacagtcgggatgacagcttggatctttcccctcagggccgtctgtcagatgtgctgaaaagaaagaggctgccgaaacgaggtccaaggcggccgaaatattctcccccacgagacgacgataaggtcgataatcaagctaagtcccctactaccacccagagtcctaaatcttcctttcttgcatctcttaacccaaagacgtggggtcgcctgagtacccagtcgaactccaataacatagagcccgctagaaccgctgggggtagcggactcgcccgagccgcctctaaggataccattagcaataacagagagaagattaaaggctggattaaagaacaggctcataaattcgtggaacgatattttagttcagagaatatggacgggagcaatccagctctgaacgttctccagagactgtgcgccgccacggagcagctgaatctgcaggttgacggaggtgctgagtgtctcgtcgaaattcggtccatcgtgtcagagtctgacgtttcctcatttgagatccagcattctggctttgtgaagcagctgctcctctatttgacgtcaaaatcagaaaaggacgccgtgagcagggaaattcggctgaaaagattcttgcacgtgttcttctctagcccgctgccaggagaagagccaatcggccgagtagagcccgtaggtaatgcccctctcctggctctggtgcacaaaatgaataactgtcttagtcaaatggagcagttccccgttaaagtgcatgactttccgtccgggaacggaactggcgggagcttttccttgaacagaggcagtcaggctctgaagttttttaacacccatcagctcaaatgtcaactgcagcggcacccagactgcgcaaacgttaagcagtggaagggtggcccagtcaaaatcgatcctttagccttagttcaagctattgagcgctatttagttgtgcggggctacggtcgcgtgcgggaggatgatgaagacagtgacgacgacggctcagacgaggaaatcgatgagagcctggccgctcagttcctaaacagtggaaacgtgcgccataggctgcagttctatatcggagagcatctgctgccttacaacatgaccgtgtaccaagccgtgaggcagtttagcattcaggccgaagatgagcgcgaaagtacggatgatgagagcaacccacttgggcgcgcggggatctggacaaagacacacaccatttggtataagcctgttcgagaagacgaggagtcaaacaaagattgcgttggaggcaagcgaggccgggcacagacagcacccaccaagacctccccaaggaatgccaaaaaacatgacgagctatggcatgatggcgtctgtccaagtgtatcgaacccactggaggtgtatctgatccctacgccgcccgagaatatcacctttgaagatccgtctcttgacgtaattctactattgcgcgtgttgcatgcaatctctcgctactggtactatctctatgataacgccatgtgcaaagagatcatacctacctcagagttcatcaattccaagctcaccgcaaaggccaatagacagctgcaggatccgttggtgatcatgaccggcaacataccgacgtggctcacagaactcgggaagacctgtccatttttctttcctttcgatacccgacagatgctattttatgtgaccgctttcgatagggacagagcaatgcaacggctgttggacaccaaccccgaaatcaaccaatccgattctcaggatagccgggtggcaccgaggcttgaccggaagaagcgcacagtgaaccgagaagaactgctgaagcaagcagaatccgttatgcaggacctggggagtagtagagctatgttggagatccagtatgagaatgaagtcggaacgggtctgggcccgacactggagttctacgcactggtgtcccaggagctgcaaagagccgacctcggactgtggagaggagaagaggtgactttgtccaaccccaaagggtcccaggaagggacaaagtacattcagaacctccaaggactgtttgcgcttcccttcggccgtactgccaagccagcgcatattgccaaggtgaaaatgaaatttaggttcctcggcaagttgatggccaaagccatcatggattttagactcgttgatttaccattgggcctgcctttctacaaatggatgctcagacaagagacttctcttactagccatgatctcttcgacattgatccggtcgttgcccggagtgtgtatcatttagaggacattgtccggcagaagaagcgattggaacaagacaagtctcaaacaaaggagagtttgcagtacgccctggaaacactgaccatgaacgggtgtagcgtagaggatctcggccttgatttcacactaccaggctttccaaatatcgagttaaagaagggcggtaaggacatccctgtaaccatccacaaccttgaggagtatctgaggctggtcatcttttgggcactaaatgagggcgtgagcaggcaattcgactcctttcgggacggtttcgagagtgtattcccactgtcacacttgcagtatttctaccccgaagagctggatcaactcctgtgtgggtcaaaggccgatacatgggacgccaaaactttgatggagtgttgccggccagaccacggctacacgcatgactccagggctgttaagtttcttttcgaaatcctcagcagctttgacaatgagcagcagcgcctttttctccagtttgttaccggctctcctaggcttcctgtgggaggttttcgttccctaaatccacccctgaccatagtgcgaaaaaccttcgaaagcaccgagaatcccgatgattttttaccaagtgtgatgacctgcgtcaattacctaaagctccccgactacagctctattgaaattatgcgagagaagcttctcatcgcggctcgagagggccagcagtctttccatctgagctag

SEQ ID NO: 208665 - DNA, 450 bp, Artificial Sequence
  Description of Artificial Sequence: Synthetic coding sequence
atgagcaaccggcccaacaacaaccccggcggcagcctgcggcggagtcaacggaatactgcaggagctcagccacaagatgatagcattggtgggagaagctgcagctcctcaagtgcagtgattgtcccccagccagaggaccccgatcgtgctaacacgtcagagcgccagaagacaggccaggttccaaagaaagacaacagtagaggcgtcaaacgttccgcttctcctgattacaaccgaactaatagcccgtcctctgcgaagaaaccgaaagccttgcaacatacggaaagtccttccgaaaccaataaaccgcattccaagtcaaagaagcgccacctggaccaagagcaacagcttaaaagtgcacagtccccaagtacaagtaaagctcacaccaggaaaagcggagcgaccggtggcagtcggagccagaagcgctag

SEQ ID NO: 208666 - DNA, 465 bp, Artificial Sequence
  Description of Artificial Sequence: Synthetic coding sequence
atgagcaaccggcccaacaacaaccccggcggcagcctgcggcggagtcagaggaacaccgcgggagcacagccacaggacgatagcatcggcggtcggagctgctctagcagctccgcagttatagttccgcagcccgaggaccccgaccgagctaatacctccgagcgccagaagaccggccaagtgcccaagaaggataatagcaggggcgtcaagcggagcgcttcccccgactataacaggactaatagtccttcctccgccaaaaaaccaaaggcactacaacacacggaaagcccgtccgaaacaaacaaacctcactctaagagcaagaagagacatctggaccaggaacaacagttaaaatctgctcagtcaccatctacgtccaaagcgcacacgcgtaaatctggggcgacaggcggtagccgttcccagaaaaggaagaggactgaatcatag

SEQ ID NO: 208667 - DNA, 1041 bp, Artificial Sequence
  Description of Artificial Sequence: Synthetic coding sequence
atgagcaaccggcccaacaacaaccccggcggcagcctgcggcggtcacaacgcaataccgccggtgctcagccccaggatgatagcatcggagggcgctcccaccttggacaggccaaacacaagggatacagcccccctgagtcccgtaagtccaactccaaagcgcctaaggtgcagtccaacactacaagtgaactatcccgaggacatctctctaagcgatcctgcagctcatcttctgccgtgatcgtgcctcaaccggaggatccggaccgcgctaatacaagcgagcgacaaaaaacgggtcaggtgccaaagaaggataacagtcggggggtaaaaagaagtgcatcccctgactataacaggacaaatagtccctcatcagcaaagaagcctaaggcactacagcacactgagagccccagcgagaccaataagccccattctaagagtaaaaagcgccacctggaccaggaacagcagctcaaatctgcccagagcccatccacttccaaagcccatacacgtaagtccggtgcaacagggggcagccggtcccagaaacggaagcgtactgaaagttcttgtgtaaagtccgggagtggtagtgagagcactggcgcagaagagaggtctgctaagcccaccaaactggcatcgaaatcagccacctctgcaaaggctggttgctctacgattacggatagcagcagcgcagcatcaaccagtagctcctccagcgccgtggccagtgcttcatctaccgtcccgcctggtgcccgagtcaaacaggggaaggaccagaacaaggcccggcggagccggtcagcatctagcccttctcccagacgaagcagtcgagagaaagagcagagcaagacaggcgggagcagcaaattcgactgggctgctagattctccccaaaggtgagcttgcccaaaaccaagctctccttgcctggctccagtaaaagcgaaacgtcaaagccaggcccaagtgggctgcaagcgaaagtgctgacaagtaagcggtag

SEQ ID NO: 208668 - DNA, 1746 bp, Artificial Sequence
  Description of Artificial Sequence: Synthetic coding sequence
atggccgtggccggcgccgtgagcggcgagcccctggtgcactggtgtacacagcagctgcggaagactttcgggctggacgttagtgaggaaattatccagtacgtattgagcattgagtctgcagaagagatccgagagtatgttacagacctgctccaggggaacgagggtaaaaaaggccagttcatcgaggagctgattactaagtggcaaaagaacgatcaggagttgatttcagaccccctccagcagtgcttcaaaaaagatgagatcctcgacggtcaaaagtctggtgatcatctgaagcgaggacggaagaagggccggaaccgccaggaagttccagcctttactgagccggacacgaccgcggaagtgaaaactccattcgatctggcgaaggctcaggaaaattctaactcagtcaagaaaaaaaccaagttcgtgaatctgtacacccgtgaaggacaagatcgacttgctgttctcctcccaggcaggcacccttgcgattgcctgggccagaagcacaaactcatcaacaactgtctcatatgcggtagaatagtgtgcgaacaggaggggagtggaccatgcctcttctgcggaactctcgtctgcacacacgaagagcaggacattcttcagcgggactccaacaagagccagaagttacttaaaaaactcatgtccggggtcgagaatagtggcaaagtggacatcagcacaaaggacttgctgcctcaccaggaactcagaatcaagagcggtctggaaaaggccataaagcacaaggataaactccttgaatttgaccggacatccattagaagaacccaggtcatcgacgatgagtcagattatttcgcctccgactccaaccaatggctcagcaaactcgaaagagaaactctgcaaaagagagaggaagaacttagggagcttcgccatgcctcccgtctttcaaaaaaggtgacaatcgattttgccggccgcaaaattctagaagaggagaattccctggccgagtaccattctcgcctggacgagacgatccaggccatcgctaatggcacactgaatcaaccactgaccaagctggaccggagctctgaggaacccctcggggtgctcgtcaaccccaacatgtatcaaagcccaccacaatgggtggatcacaccggcgctgcaagccaaaagaaagcctttagatctagcgggttcggcctcgaatttaattcttttcagcaccagctcagaattcaagatcaggagttccaagaaggattcgacggcggatggtgcctgtctgtccaccagccttgggccagtctcctcgtgcgcggcataaagcgggtcgagggccgaagctggtacacaccgcaccgcggaagactctggatcgccgcgacagcgaagaagccttccccacaagaggtatcagaattacaggctacttacaggctgttacggggcaaagacgttgaatttccaaatgattacccgagtggatgcctgctgggttgtgttgatctcattgactgcctgtcccaaaagcagttcaaggagcagttccctgacatctctcaggaatcagactctcctttcgtgttcatttgtaaaaacccacaagagatggtggtcaaattccctatcaagggaaacccgaagatatggaaacttgattccaaaattcaccagggtgcaaagaaggggttgatgaagcaaaacaaagccgtatag

SEQ ID NO: 208669 - DNA, 1431 bp, Artificial Sequence
  Description of Artificial Sequence: Synthetic coding sequence
atgagcggccccacctggctgccccccaagcagcccgagcccgcccgcgccccccaaggccgagctattccaaggggcacccccgggccgccacccgctcacggcgcagcccttcagccccaccctagagtaaatttttgtccgttgccatctgaacagtgttaccaggccccagggggcccagaggatcggggacccgcttgggtggggtcccacggtgtgcttcaacacacgcaaggtcttccggccgacagaggcgggttgcggcccggttcactcgacgccgagatcgacctgttatcgtctaccctcgcagagcttaacgggggtagaggccacgcttcgcgcagacctgatcgacaggcatatgaaccaccccctcctcctgcctacagaacaggttcactgaagcccaatcccgctagcccactgcccgcttctccatacggagggcccacccctgcttcgtacacaaccgcctccactccagctggaccggctttcccagtgcaggtcaaggtggctcagcccgtgcgcgggtgcggccctccgcgacgaggcgctagccaggcaagtgggccactaccggggcctcacttcccactccccggtagaggagaggtgtggggaccaggttatcggagccagcgtgagcccgggccaggcgcaaaggaggaggctgcgggagtgagcggtcccgccggccgagggcgaggcggtgaacacggcccacaggtgcctttatcccagcccccagaagatgagttggaccgcctgactaagaagctcgtccatgatatgaatcacccccccagcggagagtacttcggccagtgcggcgggtgtggagaagatgtggtcggcgacggtgcgggtgtggtcgcgctggaccgcgtgtttcacgtcggttgctttgtctgttccacatgccgggcgcagctgcgaggacagcatttctacgctgtcgagagaagggcttattgcgaaggatgctacgtggccactctcgagaagtgcgctacctgctcccagcctattttggataggatcctccgggcaatgggaaaagcctaccaccctggatgcttcacctgtgtagtttgtcatcggggactggatggcattccgtttaccgtcgacgcgacgagtcagatccattgtatcgaggacttccatcggaagtttgcaccaaggtgtagcgtctgcggcggggcaatcatgccagagcccgggcaggaggagaccgttcggatcgtggctctggataggtccttccatattggctgctacaaatgtgaggaatgtgggctactgctcagttcagaaggcgagtgccagggttgttacccactagacgggcacatcctctgcaaagcttgcagcgcatggcggatccaagagctctccgccacagtaactactgactgctag

SEQ ID NO: 208670 - DNA, 1473 bp, Artificial Sequence
  Description of Artificial Sequence: Synthetic coding sequence
atggagcagaagcccagcaaggtggagtgcggcagcgaccccgaggagaatagcgcccggtcccccgatggaaagcgcaaacgaaaaaatggacaatgttctcttaaaactagcatgtcagggtatatcccctcttaccttgataaagatgagcaatgcgtggtgtgcggcgataaagctaccggctatcactaccgctgcattacctgcgaaggttgtaaaggctttttccggagaacaattcagaagaacttgcacccgacatactcctgtaaatacgattcatgctgtgtgattgataaaataactagaaaccaatgtcagctctgccgattcaagaaatgcatcgcagtgggcatggcaatggacctggtcctggacgactccaaacgcgtcgccaagcgaaagcttatagaacagaatcgtgagcggcgccggaaagaggagatgatcaggagcctgcagcagcgtccagagccaacacccgaagagtgggacttgatccacattgccacagaagctcatcgctccacaaacgcacagggaagccactggaaacagaggcgcaaatttctcccagatgacattgggcagtctccaatcgtgtctatgcctgacggtgataaagtggacctcgaggcattctccgagttcacgaagattatcacacctgcgatcacacgggtagtggattttgctaagaagttgcctatgttttctgagttaccatgcgaagatcagatcatcctcctcaaaggctgctgcatggagatcatgtctctcagagcagcagtgaggtatgatccggagtccgatactctcacactaagtggcgaaatggccgtgaaacgcgagcagttgaaaaacggcggactcggcgtcgtctcggacgccatctttgaacttggtaagtctctaagtgcgtttaacctggacgatactgaggtcgctctcctccaggctgtgctactcatgagtacagatagatctggactgttatgcgtggacaagatcgaaaagagccaggaagcttacttgttggcgttcgagcactacgtgaaccacaggaagcacaacataccgcacttctggcccaaactgcttatgaaggaaagagaggtgcagagttccatcctgtataaaggggcggccgcagagggccgccccggaggcagcctgggagtgcaccccgaggggcagcagctgctgggtatgcatgtagtacagggccctcaggtgcgccagctggagcaacagttgggagaggcaggctccttgcaagggccggtccttcagcatcagtctcctaaatcacctcagcaacgcttattagagttacttcaccgatccggaatcctacacgctcgggcagtctgcggtgaagacgattccagcgaagccgacagtccatcctcatcagaggaggaaccggaggtatgcgaggatttggcaggaaacgctgcatcgccctag

SEQ ID NO: 208671 - DNA, 1473 bp, Artificial Sequence
  Description of Artificial Sequence: Synthetic coding sequence
atggagcagaagcccagcaaggtggagtgcggcagcgaccccgaggagaattctgccaggagtcccgacggtaagaggaagaggaagaatgggcaatgctctctaaaaacgtcgatgtctgggtatataccctcctacttagacaaggacgaacaatgtgtggtttgtggggataaagcgaccgggtaccattaccgatgtattacctgtgagggttgtaaaggattttttcggcgaacaatacagaagaatctgcaccctacctacagctgcaaatacgatagctgttgcgtcattgataaaatcactcggaatcaatgccagctgtgtagattcaagaagtgcatagcagttgggatggcgatggatctggtgctcgatgattctaagagggtggcaaaacgaaagctcatcgagcaaaatagagagcgccggcgcaaagaggagatgataagaagtctgcagcaaaggccagagcccacgcccgaagagtgggatctgatccacatagcaacagaggcccatcggtccacgaatgctcaaggctctcactggaaacagaggaggaaatttttacccgatgatatcggtcagtccccaattgtgagtatgccagacggggacaaggtggatttggaagccttttctgaattcacaaaaatcataaccccagctattacgagggttgtcgacttcgctaagaaactccccatgttctccgagctaccttgcgaggaccagataatccttttgaagggttgctgcatggaaattatgagcctgagagccgcggtcaggtacgatcccgagtcagatactctgacactgtcaggggagatggcagtgaagagagagcagctgaaaaacggtggtttgggggtggtatccgacgccatttttgagcttgggaaatccctaagcgcgtttaacctggacgataccgaggtcgctttgctgcaggctgtcttactaatgtcaacagaccgctcgggccttctatgtgtcgataagatcgagaagtcccaagaggcgtatctgctagccttcgaacactatgttaatcaccgcaaacataacatccctcacttttggccgaaactgcttatgaaagagcgcgaggtacagtcatccatcctgtacaagggggccgcggctgagggccggccaggcgggtcattgggcgtgcacccagagggacagcagctcctggggatgcacgtcgtccagggtccccaggtgcgccagttggaacagcagttaggcgaggctgggtccctgcagggtcctgtccttcagcatcagtcccccaagagtccccagcagagactgctcgagctgctgcataggtcaggcattcttcatgcccgtgccgtatgcggagaggatgattcttccgaggctgattctccatcttccagcgaagaagagcccgaagtgtgcgaggacttggcaggaaacgccgcctctccttag

SEQ ID NO: 208672 - DNA, 1233 bp, Artificial Sequence
  Description of Artificial Sequence: Synthetic coding sequence
atggagcagaagcccagcaaggtggagtgcggcagcgaccccgaggagaatagcgcccgcagccctgatggaaaacgaaaacggaaaaacgggcagtgttccttgaaaacttcaatgtctgggtacattcccagctatctggacaaagacgagcagtgcgtcgtatgtggagacaaggccaccgggtatcactataggtgcataacatgtgagggctgtaaggggtttttcagaaggaccattcagaagaaccttcaccctacttacagctgcaagtatgactcgtgctgcgttatagacaagattaccagaaaccaatgccaattgtgccgatttaaaaaatgcatagcagtcggaatggccatggacctagtgctcgatgacagcaaaagggtggcgaaaagaaaacttatcgagcagaaccgcgagaggcggagaaaggaagaaatgatcaggtcccttcagcagcgtcccgagcccacacccgaggaatgggacttgatccacattgcgaccgaggcacacaggtctactaacgctcagggaagtcattggaagcagcgaagaaaatttctgcccgatgacatcggccaatcccctatcgtgagcatgcccgacggcgacaaggtggacctggaggcctttagcgagtttacgaagatcatcaccccagcaataaccagggtggtcgattttgctaagaagcttccaatgttttctgagctgccctgcgaagaccagatcatcttactgaagggctgttgcatggagataatgagcctgcgggccgccgtccggtacgaccctgagtccgacacgctcaccctgtctggcgagatggctgttaagagagaacagttgaagaacggaggattgggggtggtaagcgatgcaatctttgagttggggaagtccctcagtgcttttaacttggacgacacagaagtagcactacttcaggccgtcttgctgatgtcgacggacagaagcggcctgctttgcgtggataagatcgaaaagagccaggaggcctacctgctcgcatttgaacactatgtcaatcacagaaagcataacatcccgcatttttggcccaaactgctgatgaaggttaccgatctccggatgatcggagcttgtcacgcctcccgattcctgcacatgaaggtcgaatgtcctaccgagctgtttcctcccttgtttttggaagtctttgaggaccaggaggtttag

SEQ ID NO: 208673 - DNA, 1233 bp, Artificial Sequence
  Description of Artificial Sequence: Synthetic coding sequence
atggagcagaagcccagcaaggtggagtgcggcagcgaccccgaggagaattcggcccgcagtcccgacggaaagaggaagaggaaaaacggacagtgcagcctcaaaacatccatgtcaggttatataccatcgtatctggacaaagacgagcagtgcgtggtgtgtggtgataaagccactggttatcactatcggtgtattacttgcgaaggctgcaaggggttcttcaggcgcactattcagaaaaatctgcaccccacatatagctgtaagtacgatagctgctgtgtcatcgacaagataactcgaaatcagtgtcagttgtgtagattcaagaagtgcattgcggtgggaatggccatggacttggtactggacgacagcaagcgcgtggcaaagaggaagctgattgaacagaaccgtgagcgccggagaaaggaggagatgattagatcgctgcagcaaaggcctgagccaacacccgaggagtgggacctgatccacattgcaaccgaggcccaccgctcaaccaatgcacaaggatcccattggaagcaaaggagaaagttccttccggatgacattggacagtcacctatagtctccatgccagacggagataaagtggatctcgaggcattctcggagttcactaaaattatcacccccgctatcacgcgcgtcgtggactttgccaagaagctgccgatgttttcggagctcccatgcgaagaccaaataattctgttgaagggttgctgcatggagatcatgagcttacgggccgcggtgagatatgacccagaatccgacactctaactctttcaggcgaaatggccgttaagagagaacagctcaaaaacggtggtctcggggtggtaagtgatgccatatttgagctggggaagtcactttcagcctttaacctggacgacacggaagtagccctgctgcaggctgtgttactgatgtctacagaccggtctggcctgctgtgtgtggataaaattgagaaatcacaagaggcctacctcctggcgttcgaacattatgtgaaccatcgtaagcacaacatacctcacttctggccaaagctcctaatgaaggtcactgatttgcggatgattggcgcctgtcatgcatcacgatttctgcacatgaaggtcgaatgcccaaccgagctgttcccccccttgtttttagaagtcttcgaggaccaggaagtctag

SEQ ID NO: 208674 - DNA, 1386 bp, Artificial Sequence
  Description of Artificial Sequence: Synthetic coding sequence
atgacccccaacagcatgaccgagaacggcctgaccgcctgggacaagcctaagcactgcccagacagggagcatgactggaaactcgtcgggatgtccgaagcatgtctacaccggaaaagccactccgagcgtcgaagtaccttgaaaaacgagcaatcctcacctcatctcattcagactacgtggacttcatccatttttcacttggaccacgacgacgtgaacgaccagtccgtcagttctgcgcagacatttcaaacagaggagaaaaagtgtaagggctatattcctagctacctggataaagacgagctctgtgtggtatgcggtgacaaggccaccgggtatcattaccggtgcattacctgcgagggatgcaaagggttttttcgccgcaccatacagaagaaccttcacccctcttactcctgtaagtacgaggggaagtgcgttatagataaggtcactaggaaccagtgtcaagagtgccggttcaagaaatgcatttacgtcggcatggctacagacttagtcctggacgattcgaaaaggctggccaagaggaagcttatcgaagaaaatcgcgaaaagcgccgccgggaagaactgcagaagtctattgggcacaagcccgagcccaccgatgaggagtgggaattaattaaaacagttactgaggcccacgtcgcgaccaacgcgcagggctcccattggaaacagaagcgcaagttcctcccggaggacatcggacaagcgccaatcgtgaacgcgccagaaggtggtaaagtggatttagaggcattttctcacttcacaaagataatcacccctgccatcacaagggtggtcgactttgcaaagaagcttccaatgttctgcgaactgccctgcgaagatcaaatcatccttttaaagggctgttgtatggaaattatgtcattgagggctgccgttcggtatgacccagaaagtgagacgctgaccctaaacggagagatggcagtgaccaggggccagctgaaaaacgggggccttggggtggtgagtgacgcaatctttgatcttggtatgtccttgagctcattcaacctggatgacacagaggttgcactactgcaggccgtcctgctcatgtcgtctgaccggcctgggctggcttgtgtagaacggattgagaagtatcaggactccttcctcttggcatttgagcattacattaattatcgtaagcatcacgtgacccatttttggcctaagttgctcatgaaagtgaccgacctgcggatgataggtgcgtgccacgcatcccgatttctgcatatgaaggtggaatgccccacagagctgtttcctccactatttttggaggtgtttgaggattag

SEQ ID NO: 208675 - DNA, 1386 bp, Artificial Sequence
  Description of Artificial Sequence: Synthetic coding sequence
atgacccccaacagcatgaccgagaacggcctgaccgcctgggacaagcccaagcactgtcccgaccgcgagcacgattggaaacttgtgggcatgagtgaggcttgtctgcacagaaagagccacagtgaaagacggagcaccctgaagaatgaacagtcgtccccccacctgatacagaccacctggaccagctctattttccacctggatcacgacgatgtgaatgaccagtccgtgtcaagtgcacagacgttccaaactgaggaaaaaaagtgtaaaggctacataccttcttatctcgacaaagatgagttgtgcgtggtgtgcggtgataaggccacagggtatcactatcgctgcatcacttgcgaaggctgcaagggtttttttcgtagaacaatacagaaaaacctgcatccttcttatagctgcaaatacgaggggaagtgtgtgatcgataaagtcactagaaaccagtgccaggaatgccggttcaagaagtgcatttacgtgggcatggctacagatctggtgctggacgattctaagcgactagccaaaagaaaattgattgaggaaaaccgcgaaaagcgaaggcgcgaggaactgcagaagagcatagggcataaaccggaaccgactgatgaagagtgggaacttataaagacagtgacagaagctcacgtagccaccaacgcacagggcagccattggaaacagaaaaggaaattcttgccagaagacattggacaggcacccattgtcaatgcccctgagggcgggaaagtcgacctggaggctttcagtcacttcaccaagattattactcctgcaatcacgcgcgtggttgatttcgcaaaaaaactcccaatgttctgtgaactgccctgcgaggaccagatcattctgctcaaggggtgttgtatggagatcatgagtctgcgtgcagccgtgcggtacgacccagaaagcgaaaccctcaccttgaatggcgagatggcggtgactcgaggccagcttaaaaacggagggctgggtgtggtctctgacgcgatatttgatctggggatgtcactatcttccttcaacctggacgatactgaggtggccctacttcaggcagtcctcctcatgtcttccgatcggccagggttggcctgtgtcgaacgcatcgagaagtaccaggacagcttccttctcgcctttgagcattatattaattatcgcaagcatcacgttactcatttctggcctaagctgcttatgaaagttactgatctccgcatgataggcgcatgtcacgcctcgcgctttcttcacatgaaagtggagtgcccaaccgaactctttccccctctgttcctggaagtcttcgaggattag

SEQ ID NO: 208676 - DNA, 1386 bp, Artificial Sequence
  Description of Artificial Sequence: Synthetic coding sequence
atgacccccaacagcatgaccgagaacggcctgaccgcctgggacaagccaaagcactgtcctgatcgagaacacgattggaaattggtgggcatgtcggaagcatgtttgcatcgtaaaagccactctgagcggcggagtacactcaagaacgaacagtccagcccacacctgattcagacaacctggacctcttctatttttcatctggaccacgacgacgtgaacgatcaatccgtgtctagcgcacagaccttccagaccgaagaaaaaaagtgtaagggctatatcccttcctaccttgacaaagatgaattgtgtgtggtctgtggagataaggccactggataccattatagatgtatcacttgcgaaggctgtaaaggcttcttccgacgtacgattcagaaaaatcttcacccctcttactcttgtaagtatgagggaaagtgcgtaatagacaaagtcacgcgtaatcagtgtcaggagtgtcgcttcaaaaagtgtatctacgtgggcatggcgaccgacctggttctagatgattctaaaagattggctaagcggaagctgatcgaggagaaccgggagaaacggcggcgggaagagctccagaagtctatcggacacaagcccgaacccactgatgaagagtgggaacttattaagacggtcacagaagctcacgttgctacaaacgcccagggttctcattggaaacagaaacgaaagttcctgccagaagacattggccaggccccaattgtgaatgcccccgagggaggcaaagtcgacctcgaagcttttagccatttcaccaaaataatcacccccgccatcactagggtagtggactttgcgaaaaagctccccatgttctgcgagttgccctgcgaggatcagatcattctgctcaaggggtgctgcatggaaatcatgtccctcagggcagccgtcaggtacgaccccgagtcggagaccttaacgttaaatggcgagatggcagtgacccgcggccagctaaagaatggagggcttggagtggtgtccgacgccattttcgacttgggaatgtcactcagcagtttcaacctcgacgatactgaggttgcccttctgcaggcagtgctcctaatgtcctcggaccggcccggcctggcctgtgtggagcgcatcgaaaagtaccaagactcttttttattagccttcgaacattatatcaactacagaaagcaccatgtgacccatttctggccaaagctcctgatgaaagtgaccgatctgcgaatgatcggagcctgccatgcctcccgcttcctacacatgaaagttgagtgccccactgagctctttccccctctctttctggaagtattcgaagattag

SEQ ID NO: 208677 - DNA, 87 bp, Artificial Sequence
  Description of Artificial Sequence: Synthetic coding sequence
atgacccccaacagcatgaccgagatggccctgcagcccggcaccaaccgcagcacagtgcagactgagaacacgactggaagctag

SEQ ID NO: 208678 - DNA, 366 bp, Artificial Sequence
  Description of Artificial Sequence: Synthetic coding sequence
atgacccccaacagcatgaccgagaacggcctgaccgcctgggacaaaccaaaacactgtcccgatcgtgagcatgattggaagctggtcggaatgagcgaggcctgtctgcaccgaaagtcccactcagagcgacgcagtacactgaaaaacgagcagagtagcccacatctgatccagaccacctggacctccagtatattccacctcgaccacgatgacgtgaatgaccagagcgtgagcagcgcccagaccttccagaccgaagagaaaaaatgtaaagggtatattccgtcttacctcgacaaagacgaactttgcgtcgtgtgtggcgacaaggccaccggctaccactatagatgctag

SEQ ID NO: 208679 - DNA, 441 bp, Artificial Sequence
  Description of Artificial Sequence: Synthetic coding sequence
atgcaggtgctgaccaagcggtaccccaagaactgcctgctgaccgtcatggaccgctatgcggctgaggtccacaacatggagcaggtggttatgatcccatccctgctgcgcgatgtgcagctctccggccctggtggccaagcacaagcagaagcccctgatttgtacacctactttaccatgctcaaggctatttgcgtggatgtggatcacggcttgctaccacgcgaggagtggcaggcaaaagttgccggatctgaagaaaatgggacagcagaaactgaggaagtggaggacgagagtgctagtggggaactggaccttgaggcccagttccatctgcatttcagctcgctgcatcacattctcatgcacctgactgaaaaggcccaagaggtgaccaggaagtaccaggaaatgaccggtcaagtgtggtag

SEQ ID NO: 208680 - DNA, 2802 bp, Artificial Sequence
  Description of Artificial Sequence: Synthetic coding sequence
atgcgggccctggccgtgctgagcgtgaccctggtgatggcctgcactgaagctttctttcccttcatcagccgaggaaaggaactgctctgggggaagccggaagagagcagagtctcgagcgttttggaagagagtaagcggctcgtggacaccgctatgtacgccaccatgcagaggaatctgaaaaagcgcggcatcttgagcccagcccagctgttgtctttctctaaattgcccgagcccacatccggagtaattgcccgggcggccgagatcatggagacaagtatccaggctatgaagagaaaggtgaacctcaagacccagcaaagccagcaccctacagacgccctctcagaggacctcctgtccattatcgcaaatatgtctggttgtcttccatatatgctgccccctaagtgtccaaatacatgccttgcaaacaaataccgaccaattactggagcatgcaacaaccgcgatcatcctagatggggcgcatctaataccgccttggccaggtggctcccaccggtgtacgaggatgggttttctcagcctcggggctggaatcctgggtttctttacaatggattccctttaccccccgtgagagaagtgacgagacacgtgatccaggtgagtaatgaggtcgttacagatgacgataggtactcagacctacttatggcgtggggccagtatatcgaccacgacatagcctttaccccgcagtctacctcaaaggcggcttttggtggaggtgcagactgtcagatgacatgtgagaatcaaaatccttgttttcctatccagttacccgaggaggcacggcccgccgctgggaccgcttgtctccccttctatagaagctctgctgcttgtgggaccggggatcaaggggcgctgttcgggaacctttccacggccaatccacggcagcaaatgaatggcctgacctccttcctggatgcaagcactgtctatggcagctcgcccgcgcttgagagacagctcagaaattggacttctgcagaaggtttgctccgagtgcacgcccgcttaagagattctgggagagcctatttaccctttgtgccacccagagctccggcagcctgtgccccagaacccggcatccccggagaaacacgtgggccctgcttcctcgccggggatggcagagctagcgaagtcccctccctgacagccctgcacaccctgtggctcagggagcataacaggctggctgcagccttgaaagccttgaatgctcactggtcggctgatgcagtatatcaggaggctagaaaggtagtgggagcccttcatcagataatcactcttcgagactacataccaaggatcctcggcccagaagccttccagcagtatgtgggaccctacgagggatatgactccactgctaaccccactgtgagtaatgtctttagcaccgcggcctttcgattcggccacgctaccatccaccctctagtcagacgcctcgatgcttcgttccaagagcatccagaccttcccggcctgtggctccaccaggccttcttttctccctggacgttgctaagaggagggggtctggatccactgatacgcggcctcttggccaggcccgcaaaactgcaagtgcaggaccagctgatgaacgaagaattgactgaaagattattcgttctcagtaattcatcaacattggacctggcatcaattaatctccagaggggaagggaccacggcctgcctggttacaacgagtggcgggagttctgcggcctgccgcgcctggagactcctgctgatttatcaacagctatcgcttcccgaagcgtggcagacaaaattctggacctgtacaaacaccccgacaacattgatgtgtggttggggggactcgctgaaaattttcttcccagggcaaggacaggccccctcttcgcctgtctcatcggcaagcagatgaaggccctgcgagacggcgactggttttggtgggaaaacagtcacgtgttcactgatgcgcagcggcgggagctcgagaaacactcattgtcccgagtgatatgtgacaatacgggcctcacacgtgttccaatggatgcttttcaggttggaaaatttccggaggatttcgagtcctgcgatagcattaccggcatgaacttagaagcatggcgagaaaccttccctcaagacgataagtgtggtttccccgaatccgtcgaaaacggggactttgtgcattgcgaggagagtggtcgccgggtattggtctattcttgtcgccatggatatgagttacagggccgggaacagcttacatgcacccaggaagggtgggactttcagcctcccctctgtaaagatgtaaacgagtgcgctgacggtgctcaccctccctgtcatgcttccgcacggtgccgaaacacaaaaggcggcttccaatgtctttgcgccgatccatacgagctcggtgacgacggaaggacatgtgtggacagtgggcgtctgcctcgtgtaacttggatcagtatgtccttagcagccctgctgatcggtggcttcgctgggctcactagtaccgttatttgtaggtggacacgtacaggaacaaagtcaacattgcccataagcgagaccggcggaggcacacctgaactccgttgtggaaagcatcaggccgtcgggacgagcccccagcgagcagctgctcaggattcagaacaggagtcagccggcatggaggggagggacactcaccgactgccccgagccctttag

SEQ ID NO: 208681 - DNA, 2790 bp, Artificial Sequence
  Description of Artificial Sequence: Synthetic coding sequence
atgcgggccctggccgtgctgagcgtgaccctggtgatggcctgcacagaggctttttttccttttatcagcaggggaaaggaattgctttgggggaagcctgaagagtctcgagtgtctagcgttctggaagagtccaaacgcttagtggatacagcaatgtatgccacgatgcaaagaaacttgaaaaagcgggggatcctgagccctgcacagctgttaagcttcagtaagctgcccgagccaacttcaggcgtcatcgctagagcagctgagatcatggaaacatctatccaggctatgaaaagaaaggtgaacttaaagacccagcaatctcaacacccaactgacgccctgtccgaggatctcctgagtatcattgccaacatgagcgggtgcttgccatacatgctgcccccgaagtgccctaatacatgcctggctaacaagtaccgtccaatcacgggggcctgcaataacagagatcatcctcgctggggtgcctccaacactgcgttagcgagatggctgccaccggtgtacgaagatggattcagccaaccacggggatggaacccgggcttcttgtataacgggttcccactgcctcccgttcgagaggtgactaggcacgtgatccaagtgagtaacgaagtggtcacagacgatgataggtattccgatctcctaatggcatggggtcaatacatcgaccatgacatcgcattcactccacagtccacgtctaaggccgcattcggaggcggagctgactgtcagatgacatgcgagaaccagaatccttgctttcccattcagttgcccgaggaggctcgtcccgctgcgggtaccgcctgccttcctttttaccgttcgtccgcggcttgcgggaccggcgatcagggagcgctgtttgggaacctcagcaccgctaatccccgccaacagatgaacggcctcacgagctttctcgacgctagtactgtgtacgggagttcccctgccttggagcgtcagttacgcaattggacgtctgcagagggcctgctgcgcgtccatgctcgcctccgggatagcggccgggcgtaccttcccttcgtgccgccccgggctcccgccgcatgtgcccccgaacctggcatccccggggagacgagaggaccttgttttctggctggcgacgggcgtgccagtgaagtacccagcttgaccgctctgcataccctttggctgagagagcataatcgactcgcagccgccctcaaggccctgaatgctcactggtctgccgacgctgtgtaccaggaggctaggaaagtagtcggagccttgcatcagattatcaccctgcgcgactacattccccggatacttggcccggaagcattccagcagtacgtgggaccatatgaaggctacgacagcaccgctaatccgacggtttctaatgttttctccacggccgcatttagatttgggcatgcgacaattcatccactggtcaggaggttagacgctagctttcaagaacatcccgacctccctggcctatggctccaccaggcttttttctcaccttggacgctactgcggggaggaggcctagacccgcttatccgtggattactggcaaggccagctaaactacaggtgcaggaccaactgatgaatgaggaactcacggagagactcttcgtgctgagtaattctagcaccttggatctggcgagcatcaatctccagcgtggccgcgaccacgggctgcccggctataacgagtggcgggagttctgcggactgcctcgattagaaaccccagcagacctctccacagccatcgcatcacgcagcgttgccgataaaattctcgacttgtacaaacacccagataatatcgatgtctggttgggcgggctcgcagaaaacttcctgccccgcgcgcgcacaggcccgctgttcgcatgcttgattggtaaacagatgaaagcgttaagagacggcgactggttttggtgggaaaactcccacgtgtttactgatgctcagcgtcgcgagttggagaagcattccttgtcacgcgtcatctgcgacaatacaggtcttacccgggtaccaatggacgcattccaggtcggcaagttcccggaagacttcgagtcctgtgacagcattactgggatgaatctggaggcctggcgtgaaacttttccgcaagacgacaagtgtggtttccctgaatcagtcgaaaacggcgactttgtacattgtgaagaaagtggacggagggttttggtatatagctgccggcatggatacgagctgcaagggcgcgagcagctcacttgcactcaggaggggtgggactttcagccacctctgtgtaaagacgttaatgagtgcgctgatggcgctcaccccccctgtcacgcttccgcccgctgtcgcaataccaaaggaggtttccagtgtctctgcgcagatccttatgaactgggggacgatggaaggacctgcgtggactcgggtaggttgccaagagtaacttggatcagtatgtctttggcagcgttgctcattgggggctttgctggactgaccagcaccgtaatctgtcgatggcgagtcctgggttggaaggccggaattctgacggggtgccgggagccttcagaaggaaaggttgccgggcattgtcgtacagctagctgcagccagaatcaccggaccacactatttcagacacaggcgaatcccaagtcagccgggcgcctgtttagccagcacggatag

SEQ ID NO: 208682 - DNA, 2802 bp, Artificial Sequence
  Description of Artificial Sequence: Synthetic coding sequence
atgcgggccctggccgtgctgagcgtgaccctggtgatggcctgcactgaagcatttttcccattcatctccagaggcaaggaacttttatgggggaagcccgaagagtcacgagtatcttctgtgctggaggagagcaaacgcctcgttgatacagccatgtacgcaacgatgcaacggaatctaaaaaaaaggggaatcctgagccctgcgcaactactgtcgttctctaagctgccagaaccgacaagcggcgtcattgcacgagccgccgaaattatggagactagcatccaagcgatgaagcgcaaagtcaatctgaaaacgcaacagagtcagcatcctaccgatgccctcagcgaagaccttctcagcattatcgcaaacatgagcgggtgcctcccttatatgcttccgccgaagtgccccaacacttgtctggccaataaatatcgacccatcaccggcgcatgcaacaacagggatcatcctaggtggggagcctctaatacagctttggcccggtggctgccccccgtatacgaggatggtttctcacagccacgcggctggaaccctgggttcttgtacaacggatttccgctgccacctgttcgtgaagtgacgaggcatgtgatccaagtgtcaaacgaggtagtaaccgatgacgaccgatacagcgaccttctcatggcttggggccaatacattgatcatgacatcgcctttacacctcaatcaacctccaaggcagccttcgggggcggagccgattgccagatgacatgcgaaaatcaaaatccatgctttcccatacaactaccagaggaggctcgcccagctgcaggcactgcatgtctgccattctaccggtctagcgccgcttgtggcaccggggatcagggagccttgttcggaaatctctccactgcaaatccaaggcagcagatgaatggcttgacaagctttctggacgcatctacagtgtatgggtctagcccggccctcgaaagacagctgcgaaattggacatcagcagaaggcctgctgagggtacacgctagactcagagattctggacgagcgtacctgccattcgtcccacctagggcgcccgctgcctgtgcccccgaacccggaatccctggggagacccggggcccgtgcttccttgcaggcgatggaagagcatcggaggtgccaagtttgactgcccttcacaccttatggcttcgagaacacaataggttagccgcagccctaaaggccttaaacgctcactggtccgcggacgctgtctaccaggaagctcgaaaagtggtcggtgctctgcaccaaattatcaccctgagggactacattccaaggatcctgggtccagaggcattccaacagtacgtgggaccgtacgaaggatacgactcaactgctaatccgacagtgagtaatgtcttctcaaccgcagcgttcaggttcggacacgccactatccaccccctggttaggcggctagacgcctcatttcaggagcatcccgacctcccgggtctgtggttgcaccaggcatttttcagtccttggaccctactgcgaggcggaggtctggaccctctgatccggggcctcctcgctcgtcctgccaagttgcaggtgcaggaccaacttatgaacgaagaactgaccgaacggctcttcgtgcttagcaacagtagcacacttgacctggcgtcaattaacttacagcgcgggcgggaccatggcctgccaggctacaatgagtggcgcgaattttgtggtctgcccagattagaaacacctgcggacctgtcaacggctatagcttcgcggtcagtcgccgacaaaatcttggatctgtacaaacatccagataacatcgacgtctggcttggcgggctggccgagaactttctcccccgcgcccgcactggccctctcttcgcttgcctaataggcaagcagatgaaagccctccgggatggcgattggttttggtgggagaacagtcatgtgttcacagatgcccagcgtcgtgagctggagaaacattcactgtcccgggtcatctgtgataacaccggactgacccgcgtgcctatggatgctttccaagtgggaaaattcccagaagatttcgagtcatgcgatagtataacgggtatgaacttagaggcctggcgcgagacattcccacaagacgacaagtgcggcttccctgagagtgtggagaatggggatttcgtccattgcgaggagtctggcaggcgcgttctcgtctacagctgtagacatggttatgaactgcagggccgcgaacagttgacgtgcacccaggagggctgggatttccagccacccctgtgtaaggacgtgaacgagtgtgccgacggcgcccatcctccatgccatgccagcgcaagatgccgcaatacaaaaggcggatttcagtgcctctgcgccgacccttacgaactgggggatgatggcaggacctgtgtggatagtggaagacttcccagagtcacctggattagcatgagtttagctgcactgttgataggcgggttcgccgggctgacctccacagttatttgcagatggactaggaccggaacaaagtccaccttacccatttccgagactgggggaggcacgccggagttgaggtgcggcaagcaccaggctgttggtactagcccacagcgcgccgcggcccaggactctgagcaggaaagcgcagggatggaaggacgggacacacacaggctcccccgggccctttag

SEQ ID NO: 208683 - DNA, 2670 bp, Artificial Sequence
  Description of Artificial Sequence: Synthetic coding sequence
atgcgggccctggccgtgctgagcgtgaccctggtgatggcctgcacagaagctttttttccttttatctctcgagggaaagagctgctatgggggaagcctgaagagtctagagttagtagcgtgttggaggagtctaagcggctcgtggataccgcaatgtatgccaccatgcagagaaacctgaagaagagaggaattctaagccctgcacaactgttgtctttctcgaaactccccgagcctacaagcggcgtgatcgctcgcgcagctgaaattatggagactagtattcaggcaatgaagcgcaaggtgaatctcaaaacccagcagtcgcagcaccctacagatgccctgtcagaggatctgctttccatcattgcgaacatgagcggttgtcttccatacatgctccctccaaagtgccccaatacatgtctcgcgaacaagtatcgcccaataactggcgcatgcaacaatagagaccaccccagatggggcgcatccaataccgctctcgctagatggctgcctccagtatacgaggacggtttttcacagcctcgaggatggaacccaggcttcctgtacaacggattccctctcccgcctgtaagagaagtaacgcgacacgtgattcaggttagtaacgaagtggttaccgatgacgaccggtactctgatctactgatggcttgggggcagtatatagatcatgatatcgcatttacgccccagtctacctccaaggccgctttcgggggaggagctgattgtcagatgacatgcgaaaaccagaatccctgctttccgatccagttacctgaggaagctaggccagccgccggcacagcctgtttgccgttttataggtcctccgctgcatgtggaactggcgatcagggggctctgttcggtaacctgtccacggccaatcctagacagcagatgaacgggctaactagcttcctggacgcatcaactgtttacgggagcagtcctgcactcgagcgccagctgcgcaattggaccagcgctgaaggtctgcttagggtgcacgcaagactaagggattctgggcgggcctacctgccctttgtcccgcccagggcgcccgcagcatgcgccccagagcctggaatcccaggggaaacacgggggccttgcttccttgctggtgacggccgggctagcgaagtcccgtcactcaccgccctgcacactctttggttacgggaacacaacaggctggctgcagcactcaaggcattgaatgctcactggtctgccgatgccgtttaccaggaggcacgtaaggtggtcggcgccctacaccagatcataacgctcagagactatattccacggatattaggacctgaagcctttcagcagtacgtgggcccatatgaaggatacgatagcacagccaacccgaccgtgtcaaatgtgttttctacagcagcgtttcggtttgggcacgccacgatccatcctttagtgaggcggcttgacgcgagcttccaggagcaccctgatcttccggggctttggcttcaccaggcctttttttccccatggaccttgttgcgcgggggcgggttagatccacttataaggggattgctggctcgccccgcaaagctgcaggtacaggaccagctgatgaacgaggaacttaccgagagactgtttgtcctgtctaactcctccactctggatcttgcaagtatcaacctacagcgcgggcgggaccacggactcccaggctacaacgagtggcgggagttctgcggacttccacgcctggaaacaccggccgatctgtctaccgctatagcctcacggagtgtggcagataaaatcctggacctttacaaacaccctgacaatatcgatgtgtggcttgggggtctggcggagaatttcctgcctcgggcccgaactgggcctctctttgcctgcctcattggcaaacagatgaaagctctcagggatggagactggttctggtgggagaacagccacgtttttacggacgcacagagaagagaattagagaagcactctctgtccagagtgatttgtgataacactggacttactcgtgtccctatggatgcatttcaggtcggcaaattccctgaggacttcgaaagctgtgatagcattactggtatgaaccttgaagcgtggcgggagaccttccctcaggacgataagtgcgggttccctgagagcgtggaaaacggggatttcgtgcactgtgaagaatctggccggagagtgctggtgtattcctgccggcacggatatgagctgcagggcagggaacaactcacctgtactcaggagggctgggacttccagcctcccctgtgcaaggactccggaaggttgccccgggtaacctggatctcaatgtccctagccgcgctactgattggtggatttgcaggactcacaagtaccgtgatttgccgatggaccagaactggtaccaagagtacactgcccatcagcgaaaccggcggagggactccagagctgaggtgtggaaagcatcaggctgttgggacctcaccccagcgcgcggctgctcaggattcggagcaggaatcagctggaatggaaggtcgagacacacacaggctgcccagagcgctgtag

SEQ ID NO: 208684 - DNA, 2283 bp, Artificial Sequence
  Description of Artificial Sequence: Synthetic coding sequence
atgcgggccctggccgtgctgagcgtgaccctggtgatggcctgcacggaggccttcttcccttttatcagtagaggtaaggagctcctttggggcaaacccgaggaatctcgcgtgtccagcgttctcgaagaaagtaagcggttagtcgacacagcaatgtacgctaccatgcagagaaaccttaaaaaacgcgggatcctgtcccctgcacagttactgtcattcagcaagctccccgagcctacttcaggcgttatcgccagggccgctgagataatggagacctccatccaagccatgaaacgaaaggttaatctgaagacccagcagtcgcaacatccaacagacgctctgtctgaggacctcctgtctattatcgcgaacatgtctggatgtttaccgtacatgcttcccccaaagtgtcctaatacatgccttgcaaataagtatcggcctattaccggagcctgcaataatcgcgaccacccacgttggggcgcgtctaatactgcccttgctcgctggttgccgcccgtgtacgaggacgggttttctcagcccaggggctggaaccctggattcctgtacaacggattccccctgcctccagttagagaggtgacacggcatgttatccaggtatctaacgaggtggtgaccgatgatgatcggtactctgaccttctaatggcgtgggggcagtacatcgatcacgatatcgcgttcaccccccagagcacctccaaggcggctttcggaggaggtgcagattgccagatgacttgcgaaaatcaaaacccctgtttcccgatacagataattactctaagggactatattccccggatcctgggaccggaagcattccagcagtacgtggggccctacgaggggtacgatagtacggccaatcctaccgtgagcaatgtgttcagcacagcggccttccggtttggacatgccaccatacaccccctggttcgacgcctggatgctagttttcaggagcatcccgaccttcctggcctttggctccatcaggcgttcttctctccctggacattgttacgtgggggcggcctggaccccttgattcggggactcctcgcccgtcctgcgaagctgcaggtccaggaccagcttatgaatgaagaattgacggagcgcctcttcgtgctgagcaacagcagtaccttggatctcgcctccatcaacctgcaacgtggcagagaccacggcctgccaggatacaatgagtggagggaattttgcggtctccctcgacttgagacacctgctgatctgagtaccgctatcgcctccaggtcagtcgccgataaaattctggacctgtacaaacacccagataatattgacgtttggcttgggggccttgcggaaaacttcctgccacgcgcacggacaggacccctgtttgcctgcctgatcggaaagcagatgaaggccctgcgtgacggcgactggttttggtgggaaaactcccacgtgtttacagacgcccagcggcgtgaactggagaagcacagcctgtctcgggtgatatgcgacaatacggggctaaccagagtaccaatggacgcattccaggtgggcaaattcccagaggacttcgagagctgcgatagtatcacaggtatgaaccttgaagcctggagggaaacctttccacaggacgacaaatgcgggttcccagagtccgttgagaacggggactttgtccactgtgaagagagtgggcggagggtcctggtttacagttgccgccacggatatgagttacaggggcgtgagcaattaacctgtactcaggagggctgggatttccagccccctctgtgcaaggatgtaaacgagtgtgctgatggagctcacccaccatgccacgcttctgccaggtgccgcaacactaaggggggtttccaatgcctgtgtgccgacccttacgagctcggtgatgatgggcgtacctgcgtggattccggccgcctgcctagggttacatggatcagtatgtctctcgccgctcttcttattggcggtttcgctggcctaactagcaccgttatatgtagatggacaagaactgggactaaatcaacgctgcctatctcagagaccggagggggcactccagagctgagatgcgggaaacaccaggccgtcggtaccagccctcagagagccgccgctcaggatagcgagcaggaatctgccggtatggagggaagagacactcatcggttaccccgggctctatag

SEQ ID NO: 208685 - DNA, 2283 bp, Artificial Sequence
  Description of Artificial Sequence: Synthetic coding sequence
atgcgggccctggccgtgctgagcgtgaccctggtgatggcctgcactgaggccttctttccctttatctctcggggtaaagaattgctgtggggcaagcctgaggaaagtcgggtttcttctgtcctggaggagtcaaaacgccttgtagataccgctatgtacgctaccatgcagcggaatctgaagaaaaggggcattctttctccagcccagctcttgagcttctccaaattaccagagcccacatccggagtcattgctagagctgccgagattatggagacctctatccaggcaatgaaaaggaaagtgaacctgaagactcagcagtctcagcatcccacagatgcactttcagaggacctactgtctatcatcgctaacatgtctgggtgcctgccctatatgctgccgcccaagtgcccaaatacctgtcttgccaacaagtacaggcccataacgggggcatgtaataaccgagaccatcctaggtggggcgcttcgaacactgccctcgccaggtggctgccacccgtgtatgaagacggattcagtcagcctcggggttggaatcctggatttctgtacaacggctttccactgccccccgtgagagaggttacgagacacgtgatccaagtgtccaatgaagtagtcactgacgacgatcgatatagcgacctgctgatggcttgggggcaatatattgaccacgatatcgccttcactcctcagtcaacctcaaaggccgctttcgggggcggcgctgattgccagatgacatgtgagaaccagaacccctgttttcccatacagattattaccctgcgcgattacattcctcgaatccttgggccagaggctttccagcaatacgtcggcccttacgagggctatgattcaaccgccaaccccaccgtgagcaatgtcttctcaaccgctgcgttccgctttggtcacgcgacaattcatccgctcgtgcggagactcgacgcgtccttccaagagcacccagatcttccaggcctgtggctgcatcaggccttcttcagcccatggacactattaagaggcgggggactggacccactgatcagaggcctcctcgctcgacccgctaagctgcaggtgcaagaccaactgatgaatgaggagctgaccgagaggttattcgtgctcagcaactcatctactttagacttggccagcatcaatcttcaacgagggcgcgaccacggattgccaggctacaacgaatggagagaattctgcggcctgcctcggctggagactccagctgatctgagcacagctatcgcaagcaggtccgttgctgataagattttggacctctataaacatcctgacaatattgatgtgtggttaggtggactggccgaaaatttcctcccacgagcccgaaccggaccactgttcgcctgtctaattgggaaacagatgaaggcactccgcgatggcgactggttttggtgggagaattcacatgtcttcacagatgcccagcggcgcgaactggagaaacattccttgtcgcgcgtgatatgtgataatacaggcctgactagagtgcccatggacgcatttcaggtgggcaaatttcccgaggatttcgagtcatgtgactccattacaggaatgaatctggaggcttggagagaaactttcccacaagacgacaagtgtggattcccggagtctgtggagaatggggactttgtccactgcgaagaatcaggacggcgggtccttgtgtatagttgtagacacgggtacgagttgcagggacgcgaacagctgacctgtactcaagagggttgggattttcagccccccctttgtaaagacgtgaacgagtgcgccgatggagctcatccgccctgccacgctagcgctcgatgtagaaacactaaaggcggcttccaatgtctttgcgctgatccgtacgagcttggggacgatggacgaacttgtgtggattcaggtcggctgccccgtgttacctggatttccatgtcactggccgcacttctaatcggtggcttcgctggattgacctcgaccgtaatatgtcgatggaccaggactgggactaaatctactctgcccatttcggaaaccggcggtgggaccccagagcttagatgcgggaaacaccaagctgtgggaacatccccgcagagagcagctgcacaggacagtgagcaggagagcgccggaatggaaggtcgcgacactcaccggctgcctcgcgccctttag

SEQ ID NO: 208686 - DNA, 2631 bp, Artificial Sequence
  Description of Artificial Sequence: Synthetic coding sequence
atgcgggccctggccgtgctgagcgtgaccctggtgatggcctgcaccgaggcgtttttcccttttatctccaggggaaaagaactgctctggggcaagccagaagaaagccgggtctcttcagtgctggaggagtccaagagactggtggacaccgccatgtacgctaccatgcagagaaatctcaagaagagaggaatcctctccccagcccagctgctgtccttcagtaagctgccagaaccaactagtggggttattgctcgggctgctgagatcatggaaacaagtatacaggctatgaagcggaaggtcaaccttaaaactcagcagtcccagcaccctaccgatgcactgtccgaggatctactgtctataattgcaaatatgtctggttgtctgccttacatgttgccccccaaatgccccaacacctgcctggcaaacaaatatcggcctataaccggagcctgtaacaatagagaccatccgagatggggtgcctctaatactgccctggcccgatggttaccacccgtgtatgaggacggctttagtcagcctcggggctggaatccagggtttctttataacgggtttcctctgccccccgtgcgggaggtgactcggcacgtcatacaggtcagcaatgaagtagtgactgatgacgacagatacagtgatctcctgatggcctggggccagtacattgaccacgacattgccttcacgcctcaaagtacaagtaaggcagcatttggtggcggcgctgattgtcagatgacttgtgaaaaccagaacccctgctttcccatccagctgcccgaggaggcgcggccagccgcgggaacggcgtgtcttcctttctaccggagttctgccgcttgtgggaccggcgatcaaggagccttgttcggcaacctgtcaacagccaatcccagacagcagatgaacggcctgaccagctttttggacgcctcaactgtgtacgggagctcacctgcgttagagcgacaactacgcaattggactagcgccgaaggcctgttgcgagtacacgctcggctgagagatagtggacgagcctatttgcccttcgtaccacctagggcacctgcggcgtgcgcaccagagccagggattcctggggaaacccgagggccttgctttctcgcaggcgacggaagggccagtgaagtcccctccctaaccgccctgcacacactttggctccgtgagcacaacagacttgccgccgccctgaaggctttgaatgctcactggtcagcagacgctgtgtaccaggaggcgcggaaggtcgtgggggcccttcatcagatcatcaccctacgtgattatatccctagaatactgggcccagaggcattccaacagtatgtcgggccatatgaaggctacgacagcactgccaaccccacagtaagcaatgtattttctaccgctgcgtttcgtttcggccacgctactatccacccccttgtgaggcgcttagacgcctcatttcaggagcaccccgatctccctggcctgtggcttcaccaagcgtttttttcaccctggactctgctgagaggtggctataacgagtggagggagttctgcggtctgccccgtttagagacacctgcagatctttccaccgctattgcatcccgtagtgttgccgacaagattttggatctctacaagcaccccgacaatattgatgtatggttggggggactggctgagaatttcctgccacgcgccagaaccggaccactattcgcatgtcttattgggaaacagatgaaagctttacgcgacggagactggttttggtgggagaacagccatgtcttcacagatgcccaacgcagagaactggagaagcacagcctcagcagagtgatttgcgacaatacgggcttaacccgtgtccccatggacgcctttcaggtgggaaaatttcccgaagattttgaaagttgcgacagtataacggggatgaatttggaagcttggagagagactttcccccaggatgataagtgtggttttcctgagtccgttgaaaatggggactttgtccactgcgaagagtccgggcgccgggttctcgtttactcttgccgccacgggtatgaactgcagggcagagagcaactcacctgcacacaagaggggtgggattttcagcccccactgtgtaaggacgtgaatgagtgtgccgatggcgctcacccaccctgccatgcttctgcgagatgccgtaacacgaagggtggcttccagtgtctgtgcgccgatccctatgagctgggggacgacgggcgtacatgcgtggattcaggccggctccctcgcgtaacatggatctccatgagtctggccgctcttctgattggaggattcgctggactgacttccaccgtgatttgtaggtggacgcgaacaggcacaaaatcaactttgccaatcagtgagaccggagggggcacaccagagctgcggtgtggaaaacatcaagcagtaggcacgtccccacaaagggcggccgcccaggactctgaacaggaatcagccggcatggaggggcgtgacactcatcggctgcctcgtgccctgtag

SEQ ID NO: 208687 - DNA, 519 bp, Artificial Sequence
  Description of Artificial Sequence: Synthetic coding sequence
atgcgggccctggccgtgctgagcgtgaccctggtgatggcctgcacggaggctttttttccttttatctcacgcggaaaagagctgctgtggggcaagccagaagaatcccgtgtaagcagtgtcttagaggaatcaaagcggctggtggataccgcaatgtatgccacaatgcagaggaatttgaaaaagcgtggcattcttagcccagcccagctgttatcattctccaaacttcctgagcccacgagcggagtgatcgctcgtgccgcagaaatcatggagacttccatccaagccatgaagaggaaagtcaacctgaagacacagcagtcacagcatcctactgatgcactgtcagaggaccttctctccattattgccaatatgagtgggtgcttaccctacatgttgccaccaaaatgccctaacacgtgcctggccaacaaataccgccctatcacgggcgcatgtaataaccgggaccatccaagatggggcgcttctaatacagcctag

SEQ ID NO: 208688 - DNA, 462 bp, Artificial Sequence
  Description of Artificial Sequence: Synthetic coding sequence
atgaacggcctgaccagcttcctggacgccagcaccgtgtacggctcaagtcccgctctggaacgtcagctccgcaattggacatccgccgagggtcttctgcgggtgcacgcccggcttcgcgattcagggagagcctatctcccatttgtgccgccccgagcccctgcagcttgcgcccccgaacctggcattccaggcgagacaaggggcccctgctttctcgcaggggacccccgccagagagggcccctcccagacggcactgctcacgcggtggcagctcgcgcccagccaccaggtcgcggcgctcaggggccccagtgtgcgttggaaaggggtcgccgggtcccaggaggggctcaggggcggggacgaagtgcccctgaccatcatccagaggggctgcacccccaggaccccgggacacgagggcttccagccgtgcgcggaagcctgtag

SEQ ID NO: 208689 - DNA, 525 bp, Artificial Sequence
  Description of Artificial Sequence: Synthetic coding sequence
atgcgggccctggccgtgctgagcgtgaccctggtgatggcctgcaccgaggcctttttccctttcattagcagaggaaaggaactgctgtggggcaaaccagaggaatcccgggtgtcttcagttctggaagaaagtaagcgcctggtggatactgcgatgtatgcgacaatgcagagaaatctgaagaagagagggatcctaagccctgcccagttattgtcttttagcaagctcccagagcccacgtcaggcgttatagcccgggcagcggagataatggaaacatccatccaggcaatgaagcggaaagtaaatctgaaaacccagcaaagccagcacccaacagatgcgttgtctgaagatctactttctattattgcaaacatgtccggctgccttccatatatgctgccgccgaagtgccccaacacttgcctagccaacaaatataggcctatcaccggtgcatgcaataaccgtaagatgaaatacaaacccgatcactccgagacggcgaattag

SEQ ID NO: 208690 - DNA, 2295 bp, Artificial Sequence
  Description of Artificial Sequence: Synthetic coding sequence
atgcggcccgccgacctgctgcagctggtgctgctgctggacctgccccgtgacctcggtggcatgggatgttccagtcccccatgtgagtgccatcaggaagaggacttcagagtcacctgcaaggatatacaacgtattccttccttgcctccaagtacacagaccctcaaactcatcgaaacccatctgcgcaccatcccctcgcacgctttttcaaacctgcctaacataagcagaatctacgtttcaattgacgtcactttgcaacagttagagtcccatagtttttataatttgtctaaggtgacacatattgagattcgtaatacaagaaacctcacttatatcgacccagatgcccttaaagagcttccgttgctgaagtttctcggcattttcaacaccggcctcaagatgttcccagatttaacgaaggtgtatagtaccgacatcttttttatcctggaaattactgacaacccatacatgacctcgattcctgttaacgcatttcaaggtctctgcaatgaaactctgaccctgaaactctataacaatgggttcacatccgtgcagggttatgcttttaacgggaccaaacttgacgctgtgtatctcaataaaaacaaatacctgacagtcattgacaaggatgccttcggtggcgtctactctggcccttcccttctggatgtcagtcagacgtctgttactgctctccccagcaagggcttggagcacctcaaagagctcatcgcacggaacacctggaccctgaagaaattgccgctgtcactcagcttcctgcatctgactcgagcagacttgtcttacccctctcactgttgcgcgttcaagaatcagaagaagatacgcgggatccttgagtcattaatgtgcaacgagagttctatgcagtccttgcgccagcggaaatcggtcaatgccttgaattcacctctgcatcaggaatacgaggaaaatctgggcgactccatcgtggggtacaaagagaaatccaagtttcaggatactcacaacaacgcccactattatgtcttcttcgaggagcaggaagacgagataatcggcttcgggcaggagctcaagaatcctcaggaggaaacgctgcaagccttcgactcacattatgattatactatttgtggtgattccgaagatatggtgtgcacccctaagtccgatgaattcaacccctgtgaggatatcatgggctataaatttctgcgcatcgtggtatggtttgtcagtctgcttgccctgctgggtaacgtgttcgtcctgctgattttgctcaccagccactacaagcttaatgttccccggtttcttatgtgtaacctagcattcgctgatttctgcatggggatgtacctcctactgattgctagcgttgacttgtatacacatagtgaatattataaccacgcaatagattggcagactgggccaggatgcaacaccgccgggttctttacggtgttcgcctccgaactgtccgtgtacaccctaaccgttattacactagagcggtggtatgcaatcaccttcgctatgcgtttggatcgcaaaatccgactgaggcatgcctgcgccataatggtgggaggctgggtgtgctgcttcctgcttgctctcctgccattagtggggatttcctcttacgctaaggtgtcaatatgcctccccatggataccgagaccccactagccctggcctatatcgtatttgtgctgaccctgaatattgtcgccttcgtcatcgtctgctgttgctatgtgaaaatatacatcacagtgaggaatccccagtataatcctggcgacaaggacacaaagatagccaagaggatggctgtgctcatctttactgattttatctgcatggctcctatttccttctatgccctttcagctatcttgaacaagcccctcatcactgtgagcaattctaagatccttcttgtattattctacccactgaactcgtgtgccaacccatttctgtatgcaattttcaccaaggcctttcaacgagatgttttcattctgctcagtaagtttggtatttgcaagcggcaggcccaagcctatcgaggccaaagagtgccccccaaaaattctactgacatccaggttcagaaggttacgcacgagatgaggcaggggctgcataacatggaagatgtctatgaactgatagagaattcccatcttaccccaaaaaaacagggccagatctccgaagagtatatgcagacagtcctctag

SEQ ID NO: 208691 - DNA, 762 bp, Artificial Sequence
  Description of Artificial Sequence: Synthetic coding sequence
atgcggcccgccgacctgctgcagctggtgctgctgctggacctgccacgagatctgggaggcatgggttgctcaagccctccctgtgaatgccaccaagaggaggacttccgcgtcacatgtaaggacatacagcgaattccatccctgccgcccagcacccagactctgaaactaattgagacacacttacgaacaatcccctctcacgctttctcaaatctgccaaacatcagcaggatatatgtgtcaatagatgtcacgctgcagcagcttgagtctcacagcttctacaacctgtctaaggtgacacacattgagatccgcaacactcgcaatcttacatacatcgacccagatgcactaaaggagctgcctctgctcaagtttctaggaatttttaatacaggcctgaagatgttccctgacctgactaaagtgtacagtactgacatcttctttatcctggaaatcactgacaatccatacatgacttctattcctgttaacgctttccagggtctatgtaatgaaaccctgacgctcaaattatataacaacgggtttactagcgtgcaggggtacgcattcaatggaaccaagcttgacgcagtgtatctcaataagaacaaataccttactgttatcgataaagatgcttttgggggcgtgtacagtggcccatcactgctgttgcctctgggaagaaaatccttatcctttgagactcagaaagcacctcggtcttccatgccctcttag

SEQ ID NO: 208692 - DNA, 1236 bp, Artificial Sequence
  Description of Artificial Sequence: Synthetic coding sequence
atgcggcccgccgacctgctgcagctggtgctgctgctggacctgcctcgggatctcggtggaatgggctgttcctcccctccctgtgaatgtcatcaggaggaggatttcagagtgacctgtaaggatatacagcgaataccgagtctgccgccctccacgcaaacactcaagctgattgagacgcacttgcggatcgtggtatggtttgtgtcacttctggctctgttggggaatgtcttcgtgctacttatactactgacatcccactacaagctgaatgtccctcggttcctcatgtgtaatctagcattcgccgatttctgtatggggatgtacctactgttgatcgcttcagtggatctgtatacacactcagagtactacaaccatgccattgactggcagactggtccaggttgcaatactgctggcttctttactgtattcgcctcagaactatctgtgtatacccttaccgtgatcaccctggaacggtggtacgccataacattcgcgatgcgcctggatcgaaaaattcggttaagacacgcatgcgcgataatggtgggcggttgggtatgctgcttcctccttgcgctgcttcccctagtaggcatctctagctatgcaaaggtctccatctgcctgcccatggataccgaaactccacttgctctggcctatatcgtcttcgtgctgactctgaatatcgttgcctttgtcatagtctgttgttgttacgtgaaaatctacatcaccgtgcgtaaccctcagtataatccaggggacaaggataccaaaattgccaagcgtatggccgtgcttatctttaccgacttcatttgcatggcaccgatctccttctacgccttaagcgcaattctgaacaagccgctgattaccgtttccaactcgaaaatccttctggtgcttttttacccactgaacagctgtgccaatcctttcctgtatgccatttttactaaagcctttcagagggatgtgttcatcctgttgagcaagttcgggatatgtaaacggcaggctcaggcgtatcgtggtcagcgggtgccaccgaaaaactctacagacattcaggtccaaaaagtgacccacgaaatgaggcagggtctccacaatatggaggacgtgtacgaactgattgaaaactcccacctgactccgaagaaacaggggcagatctctgaggaatacatgcagacagttctctag

SEQ ID NO: 208693 - DNA, 2295 bp, Artificial Sequence
  Description of Artificial Sequence: Synthetic coding sequence
atgcggcccgccgacctgctgcagctggtgctgctgctggacctgccaagagatctggggggcatgggctgctccagtcccccctgcgaatgccatcaggaggaagactttcgcgtaacatgcaaagacatccagcgaatcccctctctgcctccctcaactcagactctcaagcttatagagacccatctgcgcactatcccctcccacgccttttcaaacctcccaaacatcagtcggatatacgtgtccatcgacgtgacacttcagcagttggaatcccatagcttctacaacctgagcaaggtgactcacattgagattaggaatactcgtaatctgacttatatcgatccagatgccctcaaagaactgcctctcctcaaattcctgggcattttcaatacggggctcaagatgttcccagacctgacaaaagtttactccaccgatatattcttcatacttgaaattaccgataacccttacatgacaagcattccggtcaacgccttccaagggctctgtaatgagacactgacattgaagttatataacaatggattcacgagtgtgcaaggctatgcatttaatggaaccaagctcgatgccgtgtacctgaataaaaacaaatatctaacagtcatcgacaaggatgccttcgggggggtatactccggaccgagtttgctggacgtctcccagacctccgtgactgcattgccttctaaaggtctcgagcatttgaaagaactgattgccagaaacacgtggaccctcaagaaattgccccttagcctctcttttctgcacttgacccgggctgatttgagctacccgtctcattgttgcgcatttaaaaatcaaaagaaaatccgggggattttggaatcactgatgtgtaacgagagttctatgcaatctctgcggcagaggaagtccgtgaatgcattgaacagtcccctgcatcaggagtacgaggaaaacctgggagatagcatcgttggatacaaggagaaaagcaagtttcaagatacacataacaacgcccattactacgtcttctttgaggagcaggaagacgagatcattggctttggtcaggaacttaaaaaccctcaagaggagacgctgcaggccttcgactcccactatgactacaccatatgtggggactctgaagacatggtgtgcaccccaaaatccgatgaatttaacccttgtgaggacatcatgggttataagtttctgcgtatagtggtctggttcgtgagcctcctggccctcctgggaaacgtcttcgtccttctgatactgctgacaagccattacaagctgaacgtgccaaggttcctgatgtgcaatctggcatttgccgatttctgcatgggcatgtatctcctgctcattgcttccgttgatctctacacccactcagaatattacaaccacgcaatcgattggcagactgggcccggttgtaataccgccggtttcttcaccgtcttcgcttcagagctgagtgtttataccctgacagtaattacactggagagatggtatgctataacttttgctatgaggctggacaggaaaattaggctgcgacatgcctgtgccattatggtgggcggatgggtctgctgctttctgttagccttgctcccgctcgttggcataagctcttacgcgaaagtctctatctgccttccaatggacacagaaactcctctcgccctcgcttacatagtgtttgtcttaaccctcaacatagtggccttcgttattgtgtgctgttgctacgtgaagatctacatcaccgtgcggaacccacagtacaaccctggagacaaggataccaagattgctaaaaggatggccgtgctaatttttaccgacttcatctgtatggcccccatctcattttacgccctgagcgctattcttaataagcctcttattacggtcagcaacagcaagattctccttgtactcttctatccgttaaactcatgtgccaatccttttctgtatgcaatctttacgaaggcattccagagggacgtctttatcttactatctaagttcggcatttgcaaaagacaagcacaggcctacagaggtcagcgcgttccgccaaagaattccacagacattcaggttcaaaaggtgacccacgagatgagacaagggctccacaacatggaggatgtgtatgaactcatcgagaactcccacctaacccccaagaagcagggccagatctccgaagagtatatgcagacagtgctgtag

SEQ ID NO: 208694 - DNA, 825 bp, Artificial Sequence
  Description of Artificial Sequence: Synthetic coding sequence
atgcggcccgccgacctgctgcagctggtgctgctgctggacctgcctcgagacctggggggaatgggttgctcgagccccccttgtgaatgccatcaggaggaggacttccgggttacctgcaaggacatccaaaggatcccgtctctgccgccaagcacccaaactctgaagctgattgaaacgcacctgaggactattcccagtcacgcattctcaaatctgccaaacatctctcggatttatgtaagtattgacgtgacacttcagcaattggagtcgcacagtttttacaatctcagtaaagtcacacacatcgaaatccgcaacacccggaatttaacttacattgacccggacgcactgaaagagcttccactccttaagtttttgggtatctttaatactggattaaaaatgtttcctgacctgactaaggtgtactctactgacatcttctttatccttgagattaccgataacccttacatgacgtccatacccgtaaatgccttccagggtttatgtaatgaaactctgaccctgaagctctacaataatggatttacctctgtgcaaggatacgccttcaacgggactaagctcgatgctgtgtatctcaacaagaataaatatttgacggtgatcgataaagacgccttcggtggcgtctactcgggcccatccttgctggttgagaatgtggcagtctccggcaaagggttctgcaagtccttgttctcttggctgtaccggttgcccctgggcaggaagagcttatctttcgaaactcagaaggccccgcgctcctccatgccatcttag

SEQ ID NO: 208695 - DNA, 912 bp, Artificial Sequence
  Description of Artificial Sequence: Synthetic coding sequence
atgagcgacgccggcggcggcaagaagccccccgtggacccccaggctgggccggggccagggccgggaagggcagcgggcgagcgcggtttatcaggttctttccccttggtattgaaaaagttgatggagaatcctccccgagaggcacgccttgacaaggagaaggggaaggagaaactggaagaggatgaagcggcagctgcttcaaccatggctgtctcggcctctcttatgccgccaatctgggacaagacaataccgtacgacggggagtcatttcatcttgagtacatggatttagatgagtttctgcttgagaacggtatccctgcaagtccaacccatctcgcacataacctgttgttacctgttgcagaacttgaggggaaagagtcagcaagtagcagtactgcctcccctccttccagttcgactgcaatcttccagccttccgagaccgtaagctccaccgaaagctctctcgagaaggaaagagaaacaccgtctcccattgatcccaattgtgtcgaggtggatgtcaatttcaatcccgatccggcagaccttgtgctcagctcagtgccgggcggcgagctgttcaaccctcgaaagcacaagttcgccgaggaggatctcaaaccacaacccatgatcaaaaaagcaaagaaggttttcgtgcctgatgaacaaaaagatgaaaagtattggacccggagaaaaaagaataatgttgccgccaagcgatctcgagatgctcgacgtcttaaagaaaaccagatcactatcagagctgctttccttgaaaaggagaataccgcgctgcgaacagaggtcgctgagttaaggaaagaggtagggaagtgcaagactatcgtgagcaaatatgagaccaaatatggccccttatag

SEQ ID NO: 208696 - DNA, 555 bp, Artificial Sequence
  Description of Artificial Sequence: Synthetic coding sequence
tgattcatcttcctgccccggcccggcaccagcctgggccggatccgtaaagcagataaggagaagggcaaggaaaaattggaggaggacgaggcagcagctgcttcgaccatggctgtaagcgcttccctgatgccacccatttgggacaagacaatcccatacgacggggaatcatttcacctcgaatatatggacctcgacgaattcctcctcgaaaatggaattccagcttcacctacccacttagctcacaacctgcttctgcctgttgctgaactggagggtaaggaatccgcaagctcctcaacagcatctccccctagctcaagtacagccattttccaaccaagcgagaccgttagcagcacagagtccagcctggaaaaagagcgtgagacaccttcaccaatcgacccaaactgtgttgaggttgacgtcaatttcaatccagatcccgctgacttggttctcagcagtgtgccaggcggtgagctttttaatccaagaaagcataagttcgcagaggaggacctgaagcctcaacctatgtag

SEQ ID NO: 208697 - DNA, 822 bp, Artificial Sequence
  Description of Artificial Sequence: Synthetic coding sequence
atggacatgcccgaggtgctgaagagcctgctggagcacagcctgccctggccggaaaagaggactgataaggagaaaggcaaagagaaactcgaggaggacgaagccgccgcggccagcaccatggctgttagtgcctcgctgatgccccccatatgggataagaccattccctatgacggggagtcctttcatcttgaatacatggacctggacgagttccttctggaaaatggaattcccgccagccccacacacttggctcacaacctgctccttccagtcgctgagttggagggaaaagagtccgcctctagctcgacagcttctccgccttcttcttctaccgcaatatttcagccaagcgaaactgtgagcagtacagagtccagcctagagaaggaaagggaaactccatcacccatagatcccaactgtgttgaagtggatgtgaacttcaacccagatcctgccgatcttgtcctgtccagtgtgcccggaggcgagctctttaatccacgcaagcacaaattcgccgaagaagacctgaagccccagcccatgatcaagaaagcaaagaaagtctttgtgccagacgaacaaaaagatgagaaatactggacacgtcggaagaagaataacgtggctgcaaagaggtccagggatgcccggcgcttaaaggagaaccagataaccattagagcagcatttctggagaaggagaacacagctttacggactgaggtcgccgagctccggaaagaagtcggaaaatgcaagacaattgtctccaaatatgagacgaagtatgggccactctag

SEQ ID NO: 208698 - DNA, 822 bp, Artificial Sequence
  Description of Artificial Sequence: Synthetic coding sequence
atggacatgcccgaggtgctgaagagcctgctggagcacagcctgccttggcctgagaagcggacggacaaggaaaaaggcaaagaaaaattggaggaagacgaggctgcggccgcatcaacaatggcagtgtcagcatctctgatgcctccaatttgggacaaaactattccatatgatggggaatccttccatctggaatacatggatctggatgagtttttactagaaaacggcatcccagcttctccgacgcacctcgctcataacctactcttacccgtggctgaactggaggggaaagagtcggccagcagctcaactgcctctcctccatcatcgtccacagccatcttccaaccttcggagaccgtgtccagcactgaatcttccctggagaaggagagagagaccccttcccctatcgacccgaactgcgtggaggtggatgtgaattttaaccccgaccccgccgatttggtcttatcttccgtcccaggcggggaactgttcaaccctcggaagcacaaattcgcagaagaggacctcaagccccagcccatgattaaaaaagcaaagaaagtttttgttcccgacgaacagaaagacgagaagtattggaccagacgtaagaagaataatgttgcagcaaaacgcagtagagatgcccgaagattgaaagaaaaccagattacaatccgggctgcattcttggagaaggagaatacagcgttgcggacggaggtggcagagttgcggaaggaggtgggcaagtgtaagacaattgtttccaagtatgagaccaagtatggccccttatag

SEQ ID NO: 208699 - DNA, 729 bp, Artificial Sequence
  Description of Artificial Sequence: Synthetic coding sequence
atgcccggcccctggctgctgctggccctggccctgaccctgaacctcaccggcgtccctggcggcagagcacagcctgaagccgcgcaacaggaggctgtgactgctgccgaacatcccgggctggatgatttcctacgccaggttgaaaggctcctttttctgcgggaaaacattcagagattgcagggcgaccaaggggagcattccgcttctcagatattccagagcgactggctatcaaagaggcaacaccctggcaagagggaagaggaggaggaggaaggcgtggaagaagaagaagaggaggaagggggcgcagtaggacctcacaaacgacagcaccctggccgccgggaggacgaggccagctggtccgtggatgtgacgcagcacaaaaggcaacatcctggacgaagaagcccttggctcgcttacgccgtgccaaaaagacagcacccgggccgcagactcgcggatccgaaagcacaacggtcctgggaggaggaggaggaggaggaggagcgggaagaagatctgatgcccgaaaagcgacagcatcccggtaaacgcgcgttaggaggcccttgtggccctcaaggggcctatgggcaggcaggtctcctgctgggactgttagacgacttgtcacgttcccaaggtgctgaggagaagaggcagcacccaggtcggcgggccgcgtgggtgagggaaccgctcgaagagtag

SEQ ID NO: 208700 - DNA, 3075 bp, Artificial Sequence
  Description of Artificial Sequence: Synthetic coding sequence
atgggcgaggacgacgccgccctgcgggccggcagccggggcctgagtgacccgtgggccgatagcgtgggggtccgccctcgcacgacggagagacacatcgcagtgcacaagcgcctcgtgctcgccttcgcagtgagcctggtggcactcctggccgtcactatgctcgccgtgctcttgagcttgagatttgacgaatgcggtgcctcagctactcccggagcggatggcggcccctctgggtttcccgaacggggcggtaacggctccctgcctggtagtgcgagaaggaaccaccacgcaggcggggatagttggcagcccgaggccggcggagtggcgagtcccggcacaacttccgcccagcctccctctgaggaggaaagggaaccgtgggagccctggacacagttacgattatctgggcacctgaagcccctgcactataacctgatgctgaccgcctttatggagaactttacattcagcggcgaagttaatgtcgaaatcgcctgcaggaacgcgacgagatatgtcgtgcttcacgccagtcgggtcgccgtcgagaaagtgcagctggcagaggacagggccttcggagccgtgccagtggctggattttttctgtacccccagacacaggtcctggtggtcgtgcttaaccggaccttggacgcccagcgtaattacaatctgaaaatcatatataatgccttgattgagaacgagctccttggcttcttcagaagctcctatgttctccatggggagaggcgatttctgggcgtaacacagttctcccccacccacgcacgcaaggccttcccctgcttcgacgagcccatctacaaagccacgttcaagatctcaattaagcatcaggcaacctacctctcactgagcaacatgcctgtggagacctccgttttcgaagaggatggctgggttactgatcatttctcgcaaaccccccttatgtctacctactacctggcctgggccatctgtaattttacctacagggagaccaccaccaaatccggagttgtggtgaggctctacgcaagacccgacgccatacgccggggcagtggggattacgctctgcacattaccaagcgactgattgagttctacgaggattatttcaaagttccctattcccttccaaagctggacctgctagctgttcccaagcacccatacgccgctatggagaattgggggctctcaatcttcgtggagcagaggatcctgctggaccccagcgtgtcaagcatttcatacttgttggacgtaactatggttatagtacacgagatttgtcaccaatggttcggggaccttgttacacctgtgtggtgggaggacgtctggctgaaggagggcttcgcccactactttgagtttgtaggaactgactacttgtatcctggttggaacatggaaaaacagcggtttctgaccgatgtgctgcacgaggtgatgcttctggacggattagcatctagccacccggtgagccaggaagtccttcaggctacagacattgaccgggtgtttgattggatcgcctataaaaagggagccgccttaattcgaatgttggccaacttcatgggacattctgtgtttcaaaggggtttacaggactacctcacaattcacaagtacgggaacgctgccagaaacgatctgtggaatactcttagcgaagcgctgaagcgcaacgggaagtatgtgaatattcaagaagtaatggaccagtggaccctacagatgggataccccgtaatcaccatcttgggaaacaccacggccgaaaataggatcatcattacacaacagcactttatttacgacatctctgcgaagaccaaagccttgaaactccagaataactcttacttgtggcagatacccctgaccatcgttgtgggcaatagatcacacgtgagttctgaggcaatcatctgggtgagcaacaagagcgagcatcatagaataacatatttagacaaggggtcctggctgctgggcaatatcaatcagacagggtacttccgtgtaaactatgacctgagaaactggcgtctactcatcgaccagcttatccgaaatcatgaagtcctttcagtgagtaaccgcgctggattaatcgatgacgccttctccctcgcccgcgccggctatcttccacagaatattcctcttgagatcatacggtacctatccgaagagaaggacttcctcccttggcacgcagcttcgcgggccctgtatccgctggataaacttctggacagaatggagaactataatatattcaacgagtacattctcaagcaggtggctacaacttacatcaaactgggatggccaaagaacaacttcaacggttctcttgttcaagcttcctaccaacatgaggaactgagacgcgaggttattatgctggcatgttccttcggaaacaagcattgtcatcagcaggcctcaaccctcatctccgactggatcagcagcaaccgcaacaggattcccttaaacgtgcgggacatcgtgtattgcacaggggtgtccctgctcgacgaggacgtatgggaatttatctggatgaagttccactcaactacagcagtctccgaaaaaaaaattcttctcgaagccttgacttgtagcgacgaccgcaaccttcttaaccgcttactgaatttaagcctaaacagtgaagtggttctcgaccaggacgctattgatgtgatcatacacgtggcaagaaatccgcatggacgggatctcgcttggaagttttttcgggataaatggaagattcttaatacaaggtatggggaggctttattcatgaacagcaagctcatttcaggcgtgactgagttcctcaatactgaaggtgaactcaaggagctcaagaatttcatgaagaactatgatggtgtcgccgcagccagtttttctcgcgccgtcgagactgtcgaagctaacgtgcggtggaagatgctgtaccaggatgaactgttccagtggctgggcaaggccctgcgccactag

SEQ ID NO: 208701 - DNA, 1197 bp, Artificial Sequence
  Description of Artificial Sequence: Synthetic coding sequence
atggagaacgagaccgtgagcgagctgaaccagacccagctgcagcctcgggccgttgtcgccctggaatatcaggtggtcaccattctgctagtactgattatctgcggacttggcattgtggggaatatcatggtagtgctggtcgttatgaggactaagcacatgaggactccaaccaactgttacctggtgagcctcgccgtcgcagatctcatggtcttggttgccgccggactccctaatataactgacagtatctatggatcttgggtctacggctatgtgggttgcctatgtattacatacttgcagtacctcggcattaatgccagctcttgtagtatcacagcgttcaccattgaaaggtacatcgccatctgtcacccaatcaaagcacaatttctatgcaccttctcccgcgcaaagaagatcattatctttgtgtgggcctttacctctctttactgtatgctgtggttctttctgcttgacttaaacataagcacatataaggatgcgattgtgatttcgtgtggctataagatctctcgcaactattatagtccaatttacctgatggacttcggagttttttatgtggtgcccatgattcttgctacagtgctgtacggctttattgctcgtatcctttttcttaatcccattccaagtgaccccaaagagaacagcaagacatggaaaaacgactctacccatcagaacactaatctgaacgtgaacacctccaatcgatgtttcaatagcactgtgtcaagccgcaagcaggttaccaaaatgttggcggttgtagtcatcctctttgctctcttgtggatgccatatcgtaccctggtagtggttaacagtttcctaagctctcctttccaggaaaattggtttctgcttttttgcagaatctgcatttatctgaacagtgctatcaacccagtcatttacaatctgatgtcccagaaattccgggccgccttccgcaagctgtgtaattgcaagcagaagccaacagagaaacccgcaaattattccgtggcacttaactacagcgtgatcaaagagagcgatcattttagtacagagctggatgatataacagtaacggacacatatttaagcgcaactaaggtttcttttgacgatacatgtctagcttccgaggtgtcgtttagccaaagctag

SEQ ID NO: 208702 - DNA, 1197 bp, Artificial Sequence
  Description of Artificial Sequence: Synthetic coding sequence
atggagaacgagaccgtgagcgagctgaaccagacccagctgcagccccgcgcagttgtcgcattagaatatcaggttgttacaatcctgctggttctgataatttgcggcctcggcatcgttggcaatattatggtggtcctagtcgtgatgcggactaagcacatgcgtacccccaccaactgttatttagtgtcattggctgtagccgatcttatggttttggtagccgcgggtctgcctaatatcaccgacagtatttacggatcttgggtatacggatacgtcggatgcctgtgtatcacttatctccagtatctgggcattaacgcaagttcctgcagcattacggcttttaccattgagagatacatagcaatatgccatccaataaaagcacagttcctctgcacctttagtcgagcaaaaaaaatcataatttttgtctgggcttttacttctttatattgcatgctgtggttctttttgttagatctgaatatatctacatacaaagatgcaattgtgattagttgcggctacaagatctcaagaaattactatagcccgatttatctgatggacttcggggtgttctatgtcgttccgatgatcctggcaacggttctgtatggattcatcgccaggattctgttcctgaacccgatcccgagcgaccctaaggaaaattcaaaaacgtggaagaacgacagcacccaccagaacacaaatcttaatgtgaatacaagtaatcggtgtttcaactctaccgtgtcttccaggaagcaagtgacaaagatgctggccgtggtcgtgatcctgttcgcactcctgtggatgccgtatagaacactcgttgtggtaaactccttcttatcttcaccatttcaggagaactggtttcttctcttctgccgaatctgtatctatcttaactctgccattaacccagtgatctacaaccttatgtctcagaagttcagagccgcatttagaaaactgtgcaattgcaagcagaagcctacagagaaaccagcgaattactccgtggcactcaattatagcgtgataaaggaatctgatcatttctcgaccgagctagacgacatcaccgtaaccgatacatacctgagcgctaccaaagttagttttgatgacacctgtctcgcgtccgaggtatccttctcccagtcctag

SEQ ID NO: 208703 - DNA, 1128 bp, Artificial Sequence
  Description of Artificial Sequence: Synthetic coding sequence
atggaggacgagatgcccaagaccctgtacgtgggcaacctgagcagggacgtgacagaggctcttatcttgcaattgttttcccagatcggaccttgtaaaaactgtaagatgatcatggatactgcaggcaacgacccttactgcttcgtggaattccatgagcaccggcacgccgctgcagcattagcagcaatgaacggacgtaaaatcatggggaaggaagtaaaagttaactgggccactacaccgtcatcccagaagaaggatacctcgaaccacttccatgttttcgtgggggatctgtctcccgaaatcacaactgaagacatcaaggctgccttcgcaccattcggtaggatatctgacgcgcgcgtcgtgaaagacatggccacaggtaaatcaaaaggctacgggtttgtgtcctttttcaacaaatgggatgcagaaaacgctattcagcagatgggcggacagtggctgggcggcagacagattcgcactaactgggccaccaggaaaccaccagccccaaagtcaacctacgaatctaacaccaagcagctgagttatgacgaggtcgtgaaccaaagttcaccgtccaattgcacagtttattgcgggggggtgactagcggcctgaccgaacagctcatgcgccagacctttagtccttttggccaaattatggagatcagggtgtttcccgacaaagggtactccttcgttcgattcaacagccatgaatccgcagcccacgcaatcgtttctgtcaatggaacaacgatagagggacacgtggtgaaatgttactggggcaaagagacattggacatgatcaaccctgtccagcagcagaaccaaatagggtacccccagccctacggtcagtggggacaatggtacggcaacgcgcagcagattggccagtatatgcccaacggatggcaagttccagcgtacggaatgtacgggcaggcgtggaaccagcaggggttcaatcaaacacagtcctctgctccctggatgggccccaactacggagttcaaccccctcagggccaaaacggcagtatgcttccaaaccagccatccggctatcgtgtcgctggatatgagactcagtag

SEQ ID NO: 208704 - DNA, 1161 bp, Artificial Sequence
  Description of Artificial Sequence: Synthetic coding sequence
atggaggacgagatgcccaagaccctgtacgtgggcaacctgagcagggatgttacagaagcactgatcctccaattattctcacaaataggaccgtgcaagaactgtaaaatgattatggacactgctggcaatgatccctactgctttgttgaatttcatgagcatcgtcacgccgccgccgccctggcagccatgaatgggcggaagattatgggcaaggaagtcaaagttaattgggccaccacacccagttcacagaagaaggacacaagtagctctactgttgttagcactcaacggtcccaggaccacttccatgtgttcgtaggtgacctcagccctgaaatcacaacagaagacataaaagccgcctttgctccatttgggcggatctcggatgccagggtggtcaaggatatggccactggcaagtctaagggttatggctttgtttcattcttcaacaaatgggatgctgaaaacgcaattcaacaaatgggaggccagtggctgggtggccgacagattcgcaccaactgggccacccgaaagcctccagctccaaagagtacgtacgagtctaacaccaagcagctttcctatgatgaggtcgtgaatcaatcaagcccctctaactgcactgtctactgtggtggggttaccagtggactaaccgagcagttgatgcgccaaaccttcagcccgttcgggcagataatggaaatacgagtgttcccagacaaaggctactccttcgtacgcttcaacagtcacgagtctgcagcccatgccatagtaagtgtcaatggcaccaccattgagggtcacgtcgtcaagtgctattggggaaaggagaccttggacatgatcaaccccgtgcaacagcagaaccaaattgggtacccacagccgtatgggcaatggggtcaatggtatggcaacgcacaacagatcggacagtatatgccaaatggctggcaagtgcccgcatatgggatgtatgggcaagcctggaatcagcagggctttaatcagacacagtcctcagccccgtggatggggcctaactacggggtccagccccctcagggccagaatgggagcatgcttccaaatcagccaagcggctacagagtcgcaggctacgagacccaatag

SEQ ID NO: 208705 - DNA, 1392 bp, Artificial Sequence
  Description of Artificial Sequence: Synthetic coding sequence
cccctggtgagccgggagacccccctgagctgcagccacaaccggctcaatgatttgggcggcagtgagggacagggtgccggccccggtggggctgccgccacggccgccgccatggaggacgagatgccaaagaccctgtacgtcggtaacctttcaagagatgttacggaagctttgattcttcagctctttagccagattggcccctgcaagaactgcaaaatgatcatggacacagctggcaacgacccatactgctttgtggaatttcatgagcacaggcatgccgccgcagctctggcggcaatgaacggcagaaaaatcatgggaaaggaggtgaaagtaaattgggcgaccacacctagtagtcaaaagaaagacacaagctcatccacggtcgtcagtacccagaggtctcaggaccacttccacgtgttcgtcggcgaccttagccctgaaataactacagaggacatcaaggccgcctttgcccccttcggccgtataagcgacgcgcgagtggtcaaagatatggccactgggaagtcaaagggttacggattcgtgtccttctttaataaatgggacgccgagaacgccatccagcagatgggcgggcaatggctcggtggcaggcagatcaggacaaactgggctacccgcaagccacccgcccccaaaagcacctacgagtgcagatgcatcggcgaggaaaaggaaatgtggaattttggggagaaatatgctcgcttttgctcacgtcgcttgatcgccgagattgatgaaaagcagattaaaacaactattcagaagtcaaacacaaaacagctctcatatgatgaggtcgttaatcagtcaagtccctcaaattgtactgtgtattgcggaggagtgacgtccggacttaccgagcaactgatgcggcagacgttctctccctttgggcagataatggagattagggtctttcccgacaagggctatagctttgttaggttcaatagccacgaaagcgccgcccatgccatcgtgtccgttaacggcacaacaatagagggacacgtggtgaaatgttattggggcaaagagaccctggacatgatcaaccctgtgcagcaaaatcaaataggataccctcaaccttatgggcagtggggccagtggtatgggaatgcccagcaaatcggtcagtatatgccaaacggctggcaggtgcctgcttatggaatgtacggccaggcctggaatcagcaagggttcaaccagactcagtcatctgccccttggatggggcccaattacggcgttcagcctccacagggacagaacggaagtatgctcccaaatcaaccctctgggtatagggtcgcgggctacgaaactcaatag

SEQ ID NO: 208706 - DNA, 258 bp, Artificial Sequence
  Description of Artificial Sequence: Synthetic coding sequence
atgatcaccgagcacaccagcaacgacccctactgcttcgtggagttttacgagcaccgggacgccgctgcagccctagccgccatgaacggcaggaaaatactgggcaaagaagtgaaagttaattgggccactacccccagcagtcagaagaaagatacgtctaatcacttccacgtattcgtgggcgatttgagtcccgagatcaccacagaggacatcaaatccgcttttgctccattcggcaagatctcgtag

SEQ ID NO: 208707 - DNA, 759 bp, Artificial Sequence
  Description of Artificial Sequence: Synthetic coding sequence
atggacgcccgggtggtgaaggacatggccaccggcaagagcaagggctatggttttgtctccttctacaataaactggatgcagagaatgcgatagtgcatatgggaggccagtggctgggaggccgacaaattcgcaccaattgggcaaccaggaagccccccgcacctaagtcaacgcaggagaataataccaagcaactgcgattcgaagatgtagtaaaccagagtagccctaagaattgcaccgtgtattgcggagggatcgcctcaggactgactgaccagttgatgagacagacttttagtccatttggccagataatggagattagagtgtttccggagaagggatacagcttcgtgagattcagtacgcatgagtctgcagcccacgccattgtctccgttaatggaaccacaattgagggacatgttgtgaaatgttactggggaaaggaatcacctgacatgacaaagaacttccagcaggtggactactctcagtgggggcaatggtctcaggtctacgggaaccctcagcagtatgggcaatatatggccaacggatggcaggtaccgccttacggagtctacgggcagccttggaaccagcaggggttcggggtggatcagtcgccctctgctgcctggatgggcggatttggcgcacagccaccccagggtcaggcaccccctccagtcattccacctccaaaccaggccggatacggcatggcttcatatcagacccagtag

SEQ ID NO: 208708 - DNA, 1179 bp, Artificial Sequence
  Description of Artificial Sequence: Synthetic coding sequence
atgatggaggacgacggccagccccggaccctgtacgtgggcaacctaagccgggatgtaacagaagtccttattttgcagcttttctcccaaatcggtccctgtaaatcatgtaagatgatcacagaacagccagactccagacgagttaatagctccgtgggcttttccgtgctgcagcatacctctaatgacccatactgcttcgtagagttctacgaacaccgcgatgcagcagccgcactggcggcaatgaatggcagaaagatccttggcaaagaagttaaagtgaattgggctaccacaccaagtagtcagaagaaggatacaagtaaccacttccacgtcttcgttggcgacctgtcccctgaaatcactactgaagacataaaaagcgccttcgcccctttcggaaagatcagtgacgccagggtcgtcaaagatatggctaccggcaagagcaaaggatatggtttcgttagtttctataacaagcttgacgccgaaaatgccatcgtccacatgggcgggcagtggctcggaggccgccagatacggacaaattgggcaacaagaaagccaccagcccccaagagtactcaagaaaacaatacaaagcagcttaggtttgaggacgtcgtgaaccaatcttcacctaagaattgcaccgtctactgcgggggaattgcatctggtctgacggatcagcttatgagacagacattttctcccttcgggcagattatggaaattcgcgttttccctgagaagggatacagctttgtgcggttttctacacatgagtcagcagcccatgcaatcgtgtcagtgaatgggacaactatagaaggtcacgttgtgaaatgttattggggtaaggaatcaccagatatgacaaaaaattttcagcaggttgattacagtcagtggggacagtggagccaagtatatggcaatcctcagcaatatgggcagtacatggctaatgggtggcaggtccctccctatggggtatacggccagccttggaaccagcaaggctttggagtggaccaatctccaagcgctgcctggatgggcgggttcggagcccagcctccacaggggcaggcacctcctccggtcatccccccacctaaccaggcagggtatggaatggctagctaccagactcagtag

SEQ ID NO: 208709 - DNA, 399 bp, Artificial Sequence
  Description of Artificial Sequence: Synthetic coding sequence
atgatcaccgagcacaccagcaacgacccctactgcttcgtggagttttacgagcaccgagacgcagcagcagccttggctgccatgaacggtaggaagatattgggcaaggaagtgaaggtgaactgggctacaacaccttcctcgcagaagaaggatacaagtaaccactttcacgtgtttgtcggtgatctatctccggaaattaccaccgaggacatcaaatccgcgtttgctccctttgggaaaatctcagacgccagagtggtaaaggatatggctacaggaaagagtaagggttacggttttgtgagtttctataataagctggatgccgaaaacgcgattgtccatatgggggggcagtggctgggcgggcgccagattcgaacaaattag

SEQ ID NO: 208710 - DNA, 1128 bp, Artificial Sequence
  Description of Artificial Sequence: Synthetic coding sequence
atgatggaggacgacggccagccccggaccctgtacgtgggcaacctatctcgggacgtcactgaggtgctaatactgcagttattctcacagatcggaccatgcaagagttgcaagatgatcacagaacacacttctaatgacccttattgctttgtcgagttctacgaacacagagacgcggcagctgccctagccgctatgaacggccgcaaaattttaggcaaggaagtgaaagtaaactgggctactacaccttcttctcagaagaaagacactagcaaccacttccatgtgtttgtgggagatctgagccctgaaatcaccactgaggacatcaaatctgcctttgcccctttcggcaaaatttcagacgctagagtggtgaaagatatggccaccgggaaatctaagggatacggattcgtttctttttataacaaattagatgcggagaacgccatcgtacatatgggcggacagtggctcggcgggagacagatcagaaccaattgggcaactcgaaagcccccggcacccaaatcgactcaagaaaataacacgaaacagctgcggttcgaagacgtcgtgaaccagtctagcccaaaaaactgtacggtgtattgcggcgggatcgcctctgggctgactgaccagctaatgcgccaaaccttttctccttttgggcagataatggagattcgggttttccctgaaaaaggctattctttcgtgcgctttagcacccacgaatcagccgctcacgctattgtgtcagttaacgggacgactatagaggggcatgtagtcaaatgctattggggcaaagaaagcccagacatgaccaaaaatttccagcaggtggactattcccagtggggacagtggtcacaagtgtatggtaacccccagcagtacggacagtacatggcgaatggctggcaagtgccaccctatggtgtatacgggcagccatggaatcagcaaggatttggtgtcgaccagtcccccagtgccgcatggatgggagggtttggcgcacagcccccacaggggcaggcccctcctcccgtgattccccccccaaaccaggccggatacgggatggcctcgtatcagacacagtag

SEQ ID NO: 208711 - DNA, 1776 bp, Artificial Sequence
  Description of Artificial Sequence: Synthetic coding sequence
atggccagcaagtgcagcagcgagcggaagagccggaccagcctgacactaaaccagaaactcgaaatgatcaagctgtcagaggaaggaatgtccaaggctgagatcggcaggcggttgggattgttgcgtcagaccgtgagtcaggtggtgaacgcgaaggaaaagttcttgaaagaagtgaagtccgccactcccatgaacacgcgcatgatcagaaagagaaattctctcatcgcagacatggagaaggtacttgtggtgtggattgaagatcagacttcccggaacattcccctttcgcagtctctgatccagaacaaagcactgacactgttcaactcaatgaaagccgagcggggggtcgaggcagctgaagaaaaattcgaagcatcacgcggctggtttatgagattcaaggagagatcacatttccataatattaaggcccaaggggaggctgcaagcgcagatgtggaggcggccgccagttatcccgaggctctcgctaaaattatagacgaaggcgggtacacgaagcaacagatcttcaatgtggatgagacagctttctactggaaaaaaatgccaagcagaaccttcatcgctcgcgaggaaaagtccgtacctggcttcaaggcttccaaggatagactcacccttctattgggtgccaatgccgctggggactttaaactaaaaccaatgctaatttatcactccgaaaatcctagggcattgaaaaactataccaaaagcactttaccagtgttgtataaatggaatagcaaagctcggatgaccgcccatctgttcactgcttggttcacagaatacttcaaacctacagtggaaacctactgttctgagaagaagatcccttttaagatcctgttgttaatcgacaatgcaccctcgcacccaagggctctgatggagatttacgaagagattaatgttatatttatgcccgctaatacaaccagtatcttacagcctatggaccagggcgtgatctccactttcaagagttactacctgaggaatacctttcataaagcactagcggccatggacagtgatgtgtcggacggaagcgggcagtccaaattaaaaacattctggaaaggcttcaccatcctggacgccatcaaaaacatccgcgactcctgggaggaggttaagctgtctacactgacaggcgtgtggaaaaagttgattcctacgttgatagacgattacgaagggtttaaaacctccgtggaggaggtcagcgcggacgtagtggaaatagcaaaagaactcgaattggaagtggaaccagaggacgtcacagagctgctgcagagccacgataaaacactgactgacgaggagcttttcctcatggacgcacaacgcaaatggttccttgaaatggagagcactcccggcgaggacgcggtgaatatagttgaaatgacaaccaaagacctggaatactacatcaatctcgtcgataaagccgccgcaggcttcgaacgtatagatagtaactttgaacgcagctccactgtggggaagatgctgagcaacagtatcgcttgctaccgagaaatcttccatgagagaaagtcccagctcatgaggaaagcctcaccaatgtcttatttcaggaaactgccacagccaccccagcctagcgctgctactaccctcacaagtcagcagccatccactagcagacaggacccaccccccgccaagcgggtgcgtctcaccgaggggtctgattag

SEQ ID NO: 208712 - DNA, 1578 bp, Artificial Sequence
  Description of Artificial Sequence: Synthetic coding sequence
atgctgggcaagcggaagcgggtggtgctgaccatcaaggacaagctcgatatcatcaagaaattggaagaggggatctccttcaagaaactcagcgtggtgtacggcatcggggagtccacggttcgggatatcaaaaagaataaagaacgcatcatcaattacgccaactcttccgacccaacatctggcgtctcaaaacgaaaaagcatgaaatcatcgacttacgaggagctcgaccgcgtcatgatagaatggttcaatcagcaaaagactgatggcatccctgtatccggaactatctgcgcgaagcaggccaagtttttctttgacgccctgggaatggagggagacttcaacgcgagctctggctggctgacgcgcttcaaacagaggcacggcattcccaaggcagcgggaaaaggcaccaaactgaagggagacgaaacggccgcacgggagttttgtggcagctttcaggaatttgtagagaaagaaaatctacagcccgaacagatatatggagccgaccagacaggactgttctggaagtgcctgcccagccgcacccttacattagagaccgaccagtccacgtctgggtgccggagtagccgagagaggatcatcatcatgtgctgcgccaacgccacaggactccacaagctcaacctgtgtgtcgtggggaaggcaaaaaaacctcgggcctttaagggtaccgacctgtccaatctcccggttacatactattcgcagaaaggtgcctggatagaacagtcagtgtttcgccagtggttcgaaaaatatttcgtcccccaagtgcagaagcatctcaagtccaagggccttctcgaaaaggctgttttgctcctcgattttccacctgctcgacctaatgaggaaatgttaagcagcgatgatggcagaattattgtaaagtatctgccaccaaacgtgacctctcttatccagcccatgagccagggcgttcttgccaccgtcaagagatattatcgagccggcctcttgcagaaatacatggacgagggcaatgacccaaaaatcttctggaagaacttaacggtcctagatgccatctatgaagtatcacgggcatggaatatggtcaagagcagtactattactaaagcctggaaaaaattattccccggaaatgaagagaattctggaatgaacatagatgagggagcaattctcgcagctaatctggcaaccgtattacagaataccgaggagtgcgagcatgtcgacattgagaatatcgatcagtggttcgattcccggtcttctgacagcagctgccaggtgctgacagattcagaaagcgctgaggatcagaccaaggccgccgagcagaagccgagctccaagagtcgcaaaaccgagctcaatccggagaagcacatttcacacaaagccgccctcgagtggactgagaacttactagactacctggaacagcaggatgacatgctgctctctgacaaactagttctgagaagactgagaaccataattaggaagaagcagaaaattcagaataataagaaccattag

SEQ ID NO: 208713 - DNA, 1650 bp, Artificial Sequence
  Description of Artificial Sequence: Synthetic coding sequence
atgaacaagcggggcaagtacaccaccctgaacctggaggagaagatgaaagtcctgagtagaattgaggccggccgttcactgaagagcgtcatggacgagtttggtatctctaagagtaccttctacgacattaaaaagaacaaaaaattaatcctggatttcgtgcttaagcaggatatgccactggtcggagccgagaagagaaaacgcacgaccggcgccaagtatggcgatgtggatgatgccgtttacatgtggtatcagcagaaacggagcgccggggtgcctgtgaggggcgtggagctccaggcggctgcagaaaggtttgcacgctgcttcggaagaacggactttaaggcctctactggctggctcttcaggttcaggaatcgtcacgcaatcggaaacagaaaaggatgtggggagcaggtactttcatccgtctccgagaacgtggagcctttccggcagaagttgtccatgattatcaaagaggagaagctttgtctggcacagttgtattccggggacgaaaccgacctgttttggaaatccatgccagagaattcgcaagccagcaggaaggatatctgcttaccaggaaagaaaattaataaggagagactatcggctttcctgtgcgcaaatgctgatggcactcataagttaaagagtatcatcatcgggaagtcaaagttgccaaaaagtgtaaaggaggatacttctactttgcccgttatatataaaccctctaaagatgtgtggttcacgagagaattatttagcgaatggtttttccaaaattttgtaccagaggttcgacactttcaactcaatgtactgcgttttcacgatgaggatgtgcgggcgctgcttctcttggacagttgtcccgcccatcccagctcagagtccctgacatctgaggacggcaggattaaatgcatgtttttcccccacaacacgtcaacgctcatacaacctatgaaccaaggggtgattttgagctgtaagcggttgtatcggtggaaacaactcgaggagagcctagtcatcttcgaagaaagcgacgatgagcaggaaaaaggcgacaaaggtgtctctaaaataaagatttataatatcaagtccgctatcttcaactgggccaaatcctgggaggaggtgaaacagatcaccattgctaatgcctgggaaaacctactgtataagaaagagcccgaatatgatttccagggcctggagcatggcgattatagagagatcttagagaaatgcggcgaactggagacaaagttggacgacgaccgagtgtggttaaatggcgatgaagagaaaggctgcctccttaaaaccaagggcgggattaccaaagaagtcgtccagaaggggggcgaggctgagaaacagaccgcggagttcaaactgagtgcagttcgtgagagtcttgactatttgctggactttgtggatgccactcccgagtttcaaagatttcactttaccctgaaagaaatgcaacaggaaatagtcaaaaagcagtttcaatccaaaattcacagtcgcatcggaagcttcctaaaaccgcgcccgcacaacatcaaggatagctttagcggaccaagcacctctggtagtaatcactag

SEQ ID NO: 208714 - DNA, 1650 bp, Artificial Sequence
  Description of Artificial Sequence: Synthetic coding sequence
atgaacaagcggggcaagtacaccaccctgaacctggaggagaagatgaaggtcttgtcccgtatcgaagcaggtcgttccctcaagtcagtcatggatgagtttggcatcagtaagtccactttttacgacatcaagaaaaataaaaagctaatcctagattttgtattaaagcaggacatgccgctggtgggggcagaaaagaggaagagaacaacaggagctaaatatggcgacgtggatgatgccgtatacatgtggtaccagcagaagcgaagtgcgggcgtacctgttaggggcgtcgagttgcaggccgccgcggagaggttcgcccggtgcttcggccgtactgatttcaaagctagtaccggctggctgttcagattccgaaacaggcatgccattggcaaccggaagggctgtggtgaacaggtgctgtcgtccgttagcgaaaacgtggagccttttcggcaaaaattatcaatgatcatcaaagaagagaaattgtgtttggcccaactttattctggagatgagacagacttattctggaagagtatgccagagaatagtcaagcctcgagaaaagacatctgcctgcccggcaagaagattaacaaggaacgcttatctgcatttctgtgtgccaacgccgatgggacccacaagctcaagagcataatcataggcaagagcaaactgcctaagtctgtgaaagaggatacgtctacacttccagtgatttataagccatcaaaggatgtgtggttcacgcgtgaactcttctcggaatggtttttccagaacttcgtgcctgaagtacggcactttcagctaaatgtgctccgattccacgacgaggatgtacgagcgctgctcctgttggactcctgccctgctcacccctcaagcgagtcactgaccagcgaagatgggcgaattaagtgcatgttctttccccataatacatcaacgctgattcagcccatgaatcagggagtaattctctcctgcaagcggctgtaccggtggaagcaactggaagagagcctggtgatcttcgaagaatccgacgacgagcaagagaagggtgacaagggggtcagcaaaattaagatatacaatatcaaaagtgcaatctttaattgggccaaatcctgggaggaagtaaagcaaatcactatagccaacgcctgggagaaccttctgtacaagaaagagccagagtacgatttccagggactcgaacacggtgattatagggagattttggaaaagtgcggtgagctggaaactaagttagatgacgaccgagtctggctgaatggagacgaggagaaaggttgcttgcttaaaaccaagggaggtatcacgaaggaggtggtgcagaaaggaggtgaagctgaaaaacagacagcagagtttaaactgtctgctgttagggagtcgctggattacctcctagacttcgtggacgcaacgcccgagttccagcgattccacttcactttgaaagagatgcagcaggagattgtgaagaagcaatttcagtctaagattcattctcggattggttcatttttaaaaccccgtccacacaatatcaaggattcattttccggcccctcaacttctggatctaaccattag

SEQ ID NO: 208715 - DNA, 1536 bp, Artificial Sequence
  Description of Artificial Sequence: Synthetic coding sequence
atgaacaagcggggcaagtacaccaccctgaacctggaggagaagatgaaggtactgtcaaggattgaagccggccggagtctcaagagcgtgatggacgagttcggtatctccaagagtaccttctacgacatcaagaagaacaagaagctaattttggactttgtcctgaaacaggacatgcccctcgtcggggccgagaaaaggaagcggacaactggcgcgaagtacggagatgtggacgacgctgtttacatgtggtaccagcagaaacgatctgcaggtgtgcccgtgaggggagtcgaacttcaagcagctgcagaacggttcgcaagatgctttgggaggactgacttcaaagcttctactggctggctcttccgattccggaatcgtcacgcgatcggcaataggaaaggctgcggtgagcaagtgctttccagcgtctccgaaaacgtggaaccatttcgccaaaaactgtcgatgatcataaaagaagaaaagctgtgcctggcccagttatactctggcgatgaaaccgatctgttttggaagagtatgcccgaaaactcccaggcttcacgaaaagatatatgcctgcctgggaagaagatcaacaaggaaagattatctgcatttctgtgtgccaatgccgacggaacacacaagctgaagtctatcatcattggtaagagcaagctgcctaaaagcgttaaggaggatacatctaccctccccgttatttataaaccctccaaagatgtctggtttactcgagaactgttttcagagtggttcttccaaaatttcgtccccgaggtgagacactttcagctgaatgtactgcgcttccatgacgaggacgtcagagccctgctcttgctcgatagttgtcccgcacacccatcttctgagtcactgacaagcgaagacggcaggatcaagtgcatgttcttcccacacaacacctcaaccctgatccagcccatgaatcaaggcgtgattcttagctgcaaacgtctgtaccgttggaagcagctggaagagtcactggttatttttgaggaaagcgacgatgagcaggaaaagggggataagggcgtctcaaagatcaagatctacaacataaaatcagccatttttaattgggcaaaatcttgggaggaagtgaagcaaattactatcgccaacgcctgggagaatcttttatataaaaaggagcctgagtacgattttcagggcttggaacacggtgattatagggagattctggagaagtgtggcgaactggaaaccaagctggatgatgacagggtatggctcaacggagatgaagagaaaggctgcctgctgaagaccaagggagggatcactaaagaggtcgttcagaagggcggggaggccgagaagcagaccgccgaatttaaactgtccgcagtgagagagtctctcgactacctactcgactttgtcgacgctacaccagaattccagagattccattttaccctgtgtgagttttctgacgatagctag

SEQ ID NO: 208716 - DNA, 1644 bp, Artificial Sequence
  Description of Artificial Sequence: Synthetic coding sequence
atgaccagcgccgcccccgccaagaagccctaccggaaggccccccccgaacatcgcgagttgagactggagatcccgggaagtcgtttggagcaggaagaacccctgaccgacgcggaacgtatgaaactcctacaggaagaaaacgaagagctgcgccgccgtttggcctccgctacaagaaggacagaggctctggagagggaactggaaattggccaggattgcttggaattagagctgggtcagtcacgcgaggaactggataaatttaaggataaattccgccgtttgcagaattcttacaccgcgagccaacgcacaaaccaggagctggaagataagctgcataccctcatcaaaaaggcagagatggatcgaaaaaccttagactgggagatagtagagttgactaataaattactagatgcaaagaacaccatcaacaagttagaggagctgaatgagcgctaccgtctcgactgtaacctcgccgtccagttgctgaaatgcaataaatcgcactttagaaatcacaaattcgcagacttgccttgcgaacttcaagatatggtccgaaaacatctgcactccggccaagaagccgcctctcccggtccagccccctccttagctccaggtgctgtagtgcctacgtctgttatcgccagggtgctggaaaagcctgagtccctactcctgaacagcgcccagtccggctctgctggcagaccattagccgaggatgtgtttgtgcacgtggatatgagcgagggagtacccggggatcccgcgtccccaccggctccgggctcgccgactccacagcctaatggagagtgccattctctggggacagctaggggttcacctgaggaggaactcccgctgccagccttcgaaaaactcaatccatatcccacacccagcccacctcatcccctatatccagggagaagggtgatcgagttcagcgaagataaggtccggattcctagaaacagtcctcttccaaattgtacgtacgccactcgccaagcgatcagcctgtctcttgtcgaagagggctctgaaagggcaaggccatctccagtccccagtacccccgccagtgctcaggcctccccacatcatcagcctagccctgcacccctgacgctttccgcaccagcctcctctgctagcagtgaagaagatcttctggtgtcctggcaacgagcgtttgtggacaggacacctccgccggccgcagtagcgcagcgaacagctttcgggcgggatgctctgcccgagctgcaacgacacttcgcgcattcgcctgccgatcgcgacgaagtggtccaggccccaagcgctaggcccgaggaaagcgaactgctgctgcctacggagccggactctgggttcccgcgcgaggaggaggagctgaatcttccaatctctccagaggaagagcgccagtctctcctacctattaatcgaggcacagaagagggcccaggaaccagtcatacagagggccgggcgtggcctctgccttcttcgagccgcccgcagagatcccccaagcgcatgggagtgcatcatctgcaccggaaagacagtctaactcaggcacaagaacagggcaacctgcttaactag

SEQ ID NO: 208717 - DNA, 1644 bp, Artificial Sequence
  Description of Artificial Sequence: Synthetic coding sequence
atgaccagcgccgcccccgccaagaagccctaccggaaggcccccccagagcaccgcgagctccggctggagataccaggtagtcgcctggagcaagaggaaccactaactgatgccgagcgcatgaagttactgcaggaggagaatgaggagctcagaagacgcttagcgagcgctactaggagaacagaagctttagagagagagctggaaataggacaagactgccttgaattggagctgggtcagtctcgggaggaactagataaatttaaagacaagttcaggcgcctgcaaaactcttatacagccagtcagaggaccaatcaggagttagaggataaacttcacacattaatcaaaaaagccgagatggatcggaagacgcttgattgggagatcgtagaactgacaaacaaactgctggacgctaagaacaccatcaacaagctggaggaactgaacgagagatataggcttgactgcaatctcgccgtgcagttacttaagtgcaacaaatctcacttccggaaccataagttcgccgatctgccatgcgagctgcaggacatggtgaggaaacatctgcattcagggcaggaagccgccagtcctggtcccgctccctctttggccccaggggctgtggtgccaactagtgtcattgctcgcgtactggagaagcctgagagcctgctgttaaactctgctcaatcaggctctgccggaaggcctctggctgaagatgtgtttgtgcatgtggatatgagtgagggcgtgcctggcgatcctgcatcccctccggcgccaggctcacccacacctcaaccaaacggggagtgccattctctcggcacagcccgagggagtcctgaagaagaattaccactacctgcattcgagaagttaaatccctatccaactccaagcccgccccatcccctctatcccggccggagggtcatagagtttagtgaggacaaagtgcggattccccggaattctccactgcctaactgcacatatgcgacaagacaagcaatctctctgagcctggtggaagaagggagcgaacgggccagaccatcacctgtgccatccacgccggcctccgcacaagcttcacctcaccatcagccatcacctgcccccctgacattgagcgcacccgcctcttctgcctcgagcgaggaagaccttctggtcagctggcagagggccttcgtggatcgaaccccaccccctgccgctgtcgcgcaacggacagccttcggaagggacgccctgcccgaactgcagcgccacttcgctcactccccagccgaccgcgacgaagtcgtgcaggctccttcagcacgccctgaggagagtgagctcctgcttcccacggagccagattcggggtttcctcgggaagaggaagaattaaatctaccaatctctcctgaggaagaacgacagtccctgcttccgattaacagaggaacagaggaggggcctgggacttcacatacagaaggccgggcctggcccctgccgagctccagtaggccccagaggtccccaaagcgtatgggtgtgcaccatctgcaccggaaagatagtctgacccaggcccaggaacaagggaatctcctgaactag

SEQ ID NO: 208718 - DNA, 1674 bp, Artificial Sequence
  Description of Artificial Sequence: Synthetic coding sequence
atgaccagcgccgcccccgccaagaagccctaccggaaggccccccctgagcaccgcgaacttcggctggaaatcccagggtcgcggctcgagcaagaagaacctcttaccgatgccgagcgtatgaagttgttacaagaggagaatgaggagctgcgccgccgacttgcgtcggcaacgcgcagaactgaagccctggagagagagctcgaaatcgggcaagattgcctggagctggagctgggccagtcacgagaggagctggataaattcaaagacaagttcaggcgcctgcagaacagctatacggcgtcgcagcggaccaatcaggaactagaggacaagttgcatactctggccagcctcagtcactcttggatcttcgccataaagaaagcagagatggacaggaaaacgctggactgggagattgtcgagctgacaaacaagcttctagatgctaaaaacaccataaacaaattagaagaactgaacgagcgctatagactggattgcaatttggcggttcagcttctgaaatgtaataagtcacatttccgaaaccataaatttgcagacttaccttgcgaactgcaggatatggtgcgcaagcacttgcatagcggacaggaagccgcctcacctggcccagcaccttctcttgcccctggcgcagtggtgcctacatcagttattgcgcgggtgctcgaaaagccagaaagcctgctgctcaactctgcccagtcaggaagcgccggcagaccattagcagaggacgtgttcgttcatgttgatatgtccgaaggggtgcccggagatcctgcctcgcctcccgcccccggctcaccaactcctcagcctaatggagaatgccactccctcggcacagcaaggggcagccctgaggaagagctccctctgcccgcttttgagaagctcaatccttacccaacaccttccccaccacaccccctctatcccggtaggcgagtaatcgagttttctgaggacaaggttcggatcccacgcaatagtcctctgcccaactgtacctatgctacccgccaggctatttctctgtcgctcgtggaagagggaagcgagcgggcccgtcccagccctgttccttcaacccccgcctccgcccaggcttcaccccaccaccagccatcaccggcccccctgactctgagcgccccggccagctcagcttcaagtgaggaagacttactagtgtcctggcaaagggcttttgttgatcggactcccccaccggccgctgttgcgcagagaacagcattcggtcgggatgcacttcctgagctccagcgacacttcgcgcattctccagccgacagagacgaggtggttcaggccccaagcgcacggcccgaggagtcagagctccttctgcctactgagccggattccggattccccagggaagaagaagaactgaacctgcctatttctcccgaagaggagcgacaatccttactgcctatcaaccgggggaccgaagagggacccggcactagtcacacagagggcagggcatggcctctcccaagcagctcacgcccacaacgatcccccaagcggatgggagttcatcaccttcacagaaaagactccctcactcaggctcaggagcaaggaaatctgctcaattag

SEQ ID NO: 208719 - DNA, 1674 bp, Artificial Sequence
  Description of Artificial Sequence: Synthetic coding sequence
atgaccagcgccgcccccgccaagaagccctaccggaaggcccccccggagcatagggagcttcgcctcgagatcccaggaagtaggctggagcaagaggaacccttaaccgatgcagaacggatgaaactgctgcaagaagagaacgaggaattacggcgacgcctggcctctgccaccaggcgcactgaggcgttagaaagggaactcgaaattgggcaagattgcctggagctagagctgggtcagtcacgagaagaactggataagtttaaagacaagtttagaagactccagaatagctacacagccagccagaggaccaaccaagagttggaggataaattgcacacacttgcttctctgtcacattcttggatttttgcaattaagaaagcagaaatggaccgtaaaaccctcgattgggaaatagtcgagttaacaaacaaactgcttgacgcgaagaataccatcaataagctcgaggaactaaatgaacgctaccgcctcgactgtaacttagccgttcaactgttaaaatgcaacaaatcccacttccgcaatcataagtttgcagatctaccctgtgagctgcaggacatggttagaaaacacttgcatagcggccaggaagccgcaagccccggccccgccccctctttggcgcccggagctgtggtccccacttccgttatagcacgcgtgttagaaaaaccagagtccctcctgctcaactctgcccaatctggcagtgccggacgccccttagctgaagatgtctttgttcacgtggatatgtccgagggcgttccaggtgacccagcctctccacctgcacctgggtcacccacaccccaaccaaatggggaatgtcattccctgggcacggcccggggcagccctgaggaagaactgccgctacccgcattcgagaagctgaacccttaccccactccctcccctccccatcccttatacccagggaggcgtgtgatcgagttttcagaagataaagttcgtatccccaggaattctcctcttcccaattgtacatacgctactcggcaggcgatttcgttgtctctggtcgaggaagggagcgaaagagccaggccttcaccagtgccatcaactcctgccagcgcccaggcttccccacatcaccagccgagccccgcaccactgaccctttctgctcctgccagctccgcatcctctgaggaagaccttttggtgtcgtggcaacgagcctttgtggaccgcacccctccccctgccgccgtagctcagagaactgctttcggcagggatgcattgcccgagctgcagcgccactttgcacactccccagcagatcgggatgaggtcgtgcaggccccgtcagctaggcccgaagagtcagagcttttgttaccgacagagcctgactcaggatttccacgcgaggaagaggagttgaatctgcctatttcaccggaagaagaaaggcagtctctgcttcctattaatcgcgggacagaagagggccccggaacaagtcatactgaaggcagagcctggcctctgccttcaagtagccggccacagaggagccctaagcgcatgggcgtccatcacctacatagaaaagattcactgactcaggctcaggaacagggaaatttactgaactag

SEQ ID NO: 208720 - DNA, 1644 bp, Artificial Sequence
  Description of Artificial Sequence: Synthetic coding sequence
atgaccagcgccgcccccgccaagaagccctaccggaaggccccccctgagcacagggaacttaggctggagattccaggttcaagactcgagcaggaggaacccttgacagacgctgaacggatgaaactgcttcaggaggagaacgaggaacttcgccgcagactcgcctcggccacccgacgcacagaggcactcgagagagagctcgagattggacaagactgtctcgagctggagctgggtcagtcgagagaggaactggacaagttcaaagacaaatttcgtagactccagaatagctatacagctagtcagaggacaaatcaggagttggaggacaagctgcacacccttattaagaaggctgaaatggatcgtaagaccttagattgggagattgtggaacttacgaataaactcctggacgcaaagaataccatcaacaagctagaagagttaaatgagaggtatagattggattgcaatttagccgtgcagctacttaagtgcaataaaagccactttcgaaatcataagttcgccgatctcccatgtgagcttcaagacatggttcgtaaacatttgcatagtgggcaggaagcggcctcacccgggcccgctcccagcctagccccaggagctgttgtgcccacttctgtgattgcgcgagtcttagaaaagcccgagtcgctcctgctcaactctgctcagtccgggagcgctggccgccccctggccgaagatgtgttcgtacatgtggacatgtctgaaggagtgcccggagacccggccagtcctcctgctccaggatcaccaacacctcagcccaacggagaatgccactccttagggactgcccgcgggtccccggaggaagaattacccttgcccgcttttgaaaagctaaacccgtaccccacaccttcaccacctcacccgctctatcccgggagaagggtgatcgagttctccgaagataaagtgagaatcccaagaaactcaccgcttccaaactgtacctatgccacgcggcaggccataagtctatccttagtcgaagaggggagtgaaagggcgagaccatctcccgtaccaagcacacccgcttcagcgcaagccagcccacaccaccagccctctcccgcccccctgacactcagcgcccccgcaagtagtgcttcctccgaagaggacctccttgtgtcgtggcagcgcgcatttgtggaccgcaccccccctcccgcagctgttgctcaaaggaccgcatttggcagagacgctctgcccgagctgcaaaggcacttcgcacatagtccagcagaccgagacgaagtcgtgcaagctccaagcgccagaccggaggaatccgagctgctcctgcccacagaacccgattcgggatttccaagagaagaagaagagctgaatctgcccattagccccgaggaagaaagacaatctctgcttccaattaataggggaacggaagagggccccgggacatctcacacagaggggcgggcttggccactgccgagctcctcacggcctcagaggtctccgaaacgcatgggagttcaccacctacatagaaaggatagtctcactcaggcgcaggagcagggcaacctgctgaactag

SEQ ID NO: 208721 - DNA, 1644 bp, Artificial Sequence
  Description of Artificial Sequence: Synthetic coding sequence
atgaccagcgccgcccccgccaagaagccctaccggaaggccccccccgaacacagggagctgaggttggaaattccggggagtcggctggaacaggaggaaccattaacagacgctgagaggatgaaacttctccaggaagagaatgaggaattacgccggagactggcatcagctacgcgtcgcacagaagccctcgagcgcgagctggagataggccaagattgtctcgaactcgaacttggtcagtcacgggaggagctcgacaaattcaaggacaaattcagaaggctccagaactcttataccgccagccagaggaccaatcaggaattagaggacaaactacacacccttataaagaaagccgaaatggaccgaaagacgctggattgggagatcgtcgaacttactaacaaactgctcgacgcaaaaaacactataaacaaattagaggaactaaatgaacgttacagactagactgcaacctcgccgtgcagcttctgaagtgtaataagagccattttcgcaaccataagttcgctgatttgccctgtgaattacaggatatggtgagaaaacatttgcactctgggcaagaggcggcctccccaggaccggcacccagtctggctcctggggcagtagtgcccactagcgtcatcgcccgcgtccttgagaaacccgagagcctgctgttaaattccgcacaaagtggcagcgccggccgacccttggctgaagatgtgttcgtgcacgtcgatatgtctgagggagttcccggggatcctgccagcccaccagcccccgggagccctacacctcagcccaacggggagtgccacagccttgggacagccagaggctctcccgaagaagagctccctctgcctgctttcgagaaactcaatccctatcctacaccatcccccccccaccccctctatcctggacggagagtcatcgagttttccgaggacaaagtgcgcataccgagaaattctcctcttccaaactgcacctatgcaactaggcaggcaatatctttaagtttggtggaagaggggagtgagcgagccaggccatcgccagtgccttcaactcccgcaagtgcccaggccagtccccatcatcagccatccccagcacccctcaccctctcggcacccgcgagcagcgcaagtagcgaagaagacctgctcgttagctggcaaagagcctttgttgaccggaccccaccgcctgcagctgtggcccagagaacagccttcgggcgagacgccctgcccgaactgcagagacattttgcgcattcacctgccgaccgggatgaggttgtgcaggctccgtccgcccgacccgaagaatccgaactgctgctcccaacagaacctgacagcggatttcctcgggaggaagaagagctgaacctgcctatcagcccagaagaagaacggcagagtttgttgccgattaaccgggggacggaagaggggcccggaacttcccacaccgagggcagggcctggccgttgccatcctcctcacggcctcagcgaagcccaaagcggatgggcgtgcatcatctgcaccggaaggacagtttgactcaggcccaggagcagggaaatctgctgaattag

SEQ ID NO: 208722 - DNA, 1644 bp, Artificial Sequence
  Description of Artificial Sequence: Synthetic coding sequence
atgaccagcgccgcccccgccaagaagccctaccggaaggccccccctgagcacagagaactccgactggaaattcctgggagcagactcgaacaggaggagccgctgacggatgctgaaaggatgaaactcttgcaagaggagaatgaagaactgaggcggagactggcaagcgcaactaggaggacagaagccctggagagggaactcgaaatcgggcaggactgtctagaactggagctggggcaaagtagagaagaacttgacaagttcaaggataagtttagaagactccagaattcttataccgcctctcagcggactaatcaggaactagaagacaaactccataccctcatcaaaaaggcggagatggatcgaaagactttggattgggaaatagttgaactgacaaacaagttgctggacgcgaagaacactatcaacaagctggaggaactgaacgagaggtaccggctggattgtaatctcgccgtgcagctgctgaaatgtaacaaaagtcatttcaggaatcataagttcgccgatctgccctgcgagctccaggacatggtccgcaagcatctgcacagcggccaggaagccgctagccccggcccagctccgtcactcgcgcccggggcagtcgtcccaacctctgttatcgcgagggtgctggaaaagccagagagcctgctgcttaattctgcccagtctgggagtgccggaagacctctggccgaggatgtcttcgtgcacgttgacatgtcagaaggagtgccgggtgatccggcttcacctcccgccccggggtctcccactcctcagcccaatggggagtgtcactccctgggaacagcccggggctccccagaagaggagctgcctctccctgctttcgagaagcttaacccataccctactccgagtccaccccatcccctgtaccccggaagacgagtgatcgaattctcagaagacaaagtgcggatccccagaaattccccacttcccaactgtacatatgctacacgacaagcaatcagcctgtccttagtagaagaggggagcgagcgggcccgcccgagtcctgtcccctccacccccgcatcggctcaagcctcgccacaccaccagccgtcacctgccccattaaccctgagcgccccagcctcttccgcttcctccgaagaggatcttctggtgtcttggcagagggcctttgttgaccgcacacctccccccgccgcagtagcccagagaacagctttcggtcgcgatgcactgcctgagctccagaggcactttgcgcactcccccgccgacagagacgaggtggtccaggccccctctgcaagacctgaggaaagcgagctcctcctcccgactgagcccgatagcggcttcccgcgagaagaagaggagctgaacctgcccatcagtcctgaagaggagaggcagtctctgcttccaatcaataggggaaccgaagagggcccaggaacctcccacacagaaggacgagcgtggccactaccgagctctagccggccccaaagatctcctaagcgcatgggtgtgcatcatctgcaccgaaaagactctcttacacaagctcaggaacagggcaacctgctgaattag

SEQ ID NO: 208723 - DNA, 1674 bp, Artificial Sequence
  Description of Artificial Sequence: Synthetic coding sequence
atgaccagcgccgcccccgccaagaagccctaccggaaggccccccccgaacacagggaactccggctagagatacccgggtctcgcttggagcaagaagaacccctgaccgatgctgagaggatgaagctcctacaggaagagaacgaggaacttcggcgccggctggcctcagccacacgacgcaccgaggctctggagcgtgagctggagatcggccaggactgcctagagctcgagctcggccagagccgggaagagcttgataaatttaaagacaagttccgccggctgcaaaactcttacacggcatcacagcgaactaatcaggaattggaggataagctccatacgcttgcatcactctctcatagctggatcttcgccattaaaaaagccgaaatggataggaaaacactggactgggagatcgtggagttaactaataagctgctggacgctaaaaacacaatcaataagctggaggaacttaatgagcgataccgactggattgcaacctcgcggttcagctgctgaaatgcaacaaatcacactttcgcaatcataaatttgccgacctgccgtgcgagcttcaggacatggtgcggaagcatctgcactctgggcaggaggccgcctcccccggccccgccccaagtttggctccaggcgctgtcgtccccacatccgtaattgcaagagttctggaaaaacctgagtcattgctgctaaactccgctcagtcgggcagtgctgggaggcctctggcagaggatgtattcgttcatgtggacatgtcggagggggtgccgggagatcccgcttctccacctgcccccggtagtcccaccccgcaacccaacggggaatgtcactcattgggaacggcccgcggaagtccagaggaagaactgccgctgcccgccttcgagaagctgaacccatacccaacgcccagtccacctcacccactgtaccctggcagaagggtgatagagttttctgaagacaaggtgagaataccaaggaactcacctcttcccaattgtacttacgccacgcgccaggcaatctcgttgagcctggtagaagaaggtagcgagcgagcccgcccttctcctgtcccctcaacacctgctagcgcccaagctagccctcaccaccaacccagcccagccccccttaccctgtcggcacctgcctcttctgcctctagcgaggaagatctcctagtgtcctggcaacgtgccttcgtagatagaacaccaccccccgcagcagtcgcacagcgcacggccttcggacgggacgccttacccgaactgcagcggcatttcgctcatagccctgcagatcgggacgaggttgtccaagcgccttccgcgaggcccgaagaatccgagcttcttctccccactgagcccgacagcgggtttccaagagaggaagaggagctgaatttacctatctcccctgaggaggagaggcagagccttctgcccatcaatcgaggcactgaagaggggcccggaacctcccataccgaaggaagagcctggccgctaccttccagttctcgcccccaaaggtccccaaagagaatgggtgtgcatcacctacaccggaaggatagtctaacacaggctcaggaacaaggtaacctgcttaactag

SEQ ID NO: 208724 - DNA, 582 bp, Artificial Sequence
  Description of Artificial Sequence: Synthetic coding sequence
atgaccagcgccgcccccgccaagaagccctaccggaaggccccccctgaacatagggagttgagactcgagattccagggtcccgccttgagcaggaggaacctctcacagatgccgaacgaatgaagctgcttcaggaggagaacgaggaattgcgccggagactggccagcgctaccagaagaacagaagcactggagcgcgaactggaaattggccaggactgtctggagctggagctgggccagtccagagaggagctagataagtttaaggataagtttaggcggcttcagaatagctatacagcaagtcagcggacaaatcaggagctagaagacaagctacacaccctagcctcactgagtcactcctggatcttcgcaattaaaaaggctgaaatggatcgcaaaaccctcgactgggagatcgtcgaactaactaataaactgctggacgccaaaaataccataaataaactggaagagttgaacgaaagataccggttagactgcaacttagccgttcagctgttgaagtgcaataagtctcacttccggaaccacaaatttgcagactag

SEQ ID NO: 208725 - DNA, 720 bp, Artificial Sequence
  Description of Artificial Sequence: Synthetic coding sequence
tgactgctgcaggaggagaacgaggagctgcggcggcggctggcctccgccacgcgacgcactgaagccttggagcgggaactggagattggccaagattgtttagaactggaactgggccagagccgtgaagaactggacaaatttaaggacaagtttagacgcttacaaaactcctataccgccagtcagcggactaatcaggaacttgaggataagttgcataccttaatcaaaaaggctgagatggacagaaagacactggattgggagatcgtggagctgaccaataagctgctggacgccaaaaataccatcaacaaacttgaggagttgaatgaaaggtatcgcctcgattgcaatctggccgtgcaattattaaagtgcaacaagtcccattttcgaaatcataaatttgcggacgtgtcccggacccaccccctcccggcccacatcgaccactccggtcattgcagaactcctcttacccccgtaagtgccccactgagcgtcctgctgtttcccctgtgtccacctttggccagcatgtctcctctaaagccagttaattcggctaccggctggtgccctgtgtattgccccggcccaatcacttcgtccggtggccctgctttattggtcagtgtgactgagaccgaacgggaggatcccgggcaagagggagaggggtcccagagctacctgccaaaagaatattag

SEQ ID NO: 208726 - DNA, 5247 bp, Artificial Sequence
  Description of Artificial Sequence: Synthetic coding sequence
atgagcgcccgggccgccgccgccaagagcaccgccatggaggagaccgccatctgggagcaacacacagtcactctccaccgggcccctggcttcggtttcgggattgcgatcagcgggggcagggacaatcctcacttccagtctggggagacctccattgttatcagcgatgtgctaaaagggggcccagccgaggggcaactacaggagaacgaccgagtagccatggtgaacggcgtttctatggataacgtggaacacgctttcgcagtacaacaactgaggaaatcaggcaagaacgccaagattaccatccgaaggaaaaaaaaggtccagattccagtctccagacctgaccccgaacctgtcagtgataatgaggaggactcatatgatgaggagatccatgacccaagaagcggccggtctggggtggtgaatcggaggtcagaaaagatctggcctcgcgacaggagtgccagcagagagcggagcctaagccccagatccgatagacgcagcgtggcatcatctcagcctgccaaacccacaaaggtcaccctggtcaaaagccgcaaaaatgaagaatacggcctcaggctggcgagtcatatatttgttaaagaaattagccaggacagccttgccgcacgggacggaaacatacaggaaggcgacgtggtgctgaagattaatgggacagtgacggagaacatgtccctcactgatgccaagaccctgattgagcgctccaaaggtaagctgaagatggtagtccagagggacgagcgagctactctgctgaatgtccctgacctctcagactccattcactccgccaatgcatctgagcgtgatgacatatccgagattcaaagcctcgcgagtgatcacagtggccggtcacacgaccgaccaccccggaggagcaggtctcgtagccccgaccagcggtctgaaccaagcgatcatagcaggcactcaccccagcagccaagtaacgggtctctgcggagtcgtgacgaagagcgcatatctaaaccaggggccgtgtccacccccgtgaagcacgccgatgatcatacacccaagacggtggaagaggtgacagtagagcgcaacgaaaagcagacccccagtctaccggagcccaaacctgtctacgcacaggtagggcagccagatgtggacttacctgtttcaccctcagacggcgtattacccaactcaacccacgaggatggcatcctgagacctagtatgaaattggtgaagttccggaaaggtgattctgtgggcttgagattggccgggggaaacgatgtgggaatttttgtggctggcgtccttgaggactcaccagcagcgaaagaaggcctggaagaaggggaccagattctccgtgtcaacaatgtggattttactaacataattagggaagaggctgttctgtttctgctcgatctgccaaagggcgaggaagtcacgattttggcccagaaaaaaaaagacgtgtaccggaggatagtggaaagtgatgtgggggactcattctacatccgaacacattttgagtatgagaaggagagtccttacgggttgtcctttaataaaggagaggtgtttcgcgtggtggatactttatacaatggaaaactgggatcatggctagctatacggattggcaaaaatcataaggaagtggagagaggaatcattccaaacaaaaaccgcgcggagcagcttgccagcgtccaatacaccctccctaaaacggcaggcggggaccgcgcagatttctggcggtttcgaggactccgatcaagtaaacgcaatttacgcaaaagccgggaagatttgtccgcccagcctgtacagacaaagttccccgcctacgagcgggtggtcctgcgcgaggccggttttctgcgccccgtcactatttttgggccaatagccgatgtggccagagaaaagctcgccagggaggaaccagatatctaccagatcgccaaatcagaacctcgggatgcagggacagaccaacgtagcagcggaattatcaggctgcatacaatcaagcagataatcgaccaggacaagcacgcattgctagatgtgaccccgaatgctgtggaccgactgaactatgctcagtggtatccaatcgtcgtgttccttaacccagacagcaagcagggggtcaagaccatgcgcatgcggctgtgtccggaaagtcgaaagagtgctagaaagctttacgaaagatctcacaaactccgcaagaacaaccaccatctttttaccactacaataaacctaaattccatgaacgatggatggtatggagcattgaaggaggctatccagcagcaacagaaccagctggtatgggtgagcgagggtaaggcagatggtgcaacaagcgacgaccttgatctgcacgacgaccgtctaagctacctgtccgcacccggtagtgagtactccatgtattcaactgattcgcgtcacaccagtgactacgaggataccgatactgaggggggcgcctacactgatcaggaactggacgagactctcaacgacgaagtggggacacctcccgaaagtgcgatcaccagatcctccgaaccagtgcgagaggattcgtcaggaatgcaccacgagaatcagacgtatccgccctacagtccgcaggcccagccccaacctatccaccggattgacagcccaggatttaagcctgcctcccagcaaaaggcagaagcctcctcacccgttccatacctctctccggaaactaatccagcatcttcaacttcggccgtgaaccataatgtcaacttgaccaacgtgagactggaggaaccaactccagcaccttcaacctcctattctcctcaggccgattccttgcggactccttcaacagaagctgcacacatcatgctgcgtgatcaggaaccaagcctctcttcacacgtggaccccaccaaagtgtatcgtaaggacccataccccgaggagatgatgcgccagaaccacgtgcttaagcaacctgccgtgtctcaccccgggcatcgtcctgacaaggaaccaaatctgacctatgaaccgcaactcccttacgtcgaaaaacaggccagtcgcgacctggagcaacccacttaccgctatgaaagctcttcttacacagatcaatttagcagaaattatgagcaccgtctgagatatgaagacagagtgccaatgtatgaggaacagtggagctattacgacgacaaacagccctatccctcaagaccaccttttgacaaccaacactcccaggatctagattctcgacagcaccctgaggagtcctctgaaagagggtacttcccccgtttcgaggaacctgcacccctgagctacgatagccggccgcggtatgaacaggctccccgggcctcagccctccggcatgaagaacagcccgctcctggctacgatacccacggcagactccgccccgaagcccaacctcacccctcagcggggcctaaacccgccgaatctaagcagtactttgaacagtattctcgcagctatgaacaggtgccacctcaggggttcacatccagggcagggcatttcgagccgttgcacggtgctgccgccgttcctccactgataccaagtagtcaacataaaccagaagcactaccaagcaataccaaacctctgccccctcctcctactcagactgaggaagaggaggaccccgctatgaagccccaatcagtgctaactagggtgaaaatgttcgagaacaagagatcggccagcctagaaacaaaaaaagacgtaaatgataccgggagtttcaaaccacccgaagtggccagcaagcccagtggagcaccgattatcggacccaaacccacttcacagaaccagtttagcgaacacgacaagaccttataccgtatccccgaaccacagaagccacagctgaagccaccggaagatatagttagaagcaatcattacgacccagaggaagacgaggagtactaccgaaaacagctgtcctactttgaccggagatcatttgaaaacaagccgcccgcgcatatagccgcatctcatctctctgagcccgccaagccagcccactctcagaatcagagtaacttcagtagctattccagcaagggaaaacctcctgaggccgacggagtagaccgctcattcggagagaaacgatatgaacccatccaggctactcctccaccacccccactgccatctcagtacgcccagccaagccagccagtcaccagcgcttctctacatatccatagcaaaggcgctcacggagaaggcaactccgtcagcctcgatttccagaactcactggttagcaaacccgatccgcctccaagccaaaataaacccgctactttcagaccaccaaatcgtgaagacacagcacaggctgcattttacccccagaagtcttttccagataaagccccagtcaatggtaccgagcaaacacagaaaacagtgactcccgcttacaacaggttcacacccaaaccctatacttcttctgctcgccccttcgagcggaaatttgaatcccctaagttcaatcacaacctgctgcccagtgaaacagcccacaaacctgatctgtcatctaaaactcccaccagcccgaagacattagtgaaatctcactccctggcccagccccctgaatttgatagcggggttgagaccttctcaatccacgctgaaaagcctaagtatcagattaataacatctcaaccgtacccaaagcaatccccgtgtctccaagcgccgtggaggaagacgaggatgaggatggccataccgttgtcgccaccgcacgcgggatttttaattctaacggcggcgtgttatcctccatcgagacaggggtgtccattatcatcccgcagggagcaatccctgaaggtgtagagcaggagatttattttaaggtgtgcagagacaactctatattaccccctttggacaaagaaaagggggagacactgctgtcacccctcgtcatgtgcggccctcatggactaaagttcctcaagcctgtggagctccggcttcctcactgtgaccccaaaacatggcagaacaaatgtctgccaggagatccgaattatcttgttggggcgaattgtgtatccgtgcttatcgaccatttctag

SEQ ID NO: 208727 - DNA, 5007 bp, Artificial Sequence
  Description of Artificial Sequence: Synthetic coding sequence
atgagcgcccgggccgccgccgccaagagcaccgccatggaggagaccgcaatttgggagcagcataccgtgaccctgcaccgggcacccggctttggattcggaatcgccattagcggggggcgcgacaatcctcatttccagtctggtgagacatccatcgtcatcagcgacgtcctgaaaggagggccagccgaggggcagctgcaggagaacgacagggttgccatggtcaatggagtgagtatggacaatgttgaacatgcgttcgcggtgcagcagctgcgtaagtccggaaagaatgctaagataactatcagacggaaaaaaaaggttcagatcccggtgtcccgaccggatccagagccagtgtctgataatgaagaggactcctacgacgaggaaatccacgatcctcggtcaggccgatcgggcgtggttaatcggcggtctgagaagatatggccacgggatcgctctgcttctcgggagaggtctctgtcacctcgttccgacagaaggagcgttgcctcctcccagccagcgaaaccaacgaaagtgaccctcgtaaagagcagaaaaaacgaggagtatgggttaaggttggcgtcacacattttcgtgaaggaaattagccaggacagtctagccgcacgggacggcaacatccaagagggtgatgtggtgctcaagatcaatggtaccgtgacagaaaacatgagtttgaccgacgcaaaaacactcattgaacggtctaaaggaaaacttaagatggtggtgcaaagagatgagagggccaccctgttgaatgtgcctgacctcagtgattctatccacagtgccaacgcgtctgagcgagacgacatctcagaaatccagtccctggctagtgatcacagtgggcggagtcacgaccggcccccccgacgatcccgctctaggagcccagaccagcgctccgaaccctccgaccacagcaggcacagtccacaacagcccagcaatggcagtctccgaagccgcgatgaggagcggatctccaagcctggcgctgttagtacgcctgtcaagcacgcagacgaccacacccctaagaccgtcgaggaggtcacagtggagagaaatgagaaacagacaccctccctgccagagcccaagcccgtgtatgcccaggtcggccagccagacgttgacttaccggtgtcaccatccgacggcgtgcttcccaactcaacacacgaggatggcatccttcggccatccatgaagctggtgaagttccggaagggggattcagtgggtctgcggcttgccggcggcaacgacgtaggaatctttgtggccggcgtgttagaagatagccctgccgcaaaggaggggcttgaagagggagaccagatcctccgggttaataacgtggatttcactaatattattcgcgaggaagctgtgctgtttcttcttgatctcccaaagggcgaggaagtaactatcctcgcccagaagaagaaggatgtgtaccgccgcatcgttgagtctgacgtgggcgatagtttctacatcaggacccactttgagtacgagaaagaatcaccctatgggctctcctttaacaaaggcgaggtattcagagtggtcgacaccctctataacggtaagcttgggagctggctggctatccgcattggtaagaaccacaaggaggtggaacgtggaatcatccctaataaaaatcgtgcagaacaactcgccagtgtgcagtacacactgcctaagactgccggtggcgaccgggcagacttttggaggttcagaggtctgagaagctcgaagaggaacctgcggaagtcccgggaggacctgagcgcgcagccagtgcagaccaagttccctgcgtacgaaagggtcgtgctgcgcgaggccggattccttcgacccgtgaccatctttggacctatcgcggacgtcgcccgggagaaacttgctagggaggaaccagatatttaccagattgcaaagtccgaaccccgtgacgcagggacggaccagcgatcatcgggaatcatcaggctgcacacaatcaagcagatcatagaccaggacaagcacgcactgctggacgtaacccccaacgcagtagacagacttaactatgctcaatggtaccctatcgtggtgttcctcaaccccgattccaagcagggcgtgaagaccatgcggatgcgactgtgcccagaatcgaggaaatctgccagaaaactttacgagcgtagtcacaaactgagaaaaaacaatcaccatctttttacaaccaccattaacctgaactccatgaatgacggctggtacggggcccttaaggaggcgattcaacagcaacaaaatcagcttgtgtgggtcagcgaggggaaagccgacggcgcaacttcagacgatctggatctgcacgacgacagattgagctatttatccgctcctgggagtgaatattcaatgtactctaccgatagccgccacacttctgattacgaagatactgacaccgagggaggcgcttacaccgaccaggagctggacgaaacccttaatgacgaggtgggcacaccccctgagtcagcaatcacacgctcatccgagcccgtgcgggaagacagttccgggatgcaccatgagaatcaaacataccccccctactctccccaagcgcagccacagcccattcataggattgattcacctgggtttaagcctgcctcccagcaagtgtatcggaaagatccttacccagaggagatgatgagacagaaccacgttcttaagcagcccgccgtgtcccaccccgggcaccggccggacaaagagccaaatctgacctatgaacctcagctgccatatgtagagaaacaagctagccgagatttggaacagcctacctaccgatacgagtcaagcagttacactgaccaattttcacgtaattacgagcaccgcttacggtatgaggaccgggtgcctatgtacgaagaacaatggtcttattacgacgataaacaaccttacccttcacgaccaccgttcgataaccagcacagccaggatctggattccaggcagcatccagaggagtcatccgagaggggttattttccacggttcgaagaacccgccccactgagttacgattccaggcccaggtatgagcaggcacctagagcttccgctttgcggcacgaagagcagcctgcccccggatacgacacacatgggcgccttaggcccgaagcacaaccacacccgtcagctggacccaagcccgcagagtccaaacagtacttcgagcagtactccagatcgtacgagcaggttccacctcagggcttcacatctagggccgggcattttgagccactgcacggcgccgccgccgtgccccctctaattcctagtagccagcacaaacctgaggctctgccgagcaatacaaagcctttaccgccacctccaacccagactgaggaagaggaagatcctgcaatgaagccccaatctgtcctgactagggtcaagatgttcgaaaacaagcggagcgctagcctggagaccaagaaggacgtgaacgatacaggctcttttaagccgccagaggttgccagcaagcctagtggggcgcccattattggtccgaaacccacttcacagaatcaattctcagaacacgacaagacactgtacaggattccagaacctcagaaaccccaattgaagcctcccgaggacatcgtgcgctctaatcattacgacccagaggaagatgaagagtactatagaaaacagcttagctacttcgatagaaggtcattcgaaaacaagcctccagcacacattgctgcttcccatctgtctgagcccgcgaaacctgcccatagccagaatcagagcaacttttcaagctacagcagcaaggggaaacctcccgaggcagatggtgttgatcggagcttcggagaaaaaaggtacgaaccaatccaagcaacccctccgccaccccccctgcccagtcagtacgcccaaccatcccagcctgtcacttcagccagtctgcacatccatagcaaaggagcccatggcgaaggaaactccgtaagcctggatttccaaaactctctggtgagcaaacctgatcccccaccatcgcaaaacaagcctgccacttttcggccaccaaacagggaggatacagcccaggccgcgttttacccccagaagagttttcctgacaaggctccagttaatgggaccgagcagacacaaaagactgtgacgcccgcctacaaccgtttcactcccaagccatataccagctcagcaagacctttcgaacggaaattcgaaagtcccaagttcaaccataatctgctgccatccgagacagcgcataagcctgatctcagctctaaaactcccaccagccccaagacactcgtgaagagtcacagcctggcccagccgcctgagtttgacagcggcgtcgaaacgttttccatccacgccgaaaagcccaaatatcagattaataacatctccacagtgccgaaggcaattcctgtgagtccttcagctgtcgaggaagatgaggatgaggacggtcacaccgtcgtagcgacagcccgggggatcttcaactctaatggcggcgtgttaagctctatcgagaccggcgtgtccatcataatcccccaaggcgcaataccagaaggagtggaacaggagatttactttaaggtgtgtagggataattccatcttgcctccactcgataaggaaaaaggggagacactactctctcctttggtcatgtgcggcccccacggtctcaagtttttaaaaccggtggagctgcggctccctcattgtgaccctaagacatggcagaataagtgcttaccgggcgatcctaattatctcgtgggggccaactgcgtctctgtgctcatagaccatttctag

SEQ ID NO: 208728 - DNA, 2982 bp, Artificial Sequence
  Description of Artificial Sequence: Synthetic coding sequence
atgcccgtgcggggcgaccggggcttccccccccggcgggagctgagcggatggctccgggcaccaggcatggaggagctgatctgggaacaatacactgttaccctgcagaaggactccaaacgggggttcggtatcgcagtctcaggtggccgagataaccctcactttgagaacggcgaaacttcaattgtcatctcagacgtccttccaggaggaccagctgatggcctcctgcaggagaatgatagagtggtgatggtgaacggtacccctatggaagacgtacttcattcgtttgctgtgcagcagctgaggaaatctggcaaagtcgccgcaatagtagtaaaaaggcctcggaaggtgcaagtcgctgcccttcaggccagtcctcctctggatcaggatgaccgagccttcgaggttatggacgaatttgatggccggtccttccgcagcggctacagcgagaggtcccgtttaaactctcatggagggaggtccagatcctgggaagactctcccgagcgaggcaggcctcatgaaagagccaggtctcgcgagcgcgatttatcccgcgatagatcccgcgggagaagcctcgagcgcggcttggaccaggaccatgcccgaacacgcgaccgtagtaggggaaggtccctcgaacggggactcgatcacgatttcggcccctcccgagatcgcgaccgtgacaggagtcgcggcagatctatcgaccaggattatgagcgtgcttaccaccgtgcctatgaccctgactacgagagagcatactccccagagtaccgccgtggtgcaaggcacgatgccagaagccggggacctagatcgcgcagccgtgaacatcctcattctcgcagccctagtcctgagccccgcggccgacctggcccgattggggtcttactcatgaaatcccgggccaatgaagaatacggcctgaggctggggagtcagatttttgtgaaggagatgactcgtaccggtctggcgacaaaagacggcaacctgcatgagggtgacataatcttgaaaattaatggcaccgttacagagaatatgagccttacggacgctaggaaactgattgagaaaagtcgcggaaaactacaactggtggtgcttagggacagtcagcaaacattgattaacattccatctctaaacgattccgactcagaaattgaagatatcagtgaaattgagagcaataggtctttctctcctgaggagaggcgccaccagtacagtgattacgactatcattccagcagtgagaaattgaaggaaaggccaagctcacgggaggataccccaagtagactgtctcgcatgggggctactcctactcctttcaaatccacaggggacatagcagggaccgtggttcccgaaacaaataaggagccccgctatcaggaagacccacccgcacctcaacccaaagccgcgccgcgcacatttctcagaccctcgcccgaggatgaggccatctatgggcctaacacgaagatggtgaggttcaagaagggggactccgtgggcctgcgcctggcggggggtaatgacgtgggtatattcgtcgctggcatccaggaaggcacctccgcggagcaggaagggcttcaggagggggatcaaatccttaaagttaatacacaggatttccggggtttagtcagagaggacgcagtcctgtacctgttggaaatacctaagggcgaaatggtaacaatcctggcgcaatcaagggccgacgtgtaccgcgacattttggcttgtggcagaggcgattcttttttcataagatcccattttgaatgtgagaaggaaaccccccaaagcctggcgtttactaggggtgaagtgtttagggtggtagacacactgtacgatggcaaactggggaattggttggccgtgcgcatcggaaacgaattggagaaggggctgatccccaacaagtcccgcgccgagcagatggcctccgtgcaaaatgcacagagggataacgctggggaccgggctgacttttggcgcatgcggggacagcgaagcggtgtgaagaaaaatctgagaaagagccgggaggacttgactgccgtggtgtcagtgtctaccaagttccctgcatatgaaagagtgttactcagggaagctggcttcaagagacccgtggtgctctttggccctatcgccgatattgctatggagaaacttgccaatgaactgcctgactggttccagaccgccaaaaccgaacctaaagacgctggaagcgagaagagcaccggagttgtacgccttaacacagttcgacagattatcgaacaggataaacatgctctgctggacgtaactccaaaagccgttgacttactgaactacacccaatggtttccaattgtcatattcttcaatccggactctaggcagggcgtcaaaaccatgcggcagcggctgaatccaacctctaacaaaagcagcaggaaactttttgatcaagccaacaaacttaagaagacctgcgctcatctgtttacagcgacaataaatctgaattccgctaatgacagctggttcggaagtcttaaagatactattcaacaccagcaaggggaagccgtgtgggtgtccgagggaaagatggaaggtatggatgatgaccccgaagatcgaatgtcgtatctgactgccatgggtgccgattatctgtcctgcgattcccgcctgatttccgactttgaggacacagatggggaagggggtgcttacacagataatgagcttgacgaaccggccgaggagcctctcgtgtcatcaattacccgatcatccgagccagtgcagcacgaagaggtcaggcgcggacggcctcgggcaggtacaggagaacctggcgtttttctggcactgagctggacagccgtgtgttcaggctgctgcggacgccacagctag

SEQ ID NO: 208729 - DNA, 3132 bp, Artificial Sequence
  Description of Artificial Sequence: Synthetic coding sequence
atgcccgtgcggggcgaccggggcttccccccccggcgggagctgtcggggtggctccgcgctcccggaatggaggagctgatatgggagcagtatactgtcacacttcagaaagacagcaagagaggttttgggattgccgtgagcggaggtagggacaatcctcactttgaaaacggcgaaaccagtatcgtgatctctgatgtgctccccggtggacctgcggacgggctcctgcaggagaatgaccgcgtggtgatggtgaatgggacgcccatggaagatgtactacattcctttgccgtccagcagctcagaaaatccggcaaggtagcagctattgtcgttaagagacctcgcaaggtgcaggtggccgctctgcaggccagccccccactagaccaggatgatcgggcatttgaggtcatggatgagtttgacggacggtcttttagaagcgggtacagtgaaagaagtcgtctgaactcacatgggggtagatccaggtcctgggaggactcacctgagcgcggacggcctcatgagagagctcgctcccgcgagcgcgacctcagtagggatcgatctcggggtcgatctctggagcgtggccttgatcaggaccatgctcgcacgcgcgaccggagtcgagggagaagccttgaacgcggcctggaccacgacttcggcccatctcgcgaccgggaccgcgataggtcccgaggaagatccattgatcaggactacgaaagagcctatcatcgcgcatatgacccggattacgagcgagcgtatagccctgagtacaggaggggagctagacacgacgccagatctcggggaccgcgcagtaggtcaagggaacacccacacagtcgctcgccctctcctgagccgcggggaaggccaggcccgataggcgtgctcttgatgaaatcccgagccaatgaagaatatggtctgagactagggtcccagatcttcgtgaaggagatgacacggactggattagcaacaaaagatggcaacctgcatgaaggagatattatcctgaagataaatggcaccgttaccgagaatatgtccctcacggatgcaaggaagctcattgagaaaagccgcgggaaactgcagctagtggtgctgagagatagccagcagaccctgattaacatcccatccctgaacgactctgattctgaaatcgaggacattagcgaaatagaatcaaatagaagcttctcccccgaagagcggaggcatcaatattccgattacgactaccactcaagttccgaaaaacttaaggagcggccctccagccgcgaggacacaccttccagattgagtagaatgggagcgacacccacccccttcaagagtacgggggatatcgccggaaccgtggtcccagaaaccaataaagaaccacgctatcaagaggacccgcctgccccacagcctaaggctgcaccccgaacgttcttgcgccccagtcccgaagacgaagcgatttacgggcctaatactaaaatggtgaggttcaaaaagggcgactctgtagggctgaggctggcgggcgggaacgatgtcgggatcttcgtagccggcattcaagagggtacctctgcagagcaggaggggctgcaagagggagatcagattcttaaagtaaatacacaggacttccggggtctggtgcgagaggacgctgtcctgtacctgttggaaatcccaaaaggtgaaatggttaccatcttagcacagagtcgcgcggatgtgtaccgagatatactcgcgtgtggacgcggagatagtttttttattcggtcccactttgaatgtgaaaaagagaccccgcaatctttggcttttacccggggcgaggtttttagagtggtggatacattgtacgatgggaagctcggaaattggttagccgtgcggatcggtaatgaattagaaaaaggtctgatcccgaacaaaagcagggccgagcagatggccagtgtccaaaacgctcagagggacaacgcgggggatcgcgccgacttttggcgcatgcgcggccaacggtctggggtgaaaaaaaacttgaggaagtctagagaggaccttaccgccgtagttagcgtttcaacaaaattcccggcctatgagagggtcttgctgcgagaggcaggatttaagcggcccgtggttttatttggtcctatcgcggacatcgcgatggagaagctggcaaatgagctgccagattggttccagacagctaaaaccgagcccaaagacgcaggatccgaaaaatccacaggcgtcgtgagactcaacactgtcaggcagattatagagcaggataaacacgctctgctggacgtcacccccaaagcagtagatctcttgaactatacccaatggttccctatcgtcatattcttcaaccctgactccaggcagggagtcaagacgatgcgccaaaggttaaatcctacttcgaacaaatctagccgcaaactctttgatcaggcaaataaactaaagaaaacttgtgcccatctattcactgcaacgatcaatctaaatagtgccaatgactcctggttcgggagcctcaaagacacaattcagcaccagcaaggggaggctgtctgggtctccgagggaaaaatggaaggcatggatgacgacccagaggatcgtatgtcctacctcactgccatgggtgcagattacttgagttgcgactcaaggctcattagcgatttcgaagacactgacggcgagggtggtgcctacacggacaatgagctcgacgaacctgcggaagaacctttggtctccagcattactcggagcagtgagcctgtgcagcatgaggagattgaaattgcacagaagcaccctgatatatatgcagtgcctatcaagacccacaaacccgaccccgggaccccacagcatacatccagtagacctcccgaaccacagaaagccccatcacgaccgtatcaggatactcggggctcatatggatctgacgcagaggaggaggagtacagacaacagctttctgaacatagcaagcgcgggtactacgggcagtcagcccgctatcgagacacagagctctag

SEQ ID NO: 208730 - DNA, 3573 bp, Artificial Sequence
  Description of Artificial Sequence: Synthetic coding sequence
atgcccgtgcggggcgaccggggcttccccccccggcgggagctgagcggatggctccgcgccccaggaatggaggagttgatctgggagcagtacactgtgactcttcagaaggactctaaaaggggcttcggaattgcggtttcgggaggtcgcgacaaccctcactttgaaaacggcgagacttccatcgtgataagcgacgtgttacctggcggccctgctgatgggctgttgcaagagaacgacagggtagtgatggtgaacgggacccccatggaggacgtcctccactccttcgcagtccagcagcttagaaaaagcgggaaggtcgccgctatcgtggtgaagcgacctaggaaagtgcaggtcgcagccctgcaggcatccccacctctggatcaggacgacagggcttttgaggtcatggatgagttcgacggacggtcctttaggagcggttactccgaaagatcacggctgaactcacacgggggacgaagcagatcttgggaagattcacctgaaagaggacgtccacacgagcgggcccgcagccgtgaacgggacctgtctcgcgatagatcaagagggcgctcattggagagagggcttgatcaggaccatgcaagaacaagggatcggtctcggggccgcagccttgagagaggactggatcatgatttcgggccctctagggatagagatcgggatcggagtcggggacggtccatcgaccaggattatgaacgggcataccaccgagcctatgaccccgactacgaacgggcttatagcccggagtacagacgtggggccaggcacgatgccaggtcacgaggtccccgatctcggagcagagaacacccccattctcggagcccctcacctgaacccaggggacggccggggcctattggcgtgctgctcatgaaatcccgggccaatgaggaatatggtctacgcttgggttcacaaatttttgtcaaggagatgacaagaactggcctcgctaccaaggacggcaatctgcatgaaggggatataatcctaaagattaacggaactgtgacagagaatatgtctttgactgacgcaagaaagttgattgagaagtcaaggggaaagctgcaactggtggtgttgcgggactcccagcagacgctgattaatatcccctcactgaacgattcagactcagaaattgaagacatctcagagattgagtcgaatcgttcttttagcccagaggaaaggagacaccagtatagtgattacgattatcacagctctagcgagaagctgaaagaacggccatcgagccgggaagacactcctagtcgcctgtcaaggatgggcgccacacctactcccttcaagagtactggggatattgccgggaccgtcgttcctgagacaaacaaagagcccaggtatcaggaggaccctcctgcccctcaaccaaaggccgcccccagaacttttttgaggccctctcccgaagatgaggccatctatggaccaaacactaaaatggtgcgattcaagaagggagacagtgtaggacttagactggccggcgggaatgacgtcggcatctttgtggccggaatccaggaaggcacaagcgcagagcaggagggtctccaggagggggatcagatattgaaagtcaacactcaggatttccgcggtcttgtgcgagaggatgcagtcttgtacctgttggagatccccaagggtgagatggtgaccatattggcccagagcagagcagacgtgtaccgggacatactagcctgcggcaggggggatagttttttcatccgctctcacttcgaatgtgagaaggaaacaccccagtcgctggctttcactaggggcgaggttttccgcgtggtggacacgctgtatgacgggaagctggggaactggctggccgtcaggattgggaacgagttagaaaaaggcctaatcccaaataaatccagggcagagcagatggcctcggtccagaacgcccagcgggataacgccggagatcgcgcagacttctggaggatgcgcggccaaagatcaggagttaaaaaaaatctcaggaagagcagagaggacctgactgccgtggtttccgtctccaccaaattccctgcttacgaacgagttctgcttagagaggcaggattcaagaggcccgtggttttattcgggcccattgctgatattgctatggaaaagctggccaatgagctccctgactggttccagacggccaagactgagccaaaagatgccggcagcgagaaaagcacaggggtcgtgcgattgaacaccgtccgtcagattatcgagcaggacaaacacgcactgctggacgtcacacctaaagccgtagatctgctgaattacactcagtggtttcccatcgtcatttttttcaatccagacagccgccagggggtgaagactatgaggcagcgcctgaatcccacaagcaacaaatctagtcgtaagctcttcgatcaggccaacaagctcaagaagacatgcgcacacttattcaccgccacaattaacctcaattccgcaaacgactcctggttcggaagcctcaaggataccatacagcatcaacagggggaggctgtttgggtctccgaaggcaagatggaaggtatggatgatgacccggaggatcggatgtcatatctaaccgctatgggggcggattatctctcctgcgactctcggctgattagcgatttcgaagataccgatggggagggtggggcatacacagacaatgagcttgatgagcctgccgaggaaccgctggtgtcctccattactaggagctccgaacccgtccagcatgaagagagcattagaaagccaagtccagagccaagggcacagatgaggcgggcagctagttctgaccagcttcgggacaacagcccccctccagcattcaagcctgaaccaccaaaggccaaaacccagaacaaagaggaaagctatgatttctccaagagctacgagtataaatccaacccctccgccgtggcaggcaatgaaacacccggggcttccacaaagggttatcccccaccagtggctgcaaagcctacttttggtcgcagcatcctgaaacctagcaccccaattcctccacaggagggggaggaagtgggagaaagttcagaggaacaggacaacgcacctaagagcgtgctcggaaaagtgaagattttcgaaaaaatggaccataaagcgcgtctgcagaggatgcaggaacttcaggaagcacagaacgcccgcatcgagattgcccagaaacatccagacatctacgctgttcccattaagactcacaagcctgacccaggaacaccccagcacaccagtagccgccccccagagcctcaaaaggcaccatcaagaccctatcaagacactcgcgggtcctatggcagcgatgccgaggaagaggaatatcgtcaacagctctctgaacatagtaaacgaggatattatggccagagtgccagataccgtgacactgaactttag

SEQ ID NO: 208731 - DNA, 306 bp, Artificial Sequence
  Description of Artificial Sequence: Synthetic coding sequence
atggaggagctgatctgggagcagtacaccgtgaccctgcagaaggattcaaagcgcggctttggaattgccgtctccggaggccgagataaccctcattttgaaaatggcgagacatccatcgtcattagcgacgtcctgccaggaggtcccgcagatgggctgcttcaggaaaacgacagagtggtgatggtgaatgggacacctatggaggacgttttgcacagcttcgctgtccagcagctcagaaagagtgggaaggtcgcagccatagtctccaccggtttcgctttttctctaccttag

SEQ ID NO: 208732 - DNA, 486 bp, Artificial Sequence
  Description of Artificial Sequence: Synthetic coding sequence
atggaggagctgatctgggagcagtacaccgtgaccctgcagaaggattccaaacgcggcttcggtattgccgtcagcggcggccgcgacaaccctcacttcgaaaatggagagacctccatcgtgatttcggacgtgctgccaggcggacctgctgatgggcttttacaggagaatgatcgggtggtgatggttaatggaacacctatggaagacgtgctacactcattcgccgtacagcaactgcgaaagtctggaaaggtggccgccatcgtggtcaaaagaccccgtaaagttcaagtggctgccttgcaagcgtccccacctttggaccaggacgatagagctttcgaggtgatggacgaattcgacggccgctcttttcggtccggatattccgaaagaagccgcctgaattcccacgggggcagatcacgcagctgggaggattcaccggagcggggcaggccacatgagagggcctag

SEQ ID NO: 208733 - DNA, 3063 bp, Artificial Sequence
  Description of Artificial Sequence: Synthetic coding sequence
atggaggagctgatctgggagcagtacaccgtgaccctgcagaaggacagcaagcggggtttcggcattgccgtatctggagggcgggacaacccacacttcgaaaacggcgaaaccagcatcgtaatatctgacgtcctgccgggcggacctgctgatggcctactccaggagaatgacagagttgtcatggtgaacggtactcccatggaggatgtattgcactcctttgccgtgcagcagctcaggaagagcggcaaagtcgccgcaatcgtggtgaaacggcctcggaaagtgcaggtggccgccctgcaggcgtcccctcccttggaccaggacgatagggcatttgaagtgatggacgagttcgatgggagatcattcagaagtgggtatagtgagcgatcaaggctaaattcccacggcggccgctccagatcgtgggaagactctcccgagagaggccgaccacatgaaagggccagaagccgcgagagagatcttagtagagatcgctcccgcgggcgtagtctggagcgtggtctagaccaagaccacgctcgcactcgcgatcggtcccgcggtagatccttggagcgcgggcttgaccatgacttcgggccttcccgagacagagatagagaccgctcacgcggccgtagtatagaccaggattacgagagggcttatcatcgggcctacgaccctgattacgaacgcgcctactctcctgaataccgacggggagctagacacgatgccaggtccagaggcccgcggtcccgctccagggaacacccccactcacgtagcccttcaccagagcctagaggacggcctggccctatcggggtgttgctgatgaagagtagggcaaatgaagaatacggtttgcgcttaggctcccagatcttcgtgaaggaaatgacccgcactggtcttgcaacgaaagatggaaatctgcacgagggggacattattctgaaaatcaacgggactgtcaccgaaaatatgagtcttacggacgctcgtaagctcatcgagaaatcaagggggaaactgcagctcgtcgtgctcagagactctcagcagactttgatcaacatcccaagccttaatgacagtgactcagagatcgaagatatttccgaaatcgagagcaaccgtagcttctcccctgaagaaagacgtcaccagtattctgactatgattaccattctagttccgaaaaattgaaggaaaggccatcctcaagagaggacacgccttccagactgagcaggatgggcgctacccccaccccatttaaatctacaggcgatatagctggaacagtggttcctgagacaaataaggaaccccggtaccaagaagatccaccagccccacagcctaaggccgccccccgcacttttttgcgcccctctccagaggacgaagccatttacggcccaaacaccaagatggtcagatttaagaagggggacagtgttggactgcgactcgccggtggtaacgatgtggggatttttgttgcaggcatccaagagggaacatcagccgagcaagagggcctgcaagaaggcgaccagatactgaaggtcaacacacaggatttcagaggcttggtgcgggaggacgccgttctatatctgctcgaaatcccgaagggggagatggtcactattctggctcagagccgtgctgatgtataccgagacatccttgcttgtggccggggggattcctttttcattagatctcactttgagtgcgagaaggaaacacctcaatcactggcgttcacaaggggtgaggtgttcagggtggtggacactctctacgatggaaagctgggcaactggcttgccgtccggatcgggaatgagctggaaaaaggattgatacccaataaatctcgggccgagcaaatggcaagtgttcaaaatgcccagcgagacaatgcaggcgaccgcgcagacttctggaggatgcgcggccagcgtagtggggtaaaaaagaacctgcgtaagtctcgtgaagatctgacagccgtcgtgagcgtctctactaaattccccgcatatgagagagtgctcctacgggaagctggtttcaagcggcctgttgtactgtttgggccaatcgcggacatcgccatggagaaattggccaatgagctgcccgactggtttcagaccgcgaaaactgaacccaaggacgctgggtccgaaaagtccaccggagtggtgcggctcaacacagtgcggcagattattgagcaggacaaacatgctctgctggacgtaacacctaaggccgtcgatctacttaattacactcagtggttccccattgtcatcttctttaacccagactcccggcaaggggtgaagacaatgcggcagagattgaatccaacaagcaataagtcctcccggaagctcttcgaccaggccaataagcttaagaagacttgcgctcatctgtttactgcaacaataaatctgaatagtgccaacgacagctggttcgggagtttgaaagatactattcagcatcagcagggcgaagcagtttgggtttcagaggggaagatggagggcatggatgacgacccagaggataggatgagctacctgaccgctatgggtgccgactacttgtcctgtgattcgcgtcttattagcgacttcgaagacaccgatggggagggaggcgcctataccgacaatgaacttgacgagcctgcggaagagccgttagtttcgtccatcacgcggtcctccgaacctgttcaacatgaagaaatcgagattgcccagaagcatcctgatatctacgccgtgccaattaagactcataagcctgatcctggcaccccccaacatacttcttcgaggccacccgagccacagaaagcaccctcacgaccctaccaggatactaggggctcctacggttctgatgctgaggaggaggagtaccgacaacagctgagtgaacactcaaaaaggggttactatggccaaagcgctagatatagggataccgagctgtag

SEQ ID NO: 208734 - DNA, 3474 bp, Artificial Sequence
  Description of Artificial Sequence: Synthetic coding sequence
atgaagaccgcccaggccctgcaccggatgtggatccaggccgtgaaaaaactgcgaagatggaaggggcgcgcaccaggaatggaggagctgatctgggagcagtacactgtaacactccagaaggattctaaacgtggctttggtatcgcagtgtcaggcggccgagataacccacatttcgagaacggtgagacgtctatcgtcatcagcgatgttctgcccgggggacccgcggatggcctattgcaggaaaatgaccgagtcgtcatggtcaatggtactcctatggaagacgtcctccactcctttgctgtacaacagcttcgcaaaagcgggaaggtggccgccattgtggtgaaaagaccgcgaaaggtgcaagtggccgcactgcaggcttcacccccacttgaccaggatgacagggcttttgaagtgatggatgaattcgatggcagatcttttcgctctggttactccgaaagaagcagacttaattcccacgggggtagaagccggtcgtgggaggactcgcctgaaagaggcaggccccacgagagggctagaagccgggaaagggatctcagtcgtgacaggtctcgaggtcggtccttggaaagggggttagaccaggatcacgcccgcacccgcgatcggtctagaggacgcagtctggagcgaggtctggatcacgactttggacccagcagggacagggacagagataggtcccggggccgatccatcgaccaggactacgagagagcctatcatagagcttacgaccctgattatgaaagggcctactcgcccgagtatagaaggggagcacgccacgatgctaggtctcggggccccagatctagaagcagagagcacccccattcccgctcccctagcccagagccccgaggccgcccaggacccatcggcgtacttctaatgaaatcccgcgctaacgaggagtatggactgagactgggcagccagatcttcgtgaaggagatgacgaggactgggctggcgactaaggatggtaacttacatgaaggggatatcatcctcaaaatcaacggaacagtcaccgagaatatgtccctgacagacgcacgcaagttgatcgagaagagtagagggaagcttcagttggtagtcctgcgggattcacagcagacattaattaacattccatccctcaacgattctgactccgagatcgaagatattagcgagatcgagagcaaccgatcctttagcccagaagagcgacgccatcagtattctgattacgattaccatagttcatccgaaaagctgaaggagaggccttcctcccgggaagatacccccagcagactatcacgaatgggcgcaacacccaccccctttaagtcaactggagatatagccggtacggtcgtgcccgagaccaacaaagagccacggtaccaagaggaccctccagctcctcagcccaaagcagccccgcgaactttcctgcgcccgtcacccgaagacgaggctatctacggacctaacacaaaaatggtaagatttaagaaaggggattccgtgggtctcagacttgccggcggaaacgacgttggcatctttgttgccggcattcaggagggaacatctgcagagcaagaggggctgcaggaaggggaccagatactcaaggttaatacccaggactttcgtggcctggtcagagaagacgccgtgttgtatcttctcgaaataccaaaaggggagatggtgactatcctggcacagtcccgcgctgacgtttacagggacattctcgcctgtgggaggggcgactcttttttcatccgtagtcacttcgaatgcgagaaagagacgccacaaagtctggcttttactaggggagaagttttccgggttgtagacactctttacgatggcaaactgggtaactggctggctgtacggattggcaacgagctcgagaaagggctgataccaaacaagagcagggcagagcagatggccagtgttcagaacgcacagcgcgataatgccggcgatcgggccgacttttggcgcatgaggggacagcggtctggcgtgaagaagaatcttcgcaaaagtcgagaagatctgactgccgtggtctccgtaagcacgaagtttccggcttatgagcgcgtgctccttagggaagcaggctttaaacggcctgtggtgctgttcggcccgattgcagacattgccatggagaagttggctaacgagctacccgattggttccagactgccaagactgagccaaaagacgctgggagcgaaaagtctactggagtcgtgagactcaacactgtcaggcagattatcgagcaggataaacacgctttgctggatgtcacaccaaaggccgtcgatcttctgaactacacacagtggtttcccatcgtcatttttttcaacccagattcacgccagggagtgaagaccatgcggcaaagactcaaccctacttcgaataagagctccagaaagctgtttgatcaagccaataaactgaagaaaacatgtgcccatctgtttaccgcgactataaacctcaacagcgcgaacgactcgtggtttgggagcctaaaggacaccatccaacatcagcagggcgaagccgtatgggtgagcgaaggaaaaatggaaggtatggacgacgatccagaagaccgtatgtcatacctaacagcaatgggcgctgactacctcagttgcgattctagactgatatcggactttgaagacactgacggcgagggaggcgcttacaccgataacgagctggatgagcccgccgaagaacctctggttagttcgataactcggagctccgaacctgtccaacacgaggaggcaaaaactcagaacaaagaggaaagttatgatttttctaagagctatgaatacaagtctaatccgtcagcagtggccggaaacgagacccccggagccagtaccaagggctaccctcctcctgtcgccgccaaacccaccttcgggcgctcaatcctgaagccgtctactcctatccctccccaggaaggcgaggaggttggcgagtcttctgaggagcaggataatgcaccaaaaagcgtgctggggaaggtgaagatcttcgaaaaaatggatcataaggcccgcctgcaaaggatgcaggagcttcaggaggctcagaatgcccgcatagaaatcgcacagaagcaccccgatatttatgccgtcccaattaagacccacaagcctgatccaggcacaccccagcatacatcaagtagaccacccgaaccccaaaaagcgcccagcagaccttaccaagatacccggggaagctatggatcagatgccgaggaagaggaataccgccagcagttgagcgagcatagcaagcgagggtattatggccagtccgctcggtaccgagatactgagttgtag

SEQ ID NO: 208735 - DNA, 3666 bp, Artificial Sequence
  Description of Artificial Sequence: Synthetic coding sequence
atgaagaccgcccaggccctgcaccggatgtggatccaggccgtgaagaaactgaggagatggaaaggtagggtgtcgcctagtgcatcctcccccctggtgttcccaaacctgtcaagctgggagggagaggggagcaaaactatcttgacagcccctggcatggaagagctcatttgggaacagtacactgttaccttgcagaaggacagtaagcggggatttggtattgctgtgtctggcggaagagacaatccacatttcgaaaatggagagacctctatcgttataagtgacgtgctgcccggggggcccgccgatggcctgcttcaggagaatgatagggtggtgatggttaatggcacccctatggaggatgtcctgcactcgtttgcagtgcagcagttgcgcaagtcaggaaaggtggccgcaatagtggtgaagcggccaaggaaagtgcaagtggccgcacttcaggcttcgcctcccctggaccaggatgacagagcattcgaggttatggatgaatttgacggcaggagtttccggagtggttattcagaacgctcccgtctaaacagccacggcggcaggagccggtcctgggaggattccccagagcgaggcaggcctcatgaacgagccaggtccagggaacgggacctgagccgagaccggtctcgcgggcgcagtctggagcgcggcctggaccaagatcatgccaggactcgtgatcgctcaagaggtcgcagtctggaacgcgggctggaccacgattttggacccagcagagaccgcgaccgggaccgtagtaggggccgcagcatcgatcaagattacgaacgggcctaccatcgggcttatgacccagactacgagagggcatactctccggaataccgtcggggcgctcgacatgacgccaggtctcgcggaccaagaagcagatccagggagcacccacactctcgaagcccgagccctgagcccaggggccgtcctggacccattggggtgctcttgatgaaatctcgcgccaacgaggaatacggcctacggctgggttcacaaatctttgtcaaagagatgacacgcacgggcctggccactaaggatggtaaccttcatgagggcgacatcatccttaagattaatggcaccgtgaccgaaaacatgtccctgaccgacgcccgtaagctcattgagaaaagtcggggtaagttgcagctagtcgtccttagggattcgcagcagacactgattaacatcccttctctcaacgactctgatagtgagatagaggatatctcagaaatcgagtcaaaccgcagctttagccctgaggaaaggaggcatcagtactctgactatgattatcacagttctagtgaaaagttgaaggagcggccttcctcacgggaagataccccatcacgactgtctcgcatgggggccactccaacccctttcaaatcaaccggggatatcgctgggacagttgtccctgaaaccaataaagagccgcgttatcaggaagatccacccgcaccccagcccaaggctgcaccacggactttcttgcgaccttcccctgaggacgaagccatatatggccccaataccaagatggtgagatttaaaaaaggcgattctgtgggactcaggcttgccggcgggaatgatgtgggcatcttcgtggcgggaatacaagaaggaacttccgcggagcaggagggactgcaagagggagatcagatactgaaggtcaatactcaggatttccgcgggttggtgagagaggatgccgtcctttatttgcttgagatacctaagggagagatggttacaatcctcgcccagtctagagcagacgtctaccgcgacatcctggcttgcggccgaggagactcttttttcatcaggtctcattttgaatgcgaaaaggaaactccccaatccctagctttcacccgaggtgaggtattcagagtagtcgataccctgtacgatggaaagctgggtaactggcttgccgtacgaattggtaacgaattagagaagggactgataccaaataaaagccgagcggagcaaatggcttctgttcagaacgcgcagagagacaacgctggagatagagcagatttctggaggatgcggggccagagatcgggcgtaaaaaaaaatctgagaaagtcccgagaagaccttacggctgtggtctcagtatcaacaaagttccctgcctatgagcgcgtcctcttacgcgaagccggcttcaagaggcccgtggtgctgttcggccctatcgcggacatagccatggagaaacttgcaaacgaactgccagactggtttcagacggcgaagaccgagcctaaggacgccggatcagagaaatccactggggtcgttcgtttgaatactgtcagacaaataatcgagcaagataaacatgccctgctggacgtgaccccaaaagccgtagacctgctcaactacacacagtggtttcccatcgtgattttcttcaatcctgattccaggcagggagtgaaaactatgcggcagcgattaaatcccactagcaacaagtcatccagaaagctgtttgaccaagcaaacaaactcaagaagacatgtgcgcatctgtttacagcgacaatcaatcttaacagcgctaatgactcctggtttggatcccttaaagacacaattcaacaccagcagggcgaagccgtttgggtatccgagggcaaaatggaggggatggatgacgaccctgaggaccgcatgtcatatcttaccgccatgggggctgactatctgtcatgcgacagtcgcctgattagcgactttgaagacacagacggggaaggaggcgcctacacggacaacgaactggacgaaccggccgaggaacccctcgtatcttccatcacccggtctagcgaacccgtacagcatgaggagtccatccggaagcctagtcccgagccccgggcccaaatgcgaagggccgcaagctctgatcagcttcgcgataacagtcccccccccgcatttaagcctgaacctccaaaggcaaagactcagaataaagaagagtcttacgacttcagtaaatcttacgagtataaatctaacccttcggcagtggctggaaacgaaacaccaggagcgagcacgaaaggatatcctcctcctgtcgcagccaagcctacctttggacgctctatccttaaacctagcactccaatcccaccacaggagggtgaagaagtcggagaaagctctgaggagcaggacaatgcacctaagtcggtgctagggaaagtaaaaattttcgagaagatggatcacaaggctagactgcagcggatgcaagaactgcaagaagcacagaacgcccgcatcgagatcgctcaaaaacatcctgatatttatgctgtgccaatcaagacgcacaagccggatccaggtactcctcagcacacaagtagcagacccccagaaccccagaaagcaccatccaggccctaccaagacaccagaggatcttatgggtccgacgcagaggaagaggaatacaggcagcaattgagcgaacatagcaaaagggggtactacggtcagagcgcgcgataccgcgacaccgagctttag

SEQ ID NO: 208736 - DNA, 2787 bp, Artificial Sequence
  Description of Artificial Sequence: Synthetic coding sequence
atggccgtgcggttccaggtggccgacatggaggagctgaccatctgggagcaacacacagctactctttccaaagatcctaggaggggtttcgggattgccatttcgggaggtcgcgatcgccccgggggctctatggtcgtcagcgacgtcgtgccaggggggccagcagagggtcgactgcagacaggcgaccacatcgttatggtgaatggggttagcatggaaaacgctacatccgcctttgccatccaaatcctgaagacatgtaccaagatggcaaatattactgtcaagaggcccaggcgaattcacctccccgccacaaaagcttccccatccagcccggggcggcaagactctgacgaggacgacggcccgcagagagtggaggaggttgaccaaggccggggctacgacggcgattcttcaagtggtagcgggaggtcctgggacgaaaggtcccgacggccacgccctggacggcggggtagagctggaagtcacgggagaagaagccccggaggagggtctgaagccaatggtctggcgctggttagtgggttcaaacgactgcctcgtcaggatgtgcagatgaaacctgtgaagagcgtacttgtgaagaggagagattcagaagagtttggcgtgaagcttggttcccagatctttataaagcatattactgattcagggctagcagcacgacacagagggctgcaggagggcgacctgattcttcagattaacggcgtgagctcacaaaacttgtctctaaacgatactcgccggctgattgagaaaagcgagggcaaactttcgcttctggttctgcgcgacagagggcaattcctcgtcaacatccctcccgctgtgtcagacagtgactcttcacccctcgaggatatttcggatctcgccagcgagctgtcacaagccccacccagccatatacctccacctccacggcacgcacaaaggtcacctgaagcaagccaaaccgacagtcccgtggagtcaccccggctcagaagggaatcatcagtcgactcaaggaccatctctgaacccgacgaacagcgctccgagttgcctagagagtctagctacgatatctacagagttccatccagccagagtatggaggaccgtggttacagcccggataccagggtagttcggttcctgaaagggaagtccattggattacgcctggcagggggcaacgatgtcggaatattcgtgagtggagtgcaggcaggtagtcccgctgatggtcaggggattcaggaaggcgaccagatcctgcaggtcaatgatgtgccttttcaaaacttgacccgcgaagaagccgtgcaatttttgctggggttgccccccggagaagaaatggagttggtgacccagcgcaaacaggatattttctggaaaatggtgcagagtcgggtgggggattccttctacattaggacccacttcgagttagaaccgtcaccaccgtccggtctgggattcactcggggtgacgtttttcacgtactggacacgctccaccctggccccggccagtcacacgccagaggcggacattggttggcggtgaggatggggagagaccttcgagaacaggagcgcggaatcattcctaatcagtcacgcgctgagcaactggcctccctggaagctgcccaacgcgccgtcggggtcgggccagggagtagcgccggctcaaacgcgagagccgaattctggagactccgcggtctgcgaaggggcgccaagaaaacaacccaaaggagccgggaggacctaagtgctctcacaaggcaaggcagatatccgccttatgaaagagttgtgctacgagaagcttcattcaaaagacccgtggtgatcctgggcccggtggctgacatagcaatgcaaaagctgaccgcagagatgcccgatcaatttgagatagctgaaactgtgtctcgaacagactccccctcaaagattattaaattggacacagtacgggtcattgcggagaaggacaagcatgcccttctggatgtgaccccttccgctatcgagcggctgaactatgtgcagtattatccaatcgtggtcttcttcatcccagaaagtcgccctgccctgaaagcgttgcggcaatggcttgcccccgctagtcggcggtccactagacgtctctacgcacaggcacagaaactgcgcaaacattcatcacatctgtttaccgccactattcccctgaacggtacttctgatacctggtaccaggagctgaaggccattattagagagcagcagacacgtccaatctggacagccgaagaccagttggacgggtcgctggaagacaacctggatctgcctcaccacgggctagctgatagcagcgccgacctctcctgcgatagccgggttaactccgactatgaaactgacggtgagggtggtgcctacactgacggggagggatacacggacggggaaggcggtccttatacggacgtggacgatgagcctcctgctccagctctggctcggtcatccgagcctgtccaggcagacgagagccagagcccccgcgaccggggtaggattagtgcccaccaaggggcacaggtagactcgcgacatccccaggggcagtggagacaggattccatgagaacatatgaacgggaagcattgaagaagaagttcatgagagtgcacgatgccgaatcttctgacgaggacggatacgattgggggccagccacagatttatag

SEQ ID NO: 208737 - DNA, 2859 bp, Artificial Sequence
  Description of Artificial Sequence: Synthetic coding sequence
atgaacctgtgcggcctgatgcccatcttccccgcccccctggaccaggtcgccgacatggaagagttgacaatatgggaacagcacaccgcaaccctctccaaggacccccgccgagggtttggtatcgcgatatctggtggccgcgacaggccaggaggctctatggtcgtgtcagacgttgtgcccggaggccccgcggaaggtagactgcagactggggatcacattgtgatggttaacggagtgtcgatggagaacgcgacaagtgcatttgccattcagatcttgaagacttgcaccaagatggccaatatcacagtgaaaaggccccgccggatacatctccccgccactaaggcttcgccatcaagtccagggaggcaggactctgatgaggatgacggtccgcagagggttgaggaagtagaccagggccgcggatacgatggagattccagctctggaagcggtaggagctgggacgaaagaagccggcgcccaagacctggccgcagaggaagggccggatcacatgggaggcgatctcctggaggcgggtccgaggctaatggactggctttagtcagcggctttaagcgcctgcctcgccaggatgtgcagatgaagcccgtgaagtccgtgctggtgaagcggcgagactcagaggaatttggtgtgaagctgggatcccaaatttttattaaacatatcactgacagcggcctggctgcgcggcatcgggggttgcaggagggagatctgattctgcaaattaatggagtatctagccagaacttatcacttaatgatactaggagactcatagagaagtctgaaggcaaactgtctttgctggttctgcgagaccgaggacagtttcttgtgaacatccctcctgcagtgtctgattccgactcctccccactagaggaaggtgtcaccatggcagacgaaatgtccagccctccagccgatattagtgatctcgcttctgaactgtctcaggctccccccagccatataccacctccacctagacacgcacaacgcagcccagaagcctcccagaccgattctcctgtcgagtcacccaggctgcgaagagaatcttcagtggatagcaggaccatttcagagccggatgagcagcggtccgagttacccagagaatcatcgtatgatatttatagagtgccctcttcacagtcaatggaggatcggggatattcccccgacacaagggtcgttaggttcctaaaggggaagtcaatcggcctccgacttgccggaggaaatgacgtgggaattttcgttagtggtgttcaggctgggagccccgctgatggccaggggatccaggaaggcgatcagattctgcaagttaatgacgtgccgtttcagaacttaacacgtgaggaagcggtacaattcttgctggggctgcctccgggagaggagatggaactcgtaacacagagaaagcaggatattttttggaagatggtgcagtccagagtgggcgatagtttctacatccggacccactttgagctggagcccagtccgccatcaggcttgggctttacacgtggagacgttttccacgtgcttgatactttgcatccaggcccaggccaatcacacgcgcgtggaggacactggctggccgtgcgcatgggccgcgacctgcgcgaacaggaaagggggataatcccaaatcagtcaagggcagaacagttagcaagcctggaggcggctcagcgagcagtgggagtgggacccggctcatctgccgggtccaacgcacgagcagagttttggaggctgcgaggacttcgtcgcggggccaagaagaccactcagagatccagagaagacctaagcgccctgacacgacagggccgctatccaccttacgagcgggttgtgctcagggaggcatccttcaagcgacccgtggtaatcctgggcccagtggccgatattgccatgcaaaaactgaccgccgagatgccagaccagtttgagattgcagaaactgtatctcgcaccgactcgcctagtaaaattataaagttggatacggttagagtcatcgccgagaaggataaacatgcgttgctcgacgtgaccccgtcagcgatagagcggctaaactacgtgcagtactaccctatagtggtgttttttatccctgagtctcgcccggctctcaaagcactccgtcagtggttggctcccgccagccgccggtccacgcgccgactttatgctcaggctcagaaactgcgcaaacacagtagccacttatttacagctactataccactgaacggtacgtctgacacgtggtaccaggaacttaaggcaattattagggagcaacaaacccgtcctatctggacagccgaggatcagctcgacggaagcctcgaggacaacctggacctgcctcatcatgggctggccgacagctctgctgacctttcctgtgacagccgcgtgaattctgattacgagactgacggggagggcggcgcctacacggacggcgagggctacacggatggcgagggtgggccctacacagatgtagatgatgaaccgcctgcccctgccctagccagaagcagcgagccagtgcaggcggacgaatcccaatcaccacgagaccggggcagaattagcgcgcatcagggtgcccaagtggactctcgccaccctcaggggcagtggagacaggattctatgagaacttatgaacgcgaagcgctgaagaaaaaatttatgcgggtgcacgacgccgagagctcagatgaagacggatacgactgggggccagcgactgatctgtag

SEQ ID NO: 208738 - DNA, 2802 bp, Artificial Sequence
  Description of Artificial Sequence: Synthetic coding sequence
atggaggagctgaccatctgggagcagcacaccgccaccctgagcaaagatccccgtcggggattcggtattgcgatttccgggggccgggatcggcccggggggagcatggtcgttagcgacgtggtgcccggtggtcccgctgagggcaggctgcagactggggatcatatagtgatggtgaatggggtgtcaatggaaaatgcaacatcagccttcgctattcaaatcctgaagacctgcacaaaaatggccaacattaccgtaaaaaggccgcgccgcatccaccttcctgctaccaaagcctcgccttcatctccagggcggcaggattctgacgaagatgacggcccccaacgggtggaggaggtggaccaaggccgcggttatgacggggactcctctagcggcagcggtcggtcctgggatgaaagaagtagaagacctaggccgggacgtagaggcagagccggcagtcacggtcggagatccccaggtggaggtagtgaggcgaatgggctggctctggtaagcggattcaagaggttgcccagacaggatgtgcagatgaagcccgtgaagagcgtgctcgtgaagcggcgggactccgaggaattcggggtcaagctgggctcccagatcttcataaagcatatcaccgacagcggtctcgccgctcgacacagaggactccaggaaggcgatctgatactgcagataaatggcgtcagcagccagaacctcagtcttaacgacacacgaaggttaattgaaaagtcggaaggaaagttgagcctactggtcctaagggacaggggacagttcctggtcaatataccaccagccgtgtccgatagtgattcctcccctctcgaagaaggcgtcaccatggccgatgaaatgtcgtcgcccccagctgacatatccgacttggcttccgagttaagtcaggcgcccccctctcatatccccccccctccgcggcatgcccagcgtagcccagaggcatcccagaccgattcccccgtggagagcccgcgtctgcgccgcgaaagcagcgtggattcccggacgattagcgagcctgacgaacagaggagcgagctgcctcgcgagagctcttacgatatctatagggtgccatcctctcagtctatggaggaccgtggatatagtcccgacactagagttgtgcgtttcctaaagggaaagtcaattggccttcgactggctgggggaaatgacgtcgggatttttgtgtctggagtgcaagctggctcgccagctgacggccagggaatacaagaaggcgaccagatcctccaggttaatgatgtgcccttccaaaacctcacgagagaagaggcggtgcagttcctgctgggtcttccgcctggcgaagagatggagctggtgacccagaggaagcaggatatcttttggaaaatggtgcagtcccgcgtcggagactctttctacataagaactcatttcgagctggaaccttcccctcctagtggcctcgggtttaccaggggagatgtgttccacgtccttgacactctgcatcctggaccaggccagagtcatgccagaggtgggcattggctggcagtcagaatgggacgggacctgcgcgagcaggagcgtggtatcattccaaaccagtcccgggccgagcaacttgcatcactggaggccgctcagcgtgcagtcggagtagggcctggttcttcagccggtagcaacgcaagagcagaattctggaggctgagaggtctgagaagaggcgccaaaaagaccactcagcgcagcagggaagacctcagcgcactgaccaggcagggacgatatccgccatatgagcgagtagtgctcagagaggccagtttcaaacgcccagtggtgattctcggccccgtggccgacattgccatgcaaaagctcactgcggaaatgccagatcagttcgagatcgccgaaacagtctccaggacagactcaccctcaaaaattattaaattggatactgtcagggttatcgctgaaaaagacaaacatgcactcctcgacgtaacaccctccgccatcgagaggttgaactatgtgcagtattacccaattgtcgtgttctttatcccggagtcacgtcctgctctaaaagccttgagacagtggttggctccagcgtcgcgcagatccacccgacgattgtatgctcaggctcagaaactacgtaagcatagcagtcatctttttaccgctacgatcccactgaatggcacctctgatacgtggtaccaggaattgaaagcaattattcgcgaacaacagaccagaccaatttggactgctgaagaccagctcgatgggagcctggaagacaacctggatttgccacatcacggtctggcagattcttcagcagacctctcttgtgatagcagagttaatagtgattatgagacagatggcgaagggggcgcctatacagacggagaaggttatacagacggggagggcgggccctataccgatgtcgacgacgagccacccgctcccgcattggccagatcatccgaacctgtgcaagccgatgagagccaaagcccaagggataggggccgaatctccgctcatcagggagcccaggttgacagcagacatccacaggggcagtggagacaggatagcatgaggacgtatgaacgcgaggcgctgaagaaaaaatttatgagggtacatgacgccgagtcatctgatgaggatgggtatgactggggccccgccaccgacctgtag

SEQ ID NO: 208739 - DNA, 2652 bp, Artificial Sequence
  Description of Artificial Sequence: Synthetic coding sequence
atggtggtgagcgacgtggtgcccggcggccccgccgagggccggctgcagactggtgaccatattgtcatggttaatggggtttcaatggagaacgccacaagtgcttttgcaatccagatcctaaagacctgtacaaagatggccaacataacagtcaaacggccgcggcgcatccatctacctgcaaccaaagcaagcccaagctcccccggccgacaagatagtgacgaagatgacggtccacagcgcgtcgaagaagtcgaccagggtcgtggctatgatggcgatagttcttcaggtagcggaagaagctgggacgaaaggagtcgccgaccacggcccggcagaaggggtagggcaggaagccacggcaggcggagtccaggcgggggaagtgaggccaacgggctggcactagttagcggctttaagcgtttacctagacaagacgtgcagatgaagccagtgaagtccgtgctcgttaagagacgggactcagaagagtttggagtgaaacttgggagccaaatatttattaagcatatcactgattccggtttagccgccaggcataggggcctccaggagggggacctcattcttcagatcaacggggtgtcttctcagaacttatccctgaatgacaccagacgcttgatcgagaaatcagagggcaaactcagcctcctcgtgctaagggaccgcgggcagttcctcgtgaacatacctccagccgtttctgacagtgactcaagcccgctggaggacattagcgacctggctagtgagctttctcaggcccctcccagtcatattcccccaccccctcggcatgctcagcgctcacctgaggccagccagacagattcccctgttgaatctccccggctgcgaagggagtccagcgttgatagtaggacgatcagcgaaccagatgagcagcgctccgaactgccaagagagtcctcatacgacatctaccgcgttccctcctctcagtcaatggaagaccgcggttatagtcccgacacccgcgtagtccgatttcttaaggggaaatcaattggtctcagattggctgggggtaatgacgtcggaattttcgtgtccggcgtgcaggccgggtcacccgcggacggacaggggatccaggagggcgaccaaatcctccaggttaatgacgtcccttttcagaacttgaccagagaggaggcggtgcaatttctgctgggtctcccaccaggcgaagagatggagcttgtcacacagcgcaagcaagacatcttctggaagatggttcaatccagagttggagactctttttacattaggacccactttgagcttgaaccttcccctccgagtggcctgggctttacccgcggcgacgtctttcacgtactggacacgctgcaccccggccccggacaaagccacgcacgtggaggccactggttggcggtccgtatgggacgcgatctgagggagcaagaacgggggataatccctaaccagtctagggcagaacagctggcttccctcgaagcagcgcagagggctgttggtgtagggcctggtagttccgctgggtcgaacgcacgcgctgagttctggagacttcggggcttgcggcggggcgccaagaagacaacacaaaggtcaagagaagatctgtcagcattaactaggcagggacgatatcccccctatgagagagttgtcctgagggaagcttccttcaaacggcccgtggtaattcttggcccagttgcagatattgcaatgcagaagctgacagctgagatgcctgatcagttcgagatcgcagagaccgtcagccggaccgattccccttccaaaatcattaagctggacactgtgcgcgtgattgcggaaaaagacaagcatgccctgctagatgtgaccccctcagcgatagaaagactgaactacgtacaatattatcccattgtagtattcttcattccagaaagccgtcccgccctgaaggccctgcggcagtggttggctccagcaagcaggcggagtacaaggcgcctgtacgcccaggcccaaaaactccgcaagcattcatcccacctgtttaccgctacgatccccctgaacggaactagtgatacgtggtaccaggagctcaaagcaatcatccgcgagcagcaaacccgtccgatttggacagccgaggaccagctggacggttctctagaagacaatttagacctaccgcatcacgggctggccgacagctcggctgacctttcctgcgacagcagggtgaattctgactacgaaactgacggggagggcggcgcatacaccgacggcgaagggtataccgatggggagggaggtccctatacagatgtggacgacgagcccccggcaccggcactggcaagatcttccgagccggtgcaggcagacgaaagccagtcacctcgcgaccgcggcaggatctccgcccaccagggcgcccaggttgattcccggcacccgcaggggcaatggcgacaggattccatgaggacctacgaaagggaggctctaaagaagaagtttatgagagtgcacgacgccgagtcttccgatgaggatggctacgattggggccctgccaccgacctgtag

SEQ ID NO: 208740 - DNA, 2760 bp, Artificial Sequence
  Description of Artificial Sequence: Synthetic coding sequence
atggaggagctgaccatctgggagcagcacaccgccaccctgagcaaggatccaagacgaggttttggcatcgccatcagtggaggacgggatcggccagggggatccatggtggtgagcgatgtagttcccggcgggcctgctgaagggagacttcaaaccggcgaccatatcgtcatggtaaacggagtgagcatggagaacgctacgagcgcctttgctatccagatcctgaagacatgcaccaagatggccaacatcacagtgaagagacccaggaggatccatttaccagcgacaaaggcaagtccttctagtccaggtagacaggacagcgatgaggatgacgggccacagagggtggaagaagtggaccaggggagaggctacgatggggacagttccagtggctctgggcgaagttgggatgaaagatccagaaggcctcgaccaggacgtcggggccgcgctgggagtcacgggaggcggagccccggggggggcagtgaggctaacgggctagccctggtgtcgggctttaaaaggctaccccggcaggatgtccaaatgaaaccagtcaagagcgtccttgttaagagaagagactctgaagagtttggcgtaaagctgggttcccagattttcataaagcacatcacggactccgggttggccgcccgtcatagaggactgcaagagggagatctgatcttacaaatcaacggcgtgtctagccagaatttgtcactgaatgatacacggcggctgattgagaagtccgagggcaagttgtctctgctggttctaagagaccggggtcagtttctggtgaatattccaccagcggtttctgattccgactccagccccctggaggatatcagtgacttggcctcggagttatcccaagctccaccttcgcacatacctcctcctccacggcacgctcagcgctcccccgaggctagccagaccgacagcccagtggaaagccctcggctgcggagagaatcttccgtggactcccgcactattagcgaacctgacgagcagcgctccgagctacctcgggagtccagttatgatatctatcgggttcctagcagtcaaagtatggaagacagaggatactcgcctgacacaagagtggtgcgctttctgaagggcaaatccatcggacttaggctggccggtgggaacgacgtgggcatattcgtgtcaggcgtacaagcgggaagtcccgctgacggccaaggcattcaggagggagatcagattcttcaagtcaacgacgtgccttttcaaaatctcacacgggaggaggcagtccagtttctactgggactgcctcctggcgaagagatggagctggtgacccagagaaaacaggatatattctggaagatggtgcagagccgggtcggagactcgttctacattagaacccacttcgagttagagccatcccctccttccggtttaggtttcaccagaggggacgtctttcatgtattagatacgctccaccctggaccaggccaatcgcatgcccgaggcgggcactggctggccgtaaggatgggccgggacttacgagaacaagaacggggaatcattccgaaccagtcccgagctgaacagcttgctagccttgaggcagcccagagggccgtaggtgtgggccctggcagtagtgcgggatcgaatgcccgggctgagttctggagactgcgcggtctccgaaggggcgctaaaaaaaccacacagagaagccgggaggacctcagtgcactcaccagacagggtcgttaccccccttatgagagggttgtgctgagagaggcgtctttcaagagaccggtcgtcatactcgggcctgtcgccgacatcgcaatgcagaagttaaccgcggagatgcctgatcagtttgaaattgccgagaccgtaagcagaacagacagcccatctaaaattataaagctggacaccgtgcgcgtgattgccgagaaagataaacacgctttgctggacgtcaccccatccgccattgagcggctgaactacgtacagtattaccccattgttgtgtttttcattcctgagtcgcgcccagcactgaaagcactccggcagtggctggctcctgcatccagaagaagcactcgacgactgtacgcccaagctcagaagcttcgcaagcacagttctcatctctttaccgctacaatccctcttaatggtacatctgatacttggtaccaggaactcaaagccatcatcagagagcagcagactagacccatctggactgcagaggaccaactggatggcagcctggaagataacttggacctgccacaccacggtctggcggatagtagtgccgatcttagttgtgattctcgggtgaatagcgattacgaaaccgacggcgaaggaggagcatataccgacggagagggatacaccgatggcgaaggcggaccttacaccgacgtggatgacgagccccctgcacccgctcttgcgcgcagcagtgagcctgtgcaggctgacgaaagtcaatcgccccgtgatcggggccgtatatctgcccatcagggggctcaggttgactcacgacacccacaaggccaatggcggcaggacagcatgcgaacgtacgaaagggaggccttgaaaaagaagttcatgcgcgtccacgacgccgagagttccgatgaggacggttatgactggggacctgccacagacttgtag

SEQ ID NO: 208741 - DNA, 1623 bp, Artificial Sequence
  Description of Artificial Sequence: Synthetic coding sequence
atggtgcggaccgacggccacaccctgagcgagaagcggaactaccaggtgaccaattctatgtttggggcctcaaggaaaaaattcgtggagggtgtagactctgactatcacgatgagaacatgtactactcccaaagcagcatgtttccacaccggtctgaaaaagacatgctcgccagtccgtcaacctccggacaactctctcagttcggggcttccctctacggacaacaatccgcactcggacttcctatgcgaggcatgtctaacaacactccccagctgaatcgcagcctgtctcagggcactcagctaccatcacatgtaacccccactacaggggtgccaactatgagtttgcatacccctccttcaccaagccgtggcattctgcccatgaaccctcggaatatgatgaatcactcacaggtgggtcagggcatcgggatcccttcacggacgaacagtatgtctagctccggactgggctcacccaacagatcctctccttccattatttgtatgcccaaacaacagcccagccggcagccctttacagtaaacagtatgtctggctttgggatgaaccgcaaccaggccttcggtatgaacaattccttgtccagcaatatcttcaacggaactgacggctctgagaatgtcaccggactggacttgagcgattttccagccctggcagaccgcaaccgcagggaaggttccggcaatccaactccactcatcaatcccttggcgggacgggccccctacgtcggaatggttacgaaaccagctaatgagcagtctcaggacttctccatccacaacgaggacttcccagctctccccgggagtagctataaggatcccactagttctaacgacgattcgaaatctaatcttaatactagtggtaagaccactagctcaacagacggaccaaaatttcccggggataagtccagcaccacccagaacaacaaccagcagaagaaaggcatccaggtcttgcccgacgggagagtgactaacatcccgcagggtatggttaccgaccagttcggaatgatcggactgcttactttcatcagggccgccgaaacggatccaggcatggtgcatttggctcttggcagtgacctgaccacactcggtctgaatctcaattctcccgagaacctttaccctaaattcgccagtccttgggcatccagtccttgcaggccccaggacattgactttcatgtgccgagtgaatatctgaccaacatccatatccgcgacaagttggctgccattaagcttggtagatacggggaggacttgttgttctatctctattacatgaacggaggtgacgttttacagctgttggctgcggtcgagctcttcaaccgggattggcgataccacaaagaggaacgggtgtggatcactagagcaccaggtatggaacctaccatgaaaacgaacacttacgaacgcgggacatactattttttcgattgcctaaattggagaaaggtggccaaagaattccacttggagtatgataaattggaagaaagaccacaccttcctagcacatttaattacaacccagcacagcaggccttttag

SEQ ID NO: 208742 - DNA, 3627 bp, Artificial Sequence
  Description of Artificial Sequence: Synthetic coding sequence
atggacctgcacatgatgaactgcgagctgctggccacctgcagcgcactcggttacctggaaggagatacttatcacaaagaacctgactgcctggaatctgtaaaggatctgattcgttacctgcggcatgaggatgaaaccagggacgtgcgacagcaattgggagccgcacagattctgcagtccgacctcctgcctattctgactcagcaccaccaggacaagcccctgttcgatgccgtgattcgcctgatggtgaatctgactcagccagcgctcctgtgctttggtaacctccctaaggaacccagctttcgacaccattttttgcaggtgctaacttacctgcaggcctataaagaggcattcgcgtccgaaaaagcgtttggtgtactttctgagacgctgtacgaactgctgcaactgggatgggaagagagacaggaggaggataatctgctcatcgagcgaatactgcttctcgtgcggaacatcctccatgtgcccgccgatctggaccaggagaaaaagatcgacgacgatgcaagtgctcacgaccagttactctgggccatacatctgtctggactggacgacctgcttctatttctagcatccagttccgcggaggaacagtggtccctccatgtgctggagattgtgagcctcatgtttcgagatcaaaaccctgagcagttggccggcgtcggacaggggcgactggcacaggaacgctcggccgattttgcagaactcgaggtgttacgccagagagagatggccgaaaaaaaaactcgcgccctgcagcgcggaaacaggcattcaaggtttggaggcagttacatcgtgcagggactgaaatcaattggggaacgcgatctcatcttccacaagggcctgcacaacctgcggaattacagctccgacttgggaaagcagcccaaaaaggttcccaagcggcgtcaggccgcccgcgaactgagcatacaacgcagatctgcccttaacgttcgtctctttttgcgcgacttctgttcagagttcctcgaaaactgctacaaccggttaatgggttcagtgaaagaccacctgctgcgcgaaaaggcccagcagcatgatgaaacctattacatgtgggcactagctttctttatggccttcaatcgggccgcttcatttcggccgggcctggtgtctgaaacactgtcagttcgcacctttcatttcattgaacagaacctcacgaattactatgagatgatgctgacagaccgcaaggaggcggcatcttgggcacgccggatgcacctggctctcaaagcataccaggagctgctggctacagtgaatgaaatggacatcagcccggatgaggccgtccgtgagtccagccgcatcatcaaaaataacatcttttacgtgatggaatatcgggagctcttccttgcactatttagaaagttcgacgaaaggtgccagccaaggtcattcctgcgggatctggtggagaccacgcacttatttttgaaaatgctggaacgattttgccggtcccgaggcaatctcgtcgtacagaacaaacaaaaaaaaagacggaaaaagaaaaaaaaggtgctggatcaggcaatagtgtcaggaaacgtcccatcttccccagaagaagtggaagccgtctggcccgctctcgctgaacagcttcagtgctgcgcgcagaatagtgaattatctatggattccgtcgtaccctttgacgcagcctcagaagtgcccgtcgaagagcagcgggccgaagccatggtacgcattcaagattgcttgctggcaggtcaagcgccccaagcactgaccctcctgaggtctgcgagggaagtctggcccgaaggcgatgttttcggtagtcaagacatctcacccgaagaagagatccagctgctgaaacaaatcctgtccgctccactgcccaggcagcaaggacctgaggaaagaggggctgaagaggaagaggaggaggaagaggaagaggaagaagagcttcaggtagttcaagtgtcggaaaaggagttcaatttcttggattatctgaaacgattcgcctgttctacagtagtgcgcgcctacgtgctcctccttcgatcctaccagcagaactccgctcacacaaatcactgcattgttaagatgttgcatcggttagctcacgacctgaagatggaggcactgctatttcagctgagtgtgttttgtctgttcaaccgcctcctctccgaccctgccgccggggcctacaaggagcttgtgaccttcgctaagtacattctgggcaaattctttgctttggccgcggtgaatcaaaaagctttcgtcgaactactcttttggaaaaacacagccgttgtacgggaaatgaccgaaggatatggtagcttagatgacaggtccagttcccgccgggcccctacctggagccccgaagaggaagcacatttaagagaactttacctagccaataaggatgtcgagggccaggacgtggtggaggcaatcctggcgcacctgaacacagtgcctaggaccaggaagcagataattcaccacctagtgcaaatgggtcttgccgattctgttaaagattttcagcgcaaaggtacccacatcgtgttatggacgggggatcaggaactcgaactgcagagactgtttgaagagttccgagacagtgacgatgttctcggccacattatgaaaaatataacagctaaacgaagccgcgcccggattgtcgataaattacttgcactaggtctggtggccgaaaggcgagagttgtacaagaagaggcagaaaaagttggcatcatccatactgcctaatggtgcagaatctttaaaagatttctgccaggaggatttggaagaggaagagaatttacctgaagaagactcggaagaagaagaagaaggcggctccgaggcggagcaggtacagggctcactcgtgctgtccaatgagaatctggggcaatcactccaccaagaaggattctcgattccactactctggctgcagaactgcctcattcgcgctgccgacgaccgtgaggaggacgggtgcagtcaggctgtccctcttgtgcccctgacggaagagaacgaagaagccatggaaaacgagcagtttcagcaacttctgcgcaaactcggggtcaggccacctgctagtggacaggaaactttctggcggatcccagccaagctgtcaccgacccaactgagaagggcagctgcctcactttcacagcctgaggaagagcaaaagttacagcctgaactacaacccaaggtcccaggagaacagggctcagacgaagagcactgcaaagagcaccgggctcaggctctccgggccctcctattggctcacaaaaaaaaagctgggctggccagcccagaagaggaggatgcggtgggcaaagagcctctcaaggccgcaccaaagaaaaggcagctcctcgatagcgatgaagaacaggaagaggacgagggtcgcaatcgagccccagagctcggcgcccctgggatacagaagaaaaaacgataccaaattgaagacgacgaggatgactag

SEQ ID NO: 208743 - DNA, 906 bp, Artificial Sequence
  Description of Artificial Sequence: Synthetic coding sequence
atgctggagccccaggagaacggcgtgatcgacctgcccgactacgaacatgtagaggacgaaacgttcccacctttccctcctccggcttccccagaaagacaggacggcgagggaacagagcccgacgaggaatctggaaacggcgctcctgtccgtgtcccacctaaacgcacggtgaagcggaacatacccaaactggatgcccagaggctcatctctgaacgtggcctgcctgctctgcggcacgtgttcgacaaagccaaattcaaggggaaaggacatgaagctgaagatcttaagatgctgatacgacacatggagcactgggctcatagattgttcccgaaattacagttcgaagacttcattgacagagtggaatacttggggagtaaaaaagaggttcagacgtgtctgaaacggataaggctggatttgcctattctgcatgaggactttgtcagtaataatgacgaggttgccgagaataacgaacatgacgtgacttctaccgaacttgacccattcctcacaaaccttagcgaaagtgagatgttcgcgtcagaactctcccgcagcctcacagaggagcagcagcagcgaatcgaacgtaacaagcagctcgcattggaaagaagacaggcaaaactcctctctaactcccaaacccttgggaatgatatgttaatgaatactccccgtgctcacaccgtggaggaagtcaatactgatgaggatcagaaggaggagtctaatggcctcaatgaggatatccttgacaatccatgcaacgatgccatcgcaaacactctgaatgaggaggagaccctcctcgatcagtccttcaagaacgtgcagcagcagctggatgccaccagtaggaatatcactgaagcccgttag

SEQ ID NO: 208744 - DNA, 603 bp, Artificial Sequence
  Description of Artificial Sequence: Synthetic coding sequence
atgctgatccggcacatggagcactgggcccaccggctgttccccaagctccagtttgaggatttcatcgatcgagtggaatacctggggagtaagaaagaggtccaaacctgtctgaaacgtatccggttggatctaccaattctgcacgaggacttcgtgtcaaataatgatgaagtcgccgagaacaatgagcatgatgtcacgtccacagaattagaccccttcctcacaaatttaagcgagtcagagatgtttgctagcgaactgtcccggtccctgaccgaggagcagcagcaacgcattgagcgtaacaagcagttagcactagagaggagacaggctaagttactatccaatagccagactctcggaaatgatatgctgatgaatacgcctcgggcccacaccgtggaggaagtcaacacggacgaggaccaaaaggaagagtccaatggactgaacgaggacatcctggataatccgtgtaacgatgctatcgccaacacgcttaatgaggaggagacactgcttgaccagtcttttaagaatgtacagcagcaacttgatgccacatcccggaacattacggaggcgagatag

SEQ ID NO: 208745 - DNA, 537 bp, Artificial Sequence
  Description of Artificial Sequence: Synthetic coding sequence
atgatgatccacggcttccagagcagccaccgggacttctgcttcggaccctggaaactgaccgcctccaagacacacattatgaagtctgcagatgtggagaaactcgcggatgaactacacatgccctccctgcctgaaatgatgtttggtgataatgtgctgcggatccaacacggctccggctttgggatagagttcaacgccactgacgctttacggtgcgtgaacaattatcagggaatgctcaaggtggcctgcgccgaggaatggcaggagagcaggaccgagggcgagcattccaaggaggtgatcaagccctacgattggacttacactacagactacaagggcaccttactgggtgaatcactaaaactcaaagtggttcctaccaccgatcacatcgacaccgaaaagctaaaagccagagagcagatcaagttttttgaggaggtcctgctgttcgaggacgaattacacgatcacggcgtaagctcactgtccgttaaaatccctggagggggccacttgtag

SEQ ID NO: 208746 - DNA, 819 bp, Artificial Sequence
  Description of Artificial Sequence: Synthetic coding sequence
atgatgatccacggcttccagagcagccaccgggacttctgcttcggaccttggaagctgaccgcgagcaaaactcatataatgaaatctgcagacgtggagaagctggcagatgagctgcacatgccatcccttccggagatgatgttcggagataatgtactgcggattcagcacgggtctggctttggaatcgaattcaatgctactgatgccttgcgatgcgtcaataattaccagggaatgctgaaggttgcttgcgctgaggagtggcaggagagccggacagaaggagaacacagcaaagaggtgatcaaaccatacgattggacatacacgaccgattataaggggacgctgttgggggaaagccttaaactaaaagtcgttcccacaaccgatcatatcgacactgaaaaacttaaggctagggagcagatcaaatttttcgaggaggttcttttgtttgaggacgagctgcacgaccacggtgtctcctctctctctgtcaaaattcgagtgatgccttcgtctttctttctgttgctccggttttttttaaggattgatggggttctgattcgaatgaacgatacgcgcttgtatcacgaagctgacaaaacatacatgttgagagaatacacctccagggagtctaagatttcatccctcatgcatgttccacctagcctgtttactgagccaaatgagatctcccagtatctgcccataaaggaagcggtgtgcgagaagctgatcttcccggaacgaatcgatcccaatccggcggatagccagaaatcaacccaagttgaatag

SEQ ID NO: 208747 - DNA, 1143 bp, Artificial Sequence
  Description of Artificial Sequence: Synthetic coding sequence
atgaccgaggaggtgatcgtgatcgccaagtgggactacaccgcccagcaggaccaagaactagatattaaaaagaacgaacgactctggctcttggatgactctaaaacatggtggagagtccggaacgccgccaaccggaccggctacgtaccctccaactacgttgaaaggaaaaatagtttgaagaagggttctttagtcaaaaacctgaaggacactctcggacttggcaaaactcgacgaaaaactagtgcaagagacgcgtcgcccacacccagtacggatgccgagtaccctgcaaacggcagtggcgcagatcgaatttacgatcttaatatccctgccttcgtaaagttcgcttacgtggcagagcgggaggatgaattatcattggtgaagggctcaagagttaccgtcatggagaagtgcagcgatggatggtggcgtggctcctacaatggccagattggttggtttccaagtaactacgtgctcgaagaagtagacgaggcagccgcggaaagccccagttttctgagcctcagaaagggagcctcactgtccaacggacaaggcagtagagtgctccacgtcgtccaaaccctgtaccccttttcttcagtgacagaggaagagctgaattttgagaagggagagactatggaagtgatagaaaaaccagaaaacgaccctgagtggtggaagtgtaagaacgccaggggtcaagttggcctcgtgccaaagaactatgttgtcgtgctgtccgacggacctgctcttcaccccgcccatgcacctcaaattagctatactggccccagcagttcaggccggttcgcgggacgtgaatggtattatggaaatgtcaccagacatcaggccgaatgtgcgctcaacgaaaggggggttgaaggtgacttcctgatcagggatagtgaatcctcccctagcgacttttctgtcagcctgaaggcttcaggaaaaaacaagcattttaaggtgcagctagttgataatgtgtactgtatcggccagagacgcttccacaccatggacgagcttgtggagcattataagaaggcccccatctttacctctgaacacggcgagaagctgtatttggtgagggcgctccagtag

SEQ ID NO: 208748 - DNA, 756 bp, Artificial Sequence
  Description of Artificial Sequence: Synthetic coding sequence
atgatctacaccatgaagaaggtgcacgccctgtgggccagcgtgtgcctcctgctaaacctcgcaccagcccccctcaatgcagattcagaagaagacgaagagcacaccatcattaccgacaccgagttgccaccactgaagctcatgcattcattctgcgcattcaaagctgatgacgggccatgtaaggccattatgaagcgcttcttcttcaatatatttacacgacaatgtgaggaattcatctatggcggctgcgaagggaatcaaaaccgctttgagtctttagaggaatgcaagaagatgtgcacaagagacaacgccaaccggattattaagaccacccttcagcaagagaaaccggacttctgttttttggaggaggatccaggaatttgtagagggtacattacaagatacttctacaataaccaaacaaaacagtgcgagaggttcaaatacgggggttgtctgggtaatatgaacaatttcgagaccctggaggagtgcaaaaacatttgcgaggatggacccaatgggttccaggtggacaactacggtacacagctcaatgccgtcaataacagccttacccctcaaagcaccaaggtcccctcgctgttcgttacaaaggaaggcaccaacgatggatggaagaatgcggcgcacatataccaggtctttttgaatgcattttgcattcacgcctccatgttctttcttggtcttgacagtatctcctgtctttgttag

SEQ ID NO: 208749 - DNA, 915 bp, Artificial Sequence
  Description of Artificial Sequence: Synthetic coding sequence
atgatctacaccatgaagaaggtgcacgccctgtgggccagcgtgtgcctcttactgaatctggccccagctcctttgaatgcagattccgaagaggacgaggagcacaccatcattacagacacagagttaccccctctgaagctgatgcactctttctgtgctttcaaggccgatgacggaccttgcaaggcgatcatgaaaaggtttttttttaatatatttacaagacagtgcgaggagttcatctatggtgggtgcgaaggaaaccaaaatcggtttgagtctttagaggagtgtaagaagatgtgtacccgcgacaatgccaatcggattattaagactaccttgcagcaggagaaacctgatttctgtttccttgaagaggaccccggaatctgcaggggctacattacacggtacttctacaataatcagacaaaacagtgtgagaggttcaagtatgggggatgtctcggtaatatgaataactttgagactctcgaggaatgtaaaaacatttgcgaggatgggcctaatggctttcaggtagataactacggcacacagcttaatgcggtgaataattccttgaccccgcagtcaacaaaagtgccgagcctgttcgaatttcatggtccctcctggtgcctaacacccgctgatcgggggctctgccgggccaatgaaaatcgtttttactacaatagtgtaatcggcaagtgccggcctttcaaatattccgggtgtggagggaatgagaataattttacgagcaagcaggaatgcttacgagcatgcaagaaggggttcattcagaggataagcaaggggggacttatcaaaaccaagcgcaagcgtaagaagcagcgagtgaaaattgcctatgaggagattttcgtgaagaacatgtag

SEQ ID NO: 208750 - DNA, 756 bp, Artificial Sequence
  Description of Artificial Sequence: Synthetic coding sequence
atgatctacaccatgaagaaggtgcacgccctgtgggccagcgtgtgcttattgctgaacctcgccccagcgccattgaacgctgactcggaggaggatgaagaacacaccattataactgacaccgagcttccaccgttgaaactgatgcattctttctgcgcctttaaagctgatgatggcccatgcaaggcgatcatgaaaagattcttcttcaacatcttcacgagacaatgcgaggagtttatttatggaggctgcgaggggaatcagaatcggtttgagtccctggaggaatgcaaaaaaatgtgcacacgggacaatgctaaccggatcatcaagactactctccagcaggaaaagcccgatttctgtttcctcgaagaggaccccggcatatgtcgtggatatataacccggtacttctacaacaaccagaccaagcagtgcgagagattcaagtatggtggctgtttgggcaatatgaataacttcgaaaccctggaagaatgtaaaaacatctgtgaggatggcccgaatggctttcaagtagataattacggcacccaacttaacgcagttaacaacagtctcactcctcagtccacgaaggtcccctcactcttcgtgactaaagaaggaacgaacgacgggtggaaaaatgctgcccatatttatcaggtctttcttaatgccttctgcattcacgcctcaatgttctttttgggcctcgattcaattagctgcctgtgctag

SEQ ID NO: 208751 - DNA, 231 bp, Artificial Sequence
  Description of Artificial Sequence: Synthetic coding sequence
atgatctacaccatgaagaaggtgcacgccctgtgggccagcgtgtgcctcctgcttaatttggccccagcacctctgaatgctgacagcgaagaagacgaggagcacaccatcatcacagacacagaattacctccgctaaagctgatgcactctttttgcgccttcaaggcggatgacggcccgtgcaaggctatcatgaaaagattctttttcaacatcttcacctag

SEQ ID NO: 208752 - DNA, 186 bp, Artificial Sequence
  Description of Artificial Sequence: Synthetic coding sequence
atgatctacaccatgaagaaggtgcacgccctgtgggccagcgtgtgcttactcctgaacctggctcctgcccccctcaatgccgatagcgaagaggatgaagagcataccattattactgacactgaattgccaccgctaaagctgatgcactcattctgtgcgtttaaagccgacgacgggtag

SEQ ID NO: 208753 - DNA, 321 bp, Artificial Sequence
  Description of Artificial Sequence: Synthetic coding sequence
atgatctacaccatgaagaaggtgcacgccctgtgggccagcgtgtgtctcttgctgaacctagccccagcccctctgaacgctgacagcgaagaggacgaagaacataccatcatcaccgacacggagctccctccacttaagttgatgcacagcttctgcgctttcaaggctgacgatgggccatgcaaagccattatgaaacgattcttctttaacatcttcacccgccagtgcgaagagttcatttatggcggttgcgagggaaaccagaatagattcgagtcccttgaggagtgcaagaagatgtgtactagatag

SEQ ID NO: 208754 - DNA, 867 bp, Artificial Sequence
  Description of Artificial Sequence: Synthetic coding sequence
atgatctacaccatgaagaaggtgcacgccctgtgggccagcgtgtgtctcctactcaatctagcccctgccccccttaacgctgacagcgaggaggatgaggaacatacaattatcactgacactgagcttccacccctgaaactaatgcatagtttctgcgcttttaaggctgacgatggcccctgcaaggcgattatgaagagatttttcttcaacatcttcacccggcagtgcgaggaattcatttacggcgggtgcgagggtaatcaaaatcgatttgagagtttggaggaatgcaagaagatgtgcacacgcgacaacgctaataggattattaaaaccacccttcagcaggagaaaccggacttttgtttcctggaggaggatccgggaatctgcaggggctatatcacaaggtatttttacaataaccagactaaacagtgcgagcggttcaagtacggaggttgtctgggcaatatgaacaatttcgaaactttggaggaatgcaagaacatttgcgaagatggccccaatggctttcaagttgataattacgggacacagctcaacgcagtgaacaactctctgacaccacagtccaccaaggttccgtctctattcgagtttcatgggccatcttggtgtctgacacccgcagatcgaggtctgtgtagggctaacgagaaccgtttttattacaattcagtgattggcaagtgtcggcccttcaaatacagtggatgtggaggtaatgaaaataactttacatccaaacaggaatgcttaagggcatgcaaaaagggattcattcagcgaatatcaaaaggagggctgattaagaccaagcggaaacgtaagtag

SEQ ID NO: 208755 - DNA, 321 bp, Artificial Sequence
  Description of Artificial Sequence: Synthetic coding sequence
atgatctacaccatgaagaaggtgcacgccctgtgggccagcgtgtgcctgctgctgaatctggctcccgccccactgaatgccgactccgaggaagatgaggaacataccatcatcacagatactgaactgccaccactgaagctcatgcattcattctgtgccttcaaggccgatgacggcccttgtaaagccattatgaagagatttttcttcaacatcttcacccgacagtgcgaggagtttatttatggagggtgcgagggaaatcagaaccggtttgaaagcctggaggaatgtaagaagatgtgcactcggtag

SEQ ID NO: 208756 - DNA, 318 bp, Artificial Sequence
  Description of Artificial Sequence: Synthetic coding sequence
atgatctacaccatgaagaaggtgcacgccctgtgggccagcgtgtgtctgctgttaaaccttgccccggccccactcaacgccgatagtgaggaagacgaggagcataccattatcaccgatactgaactacctccactgaagctaatgcactccttttgcgcttttaaggctgacgatggtccttgcaaagctattatgaaacgcttctttttcaacattttcacacggcagtgcgaagaattcatctacgggggatgtgagggtaatcagaaccgctttgagagtctagaagagtgcaaaaagatgtgtacctag

SEQ ID NO: 208757 - DNA, 966 bp, Artificial Sequence
  Description of Artificial Sequence: Synthetic coding sequence
atgggcgagccccagggcagcatgcggatcctggtgaccggcggctccgggctggtggggaaggcgattcagaaggtggtggccgacggcgcgggcctcccaggagaggactgggtgttcgtcagttccaaggacgctgatctgaccgatacagctcagacacgtgcgctgtttgagaaggtgcagcccactcacgtcattcacctcgccgccatggtgggcggactctttaggaacattaaatataatctggatttctggcgaaagaatgtgcatatgaacgataacgtcctccattctgcttttgaggtaggcgcccgtaaagttgtgagctgtttgagcacctgcatattccctgataaaaccacttacccaattgacgagactatgattcacaacgggcctccacataatagcaattttggttattcgtacgctaagcgcatgattgacgtgcagaatcgagcctacttccagcaatacgggtgtacatttacagcagtgatccccacgaacgtatttggaccacatgacaatttcaatatagaggatggacacgtgctgccggggctcattcacaaggtccaccttgcaaagagctctggcagcgcactaaccgtgtgggggaccggtaatcctcggcggcaattcatttacagcctcgacctggcccagctgtttatctgggttctgagagaatataacgaagtggaacctataattctgtcggttggcgaggaggatgaggtgtccattaaggaagccgcagaagctgttgtggaggctatggacttccatggagaagtgacctttgacaccaccaagtccgatggacagtttaaaaaaactgcctcaaacagtaagttacggacctatctgcctgattttagattcacacccttcaaacaagcggtcaaagaaacttgcgcatggttcaccgacaattacgaacaggccagaaagtag

SEQ ID NO: 208758 - DNA, 360 bp, Artificial Sequence
  Description of Artificial Sequence: Synthetic coding sequence
atgggcgagccccagggcagcatgcggatcctggtgaccggcggctccgggttggtgggaaaggcgattcaaaaggtcgtagcggacggggcaggcctgcccggggaggattgggtttttgtctcttctaaggatgcagatctgaccgatacagctcagactcgcgccctgttcgagaaagtacagcctacccacgtgatccatctagccgctatggtgggaggactgttcagaaacatcaaatacaaccttgatttttggaggaaaaacgtccacatgaatgacaatgtcttacactccgcctttgaggtgggggcacgaaaggtggtttcatgcttgtcaacatgtattttcccttag

SEQ ID NO: 208759 - DNA, 807 bp, Artificial Sequence
  Description of Artificial Sequence: Synthetic coding sequence
atgggcgagccccagggcagcatgcggatcctggtgaccggcggctctggactcgtgggcaaggccattcaaaaggtagtggccgatggcgcagggctgccgggagaagactgggttttcgtgagtagtaaagatgctgatctgaccgatactgcccaaactcgggctctctttgaaaaggtgcagcccacgcatgtcattcaccttgccgctatggtggggggcctgtttagaaacatcaaatacaatctggatttttggaggaagaacgttcacatgaatgataacgtactgcattccgcttttgaggtgggggccagaaaggtcgtttcctgcctttctacctgtatcttcccggataaaactacttatcctatcgatgagacaatgattcacaatggccctccacacaattctaattttggatactcttacgctaaacggatgatagacgtgcagaaccgggcctactttcagcagtatggttgcaccttcaccgccgtcattcccacaaatgtatttgggcctcatgataacttcaacatcgaagatggacacgtattacctggactgatacataaggttcacctggccaagagctccgggagtgccctcactgtgtggggtaccggcaatccaagaaggcaattcatttacagtctcgacctcgcccagctcttcatttgggttctgcgcgagtataatgaagtcgagccgattatcctttccgtgggcgaggaagacgaggtgtctatcaaagaggcagctgaagccgtggtggaggcaatggatttccacggcgaatag

SEQ ID NO: 208760 - DNA, 966 bp, Artificial Sequence
  Description of Artificial Sequence: Synthetic coding sequence
atgggcgagccccagggcagcatgcggatcctggtgaccggcggcagcgggttagtcggcaaggccattcagaaggtcgtggctgatggcgctgggctgccaggagaggactgggtttttgtgagctcaaaggatgctgacctgaccgatacggctcagacacgggctctgtttgaaaaggttcaacctactcacgtgatccaccttgccgctatggtgggaggcctgtttcggaacattaagtataatttagatttttggcgcaagaatgtacatatgaacgataatgtcctgcatagcgcgtttgaagtgggcgctcggaaggtcgtgtcctgccttagtacctgtatttttccagataagaccacatatcccatcgatgagacaatgattcacaacggccctccacacaactccaacttcggctactcatatgccaagcggatgatcgatgttcagaatcgcgcctacttccaacaatacggttgcaccttcactgcggtgattccaaccaacgtcttcggccctcacgacaatttcaacatcgaagatgggcacgtcctgccaggcctcatccacaaagtgcatctggcaaaaagctccggatctgcactgacagtgtggggcactgggaatccaaggagacaatttatttatagcctggacctggcccagctcttcatttgggtccttcgggaatataatgaggtcgagcccatcatcctgagcgtgggcgaggaggacgaagtctcaataaaagaagcggcagaggccgtggtggaggctatggacttccacggcgaagtcacgtttgatactaccaaatcggatgggcagttcaagaaaaccgcctcaaactcaaagctcagaacctatctgcccgatttccggtttactccatttaagcaagcagtgaaagaaacctgtgcctggttcactgacaattacgagcaggccaggaagtag

SEQ ID NO: 208761 - DNA, 597 bp, Artificial Sequence
  Description of Artificial Sequence: Synthetic coding sequence
atgggcgagccccagggcagcatgcggatcctggtgaccggcggcagtgggctggttggaaaagccatccagaaggttgtggccgatggggcaggtctgcctggcgaagactgggtctttgtgtcatccaaggatgccgacctgacagacaccgcccagacgcgcgccctgtttgaaaaagtgcagccaactcacgtcatccatctggctgccatggtcgggggtctcttccggaatattaaatataatctggatttttggaggaagaacgtccacatgaacgacaacgttctgcacagcgctttcgaagtgggagcccgcaaggttgtctcctgcctgagcacttgtatcttccccgataaaacaacatacccaatcgatgagactatgatacacaatggtccaccgcataattccaacttcggttactcttatgcaaagagaatgattgacgttcaaaatagggcctacttccaacaatacgggtgcacctttaccgcggttatcccgacaaatgtttttgggcctcacgataacttcaacatcgaagacggccatgtgctgccaggtcttattcacaaggtacacctggcttag

SEQ ID NO: 208762 - DNA, 2658 bp, Artificial Sequence
  Description of Artificial Sequence: Synthetic coding sequence
atggtggagaagagcagcatcgacgagaacagcatcagcctggagaaggaggtcaggcacgtgcaggaacagaatctggacatattgaagaccgacctttccctgaagtctttcagcgaagaaatttatagtgagtcctgcgcactgttaccaacatcttctgccgacattgaggaaaccgatctgtctgaaaagtcatgtccgcttgaaaacggtggtagatctagcatctcacacctgaaaaaagctgccagtgaggaaaaacctctgggggtcggggagatggaagaggagtgtacattggagccggaactggccgccttccctaaacaggacgggggtacccaagaatataccgatgctacactcgaggatcatcgtggagatgtgcaagaagccgacacgctccacaggcagttgagcctgtctcagtgctttccactactgatgactgaggaacagcagaatcctggggagcaaatctccactaatattcatgcaagtggtgaagagaagtgttatgaagaagtgcaagtccaaaacgaagcctctttcagcactctggaaggagaaatgatagaaacttcattctctcaaaacattcccaaactcgatgaggcacataccacagaagccgcggagtctgagacttcgctcacacaatatcttcttgccgcaggaaaaagagaggtgccagaaacaaaagatacgcgggatcaggccaagctggtccagtctgagagcattacctcaatggaggtagaggaggttacttttaacacagtgtatgaatactataatcagaaacaggaatctctgggccggcccctgtcgcccgagagtgatatcagcatcggggtgggaagcacgacaagcgaagaaatttccgaactagaccagttctacactcctccatcgtccgtggagtactttgagtcccctaagtctcctgatctgtactttaatccaagtgatattacaaaacagtcatcaatccacagcggcggagagacagttgaacgatactcaaccccactgggtgaggtagctgaaaggtattccacccccagtgaaggtgaagtgggagagcggtactccactccccccggagaaacgttggagcgatacagcacaccaccaggggaaactcttgagcggtacagtaccccccctggtgaggctctcgaacgctactctattccaactggcgggcctaatcctacaggaacattcaaaacttatccttctaaaattgaacgcgaggacggaacaccaaacgagcacttttacacgccaacagaggagaggggctcggcctacgagatctggaggagtgactctttcggcactcccaacgaggcaatcgagccaaaagataacgagatgccacctagtttcattgaaccactgacaaaacgaaaagtgtacgaaaatacaactcttggctttatagttgaagtggaagggctacctgtgcccggtgtgaagtggtaccggaataagtctctgcttgaacccgacgagcgtatcaaaatggaacgggtgggcaatgtttgcagcttagagataagtaatattcaaaaaggtgaggggggggagtacatgtgtcatgcagttaatattatcggcgaagctaaaagtttcgcgaatgttgacatcatgccacaggaggagagggtggtggcccttccgccgcctgtcacgcatcaacacgtcatggagtttgatctggagcacacaaccagttcccgcactccaagcccacaggagattgttctggaggttgagctgtccgaaaaggacgtaaaggagtttgaaaaacaggttaagatcgtcactgtcccagaattcactcccgaccacaagagcatgattgtgagtcttgatgttctgccatttaatttcgtggatcccaacatggattcccgggagggcgaagataaagagctgaagatcgatctggaggtctttgaaatgccaccccgctttataatgccaatttgcgatttcaagatccccgaaaactcagacgccgtgttcaagtgcagtgtgattgggatccccacccctgaagtgaaatggtacaaggaatatatgtgcatcgagccagacaacattaaatatgtgatttcagaggagaagggttcacataccctcaagattcgaaacgtttgcttgtccgattccgccacctatcgatgtcgcgccgttaactgtgttggcgaagctatttgcaggggctttcttactatgggagactcggagatcttcgctgtaattgccaagaagagtaaagtgaccctgtccagcctcatggaagagctggtgctgaaatcaaactataccgattctttttttgagtttcaggtggttgagggaccaccgagattcatcaaaggcataagtgactgttacgctcctattgggaccgcagcctacttccagtgcttagttagagggagtcccaggcctactgtgtactggtacaaagacgggaaactcgtgcagggccgacggttcaccgtcgaagagtctggaaccggcttccataacctcttcattacttccttggtgaagagcgacgaaggagagtacagatgtgtcgccacgaacaaatccggcatggcagaaagttttgccgcactgacgctgacatag

SEQ ID NO: 208763 - DNA, 16815 bp, Artificial Sequence
  Description of Artificial Sequence: Synthetic coding sequence
atgaccacccaggcccccaccttcacccagcccctgcagagcgtggtggtgctcgagggcagcacagcgacattcgaggcccacatcagcggcttccccgtccccgaagtctcatggtttcgggatgggcaagtgattagcacctctacattaccgggagttcaaatcagctttagcgacggccgcgcaaaactcaccattccagctgtgacaaaagccaatagcgggcgttattcgttgaaggccacaaacggcagcggtcaggcaaccagcacggccgaattgctggttaaagccgagactgccccaccaaactttgttcagcgtttacagtctatgaccgtgcgacagggaagccaggttagactccaggttcgagttactgggatccctactcctgtcgttaaattctatcgggatggagcagagattcagtcctcactggactttcagatctctcaggaaggagacctgtactcccttctgatcgcagaagcctaccctgaagactcgggcacatatagtgtgaacgctacaaacagcgtcggccgcgccacttctactgcggagcttttggtgcagggggaggaggaggtacctgctaagaagaccaagacaattgtgagcactgctcagatatccgagagccgccagacgcgtattgagaaaaaaatagaagcccatttcgacgccagatctattgcgacggtggagatggtgattgacggtgctgccggtcaacaactcccacataaaacaccaccacggatcccgccaaagcctaaatccaggtccccgacaccacctagcatcgctgccaaggcccagttggctcgccagcagtctccatcccctatccgccattcgccaagcccggtcagacatgtccgggcccccacccctagcccggttagatccgtgtcaccggctgctagaattagtacatctcccattagaagcgtgcgatcacctctgctcatgaggaagacccaggccagtaccgttgccaccggtcccgaggttcctcccccctggaaacaagaaggctacgttgccagctcttctgaagctgagatgcgagaaaccaccctcacaaccagcacacaaatcaggacagaagagcggtgggaggggcggtatggagtgcaagagcaggttactatttcaggggctgcaggggccgccgcttccgtcagtgcgtccgcttcctacgctgctgaggccgtagctaccggggccaaggaggtcaaacaggatgcggacaagagtgcagctgtggccaccgtggttgctgcagtggacatggctcgagtgcgagagcctgttatctccgccgtggagcagaccgctcagcgcacgactaccactgctgtgcacatacagcccgcccaggagcaggtgagaaaggaggccgaaaagactgcggttactaaggttgtggtcgcagctgacaaggctaaggagcaggagcttaagtctcgcactaaagaagtgattactacgaagcaggagcagatgcatgtgacgcacgaacagattagaaaggaaaccgaaaagacgtttgttcctaaggtcgtgattagcgccgccaaggcgaaagagcaggagacaaggatctccgaagagataactaagaaacagaaacaggtgacccaagaggctatacgtcaagaaaccgagatcaccgccgctagcatggtcgtcgtcgccaccgccaaaagcaccaagctggaaacagtgcccggggctcaggaggagactactacacagcaggatcagatgcatttatcatacgagaagattatgaaggagacacgaaaaactgtggtacccaaagtcatcgtggccacaccaaaagtgaaggaacaagacctggtttctcgaggccgtgaggggataacaacaaaacgtgagcaagttcagatcacacaggagaagatgcgaaaagaggcggaaaagaccgctctgtccaccatagcagtggcaactgctaaggccaaggagcaagaaaccattctgcgaacacgggaaaccatggccacacggcaggagcaaatccaagtgacccacggaaaggtggatgtcgggaagaaagcagaggctgtggccaccgttgttgctgccgtggatcaagcacgagttcgggagcctagagagccgggtcacctggaagaatcttacgcccagcagactaccctcgaatacggatacaaagaaagaatatctgctgctaaagtggctgagccgccacaaagaccagcttccgagccacacgtcgttcctaaggctgttaaacctcgcgtcatacaggcgccctcagagactcatatcaagactactgaccagaaaggtatgcacattagctcccagattaagaaaaccaccgatttaacaacagagcgtctggtgcatgtagacaagagacctcggactgccagcccccacttcactgtgagtaagatctccgttcctaagaccgaacacggctacgaggcctctattgctggctctgctattgccaccctgcaaaaggagctatcagctaccagcagtgcacagaaaataacaaaaagcgtaaaggccccgacagttaaaccgtccgagactagggtgagagcggaaccgaccccactgccgcagttccctttcgccgataccccagatacctacaaatccgaggctggagtagaagtcaagaaggaagttggagtgagtataaccggaacaactgtgagagaggaacgatttgaggttctacatggtcgggaggctaaggtgaccgaaacagccagggtgccagctccagtggaaataccagtgacacccccgacattagttagtggtctgaagaacgtcaccgtcatcgagggcgaatccgtaacactcgaatgtcatataagtgggtacccatctcctactgtgacatggtacagagaggactatcagattgaatcaagcatagacttccagataacttttcagtcgggaatcgcccgcctgatgatacgagaggcttttgccgaagactctgggaggtttacctgttctgcggtcaatgaagccggtacagtgtccacatcttgttacctcgcagtccaagtatccgaggaattcgagaaggaaaccaccgccgtcacggaaaagtttacgacagaagaaaaacgtttcgtggagtctagagatgttgtgatgaccgatacctccctgacggaagaacaggcaggcccgggtgaacctgcagccccatacttcatcactaaacccgtagtacagaaacttgtagagggtggcagcgtggtatttggctgtcaggttggaggaaatccgaaacctcacgtgtattggaaaaagagtggcgtgccccttacaactggctaccgctataaggtgtcctataataagcagacgggcgagtgcaagctggtgatctccatgacctttgcagacgatgctggagaatacacgattgtggttagaaacaagcacggcgagaccagcgcctccgcgtccctgctggaggaagctgactacgagctgctgatgaaaagccagcaggagatgctgtatcagactcaagtaaccgccttcgtgcaagagccaaaggtgggagagacagctcctggattcgtatacagtgaatatgaaaaggagtatgaaaaggagcaggcattgatacgtaaaaagatggccaaggacacggtggtcgtgaggacatacgttgaggatcaggaattccacatatcttcctttgaggagagactcataaaggagatcgagtaccgcataatcaaaacaacactcgaagagctgctagaggaagatggcgaggagaaaatggcagtagatatctctgagtccgaggccgtcgagagcgggtttgactctagaataaagaattacaggatactcgagggcatgggtgtcacttttcattgtaaaatgagtgggtaccccttgcctaagattgcttggtacaaggatgggaaaagaatcaaacacggcgaaagataccagatggattttttgcaggatggcagagcatccctgcgtatccctgtcgtcctgccggaagacgaggggatttacacagcctttgctagtaatatcaagggcaatgcaatctgctcaggtaagttgtatgtcgagccagcggctcctctgggtgctcccacatacattccaacactggagcccgtctcacgcatccgctctctcagccccagatccgtgtcaagaagcccgatcaggatgtccccagctaggatgtctccagccagaatgtccccagcaaggatgtccccagcccgaatgtctcccgggaggcgtcttgaagagaccgatgagtcccagctcgagaggttgtacaagcccgtattcgtactcaagccagtgtcattcaaatgccttgaagggcagaccgcaaggttcgacttgaaagtcgttggccgcccaatgccagagactttctggtttcatgatggccagcagatcgttaatgactacacccacaaagtcgtaattaaggaagacggtactcagagccttatcatcgtgccagcaacacctagtgacagcggcgaatggactgttgtggcccagaaccgcgcggggaggagttcgattagtgtcatccttacagtggaggcagttgaacatcaggtgaaacccatgtttgtggaaaaactgaagaatgtgaatattaaggaagggtcgcggctcgaaatgaaggttcgggctaccgggaatcccaatcctgacatcgtgtggttgaaaaattctgacatcatcgtcccacataaatatcccaagattcggatcgaagggacgaaaggcgaggctgccctgaagatagactcgactgtgagtcaggattcggcttggtataccgccaccgcaatcaacaaagcaggaagggacactactcgttgtaaggtcaatgttgaagtggaatttgccgagcccgaaccagagagaaaattgattatccctagaggtacttatcgcgccaaggagattgcggccccggagcttgagcctctccatcttcgctacggtcaggaacagtgggaggagggtgacctttatgataaggagaaacagcagaaacccttcttcaagaagaagctgacgagcctccgactcaagcgcttcggccctgcccatttcgagtgtaggcttacccctatcggagacccaactatggtggtcgaatggctccacgatgggaagcctttagaggctgctaaccggcttcgcatgattaacgagtttggctactgttccctcgactatggggtggcatacagccgagattccgggattataacatgtcgagcgacgaataagtacggaacggatcacacgtccgcgacactgatcgtgaaggacgagaaaagtctcgtagaggaaagtcagctaccagaaggcagaaagggtctccagcgaatcgaggaactcgagcgaatggcacacgagggagctctcaccggcgtcaccacagatcagaaggaaaagcagaaacctgatattgttctttaccctgaaccggtccgggttttagagggagaaacagctcggttccggtgccgcgtgaccggctatcctcagcctaaagtgaactggtatcttaatggacaactgattagaaagagcaagcgattccgcgtgaggtatgatggaattcactatctggatatcgttgattgcaaaagctacgacaccggggaggtgaaagtgaccgcagagaatcccgagggtgtcatagagcataaagttaaactcgagatccagcagcgcgaggacttccggtctgtgctgaggagggcaccggagccccgtcccgagttccatgtgcacgagccaggaaaacttcagtttgaggtgcagaaagtcgataggccggtcgacactacagagaccaaggaggtcgtgaagttgaaacgggctgagcggattacccacgagaaagttcctgaagagtccgaagaattacggtccaagttcaagaggaggactgaagagggatactacgaagctatcacggccgtggagctgaagtctcgtaaaaaggatgaatcttacgaggagctcctgcgaaagaccaaagacgagctgctacactggactaaagagctcaccgaggaagaaaagaaggccctggccgaggaaggcaagataactatcccgacctttaaacccgacaaaattgagctgtctccgtcaatggaggccccgaagatctttgagcgaatacaatctcagaccgtgggccagggatcagacgcccattttagagttagggtcgtgggtaaacccgacccagaatgcgaatggtacaagaacggagttaagattgaacggtccgaccgcatctactggtattggccagaagacaacgtctgcgagctggtgattagagacgtgaccgctgaagactctgcttcaatcatggtgaaggcaattaacatcgctggagagaccagcagtcatgcctttctcctcgtgcaagccaaacagctcatcacttttacgcaagagctccaggatgtagtcgcaaaggagaaggacacaatggccacctttgagtgcgaaaccagcgaaccattcgttaaggtgaaatggtacaaagatggaatggaggtgcacgaaggagacaagtatcgaatgcattctgatagaaaagttcacttcctcagtatcttgaccattgacacctctgacgctgaggactacagctgcgtgctcgtggaggacgagaacgtgaagacaaccgccaaattgattgtggagggagctgttgtggagttcgttaaagagctccaggacattgaggtgccagagtcgtactcaggggagctggagtgtatagtttctcccgagaacattgagggcaaatggtaccacaatgacgtggaactcaaaagcaatggtaagtacacaatcacatctcggcggggccgacaaaacctgacggtgaaggatgtaactaaggaagaccaaggcgaatactccttcgtcatagacggaaagaagacaacatgcaaattgaagatgaagcctcgcccaatcgcaatcctccaggggctgtccgaccagaaggtgtgcgaaggcgacatcgtccagctggaggtgaaggtgagcctggagtctgtcgaaggtgtatggatgaaggatgggcaagaggtccagccttccgaccgcgtccacatcgtgatcgataagcagtctcacatgctactcattgaggacatgaccaaagaagatgcggggaattattcctttacaattcccgcacttggactcagtactagcggtcgggtgagcgtgtacagtgtggacgtcattacccctctgaaggatgtcaatgtgattgaaggcacaaaagcagttttggagtgcaaagtgtccgtgcccgatgtcacatctgttaagtggtatctaaatgatgagcagatcaagcctgacgacagggtccaggccatagtcaaggggacaaagcagagattggtgatcaaccgtacgcacgcatcggacgagggaccctacaaactgatcgtaggtcgtgtcgagaccaattgcaatctgtctgtagaaaaaatcaagatcatcagaggcctccgagacctcacctgcacagagacccaaaatgtggtgttcgaggttgagctcagccatagcggcattgatgttctgtggaactttaaggacaaggagatcaagcctagcagcaagtacaagatcgaggcccatgggaaaatttataagttaacagtgttgaatatgatgaaggacgatgaggggaagtataccttctatgctggcgagaatatgacgtcaggaaagcttacagtggcgggtggggcgattagcaagcctttgacagaccagaccgtcgccgagtcacaggaggcagtattcgagtgcgaggtagccaatccggactccaaaggagaatggcttcgggatggcaagcatcttccactgaccaataacataaggagtgagtccgatggccataaacggcgccttatcatcgcagccacgaaactggatgacataggagagtatacctataaggtggccacctcaaagacctcagccaagctgaaagttgaagctgtgaaaatcaagaaaaccctgaagaacctgacggtcactgagacccaggacgccgtgtttactgtcgaactgacacatccaaacgttaaaggcgtgcagtggatcaagaacggagtcgtcctcgaaagcaacgagaaatacgctatctccgttaaagggaccatatacagcctgcgcataaagaactgtgccatagtggacgaatcagtgtatggattcaggctggggcggctgggggcctccgctcggcttcatgtcgagaccgttaagatcatcaaaaaacctaaggacgtcacggcccttgaaaatgctactgtcgcttttgaggtctccgtctctcacgacacggtaccagtgaaatggtttcacaagagtgtcgagatcaagcctagtgataagcaccggctggtgtccgagcggaaggtgcacaagctgatgttacagaatatctcacctagcgacgctggcgaatacacagcagtggtcgggcagctcgaatgcaaggcaaagctctttgtagagacgttgcacattacgaaaacgatgaaaaatatcgaagttccagagacaaaaaccgcatctttcgagtgtgaagtgtctcacttcaacgtcccaagcatgtggctgaagaacggcgttgagatcgaaatgtctgagaagtttaagattgtagtccagggcaaactccatcaactgatcattatgaatacttccactgaggactctgcggagtatacgtttgtgtgcggaaatgaccaggtgagtgctacacttactgtgacccccatcatgattacatcgatgctgaaagatatcaacgctgaagagaaagatacaattaccttcgaggtgaccgtaaattacgaaggcatctcatacaaatggctgaagaacggcgtggaaataaaaagtacagacaagtgtcagatgcgaacgaagaagcttactcactcactgaatatacggaacgtgcactttggggatgcggcagactataccttcgtggcaggaaaagcgacctctaccgccacgctttatgtagaggcgcgccacattgagttcaggaagcatatcaaagacataaaagtgctagagaagaagagggccatgttcgaatgtgaagtgtctgagccggacataaccgttcagtggatgaaagatgaccaggagctacagattacagatcgtataaagatccagaaggaaaaatatgtgcatcgactgttgattccctccacacggatgtccgatgctggcaagtacacagtcgtggccggcggaaatgtttctacagctaagctgtttgtcgagggaagagatgtgagaattcgatctatcaagaaggaggtccaggttattgaaaaacagcgtgcggtagtcgagtttgaggttaacgaagacgacgtagacgcacactggtacaaggatggcattgagataaacttccaagtgcaggagagacataaatatgttgtggagcggaggattcaccgcatgtttatttccgagactcggcagtctgatgcgggggagtatactttcgtggccgggaggaaccggtctagcgttactctgtacgtaaacgcccccgaacccccccaggtcttacaggagctccaacccgtgaccgttcagtctggcaagcctgcgcggttctgcgcagtgatctctggtcgcccgcagcctaaaatttcctggtacaaagaggaacagctcttaagcactggcttcaagtgcaagttcctgcacgacggtcaggagtatacactgctgctgattgaggctttccctgaggatgcagctgtgtatacgtgtgaagccaaaaacgattacggggttgctactacgagtgcatcattgtccgtggaagtgcccgaagtcgttagccccgatcaggaaatgcccgtgtaccctcctgcgatcataacccctctgcaggatacagttacctccgagggacagcccgctcgctttcagtgccgggtgagtggaacggatctgaaggtgagctggtactccaaggacaaaaaaattaaaccatcacgtttctttcggatgacccagtttgaggacacctatcaactggaaatcgccgaggcttaccccgaggacgagggcacgtatacattcgtggcttctaacgctgttggtcaggtctcgtccacagcaaatctgtctcttgaggctcccgaatccattctgcacgaaagaatcgagcaggaaatcgagatggaaatgaaagagctgttcagcgagggagagagcgagcattctgagcgggacacccgtgacgcattttctgatagtgaggacatcgatcataagagcatggccgccaagaggtacgcttcaagaatctcaagcacatcctcttggcccgagtattttaaaccctcattcactcaaaaattgacatttaagtatgtgctcgagggtgaacccgttgtgttcacttgtagattgattgcatgtccaacaccggagatgacctggttccataacaacagacctatcccgaccggactccgaaggatcattaaagctgagtccgatctgcatcatcactcgtcctcccttgaaattaagcgcgtccaggatagggattccggctcttatcggctactggccattaactcagagggaagtgcagaatccaccgctagtcttcttgtgatccagaagggacaagatgaaaagtacctggaattccttaaacgcgcagagcgcacacatgagaatgtggaagctctggttgagaggggtgaggaccgaatcaaagtggacctaagattcacgggtagtcccttcaataaaaaacaggatgtggaacagaagggcatgatgcgtacaatccacttcaaaaccatgagtagcgcgaagaaaacggattacatgtatgacgaagagtacctcgagtctaagtccgatataagaggctggctgaacgtgggagagtcctttctggacaaagagaccaaagtgaagctgcagcgtcttcgcgaagcacgcaagaccctcatggagaagaagaagctaagcctgctggatacatccagcgagatttccagcaggaccctaagaagcgaggcaagcgataaagatatcctcttcagccgcgaggatatgaagattcggtctatgtctgacctggctgagtcttataaggtggaccattcagcagagagcatcgttcaaaatcctcacgctctgtctaaccagatggaccagaatatcgagtccgaagagctccccactagctttcagaccattgtcgatgaggagatcttccagactgagattagaatgagccaggaagccctcgtgaaggagtcacttcccaaagatcacctctacggggagattttggttaatgagaatacccaggcacgcgggcagttggaagaaatcatggctaataccacaatcggcgaatccagcacctacataaccaacgtgtgtgagaaagaggaggtgtacgagaccccagaaaatgtctcacaggctatcacaccacatgcttcagagtccttcggcacccttgtcaatgtagaggaatcagaagagatcgcctctgaacggattaaaaaggatgaccttcgtgaacttcagctcagtgcatcgactcgtattgacgagttcaagacggagcagaaggaagagaatatgagatttttcgagaatagcttccggaagaggcctcagcgctgcccaccaagctttctgcaggagattgaatctcaggaggtgtacgaaggagattcatgtaatttcgtgtgtcattttcaggggtaccctcagcccattgtgacctggtataacaacgacatgcctataccacggaaccagaatttcataattcatagtctcgagaattacagcattctcaccctgtcttcagtccatcatcagaatgagggctctattacctgcgtcctatttaaccagtacgggacagtcaagacaaccagtatgctgaaggttaaggccaaacagaagcatgacgtgaaagcccataaagtgccggttttccatgactacttggacgaggaggaggagctggctctcgtgtttgaccaggcgaaaggagcccacccctctatgtcacaggagggacaaaccaacctgcatctgctaaagacgaacccgcccgtccctccaagcggagacaccgaactgctgtccttcccagttgaaatacaggtcacagccgccaccccaataccagaacaggacaaggagagtaaggaagtctttcagaccgaggagctggaaccaaaagctatgccgcaggatcaggtgacccaatctcctaagcatcgcttcgtattcctgagtgacattactaacgagcctccgaaaatgctgcaagagatgccaaaacacgccagatgccgtgaaggagatagcattatcctggagtgccttatctctggcgagcctcaacccgtcgtaacctggtttcaaaacggtgtgctgctgaagcaaaatcagaagtttcagtttgaagaggtcaattgcagccaccagctgtacatcaaggatgtcaattcacaggactccggcaagtacaagtgtgttgccgaaaacaattccggggccgtagaatcagtcagcgacctgaccgtcgaacccgtcacatacagagaaaacagccaattcgagaatatcggcgaaatctatggcaagtactcccgggatcagcagctgcaggaccagggcgagtctgtaagggcccacttttacgactaccccgcaggaccgtttacaccctggaccaacgtaaaggagtactccgtgagggattacttccagtcactggagacgattgagcaaattgaccagaaggagcaggtgcgatgtattccttcccgcgagaagataccgcgcttcgtgcacggggcatcaaggaccatcaaaatctccaagcctattcgggccgaattcatccaatgccaggctgaaggtaaggagcggcacgtctcagaaaagtccaagcttcatcaggctgagggaaccgtttacccatttgttgatgacttctccgacgtcacaatcaagaaagaaatcaggaataacttcggcaaactggggaggtctgaaaaagaaaatgtgcaggaatgcgcacagtcggattacctcccaaacatccactctgagcggatctctgacagctacaataccaaggacagctccgcaattgtgtatgaggagtctctgggagaggagatacactatccgggcaaaaaggtgaagcaccgaattatagaatttgagaaactgcacgtggaaaagggggttcttgagaaaaggcctaccaggacgagcattgtaaatcctccccagaagaaaattgatgataaagcattctcccttaagcagagagagtccagaagtagtaacctgaatgccaacatgtaccaggccgagaagatgtcacccaacacagaatctgactcctcaaacatcgcaattaacttaaagttactgtcgagccagacccacaaggagttcgatgcccaggagagagagcagcaggagaagatttctctgatcgataaacctgcgatcagcaagcgagccgagcacgaaagtcccattacctttgacttaaagcagttccatacccaaatcaaacatacagatgttaaattccaggagttagacagcggccagccagaggaagcttactttaaaatccaacacccggcagacaccgaaaacattgttttcgaccttaaacagatgtattcgcacataggtgaccccgccctcgaatttcaagggcaagaaaccagagagcaacaggagatacactataaggaaaagattcccagtccagagactcttcagccagatacccataacattagtaagagtgtgcagaacaatgtgtttgcttcccaagaaatctcgtcgagccaggagctgagtaatagaacaatggtggagaagtccagtattgacgaaaacagcatatctctggagaaggaggtccggcacgtgcaggagcagaatctcgatatacttaaaacagacctatcattgaagtcattcagtgaggagatctacagcgaaagctgtgctctgctgcctacgtcttcagcagacatagaggaaacagaccttagtgagaaatcttgccctctggaaaacgggggacgctcaagcatttctcacctcaaaaaggccgctagcgaagagaaaccactgggtgtcggtgagatggaggaggaatgcaccctcgaaccagaattagccgcttttccaaagcaggacggcgggacacaggaatacacagacgccacactcgaagatcaccgcggcgacgtccaggaagctgacacgcttcatagacaactgagtctatctcaatgcttcccactcttgatgaccgaggagcagcagaacccaggtgagcagatctcaaccaatatccatgctagtggcgaggagaaatgctacgaagaggtccaggtccagaacgaggcttcgtttagcacacttgaaggggagatgatcgaaacatcattctctcagaacattccaaaactggacgaagcccacactactgaagcggccgaatccgagacctccctgacacagtacctccttgctgcaggaaaacgcgaggtgccagaaacaaaggataccagagatcaggcaaaattggtccaatccgaatctatcaccagtatggaagtggaggaggtgacctttaacacagtgtacgagtactacaatcagaaacaagaatcgctgggcaggcctctcagcccagaaagtgatataagtataggtgtgggctccacgacctcggaggagatctcagaactggaccagttttacacaccaccctcttctgtggagtactttgagagtcctaagagccccgatctctactttaatccttcagatatcactaaacagtcttcaatccacagtggaggtgagaccgttgagcggtattctactcctcttggtgaagtcgcagaacgctactctactcccagtgagggtgaagtgggggaacgctattccacacccccaggtgagacattggaaaggtattccacgcccccaggcgaaactctcgagcggtatagcaccccccccggcgaaacgctggagcgctacagcacaccacctggcgagaccctagagcgctattcgactccccctggcgagacgctggaacgctactcaacgccccccggcgaggccctggagcgatactccattcccaccggtggcccaaaccccacgggaacattcaaaacctacccctctaaaattgagcgcgaggacggtacgccgaatgaacacttttacacccctaccgaggagagaggctcggcttacgagatctggaggagtgactcatttggcacgcccaacgaagccatcgagcccaaagataatgagatgccacctagcttcatcgagccactaaccaaacgcaaagtctacgaaaacaccaccctgggctttattgtggaagtcgagggcttgcctgtaccaggagtgaagtggtatagaaataaatccttactggagccagacgagcggataaaaatggagagggtgggaaatgtgtgttccttggagatttctaacatccagaaaggtgagggcggcgagtatatgtgtcacgccgtgaatattattggcgaggctaaatcctttgcgaatgtagatatcatgccacaagaggagcgcgtggtggcgctgccccctcctgtgacacaccaacacgtgatggagttcgatcttgagcacactacttcttcccgcactccatccccccaagagatcgtcttggaagtcgagctctccgagaaggacgtgaaggagttcgagaagcaagtgaagatcgtgacggtacctgaatttactccagaccataagtctatgatcgtgtccttggatgtgcttccgttcaactttgtagaccccaacatggactctcgtgagggtgaggacaaggagttgaaaattgacctggaggtatttgagatgccgcccagattcatcatgcccatttgtgacttcaagatccccgagaattctgacgctgtctttaagtgttcagtgattgggattcccactccggaggttaaatggtataaagagtatatgtgtattgagcctgacaacatcaaatatgttatttccgaagagaaaggcagccatactcttaagattagaaatgtgtgcctcagcgattccgccacgtaccggtgtcgtgctgttaactgtgttggtgaagcaatttgccgaggtttcctgacaatgggagacagtgagatctttgccgttattgccaagaagtcgaaggtgaccctgtcatccctgatggaggagctggtgttgaaatcaaattacacggactctttcttcgaatttcaggtagtcgaggggccgccccggttcatcaaggggatctccgactgctacgcccccatcggtaccgcagcctactttcagtgcctagttcggggctcacctcgtccaaccgtgtactggtacaaggatggcaaactggttcagggtcgtcggttcactgttgaagaatcgggaactggcttccataatctctttattacaagtctggtgaagtccgatgagggcgagtaccgttgtgtggccactaacaaaagcgggatggccgagagctttgccgcactgactctaacatag

SEQ ID NO: 208764 - DNA, 1419 bp, Artificial Sequence
  Description of Artificial Sequence: Synthetic coding sequence
atgtacatctacgaggccagcgaggaggccgtgctggaggagaaggtgctggtgacccagcctcagaagactaaaccaaaactggcgaaggttcccgagcccccgaaaaaggtggtgcccgaggataagatttacgtgacaatacctaagaagcgcgagacacctgccacaaaggaacccgacactacaagaggcatcttccccgaggtggagccacctgaagctatacccgaaatccctgagcacccaccaacggaagagtttgaagttttcaaggaggtcattcccgaaggagagacacccattgtcaaacgcaggaagacgcccagtcctaccgcccctgaagcaatgaaggaagtcgtgcccgaaatgaagatattcgaagacgtgccggaagagccggagaccccccgcatgaagacacctgaggccccacaggaaatcatacctgcgaaaaccgtgcccagcaaaaagagggagccgcccagcgtcaaggtgcccgaggccctccaagagattgtgcctgaaaaaaagactctcgtggttcctctgagaaaacctgaggttcttcctgatgaagttccagaagcactccgtgaggtggtcccagagaaaaaggtccacccaccacagagggctgaggtggtcccagtgaaagtccacgaggctcctaaagaaatcattcctgaaaaaaaagtttcggtggtgccccccaaaaaacctgaggttccacctgtcaaggtcccggaagcttcaaaagaagtcatcagggaagaaaaagtcccactggccccacccaaggaacccgaggttcctcccgtgaaggtgcccgaacctccaaaagaagtggtgcccgaaaaaaaagcccccgtggctccacctaaggagccagaggtgccccccgttaaggttcccgaggcccctaaagaagtggtacccgaaaaaaaggtgcccgtgcccccgccaaagaagcccgaggtcccgcccacaaaggtgccagaggttcccaaggcggctgtccctgagaagaagctgccggaagcgattccaccaaaaccagaaagcccaccaccagaggtacctgaagtgctcccacccaaagaggtcgttcccgagaaaaaggtgccagtgcctccagccaagaagcctgaggcccctccccctaaagtgcctgaggccccaaaagaggtggttctggaaaagaaagcatctgtcgccgtgcccaagaagcctgaagctcccagagctaaggttcctgaagctgcacaggaagtggtgcctgagaagaagatccccaaggctcctataaaaaaaccagaagcacccgcagtcaccgttccggaggtgccgcaggagatagtgcccgagaagaagacacttgtcttgcccaagaaacccgaggtgccgcctgttacatag

SEQ ID NO: 208765 - DNA, 1122 bp, Artificial Sequence
  Description of Artificial Sequence: Synthetic coding sequence
gtggtgcccgagaagaaggtgcccctggtggtgcccaagaagcccgaagcaccaccagccaaagttcccgaggtcccgaaagaggttgtgccggagaaaaaggtcgcagtcccaaagaagcctgaggtgccgccggccaaggtacctgaggtaccaaagaaacctgtcctcgaggaaaaacctgccgtccccgtgcctgagcgagccgagagtcccccccccgaggtctacgaggagcccgaagagatcgctcctgaagaggagatagcacccgaagaagagaaacctgtccctgttgccgaagaagaggagccagaagtgcctcccccagctgtcccagaagagccaaagaaaatcatcccggaaaaaaaggttccggtcatcaaaaagcctgaagctccacccccgaaagagccagagatgccgaaaaaagtggtgcccgtgaaaaaagtccctactgtcaagaaacctgaaacaccagccgcaaaagtgcccgaggtacctaagaagctcgtccctgtcaagaaggaaccggtccccgttaccaaaaagcccgaggttttaccagagaaagtgcccaaagtccctgaaaagatcattccagagaaagaagtatctgtcccaatcccggctgagccagaagtgccccctgccgaggtcgaggaaaccccagaggaaattatctatgaggagaaagccagcattacgatcggccgcaaagaaaccccaccagttgaggaacgcgaaattgaaaaatatatcaagcccgaggagcccgaacctgaaccacagccagaggagatccctgtgaaagagcctgagccagagaaggtgatcgagaaaccaaagctgaagccccggccgcctcctccacctcctgcaccacctaaagaggacgtgaaggaaaaaatcttccagcttaaggccatacctaaaaagaaagtccctgaaaagcctcaggtgcccgaaaaagtggaattaacccctcttaaagtgcccgagccacccccgccaaaaccagtcgaagaggtggaagtgcccacagtgacgaagagagaacgaaaaatccccgaacctaccaaagtccctgaaataaaacccgcgattccgctgcccgcatag

SEQ ID NO: 208766 - DNA, 543 bp, Artificial Sequence
  Description of Artificial Sequence: Synthetic coding sequence
aaggtgcccgaggtgcccaagaagcccgtgctggaggagaagcccgcggtccctgtgcccgagagggccgaatcacctccacctgaagtctatgaagaacccgaggagatcgctccagaagaagaaatagcccctgaggaagaaaaacctgtaccagtggctgaagaagaggaacccgaggtgcctccacccgccgtgcccgaagaacctaagaaaattattcccgaaaagaaggttcctgtgatcaagaaacctgaggctcctccccccaaagagcccgagcccgaaaaggtgatagaaaaaccaaaactgaagccccggcccccaccacccccgcctgcacctccgaaagaggatgttaaggagaagatatttcaactgaaggccattccaaagaagaaggtgcctgaaaagcctcaggtgcctgaaaaggtggaactgacaccactgaaggttcctggcggggaaaagaaagttaggaaactgctccccgaaaggaagcccgaaccaaaggaagaggtagtactcaagagcggcatctag

SEQ ID NO: 208767 - DNA, 438 bp, Artificial Sequence
  Description of Artificial Sequence: Synthetic coding sequence
gaggacacctaccagctggagatcgccgaggcctaccccgaggacgagggtacctatacattcgtggcatctaatgcagtgggacaggtcagttctaccgccaacttgtctttggaggcaccagagtccattctacatgaacggatcgaacaggagattgagatggaaatgaaggagctgttttctgagggcgaaagcgagcattctgaacgagacacccgcgacgccttcagcgattccgaggacatcgaccacaaaagtatggcagcaaaacgatacgctagcagaatctcaagcacctcatcttggccggagtactttaaaccgtcctttacccaaaaactgacattcaaatacgttcttgagggtgagccggtcgtctttacctgtagactgattgcctgcccaacacccgaaatgacatggttccataattag

SEQ ID NO: 208768 - DNA, 546 bp, Artificial Sequence
  Description of Artificial Sequence: Synthetic coding sequence
atgttcttcgccagccacaccgaggaggaggtgagcgtgaccgtgccggaagtccagaaggaaattgtgacagaggaaaagattcacgtagcaatatctaagagggtcgaacccccacccaaagtgcccgaactgccggaaaagcccgcccctgaagaggtggcccccgtgccaattccaaagaaggtggagcctcccgccccaaaagtgcccgaagtgcctaaaaaaccagtgccagaagaaaaaaaaccggttcccgtccccaagaaggaacccgcagcaccccctaaagtccccgaagtgcctaagaagcccgtgcctgaggagaagatacctgtcccagtggccaaaaaaaaggaggccccacccgcgaaggtcccggaaattccaaagaagaaggtacccgaggagcgaaagccagtgccacgcaaggaggaagaagtccctcctcctcctaaggtcccggcgttacccaagaagccagtccccgaggagaaagtggcagtccccgtgcctgtggccaaaaaggccccacctcctaggtag

SEQ ID NO: 208769 - DNA, 2490 bp, Artificial Sequence
  Description of Artificial Sequence: Synthetic coding sequence
gtggaggagttcatcaagctggagcagcaccgggtggaggaggagcacagagtcgagaaggtgcatcgggtgatagaagtgtttgaagcagaagaggtagaagtcttcgagaaaccaaaggccccacctaaaggtcccgaaatctcagagaagatcataccgcccaaaaagccaccaaccaaagttgtgcctaggaaggagccacccgccaaagttcccgaagtgcctaagaagatcgtggtcgaggagaaagtgcgcgttcctgaggaacctagagtgccacccactaaagctcccgaggtcccaaaaaaaatcgtgcctgaagaaaaggtgcgcgaagctgttctgaagaagcctgaagtgcctcccgctaaggtgcctggaatgcctaagaagtccgtgcaggaggaaaagtctccgatcgttatctcagaggatacggaaatgtatatttacgaggcgtccgaagaagcagttctcgaagagaaagttctggtgactcaaccgcagaagacgaagccaaagctggccaaagtccctgaaccacctaaaaaggtggtgccagaggataaaatttacgtcactattcctaagaaacgggagacacccgcaacaaaggagccggatactacacgcggcattttcccggaagttgagcctcccgaagccatacccgagatccctgaacatcctccgacagaggaattcgaagttttcaaggaagtcattcctgagggggagacacccatcgtgaaacgcagaaagacaccgtcacctaccgctcccgaagctatgaaggaagtggtccccgagatgaaaatctttgaagacgttcctgaagagcctgagaccccgaggatgaagactccagaggccccgcaagagatcatccccgcgaagacagtgccttcaaagaaacgtgaacccccgtcagtgaaggtgccggaggcactgcaggagatcgtcccagaaaagaaaactttggttgttcccttgcgaaaacctgaggtactgcccgacgaagtcccagaagctctgagggaagtggttcccgaaaaaaaggtgcatcctcctcagagagcagaggttgtgccagtgaaggtgcacgaggcacctaaagagatcatcccggagaaaaaggtgagcgtggtgcctcccaagaagccagaagtgcctcctgttaaggtgccggaagcatccaaggaagtgattcgagaagaaaaagtgccactggcccccccaaaagaaccagaggttccccccgttaaagtgcccgagcctcccaaggaggtcgtaccagagaagaaggctccagtggctccaccaaaggaacctgaagttccgcctgtcaaagtccctgaggctcccaaggaagtggtgcccgagaaaaaggtgcctgtgccaccacctaagaagcctgaggtcccacccacaaaggtgcccgaagtgcctaaggccgctgtgcctgaaaaaaaacttccagaggccataccccccaagcccgagtcaccgccgcccgaggtacctgaggtcctgcctccaaaggaggtggtcccagaaaaaaaagtgcccgtgcccccggctaagaagccagaagctcctccgcctaaggtgcccgaggcccctaaggaagttgtccttgagaagaaagctagtgtggctgtgccaaagaaacccgaagctcctagagctaaggtaccagaagccgctcaggaggtcgtgccagagaaaaagataccgaaggccccgattaaaaaacctgaggccccagctgttaccgtgcctgaggtcccgcaggagattgttcccgagaagaaaacgctggtgctgcccaagaagccagaagtcccacctgtgacggtgcccgaggcccccaaagaggtggttctggagaagaaggtaccctcggctcctcctaagaagcctgaggtacctccggtcaaagtgcctgaagctcctaaagaggtcgtacctgaaaaaaaagtgccggtgccccctccaaaaaaacctgaagtaccccccacaaaagtacccgaagtcccaaaagcagcagtccctgaaaagaaggtgcctgaagctatcccaccaaagccagagagccctccccccgaagtgccagaggtactgcctccaaaggaggttgtgccagagaaaaaagttccagtccccccggcgaaaaaaccagaagccccacctccaaaagttcccgaagcacctaaagaagttgtgctcgagaaaaaagcgagcgtcgccgtgcctaaaaagcctgaggcgcctagagctaaggtccccgaggccgcacaggaagtcgttccagagaaaaagatccccaaggcgcccattaaaaagccagaggctccagccgtaactgtacctgaagtcccgcaggaggctgccgaaaaggagattccagtcgctccacctaagaaacctgaagctcctatcgtacccgtgccggaggcacaagaagtggttccggagaagaaatag

SEQ ID NO: 208770 - DNA, 504 bp, Artificial Sequence
  Description of Artificial Sequence: Synthetic coding sequence
atggccaccagcgagctgagctgcgaggtgagcgaggagaactgcgaaaggcgagaggctttctgggctgaatggaaggatctgactctgagtacccgtcccgaagaaggatgcagcctccatgaagaggacactcagcgtcatgagacttaccatcagcagggacagtgtcaggtcctcgtgcagcgctcgccatggctgatgatgaggatgggaatactgggccgcgggctgcaggagtaccagcttccttaccagcgcgtgcttcctctccccatattcactcccgccaagatgggcgccactaaggaggaacgcgaggacacacccatccagctgcaagagctgctagccttggagacagccttgggcgggcagtgcgtggatcgccaggaagtggctgagatcactaagcagctccctcccgttgtgccagtgtcgaaaccgggcgcactcagacgaagtttgtctcggtctatgagccaggaagcacagcgaggatag

SEQ ID NO: 208771 - DNA, 744 bp, Artificial Sequence
  Description of Artificial Sequence: Synthetic coding sequence
atggccggcggcgtgctgcccctgcggggcctgcgggccctgtgcagggtcctgttgttcctgagtcagttctgtatactttctggtggagaacagtcccaggcgctggcacagtcgattaaagaccccggaccaacccggaccttcaccgtggttccacgtgctgctgagagcaccgagatacccccctacgtgatgaagtgcccttctaacggcctgtgcagccgacttccagcagattgtattgactgcaccacaaatttttcttgtacatacggtaagccggtcacatttgattgtgcagtaaaaccgtcagttacctgcgtcgatcaggacttcaagagccagaagaacttcatcataaacatgacgtgccgcttttgctggcagcttcccgaaacagactatgagtgcacaaactctaccagttgcatgacagtcagctgtccccgtcaaaggtatccggccaattgcacagtccgggatcatgtgcactgccttggcaaccgaaccttcccaaagatgctgtactgtaactggaccggtgggtataagtggagtacagctctcgcgctgtcaattactctcggcggcttcggggctgatcgattttatctgggacagtggcgcgaaggcctgggaaagctattcagtttcggaggcctcggcatctggacccttattgatgtgcttctaattggagtggggtacgtcgggcctgccgacggttctctctacatatag

SEQ ID NO: 208772 - DNA, 666 bp, Artificial Sequence
  Description of Artificial Sequence: Synthetic coding sequence
atggccggcggcgtgctgcccctgcggggcctgcgggccctgtgccgagtgttactgttcctgagtcagttttgtattttatctggcggagaaagtacggagattccaccttacgtgatgaagtgtccctctaatggtttgtgcagtcggctgccagctgattgcattgactgtaccacaaacttctcatgcacatacggcaagcccgtaacgttcgactgcgccgttaagccatcagttacctgcgtggaccaagattttaagtcacagaaaaatttcattataaacatgacctgtagattttgttggcaactcccagaaaccgattacgaatgcaccaactccacatcatgtatgacagtgtcttgtccacgccaaaggtacccggccaactgcaccgtgagggatcatgtccattgtctgggcaaccgcacttttccaaagatgctgtattgtaattggacaggagggtataaatggagtactgctttggccttaagcataactctgggaggctttggcgccgataggttttatcttggacagtggcgtgagggactgggaaagcttttttctttcggcggactgggaatatggaccctgattgatgtgctattaattggtgtggggtatgtcggccctgccgatggctctctgtacatatag

SEQ ID NO: 208773 - DNA, 1251 bp, Artificial Sequence
  Description of Artificial Sequence: Synthetic coding sequence
atggccagcagcagcggcagcagcccccggcccgcccccgacgagaacgagttccctttcggctgtccccccactgtgtgtcaggacccaaaggagccacgcgccctatgctgcgcaggctgtttgtcagaaaaccccaggaacggcgaagatcagatctgtccaaagtgtcgaggggaagatttgcagtcaatctctcccggcagccgccttcggactcaagaaaaagcacatccggaggtggcggaggcggggatagggtgtccattcgccggagttggatgctcttttaagggctcacctcagtcggttcaggagcatgaggtcacttcccaaaccagccacctcaatctcctactcggcttcatgaagcaatggaaggcgcggcttggttgcggactggagtctgggcctatggcgttagaacagaacctgagcgatctgcagctccaggcagcggtggaggtggctggagacctggaagtcgattgctaccgagctccatgctccgaatcacaggaggaactggctctccaacacttcatgaaggagaagcttttagcagaattagaaggaaaattacgggtattcgagaatatcgtcgcagttctgaataaggaggttgaggcgagtcatctggcactggctacatccatccaccagtcacagctggaccgggaaaggatcctgtccctggagcagcgcgtggttgaactccaacagaccctggcccaaaaagaccaggcactgggcaaattggagcagagcttaagactgatggaagaggcctctttcgacggtaccttcctgtggaaaataactaatgtgacacgccgctgccacgagtccgcatgtggccgaaccgtgtcgctgttcagcccggcattctatacagccaagtacgggtacaaactgtgtttgcgactgtatctgaacggtgacgggaccgggaagcgcactcacctcagtctgtttatcgtgatcatgcgcggtgagtacgacgcactgctgccctggcctttcagaaacaaggtcacattcatgttactggaccagaacaatagagagcacgccatcgacgcctttcgtccagatcttagctccgcctcattccagcgcccacagtcagaaacaaatgtggcatcagggtgccctctgttttttcctctgtcaaagttgcagagccctaaacacgcgtacgtcaaggacgacaccatgtttttgaaatgcatcgtcgagacatccacttag

SEQ ID NO: 208774 - DNA, 1251 bp, Artificial Sequence
  Description of Artificial Sequence: Synthetic coding sequence
atggccagcagcagcggcagcagcccccggcccgcccccgacgagaatgaatttcccttcggctgcccgcccacagtgtgccaggacccaaaagagcctcgggctttgtgttgtgccgggtgtctgagtgagaacccccgcaacggcgaagatcaaatttgtcccaaatgcaggggagaagatctgcagtccataagcccgggcagccggctccggactcaggaaaaggcacaccccgaggtcgctgaggccggtattggctgtccctttgctggggtgggatgcagctttaagggctcaccacagtctgtccaggaacatgaagtgacttcacagacatctcatctcaacctcttactgggcttcatgaagcagtggaaggcgagactgggttgcggcctggagtccggcccaatggccctggagcagaacctctccgatttacagctacaagctgccgtcgaagtggctggtgatctggaggtggactgttaccgagctccgtgctccgagagccaagaggagctcgccctccagcattttatgaaggagaaattactagcagagctggaaggcaagctcagagtattcgagaacattgtggccgtgctgaacaaggaggtggaagcctcccacctggctttggcgacttctatacaccagtcgcagttagaccgagagaggattctcagcctcgagcaaagggtcgtcgagttgcagcagactctagctcagaaagaccaggccctgggcaaattagaacaaagcttaaggctcatggaggaagcgagcttcgacggcacatttctgtggaagatcaccaacgtgaccaggcgctgtcatgaatccgcgtgcggcagaactgtgtcgctcttcagtccagcgttttatacagctaagtacggctataaattatgcttaaggctttatttgaacggagatgggactggcaaaaggacacacctgtccctcttcattgttataatgaggggagaatatgatgccttgctcccatggccattccgtaataaagtcacctttatgctgctcgatcagaataacagagaacacgcaatcgacgcttttaggcctgatctgagcagtgcctccttccagagacctcaaagcgagactaatgtggcaagcggatgccctctgttttttcccttgtctaagctccaatctcccaaacatgcttacgttaaggatgataccatgttcctcaagtgtatcgtagagactagtacgtag

SEQ ID NO: 208775 - DNA, 885 bp, Artificial Sequence
  Description of Artificial Sequence: Synthetic coding sequence
atgaagcagtggaaggcccggctgggctgcggcctggagagcggcccaatggcactggagcaaaacctcagtgatcttcagctacaggcagccgtcgaagtggcgggcgacttggaggtggattgttaccgcgcaccttgtagtgagtcacaggaggaactggctcttcaacatttcatgaaggagaagctgctggcagagctcgaagggaaactccgggtctttgagaacatcgttgccgtactgaacaaggaagtagaggccagccacctggcactcgctacctctatccaccagtcacagctggaccgagagcgtatactctctctggaacaacgcgtcgtcgagctgcagcagactctggcccagaaggaccaggctcttggcaagctggagcagagcctacgcctgatggaggaggcatcctttgacggcacattcctttggaaaatcacaaacgtgacaagaaggtgccacgagtccgcgtgtggccgaactgtgagtctgttcagtcccgccttctataccgcaaagtatggatataagttatgtcttaggctgtacttgaacggtgacggcaccggcaaacgcactcatctgtctctgtttatcgtcattatgaggggagaatacgacgctctgttgccctggccattcaggaacaaagtgaccttcatgctgctagatcagaataacagagagcacgctatcgatgctttcaggcctgacctctcctctgctagcttccagaggcctcagtccgagaccaatgtggcgtccggctgccccctctttttccccctgagtaagctccagtccccaaaacacgcttatgtgaaagacgacaccatgtttcttaagtgtattgtagaaacatccacatag

SEQ ID NO: 208776 - DNA, 2076 bp, Artificial Sequence
  Description of Artificial Sequence: Synthetic coding sequence
atgaacgccgccgtggtgcggcggacccaggaggccctgggcaaggtcataaggaggcctccattgactgaaaaacttctgagcaaaccccccttcagataccttcacgatattatcacagaggtgatccgcatgactggcttcatgaaagggctttacaccgatgctgaaatgaaaagtgacaatgtgaaggacaaggacgctaagatctcatttttacagaaagccatcgatgtggttgtgatggtgtccggagagccccttctggccaagcctgcccgtatagtcgccgggcacgaacccgagcgtacaaacgagctattgcagatcatcggcaaatgctgtctaaacaaactgtcttcagatgacgctgttagacgggtgctggctggggagaagggcgaggtcaaggggcgagcaagcctgacaagtaggtcacaggaacttgacaacaaaaatgttagggaggaggaaagtcgagtacacaaaaatacggaggaccgtggagacgccgaaattaaagagcgatccaccagtcgagacaggaagcagaaggaggagctgaaagaagacaggaagcctagggaaaaggacaaagacaaggagaaagcgaaagaaaacgggggcaataggcacagggagggagaaagggaacgggctaaggccagagcccgccctgataacgagaggcagaaagacagggggaaccgagaacgcgatcgagattcagagcgcaagaaggaaaccgaacgcaaaagtgagggcggtaaggagaaagaacgcctccgtgatagagatagggagagagatagagataaagggaaagaccgggaccgaaggagggtcaaaaacggcgagcatagctgggatctggatagagagaagaaccgggagcacgataaacccgaaaaaaaaagtgcctcgtctggtgaaatgagtaagaaactatcagacgggactttcaaggactcaaaagcagagacggaaactgagatctcaacacgtgctagtaaatcactaaccaccaagacctctaagagaagatcaaagaactctgtggaaggtaggaaagaggataatatttctgccaaatccctggactctattgttagcggtatcaacaatgaacccaatcaggaaaccacaacgagcgaaatcgggactaaggaagctaatatcaatagcacaagcatttccgatgacaactccgcctccctgcggtgtgagaacatccagcccaatcctactgagaaacaaaaaggcgattctacgagtgatgctgagggagatgccggccctgctggacaggacaaatcagaggtgcccgaaacacccgagatccctaacgaacttagttctaacatcaggcggatcccgcgaccaggatcagcacgccccgcacccccccgcgtcaagcgtcaggatagtatggaagctttgcagatggatcgatccgggtccggcaaaaccgtcagtaacgtaataaccgagagccacaattcagataatgaagaggacgatcagtttgtggtggaagcggcccctcagctgagcgaaatgtcagagattgagatggttacggctgtagagttggaggaagaggaaaaacacggggggctggtcaaaaaaatccttgagaccaaaaaagactacgaaaaattgcaacaaagtcctaagcctggggaaaaggagcggtccctctttgagagcgcctggaaaaaggagaaggatattgtgtcaaaagagattgagaaactgagaacctccatccagaccctgtgtaaaagcgccctccccctgggtaaaataatggattatatccaggaggacgtggatgcgatgcagaatgagctgcaaatgtggcactcagagaatagacagcacgccgaagctctgcagcaggaacaaaggattacagactgcgccgtcgagcccctgaaggctgagctggctgagctggaacagctgattaaagatcagcaagacaagatatgcgctgtgaaagcaaatatcttgaagaatgaagagaaaattcaaaagatggtttattccatcaatctgacgagccggcgctag

SEQ ID NO: 208777 - DNA, 1878 bp, Artificial Sequence
  Description of Artificial Sequence: Synthetic coding sequence
atgaacgccgccgtggtgcggcggacccaggaggccctgggcaaggtcattcgccggccacccctgaccgagaaattgctgtctaagcccccatttcgatatctacatgacatcattaccgaggttattaggatgacaggatttatgaaaggactttacacggatgcggaaatgaagagcgacaacgttaaagacaaagacgccaaaataagtttcttacaaaaggctattgatgtcgtggttatggtgtcaggagaacctctgctcgcaaaacccgcacgcatcgtcgctggccatgagccagagcgaactaacgaactgctacagattatcggtaagtgttgtctgaacaagttgagctcagacgatgctgtccgccgggtgctggccggtgaaaagggagaagtcaaaggacgggcatctctaacatcgcgcagccaggaactcgataacaagaatgttagggaggaagagtctagagtccataagaacacggaggatcggggagatgcagagataaaggagcggtctacttctagggaccgtaaacagaaggaagagctaaaggaggaccgcaaacctcgggagaaagacaaagacaaggaaaaagcgaaagaaaatggcggcaaccgccacagagagggagagcgagagagagccaaggcaagggctcgacccgacaatgagcgccagaaggatagaggaaatagggagcgcgacagggactccgagcggaagaaggaaacagaacggaaatcggaaggcggcaaggagaaggagcgacttagggaccgggatcgagaaagagacagggataaagggaaggatcgggataggcgacgggtgaagaatggggaacactcctgggacctagaccgagagaaaaatcgagaacatgacaagcccgaaaagaaaagcgctagttccggcgaaatgagcaagaaactctctgatgggaccttcaaagacagcaaagcagagacagagacggaaatctccacacgggcaagcaagtcactcacgacaaaaacctctaagcggaggtccaagaactctgtcgagggtgactccacctccgatgccgagggagatgccggaccggctggtcaggataagtctgaggtccccgagaccccagagatccctaacgaactatctagtaacatccgcaggatcccccggccaggaagcgccagacccgcgcctccacgcgtgaagcgacaagactccatggaagccctccagatggaccgcagtggaagtggcaagacagtgagcaacgtgatcaccgagagtcacaatagcgacaacgaagaagacgatcagttcgtagtcgaagctgctccccaactatcagaaatgtcagagatcgagatggtcactgccgtggagctggaggaagaggagaaacacggcggtctggtcaaaaagatcttggagaccaagaaggattacgaaaaactgcaacaatccccgaaacccggagagaaggaaagaagtctgttcgagtccgcatggaagaaagagaaagacatagtttccaaagagatcgaaaagctacgcacgagtattcagactctgtgcaagtcagcactgcccttaggaaaaataatggattatattcaggaggatgtcgatgccatgcagaatgagctccagatgtggcatagcgagaacaggcagcatgctgaggccctgcagcaagagcagaggatcacagattgtgcagtcgaaccactgaaagcagagctggctgaacttgaacagttgatcaaggatcagcaagacaagatctgtgcagtgaaggcgaatatcctaaagaacgaggagaagattcaaaagatggtttatagcattaaccttacttctcgacgttag

SEQ ID NO: 208778 - DNA, 2076 bp, Artificial Sequence
  Description of Artificial Sequence: Synthetic coding sequence
atgaacgccgccgtggtgcggcggacccaggaggccctgggcaaggtcattcggcgcccaccactcactgaaaagcttctgtctaaacctcccttccgctacctgcacgatatcattacggaagtaatccggatgaccgggtttatgaagggcctctacaccgatgctgagatgaagtcagacaacgtcaaggataaagatgctaaaattagctttcttcagaaagccattgacgtagtggtaatggtgtctggtgagcccctccttgctaaacctgccagaattgttgcgggccatgaaccagaacggactaatgagctcctgcagattattggcaaatgttgtttgaacaagctttcctctgatgatgccgtgaggcgcgtgttagctggcgaaaaaggtgaagtcaaaggaagagcctcactgacttctcggagtcaggaactggacaataaaaacgtccgggaggaagaatctagggtgcataagaacaccgaagatcgcggcgacgcagagataaaagaacggagtacatctagggacagaaagcaaaaggaggagctcaaagaggaccggaagccccgcgagaaggacaaggataaagagaaagccaaggaaaacggtggaaatcgccaccgggagggcgagcgagagagagctaaggccagagcaagacccgacaatgaaagacagaaggaccggggcaaccgagagagggaccgggattctgagagaaaaaaggagaccgagcgcaagtcagaaggagggaaagaaaaagaaaggctgagggacagagacagggaaagggacagggataagggtaaggatagagacagaaggcgggtgaagaatggagaacactcttgggacttggatagggaaaagaatagagagcatgacaagcccgagaaaaagagcgccagctccggcgaaatgagtaagaagctttcagatggaacattcaaggattccaaagctgaaactgagactgagatctccactcgagcctctaaaagcctgactactaaaacttcaaagcggaggtctaaaaattcagtcgaggggcgaaaagaagataatattagcgccaagagcctggactctattgtgtcagggatcaacaatgagccgaaccaggaaacaacaacctccgagattggtacgaaagaggcgaatatcaacagcaccagtatcagtgacgacaatagtgcttccttacggtgtgagaacattcaaccaaatccgacagagaaacagaagggcaaaaatgggtcagaacgggagggggatgcaggacccgccgggcaggacaaatctgaggttcctgagacgccagagatccctaacgagctctcatctaatatccgacgcatcccccgaccaggtagcgcacgacccgctcctcctcgggtgaagaggcaggactccatggaggcccttcagatggatcgttctggtagtgggaagactgtgtcaaacgtaatcacagaaagccataattccgataacgaggaggacgatcaattcgtggtggaggccgcccctcagctgagtgaaatgtccgaaattgaaatggtaacggctgtagaactggaagaggaggagaagcacggcggcctggtgaaaaagatcctagaaactaaaaaggactatgagaaactgcagcaaagccccaagcctggcgagaaagagcggtctctttttgagagcgcatggaaaaaagaaaaggacatcgtcagcaaggagattgagaagctgcgcacaagcatccaaactctctgcaaatccgctctacccctgggtaaaattatggactacatccaggaagacgtggacgcgatgcagaatgagctacaaatgtggcattcagagaatcggcagcacgcagaggccctgcagcaggaacaaaggattaccgattgcgcggtggagcctctcaaggcagagcttgctgaattggagcaactgatcaaggaccaacaagataagatttgtgctgtaaaggctaatattctgaaaaatgaggagaaaattcagaagatggtttattccatcaatttgacttccagacgctag

SEQ ID NO: 208779 - DNA, 1878 bp, Artificial Sequence
  Description of Artificial Sequence: Synthetic coding sequence
atgaacgccgccgtggtgcggcggacccaggaggccctgggcaaggtcatcagaagaccccctttgactgagaaactgctgagcaagccccccttccggtacctgcacgacattattactgaggttatacgaatgacgggattcatgaaaggcctgtataccgatgcggagatgaagagtgataatgtgaaagataaggacgctaagatctccttcctgcagaaggccatcgatgtggtcgttatggtgagtggcgaacccttgttagcaaagccagcacgcattgtcgccggtcacgagccggagaggaccaatgagcttttacagatcattggcaaatgctgcctgaacaagctgagtagcgatgacgccgtgaggcgcgtgttggcaggggaaaaaggagaggtaaaggggagggcttccttaaccagtcgcagtcaggagctagataacaaaaacgtccgggaagaagaatctagagtgcataaaaacactgaggataggggagatgctgaaattaaggagaggtccactagccgggatcggaaacagaaggaggagctcaaggaggaccgaaagcccagggagaaagacaaagataaggagaaagccaaggaaaacggtggcaaccgacaccgtgagggcgaacgtgagcgagctaaagcacgggcacgccccgataatgaacgccagaaggatcggggtaatagggagcgggatcgagattccgaacgaaaaaaagagactgagcgcaaaagcgagggcggaaaggagaaagaacggctgcgggacagagacagggagagagaccgagacaagggaaaagatagagatagaagaagagttaaaaacggagagcatagctgggacctggaccgagagaaaaaccgggagcacgataagcctgaaaaaaaatcagcaagctccggagaaatgtccaaaaagttgtcagacggcaccttcaaggatagcaaggccgagacagagacggagataagtacccgtgctagtaaaagccttacaactaaaacttcaaagagacgcagtaagaactccgtagaaggcacggcaaagctaatccttgagggcgatgctggacctgctgggcaggacaaatcagaggtgccagagactcctgagattccgaacgaactgtcatcaaatatccggcgcataccgaggccagggtccgctcgaccagcccccccgagagtgaaacggcaggactcaatggaagccctgcaaatggaccggtcaggctccgggaagacagtgagcaacgtgattactgaaagtcacaactctgacaacgaagaggacgaccagtttgtcgtggaggccgctcctcagttgagcgagatgagcgaaatcgaaatggtcactgcggtcgaacttgaagaggaggaaaagcacggggggttagtgaaaaagatactagagacaaagaaagactatgagaagttgcaacagtcacctaaaccaggggaaaaagaacggagcctgtttgaaagtgcatggaaaaaggaaaaggacattgtgagcaaggaaatcgagaagctgcgcaccagcatccagacgctgtgtaaatcggcactcccactcggtaaaatcatggactacattcaggaggacgtagatgctatgcagaatgagctgcagatgtggcacagcgagaaccgacagcacgccgaggcactacagcaagaacagcgtattacggattgcgctgtggagccgctcaaagctgagctcgccgagctggaacagctgattaaagaccagcaggacaagatttgcgcggtgaaagctaatattctgaaaaatgaggagaagattcagaagatggtgtactccatcaatctgacaagtcgaagatag

SEQ ID NO: 208780 - DNA, 1674 bp, Artificial Sequence
  Description of Artificial Sequence: Synthetic coding sequence
atggcctacagcgaggagcacaagggcatgccctgcggcttcatccggcagaatagcgggaactccataagtctagacttcgagccctctatagagtatcaattcgtagagcggcttgaagaacgctacaaatgtgccttttgtcatagtgtgctccacaaccctcatcaaaccgggtgcgggcatcgcttttgccagcactgtatcttgtccctgcgcgaactgaatactgtgcctatttgccccgtggataaagaggtgatcaaatctcaggaagtatttaaagacaactgttgcaaaagagaggtgcttaacctctatgtctactgtagtaacgccccaggatgcaatgccaaggttattctgggccgatatcaggatcacctccaacagtgcctgtttcagcctgttcagtgctcaaatgaaaagtgtagggagcccgttctacgaaaggacctgaaggagcacttaagcgcttcatgtcagttccgcaaagaaaagtgtctgtattgtaaaaaggacgtggtggtcattaacttgcaaaaccacgaggagaacctctgtccagagtatcctgttttctgcccgaataattgtgccaaaatcattcttaaaaccgaagttgatgaacacctggcggtttgtccagaggcggagcaagactgcccattcaaacactacggttgtgcggtgactgacaagagacggaacctgcagcagcacgagcatagcgccctcagagagcatatgaggctcgtgctggaaaagaacgtgcagctggaagagcaaatctcagaccttcataaatcactcgagcaaaaagagagtaaaatccagcagctggcagaaaccattaaaaagctcgaaaaagaattcaaacaatttgcccagctgtttggaaaaaatggttctttcctgcccaatatacaggtgtttgcctcccatatcgacaaaagcgcctggctggaggcgcaggtccaccagctgctccagatggttaaccaacaacagaataagttcgacttacgacctctgatggaagctgtggacaccgtaaaacagaaaatcacgttgcttgagaataatgatcagcgactggcggttctagaggaagagacaaacaaacatgatacacacatcaacattcataaagcgcagcttagtaagaacgaagagcgattcaagctcctggagggcacctgctataacggtaaactcatttggaaggtgacggactacaagatgaaaaagagggaggctgtggacggccacaccgtcagtatcttctcccagtctttttacaccagtcgctgcggctataggctgtgcgcacgggcgtatttaaacggcgacggcagcgggcgtggctcccacttgagtctgtactttgtggtaatgcgaggcgagttcgattcactcctccagtggcccttcaggcagcgcgtcacactaatgttgctcgatcagagtgggaagaagaacattatggaaacgttcaagcctgatccgaatagcagctcttttaaacgcccagacggcgagatgaacatcgcctcaggatgtccaaggtttgttgcacatagcgtacttgagaatgccaaaaacgcttacattaaagatgacacgttgttcctaaaggtcgccgtagatctcactgacctcgaggatctctag

SEQ ID NO: 208781 - DNA, 1674 bp, Artificial Sequence
  Description of Artificial Sequence: Synthetic coding sequence
atggcctacagcgaggagcacaagggcatgccctgcggcttcatcagacaaaactccggtaacagcataagtctcgattttgaaccctcaatcgagtaccaatttgtcgagcggttggaggagagatacaagtgcgctttctgccactccgttttacacaacccacaccagactggttgtggccaccgcttttgtcagcactgcatcttaagccttcgtgaattaaacaccgtccccatctgtcctgtggataaggaagtcattaaatcccaagaggtgttcaaggacaattgctgtaaacgcgaagtgcttaatttgtatgtctattgcagcaatgctccgggctgtaatgctaaagtcatcctgggacggtaccaggatcatttgcagcagtgtctgtttcagcccgtgcagtgtagtaacgagaagtgtcgtgagcctgttctcaggaaagacttaaaggagcacctgtcggcctcctgtcagttccgcaaggagaaatgtctgtattgtaaaaaagatgtcgtagttataaatctgcagaatcacgaagaaaatctgtgtcctgagtaccctgtgttctgtccgaacaattgcgcaaaaatcattctgaaaacagaagtggacgaacacctggccgtctgcccggaggccgagcaggactgcccctttaaacattatgggtgtgctgtaacggacaagcggcggaacctccaacagcatgagcattcagcactcagagaacatatgcggctggtgttagagaaaaatgtgcagttggaagagcagattagcgacctgcacaagagcctggagcagaaggagagcaagatccagcagctcgccgagactatcaagaagctggaaaaggaattcaagcaattcgctcagttgttcggaaagaatggctcctttctgcccaatatacaggtcttcgcaagtcacatcgacaagtcagcctggctggaagcccaggtgcaccagcttctgcaaatggtcaatcaacagcagaacaagttcgatcttcgccctctgatggaagccgtcgatacagtgaaacagaagattactctcctcgaaaacaacgaccagcggcttgcagtactggaggaagagaccaataagcatgatacccacataaacattcataaggcgcagctgagcaagaacgaggagaggttcaagctcctggaagggacatgctacaacgggaaacttatatggaaggtaaccgactacaagatgaagaagcgtgaggctgtggacggacacactgtctcaatctttagtcagtctttctatacctctcgctgtggatatcgcttatgtgctcgcgcctacctgaacggggatggaagtggccgcggaagtcacttgagtttatatttcgtggtcatgcggggcgaattcgacagcttgctgcagtggcctttcaggcagcgagtgacactgatgctcctcgaccagagcgggaagaagaatattatggagaccttcaagcctgatcccaactcttcctcctttaagaggcctgacggggaaatgaacatagccagcggatgtccacgctttgtggcacatagcgtgctggagaatgctaaaaatgcctacatcaaagacgataccttattcttaaaagtggccgtcgacctcacagaccttgaggacctgtag

SEQ ID NO: 208782 - DNA, 1674 bp, Artificial Sequence
  Description of Artificial Sequence: Synthetic coding sequence
atggcctacagcgaggagcacaagggcatgccctgcggcttcatccgacagaatagcgggaactccatctcactggatttcgaaccatcaatagagtaccagtttgtagaacgccttgaagaacgttataagtgcgcattttgtcattctgttctgcataatccgcaccagaccggatgtgggcaccgattctgccaacactgcatcttgagcctgcgagagctgaacaccgtgcctatttgcccagtggataaggaggtaatcaagagccaggaagtctttaaggacaactgctgcaaacgggaggtcttaaatctctacgtctattgcagtaacgcccccgggtgtaatgccaaggtgatcctgggcaggtaccaagatcaccttcaacagtgtcttttccagcccgttcagtgctctaacgagaaatgccgggaaccagtgcttagaaaagatctgaaagagcacctgagcgccagctgccagtttaggaaggagaagtgtttgtattgcaagaaagatgtggtggtgatcaacctccagaatcacgaggaaaacctgtgccccgaatatccagtgttttgtcccaataattgtgcaaaaatcatcctcaaaaccgaggtcgatgagcacctggccgtctgtcccgaagctgagcaggactgccccttcaaacactacgggtgtgccgtgactgataaaagacgaaatctgcagcagcatgaacacagtgcactgcgagaacacatgcgcttagtcctggagaaaaatgtccagctggaggaacagatatcagatctccacaagagcctagagcaaaaagaatccaaaattcagcagctggccgagactattaaaaagctggaaaaagagttcaagcagttcgcacagctgtttggaaaaaacggctccttcttacccaatatccaggtattcgcatcacatatcgacaaatccgcttggcttgaggcccaggtgcatcagctgcttcagatggtgaaccagcagcaaaacaaattcgacttgcgcccgctcatggaagctgtggataccgtaaaacagaagattactctcctggagaacaacgatcagaggctcgccgttcttgaggaagaaaccaataaacacgatacacacatcaacatccacaaagcacagctcagcaagaatgaagaacgcttcaaattactggaagggacttgctataacggtaaactgatctggaaagtcaccgattacaaaatgaaaaaaagggaggccgttgacggacacacagtgtccatcttttctcagtccttttatacttcccgctgtggctatcgattgtgcgctcgtgcttacttgaatggggacgggtcgggcaggggcagtcatctgagcttgtactttgtggtgatgaggggcgaatttgattctctactgcaatggcctttccgccagagggtgacgctcatgctcttagaccagagcggaaagaagaacatcatggagactttcaaacctgaccctaatagcagctcctttaagaggcctgacggtgaaatgaatatagcaagcggctgcccccgttttgtcgcccactccgtgctggaaaatgctaagaatgcttatataaaagatgacacactttttttgaaagtcgctgtcgatctgaccgacctcgaggatttgtag

SEQ ID NO: 208783 - DNA, 1356 bp, Artificial Sequence
  Description of Artificial Sequence: Synthetic coding sequence
atggcctacagcgaggagcacaagggcatgccctgcggcttcatcaggcaaaatagtggaaattcgattagtcttgacttcgaaccttccatcgaataccagtttgttgagcggctggaagaaagatataaatgtgccttttgccacagcgtactgcacaacccacaccagacagggtgtgggcataggttttgtcagcattgcattctgtcactgcgcgagctgaatactgtgcctatctgccccgtagacaaagaagtgatcaaaagccaggaggtgtttaaggacaactgctgtaagagagaggtgctaaacttgtacgtgtactgcagcaatgcgcctgggtgtaacgcaaaggtgatccttggtcgttatcaggataaaagaaggaacctccagcagcatgaacatagcgcgctgcgcgaacatatgcgcttggtcttagagaaaaacgttcagttagaagagcagattagcgatctgcacaaaagtctggagcagaaggagagtaagatacagcagctggccgagacgatcaagaaattggagaaagagtttaaacaatttgcccaactgttcggaaaaaacgggagtttcctgcccaatatccaggtctttgcttcacatattgataaatctgcttggctggaggctcaggttcatcagctattgcaaatggtgaatcagcagcagaataagttcgacctgcgccccctgatggaggctgtcgatactgtgaagcagaagataaccctgctggagaataatgaccaacgactggccgtgctggaagaggagacaaataagcacgatacccacattaatattcacaaagctcaattgtctaaaaatgaagaaagattcaagctcctggaagggacatgctacaatggcaagctgatttggaaggtaactgactacaagatgaagaagcgtgaggcagtcgacgggcacacagtgtcgatcttctcgcagtcgttttacacttcccgttgcggatatagactgtgcgctcgggcttaccttaatggggacgggagcggccgaggcagtcacctgtccctgtacttcgtggttatgcgaggtgaatttgactcattactacaatggcctttccgccagcgggtgactcttatgctgttagaccagagcggcaagaaaaatattatggagaccttcaagccagatccaaactccagctcattcaagcggcctgacggagaaatgaatattgcctccgggtgtcccaggtttgtcgcccactctgtcctggaaaacgccaaaaacgcctacataaaggacgacacccttttcttgaaggtcgctgtcgatctgactgatctcgaggacctttag

SEQ ID NO: 208784 - DNA, 1569 bp, Artificial Sequence
  Description of Artificial Sequence: Synthetic coding sequence
atgagcctgctgaactgcgagaacagctgcggcagcagccagagcgaatcagactgttgtgtggccatggctagttcatgctccgcagtaaccaaagacgacagcgtaggcggcacggccagcacaggaaacctgtcatcaagtttcatggaggagattcagggctacgatgttgagttcgacccacccctggaaagtaaatacgaatgccccatatgcctcatggccctgcgtgaagccgtgcaaacaccttgcggtcatcggttctgcaaggcctgcattatcaaaagtatcagggacgctggacataaatgtcctgttgacaatgaaattctgttggaaaaccagttgtttcctgacaactttgctaagcgagagatcttgtctctcatggttaagtgtccaaacgaaggctgtctccacaaaatggaactccgccacctggaggaccaccaggcccactgtgaatttgcgctgatggattgtccccagtgtcaaaggccgtttcagaagttccatatcaacatccacattcttaaggactgcccgaggcgacaagtcagctgcgataattgcgccgcgagcatggcctttgaggataaagaaattcatgaccagaactgtccactagccaatgtgatttgcgagtactgcaacaccatcctaatcagggaacagatgcccaatcattacgatctggactgtcccacagctcctatcccttgtacatttagtacctttgggtgtcacgagaaaatgcagaggaatcacctcgctagacacctgcaggagaacacacagtctcatatgcgtatgttggcgcaagccgtgcactctttatccgtgatcccagattcaggctacatctcggaggtcagaaatttccaggaaactatccatcagctcgaagggcgtcttgtcagacaggaccaccagatcagagagctcaccgccaagatggaaacacagtcaatgtatgttagcgaactcaaacgaactattcgtacgctggaggataaggttgcagagatcgaggctcagcagtgtaacggaatctacatttggaaaatcggaaatttcggcatgcacttgaagtgccaggaagaggagaagcccgttgttatacacagccccggcttctatactggcaaacccggttacaagctatgtatgcgcctccacttgcaattgcctacagcccagcgctgtgccaattatatatccttgtttgtgcacactatgcagggggaatacgactcgcacctcccctggcccttccagggtacaatccggctgactatcctggatcagagcgaggcgccagtacggcagaaccacgaggagatcatggacgctaaacctgaattgctcgccttccagagacctacaatacctcggaatcccaaaggttttggatatgtaactttcatgcatctcgaagccctccgccagcggacgttcataaaagacgatacccttctggtccgttgtgaagtcagcacccgctttgatatgggatcattgcgtcgggagggattccaaccacggtctaccgacgccggcgtttag

SEQ ID NO: 208785 - DNA, 1569 bp, Artificial Sequence
  Description of Artificial Sequence: Synthetic coding sequence
atgagcctgctgaactgcgagaacagctgcggcagcagccagagcgaaagcgactgttgtgtggccatggcatcctcttgctccgccgtcacaaaggacgattcagtgggcggtaccgcaagcactggcaatctctcctcttcttttatggaagagatccaaggttatgatgtagaattcgacccaccacttgagtccaagtacgagtgtccaatttgcctgatggcccttagggaagctgtgcagacgccttgcggacatcgcttttgtaaggcgtgtattattaagagcattagggatgccggacacaagtgtccggtcgacaacgaaatactactggaaaaccagttatttccggataatttcgcgaaaagggaaattctgtctctgatggtgaaatgcccaaatgagggctgtcttcataaaatggaactccggcacctcgaggaccaccaggcgcactgcgaattcgccctgatggattgccctcagtgtcagcgtccctttcagaagttccacattaacattcatattttgaaggactgccctagacgccaggtgtcttgcgacaattgtgccgcctccatggcctttgaggacaaagaaattcatgaccagaattgccctttggctaatgtgatttgcgaatactgcaacaccattctaatccgcgaacaaatgcccaaccactacgatctagactgtcctacagcccccatcccctgcactttcagtacctttggttgtcacgagaagatgcagcggaatcatctcgcacggcatttgcaggaaaacactcagtcacacatgcggatgctggcccaggccgtgcacagcctgtctgttataccagattcgggttacatctccgaagtacgaaattttcaggaaactattcaccagctcgaaggacgtttggtcaggcaggaccaccagatcagggaactaacagcgaaaatggagacccagtctatgtatgtatcagaactcaaacgtaccattaggactttagaagataaagtggctgagattgaagcacagcagtgtaacggtatctacatctggaaaatcggcaacttcgggatgcatttgaaatgtcaggaggaagaaaagccagttgtcatccattccccaggcttttacaccggcaaacctggatacaagctgtgcatgcgattacacttgcagctaccaaccgcgcagaggtgtgccaattacatttcgcttttcgtgcatactatgcagggcgaatacgacagtcatctcccctggccgttccaaggcacgatacggttgacaatcctcgatcagagtgaagctcctgtgcgacaaaatcacgaggaaatcatggatgcaaagcccgagctactggcatttcaaaggcccacaatcccccgtaatcccaaggggtttggctacgttacgtttatgcatcttgaggccctgaggcagaggaccttcatcaaggacgacactctcctcgttagatgcgaagtttctacacgatttgatatggggagcttacgccgagagggcttccaacctagatccaccgacgcaggcgtctag

SEQ ID NO: 208786 - DNA, 2013 bp, Artificial Sequence
  Description of Artificial Sequence: Synthetic coding sequence
atgagcagcggcaagagcgcccggtacaaccggttcagcggcggcccaagcaatctccctacgcccgacgtgaccacaggcaccagaatggagacaacctttggacctgctttctccgccgtcactaccatcacaaaggctgatgggacaagtacgtacaaacagcattgtcgaacaccaagcagctcctctaccctagcctacagtccacgagatgaggaagactcgatgcctccaatcagtactcctcggaggagtgacagcgccatttcagtgaggtcattacactctgaatcttcaatgagcctgcgtagcactttttcactgccggaggaggaagaagagcccgagccccttgtgttcgccgaacagccctctgtgaaattatgctgtcaattatgttgctcagtgtttaaggatcccgtaatcaccacctgtggccacacattttgccgaaggtgcgcactaaaatctgagaaatgccccgttgacaatgtgaagttgacagtcgttgttaataatattgccgtggcagagcagatcggggagttgttcattcattgcaggcatggctgccgcgtggcgggtagtggcaaaccccctattttcgaagtcgaccctaggggctgtcctttcaccattaagttatctgcacgcaaggaccatgaaggttcctgtgactaccggcctgtgcgatgccctaataatccatcttgccctccactgcttcgcatgaacctcgaagctcacctgaaggagtgtgagcatattaagtgcccccacagtaagtatgggtgtacttttatcggaaatcaggatacttatgagactcatctggagacgtgcagatttgagggtcttaaggaattccttcaacagactgatgacagattccatgaaatgcacgttgcattggcccagaaggatcaggagatagctttcctgcgctctatgctgggcaagctgtctgaaaaaattgatcagcttgaaaaaagcctggaactcaagtttgatgtcttggacgaaaatcagtctaagcttagcgaggatcttatggagttcaggcgagatgcctccatgctgaatgatgaactgagccacattaacgcccgtctgaatatgggcattctcggaagttacgatcctcaacagatcttcaagtgtaagggcacctttgtgggccaccagggtcccgtttggtgcctctgcgtgtacagtatgggtgatctacttttttctggatcatcggacaagaccataaaggtatgggatacttgcaccacgtacaagtgtcagaagaccttagagggccacgacgggatcgtcctagcactttgcatacagggttgtaaactctactcaggatccgccgactgcactattatcgtctgggatattcaaaacctgcagaaagtcaatactataagagcacacgacaacccagtgtgtacccttgtcagctcgcataatgttctgttctccgggagcctgaaggctatcaaggtctgggatattgtcggaactgagctgaaacttaaaaaagagcttacaggattgaatcattgggtccgggcattagtagccgcccaatcctacttgtattctggcagttatcagacaatcaagatatgggacattcgaacactcgattgcatccacgttcttcagactagtggcgggagcgtttacagcatcgcagtgaccaatcatcatattgtttgcggcacgtacgaaaacctcatacatgtctgggacatcgaatctaaggaacaagtccgtacgctgactggtcatgtggggactgtatacgcccttgctgtcatctctaccccagaccagactaaggtgttcagcgccagctacgacaggagcctccgggtctggtccatggataatatgatttgtacccagactcttctgaggcatcagggaagtgttacagcactggccgtttcgagaggaaggctcttctccggggcagtcgattcgacagtgaaagtgtggacctgttag

SEQ ID NO: 208787 - DNA, 2115 bp, Artificial Sequence
  Description of Artificial Sequence: Synthetic coding sequence
atggcccgggagctgcgggccctgctgctgtggggccggcggctgcggccattattgcgagcacctgctctcgctgccgtcccgggaggcaagcccatcctgtgtccgcgtcgcaccacagctcaactagggccccgtcgaaacccagcttggagcctccaagcaggccgcttattttcaacacagactgcagaggataaggaagagccccttcattcaattattagctccacggaaagtgtgcaaggaagcacctctaagcatgaatttcaagccgagaccaagaagttgctcgacatcgtggcaaggtcgttatattccgagaaagaggtgtttatccgcgaactcattagcaacgctagtgacgcactggaaaaactgcgccataagctggtaagtgatggacaggccttgcccgaaatggaaattcatctccagacaaatgctgagaaagggacgatcacaatacaggataccgggatagggatgacacaggaggaactggtgtcaaatctcggcacaatagcccgatccggcagtaaggcctttttggacgctctgcagaaccaggctgaagcatcatcaaaaatcatcggacaattcggagttggattctacagcgccttcatggtggccgaccgcgtggaagtctatagcaggagcgctgcacctggaagccttggctaccaatggctgtccgatggttcaggtgtgttcgagattgcggaggcatccggcgttcggaccggaaccaagatcatcatacacctcaagtccgactgcaaggagttctctagcgaagccagggtgagagacgtggtgacaaagtattccaacttcgttagctttcctctgtacctgaatggacgcagaatgaacaccctgcaggcaatatggatgatggatccaaaggacgttcgcgagtggcagcacgaggagttctaccggtacgtcgcccaggctcacgataagccacgctacaccctccattataagaccgacgccccgttaaacatacggtctattttctatgtgcctgatatgaagccgagcatgtttgacgtttcccgcgagctcggctcatccgtggccctctacagccggaaggtcctcatccagacaaaggcaacagacattctaccaaagtggctaaggtttataaggggggttgtcgactcagaggatatcccacttaacctgtctagggagctgctgcaggagagtgccctcatccgcaagttgcgagacgtgctgcagcagcgactaatcaaatttttcatcgaccagtcgaagaaagatgcggaaaaatatgccaaatttttcgaagactacggactctttatgcgtgagggcatcgtcactgcaactgagcaggaagtgaaagaagatatagccaagctgctacgttacgagtcatcggcgctcccttccggacagttaacttctctatctgaatatgcgtcacggatgcgggccggaacccgcaacatttactatctgtgtgcccccaatagacaccttgccgagcacagtccgtattacgaggcgatgaagaagaaggacacagaagtgctgttctgcttcgaacagttcgatgagctcaccctgctgcacctgcgggagttcgacaagaaaaaactgatttctgtcgaaaccgacattgtcgttgaccactacaaagaggagaaattcgaggataggagccccgccgctgaatgtctgtctgagaaagaaacagaggagttaatggcttggatgagaaacgtgctgggcagtagagtgacaaacgtcaaagtgacacttcgactcgatacccatccagccatggtaaccgtgctggagatgggggcagctagacatttcctgcgtatgcagcagctggccaaaactcaggaggaacgggcgcagctcctccagcctacgctcgagattaatccccggcatgctctaatcaaaaaactgaaccagctgcgcgcctccgagcccgggttggcgcagctgcttgtagatcagatctacgagaacgccatgatagctgctggcttagtcgacgaccccagggccatggtgggccgactgaacgagctgctggtcaaggcacttgagagacactag

SEQ ID NO: 208788 - DNA, 1956 bp, Artificial Sequence
  Description of Artificial Sequence: Synthetic coding sequence
atggcccgggagctgcgggccctgctgctgtggggccggcggctgcgccctcttctccgcgcccctgcgctggcagctgtccctgggggaagcacctcgaagcatgagttccaagccgagaccaaaaagcttttggatattgtagcccgaagcttgtattctgagaaggaggtgtttattcgtgagctgatttccaatgccagtgatgccctggagaagctacgccataaactcgtgagtgacggacaggccttgcccgagatggaaattcacctgcaaactaacgctgaaaagggcacaatcactatccaggacaccggaattgggatgactcaagaagaactggtgagcaacctgggaacaattgcacggtctgggtccaaagcgtttcttgatgccctacagaatcaggccgaagcctcaagtaaaatcataggccaattcggcgtgggcttttacagtgcctttatggtcgcagatcgggttgaagtctacagccgctcagcggcccctgggtcgctcggctatcagtggctgagcgacggcagtggggtattcgagattgctgaggcaagtggagttagaactggcacaaagatcataattcatctgaaatccgactgtaaagaatttagtagtgaggccagagtgagggatgtggtcacaaagtatagtaatttcgtgagcttcccactttatctcaacggccgacggatgaatactttgcaggcgatatggatgatggatccaaaggacgtaagggagtggcagcacgaggagttttatagatacgtggcccaggctcacgacaagccacgctatactctgcattataagacagatgcgcccttaaatatccgctccatcttctatgtgcccgacatgaaaccctccatgttcgacgtgagtcgcgagctggggtccagcgtcgctctttacagccggaaggtactgatacagacaaaggccaccgatattctaccgaagtggctgcgatttattcggggagttgttgactctgaagatataccacttaatctttcccgagaattgttacaggaaagcgcattgatcaggaagctgcgggacgtgcttcagcagcggttgattaaatttttcatcgatcagtccaaaaaggatgcggagaaatatgcgaagttctttgaagactacggtctgtttatgagggaaggtattgtgacagcgaccgagcaggaggttaaagaagacatcgccaagctgctccgctatgagagcagtgcattgccctctgggcagctgaccagcctgtccgagtacgctagccgaatgcgcgctggtactcgcaatatctattacctctgcgccccgaaccgccatctggccgagcacagtccatattacgaagcaatgaaaaagaaagataccgaagtgctgttttgcttcgagcagtttgacgaacttaccctgcttcatctgcgagagtttgacaagaagaagctgatcagcgtggaaacagatattgtcgtcgatcactataaggaagagaaatttgaagatcgttcccccgccgctgagtgcctgtctgagaaggagactgaagaactgatggcctggatgaggaacgtactaggaagtagagtcacgaacgtgaaggtcacgctacgtctggatactcaccctgcgatggtcaccgttctcgaaatgggtgccgcaaggcatttcctgcgaatgcaacagcttgccaagactcaagaggagcgcgcacagctgctgcagcccaccctcgaaatcaaccctagacacgcactcatcaagaagctgaaccagctgagggcctcggagcctggcctggcacagcttctcgttgatcagatttacgagaacgcaatgatcgcagctggccttgtagatgacccacgagccatggtgggacgtctgaacgagttgttggttaaagcactggagcgccactag

SEQ ID NO: 208789 - DNA, 1911 bp, Artificial Sequence
  Description of Artificial Sequence: Synthetic coding sequence
atggagggccggggcccctaccggatctacgaccccggcggcagcgtgccctctggagaagcgtcagccgcttttgagaggttagtgaaggagaattcccggctgaaagagaaaatgcagggcattaaaatgcttggcgagttgctcgaggagtctcaaatggaagccacacgcctgcggcagaaagccgaggaattagtgaaagataatgaactgctgcctcctcccagtccctccctggggtcatttgatcccctcgccgaactcactggcaaggattccaatgtgactgcctcccctacagctcccgcgtgtcctagtgataagccagccccggtgcagaaaccaccctcttctggaactagcagtgaattcgaggtggtgactccagaggagcagaactccccagaatcttcctcacatgccaatgccatggcactcggcccactcccacgggaagatggcaatctgatgctacaccttcagagactcgagaccacattgtccgtttgtgccgaagagcctgaccatggacagttgttcacacaccttgggcgtatggcccttgaatttaataggctggcctctaaggtccataagaacgaacagcggacgagcatccttcagaccctgtgcgaacagctcagaaaagaaaatgaggctctgaaggccaagttggacaagggattagagcaacgggatcaagctgcagaaagactgcgtgaggagaatctggagttgaagaagcttttgatgagtaatggaaataaagagggtgcatctgggcggccgggctcgcctaaaatggagggtacaggcaaaaaggctgttgccggtcagcagcaagctagcgtcaccgccgggaaagtgcctgaggttgtggcactcggagccgccgagaagaaagtgaaaatgctggaacaacagcgatccgaacttctggaggttaacaagcagtgggaccagcattttcggagcatgaaacagcaatacgaacaaaaaatcactgaacttcggcagaagctcgcagatcttcagaaacaggtgacggacctggaggccgagagggaacaaaagcagcgtgattttgatagaaagctactgcttgctaagagcaagatcgaaatggaggaaacggataaggagcaattaacagctgaggcgaaggagttgagacaaaaggtcaaatatctgcaggaccagctaagtcccctaacacggcagagggagtatcaggagaaagaaatccagagactcaacaaggcattggaagaggcacttagtatacagactccaccctcctccccacctaccgcatttgggagtccggagggagcaggagcgctgctgcgtaagcaggaattggtcacccagaatgagctgctgaaacagcaggtcaaaatttttgaggaagacttccagcgggagcgctctgaccgggagcgtatgaacgaggagaaagaagaactgaagaagcaagtggaaaagctccaagcccaagttaccctctccaacgcacagctgaaagcattcaaagacgaggaaaaagctcgcgaggctctgcggcaacagaaaagaaaagcgaaggccagtggcgagcgctaccacgttgagccccatcccgagcacttatgtggcgcatacccctatgcctatccccccatgcctgctatggtcccccatcacggattcgaggactggtctcaaatccgatatccacccccaccaatggctatggagcacccccctccgttgccaaactctcggctctttcacctccccgagtatacgtggaggttgccctgcggcggcgttcgaaacccgaatcagtcatctcaggtcatggatccccctaccgcccggccaacagagcctgagagcccaaagaatgaccgagaaggaccacagtag

SEQ ID NO: 208790 - DNA, 1911 bp, Artificial Sequence
  Description of Artificial Sequence: Synthetic coding sequence
atggagggccggggcccctaccggatctacgaccccggcggcagcgtgccctcgggagaggcgtcagctgcatttgagcgtctcgttaaggaaaattccagactcaaggaaaagatgcagggcatcaagatgttgggagagctgctcgaggaaagccagatggaggctacacgtctccgccagaaggcggaagagctggttaaggacaatgaactactgcccccaccctctccaagtctcgggtcttttgaccctctggccgaactgactggcaaggattccaacgtgacagctagccccactgcccctgcctgccccagcgataagccagctcctgtgcaaaagccaccatcatctgggacatcctccgagtttgaggttgtaacacctgaggaacagaactcccccgagtcctcaagccacgctaacgccatggccctgggacctctcccgcgggaagatggcaatctgatgcttcatctacagagactcgaaaccacactgagcgtgtgcgcggaggaaccggatcatggacagttgttcacccacttgggaagaatggccttggaattcaatcgactcgccagtaaggtgcacaagaacgagcagaggacctcaattctgcagacgctgtgtgaacagctgcgcaaggagaatgaagctttaaaggcgaagctcgataagggcctggaacagcgtgatcaggctgcagaacgcctgcgcgaagaaaacctggagcttaagaagctgttgatgtccaatggcaacaaagaaggtgcctccggacgaccaggctcacctaaaatggagggtacagggaagaaagccgtcgctggccaacagcaggctagcgtgactgccgggaaagtgccggaagtggtcgcccttggagcggcggagaagaaggtgaagatgctggagcagcagcggtccgagctactggaggtgaataagcagtgggaccaacatttcaggtccatgaagcaacaatatgagcagaagattacagagctgcgacagaagctcgccgacctccaaaagcaagttacggacctagaggccgaacgcgagcagaagcaacgggatttcgatcggaaactgctgcttgcaaaaagtaagatcgagatggaggaaactgataaggagcagctcaccgccgaggccaaggaactgcgccagaaagtaaagtatctccaagaccaactcagcccactcactcggcagagggagtatcaagaaaaggagatccagcggttgaacaaagccctagaggaggccctctcaatacaaacccctccctcatcacctccgacagccttcggatccccagagggcgccggtgcgctgctgcgcaagcaggaattagtcacccagaacgaactgctcaagcagcaggtaaaaattttcgaagaagatttccagcgggagcggtctgaccgtgagaggatgaacgaggaaaaagaggagctcaagaagcaagtcgagaagctacaggcccaggtgacccttagcaacgctcaactcaaagcgtttaaagacgaagagaaggctcgggaggccctcagacaacaaaagcggaaggccaaggctagtggagaaaggtatcatgttgaaccccacccggagcacctgtgcggggcttacccatacgcctaccctccaatgccagcaatggttcctcatcatggcttcgaggattggtcgcaaatccggtacccccctccgcccatggccatggagcaccccccacccttgcccaattctcggttgtttcacttgcccgaatatacttggaggcttccgtgtggaggcgtgcgcaacccaaatcagtcctcgcaggtgatggatcctcccacagcacgacccactgagccagagtctccaaagaatgaccgggagggtccccaatag

SEQ ID NO: 208791 - DNA, 1590 bp, Artificial Sequence
  Description of Artificial Sequence: Synthetic coding sequence
atgctgggcgagctgctggaggagagccagatggaggccacccggttgaggcagaaagccgaagaactggtaaaggacaatgagctcctgcctcctccatccccctctttagggtccttcgacccacttgcggaattaaccggcaaggatagcaacgtgacagccagtcccaccgcacctgcctgcccgtcagacaagcctgcccctgtccagaaacccccctcatcggggacttctagcgagttcgaggttgtaactcctgaggaacagaactctcccgaatcatcatcccacgccaatgctatggctctgggtcccctgccaagagaagatggaaatctcatgcttcatctgcaacgcctggagaccaccttgagcgtgtgtgccgaggaacctgaccacggccagctgttcacccacctgggccgaatggctcttgagttcaatagactagcgtctaaggttcataagaatgagcagcgaacctctattctgcagactttgtgcgagcagctgaggaaggaaaacgaagctctgaaagccaagttagataagggacttgagcaaagggatcaggcagccgagagactcagggaggagaacctcgaactgaagaagcttctgatgagtaacgggaataaggagggtgcatctgggcgtcccggtagcccgaagatggagggtaccgggaagaaggcagtcgccggccagcagcaagcttccgtgacagccgggaaggtccctgaagttgtggcattgggagcagccgagaaaaaggtgaagatgcttgaacaacaacggtcagagctgcttgaggtgaacaagcagtgggatcagcactttcggtctatgaagcagcaatacgagcaaaagattactgaactgcggcagaagctggctgacctccagaaacaggtgaccgacctagaggccgagagggaacagaagcagcgagactttgaccggaaattattgctggctaaaagtaagattgagatggaggaaactgacaaggaacagcttaccgcggaggcaaaggagctccgacagaaagttaaatacctgcaagaccagctaagtccattgactcgtcagcgcgaataccaggaaaaggagatccagaggctaaataaagcgcttgaggaggcactgtctatccagactcccccttcctccccgcctacagcattcggcagccccgagggtgcaggagctttgcttaggaaacaagaacttgtgactcagaacgagctgctaaagcagcaagtgaagattttcgaggaagatttccagagggagaggtccgatagggagcggatgaatgaggagaaggaggaactaaaaaagcaagtggagaagctgcaggcgcaagttactctgagtaatgcccaactgaaagccttcaaggacgaggagaaggcacgggaagctctccggcagcagaaaagaaaggcaaaaccggaatacacatggcgactcccctgtggtggcgttaggaaccctaaccagtcttcccaggtaatggatccccccactgctaggcccaccgaaccagagagtccaaaaaacgatcgcgaagggcctcaatag

SEQ ID NO: 208792 - DNA, 1908 bp, Artificial Sequence
  Description of Artificial Sequence: Synthetic coding sequence
atggagggccggggcccctaccggatctacgaccccggcggcagcgtgccctccggcgaggcttccgccgctttcgagaggcttgttaaggagaattctaggctaaaggaaaagatgcagggaataaaaatgctcggggagttgcttgaggagagccagatggaagcaaccaggttaagacagaaagctgaagaactggtcaaagataacgagttgctgccccctcccagcccgtctctgggcagctttgatccactcgctgaactgacgggcaaggattctaacgtgacagcctctcctacagcacccgcctgccctagtgacaaaccggctcccgtccagaaaccccccagtagcggtacctcctcagaattcgaagtcgttacccctgaagagcaaaactcccctgagtcctcctctcatgccaatgcaatggcattggggccattacccagggaggacgggaacctgatgctgcacttacaacgccttgagaccacgctcagcgtttgcgcggaggagccggatcacggtcagttgtttacccaccttggaaggatggcactcgaattcaaccgcctcgccagtaaagtccataaaaatgaacagcgcacctccattctccaaactctgtgcgagcaactgaggaaggagaacgaggccctgaaggccaagctggataaaggcctagagcagagagaccaggcggctgagcggctccgggaagaaaacttagaactgaagaagctcctcatgagtaatgggaataaggagggggcctcaggccgcccaggatcacctaaaatggaggggacgggcaaaaaggcagttgccggtcagcagcaagcctccgttactgccggtaaagttcccgaagtagtggctctaggtgccgctgaaaagaaggtgaaaatgctagagcaacagagatcggagctgctggaagtaaataaacagtgggatcaacactttagatccatgaaacaacagtacgagcagaagatcacagaactgcggcagaagctcgctgatctccaaaagcaggtgactgatctggaagccgagcgcgagcagaaacaaagggatttcgatagaaagcttctcctggccaagagcaagattgaaatggaggaaaccgacaaagagcagttgaccgctgaggctaaagagcttcgacagaaggtgaaatatcttcaggatcagttatcacccctcacacggcagcgggagtaccaggagaaggagattcaaaggttaaataaagccctcgaagaagccttgagtatacaaactcccccctcctcccctcctactgctttcgggtctcccgagggagcaggcgctctgctccggaagcaggagctagtgactcagaatgagctgctaaagcagcaggtaaaaatattcgaggaagacttccagagagaacgatctgaccgggagcgtatgaacgaagaaaaagaagagcttaagaaacaagtagagaaactgcaagcccaagtgaccttgtcgaacgcccagttgaaggcttttaaggacgaagagaaagctagagaagcgctgagacagcaaaaacgaaaggccaaggcttctggcgaacggtaccatgtcgagcctcatccagagcacctttgtggcgcctacccctatgcttaccctcccatgcccgcaatggtgcctcatcacgggttcgaggattggtctcaaatcaggtaccctcctccacccatggccatggaacaccctccaccactgcctaatagtagactctttcaccttcccgaatacacctggcggctgccctgcggtggcgtgaggaatccaaaccagtcctcccaggtgatggatccgcccacagcccgaccaacagaacccgaacctgccgatctgcgcctgccacgcaactag

SEQ ID NO: 208793 - DNA, 1479 bp, Artificial Sequence
  Description of Artificial Sequence: Synthetic coding sequence
atggaggccacccggctgcggcagaaggccgaggagctggtgaaggacaacgaactgcttcccccccctagccccagtctggggtctttcgaccctctcgccgagctgactggtaaggactcaaatgttaccgctagcccaacagcaccggcgtgtccaagtgacaagccagccccagtacagaagcctccttcttccgggacatccagcgaattcgaggtggttacacccgaggagcagaattcgccggagtctagcagtcatgccaacgcgatggccttggggcccctgccacgggaagacggcaatctcatgctgcatctgcagagactggaaactacactgtctgtctgtgctgaagagcccgatcacgggcagttgttcacccacctggggaggatggctctggaatttaatagactagctagtaaggtgcacaaaaatgagcaaagaaccagcatcctgcaaaccctctgtgaacagctccgcaaggaaaatgaggctctaaaggccaaattggataaaggactcgagcagagggatcaggccgccgaaaggctgcgtgaggaaaacctggagcttaaaaagctcctgatgagcaacggaaacaaggagggcgcttctggacgacctgggtcacctaaaatggagggcacgggtaagaaggctgtggccggtcagcagcaggcatccgttaccgccggtaaagtgccagaggtcgtggccctgggcgcagcagaaaagaaggtgaagatgctggagcagcagcgctctgagttgcttgaggtgaataaacagtgggatcagcacttccggtccatgaaacagcagtacgaacagaagatcacagagctgcggcagaaattagctgacctgcagaagcaagtgacagacttggaggccgaacgcgagcaaaaacaacgggacttcgacagaaaactgctgctggcgaaaagcaaaatagaaatggaagagacggataaggaacaattaaccgcagaagcgaaagagctcaggcagaaggtcaagtatctgcaggatcagctgtcccctcttacacggcagagggagtaccaagaaaaagagatacagaggcttaacaaagccctggaagaggccttgtccatccagactcccccttctagcccacctacggcttttggctctcctgagggtgcaggggctctcctccgtaaacaggaactcgtgactcagaacgagcttcttaagcagcaggtcaagatctttgaggaagactttcagcgagagagaagtgatagggagcgtatgaacgaggaaaaggaggaactgaagaagcaggtcgagaaattgcaggctcaggtgaccctgagcaatgctcagctgaaagcttttaaggacgaggagaaggctcgtgaggcgttgcggcaacagaagaggaaggctaagggaacccatcgaggctgtcctcggcatctcccagagaggaaggtgaagtag

SEQ ID NO: 208794 - DNA, 435 bp, Artificial Sequence
  Description of Artificial Sequence: Synthetic coding sequence
atggagggccggggcccctaccggatctacgaccccggcggcagcgtgccctctggggaggcctctgctgccttcgaacgcctggtgaaggagaactcccgccttaaggagaagatgcaggggatcaagatgcttggggaacttcttgaagaatctcaaatggaagccacacgcctccgccagaaggctgaggagctggtgaaagacaacgaactgctgccaccaccaagtccttctctcgggtcgttcgaccccctggcagaacttacgggcaaagattccaacgtgacagcttccccaacggcacccgcatgcccaagtgacaaaccggctccagtgcagaagcctccgagctctggaacgtcgtcagagtttgaggtagtgacccctgaggaacagaattcgcctgagtcttcctcccacgccaacgcctag

SEQ ID NO: 208795 - DNA, 1752 bp, Artificial Sequence
  Description of Artificial Sequence: Synthetic coding sequence
atggaggccacccggctgcggcagaaggccgaggagctggtgaaggacaacgaactgctcccacccccatcgccttctctgggttctttcgatcctctggccgaattaacaggaaaagactccaatgtgacggccagcccgactgctcccgcatgcccatctgacaaaccagcacccgtacagaaacctcctagctccggaactagctccgagtttgaggtcgtgactcctgaagaacaaaactcacctgagtcttcctcacatgctaatgccatggccctgggcccactaccacgggaagatgggaacctgatgttgcatttacagcggctagagaccactcttagtgtatgtgccgaggagcccgatcacggacagcttttcacgcatctgggccggatggccctcgagtttaaccggttagcttctaaagtccacaagaacgagcaaaggacttctattttgcagacgctgtgtgaacagctgcggaaagagaatgaagccctgaaggccaagctcgacaaaggactggagcagagagatcaggctgccgaacggctgcgtgaggagaacctggagctcaaaaaactgcttatgagtaatggcaacaaggagggagccagtggacgtcctgggagtccaaaaatggagggcactggcaagaaagcggttgctggacagcaacaggcctctgtgacagcgggaaaggtgcctgaggtggtggcactgggagccgccgagaaaaaggtcaaaatgttagagcaacagcgctccgagctgcttgaggttaacaaacagtgggaccagcactttagatccatgaagcagcagtatgaacagaaaattactgagcttcggcaaaagctggccgacctccagaaacaggttacggacctcgaggcggaaagggagcaaaaacagcgagattttgaccgcaagctgttgttggccaagagtaaaatcgagatggaagagaccgataaggagcagctgactgccgaggcaaaggaattacgtcagaaggttaagtacctccaagatcaattatctcctttgaccaggcagcgggagtaccaggaaaaggaaatccagcggttgaataaagcactggaagaggccctgagtatccagactccccctagctccccacccaccgcattcggtagtccagaaggcgcgggagcattgttgcgcaagcaggagctcgtgacccaaaacgaacttctgaaacaacaagtcaagatattcgaagaggacttccagcgggaaagaagcgaccgcgaacgaatgaacgaggaaaaagaggaattaaagaagcaggtggagaagctccaggcgcaggtcacgctgtctaacgcccagctgaaagcattcaaggacgaggagaaggcaagggaggccttgcgccagcaaaagcgaaaagctaaagcctcgggagaacgataccacgtggaaccgcacccggagcacctgtgcggcgcctacccatacgcctaccctccaatgccagctatggttccccaccacggatttgaagactggtctcaaatcagataccctcctccccccatggcaatggagcaccctccgccactgcctaacagccgtttgttccacctcccagaatatacttggagactgccctgcggaggggtccgaaacccaaatcagagttcgcaagtgatggatccgcccaccgccaggcccactgagccggaatcaccaaagaatgacagggaaggccctcaatag

SEQ ID NO: 208796 - DNA, 402 bp, Artificial Sequence
  Description of Artificial Sequence: Synthetic coding sequence
atggagggccggggcccctaccggatctacgaccccggcggcagcgtgcccagtggagaggcctctgccgcattcgaaaggctggtcaaagagaactcaaggttgaaagagaagatgcagggaatcaagatgctgggcgagctgctcgaggagagccaaatggaggctacccgacttaggcagaaagcagaggagctcgttaaagacaacgaattgctacctccaccttctcccagtctaggctctttcgaccctctagccgaactgaccggcaaggattccaatgtgaccgcttcaccaactgcgcctgcgtgccctagcgacaaaccagcacccgtacagaaacctccttctagtggaaccagcagcgaattcgaggtcgtcacgcctgaagagcagtag

SEQ ID NO: 208797 - DNA, 1911 bp, Artificial Sequence
  Description of Artificial Sequence: Synthetic coding sequence
atggagggccggggcccctaccggatctacgaccccggcggcagcgtcccctcaggggaagctagtgctgcctttgagagactggttaaggaaaattccagacttaaagaaaaaatgcagggaattaaaatgctaggcgagctgctcgaggagagccagatggaagcaactcgcctccggcagaaggcggaggagttggtgaaagacaacgaattgcttcctccgccctcaccatccctgggatcatttgacccactggcggaactaaccggaaaagactccaatgtcacagcctcccccacagcacctgcttgtcccagtgataagccagcacccgttcagaagcccccatccagcggcacttcctccgaattcgaagtggttactcccgaagaacaaaactcacccgagtccagtagccatgcgaatgctatggcgttaggccctctgcccagagaggatggaaatctgatgctccacctgcaacggctagagactaccctctccgtgtgtgccgaggagccagatcatggtcagttgttcacccatctggggcggatggctctggagttcaaccggttagcctccaaagtacacaaaaacgaacagaggacaagcatcctgcagacgctttgtgagcagcttcgcaaggaaaatgaagcccttaaggctaagctggataagggcttggagcaacgggaccaggcagcagaaaggctgcgagaagagaacctcgagcttaaaaaactcttaatgtcaaatggaaataaagagggggcgtcgggaagacctggatctcctaagatggagggcacgggcaagaaagccgtggctggacagcagcaggcaagcgtgactgcagggaaggtgcccgaggtcgttgcgctgggggctgctgagaagaaggtgaagatgctggaacaacaacgctccgaacttttagaggtgaacaagcagtgggaccaacactttcgttccatgaaacagcagtatgagcagaaaataaccgaactccggcagaaactcgccgatctacagaaacaagtcacggatctggaggccgagagggagcaaaagcagagagattttgatcggaagctactcttggcaaagtccaagatcgagatggaggaaacggataaggagcaactgaccgcagaagctaaagaactgaggcagaaagttaaatacctgcaggaccagctgagtccgttaactagacagcgggagtatcaagagaaggaaatccaaagactcaacaaagccctcgaagaagccctgtccatacaaactcccccttcatcacctccgaccgccttcggaagtcccgagggcgcaggggcattgttgagaaagcaggagctggttacgcagaacgagcttctaaaacaacaggtaaagatttttgaggaggattttcagcgcgagcgctcggacagggagagaatgaatgaggagaaagaagagctgaagaagcaggtggagaaactgcaagctcaggtgaccctgtccaacgcacagctgaaggcctttaaggacgaagagaaggcaagagaggcgcttaggcagcagaagagaaaggccaaggcatcaggcgagaggtaccacgtcgaaccacatcccgagcatctgtgtggcgcttacccgtacgcgtatccacccatgcccgccatggtccctcaccatgggttcgaagactggtcacagatacggtacccccctccccctatggccatggaacaccccccccctctgccgaacagccgcctgtttcacctccccgagtatacatggcggctcccctgtggcggggtaaggaatcccaatcagtcatcacaggtcatggaccctccaactgcccgcccgactgaacctgagtcacccaagaatgaccgggaaggtccccagtag

SEQ ID NO: 208798 - DNA, 774 bp, Artificial Sequence
  Description of Artificial Sequence: Synthetic coding sequence
atggaggccacccggctgcggcagaaggccgaggagctggtgaaggataatgagttactgccccccccaagtcccagccttggctctttcgatccgttagcagagcttacggggaaagactcaaacgtcacggcttcaccgactgcaccggcctgccctagtgataagcccgccccagtccagaagccccccagctcagggacgagttctgagttcgaagtcgtgacccccgaagagcagaatagtcccgagagtagttcacacgccaatgccatggccctgggccccctccccagggaggatggaaatctgatgttgcatttgcagagactcgagaccactctgtcagtttgcgctgaggagcctgatcacggccagttattcacccacctgggaagaatggcccttgaattcaataggctcgccagcaaggtccacaaaaacgaacagcggacatcaattctgcagaccctctgcgaacaactgcggaaggagaatgaagcactgaaggccaagctcgataaagggctagagcagagggaccaggcggcagaacggctgcgggaggaaaatctggagctgaagaagctacttatgtcgaatggcaataaagagggggccagtgggcggccagggagtcctaagatggagggcaccgggaaaaaggctgtcgctggacaacagcaagcctccgtgacggccggcaaagtcccagaggttgtagccttgggagccgccgaaaagaaggtgaaaatgctggaacagcagcgctag

SEQ ID NO: 208799 - DNA, 1911 bp, Artificial Sequence
  Description of Artificial Sequence: Synthetic coding sequence
atggagggccggggcccctaccggatctacgaccccggcggcagcgtaccctccggtgaggcatcggcggccttcgaacgtctggtcaaagagaacagtaggctgaaggaaaaaatgcaagggatcaagatgctgggcgaattgcttgaagagtcccagatggaagctacccgcctcagacaaaaagccgaagaattagtcaaagataacgaactgctgcccccgcctagccctagcctgggctcattcgacccgttggccgaactcacaggcaaggactcaaacgtcactgcctcacccaccgctccagcctgtccttcagacaaaccggccccagttcagaagcctcctagttctggaacaagtagcgaattcgaggtggtgactcccgaagagcagaactcaccagaatcttctagccatgctaacgccatggccctcgggcccctgcctcgggaggatggaaaccttatgttgcacctgcagcggctcgaaacaactttgtctgtttgcgcagaagaacctgaccatgggcaactgttcacacatctgggacggatggctctggaatttaacaggctcgcaagcaaagttcataaaaacgaacaaagaaccagcatcttgcagacactatgtgagcagttgcgaaaagagaacgaagccctgaaagctaagctcgataaggggctggagcaacgcgatcaggccgctgaacgacttcgagaggaaaacttagagctgaaaaaattgctgatgagcaatgggaataaggagggtgcgagcggccggcccggctcccccaagatggaggggaccgggaaaaaagccgtggcagggcaacagcaggccagcgtaaccgctggaaaggtacccgaggtggtggccctcggagccgctgaaaagaaagttaaaatgttggagcagcaacgcagcgagttgctggaggtgaacaaacagtgggatcagcacttccgtagtatgaagcagcagtatgaacaaaaaatcaccgaacttaggcagaaacttgccgatctgcagaagcaggtgaccgatctcgaggctgagcgcgagcagaaacagcgggactttgaccgcaagctcctgctggccaagagcaagattgaaatggaggagactgacaaggaacaacttacagcagaggccaaagagttaaggcagaaggtgaaatacctgcaggaccagctgtctcctctgacgaggcagcgggaataccaggaaaaagaaatccaacgcctcaacaaggccttggaggaagccctcagcatccagacacccccatctagccctcccaccgcatttggcagtcctgaaggggctggagccctcttaaggaaacaggaattagtgacccagaatgaactgttgaagcagcaggtgaaaattttcgaagaggattttcagcgggaacgatccgatcgagagagaatgaacgaagagaaggaggagctgaaaaaacaggtagaaaaattgcaggcacaagtgactttatcaaatgcccagctgaaggcttttaaggacgaggagaaggctcgcgaggccctcagacagcagaagagaaaggccaaagcgagcggcgagcggtatcatgttgaaccgcatccggaacacctgtgtggggcctatccgtacgcttaccctcctatgcctgcaatggtccctcatcacggattcgaggactggagtcagataaggtacccacccccccccatggctatggaacacccccctccactgcccaactctcgactgtttcacttacctgagtacacgtggagactgccttgcggaggggtgaggaaccccaaccagagctctcaggtgatggatcccccaacagcccgacccaccgaacccgaaagtcctaaaaatgatagagaggggccacagtag

SEQ ID NO: 208800 - DNA, 1719 bp, Artificial Sequence
  Description of Artificial Sequence: Synthetic coding sequence
atggagggccggggcccctaccggatctacgaccccggcggcagcgtgccgtctggagaggcctctgccgcttttgaaagactcgtgaaagaaaacagtagattgaaggaaaagatgcagggcatcaagatgttgggggaattactggaagaaagccaaatggaagcaacgcgccttaggcagaaggctgaagagttggtgaaagataacgagctgctcccacccccgtcgccatccctgggttctttcgatcctctcgccgaactaactgggaaggacagcaatgtgacggcgtcaccaactgcccctgcttgcccatccgataagcccgccccagttcagaaacccccatcgagtgggacaagctccgagtttgaagtggtgacgcccgaagagcagaactcccccgaatcaagctcgcacgcaaatgccatggccctgggcccattgccgcgggaagatggaaatcttatgttacacctgcagcggctcgagaccacattgtcagtttgtgctgaagagccggaccacggccagctgttcacacacttagggaggatggccttagaatttaaccgactggctagcaaggtgcacaagaacgaacagagaacctctattctgcaaacactctgtgagcaattacggaaggaaaacgaggccctgaaggcgaaattagacaagggactggagcagcgggaccaggctgccgagagactcagagaggagaatttggagctcaaaaaattactgatgtccaacggcaacaaggaaggggccagcgggcgtcccggatcgcctaaaatggagggcacaggtaaaaaggcagtggcgggccagcagcaggctagtgttacggctggaaaggtccctgaggtcgtcgctctgggggctgcggaaaagaaggttaagatgcttgagcagcagaggtctgagctgctcgaggtgaacaagcaatgggatcaacacttccggagcatgaagcagcagtatgagcagaagattacagaacttaggcagaaactggcggatctccagaagcaggtaactgatctggaggctgaacgggagcaaaagcaacgggatttcgaccgcaaactgctccttgccaaaagtaaaattgagatggaagagaccgacaaggagcagctaactgccgaggctaaagagctgaggcagaaggttaagtacctgcaggatcagctgagtcccttaactcgccaaagggagtatcaggagaaagaaatccagaggttgaacaaggccctcgaggaggctctgagcatccagactccgccttctagtcctccaactgccttcggaagtcctgaaggcgcaggtgcccttctcaggaaacaggaactggtcacacaaaacgaactgctcaaacagcaggtaaagatttttgaggaggattttcagcgggaacgatcagatcgggagcggatgaacgaggaaaaggaggaactgaaaaaacaggtggagaagctgcaggctcaggtgacactctctaacgcacagcttaaagccttcaaagatgaggagaaggcccgcgaagccttaagacagcagaaacgcaaagctaaaccggagtacacatggaggctgccatgcgggggtgtgcgcaacccaaatcagtcaagtcaagtaatggacccgccaacagcaaggcctaccgagcccgagtctcctaagaacgatcgagagggccctcagtag

SEQ ID NO: 208801 - DNA, 1908 bp, Artificial Sequence
  Description of Artificial Sequence: Synthetic coding sequence
atggagggccggggcccctaccggatctacgaccccggcggcagcgtgcctagcggggaagcgtctgccgcatttgaacgcctggttaaggagaacagcaggctcaaagaaaagatgcaaggaatcaagatgttgggggagctgctggaagagagtcaaatggaggcaacaaggttaagacagaaggcagaggaactggtcaaggataatgaactgctgccccctccatctccgtccttgggcagcttcgatccgcttgccgaactgacaggcaaagattcgaatgtgaccgcatcgcctactgcgccagcttgtccctcagacaaacctgctcctgtacagaaacctcctagctctgggacctcctccgagtttgaggtcgtaactcctgaagagcagaactctcctgaatcctcctcacacgctaatgccatggctctaggacccctgcctagagaggacgggaacctcatgctccacctgcagagactggagaccacccttagcgtctgcgcagaggagcccgatcatgggcagctgttcacacacctcggacggatggccctcgagtttaatcgtttagcctccaaagtgcataaaaacgaacagagaactagcatacttcagactctctgtgagcagcttcggaaggaaaacgaagccctcaaggctaagttggataagggattggaacagagagaccaggctgcagagcggctgagggaggagaacctggagctgaaaaaactcttaatgtccaacggcaataaagagggcgcatctgggcggcccggatcccctaaaatggagggtaccggcaagaaagctgtggcgggacagcagcaggcttctgtcaccgctggtaaagtcccagaggtggtggccctgggcgctgccgagaagaaagtgaagatgttagaacagcagcgatccgagttactggaggtgaacaagcagtgggatcagcattttcgcagcatgaagcaacagtacgagcagaagatcaccgagctcaggcaaaagctagcagatctacagaaacaggtaacagacctggaagctgagagagaacagaagcagcgcgacttcgatagaaagttgttgcttgcaaagtccaaaattgaaatggaggagaccgacaaagaacaactgactgctgaagctaaggagttgcgccaaaaggtaaaatatctgcaggaccagttgtcccccctaacaaggcagagggaatatcaagagaaggaaattcagagactcaataaagccctggaggaggcactgtctatccaaactcccccctcctcaccccctacagccttcggcagcccagaaggcgccggtgccctcctccgcaaacaggaacttgttacccagaacgaactgctcaaacagcaggttaaaatctttgaggaggatttccagcgcgagcgcagcgatagagagcgaatgaacgaggaaaaggaagaactgaagaaacaggttgagaagctccaggcccaggtgacgctgtctaatgcccagctaaaggcgtttaaagacgaggaaaaggccagagaagctctgcgtcagcaaaagagaaaggcgaaggcttctggcgaacgataccatgtcgagccccaccccgagcacctctgcggtgcctacccctatgcataccctcctatgcctgccatggtccctcatcatggattcgaagactggagccagatcagataccctcctccccccatggccatggagcaccctcctccgctgccgaactcaaggctgtttcaccttcctgagtacacttggagactgccctgcggcggggtcaggaatcctaaccagagttctcaagtgatggaccctcctaccgcccgtccaaccgaaccagagccagccgatctccggctgccacgcaactag

SEQ ID NO: 208802 - DNA, 1671 bp, Artificial Sequence
  Description of Artificial Sequence: Synthetic coding sequence
atggagggccggggcccctaccggatctacgaccccggcggcagcgtacccagtggcgaggcctcggccgcgtttgagagactcgtcaaagagaatagccggctaaaagaaaagatgcagggtattaagatgctgggggaacttttagaagagtcacagatggaggccaccaggttacgtcaaaaggctgaggaactggttaaagataacgagctgttgcccccgcccagcccgtccctcggctctttcgaccctctggccgagctgactggtaaggacagcaacgttactgccagcccgacagctcctgcctgccctagtgataaaccagctcccgtgcagaagccgcccagcagcgggacgagttcagagttcgaggtggtcacgcctgaggaacaaaacagtcctgagtcatcatctcacgctaacgccatggcgttaggcccactgcctcgcgaggacggaaatctgatgctgcacttgcagcggttagagacaaccttaagtgtctgcgccgaagagccagatcatggacagctatttacacacctgggccgcatggctcttgaattcaacagacttgcaagcaaggtccataagaacgaacagcggacatccatcctgcaaacattatgcgaacaactgcggaaggagaacgaagcactcaaggcaaagctcgacaagggacttgagcagagagatcaagcagcagaaagattacgggaagagaatctcgagctgaaaaaactgctgatgtcaaatgggaataaagaaggcgcctccggtagacctggatcacctaaaatggaggggaccggcaaaaaggctgtggctgggcagcaacaggcctcagtgaccgccggtaaagtcccggaagtggtagctctcggtgccgccgaaaagaaagttaagatgctggagcagcaacgcagtgaactgttagaagtgaataaacaatgggatcagcatttccgctcaatgaagcagcagtacgagcagaagatcacagaactcagacagaaattagctgacttgcagaagcaggtcactgacttggaagccgagcgggaacaaaagcagagggactttgatcgtaagttattactggccaagtccaaaattgaaatggaggagacagacaaagagcagctgaccgcggaagccaaagagcttcgtcaaaaggtgaagtatctgcaggatcaactgtctcctctcactcggcagcgggagtatcaagagaaagaaatacagcgcttgaataaagccctggaggaggctcttagcatccaaacccccccttccagccccccaaccgctttcggttcccccgaaggagcaggtgccctcctcagaaaacaagagctcgtgacacagaacgagctcctgaaacagcaggtgaagatcttcgaagaagactttcaacgcgaaagatcagatcgtgagaggatgaatgaggaaaaagaggagcttaaaaagcaagtggagaaactgcaggcacaggtgacgctgtcaaatgctcagctcaaagcctttaaagatgaagaaaaggcccgtgaggctctgaggcagcaaaagaggaaggccaagagccttcagaaaatgaccgtccgcggcctcagcgagacgcggctttgtcacctggccccaccctctagctgtcgggcctcttag

SEQ ID NO: 208803 - DNA, 1797 bp, Artificial Sequence
  Description of Artificial Sequence: Synthetic coding sequence
atgcagggcatcaagatgctgggcgagctgctggaggagagccagatggaggccacccgtctaagacagaaagccgaggaactggtgaaggataatgagctgctgccccctccttccccctccctgggctcttttgatccattggccgagcttacgggcaaagacagtaacgtgacagcttcccccactgcccctgcttgtccaagtgataagccagcccctgtgcagaagccaccatcttctgggactagttcggagtttgaagtggtgactccagaagaacagaattcaccagagagctcctcgcacgctaacgctatggcactcggtccactccctcgcgaggatggcaacctgatgcttcacctgcagcggttggagacgaccttgtccgtttgtgctgaggagccagatcacggccagctcttcacccaccttggaagaatggctcttgaatttaacaggctggctagtaaagtccacaagaacgagcagcggacttccatcctgcagaccctgtgtgagcaactccgaaaagaaaatgaagcgctgaaagctaagctcgacaaggggctcgagcagcgagatcaggccgcggagcggcttcgcgaagaaaaccttgagctaaaaaaactcttgatgtctaatggtaacaaggaaggtgcaagtggccggccaggatctcctaaaatggaaggaacaggcaagaaggcagtcgcgggccaacagcaggccagtgtaaccgcaggcaaagtgcctgaagtcgttgccctgggtgctgctgagaagaaggttaagatgttggaacagcaacgctcagagctgttggaggtcaacaaacagtgggatcagcattttagatcgatgaaacagcaatacgagcagaaaattactgagctcaggcaaaaattggctgacctccaaaaacaggtcacagacctggaagccgaacgggagcagaagcagcgggattttgataggaaattactgcttgccaaatcaaagatcgagatggaagagaccgacaaggaacaactaactgctgaagcaaaggagctgagacaaaaggtgaagtatttgcaggaccagctgtctccactgactagacagagagaataccaggaaaaagagatccaacggcttaataaggctctggaggaagccctgagcatccagactccaccgagttcccctccgaccgctttcgggagccccgaaggagccggcgccttactgaggaaacaggagctggtcacacaaaacgagctcctcaaacagcaggtcaaaatatttgaggaagacttccagcgagagcgctccgatcgcgagcgcatgaatgaagaaaaagaggagttgaagaaacaggtggagaagctgcaggcacaggtgaccctgtctaacgcacagttaaaggcttttaaagatgaggaaaaagcaagagaagcccttagacagcagaaacgcaaagccaaagcctccggagaaaggtaccacgttgagccgcatcccgagcatctatgtggtgcatatccctacgcataccctccgatgccagcaatggtccctcaccacggcttcgaagattggagtcagatacggtatcccccgccccctatggccatggaacatccacctcctctccccaatagtcggctgttccacctgccagagtatacgtggcgactaccgtgtggtggagtgaggaaccctaatcagtcgagccaagtcatggatcccccgacggcaaggccaaccgaaccagagtctccaaagaatgaccgggagggtccacaatag

SEQ ID NO: 208804 - DNA, 1542 bp, Artificial Sequence
  Description of Artificial Sequence: Synthetic coding sequence
atgctgggcgagctgctggaggagagccagatggaggccacccggctaaggcagaaggctgaggagctggtgaaagacaatgaactgcttccaccaccgtccccctccctaggaagctttgacccacttgcagagctgacagggaaagactctaatgtgacagcctccccaacagcaccggcatgcccctcagataagcccgcaccggtccagaagccccccagcagtggcacgagcagcgagttcgaggtggttacaccggaggagcagaatagcccagagtcctcttcacatgccaacgctatggcattaggcccactccctcgtgaagacggtaatctgatgctgcatttgcagcggctggagactacattgagcgtctgcgccgaagagcctgaccatgggcagctcttcacacatttaggccgcatggcactggagtttaacaggctggcatccaaggttcacaagaatgagcagcggaccagtattctgcagacattgtgtgaacaacttcgcaaagagaatgaagccctgaaagcgaagctcgacaaaggactggaacagcgcgaccaagccgcagagaggctacgggaggagaatctagagctcaaaaagctgctgatgagcaatggtaacaaggaaggagcttccgggcggccgggcagcccaaaaatggaaggcacaggcaagaaagctgtggccgggcagcaacaggctagcgtgaccgccgggaaagtgccggaagtagtcgcactgggtgcggcagaaaaaaaagtgaagatgctggaacagcagagatcagagttgcttgaagttaacaaacagtgggatcagcactttcggtcaatgaaacagcagtacgagcagaagatcactgaactgcgccagaaactggccgacttgcagaagcaggtgactgacctggaagctgagagggagcaaaaacagagggattttgaccggaaactgctgctcgctaaaagcaagatcgaaatggaggaaacagacaaagaacagctgacggcagaagccaaggagctgcgacagaaagttaaatatttacaagaccagctgtcccctctgacacgccagagggaatatcaagaaaaagaaatccagcggctcaataaggcactggaggaagcactgtccatccagacgccaccttcatctccaccgaccgctttcgggtcacccgaaggagccggcgcccttctgcggaagcaggagctcgtgacgcagaatgaactgctcaaacagcaggtcaaaatttttgaggaagattttcagagggaaagatcagatagagagcgaatgaacgaggagaaggaagagcttaaaaagcaggttgaaaaattgcaggcccaagtgacactgtccaacgctcaactgaaagcctttaaggacgaggaaaaggctcgtgaggccttacgccaacagaagcgcaaggccaaatcgctgcagaaaatgacggtgcggggcctgtcagaaacgcgcctgtgccacttggccccacctagttcttgtcgtgcttcctag

SEQ ID NO: 208805 - DNA, 1509 bp, Artificial Sequence
  Description of Artificial Sequence: Synthetic coding sequence
atgctgggcgagctgctggaggagagccagatggaggccacccggctgaggcagaaggccgaggagcttgtaaaagataatgagcttcttcctccaccctctcccagtctggggtcctttgatcccctcgctgagctgactggcaaagacagcaacgtgaccgcttcccctactgccccagcgtgtccttccgacaaacctgcgcctgtgcagaagcccccctcttctggaaccagcagtgagtttgaggtggttacacccgaggaacagaattcccccgaaagctcctctcacgctaacgctatggctttaggtcctttacctagggaagatgggaacctgatgctgcacctgcagagactggagaccactcttagtgtttgcgctgaggaacctgatcacggacagctcttcacacatctggggaggatggctctggagtttaacagacttgcgagcaaggtgcataagaatgaacaacggacaagcatcctacagaccctgtgcgaacagctgcgtaaggagaatgaggctctcaaggcaaaactcgataaaggacttgagcaacgtgaccaggctgctgaacgcctcagagaggagaacctcgagctcaagaagctgctcatgtctaatggcaacaaggagggggccagcgggcgccccgggtctccaaaaatggaaggcactggtaagaaagctgtagccggccaacagcaggctagtgtgaccgcgggcaaagtacctgaggtagtggcgttaggggcggcggaaaaaaaggtgaagatgttggaacaacagcgctcagagctgctggaagtgaataagcagtgggatcagcatttccgctcaatgaagcaacagtatgagcagaagattactgagttacgacaaaaactagccgacctccagaagcaagtaaccgatctagaggcagagagagagcagaaacagagggactttgatcgcaagctcttgctcgcaaagagtaaaatagaaatggaggaaaccgacaaggaacagttgactgctgaggctaaggaactacggcagaaggttaagtacttgcaagaccagctctcccccttgacgaggcagagagagtaccaggagaaggaaatccagaggttgaacaaagccctggaggaggccctgtctatccagactccaccctcttcccccccgactgcctttggctccccagagggtgctggagccctgctgagaaagcaggagttggtcacacagaatgaactcctgaagcagcaggtcaaaatcttcgaggaagacttccaacgcgagagaagtgaccgcgagcgaatgaacgaagaaaaagaagagctgaagaagcaggtggagaagcttcaggcgcaggtgacactgtccaacgctcaactcaaggctttcaaggatgaggaaaaggcccgagaagcattgagacaacagaagaggaaagcgaagggcacccatcgggggtgccctaggcaccttcccgaacgcaaagtgaaatag

SEQ ID NO: 208806 - DNA, 1290 bp, Artificial Sequence
  Description of Artificial Sequence: Synthetic coding sequence
atgagccgggaccccggcagcggcggctgggaggaggccccccgggctgcggccgctttgtgtaccctgtatcacgaggcaggacagcggctgcgacgactgcaagatcagttggctgctcgtgatgcactgatagctagactgagggctcggcttgctgctctagaaggcgacgcagcaccatcactcgttgacgccctcttggagcaggtagcgaggtttcgtgagcagctgcgcaggcaggaaggcggcgctgctgaagcccagatgagacaggagatagaaaggctaacagagcgtcttgaagagaaggaacgcgaaatgcaacagctgttatctcagccgcagcacgaaagggagaaggaggtggtgttgcttaggcggagtatggccgagggtgaacgggcaagagcggccagtgatgttttatgtcgatcgctggcaaatgagactcaccagcttagacgaactctaaccgcaactgctcacatgtgccagcatctcgccaagtgcctggacgaacgacagcatgctcagcgcaatgtaggcgagagatctccagaccagtcagagcacactgacggccacacgtcagtgcaatctgtcatcgagaagctgcaggaagagaatcgcctgttaaaacaaaaggtgacacacgttgaggatcttaacgccaaatggcaacggtataacgcctccagagacgaatacgttaggggattgcacgcccagttgcgcggcctgcaaatccctcatgagcccgaactgatgaggaaggaaatttccagattaaatagacagctggaggaaaagatcaacgactgtgccgaggtgaaacaagagctggccgctagtcgcactgctagggacgccgctcttgagcgcgttcagatgctggaacaacagatcctggcctacaaagatgacttcatgagcgagcgggctgaccgagaaagagcgcaaagtcgaattcaggagcttgaggaaaaggtggcctcgctccttcaccaggtctcctggcgccaggatagccgcgaacctgatgccggtcggatccacgccggtagcaaaaccgctaagtatctcgcagccgatgctctggagctcatggtacctggcgggtggcgccctggaactggcagccagcagcctgagccccctgcagaagggggtcacccaggggcagcacagcgaggccaaggcgacttacaatgtcctcactgcttacagtgtttctccgatgagcagggagaggaacttttaagacatgtggccgaatgctgccagtag

SEQ ID NO: 208807 - DNA, 969 bp, Artificial Sequence
  Description of Artificial Sequence: Synthetic coding sequence
atgcagcagctgctgagccagccccagcacgagcgggagaaggaggtggtactgttgaggcggtctatggccgaaggggagagggcccgtgctgcgtccgatgtgctctgtcgaagcttagctaatgagacacatcagctgcggcgtacgttgacggccactgcccatatgtgccagcatctcgccaagtgcttggatgaacggcaacacgcacagagaaatgtgggggaaagaagccctgaccaaagcgaacacacagatggacatactagcgtccaaagcgtgatcgaaaaacttcaggaggagaaccgcctcctgaagcaaaaggtgactcatgttgaggacctcaacgccaagtggcagcgctacaacgcctcaagggacgagtacgtgcggggcttgcacgctcagttgagaggactgcagatacctcacgaaccagagctgatgcgtaaggaaatctctcgacttaatcggcagctcgaagagaagatcaatgattgcgccgaggtgaaacaagagctggcagcctcaagaaccgccagagatgcagctctggaacgggttcagatgctggaacagcagatcctggcgtacaaggatgactttatgtcagaaagggccgacagggagagagctcaatcccggattcaggagctggaggaaaaagtggccagcctgctgcaccaggtctcgtggcgacaagacagtcgcgagccggacgcaggacgaatacacgccggtagcaagactgcaaagtacctggcggccgacgccttggagctcatggtgcctggcggttggagacccggtacaggctcccaacaacccgaacctcccgccgagggcggacatcctggggctgcccaacgggggcagggggacttacagtgtccgcattgcctgcagtgtttctcggacgagcagggtgaggaactgctgagacacgttgcggagtgttgccagtag

SEQ ID NO: 208808 - DNA, 837 bp, Artificial Sequence
  Description of Artificial Sequence: Synthetic coding sequence
atggccgaggcccggagccagcccagcgccggcccccagctgaacgccctccctgatcatagcccactgctacagcctggcttagctgcgctgcgaaggagagccagagaagctggcgtaccactggcacccctccccctgaccgatagctttctgctgaggtttctgcgcgctagggactttgacctggatctggcctggaggttgctgaagaactactacaagtggagggctgagtgccctgagatttctgctgatttgcatcccagaagtataatcggcctgttgaaggcgggataccacggcgtcctacgatcaagggacccaactggctccaaggtccttatttacagaattgctcactgggaccctaaggtatttacagcttatgacgtctttcgcgtctcgctgatcacaagcgaattaatcgttcaggaagttgagactcagcgaaatggcatcaaggctatctttgacctggaaggttggcagttttcccatgccttccagatcaccccatcagtggccaaaaagattgcagcagtcctcacggacagcttcccactgaaggttagggggatccacctgatcaacgaacccgtcatcttccatgctgttttcagcatgatcaaaccctttctcactgaaaaaataaaagaaaggatacacatgcacggtaacaactataagcaaagtctgctccaacattttcccgatattctgcctctggagtatgggggagaggaattcagtatggaggatatttgccaggaatggactaattttattatgaaaagtgaggactatctttcttcaatttctgaatcaatacagtag

SEQ ID NO: 208809 - DNA, 2361 bp, Artificial Sequence
  Description of Artificial Sequence: Synthetic coding sequence
atgaccagcatcttccacttcgccatcatcttcatgctgatcctgcaaataagaatccagctaagtgaagaaagcgagttcctggtcgaccggtctaagaacggcctgatccacgtccctaaagatctgagccagaaaacaactattctcaatatttcacaaaactatatttctgagctgtggacgtcagatattctctcactgtcaaagctgaggatcctgatcattagtcacaacagaattcagtacctggacattagcgtgttcaagttcaaccaagagctagagtatctggatctcagtcataataaactggtgaaaatttcgtgtcaccctactgtaaacctgaaacacctggatctgtcgtttaatgcctttgacgcactgccaatctgcaaagagttcgggaatatgtctcaactcaagttcctcggcctttccacaacccatctcgagaaatctagtgtgttgccaattgcccaccttaatatctcaaaggtcctcctggtcctcggcgagacctatggtgagaaggaagaccccgagggtttacaggacttcaacaccgagagcctacacatcgtgttcccgacaaataaagagtttcattttatcctcgatgtgtccgtgaagaccgtggccaatctcgagctctctaacatcaagtgcgtcctggaagataacaaatgctcatacttcctgtccattctcgcgaagctgcagacgaacccgaaattgtctaaccttacgctgaataacattgaaacaacttggaacagcttcatcaggattctgcaattagtgtggcacaccactgtgtggtacttctctatctccaacgtgaagctgcagggacagcttgatttcagggattttgattattctggcacctccctcaaagccctttcgatccaccaggtggtgtcagacgtatttggtttccctcagtcatacatttacgagatttttagcaatatgaacatcaagaactttaccgtctccggaacccgcatggttcacatgctttgtccttcaaagatctcccctttcctgcacttagattttagcaacaacctgttaactgataccgtattcgaaaattgtgggcacctgacagagcttgaaaccctgatcctgcagatgaatcagttaaaagagctttcaaagattgctgaaatgaccacccaaatgaagagtcttcaacagctggatatcagtcaaaactcagtgtcttatgatgaaaaaaagggggactgttcctggaccaagtccttattatcactcaatatgtcaagtaacatcctgaccgataccatctttcgctgcctacccccaaggattaaggttcttgacctgcatagcaataagattaaatccattcccaagcaggttgtcaagctagaagccctacaggagctgaatgttgcttttaatagcctgactgaccttcccggttgtggcagtttctcttccctgtcagttctcataatcgatcacaattcagtgtcccatccctcggcggatttcttccagtcgtgccagaagatgcgtagtatcaaagctggcgacaacccatttcagtgtacctgcgaactgggtgaattcgtgaagaatatcgaccaggtatcatccgaggtgctcgaaggctggcccgatagctacaagtgcgactaccctgaatcctaccgcggaacactgcttaaggacttccatatgtctgagcttagctgtaacattacactcctcatcgtgacaatcgtggctaccatgctggtgcttgccgttactgtgactagcctttgtagttatctggacctcccgtggtacctgaggatggtgtgtcagtggacccagactcgccggcgagcccggaatattccactggaagagctccagcggaatctgcagtttcacgcattcatctcatacagcggtcatgacagcttttgggtgaaaaacgaactgctgccaaacttggagaaggaaggaatgcagatctgtctgcacgagagaaatttcgtgcctggcaagtccatagtagagaacatcatcacttgtatagagaagagctacaaaagcattttcgttttaagcccgaactttgtacagagcgaatggtgccactatgagctgtattttgctcaccacaacctctttcacgaagggagcaattcgctgattctcattctgcttgaacccatcccacagtactcaattccgtcctcttaccacaaactcaagtcacttatggccagacgcacatacctcgaatggccgaaggagaagtccaagcggggcttgttctgggcgaatctgagagctgcaatcaacatcaaactcaccgaacaggcgaagaagtag

SEQ ID NO: 208810 - DNA, 2361 bp, Artificial Sequence
  Description of Artificial Sequence: Synthetic coding sequence
atgaccagcatcttccacttcgccatcatcttcatgctgatcctgcaaatccgcattcagctgtccgaagagtcagagttccttgttgataggtctaagaatggactgatccacgtgcctaaagacctctctcaaaagacaactatcctgaacatcagtcagaattacataagcgaactctggacttctgatattctcagcctgtccaaactgagaatcttgattataagtcataaccgcatccagtacctggatatcagcgtgttcaaattcaaccaggagctggaatatttggacctgagtcacaataaacttgtcaaaatctcctgtcaccctacagtgaatctcaagcacctcgacctgagttttaacgcctttgacgcattgcccatctgcaaggaattcggaaacatgtcacaactgaaatttctgggactttctactacccaccttgaaaagtcttcggtgcttcctattgcacacctgaacatatcgaaggtcttgctggtactgggggagacctacggcgagaaggaagatccagaaggtttacaggactttaacaccgagtcactgcatattgtctttcctacgaacaaagaatttcattttattctggacgtctctgtcaagacagtagcaaatctggagctcagcaacatcaagtgcgtgctagaagacaacaagtgctcatattttctgtccattcttgccaaactgcagactaatccgaagctgtcaaatctgacactgaataatatcgagacaacatggaacagcttcatacggattctgcagcttgtatggcatactaccgtttggtacttctccatatctaacgtaaagctccagggacagctggactttcgggacttcgattactccgggacctccctgaaggccttgtctatccatcaggtggtcagcgatgtgttcggcttcccccagagctacatttatgaaatcttttcaaatatgaatattaagaactttactgtaagtggtaccagaatggtgcatatgctgtgtccgtccaagatttctcctttcttgcatttggattttagtaataacctgctcactgataccgtgttcgaaaattgtggtcatttgacagagctggagaccctcattttgcaaatgaatcagctgaaggagctttctaaaattgcagagatgaccactcagatgaagtcccttcagcagctggacattagtcagaatagcgttagctatgatgaaaaaaaaggagactgtagctggaccaagtccctcctgtcactgaatatgtcttccaatatcctcacagacaccatcttccggtgcttaccacctaggattaaggtactggacctgcattctaacaagatcaaaagcataccaaagcaggtggtaaaattggaggcgctacaggagctgaatgtcgcctttaactccctaactgatctaccgggctgcggatccttcagcagtctcagtgtccttataatagaccacaattccgtgtcccatccttccgccgactttttccagtcttgccaaaagatgcggtccattaaggcaggtgataaccccttccagtgcacctgtgagctgggagaattcgtgaagaacattgaccaagtctcctctgaggtgctggagggttggcctgactcttacaaatgcgactatccagagtcctatcggggaacacttctcaaggatttccacatgagcgaattaagctgcaacatcacgctgctgatcgtcactattgtagcaaccatgctggtgcttgctgtgacggttaccagcctctgctcataccttgacctgccctggtatctgagaatggtgtgccagtggacacagacaaggcgtcgggctcgaaatatccccctggaggagttacagcgtaatttgcaattccacgcatttatctcctatagcggtcacgactccttttgggttaagaacgagctcttgcccaatctggagaaggaaggcatgcagatctgtctgcacgagagaaattttgttcccggcaagtccattgtcgagaatattatcacctgcatcgagaaatcatataaatctatcttcgtactctcccccaactttgtgcaatccgagtggtgtcactacgagctgtacttcgcccatcataatcttttccatgaaggaagcaacagcctgattcttatcctactggaaccaattccacagtactcaatcccctcgtcctaccacaagttaaagagcctgatggcccgtcggacctacttagaatggccgaaagagaaatccaaacgaggactattctgggcaaacctgagagccgctatcaacatcaagctcacagagcaggccaaaaagtag

SEQ ID NO: 208811 - DNA, 486 bp, Artificial Sequence
  Description of Artificial Sequence: Synthetic coding sequence
atgaccagcatcttccacttcgccatcatcttcatgctgatcctgcagatcagaattcaactctctgaagaaagtgagtttctcgtagaccggtctaagaatgggctgatccacgtaccaaaagacctgtctcagaaaaccactatcctcaacatcagccagaactatataagcgagctatggacatccgatattctgtccttgtccaaattgcggattctcatcatcagtcacaaccgaatccagtatctagatataagcgtgttcaaatttaaccaggagttagagtatttggacctctctcataataaactggtcaagattagttgtcaccctaccgttaatcttaaacacctcgacttgtcattcaacgccttcgacgccctccctatatgcaaggagtttggcaacatgagccagctgaaattccttggactttccaccacacatctcgaaaagagcagcgtgctgcccatcgcccactag

SEQ ID NO: 208812 - DNA, 147 bp, Artificial Sequence
  Description of Artificial Sequence: Synthetic coding sequence
atgaccagcatcttccacttcgccatcatcttcatgctgatcctgcagattagaattcaattgtccgaagagagcgagtttttagtggacagatctaagaatggactgattcacgtacctaaagatcttagccagaaaaccacttag

SEQ ID NO: 208813 - DNA, 72 bp, Artificial Sequence
  Description of Artificial Sequence: Synthetic coding sequence
atgaccagcatcttccacttcgccatcatcttcatgctgatcctgcaaatcagaatccaactgagtgaatag

SEQ ID NO: 208814 - DNA, 273 bp, Artificial Sequence
  Description of Artificial Sequence: Synthetic coding sequence
atgaccagcatcttccacttcgccatcatcttcatgctgatcctgcaaatcagaatccagctttccgaagagtccgagtttctggtggaccggagcaagaatggcctgatacatgtcccaaaagacctcagccaaaagaccacaatcctgaacataagccagaattacattagcgagttgtggacgtccgacatactgtcgctctctaagttacgaattctgattatctctcataatcgaatacagtacctggacatttccgtgttcaaatag

SEQ ID NO: 208815 - DNA, 2355 bp, Artificial Sequence
  Description of Artificial Sequence: Synthetic coding sequence
atgccccacaccctgtggatggtgtgggtgctgggcgtgatcatcagtctgtccaaggaggagtccagtaaccaggccagcctgtcctgcgaccggaatggcatttgtaaaggatcaagtggaagtctgaattccatccctagcggcctgaccgaagctgttaagagcctcgatctgagtaacaataggatcacctatatcagcaactctgacctgcagcgatgcgttaacttgcaggccctggtactcactagcaacgggataaatactattgaagaagacagtttttcgtcgctagggagccttgaacatctggatctttcgtataactatctgagtaatctatccagctcctggttcaaacctctttcctccctcaccttcctcaacctattgggcaatccctataagacccttggcgagaccagcttgttttcccacctgacaaaactgcagatactcagggtgggcaacatggacactttcactaaaatccagagaaaagactttgcagggttgacatttttagaagaattagagatcgacgcttccgacctacagagttacgaacctaagagcctgaagagtatccagaatgtgtctcatcttatactccacatgaagcagcatatcttactactagagatctttgtggacgttaccagcagtgtggagtgtctggagttgcgggatacagatctggacaccttccatttttccgagctctctactggtgagacgaattctctgatcaagaaattcacctttcggaacgtaaaaataaccgacgagtctctattccaagtaatgaagctactgaaccagatctccggtctgttggagcttgagtttgacgactgcaccctgaatggggttggtaactttagagcttcagacaatgatagggtgattgatccgggcaaggtagagacactgactatcagaaggttacatatcccccggttttatctgttctatgacctgtccacactctattctctaaccgaaagagtcaaaaggattaccgtcgagaactcaaaagtatttctagtgccttgtctgctcagccagcacctaaaatcgttggaatatttagacctttctgaaaacctgatggtagaagaatatttgaagaatagcgcgtgcgaggacgcttggccctctctgcagacccttattctgcgtcagaaccacctggcaagcttggagaagactggcgagacgctgctcaccctcaagaatctgacgaatattgacatctccaagaacagttttcattccatgcccgagacgtgtcaatggcccgagaagatgaagtacttaaatctttctagtacacgcatccacagcgtgaccggatgcatacccaagacccttgagattctggatgtgtccaataataatctcaatctgttcagtctcaacctcccacagttaaaggaactgtacatatcccggaataagctcatgacactgcctgatgcttccctcctaccgatgttgctggttttgaagatctctagaaacgcaatcacaacattcagcaaagagcaattggacagcttccacaccctgaaaaccctggaggccggcggtaacaatttcatatgttcctgtgagtttctgagtttcacccaggagcagcaggcactcgcaaaagttttgatcgactggcccgccaactatctatgcgattccccctctcatgtaagagggcagcaggtgcaggatgtccggttatcagtgtccgagtgccaccggacagctctcgtatccggcatgtgctgcgcactgtttctgcttatccttcttaccggtgtcctctgccaccgattccacgggctgtggtacatgaaaatgatgtgggcatggttgcaggccaaaaggaaaccgcgcaaggccccttccagaaatatctgttatgatgccttcgtttcatatagtgagcgcgatgcatactgggttgagaacctgatggttcaggagctcgagaatttcaaccctcctttcaagttatgtctgcataagcgcgattttatcccagggaaatggattatagacaatatcattgatagtattgaaaagtctcataagacagtgtttgttttgtcagagaactttgtaaaatccgagtggtgtaaatatgaattagacttttcacacttcagactgttcgacgagaacaatgacgcagcgattcttattctgttagaaccaatcgagaagaaagctatcccgcagaggttttgtaagctccgaaaaatcatgaacacaaaaacttatctcgaatggcctatggatgaagcccaaagagagggcttctgggtcaaccttagagcagccattaaatcttag

SEQ ID NO: 208816 - DNA, 2715 bp, Artificial Sequence
  Description of Artificial Sequence: Synthetic coding sequence
atgcggcagaccctgccctgcatctacttctggggcggcctgctgcccttcggcatgctgtgcgcatccagcacaactaaatgtaccgtgagccacgaggttgccgactgcagtcacctcaaacttactcaagtaccagatgatcttcctactaacataaccgtgctgaaccttacgcataatcagctccgtcggctgcctgcagctaacttcacccgatactcccaactgacctctctggacgtgggattcaacactatatctaaactcgaacccgaactatgtcagaaattgcccatgctcaaggttctcaacctgcagcacaacgagctgagccagctgtcagacaagacattcgccttttgcacaaatctgacggagttgcaccttatgtctaactccattcagaagatcaaaaacaacccctttgttaagcagaagaatctgataaccctggacctttctcataacggactatcttcaacaaaacttggaacacaagttcagctagagaacctgcaggaactgctgttgtctaacaacaaaatccaagccttaaaatccgaggagctcgacattttcgcaaactcttctcttaagaaacttgaattgtcttcaaaccagataaaggagttttcacccggctgcttccacgccattgggaggttatttgggctgttcttgaacaatgtccagttggggcccagcctgaccgagaagctttgcttggagttggccaataccagcataagaaatctgtctctcagcaatagtcaattatcgacaacctctaacacgactttcctaggtctgaaatggacaaacttgactatgctcgacctgtcatacaacaatctcaacgtcgtgggcaatgactcctttgcttggcttccacagctggaatactttttcctggagtacaacaatatccagcacctgttttcccattcactgcacgggctgttcaatgtcagatacttgaacctgaagcggtccttcacgaagcagagtatctccttagcttctctccccaaaatagatgacttttccttccagtggctgaaatgcctagaacacttaaacatggaagataacgacatcccaggaatcaaatccaatatgttcacaggtctgatcaaccttaagtatcttagtctgagtaacagctttacctcattgagaaccctaactaacgagacatttgtgtctctggcgcacagccccctacacattttaaaccttacaaaaaataagatttctaaaatcgaatcagacgctttttcgtggctaggtcatctggaggtgctggatcttggactcaacgagattggacaggaacttactggccaggagtggcgaggactcgaaaatatatttgagatctatctcagttacaataaatatctccagctaacacgtaatagcttcgcgctggtaccttctctccaacggcttatgctaagacgcgtcgctctgaaaaatgtggattcatcccccagccctttccaaccactgcggaatctgacaatattggacctcagcaacaacaacattgccaacattaacgacgacatgctggaggggttagagaaactggagatcctggacttacagcacaataatttggcacgcctgtggaaacatgcgaacccgggcggaccaatctactttctgaaaggactgtcccacctacacatcctgaatctggagtccaacggcttcgacgagattcccgttgaagtgtttaaggacttattcgagttaaagattatagacctgggtctgaacaatttgaacacactgccagcaagtgtgttcaacaaccaggtgtctctgaaatcccttaacttgcagaagaatctgatcacttccgtggaaaaaaaagtgtttggaccagccttccgtaacctgacagagctcgacatgagatttaacccttttgattgtacgtgcgaatccatcgcctggttcgtgaactggatcaacgagactcacacaaacataccagagcttagctcacactacctctgtaatacgcctccgcactatcacggtttcccggtgagactgtttgacacctcatcctgtaaggatagcgctccgttcgaattgttctttatgatcaataccagcatactgctgatattcatttttatcgtactgctgatccatttcgagggatggcgaatctctttttattggaatgtgtccgttcatagagtactgggctttaaggaaatcgataggcagacagagcaattcgagtatgcagcttatatcattcatgcttataaagataaggactgggtgtgggagcactttagttcaatggaaaaagaggatcaaagcctcaagttttgcctagaggaaagggacttcgaggcaggagtattcgagctggaggccattgtgaactccattaaacggtcacgcaaaatcatcttcgtgataactcaccatttgctcaaagaccccttgtgtaaaaggtttaaagttcaccacgccgtccagcaggccatcgagcagaatctagacagcataattttagttttcttggaagaaattcccgactataaacttaaccacgctttatgtctgaggcgagggatgtttaagtcacactgtatattaaattggcctgtgcagaaagagcggataggcgccttccggcataagctccaggtggccctcggatccaaaaatagcgtgcactag

SEQ ID NO: 208817 - DNA, 1884 bp, Artificial Sequence
  Description of Artificial Sequence: Synthetic coding sequence
atgctggacctgagctacaacaacctgaacgtggtgggcaacgacagcttcgcctggctcccacaacttgagtattttttcttagaatacaacaacatccaacacctgttctctcactctctgcacggcctctttaatgttcggtatcttaatctcaagaggagttttacaaagcagagcatcagccttgcttcactgcccaagatagacgactttagcttccagtggctaaaatgcctggagcatctaaacatggaggacaatgatatccctgggattaaaagtaacatgtttacaggactcattaacttgaagtatctaagtttaagcaactcgtttacaagcctgcggactcttactaacgagacgttcgtttctttggcacattctccactccacattctcaatctcaccaaaaataagatatccaaaatcgagtctgatgctttttcctggctcggtcatttagaagtgctggatctgggtctcaatgagattggccaggagctgactgggcaggagtggagaggtctggagaacatcttcgagatctatctgtcctacaacaaatacctgcagttaactcggaactcctttgctttggttccatccctacagaggctgatgctgcggcgggtcgccctgaaaaacgtagacagttcaccttcaccttttcagccactgcgcaatctcacgattctggacctctccaataataacatcgccaatatcaacgacgatatgctcgagggtctggaaaaactcgagatactggacctgcagcataataacctcgctaggctgtggaaacacgccaaccctggagggcccatttatttccttaaggggctcagccatctgcacatcttgaacctggaatctaacggctttgacgagatacccgtcgaagttttcaaggacctgtttgaactcaagattatcgacctgggattaaacaatcttaatacgctgcctgctagcgtattcaataatcaagtgtcgctgaaatcgctgaacctgcaaaaaaacctcattacatccgtagagaagaaggtgttcggacccgctttcaggaatttaactgaactggacatgcggttcaacccctttgactgtacttgtgagagcatcgcatggtttgtcaactggataaacgagactcacacaaatattcccgagctgtctagtcactatctgtgcaacacccccccgcattatcacggttttccggtgcggctgtttgacacaagcagctgcaaagatagcgctcccttcgagctcttctttatgatcaatacatctattctcctcattttcattttcatcgtgttgctgatacattttgaaggctggagaattagcttctattggaacgtgagcgtccacagagttctcgggtttaaggagatcgataggcagaccgaacaatttgaatatgcagcttatatcatccatgcttacaaggataaagattgggtgtgggagcacttctcttccatggaaaaggaagatcagtcactgaagttctgcctcgaagagcgagacttcgaggcaggagtgtttgagttggaggccattgtcaattctatcaagcggtcacgcaaaatcatcttcgtcattacccatcacttattgaaggatcctctctgcaaaagatttaaagttcatcacgccgtgcagcaggcaatcgagcagaatctagattctataattctggtattcctggaggagattcccgattacaaactcaaccacgccctttgtctaagaagaggtatgttcaaaagtcactgcattctcaactggcccgtacagaaggaacgcattggcgcctttcggcacaagctccaggtagctttgggaagcaagaactctgtacactag

SEQ ID NO: 208818 - DNA, 2613 bp, Artificial Sequence
  Description of Artificial Sequence: Synthetic coding sequence
atgcggcagaccctgccctgcatctacttctggggcggcctgctgcccttcgggatgttgtgcgctagctcaacaactaaatgtacagtcagccacgaggttgccgactgttcccacctgaaactgacccaggtgcctgatgacttgcccacgaacattacagtactgaaccttacacacaatcaactcaggagactgcctgcggctaactttactcggtactcacagttaacctctctcgacgtcggattcaacactatatctaagctggaacccgagctttgccagaagctcccaatgctcaaagtcctaaaccttcagcacaacgagctgtcacagttaagcgacaaaacttttgcgttttgtactaatctgaccgagctccacctcatgagcaattcaattcagaagatcaaaaacaaccctttcgttaagcaaaaaaacctgattacgctcgacttatcacacaacggattgagcagtaccaaactcggcacccaagttcagctggagaatctgcaggaattgttgctatctaacaataagatccaggctttaaaatccgaggagttagatatcttcgccaactcctctttgaagaagttggagctgtcgtccaaccaaattaaagaatttagccccggctgtttccacgccattggtaggctgtttggcctcttcctcaataatgttcagctgggacccagtctgaccgaaaagctttgccttgaactggccaacacaagcatccgcaacttaagcctcagtaactcacaactgtctaccacaagcaacactacttttcttggtcttaagtggaccaacctgaccatgctcgacctttcttacaataatctgaatgttgtgggcaatgacagcttcgcatggctgccacagcttgagtattttttcttggaatataacaacatacagcatcttttttcccactcgctgcacggtctgtttaacgtgagatacttaaatctcaagcgatcttttacaaagcagagcattagcctcgcctccttgcctaagatcgacgatttctccttccagtggctcaaatgcttggaacatcttaatatggaagacaacgacattcccggtatcaagtctaatatgttcactgggcttatcaacctgaagtacctctccctgagtaatagctttacctccctgagaaccttgacaaatgagacttttgtgtcactcgcccattccccattacacattctcaatctcaccaaaaacaagatttctaaaattgagagcgacgcgtttagttggctgggacatctggaggtgctggacctcggattgaatgagatcgggcaggagctgaccggccaggagtggaggggcctggagaacatcttcgaaatatatctgagctataacaagtacctgcagttgacgaggaactcatttgcactggtgccctccctgcaacgactgatgcttcgcagagtggcattaaaaaacgtggactcctccccatcacccttccagccattgcggaacctgactatcctggacttaagtaacaacaacatcgccaacataaacgacgacatgctggagggcctggaaaaactggagattctcgatctgcaacacaataacctggctaggctgtggaaacatgccaacccgggagggcccatttatttcctcaagggactctcccacctccacatcctgaacttggagtctaatggtttcgacgagatcccggtggaagtcttcaaggatcttttcgagctgaagatcatcgatctgggtctgaataatctgaacacactgcctgcaagcgtgttcaataaccaggtatctctgaagagtctaaacctgcagaagaatctgatcacttctgtcgagaagaaggtattcggacctgcgttcaggaacctgaccgagttagatatgagattcaatcctttcgactgtacctgcgaatccatcgcctggttcgtgaattggattaacgaaacccacacaaatatccccgagttgagcagccactatctctgcaacaccccaccacattaccacggatttcccgttcgcctctttgatacaagtagctgcaaagactctgcccccttcgaactcttcttcatgataaacacgagcatcctactgatttttatcttcatagttctcctgatccactttgagggctggagaatttctttttactggaacgtcagcgtgcatagagtcttaggcttcaaggagatcgacaggcagaccgagcagtttgaatatgccgcttacatcatacatgcctacaaggacaaggactgggtctgggaacacttttcttccatggaaaaagaagatcagagtctgaaattttgtctggaggaacgagattttgaggccggagtgttcgagctcgaagccattgtgaattccatcaaacggtctcgaaaaattatttttgtcataactcaccacctgctaaaggaccccctgtgcaagcggttcaaggtgcaccacgctgtgcagcaagccatcgaacagaacctggatagcatcatcctagtttttctggaggagattcctgattacaagctcaatcacgctctctgcttgaggcgcgcaaaatag

SEQ ID NO: 208819 - DNA, 2391 bp, Artificial Sequence
  Description of Artificial Sequence: Synthetic coding sequence
atgaccaaggacaaggagcccatcgtgaagagcttccacttcgtgtgtctaatgattatcatagtgggtacaaggatccagttttcagatgggaatgaatttgccgtcgacaagtctaagcgtgggcttatccacgtccccaaggatctgcctctgaagacaaaagtgctggacatgagtcagaactacatagcagagttgcaggtgtctgacatgtcctttctgtctgagctaactgtgctgaggctcagccataacagaattcagctgctcgacttgagcgtgttcaagtttaatcaggacctcgagtacctggacctgtcccacaaccagctgcagaagatcagctgccacccaatagtctccttccgtcacctggatttgagttttaatgattttaaagcgctaccgatctgtaaggaatttggcaacttgagtcagttgaactttctcggactgtccgcaatgaagctccaaaagctggacctcctccccattgcccacttgcatctgagctatatactgctggatctgaggaattattatatcaaagaaaacgagactgagtcccttcagatcctcaacgcgaaaacgcttcatctggtgtttcaccccacaagcctcttcgctattcaggtgaacatcagtgtcaacacacttgggtgtttacagctgaccaacattaagctcaacgacgataattgtcaagtctttattaaatttctgtctgaactcacaagaggttcaactcttttgaatttcaccctgaatcacattgagaccacgtggaagtgcttagttcgcgttttccaattcctttggcctaagccagtggagtatctgaatatatataacttaactatcatagagagcatacgcgaggaggacttcacctattcgaagactactctgaaggctctcaccatcgagcatatcactaatcaggtgtttctcttttctcaaaccgccttgtacacagtgttctcagaaatgaacatcatgatgcttaccatcagcgacactccgttcattcacatgttgtgcccacacgcaccgtccacgttcaaattccttaacttcacacagaatgttttcactgactccattttcgagaagtgttctactctggtgaaactggagacgctgattttacaaaaaaatggtctgaaagatctgttcaaagtcggccttatgacgaaagacatgccatccctggagatcctggatgtcagttggaactcattggagagcggaaggcataaagaaaactgcacatgggtagaatccattgtggtgcttaacctgtcctcaaatatgttgactgattcagtgttccgatgcctacccccccgaatcaaggtgttagatcttcacagtaacaaaatcaaatcggtgcccaaacaagttgtgaaactggaagccctgcaggagctgaacgtcgcattcaattccctgactgacctgcccggttgtggctctttctcgtcccttagtgtactgattattgaccataactcagtgagccaccccagtgcagattttttccagtcatgccagaaaatgcgttctattaaagctggagacaaccccttccagtgcacttgtgaactgcgagagtttgtgaagaacattgatcaggtgtcaagcgaggtcctggaaggctggcccgattcgtacaaatgtgactatcccgaatcataccgagggtccccacttaaggacttccatatgagcgaattgtcctgcaatatcacactgcttatagtgaccatcggcgccactatgctggtgcttgctgtgacagtcacttccctctgtatttacctggacctgccatggtatttaagaatggtgtgccaatggacgcagaccaggcgaagggcccgaaacatccctttagaagagctacagcgcaacctccagtttcacgcatttatttcatatagcgagcacgactcagcgtgggtcaaaagtgaacttgtgccttatctcgagaaggaggacattcagatttgtttacacgagagaaatttcgtaccagggaagtcgattgttgagaatattattaattgcatcgaaaaatcatacaagtccattttcgtcctatcaccaaacttcgttcaatcagaatggtgccattatgagctctattttgcccaccacaacctgtttcacgaagggtcaaacaacctgattctgattttgctcgagcctattccccagaacagcatccctaataagtaccataagttgaaggccctgatgactcaaagaacgtacctgcaatggcccaaagagaaaagcaaacgggggctcttctgggcaaacattagagctgcctttaacatgaaactcacactcgtgacagagaataatgatgtcaaaagctag

SEQ ID NO: 208820 - DNA, 2391 bp, Artificial Sequence
  Description of Artificial Sequence: Synthetic coding sequence
atgaccaaggacaaggagcccatcgtgaagagcttccacttcgtgtgtctgatgattatcatcgtggggactcgaattcagttctctgacgggaatgaattcgctgtggacaagtcaaaacggggactcattcacgtccccaaagacttacccctgaaaacaaaagtcctcgatatgtcccagaattatatcgctgagcttcaggtgtcagacatgtctttcttatctgaactgactgtgctcagactgtcccacaatcgcatacaactgctcgacctgtccgtgtttaagtttaaccaggaccttgagtatttggacttatcacacaatcagctacagaagataagctgtcatccgatcgtgagcttcaggcatctggacctgtcttttaacgactttaaggccctccctatatgcaaagagttcggaaacctgtctcagctgaattttctgggacttagcgctatgaagcttcagaaactggacctgcttcctatcgcgcacctgcatctttcttacatcttactggacctgcgtaattactacatcaaagagaatgaaacagaaagcctgcagatattgaatgccaagaccctgcacctggtgtttcatccgacttcacttttcgctatccaggtcaatataagcgtaaatactctcgggtgtcttcaactgactaacattaagctgaatgacgataattgccaggtttttataaaattcctgagcgaactgactcggggatccactttgttgaactttacccttaaccatatcgagaccacatggaaatgtcttgtccgggttttccaatttttatggccgaagcccgtggagtacctgaacatctataaccttacaattattgagtccatcagagaggaagacttcacgtattccaagaccaccctgaaagctctaacaattgaacatattacaaaccaggtgtttctgttcagccagactgccctgtacacggtattttcagagatgaatatcatgatgttaactatcagcgacactccattcattcacatgctatgtccccacgcccccagtacatttaagtttctcaactttactcagaacgtatttacggacagcatcttcgagaagtgttcaactctggtgaaattggaaacattgattttacaaaagaacgggttgaaagacctgttcaaagttggcttgatgacaaaggacatgcccagcctggagattttagatgtctcctggaactcactggagagcggcaggcacaaggagaactgcacctgggtggagtctattgtggtgctgaatttgtcatcaaacatgctcaccgactcggtgtttcggtgccttcctcccagaataaaagtcctcgatcttcacagcaacaaaatcaaatcggtccccaagcaagtcgtcaagctcgaggctcttcaggagctgaacgtggcctttaattcattgacagatcttcctggttgtgggtctttttcgagcctttccgtgctgattatcgatcacaacagtgtgagccaccctagtgcagactttttccaatcttgccagaagatgcgaagcatcaaggcgggcgataacccatttcagtgtacatgcgaattgcgggagttcgtgaagaatatagatcaggtcagttcagaggttctggaagggtggcctgattcatataaatgcgactaccctgaatcatatagaggcagtcctctcaaagattttcacatgagcgaactgtcgtgcaatattacgttattgatcgtcaccatcggtgctacaatgttggttttggcggtgacagtcacgtccctgtgcatttaccttgacctgccttggtacttgcgaatggtgtgccaatggacacagacccggcgcagagctagaaatattcccctggaggaactgcagaggaacctccagtttcacgcatttattagttattctgaacatgacagcgcctgggtgaagtccgagttggtcccctaccttgaaaaagaggatattcaaatatgcctgcatgaacgcaacttcgttcccggtaaatcaatcgttgagaatattattaactgtattgaaaaatcttacaagtctatctttgtgctatccccaaacttcgtccagtctgagtggtgccactacgagttatactttgcccaccataatttatttcacgaggggtccaataatttaatcctgatcttgctggagcccatcccccagaatagtatcccaaacaaataccacaagttgaaggcattgatgacacaacgtacataccttcaatggccaaaagaaaagtctaaacgagggctgttctgggctaacattcgagctgcctttaacatgaaattgactcttgtcacggagaacaacgatgttaagagctag

SEQ ID NO: 208821 - DNA, 453 bp, Artificial Sequence
  Description of Artificial Sequence: Synthetic coding sequence
atgaccaaggacaaggagcccatcgtgaagagcttccacttcgtgtgtctcatgattattatcgtgggtaccaggatacaattctcagatgggaacgaatttgctgtggacaaaagcaaaaggggcctgatccacgtgcccaaggaccttccactcaagaccaaggttcttgatatgtctcagaactatattgcagagcttcaggtgagcgatatgtctttcctgagtgaactgacggtcttgagactctctcataacaggattcagcttcttgaccttagtgtgttcaagttcaatcaagatctggaatacctggatctgagccataatcagctccagaaaatcagctgtcaccctattgtcagctttcgccacctggacctctccttcaatgacttcaaggctctgcccatctgtaaggagtttgggaacctgtctcagctcaatttctag

SEQ ID NO: 208822 - DNA, 1443 bp, Artificial Sequence
  Description of Artificial Sequence: Synthetic coding sequence
atgaccaaggacaaggagcccatcgtgaagagcttccacttcgtgtgtctcatgatcatcatcgttggcacccgtattcaattttctgacggcaatgaattcgccgtcgacaagtctaaacgcggccttatccatgtgcccaaagatctgcctctcaaaacgaaagtgctggatatgtcccagaactacatcgccgagctgcaggtgagcgatatgtcattcctgtctgagctcacagtgttgcggcttagccataaccgcattcagctgctcgacctctcagtgttcaaattcaatcaagatttagagtatctcgacctcagccataatcagcttcagaagattagctgccaccctatcgtgtcatttcgtcacctggacctgtcctttaatgacttcaaggcactccccatatgcaaggaatttgggaacctgagccagcttaactttctgggtctgtccgccatgaaacttcagaagctggatctgctgcccatcgctcaccttcatctctcttacattctgctagacctgcgcaattattatattaaagagaatgagaccgaaagtctgcagatcctcaatgctaagacactacatctcgtgttccaccccacgagtctctttgctatccaagtgaacatttccgtcaacaccttgggatgccttcagcttaccaacataaaattgaatgacgataattgccaagtgttcatcaaattcctgtccgaactcacgaggggatcaactctcctgaattttactctgaatcacatcgagaccacctggaagtgcttagtaagggtgtttcaattcctgtggcctaagcctgtcgagtatcttaacatctataatcttacgatcattgaatctattagggaggaagattttacttattccaagacaaccctaaaagcgttgacaatagagcacatcaccaaccaggtgtttttgttctcccagacagctctgtacaccgtgttttccgagatgaacatcatgatgctgactatttctgataccccatttatccacatgctgtgcccccacgctccatctacctttaaattcctgaattttacacagaacgtgtttaccgatagcattttcgagaagtgctctaccctggtgaaactggaaaccctcatcttcgtgctttctcctaatttcgtgcagagcgaatggtgtcactacgagctttattttgcccatcataatctctttcacgaaggatccaacaacctcatcctcatcttattggagcccataccacagaatagcatccctaacaagtaccataaactaaaggcactgatgacacaaagaacttacctgcagtggcccaaggagaagtcgaaaaggggactgttctgggcaaacatccgggccgccttcaatatgaagcttactttagtcacggagaacaacgacgtgaaaagctag

SEQ ID NO: 208823 - DNA, 276 bp, Artificial Sequence
  Description of Artificial Sequence: Synthetic coding sequence
atgaccaaggacaaggagcccatcgtgaagagcttccacttcgtgtgcctcatgatcataattgtaggtaccagaattcagttctcagatgggaatgaattcgctgttgataaatccaaacgcggcctgatccatgttcctaaggatttgccactgaaaaccaaagtgctggacatgtcccaaaactatatagccgagctgcaggtctccgacatgtcttttctgtctgaactcactgtactccggttgagccataatcggattcaattgctgtag

SEQ ID NO: 208824 - DNA, 3150 bp, Artificial Sequence
  Description of Artificial Sequence: Synthetic coding sequence
atggtgttccccatgtggaccctgaagcggcagatcctgatcctgttcaacatcatcctgatcagcaagctcctgggtgccagatggtttcctaagaccctgccctgcgatgtgaccctggatgtgcctaaaaatcatgtcatcgtggattgtacagataagcacctgactgaaatcccgggcggaattcccacaaacacaactaatctgactctgaccattaatcacataccagacattagtcccgcctcattccatcgactggaccacctggtcgaaatcgatttccggtgtaattgcgtcccaattcctctaggatccaaaaacaatatgtgtataaaacgcctacaaattaagccccgttcgttctcaggtctcacatacctcaaatctctttacctcgacgggaatcaactcctagagatcccccagggcctccctccctccctgcagttattaagccttgaggccaataatattttttcgatacggaaagaaaatttaaccgagctggcaaacatagagatcttgtacctagggcagaactgttactaccgtaacccctgctatgtgtcctacagcatagagaaggacgcatttcttaatctgaccaaattaaaagtactctccctcaaagacaataacgttaccgcagtccctactgttctcccgtcaactctcaccgagctatatttgtacaacaacatgatagctaaaatacaggaagatgattttaacaacctcaaccagctgcagattctcgacctttcaggcaactgccctaggtgctacaatgctcccttcccatgcgctccatgcaagaataatagccctctacagatccctgtgaacgctttcgatgcgctgacagagctcaaagtgctccggctgcactctaatagcctgcagcatgtgcctcctcgctggttcaagaatatcaataagctgcaagagctcgacctctcccaaaacttcttggccaaagagattggtgacgcaaagtttctgcatttcctacctagcttgatccagctggatctatctttcaattttgagctgcaggtgtacagggcaagtatgaatttgagtcaggccttctcttcattgaagtctctcaagatcctgcgcatacgcggatacgtgttcaaagagctcaaatccttcaatttaagtcctctgcataacctgcaaaatcttgaggtgctcgatttggggaccaactttatcaagatcgcaaacctgtccatgttcaagcagtttaagcggctgaaagtgatagacttgtcagtgaataaaatctcaccctccggtgattctagcgaggtcgggttttgcagcaacgccaggacctcagttgagtcatacgaacctcaggtcctggagcagctgcactatttccggtatgataaatatgcccgctcttgcaggtttaaaaacaaagaggccagtttcatgtcagttaacgagtcatgttacaaatacggccagactctagatctgtcgaagaactccatcttcttcgttaagagtagcgatttccagcacctcagctttttgaagtgcctcaatctgagcggcaatctaatctcacagaccttaaacggtagcgagttccaaccattggctgaattgagatacttagatttttcaaataacaggctggacctgttacatagcaccgccttcgaggaactgcataagctcgaagttctggacatctcctccaatagccactattttcaaagcgagggaattacgcatatgctgaatttcactaagaatctcaaggtcctccaaaagctgatgatgaatgataatgatattagttctagcacctcccgtacgatggaatccgagagcctccgaacactcgaatttaggggtaaccatctggacgtgctctggagagagggcgataacagatatctacagttattcaaaaatttgctcaaactggaggagctagacattagcaagaactcactgtcgtttctcccctcgggcgtgttcgacggcatgccacccaatctgaagaatcttagtttggccaagaacggcctgaagtcattcagctggaagaaacttcagtgcctgaaaaacctggagactctcgatttatcacacaaccaattaacgaccgtgcccgaacgactttctaactgttctcgctccctgaagaatctgattttgaaaaataatcagattaggagtctcaccaagtacttcctgcaggatgccttccagctgcgctacttagatttgtcatctaataagatccaaatgatccagaagacctcattccctgagaacgtgctgaataacttgaagatgttgttgctccatcacaaccgtttcctgtgcacatgcgacgccgtgtggtttgtgtggtgggtcaatcacaccgaagtaacaatcccttacctggcaacagacgttacctgtgtgggccccggcgcccataaaggccaatccgtgatctcactcgacttatatacttgtgagctggatctaacaaatcttattttgttttctctcagcataagcgttagcctgttcctgatggtgatgatgacagcatctcacctctacttctgggacgtctggtacatctatcacttctgcaaggctaaaataaaaggatatcaaaggcttatttcccctgattgctgctacgacgcctttatcgtgtacgacaccaaggatccagcagtcactgagtgggtactagccgaactggtcgcaaagctcgaggaccctagagagaagcactttaacctgtgtctcgaggagagggactggctgccaggccaaccagtcctggagaacctatcccagtccatccagctgagtaagaagacagtgttcgtgatgactgataagtatgcaaagaccgaaaacttcaagattgccttttatctttctcaccaaaggctgatggatgagaaagttgatgtcattatcctcatatttctcgaaaagcccttccagaagtctaaattccttcaactgcgtaaacgtctgtgcggatcctccgttctcgaatggccaactaatccacaggcacacccatacttttggcagtgtcttaagaacgccttggccaccgacaaccacgtggcttacagtcaggttttcaaggaaaccgtctag

SEQ ID NO: 208825 - DNA, 1074 bp, Artificial Sequence
  Description of Artificial Sequence: Synthetic coding sequence
atgcggcggcagctgcggagccggcgggcccccagcttcccctacagctacaggtatagattggatgatcctgacgaggccaatcagaactacctcgcggatgaagaggaggaagctgaggaagaggctcgggtgactgtcgtgcccaaaagcgaggaggaggaggaggaggaggaaaaggaggaagaggaggaggaggagaaggaagaggaggaaggccagggtcagcctactggcaacgcctggtggcaaaagctacagatcatgagtgagtatctatgggaccctgaacgaagaatgtttttggcccgcacagggcagtcctggtctctgatcctgctgatctatttcttcttctacgcctccctcgctgcagtaataaccctgtgcatgtacacattgttcctaactatcagtccctatattcctacgtttactgagcgggttaaacctcctggcgtgatgatccggccgttcgcacatagtctcaacttcaactttaatgtcagtgagcctgacacttggcagcattatgtcatctcactcaatggctttctacagggctacaacgactccttacaggaggagatgaacgtggactgccctcctggccagtacttcatccaggatggtaacgaagatgaagacaaaaaagcctgccagtttaagaggagcttcctaaaaaattgttcaggccttgaagatccgactttcggctacagcacgggccaaccatgcatcctgttgaaaatgaataggatcgtcggatttcgacccgaactcggtgacccggtgaaagttagctgcaaggtgcagagaggcgacgagaacgatatccgaagcatttcgtattaccctgagagtgcaagctttgatcttcggtactacccctactacgggaagcttacacacgtcaattacacgtcaccccttgtggcaatgcacttcaccgacgtagtgaagaaccaggccgttccagtgcagtgtcagctcaaagggaagggggtgataaatgatgtaataaatgaccggtttgtgggtcgggtcatatttaccttgaacattgagacttag

SEQ ID NO: 208826 - DNA, 3180 bp, Artificial Sequence
  Description of Artificial Sequence: Synthetic coding sequence
atgaaggagagcagcctgcagaacagcagctgcagcctgggcaaggagacaaagaaagagaacatgttcttgcagtcatccatgctgacctgcatcttcctcctgatcagtgggtcgtgcgagctctgcgctgaggaaaacttcagtaggtcttatccctgcgatgagaaaaagcaaaatgacagcgtaattgctgaatgctccaatcgtcgcttacaggaggttccccaaaccgtggggaagtatgtgacagagctggacctttcagacaactttattactcatatcacgaacgagtctttccagggcctgcagaatctcaccaaaatcaacctgaaccacaatccaaatgtgcagcaccagaacggcaaccctgggatccagtccaacgggctgaacattactgatggggcctttctgaacttgaagaaccttcgtgagctgttgttggaggacaatcaattacctcagataccctctggactgccagagtccctcacagaattatccttgatccagaataatatttataacataacaaaggagggaatctcccgcctgattaatttgaagaacctgtacttagcttggaattgctacttcaacaaggtgtgtgaaaaaactaatatcgaagatggggtgttcgagactctgaccaatctggagctgctttctctcagctttaacagtctgtcccatgtcccacctaaactcccttcctcactgagaaaactgttcctaagcaacactcagataaaatatatcagtgaggaggatttcaaggggctgataaacctcacgcttctggatctgtccggaaactgtccaaggtgttttaacgcccccttcccatgtgttccttgtgatggcggggcctcaatcaatatcgaccgatttgcgttccaaaatctcacccaactgcgctatctcaatctaagttccacatcactccgaaaaatcaacgctgcttggttcaaaaacatgccccatcttaaggttttagacttggaattcaactacctggttggcgagatcgcatctggggccttcttaaccatgctaccccgcctggaaatattggatctgtcctttaattatataaaagggagctatccacagcatattaacataagtcggaatttcagtaagctgctgtccttgcgagccctgcatctgcgcgggtacgtgttccaggagttgcgtgaggacgatttccagcctcttatgcagttacccaatcttagcacaatcaatctaggtattaactttattaagcaaatcgactttaaattgtttcagaacttcagtaatctcgaaataatctacctgtccgagaataggatatcaccactggtgaaagatactcgacagagctacgccaactcaagttcctttcaacggcacattagaaaacggagatctaccgacttcgaattcgatcctcactcaaatttttaccacttcacccgtcctctgattaaaccccagtgcgctgcgtacggaaaagcactcgatctcagcttaaatagcattttcttcattggaccgaaccagttcgaaaatcttcccgacattgcttgtctcaatctaagcgcaaactccaatgcccaagtgctgtccggaacagagttcagcgcaatccctcatgttaaatatctcgacctgacaaataatcgcctcgattttgataacgcatcagcattgacagagttgagtgatctcgaggttctcgacctttcttacaactcacattatttccgtatcgccggggtcactcatcacctggaattcattcagaactttacgaatttgaaggttctaaacttgtcccacaacaacatatacacactcacagataagtataatttagagagcaagagcttagtggagctggttttctcaggaaacagactggatatcttgtggaatgacgacgacaaccgatacatctctatttttaaggggttgaaaaacctgactcggctcgacctttccttgaaccgactgaagcatataccgaatgaagcttttcttaatttgcctgccagtctgactgaactgcacataaatgacaatatgctgaagttcttcaactggaccctgctacagcagtttccccggctcgaactgctcgacctcagggggaacaaacttctgttccttacagactctttgagcgactttacctccagtctgcgaactctcctgctcagtcataatcgaatctcccacttgcctagtgggttcctttccgaagtaagttccctgaagcacctggatctgtctagcaatctgctgaagacgataaacaagtcggccttagagacaaaaaccaccactaagctctccatgctggagctgcacgggaacccattcgagtgtacatgtgacatcggagactttaggcggtggatggatgagcatttgaacgtaaaaatacctcggctggtggacgtgatctgcgccagtcctggagatcagcgaggtaagagtattgtgtccctcgagctcaccacgtgtgtaagcgacgtgactgctgtgatcttgttcttctttacattcttcatcacaaccatggttatgttagctgcccttgctcaccacttgttttactgggacgtgtggttcatctacaacgtctgcctggctaaagtgaagggctaccgcagcctgagtacatcacagactttctacgatgcctacatctcttacgacaccaaggatgcctctgtcaccgactgggttatcaacgagctgcggtaccaccttgaagaatcccgcgataaaaatgtactgctctgtctggaggagcgagattgggaccccggactggccattatcgacaacctgatgcagtccatcaaccagtctaaaaaaaccgtgtttgtcttgacaaaaaaatacgctaagtcgtggaacttcaagactgccttctacctcgctttgcaacgcctcatggatgagaacatggacgttattatctttatactgcttgagccagttttgcagcactcacaatacctgagattacgccagcgaatttgtaagtccagcatactgcaatggccggacaatccaaaggccgagggccttttctggcagaccctaagaaacgtggtgctgacagaaaatgattctagatacaacaatatgtatgttgattccattaagcaatactag

SEQ ID NO: 208827 - DNA, 3099 bp, Artificial Sequence
  Description of Artificial Sequence: Synthetic coding sequence
atgggcttctgccggagcgccctgcaccccctgagcctgctggtgcaggcgattatgctggcgatgacgctggccctggggaccctgccagcctttctgccatgcgagttgcagcctcatggtctggtaaactgcaattggttgttccttaagagtgtcccccatttctcgatggcagctccgagaggtaatgttacaagcctgagtctatcctccaaccggatccaccatctgcatgattccgactttgctcacctgccgtcattgcgacatctcaacctaaaatggaattgtcctccagtggggttatccccaatgcatttcccatgtcatatgacgattgagcctagcacatttctggccgtgcccactcttgaagagctgaatttgagttataacaacatcatgactgtgcctgcattaccgaaatccttaatttcattgtccctgtcgcacacgaatattctgatgctagattcagcttctcttgctggcctacatgctctgcggttcctgtttatggatggcaattgctactacaagaacccttgtcgacaggcattggaggtggctccaggtgccctgctcggcctgggaaatctcacccacttatccctgaagtataataatttaactgtggtcccccgcaacctgcctagctccttggaatatctgcttctgagctacaacaggattgttaaattagcacctgaggaccttgctaacctgacagccttaagggtcctcgatgtgggcggaaattgtagaagatgtgaccatgctccaaacccttgtatggaatgtcctcggcattttccccaacttcatcccgataccttctctcacctttcaaggctcgaaggcctggtgcttaaagacagctcattaagttggttgaatgcgagctggttccggggactgggcaacttgagagtgctggatcttagcgaaaatttcctgtacaagtgtatcactaagactaaggccttccaaggcttaacgcagctgcggaaactcaatctctcgttcaactaccagaaacgggtctcattcgcacacctgtctctcgccccatcctttggaagtttggtcgcgctcaaagagctggacatgcacggcattttctttcggtcactcgacgagaccaccctgagacccttggcaaggctcccgatgctgcagacattgcgccttcagatgaacttcattaaccaggcccaattgggcatttttagggcatttcctgggctgagatatgtggatctatcagataaccggattagtggtgcaagtgagctcaccgccactatgggagaggcggatgggggcgagaaggtctggcttcaaccaggggatctggcgcccgcgcccgtcgacactccatcctcagaggacttccggcctaattgtagcaccctgaatttcacattggacctgagccgcaataatcttgtgaccgttcaacctgaaatgttcgctcagctatcccatctccagtgcctgaggttatcccataattgcattagccaggcagtgaacggcagtcaatttctgccattaacaggtctgcaggttctcgatctgtcccataataaactagacctgtatcacgaacatagtttcaccgagctcccccggctcgaggccctcgacctgtcttataattcacaaccattcggcatgcagggcgttggccacaatttcagctttgtggcccacttgcgcaccctgagacacctgtccttagcacataacaatatccacagccaagtatctcagcagctgtgtagtacgtccctccgggcgcttgacttctcagggaatgccctgggtcacatgtgggctgagggggatctctatttgcatttttttcagggcctcagtggactcatttggctggatttgagccagaaccgcctccacacactgctccctcaaacattaaggaatctacccaagagtctccaggtacttcgccttcgggataactaccttgctttcttcaaatggtggtccttgcactttctgcctaaactggaggtcttagacctcgctggtaatcagctgaaggccctgactaatgggtcacttcctgccggcacacgcttgcggaggctcgacgtatcctgtaattccatctcgttcgtcgccccggggttcttcagtaaagctaaggaactacgggaactcaacctaagtgcaaatgcgctgaaaacagttgaccacagctggtttggtcccctcgcctccgccctccagatcctggacgttagcgcgaatcccctacattgcgcgtgtggtgcggcttttatggactttctgcttgaggtgcaggccgctgtgccagggttgcctagtcgggtcaagtgcggctctccgggtcagctgcagggtctatccatcttcgcccaagacctgaggctgtgcctggacgaggccctttcctgggattgtttcgcgctgtccctattagctgtggccctgggtctgggagtgccgatgctgcaccacctatgcggatgggacctctggtattgttttcacctgtgtctagcctggctcccttggcgcggaaggcaatcaggcagggacgaggacgccctgccatacgatgctttcgtggtgttcgataaaacccaaagcgcggtggccgactgggtgtacaacgagctacggggtcaacttgaggagtgtcgaggacgttgggccctgcgactgtgcctagaggagagagactggctcccgggaaaaacattattcgagaacctgtgggctagtgtctacggatccagaaaaaccctgtttgtgctggcccatacagaccgtgtctccgggctgctaagagcttcattcctgcttgcccagcagcgcctgcttgaagatcgtaaggatgtagtcgtgcttgtgattctgtctccagacgggcgccggagccggtatgtgaggctgcgccagagactttgtcgacagagtgtgctcctctggccacatcaaccgtccgggcagcgctcattttgggcccagctaggaatggccctgacccgggataatcatcatttttacaatcggaacttctgccagggtcccaccgctgagtag

SEQ ID NO: 208828 - DNA, 2139 bp, Artificial Sequence
  Description of Artificial Sequence: Synthetic coding sequence
atggcctgcaccggccccagcctgcccagcgccttcgacatcctgggggccgcaggacaggataaactgctttacttaaaacacaagttaaaaacccctcgccccggatgccagggacaggatctgctccacgctatggtgttactgaaactgggccaagagaccgaggccagaatatctctcgaagctctcaaagctgatgctgtggcaaggttggtggcccggcaatgggcgggcgtcgacagcacggaggatccagaagaacctcccgacgtctcctgggcagtggctagactttaccacctcctcgctgaagaaaaactgtgtccggcctcactccgagatgtggcctaccaggaggctgtaagaacactatcctcccgggacgaccaccgactcggggagctccaagatgaagctcgcaatagatgtgggtgggatattgccggcgatccgggtagcatcaggacgcttcaatctaacttggggtgcctccctccttccagcgctctgccatcaggcactcggagcctaccgagacctatcgacggcgtctctgactggtctcagggatgcagcctcaggagtacaggcagtccagcctctttggcctcgaacctggaaatctcacaatcaccgaccatgccattcctttccctccacaggagcccccacgggccttctaagctgtgtgatgatccccaagctagtttggtgccagagccagtaccaggcggctgtcaggagcccgaggagatgagctggcctccctccggcgaaattgccagccctccagaactgccatcaagcccaccccccggactgcccgaagtggcacccgacgcaacatctaccggcctccccgacacacccgcagctcctgagacttccaccaactatcctgttgaatgcaccgaaggcagtgcaggcccacagagcttgccactccccatcctggaaccagttaaaaatccatgtagcgtgaaagaccagactccgcttcagctgtcggtggaagacaccacttcacctaacacaaagccctgccctccaaccccaacaacccccgagactagcccacccccaccaccgcctcctcccagtagcaccccctgcagcgcacatctgaccccatcgtctctgttcccgtcatctctggagtcaagctccgaacagaagttttacaattttgtgattcttcacgctcgggctgacgagcacattgcgctaagggtgagagaaaagctcgaagccctgggggtacccgacggcgcaaccttctgtgaggactttcaggtgccggggagaggcgagttgtcatgcctccaggatgctatagatcatagtgcgttcatcatcctgctcctaacctctaactttgattgtagactgagtctgcatcaggtgaatcaggctatgatgtcgaatctgacacggcagggctcgccagactgtgtaatcccattcttgccgctggagtcttcacctgcccagttatcaagcgatactgcctctctgctaagcggcttggttcggctggacgagcactcccagatatttgcccggaaggtcgcaaacacctttaagcctcatagattgcaggccagaaaggccatgtggagaaaagagcaagataccagggccctcagagagcagagtcagcacctggatggagagcgtatgcaagcagcagcccttaatgcagcctacagcgcttacctgcagtcatacttgagctatcaagctcagatggagcaactgcaggtagcctttggaagccacatgtctttcgggaccggagcgccatatggtgcacgcatgccttttggaggccaagtgcctctgggcgccccaccccccttccctacttggcctgggtgcccacagccacctccactccatgcctggcaggctgggaccccgccacctcccagcccacagccagccgcgtttccacagtcattgcctttccctcagtctccagcgttccccaccgcctcacctgctccacctcaaagccccggtctccagcctttaattatccaccacgcacagatggttcagctgggcctcaataatcacatgtggaaccagcgagggtctcaggctcctgaggataagacacaagaggctgaatag

SEQ ID NO: 208829 - DNA, 3042 bp, Artificial Sequence
  Description of Artificial Sequence: Synthetic coding sequence
atgggcctgggcaccctgagcccccggatgctggtgtggctggtggctagtggaatcgttttttacggcgagctctgggtctgcgccggtctagactacgactatacctttgatggtaacgaggaggacaaaactgaaaccatagactataaagacccatgtaaagcggcggtattctggggggatattgctttagatgatgaggacctgaacatttttcaaatcgaccgcaccattgatctgacccagaaccccttcggtaatctcgggcacactaccggaggcctaggagaccacgccatgtctaaaaagcgcggagccctgtaccagctcatcgaccgcatccggcgcattggattcggactcgaacaaaataatacggtcaaaggaaaggttcctcttcagttctcaggacagaatgagaaaaacagggtgccgcgcgcggcgacatctagaacagagcgcatctggccaggcggagttatcccctatgtcatcggcgggaacttcactggttcccagcgcgctatgtttaaacaggccatgaggcactgggagaagcacacgtgtgtgacattcatcgagagaagtgacgaagaaagttacattgtctttacttatcggccctgcgggtgctgttcctacgtgggcaggaggggcaacggtccccaggccatctcgatcggcaagaactgtgataaattcggaatagtggtgcacgagctcggccacgtcatcggcttttggcatgagcacacgagacctgatagggataatcacgtcaccattatacgagaaaatatacagcccgggcaagagtacaatttcttgaaaatggagcctggagaggttaatagtctcggcgagcggtacgactttgactctataatgcactacgcgagaaacaccttttctagggggatgtttctggacaccatactcccctcacgcgatgacaacggcatcaggccggcgatcggccagcgcaccaggctgagcaagggcgacatcgctcaggcccgaaaactatacaggtgtcctgcttgcggggagacccttcaggagtccaatgggaatttgagtagccctggattccccaatggatacccgtcttacactcattgtatttggcgggtgtcggtgaccccgggggagaagattgttctcaattttaccaccatggatctgtacaaaagcagcttatgctggtatgactatattgaggtgagggacgggtattggcgcaagtctccattgttgggccggttctgtggggataagcttcccgaggttctgaccagtaccgattccaggatgtggatcgagttccgcagcagtagcaattgggtggggaagggctttgcggctgtctacgaggcaatttgtggcggggaaataaggaagaatgaaggccaaatccaaagcccaaactaccccgacgactaccgtcccatgaaagagtgcgtgtggaaaattaccgtgagtgagtcctaccatgttggcttaacgtttcagagtttcgagatcgagcgtcacgacaactgcgcgtacgactacctggaagtgcgcgacgggaccagtgagaactcccctttgattggacgcttctgcggctacgataagccagaggacataagaagtacatctaacacactgtggatgaaattcgtgtctgatggaaccgtcaacaaggcgggcttcgcagcaaacttttttaaagaggaagatgagtgtgctaagccggaccggggaggctgcgagcaacgatgtctgaatacactgggatcgtatcagtgcgcatgtgagcccggttacgaactcggccccgatcggagaagctgtgaggcagcatgtggcggactcctgaccaaattaaacggtactatcaccacccccggatggcccaaggagtaccccccaaacaaaaactgtgtatggcaggtggtcgctccaacgcagtataggatctctgtgaagttcgaatttttcgagttggagggcaatgaggtatgcaaatatgattacgttgagatatggtcaggcctctcatctgaatcaaagttgcatggcaagttttgtggcgccgaagtgcctgaggttatcactagccagttcaacaacatgcggatcgaattcaagagtgacaacacagtatctaagaaaggttttaaggctcacttttttagcgataaggacgagtgtagcaaagacaatggaggttgccagcatgagtgcgtgaacaccatgggttcctatatgtgtcagtgccggaacgggttcgttctacacgataacaagcacgattgtaaggaggctgaatgcgaacagaagatccactcaccttccgggttaatcacgtcaccaaattggccagataaatatccttcaaggaaagagtgcacttgggaaatttctgccactccaggacacagaatcaagctggctttttctgagtttgagattgagcagcatcaagagtgtgcctacgaccacctcgaggtcttcgatggggagaccgagaagagccccatcctcggtcggctgtgtggcaacaaaattcctgatcctcttgtcgctactgggaataaaatgttcgtgcgcttcgtctctgatgcatccgtccagaggaaaggatttcaagcaactcactccactgaatgtgggggccggctgaaggccgagtccaagccccgcgacctgtactctcacgcccagtttggcgataacaactaccctggacaagtagattgtgagtggctcctcgtgtccgagagggggagcaggctagagctgtcattccagacctttgaagtggaggaggaggccgattgcgggtatgattacgtggagctctttgacggcttggatagtacggctgtagggctgggccgattctgcggttcggggccccccgaggagatttattctattggggatagcgttttaattcactttcacaccgacgacaccattaataaaaaaggcttccacatcagatacaagagcattcgttacccagacaccacgcatacgaaaaagtag

SEQ ID NO: 208830 - DNA, 1179 bp, Artificial Sequence
  Description of Artificial Sequence: Synthetic coding sequence
atgggcctgggcaccctgagcccccggatgctggtgtggctggtggcatccggaattgttttttatggcgagctttgggtctgcgcaggcctggattatgactacacattcgatggcaatgaagaggacaaaacggagaccatagactataaagacccgtgtaaggcagcagtcttctggggggatatagccctggatgacgaagacttaaatatattccagatagatcggacaattgatttgactcagaacccattcggcaaccttggacataccaccggcggcctaggcgaccatgccatgagcaaaaagagaggggccctgtatcagctgatcgaccgcattcggcggatcgggttcggactggagcagaataacacagtgaaaggaaaagtgccccttcagttctctggccagaatgaaaagaacagagtccctagagctgccacgagtcgcacggagagaatatggcccggaggtgtgatcccttacgtcattggagggaatttcactggttcccagcgtgccatgttcaagcaggccatgcggcactgggaaaagcacacctgcgttacttttattgagagatcagatgaggaatcctatatcgtgttcacttatcgcccatgcggctgctgtagctatgtgggaaggaggggaaatggccctcaggccatttccataggcaaaaattgcgataaatttgggatcgtggttcacgagctaggccatgtgataggcttttggcatgaacacacgcgccccgatagggataaccacgtcactattattcgggagaacatccaaccggggcaggagtacaattttttaaagatggagcccggagaagtaaactctttgggggaacgctatgatttcgattccattatgcattacgcacgtaataccttcagtaggggtatgtttctggatacaatcctgccctcgagagacgacaatggtattagacccgcaattggacaaagaactaggctgagcaagggggacatcgcacaagcaaggaagctgtatcgctgccctgcttgtggagaaacgctgcaggagagcaatggaaacctttcaagccctgggtttccaaatggttaccctagttacactcactgtatttggagagtgtctgtaacccccggtgagaaggtcgtgttttctctatgttag

SEQ ID NO: 208831 - DNA, 3048 bp, Artificial Sequence
  Description of Artificial Sequence: Synthetic coding sequence
atgccccgggccaccgccctgggcgccctggtgagcctgctgctgctgctgcccctgcctcgcggtgctggaggcctgggcgaacgccccgatgcaactgccgactacagcgaactggacggagaggagggtactgaacagcagctagaacattaccacgacccatgcaaagccgccgttttttggggggacattgctttagacgaggacgacttaaagctgttccatattgataaagcccgggattggaccaaacagacagtgggcgctaccggccactcgaccgggggtttggaggagcaagcctccgagtccagtccagacacaaccgccatggacacgggaactaaggaggccggaaaggacggccgcgaaaatactaccctgctccacagccccggtacccttcatgctgcagcgaaaaccttctcccctcgcgtccggcgagccaccacaagtcgtaccgagagaatctggcctggaggcgtgattccttatgtcattggaggcaattttaccggcagtcagcgggcaatctttaaacaggcaatgcgccattgggaaaagcacacatgcgttactttcatagagaggacagacgaggagtcgttcattgtattttcttatcggacctgtggttgctgttcttacgttgggaggcgagggggcggccctcaggccatctcaattgggaagaattgcgacaagttcggcattgttgcacacgagctcggccatgtagtgggcttctggcatgagcacacgagaccggaccgtgatcagcatgtgacaatcattagagagaacatccagccagggcaggagtataatttccttaagatggaggcaggagaagtctcgtctctcggcgaaacatacgactttgattcaattatgcactatgccaggaatacattctcccgcggcgtgttcctggataccatccttccaagacaagatgacaacggcgtaagaccgaccattgggcaaagggtaaggctttcacaaggggacatagctcaagcccgcaaactgtacaaatgcccagcatgtggcgaaactcttcaggacacaaccggtaacttcagcgcccctggatttcctaatggctatccatcatactcacattgtgtttggcggatctctgtaacccccggggagaagatcgtcctgaacttcaccagcatggacttgttcaaatctagactctgctggtatgactacgtggaggttcgggatggatactggcgcaaagcgcccctgctggggcgtttttgtggcgacaagattccagagccactggtcagtacagacagcagattatgggtcgagtttaggtcctcgtctaatattctcgggaagggcttttttgccgcctacgaggccacatgtggtggggacatgaacaaagatgctggccaaattcagtctccaaattatccggatgattaccgaccatccaaagagtgtgtgtggcgaatcaccgtaagtgagggcttccacgtgggccttaccttccaagcctttgagatcgaaaggcatgatagctgcgcttacgactatcttgaggtgagagacgggccaacagaagagagcgccctgatcggacatttttgcggttatgaaaagcccgaggacgtgaagtcgtcaagtaaccgtttgtggatgaagtttgtttctgacgggtcaattaataaggcagggtttgcagccaatttctttaaagaagtagatgagtgttcctggccagaccatggggggtgtgagcatcggtgcgtaaacacattgggatcctacaaatgcgcatgtgaccctggatatgagctcgccgctgacaagaaaatgtgcgaggtggcctgcggcggcttcatcaccaagctgaatggcacaatcacgagcccagggtggccaaaggagtatccgaccaacaagaattgtgtttggcaggttgtggctcctgctcagtaccggatcagcctccagtttgaggtatttgagctcgaaggcaacgatgtatgcaagtatgattttgtggaggtccggtcagggctgtctcccgatgccaagctgcatgggcgtttctgcgggagcgagactccggaggtcattacctcacagtctaacaatatgagggtcgagttcaagtcagacaataccgtgtccaaacgaggtttccgagcacacttcttttcggacaaggacgaatgtgctaaggacaacggaggttgccaacatgagtgcgtgaacacgttcggttcctacctgtgtcgatgccggaacggatactggctgcacgagaacggtcatgattgcaaggaggcgggttgtgcccataaaatcagcagtgttgagggtaccctagcgtctcccaactggcccgacaaatacccttcaagacgggagtgcacttggaacatctctagcaccgctggccaccgcgtcaaactgacattcaacgaattcgaaattgagcaacatcaggaatgtgcttatgaccacctggaaatgtacgacggacctgattccttagcccccatactcggacggttttgtggaagtaaaaaaccagaccctaccgtggcaagcggaagcagcatgtttctgcgcttctatagcgacgcctccgtgcaaagaaaagggtttcaggccgtgcactctactgagtgtggcggtcggttaaaagccgaggtccagaccaaggagctatactctcatgcacagtttggcgataataactatcctagtgaggcccgttgtgattgggtgattgtcgcagaagatggctacggagtggaattgaccttccgcacattcgaagtagaggaagaagccgattgtgggtacgactatatggaagcctacgatgggtatgatagtagcgctcccagactgggacggttttgtggatctggaccactggaggaaatttacagcgcaggggacagtttgatgattcggttccggacggatgacaccataaataaaaaaggtttccacgctcgatatacttctacaaagttccaggacgcactgcacatgaagaagtag

SEQ ID NO: 208832 - DNA, 2298 bp, Artificial Sequence
  Description of Artificial Sequence: Synthetic coding sequence
atgagcggcgaccacctgcacaacgacagccagatcgaggccgacttccggctgaatgatagccacaaacataaggacaagcacaaagatcgcgagcacagacacaaggaacacaagaaggaaaaagatcgggaaaagagcaagcacagtaattctgaacacaaggattctgagaagaagcacaaagaaaaagagaaaactaagcacaaagacggatcctcagagaagcacaaagacaagcacaaagacagggacaaagagaaacgaaaggaggaaaaagttcgggcgtccggggacgctaagattaaaaaggagaaagagaatggcttttcgtcgcctccccagattaaagacgagcccgaggacgatggatattttgtgcctccgaaggaggacatcaaacctttgaagaggcctcgggatgaggacgatgcagattacaagcccaagaagattaaaacagaagatacgaagaaagagaagaagcgaaaactggaggaggaggaagacggcaagctgaaaaaacctaaaaacaaggataaggacaaaaaggtgccagaacccgacaataaaaagaaaaagccaaaaaaggaagaagagcagaaatggaaatggtgggaggaggagcgttaccccgaaggcatcaagtggaagtttctggagcataagggacccgtgtttgcccccccgtatgagcctctacctgaaaacgtgaagttctactacgacggcaaagtgatgaaactctctccaaaggccgaagaagtcgctaccttctttgctaaaatgcttgaccatgaatatactacaaaggagatttttagaaagaacttcttcaaagattggaggaaggaaatgaccaatgaagagaagaacattattacgaatctcagtaaatgtgatttcactcagatgagtcaatatttcaaggcccagaccgaggccagaaagcagatgagcaaggaagagaagctcaagatcaaggaagagaacgagaagctactgaaagagtatggattctgtattatggacaatcataaagaacggattgccaattttaagattgaacctccaggtctttttcgcggccgaggaaatcatccgaaaatgggaatgctgaaacgtaggattatgcccgaagacataataatcaactgcagtaaggatgcaaaggttcccagcccacccccaggccataaatggaaagaagttcgacatgataacaaggtgacctggttggtaagttggaccgagaatattcagggatccatcaagtacatcatgcttaacccaagcagtaggattaagggtgaaaaggattggcagaagtacgagactgctaggcgactgaagaaatgcgtagataaaatcaggaatcagtatcgtgaagactggaaatctaaagaaatgaaagtccgacaacgcgccgtggcactctatttcatcgataagctggccctgagagccggaaacgaaaaagaagagggggagacagccgatacagttggatgttgttccctccgtgtggagcatatcaatttgcatcccgagcttgacggacaagaatacgttgtggagttcgactttcttggcaaggattctatccgatactacaataaagtccccgtagaaaaaagggtattcaaaaacttacagctctttatggagaacaaacagccagaggatgacctttttgaccgcctcaacaccgggattttgaataagcatcttcaggacctgatggagggactaactgccaaggtctttcgcacatacaatgcgagtatcacacttcagcagcagctgaaagagttaaccgctcctgatgaaaacattcctgctaagattctgtcatataaccgcgccaacagggctgtggctatactctgcaaccatcagcgggcgccgccaaaaaccttcgagaaatccatgatgaatctacagacaaaaattgacgccaagaaggagcaactggccgacgctcgccgggacctgaaatccgctaaggcggatgccaaagtgatgaaggatgccaagaccaagaaagtcgttgagtctaagaagaaggccgtccagcgactggaagagcagctgatgaaactcgaagtgcaggcaaccgatagggaggagaataagcagatcgcactcggaaccagcaaactaaactacttagaccccaggattaccgttgcttggtgtaagaagtggggggtgcccattgaaaaaatctacaataagacccagagggagaagttcgcctgggccatcgacatggcagacgaggattacgaattctag

SEQ ID NO: 208833 - DNA, 1806 bp, Artificial Sequence
  Description of Artificial Sequence: Synthetic coding sequence
atgcgggtggtgcggctgctgcggctgcgggccgccctgaccctgctgggcgaggtgcccagacgacctgccagcaggggtgtaccaggatctcgcaggacccagaaagggtcaggcgccaggtgggaaaaagagaagcacgaggatggcgtcaagtggaggcagctcgaacacaaagggccatactttgcaccgccatacgaacccctgcccgacggggtccggtttttctacgagggacgccctgtgaggctaagcgtggctgctgaagaagtcgcgacgttttacgggagaatgcttgaccacgagtacacgaccaaggaggtgttccggaagaacttcttcaatgattggcggaaagagatggcagtggaagagcgggaagtaatcaagagcctggataagtgtgacttcacagagatccacagatacttcgtggataaagcagcggcaaggaaggtgctgagccgcgaggagaaacagaaactgaaggaggaggcggaaaagctgcaacaggagttcggctactgtatcctcgacggacaccaggaaaagatagggaactttaaaattgagccgccaggcctgtttagaggccgtggggatcaccccaaaatgggcatgctcaaaaggcggattacccccgaggatgtcgtgatcaattgttccagggactcgaaaattccagagccgccagcagggcatcagtggaaggaagtgcgaagcgacaatacagtgacttggctggcggcatggacggaatctgtacaaaattcaatcaaatacattatgttgaacccgtgttcgaaattgaagggagagacagcatggcagaaattcgagacagcgcggcggctacgaggcttcgtcgatgaaataagatcacagtaccgagccgattggaaatcacgggagatgaagacccgccagcgagctgtggccctatacttcatcgataaacttgcactccgcgctgggaatgagaaagaggacggggaagcagctgacaccgttggttgctgttccctgcgcgtggaacatgtgcaactgcaccccgaagccgacgggtgccagcacgtggtcgagtttgacttcctgggcaaggactgcatccggtattataatagggttcccgtggagaagcctgtgtataagaacctccagctgttcatggaaaacaaagatccgagagatgacctgttcgaccgtctgactactacatcacttaataaacacctgcaagagctcatggacggtttgaccgctaaagtttttaggacgtataatgcgagcatcactctccaggagcagttaagggcattaactcgagctgaagatagcatcgctgcgaagatccttagctataaccgagctaaccgcgttgtggccatcttgtgtaaccaccaacgcgctactccaagcacgtttgaaaaatctatgcagaacctgcaaactaagatccaggctaagaaggagcaagtggcagaggcccgagccgagctcaggagggcccgagccgagcataaggctcagggtgatggaaagtctaggagcgtgctggaaaagaaacgccgattacttgagaaactccaggagcagctggcacaactgagtgtgcaagcgactgataaagaggaaaacaaacaggtggctcttggcactagtaaattgaactatctggacccacgcatctccattgcctggtgtaaacggtttcgcgtgccagtcgaaaagatttacagcaaaactcagagagagcgcttcgcgtgggcgttagctatggccggggaagatttcgaattctag

SEQ ID NO: 208834 - DNA, 1512 bp, Artificial Sequence
  Description of Artificial Sequence: Synthetic coding sequence
atgctggaccacgagtacaccaccaaggaggtgttccggaagaactttttcaatgactggagaaaggaaatggctgtcgaagaacgggaggtgattaagtccctggacaaatgcgacttcacagagatccatcgatacttcgtggataaggccgcagctcggaaggtgttgtctcgagaggaaaaacaaaaactgaaggaggaggccgagaaactacagcaagaattcggctactgcatactggacggtcaccaggagaaaattggaaactttaaaatcgagccccccggcctttttagaggtcgtggcgatcaccccaagatggggatgttaaagagacggataaccccagaggatgtcgtcataaactgctctcgtgattccaagattcctgagcctccggccggtcaccagtggaaggaagtacgctccgacaacactgtgacctggcttgctgcgtggactgaaagtgtccagaatagcataaaatatataatgctgaatccatgcagcaaacttaagggagagaccgcttggcagaagtttgaaacggcaaggcgattaaggggattcgtggatgaaattagaagccaataccgagctgactggaagtcacgcgaaatgaagacacgacagagagcagtggctctatactttatcgataagctggctttacgcgctggcaatgaaaaggaagatggagaagctgctgatacagtggggtgctgtagtttgcgtgtcgagcatgtccaattgcacccagaagccgacggctgccagcacgtggtggaattcgacttcctaggaaaggactgcatcagatactataaccgagtgcctgttgaaaagcccgtgtataaaaatttgcagcttttcatggagaataaggatcccagggacgacctgttcgatcgccttacaacaacttctcttaacaagcatctgcaagagctcatggacggcttgacagccaaggtcttcagaacatacaacgcctctatcacgctgcaggagcagttacgagctctgactagggcagaggattcaatcgctgcaaaaattctgtcctacaacagggccaatagggtggtggctatactgtgcaatcatcaacgagccacacccagcaccttcgagaaaagtatgcagaacttgcaaactaagatccaggccaaaaaagagcaggtcgccgaggctagggccgagcttaggagagcaagagcagagcataaagcgcagggagacgggaagtctcgttcggtgttggagaaaaagcggcgcctcctggagaagctacaggaacaacttgctcagctcagtgttcaggctacagacaaagaggaaaacaaacaggtcgcccttggcacatcgaaattgaactacctcgacccccggatttccatagcctggtgtaagagattccgggtgcccgtagaaaagatctattctaaaacgcagcgcgagcgatttgcctgggcccttgcaatggctggagaagacttcgaattctag

SEQ ID NO: 208835 - DNA, 1512 bp, Artificial Sequence
  Description of Artificial Sequence: Synthetic coding sequence
atgctggaccacgagtacaccaccaaggaggtgttccggaagaacttctttaatgactggcgaaaggaaatggccgttgaagagagagaggtgattaagtccctggataaatgtgatttcacggagatacaccggtacttcgtggataaggccgccgccaggaaggtcctctcaagggaggagaaacagaagctgaaagaggaggccgaaaaactgcagcaggagtttggttattgcattttggatgggcaccaagagaagatcggcaatttcaaaattgaacctcctggcctcttccgggggcggggcgatcatcctaaaatgggtatgctgaaacgccggataaccccagaagacgtggtcatcaactgctctagggactctaagatccctgaacctcctgccggccaccagtggaaggaagtgagaagtgacaacacagtcacgtggctggcggcttggacagaatctgttcagaactcaatcaagtatataatgctgaacccatgcagcaagttgaagggggaaactgcctggcaaaaattcgagacggcccggaggctgaggggattcgtggacgagattcggagtcagtaccgcgcggactggaaatcccgtgagatgaaaactcgacagcgcgccgtggcactgtatttcattgacaaactggcacttagggctggtaacgagaaggaggacggggaggccgcagacaccgtcgggtgctgttcacttcgcgtggagcacgtgcagctgcatccggaggcggatggttgtcagcatgtggtcgaatttgactttcttggaaaggactgcatcagatactacaatcgagttccagttgaaaagcccgtctataagaatcttcagcttttcatggaaaataaagatcctagagatgatctgtttgatagactgaccaccacaagccttaacaaacatttgcaggaactgatggacgggttgacagcaaaggtattccggacttacaacgccagtatcacactccaagagcaactgagggcactgacacgtgctgaggacagtatcgctgcaaagattcttagctataacagggccaatcgcgtcgtagctatactgtgcaatcatcagcgagccaccccttcaaccttcgagaagtcaatgcagaatctccagacaaaaatccaagcgaaaaaagagcaggtcgcagaagcgagggccgagctccgtcgagccagagccgagcataaagcgcagggcgatggaaagtcccgatcagtcctggagaagaagaggagactgttggagaagttgcaggaacagttggcccagctgagcgtgcaggccacagacaaagaggaaaataagcaggtggccctgggaactagcaagctgaactacctagacccccggataagtattgcgtggtgtaagagattcagagtgcctgtagagaagatttattccaaaactcagagggagcgctttgcctgggcgctggcgatggctggggaggactttgagttttag

SEQ ID NO: 208836 - DNA, 1512 bp, Artificial Sequence
  Description of Artificial Sequence: Synthetic coding sequence
atgctggaccacgagtacaccaccaaggaggtgttccggaagaactttttcaatgactggcggaaggagatggccgtcgaggaacgcgaagtgattaagtctttggacaagtgcgactttaccgagatccacagatattttgtcgataaagcagcagcccgcaaggtactgagccgcgaagaaaagcaaaaactgaaggaggaagccgagaagcttcagcaggaattcgggtactgtattttagacggtcaccaggagaagattggaaatttcaaaatcgagccacccggtctgtttcgcgggaggggcgatcaccccaaaatggggatgcttaaaaggcgaattacaccagaggacgtggtaatcaactgctcccgagatagtaagatccctgaaccccccgccggacaccaatggaaggaagtgaggagtgataatacagttacatggctggcagcctggaccgagagcgtgcagaacagcatcaagtacatcatgctaaatccttgctctaagctcaagggggagaccgcctggcagaaatttgagactgccaggagactccgaggcttcgtggatgaaatccgcagccagtatagagcagactggaagtcgcgtgagatgaaaactcgccagagagccgtggctctgtactttatcgacaaactggcacttcgcgcgggtaacgaaaaggaggatggggaggcagcagatacagtggggtgctgctcactgcgagtggagcatgttcaattgcaccccgaggcagacggttgtcaacacgtcgtggaattcgatttcctcggcaaagattgtatcaggtattacaatagagttccagtggaaaaacccgtttacaagaacctgcagctctttatggagaacaaagatccgcgcgatgacctcttcgaccgactgaccacaacctccctgaataagcatctacaggaacttatggacggcctgacagcgaaagtgttccgcacctacaacgcatctattacccttcaagagcagctgcgggctctcacaagagctgaggactccatcgctgcgaaaatcctatcttacaacagagccaatagagtcgtagccattctgtgcaaccatcagcgggccactccttcaacgttcgagaagtctatgcagaatctccagacgaaaatccaggcaaaaaaagaacaagtagccgaggcaagagccgagctgcgccgcgcccgcgcggaacacaaagcccagggagatggaaagtcaagaagtgtactggaaaaaaagcgcaggttgctcgaaaagcttcaggaacaactcgcccagctgtctgttcaggccacagacaaggaggaaaacaaacaggtagcgctcggcacaagcaaactgaattacttggaccctaggattagcatcgcttggtgcaagaggtttagggtacctgtggagaagatttatagtaaaacccagagagagagattcgcctgggcactggctatggccggggaggatttcgagttttag

SEQ ID NO: 208837 - DNA, 4569 bp, Artificial Sequence
  Description of Artificial Sequence: Synthetic coding sequence
atgagccggaacgacaaggagcccttcttcgtgaagttcctgaagtcctctgacaactccaaatgttttttcaaagccctcgagagtatcaaagaatttcagtcagaagagtacttgcagatcatcacagaagaggaagcccttaagatcaaggagaatgacagatccctctatatatgtgaccccttctccggagtcgtgttcgaccacctcaaaaaactgggttgtaggattgttggtccacaggtcgtgatcttttgcatgcaccaccagcgctgcgtccctcgggcggaacaccctgtgtacaacatggtgatgagcgacgtgaccatctcctgcacttccctggagaaagagaaacgcgaggaggtgcataagtatgtccagatgatggggggtagagtgtatagggacctcaacgtgtccgtgacacaccttattgccggagaggtcggctcaaaaaagtacttggtcgccgctaacctgaaaaagccaattttgcttccctcttggattaaaaccctgtgggagaagtcacaggagaaaaagataacccggtatacagatataaacatggaagactttaaatgtcccatttttctgggctgtatcatctgtgtgactgggttgtgtggcctcgatcggaaagaggtgcagcagctgaccgtaaagcacggtggtcaatatatgggacagctgaaaatgaacgaatgcactcatctgatcgtccaagagcctaagggacagaagtacgaatgtgccaaaaggtggaatgtgcattgcgtcacgactcaatggttcttcgactccatcgagaagggattttgtcaggatgaatcaatttataaaaccgagcccagacctgaagccaagaccatgccaaacagcagcacacccaccagtcagatcaacaccatagatagtcgcaccttatccgacgtgagtaacattagcaacattaacgcttcgtgtgtcagtgaatctatctgtaacagtttgaactcaaagctcgagccgacactggagaacctggagaatctcgacgtgtctgcattccaagctcccgaagacttgcttgatggctgtaggatctacctgtgtggctttagcgggcgcaagctggacaagttgaggaggcttataaacagtggaggaggagtgcggttcaatcaactaaatgaagatgtgacccatgtcatcgtaggtgactacgacgacgaactgaaacaattttggaataaatcagcacatagaccccatgtggtgggtgccaaatggcttctggagtgcttttccaagggttatatgttgtccgaggaaccttacattcacgcaaactaccagcccgtcgaaatccccgtgtctcacaagcctgagtctaaagccgctttgctcaagaagaagaacagtagctttagcaagaaagactttgcccccagtgaaaagcacgaacaagcagatgaagatctattatcacaatacgagaacgggtctagcactgtcgtggaggccaagacgtccgaggctcgcccattcaacgatagcacacacgccgagcctttgaacgactctacgcatatcagcctgcaagaagaaaatcagtcgtcagttagtcactgtgtcccggacgtttcgacaattaccgaggagggccttttttcacagaagtcgtttctcgtcctgggatttagcaatgagaatgaaagcaacatcgcaaatatcatcaaggagaacgccggaaagattatgtccctcttatcgagaactgtggccgattacgcggtggtacctcttctcgggtgtgaagtagaagcaacggtgggcgaagtggtgaccaatacctggctcgtgacttgtatagattaccagactcttttcgaccccaagtctaatccactgttcactcccgtccctgtgatgacaggtatgacaccgctggaagactgtgtgatcagtttctcccaatgcgcaggcgctgaaaaggaatctttaaccttccttgcaaatctactaggagcctcggtccaggaatatttcgtgagaaaatctaacgctaagaaaggcatgtttgcctcaactcatttgattctgaaagaaagaggcggaagcaaatatgaagctgccaaaaaatggaaccttcctgctgtgacaattgcctggcttctggaaacggctagaaccggtaagagggcagatgaatcgcactttctaattgagaattcaaccaaagaggaaaggtcactcgaaaccgaaattacaaacggtatcaacttaaactcagatactgctgagcacccgggaacaagacttcagactcacaggaaaaccgtcgtcacaccactggatatgaataggtttcagtccaaggcgttcagggcagtagtaagccagcacgcaaggcaggtcgcagcttccccggctgtgggtcaacccctgcagaaggagccgtcattacacttggatacgccctccaagttcctgagcaaggacaagttgtttaaaccctcttttgacgttaaagacgctctggccgccctagagacccctgggcggccctctcagcagaaaagaaagccatccaccccactctccgaagttatcgtgaagaatcttcaacttgcgctggccaacagctcccgaaatgcggtcgccctgagtgcctccccacagctgaaggaggcccagagcgagaaagaggaagctccgaaacctctccataaggtggttgtttgtgtctctaagaagctcagcaagaagcagtcagagcttaacggcatcgcagcctcactgggcgcagattaccggtggagctttgatgaaactgttacccactttatttatcagggcaggccaaatgacaccaaccgagagtataagtcagttaaagaacggggtgtacacattgtcagtgagcactggctcctagactgtgctcaagagtgtaaacaccttcccgagtccctgtaccctcatacctacaatcctaagatgtctctggacatcagcgccgtgcaggacggaaggctttgtaacagcagactgttatctgccgtgtcttctaccaaggacgatgagccagacccactcattcttgaagaaaacgatgtcgacaacatggctacaaacaacaaagagtcagccccaagcaacgggtctggtaagaacgactccaagggcgtcttaacccagaccctcgaaatgcgcgagaacttccagaagcaattacaggagattatgtccgctacatcaattgtgaaacctcagggccaacggacatctcttagtaggtctgggtgtaacagtgcttccagtacaccggacagcacacggagcgcaagatccggaaggagtagagttttagaagccttgaggcagagtaggcaaacagttcctgacgtgaacaccgaaccgtcgcagaacgaacagatcatctgggacgaccccacagcccgcgaggagcgggctagactggcctccaacttgcagtggcccagttgtccaactcagtattccgagcttcaagttgacatccagaacctggaagactcacctttccagaagcctctgcacgattctgaaattgcaaaacaagccgtttgcgaccctggcaatatccgggtgaccgaagcgcccaagcatcccatctctgaagagctggagaccccaattaaggattcccatttgataccaactccgcaagctcctagcatagcttttccattggccaatccacccgtagctcctcatccacgtgagaagatcatcacaattgaggagacacatgaagagttgaagaagcaatacatattccagcttagctcactgaacccacaagagaggattgactattgtcatttaatcgagaaattgggtggcttggtcattgaaaagcagtgcttcgatccaacttgcacacatatcgtcgtcgggcatccactccggaacgagaagtatctggctagcgtcgctgcaggcaagtgggtgctccaccgttcctacctcgaagcttgtcggaccgccggtcactttgtgcaggaggaagattatgagtggggctctagctccatcctggacgtgcttactgggatcaatgtgcaacagaggaggttggcacttgccgccatgaggtggcgtaaaaagattcagcagcgacaagagtctggcatcgtcgaaggtgcattcagcggatggaaggtcattctccacgtcgaccagagtcgagaagccggttttaaacggttgctgcaatctggcggggcaaaggttctgccgggccacagcgtgcccctattcaaggaagcgacccatttattctcagacttgaacaagctcaagcctgatgactcgggtgtcaatatcgccgaggcagccgcacaaaacgtttactgcttgagaacggagtatattgcagactatttgatgcaggaaagcccaccccacgtcgagaattattgccttcctgaagcaatctcatttattcaaaacaataaagaattggggactggactgagccagaaacgaaaggcccccacagagaaaaataaaattaaacggccgcgcgtgcattag

SEQ ID NO: 208838 - DNA, 3138 bp, Artificial Sequence
  Description of Artificial Sequence: Synthetic coding sequence
atgggcagccagccccccctgggcagccccctgagccgggaggagggagaagcccccccccctgcccccgccagcgagggcagaagacggtccagaagagtacgtttgaggggaagctgccgccacagaccgtccttcttggggtgtcgagaactggccgcatctgctcctgccaggcccgccccagcttccagcgagatcatggccagtgctgccaaggaattcaaaatggataatttctcccccaaagcaggaacttccaaactccagcaaacggtgcctgctgacgcatctccggattccaaatgccccatatgtcttgaccgattcgataatgtgagttaccttgaccgctgccttcataaattttgcttcagatgcgtccaggaatggtccaagaataaagctgaatgccccctgtgtaagcagccttttgacagcatcttccacagcgtgcgggctgaggatgactttaaggaatacgtactgaggcctagctataacgggtctttcgtgactcccgaccggaggtttaggtaccgaacaaccctcacgagggaacgaaatgcctccgtgtactccccctcgggcccagtgaaccgccgcactacaacacccccagatagtggcgtcttgttcgagggcctcggtatcagcacgcgtcccagggacgtggaaatcccacagttcatgaggcaaatcgcagtgcggcgcccgacaacagcagatgaacgctcactccggaagatccaggaacaggacatcattaactttagaaggacactgtacagagccggcgcgcgagttcggaacatagaagacggagggcggtatcgcgatatttccgcagagttcttcagaagaaatccggcctgccttcatagacttgtcccatggctgaagcgggagctcacagtgctgttcggcgcccatggctcactggtgaacatcgtgcagcacatcatcatgagcaatgtgacacgctatgatcttgaatcccaggcctttgtatccgacctgagaccatttttgcttaatagaaccgagcatttcattcatgagtttatcagctttgctaggtccccatttaatatggccgcttttgatcagcatgccaactacgattgcccagcgccatcctacgaggagggatcacacagtgacagctccgttattaccatcagtccagatgaggcagagacccaagagcttgatatcaacgtcgcaacagtgtcccaggccccgtgggatgacgagacaccaggcccatcatactcctcctctgaacaggttcacgtgaccatgtcttcactacttaacacctcagacagcagtgatgaagagctcgtcactgggggggctacctctcaaattcagggcgtgcagacaaatgatgacctgaataatgactccgatgactcaagcgacaattgcgtaattgtgggattcgtcaagcccttggccgagcgaacccctgaattggtggaactgtcctcggactctgaagatctgggctcgtatgagaaaatggaaactgtgaaaacccaggagcaggagcagagttacagctccggagatagcgacgtttctcgatgctcatcaccacattctgtactggggaaggatgagcagattaacaaaggacactgcgattcttcaactagaataaaaagtaagaaagaggaaaaaaggagcacatctctgagctctcctcgaaacctcaactcttccgttcggggcgaccgggtctacagtccctacaatcacagacaccggaagcgaggaaggtcccgcagtagcgacagtcggtcccagagccgtagtggacacgaccaaaagaaccacagaaagcatcacggaaaaaagcggatgaagtccaaaagatcacgcagccgcgagagttcacgccccagggggaggagggataaaaaacgaagccggaccagggattcatcctggtctcgaagaagccaaacactatccctcagttcagagagcaccagccgtagcagatcgaggtcatctgaccacgggaagcgtcggtcccggtcacgaaaccgcgataggtattatttgaggaacaactatggaagccgatacaaatgggaatacacgtattattcaaggaacaaggatagagacgggtacgaaagcagctaccgacggcgaacactgagcagggcacattattcacgccaatcatccagtccagagtttagagtgcagagcttcagcgaaaggaccaacgctcgcaaaaagaacaaccattctgagcggaagtactattactacgagaggcaccggtctcgttccctctcaagtaaccgctctcggacggcaagcaccggcaccgaccgggttagaaatgaaaagcctggcggtaagcggaagtacaaaactcgtcacctagagggcacaaacgaggtggcacagccatctcgcgaatttgcatcaaaggctaaagattctcattatcagaaatcctcaagcaagctcgatgggaattacaaaaacgagtccgatactttctctgactccagaagttccgacagggaaaccaagcacaagcgccggaagcggaagacgcgttctctatctgtagagatcgtgtacgaaggaaaggctacagacacaaccaagcatcataaaaagaagaagaaaaagcataagaagaaacacaaaaagcaccacggggataacgcttcccgatccccggtcgtcataacaattgattcagactccgataaagactcggaggtaaaggaagatactgaatgtgataactccgggccacaggaccccctgcagaacgagtttttggctccctcattggagccctttgagactaaggatgtagtcaccatcgaggctgagttcggcgtgttggataaggagtgtgatatagcgaccttatctaataacctgaacaatgctaataagaccgtggacaatataccgcccctggccgcctcagtggagcagacactggacgtacgagaggagtccacgttcgtcagtgacctcgaaaaccaaccatccaacatcgtgtcgctgcaaaccgaacctagccggcagctgccctcaccacgcacttccctgatgagtgtttgtctgggcagggactgtgatatgtcttag

SEQ ID NO: 208839 - DNA, 2943 bp, Artificial Sequence
  Description of Artificial Sequence: Synthetic coding sequence
atgatcatggccagcgccgccaaggagttcaagatggacaacttctccccaaaagccgggactagcaagttacagcagaccgtccctgcggatgctagtcccgactcaaagtgtccaatttgcctggacaggttcgataacgtcagttatttggatcgctgtcttcacaaattttgcttcaggtgtgtgcaggaatggagcaaaaataaagcagaatgtcccctttgcaagcagcctttcgacagcatctttcacagcgtccgcgccgaagatgatttcaaggaatatgtgctaagaccctcatataatggatccttcgtgactcccgaccgccgcttcaggtatcgaactacgctcactcgggagaggaatgcaagcgtgtactctcccagtgggcccgttaacaggcgaacaactacgccacccgatagtggagtgttgtttgagggcctgggtatttctacccgcccacgcgacgtggaaattccacaattcatgcgacagatcgccgtgcgcaggccgaccactgccgacgaacgttctttgagaaaaatacaggaacaggatatcattaacttcagacggacactgtacagggccggcgctagagtgcggaatatagaagatggcggacgttatcgcgatatctctgcggaattcttcaggaggaatcccgcctgtcttcaccgattagtgccctggctcaagagagaactcaccgtgctcttcggcgcccatggctcattagttaacatcgtgcagcatattattatgtcgaacgtgacacgatatgacctggagtcacaggcgttcgtttcagacctgcggccattcctgctcaataggaccgagcacttcatccacgaatttatttcttttgcaaggtcacccttcaacatggccgcttttgaccagcacgctaattacgactgcccagctccatcttacgaagaagggtcacactctgattctagcgtcatcaccatcagtcctgacgaggccgagacccaagaacttgacattaatgttgccacagtctcacaggctccctgggacgatgaaactccaggcccctcctacagcagctccgaacaggtacacgtgacaatgtcgtctctgctgaacacatcagactcttcagatgaggagttggttactggaggggccacttcccagattcagggggtacaaaccaacgatgaccttaataatgacagcgacgactcctccgacaattgcgtgatagtgggtttcgtgaagccacttgcggaacgcactccagagctggtggagttgtcctccgactcagaggatctggggagttacgagaagatggagactgttaagacacaagaacaagaacagtcatactcaagcggagacagcgacgtgtcccgctgttctagtccacacagtgtgctcggcaaggatgaacagatcaacaagggccactgtgactcctccaccaggatcaagtcaaaaaaggaagagaaacgctcaacatcattaagctcacccagaaacctcaactcatccgttcgtggcgaccgcgtctacagtccgtataaccatagacatagaaagcgtggacggtctaggtccagtgattcacgttctcagagtaggagcggccacgaccagaagaaccacagaaagcaccacggaaagaagaggatgaagtccaaaagatcgcggagtcgcgagagctcacggcctagagggcggagggataagaagagaagccgcactcgtgattcttcttggtcccggcggtcacagaccctctcactaagcagcgagtctacaagtcgcagcagatcccggtcctcagatcacggaaaacggcggtccagatctcggaaccgcgaccgttattacctcaggaataattacggtagccgctacaagtgggaatacacctactacagtcggaataaggaccgggacggttatgaaagctcctaccgcagaaggacactatctagagctcattattcgcgccaaagctcttcacctgagttccgggtccagtctttttcagaacgcacaaacgccaggaaaaaaaataatcactccgagcggaagtattactattatgagcgacacaggtcacgttcgttatcatcaaaccggagtcgcactgctagcacaggaactgatcgggtgagaaacgagaaacctggtggcaagcgaaagtacaaaactagacacctagaaggcactaacgaagtggcacaaccgtcaagagagtttgcctccaaggccaaggattctcattaccagaaatccagcagtaagctggatgggaactacaaaaacgagtctgataccttctccgatagcagatccagtgaccgggagaccaaacacaaacgccggaagaggaaaactcgctcgctttccgtggaaatcgtgtacgaagggaaggcaacggacacaacgaagcaccataagaaaaagaaaaaaaaacataagaagaaacataaaaagcatcacggagacaacgcatcgagaagccccgtggtgattactatcgacagtgacagtgataaggattctgaagtcaaggaggacacagaatgcgataattcggggcctcaagaccccttacaaaacgagttcctggccccatcgttggaacctttcgagacgaaagacgtagtgactatagaagctgagttcggagtgttggataaggagtgtgatatcgctaccctgtccaacaatctgaacaatgccaacaagacggtggacaacattccgcccttggcggcttctgtggagcagacacttgacgtccgagaggagagtacattcgtgagcgacctcgagaaccagccaagcaatatcgtgagtcttcagacggagccttcccgccagttgccttctccacgcacatcactgatgtcagtgtgcctcggtagagattgtgatatgtcttag

SEQ ID NO: 208840 - DNA, 999 bp, Artificial Sequence
  Description of Artificial Sequence: Synthetic coding sequence
atgaagctgggccgggccgtgctgggcctgctgctgctggccccctcggtcgtgcaggcagtcgaacccatctctctagggttggcactggctggagtgcttacaggttacatctatccgagactctactgcctattcgccgaatgttgcggacagaagcgatccctttcccgggaggctctccagaaggacctagatgataacctatttgggcaacaccttgccaagaagatcatactgaatgcggtgtttggattcatcaacaatcctaagcctaagaagccgctgaccctttcactccatggatggacgggaaccgggaagaactttgtgtccaagattatcgctgaaaacatctacgaagggggactaaattccgactacgttcacttattcgtggcaacattgcacttcccacatgcctccaacattacactgtacaaggaccagctgcagctctggatccgcggaaatgtgtccgcatgcgcgaggagtatttttattttcgatgagatggataaaatgcacgccggtctcatcgatgcaatcaagccattccttgattactatgacttggttgatggagtgtcctatcagaaggcaatgtttattttcctttcaaacgctggcgccgagagaatcaccgacgtggctctcgatttttggcggagcggtaagcagagggaagatataaagctcaaggacattgaacatgcgctctccgtttcagtcttcaataataagaatagtggcttctggcactccagcctgatcgataggaaccttatcgactacttcgtccccttcctgccattggagtataagcaccttaaaatgtgcattcgcgtcgagatgcagagtcgcgggtacgagatagatgaagatatcgtttccagggtcgccgaggagatgacctttttccccaaagaggaacgggtgttttctgataaaggatgtaaaacggtattcaccaagcttgattactactatgacgactag

SEQ ID NO: 208841 - DNA, 906 bp, Artificial Sequence
  Description of Artificial Sequence: Synthetic coding sequence
atgaagctgggccgggccgtgctgggcctgctgctgctggccccctccgttgtgcaagccgttgagccaattagccttggcctggctctcgctggcgtgttgacagggtacatctaccccaggttgtattgtctgttcgccgagtgttgcgggcagaagaggtcactttctcgggaggccctgcagaaagacctagacgataacttattcggccaacatttggccaaaaagatcattttgaatgctgtgttcggttttattaacaacccaaaaccgaagaaaccccttactctttccctgttcgtcgccactctgcactttccgcacgcctctaacatcaccctgtacaaggaccagctacagctgtggatccgcggaaacgtctctgcatgcgccagaagtatatttatttttgacgaaatggacaaaatgcacgcagggctgatcgatgccatcaaaccattcctggactactatgatctggtggatggggtgtcatatcaaaaagcaatgtttatcttcctgtctaatgctggcgccgaacggatcaccgatgttgctctcgatttctggcgatccggaaagcagagggaggacattaagctgaaggatattgaacacgccctgagcgtgagtgtcttcaataacaaaaacagtggcttttggcactcttcactgatcgatcgcaatctcattgactactttgtgccattcctaccgttagagtacaaacatctcaagatgtgcatcagggttgaaatgcaatctcgaggttacgagatcgatgaggacatcgtgtcgcgggtggccgaagagatgaccttctttcctaaggaggaacgcgtgttttccgataaggggtgtaagaccgtgttcacgaaattagactactattacgatgattag

SEQ ID NO: 208842 - DNA, 1011 bp, Artificial Sequence
  Description of Artificial Sequence: Synthetic coding sequence
atgctgcgggccggctggctgcggggcgccgccgccctggccctgcttctcgctgccagggtggtggctgcattcgagcctatcaccgtgggactcgccattggcgccgcctcggctattacgggctacttatcttacaacgatatctattgccgttttgcagaatgctgtagggaggagaggccactgaacgctagcgcgctgaaacttgacctggaagagaagctgttcggacaacacctggctactgaagtcatttttaaagctctgacaggattcaggaacaacaagaatcctaagaagccactgactctgtccctgcatggctgggctggaaccggaaagaatttcgtatcccaaatcgttgcagagaatctccaccctaaagggctgaaatctaattttgttcatctgttcgtaagtactctgcacttcccgcatgaacaaaagattaagctctaccaagatcaactgcagaagtggatccgcggtaatgtgagcgcctgcgccaacagcgtcttcatattcgatgagatggataaactccatcctggcattatcgacgctataaaaccatttctggattattacgagcaagtagacggcgtgagctatcgtaaggccattttcatatttttgagcaacgccggtggcgacctgatcaccaagacggctttggatttttggagagccggccggaagcgagaggatatccagctgaaagacctggaacccgtgctttctgttggtgtgtttaataataagcacagtggcctgtggcactctggcctcattgataaaaatctgatagactattttataccctttctccccttggagtatagacatgtgaagatgtgcgtgcgagctgaaatgagagccagaggtagtgctatcgatgaggacatagtgacaagggttgccgaggaaatgacatttttcccccgggatgagaagatctatagtgacaaaggttgcaagactgtccagtccagattggattttcattag

SEQ ID NO: 208843 - DNA, 426 bp, Artificial Sequence
  Description of Artificial Sequence: Synthetic coding sequence
tgacgggtggtggccgccttcgagcccatcaccgtgggcctggccattggcgcagcgtccgcaattacggggtatctgtcatataacgacatctactgccggtttgccgaatgctgcagagaagagaggccactgaatgccagtgccttaaaactcgacctggaggagaaactatttggacaacacctggctacagaagttatcttcaaggccttgaccggattcaggaacaataagaacccaaaaaagccattaaccctctccctccacggctgggccgggaccgggaagaattttgtgagccagatcgtggctgaaaatctgcaccctaagggcctcaagagcaacttcgtacatctgttcgtgagcacacttcactttcctcacgaacagaaaatcaagctgtaccagagttccctgacttag

SEQ ID NO: 208844 - DNA, 918 bp, Artificial Sequence
  Description of Artificial Sequence: Synthetic coding sequence
atgctgcgggccggctggctgcggggcgccgccgccctggccctgctcctcgctgccagagtggtggcggcatttgaacctatcaccgtcggactggcgattggtgccgcaagcgcaatcaccggctacctctcgtacaacgatatatactgtagattcgcggagtgctgtcgggaagaacgtccattaaacgcatccgccctcaagctggacctggaggaaaagctcttcgggcagcatctggcgacagaagtcatcttcaaggcactgacaggcttcagaaataataaaaaccccaaaaagccgctgacccttagcttattcgtgagtactctgcactttccccacgagcagaagatcaaactttaccaggaccagttgcagaagtggattagggggaacgtctcagcatgtgcgaactcagtcttcatcttcgacgaaatggataagttgcatcccgggatcatcgatgcaatcaagccattccttgattactatgagcaggtggacggtgtgtcttatcgcaaagcgatctttatatttctttcgaatgctggcggggacctgatcactaaaaccgccctggacttttggagagcagggcggaaaagggaagacattcaactcaaagaccttgaacctgttctctctgtgggagtttttaataacaaacatagtgggctttggcacagcggactaatagacaaaaacttgattgattattttataccttttctccctcttgagtatcgtcacgtcaaaatgtgcgtgcgggctgagatgcgagccagaggaagcgctatcgatgaggatattgtgacaagggtcgccgaagaaatgaccttctttccacgagatgagaagatatatagcgacaaaggctgtaaaaccgtccagtccagattggatttccattag

SEQ ID NO: 208845 - DNA, 1011 bp, Artificial Sequence
  Description of Artificial Sequence: Synthetic coding sequence
atgctgcggggcccctggcggcagctgtggctgttcttcctgctgctgctccccggtgctccggagccgagaggcgcatctcgaccgtgggagggcactgacgagcccggctccgcatgggcctggccaggctttcaacggctgcaggagcagctgagagctgcaggggctctttcaaaacgatactggacactgttctcttgccaggtgtggcctgacgactgtgacgaggatgaggaagccgccacggggcccctcgggtggagactgcccctcttggggcagcggtatctggacctgctgactacttggtactgctcgtttaaggattgttgccctcgcggggattgtcgcatatctaacaatttcacaggactcgaatgggacctcaatgtaagacttcacggccagcatcttgttcagcaactggttctacggaccgtgcgggggtaccttgagaccccacaacctgaaaaagccctcgccttgagtttccatggttggtcgggcactggcaagaattttgtggccaggatgctggtcgagaacctgtaccgggacggtctgatgtctgactgtgtgagaatgtttatcgcaacttttcacttccctcaccccaagtatgtggacctgtacaaggagcagttgatgagtcagatccgagaaacgcaacagctgtgccatcaaacgctcttcatctttgatgaggccgagaagttgcaccccggtctgctggaagtgctggggcctcacctagaacgccgggcccccgagggccaccgcgcagagagcccatggacaatcttcctgttcctttccaatctgaggggggatatcataaacgaagtggtgctcaagctcttaaaagctggctggagcagggaggaaatcacaatggagcacctggagccccacctacaggcggagatcgtcgagaccatcggattcagtttcctcaccacccgctggcctcacctggatttaccaacaagcagtgtggcccctacatag

SEQ ID NO: 208846 - DNA, 462 bp, Artificial Sequence
  Description of Artificial Sequence: Synthetic coding sequence
atgctgcggggcccctggcggcagctgtggctgttcttcctgctgctgcttcctggggcccccgagcctcgaggcgcctcccgcccttgggaagggacggacgaacccggatcagcctgggcgtggccggggttccagcggctacaggagcagctccgcgctgctggtgcactgtccaagcgatattggaccctgttctcttgccaggtgtggcctgacgattgcgatgaagatgaggaagcagccaccggacccctgggctggcggttaccgctgctcggtcagaggtatctggaccttctgactacttggtactgttcattcaaagattgttgtcccaggggggactgtaggattagcaacaacttcacgggaaagaattttgttgcacggatgctggtagaaaacctatatcgggacggtctgatgtccgattgtgtcaggatgttcattgcaacctag

SEQ ID NO: 208847 - DNA, 1194 bp, Artificial Sequence
  Description of Artificial Sequence: Synthetic coding sequence
atgctgcggggcccctggcggcagctgtggctgttcttcctgctgctgctgcccggagcacccgagccaaggggtgccagcaggccttgggaaggcaccgatgaaccagggtctgcctgggcctggcctggatttcagcgcctgcaggagcaactgcgtgctgccggcgccctctctaagagatattggacgctgttcagttgccaggtatggcccgacgactgtgacgaggacgaagaagccgcaaccggtcccttaggctggaggctgcccctcctcgggcaaagatatctggatttattgaccacttggtattgttccttcaaggattgctgtccacgcggggattgtaggatttccaataattttactggtctcgagtgggatctaaatgtcagactccacgggcaacatctggtccagcagctcgtgctgcgtacagtgaggggctaccttgagaccccgcagccggaaaaagcgttggccctatctttccacggatggtctggtacgggcaagaacttcgtggcgcgtatgctggtcgagaatctctatagagacggcttaatgtctgactgtgtgagaatgttcattgccacgttccacttcccccacccgaagtacgtcgatctctacaaggagcaacttatgagccagatccgcgagacccagcaactgtgtcaccagaccttgtttatctttgatgaggcagagaaactgcatccgggcctgttagaagtcctagggccgcatctggaacgacgtgcaccagagggacaccgcgccgagagcccctggacaatcttcctgttcctgtctaacttgaggggcgatattatcaatgaagttgtgctaaagttgctcaaggcaggatggagccgcgaagaaataaccatggagcatctggaaccgcacctccaagctgaaattgtggaaacaatagacaatggcttcggacatagccgtctggtaaaagagaacttgattgactattttattccttttcttcccctggagtataggcacgtgaggttgtgcgcccgagatgcttttctctcacaggaactcctctacaaggaagaaaccttggatgagatcgcccagatgatggtatacgttccaaaagaagaacagctatttagttcgcaagggtgtaagagcatctctcagagaatcaattacttcctgtcctag

SEQ ID NO: 208848 - DNA, 525 bp, Artificial Sequence
  Description of Artificial Sequence: Synthetic coding sequence
atgggcctgtgcgtgcccttcgccgtgaccaccagcttcctgagcctggggttagaatgggacttgaacgtgcggctgcatggacagcaccttgtgcagcagttggttttgcgcactgttcgggggtacttagagacaccacaacctgagaaggccctggctctgagttttcacggctggtctgggaccggtaaaaatttcgtggcccgcatgcttgtagaaaacctgtaccgcgatggcttgatgtcggactgtgttagaatgttcatcgcgaccttccacttccctcatcccaaatatgtggatctgtataaggagcagttaatgagccaaatccgcgaaacccagcagctttgccatcagactcttttcattttcgatgaagccgagaagctgcatccgggattgctggaggtcttgggaccacacctggagaggagagctcccgaaggacaccgggcagaaagcccctggaccattttcctgttcctgtccaatctcaggggagacattattaacgagtag

SEQ ID NO: 208849 - DNA, 1866 bp, Artificial Sequence
  Description of Artificial Sequence: Synthetic coding sequence
atggagttccccggcggcaacgacaactacctgaccatcaccggcccctcccatccattcctgagcggagccgaaactttccatacaccatccctgggggacgaggagtttgagatcccacctataagtctggatagcgaccctagtttagctgtaagcgacgtggtgggacacttcgatgacctggccgatccatccagctcccaggatgggagcttttccgctcagtatggtgtgcagacactggacatgccagttggcatgacgcacggtctgatggagcaaggcggcggtttgctctcagggggcctcaccatggacctggatcacagtattggtacccagtacagcgcgaacccgccagtaacaattgacgtgcctatgacagatatgacgagcggcctgatgggccattcgcagctgacaactatcgatcaatctgaactttccagtcaactggggctatcactgggcggaggcaccatactcccacctgcacaatctcccgaggatcgactctccacgacaccttctcctacctcaagccttcatgaggatggcgtggaggattttcggcgacagctgccctcacagaagaccgtcgtagtggaggcaggaaagaaacagaaggcccccaaaaaaagaaaaaaaaaagacccaaacgagccccaaaagcctgtgagcgcctacgctctgttcttcagggatacccaggctgcgataaaagggcagaacccaaacgcaacctttggcgaagtctcaaagatcgtcgcctctatgtgggactccttaggagaagagcagaagcaggtctacaagcgtaagacggaagcagcaaagaaggagtatctcaaagcccttgctgcttacaaggacaatcaggagtgccaggcaaccgtcgagacggtggagctggatccagctcccccctcacaaactccctcacctccgcccatggccaccgtggatcctgcctcgcctgcccccgcttctatcgagcctccagccctctccccaagcattgttgtgaactctacgttgagctcatatgtcgctaatcaagcctctagcggcgctggcggccaaccgaacataacaaagttgatcattaccaaacaaatgctgccaagtagcatcacaatgagtcaagggggtatggtgaccgtcatcccagccaccgtggtgacatcaaggggtctacagctcggccaaacgtccacggccaccatccagccaagtcagcaagcacaaatcgtgacccgctctgtgctgcaagccgccgccgcagccgcagccgcagcttccatgcaattgccccctccgcgacttcagccccccccacttcagcagatgccccagcccccaacacaacaacaagtcacaatactccagcaacctcctccactccaggccatgcagcagccaccaccccagaaagtcaggattaatctgcagcagcagcctccaccattgcaaataaaatctgtccctttgcccactctgaagatgcaaaccactttggtgccccctacagttgagtcatcccctgaacggcccatgaataatagcccagaagcgcacacggtggaggcccctagccccgaaacaatatgtgagatgataaccgatgtcgtgcccgaggtagaaagccctagccagatggatgtagaactggtgtcaggctctcctgtagccctctctccacagcccagatgcgtgagaagtggctgtgaaaatcccccaatagtctctaaggactgggataacgaatactgctcaaacgaatgcgttgtcaagcactgtagggatgtctttttggcctgggtggctagcagaaattctaatactgtggtcttcgtgaaatag

SEQ ID NO: 208850 - DNA, 1866 bp, Artificial Sequence
  Description of Artificial Sequence: Synthetic coding sequence
atggagttccccggcggcaacgacaactacctgaccatcaccggcccatcccatccgtttctctcaggcgcggagacattccataccccgagcctgggcgatgaagaatttgaaattccacccatttccctggactccgaccccagcctcgctgtgtccgacgtggtcgggcactttgacgatcttgctgatccttcgtccagccaggatggatccttttctgcacaatatggagtgcagacgctggacatgcccgtgggaatgacacacggtctcatggagcaaggcggtggactgctgtctggtggtctgaccatggacctggaccactctattggaacgcagtattccgcaaaccccccagtcaccattgatgtcccaatgaccgacatgacgtcaggtctcatgggccactcacagcttacaacaatcgaccagtcggagcttagcagtcagctgggtcttagtctcggaggcgggacaatcctacctcccgcccaaagcccagaggataggctatccaccaccccgagtcctacatcgtcgttgcatgaagatggagtggaggatttccggagacagcttccttcacagaagacagtggtggtggaagccggaaaaaagcagaaagctcctaaaaaacgcaagaagaaggatccgaatgaaccccagaagcccgtcagcgcttacgctctttttttccgggatacacaggcagcaattaaaggacagaatcctaacgctacatttggtgaagtgtctaaaatcgttgcctcaatgtgggattctctaggagaggagcaaaagcaagtgtacaagaggaaaaccgaggccgcgaaaaaagagtacctgaaagcccttgctgcttacaaggataaccaggagtgtcaggcgactgttgagaccgttgagctggaccccgccccgcctagtcagacgccaagccctccacccatggccactgtagatccggcctccccagcaccagccagtatcgagcctccggccctgagccctagtatcgtggtgaatagtaccctgtcatcctacgtggcaaaccaagcctcctcaggggctggcgggcaaccaaatataacaaagctgatcattacaaagcagatgctgccgtcctcaataactatgtctcagggcgggatggttacagttatacccgccacagtggtcactagccggggcttacaactgggccagactagcacagccactatacaaccttcccagcaggctcagattgtgactcgctctgttctgcaggctgccgcagctgctgccgccgccgcgtctatgcagcttccacccccgcggcttcagcctcctccactgcagcagatgccccagccgccaacccaacagcaggtgaccatccttcagcagcctccacctttacaggcgatgcagcagcccccgccacaaaaggtcaggataaatctacaacaacagcccccgcccttacagatcaagagcgtgcccctgcccacactcaaaatgcagactacactggtgcctcccacagtcgaatcatcgcccgagaggcctatgaacaacagccccgaggcacataccgtggaggctccttctcccgagacaatttgtgagatgattaccgatgtggtgcccgaggtggagtcacccagtcagatggatgtcgagctggtatctggttctcctgtggcactgagtccacagccccgctgcgtaaggtctgggtgcgaaaacccaccgatcgtatccaaggactgggacaacgaatactgctctaatgagtgtgtggtgaaacattgccgggacgtgtttctcgcgtgggttgcgagcaggaattcgaatacagtggtgtttgtgaagtag

SEQ ID NO: 208851 - DNA, 1797 bp, Artificial Sequence
  Description of Artificial Sequence: Synthetic coding sequence
atggagaccttccacacccccagcctgggcgacgaggagttcgagatcccccccatcagcctggactccgacccttctctggccgtgagcgacgtggtgggccacttcgatgacctggctgatccctcttcttcccaggacgggtcattttcggcacaatacggggtgcagacattggatatgcctgtgggcatgacacacgggctgatggagcagggaggcggattgctctcaggcggactcaccatggacctggatcactccatcgggacccagtattccgccaatccgcctgttaccattgacgtgcctatgacggacatgacgagcggactcatggggcattctcaactgacaactattgaccaatcagaactctctagccagttgggcctgtcacttggtgggggaactattctgcccccagcacagagtccggaggataggttgagtacaacaccatctcctacatcttcccttcatgaggacggggtggaggatttcagacgacaattgccatctcagaaaacagtggtggtggaagccgggaaaaagcaaaaagctcccaaaaagaggaagaaaaaggatccaaatgagccacagaagcctgttagcgcctacgccctgttctttcgggacacccaggctgcgattaaaggacagaacccaaacgccacattcggcgaagtgtccaaaatcgtggctagcatgtgggatagcctcggtgaggagcaaaagcaagtctacaagaggaagaccgaggccgccaaaaaggaatatctcaaagcccttgcagcatacaaagataatcaggaatgccaggccaccgtggagaccgtcgaactggatcccgctcccccatctcagacgcccagtccacccccaatggcaacagtagaccccgcatccccagcccccgcatccatagaaccccctgctctgtccccaagcatcgtggtcaacagcactctgagttcttatgtggctaatcaagctagctcaggggccggagggcaacctaatattactaagttaattataaccaagcagatgttgccaagtagcatcactatgagtcaaggtgggatggtcacagtcattcctgcaactgtggtgacctctaggggcctgcagttgggtcaaaccagcacggctaccatccagcctagccagcaggctcaaatcgtaactcgttcagtgctccaggctgccgcagctgcagctgccgccgcctcaatgcaactacccccaccgagactgcagcccccccctttgcagcagatgcctcagcccccaactcagcagcaggtcactatattacagcaaccgccgccgctgcaagccatgcagcaacctcccccccagaaggtgagaattaatttgcagcagcagcctcccccactgcagatcaagtctgtgccccttccaacgctgaaaatgcagactacactggtgccccctactgtcgagtcatcccctgagcgtcccatgaataactctcctgaggcccacaccgtcgaggcccccagccctgaaaccatatgcgagatgatcaccgacgtagtgcctgaagtcgaaagcccctcgcagatggacgtggaacttgtcagcggttcaccggttgccctgagcccccagccacgctgtgtaagatctgggtgtgagaatcctcccatagtgagcaaagattgggacaatgaatactgtagcaatgagtgcgtggtgaagcactgccgggatgtcttcctggcatgggtcgcttcaagaaattcaaacacagtggtgttcgtcaagtag

SEQ ID NO: 208852 - DNA, 1650 bp, Artificial Sequence
  Description of Artificial Sequence: Synthetic coding sequence
atgcggaacctgaagagccacctgagcccctggatcctgatcccccactggctatctcaaatgtggctggccaccctcatgacatggcagttctttagccccgacctggatcactcaatcggcacccagtactcagcgaacccgcccgtgaccatagacgtgccaatgaccgatatgacgtctggacttatgggacatagccagctgacaacaatcgatcagtccgaactaagttctcagctcggtcttagtctggggggtgggaccatcctaccccctgcccagtcgccagaggaccgtctgtcaaccaccccttctcccactagcagtcttcacgaagatggcgtggaggactttcggcgtcagctgccgtctcagaaaaccgtggtggtcgaggctggtaagaagcagaaggctccaaagaaaagaaaaaaaaaagaccctaacgaaccccaaaagccagtgagtgcgtacgcactgttcttccgcgacacacaggccgctatcaaaggacagaaccccaatgctacttttggggaggtgagcaagattgttgcgagtatgtgggacagtttgggagaagagcagaagcaggtgtataaacgcaaaaccgaagccgcaaaaaaagagtatctcaaggctcttgccgcatataaagataaccaggagtgtcaggccaccgttgaaaccgtcgagctagatccagcccctcccagccagacccctagtcccccccctatggccacagtggacccagcctcacccgcccctgcatcgatcgagccaccagccctgagcccctccatcgtggtaaattctaccctcagcagttacgtggctaaccaggcttcaagcggcgccggtggacagccgaatattaccaagcttatcatcacaaaacagatgctgcctagctctatcaccatgagtcagggaggcatggtgacagtaattcctgcgaccgtggttacaagcagaggcctccagctaggacagacatccaccgcgacaatccagccttcccaacaagcccagatcgtgactcggtccgtgctgcaggctgctgcagcggccgctgccgcagcctcgatgcagctaccacccccccggctccagccacctcctttgcagcagatgccccagcccccaacccagcagcaggtgacaatcctacagcagccccccccactccaggcgatgcagcagccaccccctcagaaggtccggatcaacctacaacagcagcccccccccctccagatcaaatctgtgccactgcccacactcaagatgcagacaacccttgtgccacccactgtggagtctagtccagagaggcccatgaataattctcccgaggcgcacactgtggaggctccgagccctgagaccatatgcgagatgattacagatgtagttcccgaagtagaaagcccttctcagatggatgtggaactcgtgagtggatcccccgttgctctgtctccccagccgaggtgtgtcaggagtggctgcgagaatccgcctatcgtgagtaaagattgggataacgagtactgtagcaacgagtgcgtcgtcaagcattgccgcgatgtgtttctagcctgggtggccagcagaaacagtaataccgtggtgttcgtcaagtag

SEQ ID NO: 208853 - DNA, 1020 bp, Artificial Sequence
  Description of Artificial Sequence: Synthetic coding sequence
atgatgcccttctgccacaacatcatcaacatcagctgcgtgaagaacaattggtcaaatgacgtgcgtgcctcactgtactctctcatggtgttaattattttaaccactctcgttgggaatctgatcgtgatcgtctcgattagtcactttaagcaacttcacacacccacaaactggctgatacattcaatggctactgtggattttctgctgggctgcttagtcatgccttactccatggttcgctctgccgagcactgttggtacttcggggaggtattctgtaaaattcataccagtacagacattatgcttagtagcgcctcaatcttccacctcagcttcattagtatagaccgctactatgccgtttgtgatccgcttaggtacaaggcaaagatgaatatattagttatctgcgtgatgattttcatctcctggagtgtgcctgctgtcttcgcctttggcatgatattcctggaactgaactttaaaggagctgaggagatatattataaacacgtgcactgccggggcgggtgctccgtgtttttcagcaagataagtggcgttctgacattcatgactagtttctatatacctggctcaatcatgctgtgcgtctattatcgcatctatcttatcgctaaagaacaagcccgtctcatctcagacgccaaccaaaaactgcagattggcttggagatgaaaaatggaatctcccaatcaaaagaaagaaaggccgtgaagaccctggggattgtcatgggcgtgtttctgatttgttggtgcccattcttcatctgcactgtgatggacccattcctgcactatattatccctccgacattaaatgacgtccttatctggttcgggtaccttaattctaccttcaatcccatggtgtacgcattcttctatccatggttcagaaaggcattgaaaatgatgctgttcgggaaaatcttccaaaaagattccagccggtgcaaactctttctggagctgtccagttag

SEQ ID NO: 208854 - DNA, 921 bp, Artificial Sequence
  Description of Artificial Sequence: Synthetic coding sequence
atgtacagcttcatggccggcagcatcttcatcaccatcttcggcaaccttgcaatgataatttcgatcagctacttcaaacagctgcacacgcccactaattttcttattttgagcatggctattaccgattttctgctgggcttcacaatcatgccttacagtatgattcggagcgtcgagaactgttggtacttcggcctcaccttctgcaaaatttattactccttcgacctcatgctgtccataactagcatatttcacctctgcagcgttgcaattgacaggttttacgctatatgttatccactgctctactctaccaaaatcacgattcccgtgataaagcgtctgctcctgctttgctggagcgtaccaggagcatttgcgtttggcgtcgtgttttcggaagcatacgccgatgggatcgagggatatgacatcctggtcgcatgcagctccagttgtccggtaatgttcaacaagctgtgggggaccactctgtttatggccggcttcttcacacctggatcaatgatggtcggaatatatggaaaaatattcgcggtgtcacggaagcacgcgcacgccatcaacaatctacgcgagaatcagaataatcaggtcaaaaaggacaaaaaggctgccaaaacactagggattgtaatcggcgtttttctgctttgctggtttccttgttttttcactatcctgttggatccctttctgaatttttcgactccagtggtcctgttcgatgccctgacatggtttggctattttaactcaacttgcaacccattaatttacgggtttttctatccctggttccgccgagccctcaagtacattcttctgggtaagatcttctctagttgttttcataacactattttgtgtatgcagaaggagtctgagtag

SEQ ID NO: 208855 - DNA, 1056 bp, Artificial Sequence
  Description of Artificial Sequence: Synthetic coding sequence
atggccgtgagcagcgagcagcacgagctgagccacttcaagcggacgcagaccaagaaagagaagtttaactgctctgagtacggaaacaggtcttgtccggagaacgagcgctccctgggagtcagggtcgctatgtactcgttcatggcagggagcatcttcatcaccattttcggaaacttggccatgatcataagcataagctattttaagcagctgcatacccccacaaacttcctcatcctctcaatggccataacagatttcttgttggggtttacaattatgccatattctatgatccgctctgttgaaaattgttggtatttcggcttaacattctgtaaaatctactatagttttgacctgatgcttagcatcactagtatcttccacctatgcagtgtcgccattgaccgcttttatgccatttgttacccactgctctacagtactaaaattactattcccgtaatcaagaggcttcttctgctgtgctggtccgtacctggggctttcgctttcggagtcgtcttttctgaagcgtacgccgatggcatcgaaggctatgacatacttgtcgcctgttcgagtagctgccctgtcatgttcaataagttgtggggtacaaccttgttcatggccggatttttcacccccgggtccatgatggtaggcatctacggcaagattttcgctgttagtcgcaagcatgcgcatgcgattaacaaccttcgcgagaaccagaacaatcaagtcaagaaggacaagaaggctgccaaaactctgggcatcgtgatcggcgtgttcctgctgtgctggtttccttgcttttttacgatcctgctggaccctttcttaaactttagcaccccggtggtattatttgacgccctgacctggttcggttactttaacagcacctgcaatcctctgatttatggattcttttatccttggttcagaagggccctgaaatacatcttgttgggcaaaattttctccagctgttttcacaacaccattctgtgtatgcagaaggaatcggagtag

SEQ ID NO: 208856 - DNA, 921 bp, Artificial Sequence
  Description of Artificial Sequence: Synthetic coding sequence
atgtacagcttcatggccggcagcatcttcatcaccatcttcggcaacctggctatgatcatctccatcagttacttcaaacagttacacacacccacgaatttcctgatcctctccatggcgataacagatttccttctcggctttaccattatgccatacagtatgattaggtcagtggagaactgttggtatttcggattgaccttctgtaagatttactacagctttgatctgatgttgtccattacaagtatctttcacctgtgcagtgttgctatcgacaggttctacgctatctgttatccattgttatacagcacgaagatcacaatccccgttatcaaacgtcttctgttattatgttggagcgttccgggggcctttgcattcggtgtggtcttcagtgaagcatacgctgatggtattgagggctatgatattctggtagcttgctctagttcatgcccagtgatgtttaacaaactctggggaacaacactgttcatggctggcttcttcactcccggtagcatgatggtgggcatctacggcaaaatattcgctgtttcccggaagcacgcacacgctattaacaatctgcgcgaaaaccagaacaatcaggtgaagaaggacaaaaaggccgccaaaacacttggtattgtcattggagtctttctgctatgctggtttccctgcttttttacaatcctcctggatccgttccttaatttttccacacccgtggtgttattcgacgcacttacttggtttggctattttaattctacctgtaaccccttaatttacggattcttttatccgtggtttcgccgggccttgaagtatattctactgggcaagatatttagtagctgcttccacaataccatcctgtgtatgcagaaagaatcagaatag

SEQ ID NO: 208857 - DNA, 1038 bp, Artificial Sequence
  Description of Artificial Sequence: Synthetic coding sequence
atgagcagcaacagcagcctgctggtggccgtgcagctgtgctacgccaatgtgaacgggtcttgcgtgaagattcctttcagccctggaagtcgagtcatcctctacattgttttcggattcggggccgttttagccgtcttcggcaacctgctggtgatgatatctatactccacttcaagcagctccattctccaaccaactttctagttgcatcactggcctgtgctgattttttggtgggagttactgttatgcctttttcaatggtacggactgttgagtcatgctggtactttggtagatctttttgcaccttccacacatgttgcgacgtggccttttgctactcatctctgttccatctttgcttcataagtattgatcggtatatcgctgtgacagaccccctggtgtacccgacaaagttcacagtaagcgtctccgggatctgcatctccgtatcttggattctccccctcatgtatagcggcgccgttttttataccggcgtgtatgacgacggcttagaggaactgagcgatgctctcaactgcatcggcgggtgtcagaccgttgttaaccagaactgggtgttaacagacttcctttctttcttcattcctacatttattatgataattctgtacggcaacatctttctggtagcccgccggcaggcgaagaaaattgagaataccggtagcaaaactgaatccagctccgagtcttataaagcacgggttgcacggagagagcggaaggctgcgaagacccttggcgtgaccgtagtcgcgtttatgatcagctggctgccctatagcatcgacagtctaatcgatgcattcatgggcttcattacacctgcatgcatctatgaaatctgttgctggtgcgcctattataatagcgctatgaaccccttgatctacgctctgttttacccatggtttcggaaggctatcaaagtgatagtgacggggcaagttctgaagaatagtagtgctaccatgaacctcttctccgaacatatctag

SEQ ID NO: 208858 - DNA, 957 bp, Artificial Sequence
  Description of Artificial Sequence: Synthetic coding sequence
gtgaacggcagctgcgtgaagatccccttcagccccggcagccgggttattctctatattgtgttcggattcggagcagtgttggcagtattcggcaacctgctggttatgattagtatcctgcatttcaagcaactgcacagccccaccaactttctggttgcttcgcttgcatgtgccgactttctggtcggcgtgactgtcatgccgttttctatggtaagaacagtcgagtcctgttggtatttcggaaggtccttctgcacattccacacatgttgtgatgtggcattctgctactcaagcctgtttcacctgtgtttcatcagtatagacagatacattgcagtgactgatccgcttgtgtatccaaccaagttcacagtgtctgtgtccggcatttgcatttcagtgagttggattctacctctgatgtactccggtgcggtcttttatactggggtgtacgacgatggactggaggaattgagtgatgccttaaattgcataggcggatgccagacggtggtcaaccagaactgggtcctcaccgatttcctgtcattcttcatccccactttcatcatgatcattctttacggaaacattttcttagttgcccgcagacaggcgaagaaaattgagaatacggaaagctacaaggcaagagttgcccggagggaaaggaaagctgctaaaacccttggcgtcacagtggtggcattcatgataagttggctaccatattcaatcgactccttgatcgacgcctttatgggtttcatcactcccgcttgtatctacgagatctgttgttggtgcgcctactacaatagcgccatgaacccgctgatttatgcattgttctacccttggttcagaaaagctataaaggtcatcgtcaccggccaggtgctgaaaaattcgtctgcaactatgaacctttttagtgaatag

SEQ ID NO: 208859 - DNA, 1410 bp, Artificial Sequence
  Description of Artificial Sequence: Synthetic coding sequence
atgcccatccgggccctgtgcaccatctgcagcgacttcttcgaccattctcgggacgtcgccgccattcattgcggccatactttccacctgcagtgtttgatccaatggtttgagacggccccctctagaacgtgtcctcagtgtcgtatccaagttgggaagagaacgattataaataaattgtttttcgacctggcccaggaggaggagaacgtgctcgacgccgagttcctgaagaacgagctggacaatgtgcgagctcagcttagccagaaagacaaggagaagcgtgactcacaggtcatcatcgacacgctgcgggacactcttgaagaaagaaatgcaacggttgtgtctctgcagcaggccctgggtaaggccgaaatgttgtgcagtacccttaagaagcagatgaagtatttggagcagcagcaggacgaaaccaagcaagcgcaagaggaggccaggcgcctgaggtccaagatgaagacaatggagcagatagagttattacttcagtcccagcggcccgaggttgaggaaatgatccgagatatgggcgtggggcaatccgccgtggaacagctggccgtctattgcgtctctctaaaaaaggagtacgaaaacctgaaggaagctcggaaagccagcggcgaggttgccgacaagcttcggaaggatttgttcagtagtaggtctaaactgcagaccgtgtattccgaactggaccaggcaaaactggaactgaaatcggcacaaaaggacctgcaatccgcagataaggagatcatgagccttaagaagaagctgactatgctgcaggagacactcaatttgccccccgtggcaagcgaaaccgtcgacaggttagtgctcgaaagtccagctccagtggaggttaatttaaagctgcggaggccctctttcagggatgatatagatttgaacgccactttcgacgtagatacaccgcctgctcggccttcctcaagccagcatggatactacgagaagctgtgcctggaaaagtcacacagccctattcaagacgtccctaaaaagatctgtaaggggccacgcaaggagagccaacttagcctgggtggacagtcctgtgctggtgaacctgatgaggagctcgtgggtgcttttccaatatttgtgcgcaacgccatcctgggccaaaagcagccgaaaagacctaggtcagagagcagctgtagtaaagatgtcgtccggacgggtttcgatggacttggagggcgcacgaagtttatccaaccgacagatacggtgatgatccgtcctctccccgtgaagcccaagactaaggtaaagcagagggttcgcgttaagaccgtgccgtctttgttccaagctaagctagatacctttctgtggtcgtag

SEQ ID NO: 208860 - DNA, 4059 bp, Artificial Sequence
  Description of Artificial Sequence: Synthetic coding sequence
atggccagcgacagccccgcccggagcctggacgagatcgacctgtctgcgttgcgggaccctgccgggattttcgaattggtcgagctcgtcggaaatgggacctacggacaggtttataagggccggcatgtaaaaacagggcagttagccgctatcaaggttatggatgttaccggggacgaggaagaagaaattaaacaggagatcaatatgctgaagaagtactcacatcaccggaacattgccacatattacggagcctttatcaagaagaatcctcccgggatggatgaccagctgtggctcgtgatggagttttgcggcgctgggtccgtgacagatcttattaagaacacgaagggaaacacattgaaagaggagtggattgcgtatatctgcagggagatactgagagggttgtctcacctgcaccaacataaagtcatacatcgggacatcaagggccaaaacgttctccttaccgaaaacgctgaggtgaagctcgttgactttggcgtgtctgcacaacttgaccggaccgtcggaaggagaaacacttttattgggacgccctattggatggcacccgaagtcattgcctgtgacgagaatcccgatgcaacatatgacttcaagtccgacttgtggtcactcggcattacggccattgaaatggctgaaggggcacctcccctgtgcgacatgcacccaatgagagctctgttcctcatccctcggaatcccgctccccggcttaagtcaaagaagtggagtaaaaaattccagagttttattgaatcatgtttggtcaagaaccattctcagagacctgccactgaacaactgatgaagcatccctttattcgagaccaacctaatgaacgccaagttcgaatccagttaaaggaccacattgatagaactaagaaaaaacggggagagaaggatgagactgagtacgagtatagcgggtctgaggaggaagaagaggaaaatgattcaggtgagcccagctcaatcttaaatcttccgggggaatccactctccgacgagattttctccggttgcaactcgccaacaaagagcggtctgaggcactgagacgccagcaactggaacagcagcagagggaaaatgaggaacacaagcgccagctgctagctgaacgacagaagcgtatcgaggaacagaaggagcagagacggcgcctcgaagaacagcaaagaagggagaaagagctcaggaagcagcaggaacgagagcagagacgccattacgaggagcaaatgcgccgagaagaggagagaaggcgagccgaacacgagcaagaatatattcgacgccaactagaggaagaacagcgacagcttgaaatcctgcagcagcagctcctgcacgagcaagctttactgctcgagtacaagcggaagcagctggaggaacagagacaggctgaacgtttgcagaggcagctgaaacaagaacgcgattacctcgtttccctgcagcaccaacggcaggagcaaaggcccgtggagaagaaacctctgtatcattacaaggaggggatgtcaccttcagagaagcctgcttgggccaaggaagtcgaagaacggagtcggttgaacaggcagtcttctcccgccatgccgcataaggtcgccaaccgcatatccgatcctaaccttccacctcgtagcgaatcctttagtatttcaggggtccaacctgcacggacccccccgatgctgcgaccagttgacccacagatcccccatttagttgccgtcaagtcccagggcccggcactgaccgcttcccagagcgtccacgaacagcccactaagggtctgtcaggattccaagaggctctcaacgtgacttctcatcgggtggaaatgccccgccaaaatagcgacccaacatctgaaaacccgcccctccccaccagaatcgagaaatttgacagaagctcctggctccggcaggaggaagatatcccccccaaggtgccccagagaacaacttcgatatcaccagccctagcaagaaaaaatagccccgggaacgggtctgcactcgggccgagactgggaagtcagccgatccgggccagtaacccggacctgcgtcggactgaacccatcctggagagcccgctacagcgcacttcctctggaagttctagttccagtagcacaccctcatcacagccaagtagccaggggggcagtcagccaggctcccaggctggtagttctgagcgaactcgtgtgcgagctaacagcaaaagtgaggggtcacccgttttgcctcacgagcccgcaaaggtgaaacccgaagagagccgcgacatcacccgcccctcacgtcccgctgacttaacagcgttggcaaaggagttaagggagctgcgaattgaggaaaccaaccgacccatgaaaaaggttactgattacagttcaagttccgaggaatcagagagctcagaggaagaagaagaggatggcgaatctgagacccatgacggcaccgtggcagtctcggacatccccaggctgatacctaccggggcccctgggagtaacgagcagtacaatgtaggcatggtaggcacacacgggctggagacaagccatgcagacagtttttcagggagcatttccagggaaggcacactcatgatccgagaaacaagcggggaaaaaaaacgcagtggacatagcgactccaacgggttcgctgggcatatcaacttgcctgacctggttcaacagtcccactctcctgcaggcactccaaccgagggtctcggcagagttagtactcattcccaggaaatggattcagggactgaatacggcatgggctccagcacaaaagcaagctttaccccttttgtggacccccgggtatatcagacttcacctactgatgaagatgaagaagatgaggagagttctgcggccgccctgtttacatccgagctgctgcggcaagagcaggccaagttaaacgaagctaggaaaatatcggtcgttaacgtgaacccgaccaacatccgaccacattctgacacccccgagatcagaaaatacaagaaacgatttaacagtgagatactgtgcgccgcgctgtggggagtgaacctcttggtgggaacagagaatggcctgatgctgctggaccgctctgggcagggaaaagtatataatttgatcaataggcgacgattccaacaaatggacgtcctggaagggttgaacgtccttgtgactatttcggggaagaagaataagttgcgtgtttattacctgagctggctgcggaaccgcatcctgcacaacgaccccgaagtcgagaagaaacaaggatggataaccgtcggagatctcgagggctgcattcattacaaggttgtgaaatatgagcggattaagttcttggttatcgcgctgaaaaacgctgttgaaatctacgcttgggcgcccaaaccctaccacaaattcatggcttttaagagctttgcagacctccagcacaagcccctgcttgtcgatttgaccgtggaggaaggacaacgcctcaaagtgatttttggcagccatacaggctttcacgttatcgacgtcgactctgggaattcttatgatatctacatacccagtcatattcaagggaatattacaccccacgctattgttattctgcccaaaaccgacggcatggagatgctggtgtgttatgaagacgagggggtgtatgtcaacacttacggtcgcattaccaaagatgtggtacttcaatggggcgagatgccgacatcagtggcatatatccactccaaccaaattatgggctggggtgagaaagccattgagatccgctcagtcgagacaggccacctcgacggcgtgtttatgcataaaagagcccagaggctaaagttcctgtgcgaacggaatgataaagtctttttcgccagtgtcaggtccggcgggagctcccaagtgttttttatgacactgaaccgaaattccatgatgaactggtag

SEQ ID NO: 208861 - DNA, 3831 bp, Artificial Sequence
  Description of Artificial Sequence: Synthetic coding sequence
atggccagcgacagccccgcccggagcctggacgagatcgacctgtctgcactccgagaccctgctgggatcttcgaactagtggaactggtgggcaacgggacttacgggcaggtctacaagggcagacatgtgaaaaccggacagttagctgctatcaaggtgatggatgttacaggggacgaggaggaggagattaagcaggaaatcaacatgctgaaaaagtactcccaccacaggaacatagccacctactacggagcatttatcaagaaaaatccccccgggatggatgatcagctctggttggtgatggaattctgcggggcgggcagtgtgaccgatttgatcaaaaataccaaggggaacactctgaaggaagagtggatcgcatacatctgccgggagatcttgcggggtctttctcaccttcaccagcacaaggtgatccatcgcgatatcaaaggacagaacgtcctcctgaccgagaacgctgaagtgaagctcgtcgacttcggcgtctctgcacagctggaccgtaccgtcggccggcggaacacctttataggcacaccttattggatggctcctgaggtgatcgcctgtgacgaaaacccagacgccacttacgactttaagtccgatctctggagtctgggcataacggccatcgagatggcagaaggtgccccacccctctgtgacatgcatcccatgcgcgccctgttcctgattcctagaaatccagcccctcgcctcaagtcaaaaaaatggagcaaaaaatttcagtcctttatcgaaagttgtttagtcaaaaaccacagtcagaggccagccacggaacaactgatgaaacatcccttcatacgggatcaacctaatgaaaggcaggtgcgcatccagctcaaagaccacatcgataggactaaaaaaaaacgcggtgaaaaagatgaaacagagtacgagtattccggctctgaggaagaggaggaggagaatgattctggggagccttcctcaattctgaatctcccaggcgaatccacgctaagaagagactttctgagactgcagctggcaaacaaggaaagaagcgaggctctgcggaggcaacaactggagcagcagcagagggagaacgaggaacataagcgccaactgctggctgaaaggcaaaagaggatagaggagcagaaggagcagaggcgccgcttagaggaacaacagcgtcgggagaaggagctgagaaagcaacaagagcgggaacagcgcaggcattacgaagaacagatgagaagggaagaggagcgacgaagggctgaacacgagcaagagtacaagcgtaaacaacttgaggaacaacgacaagccgaaagactgcaacgccaactgaagcaagagcgcgactatttggtcagtctgcagcaccagcgccaagaacagagacccgtggagaaaaaaccgctgtaccactataaggagggcatgagcccatcagaaaagccggcctgggccaaggagattcctcacctcgtggcggtcaagtcccaagggccagccctgaccgcatctcagagtgttcatgagcagcctactaaaggcctgtcgggcttccaggaagctctaaatgttactagccatagagtggaaatgccccgccagaacagcgatccaacaagcgaaaaccctcctttacccactcggatagaaaaatttgaccggtcgagttggttacggcaagaagaggatattcctcccaaggtgcctcaaaggacaacaagcatatcccccgcactggcacggaagaatagccccggaaatggttcagccctcggcccccgcctcggctctcagcctataagggcttcgaaccctgatcttcggaggacagaacccatccttgagagtcctctgcagcgtacatccagcggaagtagttcctcaagctccacaccatcttcccagccatcctcacaaggcggcagccagcctggcagtcaggcgggttcatcagaaagaactagggtgcgcgcaaatagtaaaagcgaggggagccccgtcctacctcacgagcccgcaaaagtcaaacccgaggagtctagggacattactcgcccgtcacgccccgccagctacaaaaaggccatcgatgaggatctcaccgccttagctaaagagctgagggaactgcggatcgaggagacaaaccgccctatgaagaaggtaactgactactcatctagtagcgaagagtcagagtcctctgaggaggaagaagaggacggtgaatcggaaacccacgacggtacagtggcggtgtcagatatcccgcggctcatccccaccggggctcccgggtcaaatgaacagtataacgtcggtatggtcggcacacacggcctggagacttctcacgcagacagcttttctggcagcattagtcgtgagggcactcttatgatacgagagaccagtggagagaaaaaacgcagcggccattccgactctaacggttttgcgggacacattaacctgcctgatctggttcagcaatcacattccccagccggtacacctactgaaggactggggcgagtctcaacccactcccaagagatggacagcggcaccgaatatgggatggggagcagcacaaaggcatcctttacccctttcgtggaccccagagtatatcagacatctccaacggacgaagacgaagaggatgaggagtctagcgcagccgccctctttacgtccgaactcttaaggcaggagcaggcaaaattaaacgaggctaggaagatttctgttgttaacgtcaaccctacaaacataaggcctcactccgacacccccgaaattcggaaatataagaagcgattcaacagcgagattctctgtgcagccctttggggcgtgaacctgctggtgggaaccgaaaacgggctaatgctgttagaccgctccgggcaggggaaggtatataacctgatcaatagacgaaggttccagcagatggatgttttagagggcttgaatgttctcgtgaccatttcaggaaagaaaaacaagctgagggtgtattatctgtcttggctccgcaacaggatccttcataatgatccggaggtagagaagaaacaagggtggataaccgttggagacctagagggctgcattcactacaaagtggttaagtacgagaggatcaagtttctcgtcatcgcactgaaaaacgccgtagaaatatatgcctgggcccccaaaccatatcataaattcatggccttcaagtccttcgctgacctgcagcacaaacctctcttggtcgatctcaccgtagaagagggtcagcgcctgaaagtgatcttcggctcacacactgggtttcacgtgatcgatgtggatagtggtaactcttatgacatatatataccttcccatattcaggggaatattacgccgcatgccattgtgatccttcccaaaacagatggcatggaaatgttggtatgctacgaagatgaaggcgtatacgttaatacctacggacgcattaccaaagacgttgttttgcagtggggagaaatgcccaccagcgttgcctacatccactctaatcagattatgggttggggggaaaaggctatcgagattcggtcggtggagacaggccacctggatggagtctttatgcataagagggcacagcgtctcaagttcctttgtgagcgtaacgacaaggtgttctttgcctctgttcgcagtggaggttcctctcaagtcttcttcatgaccctgaatagaaattcaatgatgaattggtag

SEQ ID NO: 208862 - DNA, 3996 bp, Artificial Sequence
  Description of Artificial Sequence: Synthetic coding sequence
atggccagcgacagccccgcccggagcctggacgagatcgacctgtccgccttacgggatcccgccggcatatttgagcttgtagaactcgtgggcaacggaacctacggacaggtctacaaaggccgacatgtgaagacggggcaactggctgcgatcaaagtgatggacgtgacaggggacgaggaggaggagatcaagcaagagattaacatgttaaagaagtactcccaccaccggaacattgccacctactacggcgcgtttatcaaaaagaatcctccgggtatggacgaccagctatggttggtgatggagttctgcggcgccggctctgttacagacctaattaagaacaccaaaggtaatacccttaaggaagaatggattgcctatatctgcagagagatcttgcgcggccttagccacttgcatcaacataaggttatccatcgggatatcaaaggacagaacgtcttgctcaccgagaatgctgaagtgaaactggtggacttcggggtgtcagctcagttggaccggacagtcgggcggagaaatacattcataggaactccatactggatggcaccagaggtgatagcgtgtgacgagaaccctgatgctacgtatgatttcaagtcagatctgtggagcctgggcatcaccgccattgaaatggccgaaggggcacccccattatgcgatatgcatcctatgcgcgccctgttcctaattccaagaaaccccgctcctagacttaaatctaaaaagtggtccaaaaagttccagtcctttatcgaatcctgtctagtgaagaaccactcacagaggcccgccactgaacaactcatgaagcacccatttattcgggatcagcctaacgaacgccaggtcaggatccagctcaaagaccacatcgatcgtaccaaaaagaagcggggggaaaaggatgagactgaatacgagtactctggaagcgaagaagaggaggaggagaatgattccggagaacctagttcgattttgaacctacccggcgagtcaacactcaggcgtgactttttaagacttcaactggcgaacaaggaacggagcgaagctcttaggagacaacagctggagcagcaacagagagagaatgaagagcacaagcggcagctgctcgccgaaaggcagaagaggatagaagagcagaaggagcaaagacgcagattggaagaacaacagcgaagagagaaggagcttcggaaacagcaggaacgcgagcaaaggcgccattacgaagagcagatgcggagggaagaggaacgacgaagggcggagcatgagcaggagtacaagagaaaacaactggaggaacaaagacaggccgaaaggcttcagaggcagctgaagcaggagcgcgactatctcgtgagtctccaacaccagcgacaggagcagcgtcctgtcgaaaagaagcccctataccactacaaagagggcatgagtcccagcgagaaaccggcgtgggcgaaagaggtagaggagcgtagccgactcaataggcagagcagtccagccatgcctcacaaggtggcgaataggatctctgatcctaatctcccacctcgctctgaatcattttctataagcggggttcagcccgctaggacacccccaatgttgagacccgtggaccctcaaataccccatttggttgcggtgaaatcacagggtcctgcacttacagcatctcaaagcgtgcatgagcagcccactaaaggactgagcggcttccaggaagctctaaacgttacgtcacatcgtgtggaaatgccaagacaaaattccgaccccacctccgaaaatccgcccttaccaactcgaatcgaaaaattcgaccggagtagttggcttaggcaggaggaggacattccacccaaggttccgcagaggacaacttctatctcccccgccctggctcgcaagaattcccctgggaacggtagtgcactggggcccagactgggctcacagccgatccgcgcgagtaacccagacctgaggagaacggagcctatcctggagtctccattgcagcggaccagtagcgggtcatcgtcttcctccagcactccttcttctcagccaagctcccagggtggaagccaacctgggtctcaggccggctccagtgagcggaccagggtacgcgcaaactccaagtccgagggcagccctgtcttgcctcacgaacctgcaaaggtaaagcccgaggagagtagggacatcactcggcccagcagacctgccagctacaagaaggccatagacgaagatctgaccgctctggcgaaggaacttagggagctccggattgaggagaccaacagacccatgaaaaaggtaacggactattccagctcgtctgaagagtctgagtcatccgaggaagaagaagaggacggggagtcagaaacccacgatggaaccgtggccgtttctgacattcccagactcatcccgaccggtgctcccggctccaacgaacagtacaatgtgggaatggtcggtacccacggtctcgagacaagccatgccgacagtttcagcgggtccatatcccgggaggggaccctcatgatcagggagacaagcggggaaaaaaaacgaagtggacactctgatagtaatggattcgcagggcacattaatcttcctgacctggttcagcagtctcattcaccagcagggacacctacagaggggctgggcagggtgtccacacactcacaggagatggactccggtacagagtatggcatggggtcatctacaaaagcctctttcaccccatttgtggacccacgtgtgtatcaaacttcaccaacggacgaagacgaggaggatgaagagagctcggccgcagccctattcacgtccgaattgctacgacaagagcaggccaagcttaacgaggcccggaaaatctcagtggtcaatgttaatccaacaaatatcagaccccactctgatacacctgaaattcgtaaatacaagaagcggtttaactcagaaatactgtgcgccgctctctggggggtgaaccttcttgtcggcaccgagaacgggcttatgctcctggaccgcagcggtcaggggaaagtgtacaacctgatcaatcgacgcaggttccaacagatggatgttctagagggcctcaatgtgctggtgactatatcaggcaagaaaaacaagcttcgtgtctactacctgagctggctgagaaacagaatactgcataacgaccctgaggtggagaaaaaacagggctggatcacagtcggcgatctagagggctgcatccactacaaggtggttaagtacgagaggattaaattcctcgtgattgccctgaaaaacgccgtggagatttatgcttgggcaccaaagccctaccacaaatttatggcgtttaagtctttcgcagatcttcaacataagcccttgctggtggatctgactgtggaagagggccagaggctgaaggttatatttggttcccatacaggcttccacgtgatcgacgttgattcagggaatagctatgacatctatataccctcccacattcaaggtaatattaccccacatgccattgttattctcccaaaaaccgatggcatggagatgctggtgtgttatgaagacgagggagtatatgtcaacacatatgggcggattaccaaggatgtagtccttcagtggggggaaatgccaaccagtgtggcttacatccacagtaaccagatcatgggatggggggagaaagcgatcgagattcggagtgtggaaacgggacacctggatggggtgttcatgcataaacgggcacaaagactcaaattcctgtgtgaaaggaacgacaaggttttctttgcaagcgttcgcagcggaggatctagtcaggtgttttttatgaccctgaatagaaacagtatgatgaattggtag

SEQ ID NO: 208863 - DNA, 4017 bp, Artificial Sequence
  Description of Artificial Sequence: Synthetic coding sequence
atggccagcgacagccccgcccggagcctggacgagatcgacctgtccgctctgagagatcccgctggcattttcgaattagtggagttagtgggaaacgggacttacgggcaagtctacaagggtcgccatgtgaagaccggtcagctggcggcaatcaaagtgatggatgtgaccggggacgaggaggaagagatcaaacaggaaatcaacatgcttaagaagtattctcaccatagaaatattgcgacttactatggtgctttcattaagaagaatccgcctggcatggatgatcagctatggctcgtgatggaattctgcggagccgggagcgtgaccgatttaataaagaatacgaagggcaacacattaaaagaagagtggattgcttacatatgtcgagaaattttgcgcggactatcacatctgcaccagcataaagtgattcatcgcgatatcaaggggcagaacgtgctcctgaccgaaaacgcagaggtgaagatcgtagattttggggtgagtgcccagctggatcggactgtggggcgcagaaatacgttcatcggaaccccctactggatggcaccagaggtgatcgcctgcgatgaaaatccagacgctacttacgacttcaaaagcgacctttggagtttaggcatcaccgcaattgagatggccgagggggctcctcccctctgcgacatgcatcctatgcgcgcactgttcctcatcccccgcaaccccgctccacggctgaagtcaaaaaaatggtcaaagaagttccagtcattcatcgaatcctgcctggtgaaaaaccactcccagagaccagccaccgagcaattgatgaaacacccctttatccgcgaccagcctaatgaacggcaagttcggatacagctgaaagaccatatagatcggactaaaaagaaacgtggagaaaaggatgagactgagtatgaatactccggatcagaggaagaggaagaggaaaacgacagcggagaaccctcgtcgatcctgaatctacctggggaaagtaccctccgccgcgattttttgcggcttcaactggctaacaaggaacgcagtgaagctctcagacgccagcagttagagcaacagcagcgcgaaaacgaagagcataaaaggcaactccttgctgagcggcagaaacgaatagaggaacagaaggaacagcgcaggcgattggaggagcagcagaggcgcgaaaaggaacttcggaagcagcaagagcgcgagcagcggaggcattatgaagagcagatgcgaagggaagaagaacggcgacgcgccgagcatgaacaggagtacaaacgtaaacaactcgaggagcagcgccaggctgagcgtctccagcggcagctgaagcaggagcgggattatctggttagtcttcaacaccaaagacaagagcagaggccagtagagaaaaaacccttgtatcattacaaagaaggtatgagcccttcagaaaaacctgcctgggccaaggaagtcgaagagcggagcaggctgaacaggcagtcatcacctgcaatgcctcacaaggtggccaacaggatctctgaccccaatctgcctcctcggtccgagagcttctcaatttctggcgtgcagcctgctcgtactcctcctatgctgagaccagtggatccacaaatcccacacttagtagccgtgaagagccagggacctgccctaacagcatctcagtccgtccacgagcagccaactaaaggactgtctggcttccaagaggccctcaatgtcacgtcccatcgggtagagatgccaaggcagaatagtgaccccacaagtgagaatccccccctgcccacacggatcgagaagtttgataggagttcctggctgaggcaggaagaggacatccctccaaaggttcctcagcgcaccacgtcgataagtcctgccctggctagaaagaatagccctggcaatgggagcgcccttgggccaagactcggttctcagcccatcagggcaagtaatccagatctgcgacgtactgagcccattctggagtctccacttcagcgtacgagctcaggttcgagttcgtcctcctccacacctagcagccaaccaagcagtcaaggaggctcccagcctgggtcacaagccggaagctcagagcgcacgagggtgagagcgaatagtaaatcagaagggagcccagtcttgcctcatgagcccgctaaagtgaaacctgaggaatcacgggatatcactaggccatctcgaccagcagtatctgctttcctctcgaaaagctttgaattgttaatctatcaggatttgaccgcattggccaaagagcttcgagagctgaggatcgaagaaactaacaggcctatgaagaaggtgacggactactcttcctcctcagaggaaagtgagtcctcggaagaggaggaggaagacggcgagtcagaaactcatgacggaaccgtggccgtgtctgacatcccaagactgatccccactggcgcgcctggatcgaatgagcagtacaacgttggcatggtgggaactcatggtctggaaacctcccatgcagacagcttctccgggagcatcagccgcgaaggcaccctaatgataagagagacttcgggcgaaaagaagcggagcggccactcagactccaatggattcgctgggcatatcaacttgccggatctcgtccaacaatcccacagtccagctggtacacccaccgagggattaggcagggtgtcaacacattcacaggagatggatagtgggacagagtatggcatgggaagtagcaccaaagcgagttttaccccgttcgttgatccaagagtatatcagacatcgcccaccgacgaagacgaggaggacgaagagtcttcagccgcagccctgtttactagtgagctgctcaggcaggagcaggcaaagcttaatgaggctcgcaagattagcgtcgtgaatgtcaaccctaccaatatccggccccactcagacacccccgagatcagaaaatataagaagcggttcaattcggagatactatgcgcagccttgtggggcgtcaatctacttgtgggtacggagaatggcctaatgctcctcgataggtcagggcagggaaaagtttataacttaatcaacaggcgtcggtttcaacagatggacgtgctagaaggactcaacgtgctagtgacaatcagcgggaaaaagaacaaactgcgagtgtattacttatcttggttgaggaacagaatcctccacaacgaccccgaggtcgaaaagaagcagggctggatcaccgtcggggacctcgaagggtgcatccactataaagtcgtcaagtatgaacgaatcaagttcctggtgattgctctgaaaaatgccgtggagatctatgcctgggcacctaagccttaccacaaattcatggcttttaagtctttcgccgatttacagcataagccactgctggtagacctcacagtggaggaagggcagagactaaaggtcatatttggcagccacactggatttcacgtgatcgatgtggacagtgggaactcatatgacatctacatacctagccacatccagggtaatattactccacacgcaatcgtgatcttaccaaaaacagacggcatggagatgttggtgtgttatgaggacgaaggagtatatgtcaacacatacggaagaatcacaaaagacgttgtcctacagtggggtgagatgccaacctcagtggcttatatccactccaatcagattatgggctggggcgagaaagcgattgagatcaggtccgttgaaactggccacctggacggagtgttcatgcacaaacgggcgcagagactcaaattcctgtgtgagagaaacgacaaagtgttttttgcttctgtccggagcggtggatctagtcaagtgtttttcatgactttaaatcggaactcgatgatgaattggtag

SEQ ID NO: 208864 - DNA, 4083 bp, Artificial Sequence
  Description of Artificial Sequence: Synthetic coding sequence
atggccagcgacagccccgcccggagcctggacgagatcgacctgtctgccctgagagacccagctggaatcttcgagctcgtggagctggttggaaacggcacctatggccaggtgtacaaaggccgccatgtgaaaactggccagctcgctgctattaaagtgatggatgtgaccggggacgaggaggaagaaataaagcaagaaattaacatgctcaagaaatattctcaccataggaatattgccacatactacggagcatttatcaaaaagaatcctcccggtatggacgaccaactctggctggtcatggagttttgtggggccggcagtgtcaccgacctcatcaaaaataccaaaggaaataccctcaaagaagagtggatcgcgtatatatgtcgagagatcctgaggggtttatcccacctgcaccagcataaagttatccaccgtgatattaaaggccagaacgtgctacttaccgaaaacgccgaagtaaagctggtggactttggagttagtgcgcagttagataggaccgtgggacggcgcaacaccttcattgggacaccatattggatggcccctgaggtaatagcttgcgatgaaaaccccgatgcgacctatgattttaagagcgatctgtggtccctgggtattaccgccatagagatggccgagggagctccccccctgtgtgacatgcatcccatgagggctctgttcttgattccacggaacccggctcctagactaaagtctaagaagtggtcaaagaagtttcagtccttcatcgagtcatgtctggtgaagaaccacagccagcgaccagccaccgagcaactgatgaaacacccattcatccgagatcaacctaatgagaggcaggtccggatccaattaaaagaccatattgacaggacaaagaagaagcggggggagaaggatgaaactgagtacgagtactctggatcagaggaggaggaagaagaaaacgattccggagaaccaagcagcatcctcaatttgcccggcgagtctaccctcaggagagacttccttaggctgcagctcgcgaataaagagaggtccgaggcactgcgcaggcagcagctggagcagcagcagcgcgagaatgaagaacataaaagacagctgttagccgaacggcagaagcgcatcgaagagcaaaaagagcagaggcgtcgcctggaggaacagcagcggagggagaaagaactgcgcaaacagcaagagagggagcagcggaggcactacgaggagcagatgaggcgagaggaggaaaggcgcagggcagagcacgagcaagaatacataagaagacaattggaggaggaacaacgtcaactggagatcttacagcaacaattactgcacgaacaggccctcctgctggaatataagcgaaaacagttggaagagcagcggcaggcggagagactgcagcgccagctgaaacaagagcgagactatcttgtgagcttgcagcaccagcgccaagaacagcgacctgtggagaaaaaacccctgtaccactataaggagggcatgtctccaagtgagaaaccagcgtgggccaaagaagtggaagagcgatcacggctgaatagacagagctctccagctatgccccacaaggtagcaaatcgcatctccgaccccaatctcccccctcggtctgagtctttttccatcagcggagttcagcctgcgagaaccccccctatgctgcgaccggtcgacccacaaattccacacctggtcgccgtcaagtctcaagggccagccctgacagcctcccagagcgttcacgagcaaccaacaaaagggctgtccggcttccaggaggcgcttaacgtgacaagccaccgggttgagatgcctagacagaactcagaccctacgtcagagaacccacctctgcccacccggatcgagaagttcgatagaagttcttggctccgccaggaggaagatattcccccgaaggtgccacagcggactacctccatttcccctgcactggcgaggaagaattcgcccggaaatgggtctgcactgggcccacgccttggctcgcaacccatacgggcttcgaaccccgatttgcgcagaaccgagcccatcctggaatctccactgcaacggacaagcagtggttcgagctccagcagctccaccccatcttctcagccctcgtcccagggcggtagccaaccgggctctcaagccggaagtagcgaaagaacacgtgtgcgagctaatagcaaatccgaaggctctcctgttctacctcacgagccagccaaagtgaaacccgaagagagtcgggacatcactcgcccatcccggcccgccagctataaaaaagctatagacgaagatttaactgcactcgcaaaggaacttcgcgaactccgcattgaggagaccaacagacccatgaaaaaagtgaccgactactcttcatccagcgaggaatctgaaagttctgaggaagaagaagaggatggagaatctgagactcacgacggcaccgtggccgttagcgacattccaagactcataccaacaggtgccccgggttccaatgaacagtacaatgtgggtatggtcgggactcatgggttggaaacttcccatgccgactcattttccggcagtatcagccgcgagggcaccctcatgattagggaaacgagcggagagaagaagcgttcggggcattccgatagcaacggcttcgcaggtcatattaacctccctgacttggtgcaacagtcccacagccctgctgggacacctacagagggattggggcgagtgtcaacccactcccaggagatggacagcggcaccgagtacggcatggggtcctccaccaaagctagttttactcccttcgttgacccaagggtctatcagacttcacctaccgacgaggacgaggaggacgaagaaagttccgccgctgccctcttcacgtccgaattgctcagacaagagcaggcaaaacttaacgaggctcggaagatttccgtggttaacgtgaatccaaccaacatccgcccgcattccgatactcccgagataaggaagtataaaaagcgctttaattctgagatcctttgcgctgctctgtggggggtaaatctactggtgggtactgagaatggcctaatgttactggacagatctggtcaagggaaggtttataatctgattaatcgcaggcggttccagcaaatggacgtcctagaggggctgaatgttttggtgacaattagcggcaaaaaaaacaaactaagggtatattacctctcttggctacggaatcggattctccacaatgatcccgaggtcgagaaaaagcagggttggattacagtaggagacttagaaggatgtatccactacaaggtggtgaagtatgaaaggatcaaattcctggtgatcgctttgaaaaatgctgtggaaatatacgcctgggctcctaagccctatcacaagttcatggcatttaagagcttcgccgacctccagcacaagccgctgctcgtagacctgacagttgaagagggacaaagattgaaggttatttttggctctcatactggctttcacgtcatcgacgtggatagcgggaactcatatgatatatacatcccttctcacatccaggggaacatcacacctcatgccatcgtaatccttcccaaaacggacggtatggaaatgttagtgtgctacgaggatgagggcgtttatgtgaatacatacggaaggatcacaaaagatgtagtccttcagtggggtgaaatgcccacatctgtggcttatatccattccaaccagattatgggttggggtgaaaaggccatcgaaatcagaagtgtggagaccggccacctcgacggcgtctttatgcacaagcgggcccagcgcctaaagtttctctgtgaaaggaacgataaagtgttctttgcgagcgtgcgttctggcggctcgagccaggtctttttcatgacccttaatcgtaattccatgatgaactggtag

SEQ ID NO: 208865 - DNA, 3894 bp, Artificial Sequence
  Description of Artificial Sequence: Synthetic coding sequence
atggccagcgacagccccgcccggagcctggacgagatcgacctgtccgctctgcgcgacccagctggcattttcgagctagttgaactggtgggcaacggaacctacggccaggtgtataaaggccggcacgttaagaccgggcaactcgcagccatcaaggtgatggatgttacgggcgacgaggaagaggagatcaagcaagagattaatatgctaaagaagtactcacaccaccgcaatatcgctacctactatggcgcgttcataaaaaaaaatccacccgggatggacgaccagctctggctggtaatggagttctgtggggctggatctgttacagacctgattaaaaacactaaaggaaatacactgaaggaagagtggatcgcctacatttgtagagagatcctgcgtgggctcagccacctgcatcaacacaaagtcatccatcgagatattaaaggccaaaacgtcctgctgactgagaatgccgaggtaaagctcgtcgacttcggggtgtctgcccagctggaccgcaccgtgggtcgcagaaataccttcattggaaccccttattggatggctccggaggtaatcgcttgcgatgaaaatcccgacgccacttacgactttaaatcagacctctggagtcttggcataactgctatcgaaatggctgagggcgctccccccttgtgcgacatgcatccaatgcgagccctctttctcattcctcggaacccggcccctcgcctgaagagtaaaaagtggtcaaagaagtttcagagctttatcgagtcatgtctggtgaagaaccactcacaacggcctgctactgaacagctaatgaaacatcccttcataagggaccagcccaacgaaaggcaagtgagaatccagctgaaagaccacattgacagaacaaagaagaagcgcggcgagaaagacgaaaccgaatacgaatacagtggaagtgaggaagaagaggaggagaatgactcgggcgaaccctccagcattctgaacttgcccggggagtcgacgctacggagggactttctgaggcttcagctggccaacaaggagcggtctgaagccctgcggcggcagcaactcgagcagcagcaaagggaaaacgaggagcacaagagacagctcctcgcagaaagacagaagcgcatcgaggaacaaaaagaacagaggcgcagacttgaagagcaacagaggcgcgagaaagagcttagaaagcagcaggagagagagcagagacgacactatgaagagcagatgcgcagggaggaggagcggagaagagcggaacatgagcaagagtacatccgtagacagcttgaggaagaacaacggcagttggaaattctacagcagcagcttctgcatgaacaggcactactcctagagtacaagcggaagcagcttgaggaacagagacaggccgaacggctgcagcgacagctgaagcaggaacgcgactacctcgtcagcttgcagcaccaaaggcaagaacagcgtcctgttgagaagaaacccctgtatcactacaaagagggtatgtctccgagcgaaaaaccagcttgggcaaaggagatccctcatctggtagctgtcaagagccagggacccgcattgacagccagccaatctgttcatgaacagcccactaaaggcctgagcggtttccaggaagctctgaatgttacctcgcatagggtcgagatgcctcggcagaactccgatcctacctccgaaaatccgccgctgccgaccagaatcgaaaaattcgatagatcaagttggctccgccaagaggaagatatcccacccaaggtgcctcagcggaccacttctatctcgccagctctggctagaaaaaatagccccggcaatggctcagccctcgggccacgacttggctcacagccaataagggcctcaaatcctgacttgcgtcgaactgagccgatcctcgagtcaccgttacagcggacctcttctggcagttcgtctagttcttccactccttcttcccagccatcttcgcagggaggatcacagcccggtagccaggctggaagtagcgaacgtactcgggtgagggcaaattctaaaagtgaaggatcccctgttctccctcacgagcctgctaaagtcaagcccgaggaaagccgagacatcacacgtccttctagaccagcggacctcacagcccttgccaaggagctccgcgagttgagaatcgaggagaccaatcgtccaatgaagaaggtgactgactactcaagtagttccgaagagtctgaatcttctgaggaagaagaggaggatggggagagcgagacccacgatggcactgtggccgtgtccgatattccccgactaatccccactggagccccagggagcaatgagcagtataatgttggcatggtcggtactcacggtctggagactagccacgcggacagtttctctggctctataagccgcgagggaactctgatgatccgtgagactagtggagagaagaagaggagcgggcactccgacagcaacggtttcgccggacacattaatctgccagacctggtgcaacagtctcactcccccgcaggaacaccgacagagggactgggccgagttagcacccatagccaggagatggactccggaactgaatatggtatgggaagcagcaccaaagcgagcttcacccctttcgtcgacccgcgggtgtatcagactagcccaactgatgaggacgaggaagatgaggagagctcagctgcagctcttttcactagcgaactgctgcgccaggagcaggccaagctaaacgaagctagaaagatcagcgtcgtgaacgttaaccctacaaacattaggccccacagcgacacacctgagatcagaaaatacaagaaaagatttaattcagaaattctgtgtgccgctttgtggggggtcaatctcctggtcgggactgagaatggattgatgctgctcgacaggagtgggcagggaaaagtgtataatctgattaatcgccggcggttccagcaaatggatgttctggaaggtcttaacgtattagtgacgatctctgggaaaaagaacaaactgagggtgtactatctttcctggctgaggaaccgcatccttcacaacgacccggaggttgaaaagaagcagggttggattacagtaggcgatctggaaggatgcattcattacaaagtggtaaagtacgagcgcatcaagttcctagtcattgccttgaaaaatgctgttgaaatctacgcttgggctcctaagccctaccacaaattcatggccttcaagtcctttgcggatctccaacataaacccctcctcgtggacctgacagttgaagagggtcagcggctcaaggtaatctttgggtcccatactggctttcacgtcatcgatgtggacagcggtaacagctacgatatatacatccccagccatattcagggcaacatcacacctcacgccatcgtgatcctgccgaagaccgatgggatggagatgctggtttgctacgaggatgagggcgtgtacgtaaacacctatggacgtattacaaaagacgttgtgcttcagtggggagaaatgcccacaagcgtggcctacatacattcgaaccagatcatggggtggggggaaaaagctatagaaatcagaagcgtagagaccggccatctcgatggggtctttatgcataagcgagcgcagcgccttaagtttctgtgtgagcgcaatgataaggttttctttgccagtgtccgatccggggggtcttcccaagtgttttttatgactcttaatagaaacagtatgatgaactggtag

SEQ ID NO: 208866 - DNA, 3972 bp, Artificial Sequence
  Description of Artificial Sequence: Synthetic coding sequence
atggccagcgacagccccgcccggagcctggacgagatcgacctgtccgccttgcgggaccccgccgggatttttgagcttgtggagctagtgggcaatggaacatacgggcaagtatataaagggcgccatgtcaaaactggacaactcgcagcaattaaggtgatggacgtcacaggtgacgaagaggaggaaatcaagcaagagatcaatatgctgaaaaagtatagtcatcaccggaatatcgccacttattatggcgcttttataaaaaaaaatccgccagggatggacgaccagctctggctggtgatggagttctgcggagccggttcagtgaccgatcttatcaaaaacacaaagggcaacacactgaaagaggagtggatcgcctacatttgccgggaaatcctgcggggactgtcacatctgcatcagcataaggttattcatcgcgatataaaggggcagaatgtgctactcaccgaaaacgctgaggttaaattggtggattttggagttagcgcacaactggaccgtacagtagggagaagaaatacttttatcgggactccatactggatggcacccgaagtcatagcctgtgacgagaaccccgacgccacctatgattttaagtccgacctgtggtcgctgggtattacagccattgaaatggccgaaggagccccacccctgtgtgacatgcatccaatgcgagccctgtttttgatcccgcgtaatccggctccccggcttaaatcaaagaaatggagcaagaagttccagtcttttattgagtcctgcttggtcaaaaaccacagccagcgtcccgcaacggagcaattaatgaagcatccttttatccgcgatcagcccaatgagagacaggtgaggatccagctcaaagatcacatagaccgcactaaaaagaagaggggcgaaaaagatgaaacagagtacgagtacagcggatcggaggaggaagaagaggaaaatgatagcggtgagccgagcagtatcctgaatttgcctggcgagtctaccctgcgtcgggatttcttgcgcttacaactcgctaataaggagcgatctgaagccctcaggagacaacagctggagcaacagcagagggagaatgaagagcacaagcgccagctattagcagaacggcagaaaagaattgaagaacagaaagagcagagacggaggcttgaggagcaacaacgccgggaaaaagagctccgcaaacagcaggagagagaacagcgacgccactacgaagaacagatgaggcgtgaggaggagcgcaggagagccgagcacgaacaggagtacaaacggaaacagctcgaagagcaacggcaggccgagcggctacagcgccagctgaagcaggaacgggactacctggtaagtctgcagcaccagaggcaggaacagagacctgtggaaaagaaacccctgtatcactacaaagagggaatgtccccatccgagaagcccgcgtgggctaaagaggtggaagagcggtcaagactgaatagacaaagcagccctgccatgcctcataaagttgccaatagaatttccgacccaaacctgccaccaaggagcgagagcttcagtatcagcggggtgcagccagctcggacaccaccaatgctccgccctgttgatcctcagatccctcatctagtcgctgtgaagtcccaggggcctgctctcacagccagccagtctgttcacgagcaacccacaaagggcctctcaggcttccaggaagccttgaatgtcacatcacacagggtggagatgccccggcaaaattccgatccaacttctgaaaacccgcccctcccaacgcggattgaaaaatttgacaggtcttcctggttgaggcaggaggaggacatccccccgaaagtcccacagaggaccacctccatttcacccgctttagcaaggaaaaattcacctggaaatggatcagcccttggacccaggctgggctcccagcctataagagcatcgaaccctgaccttagaaggactgagcctattcttgaatccccactgcagaggacaagctctggcagcagcagttcaagcagcacaccaagctcccagccgagtagtcaggggggatcacagcctggaagccaggccggcagcagcgaacgtaccagagtcagggcgaactcaaagtcggaaggatctcctgtgctcccgcatgagcccgccaaagtcaaaccggaggagtctcgcgacattacacggccttcacggcctgctgacctcaccgcccttgcaaaggaattacgggagctgaggattgaggaaaccaatcgtccaatgaaaaaagtgactgactattcttcatcatctgaggaaagcgagagcagcgaggaagaggaggaagatggagagtcagaaacccatgatgggacggtggccgtgtctgacatcccaagattaatacccactggagcgcctggaagtaatgagcaatacaatgtaggcatggtgggtacacacggccttgaaacctcacatgctgactccttcagcggaagtattagtcgggaagggacccttatgatcagagagacctcaggcgaaaaaaaacgctccggtcatagtgatagtaacggctttgcgggccacataaacctgccagacctggtgcagcagtcgcatagtcccgctgggactcccacagagggcctgggcagggttagcacacacagccaggaaatggattcgggcaccgaatatggtatgggctcgtccactaaggccagcttcacgcctttcgtcgaccccagggtgtatcagacttcaccgaccgatgaggacgaggaggacgaagagtctagtgccgccgcactttttacaagcgagctcctccggcaggagcaggccaaacttaatgaggcaagaaagatatctgttgtgaatgttaatccaactaatattagaccccatagcgatactcctgaaatccggaaatataaaaaacggtttaatagtgagatattgtgcgccgccctgtggggcgtcaatctcttagttgggaccgaaaatggcttgatgctgctcgacagatccggacaggggaaggtgtacaacctgatcaatcgccgcaggtttcagcagatggatgtgctcgaggggctgaacgttctggtgaccatctccgggaaaaagaataagcttcgggtatattatctgtcttggctgagaaataggatcctgcataacgaccccgaggttgagaagaagcaaggctggatcaccgtgggggacctcgagggatgcattcattataaggtggttaaatacgaacggatcaagtttctggttatcgccttaaaaaacgccgtagaaatttacgcgtgggccccgaagccttaccataagttcatggcttttaaatcattcgccgacttgcagcacaagcccttacttgtggacctcactgtggaagaaggacaaaggctgaaggtgattttcggatcccatactggtttccacgtcatcgatgtggactctggaaatagttatgatatctatatcccgtcgcatattcagggcaacatcactccccacgccatagtcatcctccctaagacagacggcatggaaatgctggtgtgctacgaggacgagggagtttatgttaatacatatgggaggattacgaaggacgtggtcctgcagtggggcgagatgccaacatccgtcgcctatattcatagcaaccaaattatgggctggggcgaaaaagcgattgaaatccgttccgtcgagaccggtcacctcgacggcgtgttcatgcacaaaagagcccaaagactgaagtttctgtgtgaacggaacgacaaggtgtttttcgcctccgtaagatccggagggagttctcaggttttttttatgacactgaaccggaactccatgatgaactggtag

SEQ ID NO: 208867 - DNA, 3807 bp, Artificial Sequence
  Description of Artificial Sequence: Synthetic coding sequence
atggccagcgacagccccgcccggagcctggacgagatcgacctgagcgccctccgggatcccgccggcatttttgagctagtggaactggtcggtaatggaacctatggacaagtgtacaagggccgccacgtgaaaaccggtcaactagcagccatcaaagtgatggacgtgaccggggatgaggaggaggaaataaagcaggaaatcaacatgctcaagaaatactcacaccaccgcaacatcgccacatattatggggcctttatcaaaaagaatcccccagggatggacgatcagttgtggctggtgatggaattctgtggggcgggctcagtgacggatttaatcaagaacacaaagggcaataccctgaaagaagaatggatcgcatacatatgtcgagaaattctgagaggactttctcatctgcatcagcataaagtcatccaccgagacatcaagggacaaaacgtcctcctcacagagaacgcagaggtcaaactggtcgatttcggagtgtcagcccaactagaccggacagtcggtcggcgcaacaccttcattggaaccccatattggatggccccagaggtgattgcctgcgacgagaatcccgatgccacctacgatttcaaaagcgacctgtggagtctcggaattacagccatagagatggccgaaggggcacctccactctgcgacatgcatccaatgagggcccttttcctgattccacggaaccccgccccccggctcaaatctaagaagtggtccaagaagtttcagtccttcattgagagttgcctagtcaagaatcactcacagcggcccgctaccgagcagctaatgaaacacccttttatcagagaccagcctaacgagcgacaggtccggattcagctcaaagatcacatcgaccgcaccaagaaaaaaagaggtgagaaggatgaaacagagtacgaatacagtggatccgaagaggaggaagaggagaatgacagcggagaaccttctagtatactgaacttgccaggggagagcaccctgcggagagactttctgcgtctgcagttggccaacaaggaaaggagcgaggccctgcgtcggcagcagttagagcaacagcagcgcgagaatgaggaacacaagaggcagctgctggccgagcggcagaaaagaatagaagaacagaaggaacagcgaaggcggctcgaggaacagcaacggagggagaaggaacttaggaagcaacaggagagagagcagcgacgacactacgaggaacaaatgcgtcgcgaagaagaaaggaggcgagcagagcacgaacaggaatacaaacgaaaacagctcgaggagcagagacaggcagagcggctccaacgacagctgaagcaggagcgcgattatttggtgagcctccaacaccagagacaggagcagagacctgtcgagaaaaaaccactttatcactataaagaaggcatgtccccatctgaaaagcctgcctgggccaaggagatcccccacctggttgcagtgaagtctcagggacccgctctgaccgcttctcagtcggtacatgaacagccaacgaagggattgtcggggttccaggaggctttgaacgtgacttctcaccgcgttgagatgccaaggcagaactctgatcctacgagcgagaatccccctttgcccacccgaattgagaagttcgaccgaagtagttggttgcggcaagaggaggacatacccccaaaagtcccccagagaactacgtctatcagccctgctcttgctcgcaagaattctcctggaaacggctccgctcttggccccagattaggcagccagccgattcgtgcgagcaatccggatctgcgcaggactgagcctatactggaatccccacttcagcggacctcctccggatcctcctcaagctccagcactccttcgagtcagccgtccagccaagggggatcccaaccgggctcgcaggcaggaagcagcgaaagaaccagggtaagagccaactctaaatccgagggctcacccgtgctacctcatgaaccggctaaggtgaagcctgaggaaagccgtgatattaccagaccatcacggccagctgatctcacagcgctggcaaaggaattacgggagttacgaattgaggagactaacagacccatgaaaaaagttactgattactcttcttcttccgaagaatctgagagctccgaagaagaggaagaagatggagaaagcgaaactcatgatggcacggtagccgtatccgatatccctcgattgatccctaccggtgcccccgggagcaatgagcagtacaatgttgggatggtcggcacccacggtttggagactagccacgccgactcattttccggttccatttcgagagagggtaccctaatgattcgcgagaccagcggtgagaagaagagaagtggccattcagactcgaatgggtttgctggtcatatcaatctaccagatctggtacagcagtctcactccccagctgggacgcctaccgagggcctgggcagggtatcgactcacagccaagaaatggactctggcaccgagtatgggatgggtagctccacaaaggcctctttcactccgttcgtggacccacgagtttaccagaccagcccgaccgatgaggacgaggaggatgaggagagcagcgcggccgcattatttacctccgaactgctgagacaagagcaggcaaagctaaacgaggccaggaagatctcagtggtcaatgtgaacccaaccaatatacgcccccatagtgacacccctgagatcaggaaatataagaaacgcttcaactccgaaatcctctgcgcagctctctggggcgttaatctgctcgtcgggactgaaaacggtcttatgcttctggacagatccggacagggaaaggtctataatctgatcaaccggagaagattccagcaaatggatgtgcttgaaggactgaatgtcctggtgacaatctcagggaagaaaaacaaactgcgtgtatattatctgagctggctgaggaatcgaatcctgcataatgaccctgaggttgaaaagaaacagggttggattactgttggagatctcgagggatgtattcattataaggtcgtaaagtacgaacggatcaaattcttggtcattgccctcaaaaacgctgtggagatttacgcatgggcaccaaagccataccacaagttcatggcttttaaatcttttgcagatctgcaacacaaacccctgttagtcgatttaacggtggaggaaggacaaagactgaaggtcatatttggctctcacacaggatttcatgtgattgatgttgattctgggaattcttatgacatctatatcccatcacacatccagggaaacatcacaccccatgctatagtaatcttgcccaaaacagacggtatggagatgctagtttgttacgaggatgagggagtctacgtaaatacgtatgggaggatcacgaaagacgtcgtgttacagtggggcgagatgcctacatcggttgcatacatccatagtaatcagattatgggatggggtgaaaaggcgattgagataaggtccgttgagaccggccacctggacggcgtctttatgcacaaaagagcacaacgcctaaaatttttgtgtgaacggaacgataaggtgttttttgcttccgtccgatcgggggggtccagtcaggtattctttatgactctgaaccggaacagtatgatgaattggtag

SEQ ID NO: 208868 - DNA, 3918 bp, Artificial Sequence
  Description of Artificial Sequence: Synthetic coding sequence
atggccagcgacagccccgcccggagcctggacgagatcgacctgtctgctctgcgagaccccgcaggcattttcgaactcgttgagctcgttggtaacgggacttatggccaagtctacaagggacggcacgtgaaaactggccagctggccgctattaaggtaatggatgtgactggtgacgaggaagaagagatcaagcaagagattaacatgctgaagaaatatagccaccatagaaacatcgcgacatattacggcgcctttatcaaaaaaaacccgcctgggatggacgatcaactctggctggtcatggagttctgcggagctggctcagttactgacttaatcaaaaatactaaagggaataccctgaaggaggaatggattgcgtatatatgtagggaaatattacggggactgtctcatcttcaccaacacaaagtgatccaccgcgatataaaaggacagaatgttctgctgaccgaaaacgctgaagtaaaactagtcgactttggagtgagtgcgcagctggacaggactgtggggcgtcggaatacattcattggaacaccctactggatggccccagaagtgatcgcttgtgacgagaatcctgacgcgacttacgacttcaaaagcgacctttggagcttgggaattacagccattgagatggccgagggggctccccccctttgcgatatgcacccgatgcgggccctgttcctaattccacgaaatcccgctccaagactaaaatcaaaaaaatggtccaaaaagtttcagtccttcattgaatcctgcctcgtgaaaaatcacagtcagcgccctgccaccgagcagcttatgaagcacccgtttattcgcgaccagcctaacgagcgtcaggtgaggatccagcttaaggaccacattgatcgcactaaaaagaaaagaggggaaaaggatgagaccgagtacgagtatagcggcagcgaggaggaagaagaggaaaacgactccggcgaaccgagttccatcctgaacctccctggggagagtacgcttcggcgggatttcctaagactccagttggccaataaagagcgatccgaagcgctgaggcgccagcaactggagcaacaacagagagagaatgaagaacacaagagacaacttttggccgagaggcaaaagcggattgaggagcaaaaggagcagcgccgtaggctcgaagagcagcagagacgcgagaaggagttacggaaacagcaggaacgagagcagaggcggcactatgaagagcagatgagacgtgaagaggagcggagaagagctgagcacgaacaggagtatattcgccgccagctcgaagaggagcagagacagctcgagattctccagcagcaactccttcacgagcaggccttgctgctggagtataaaagaaagcagctggaggaacagaggcaagccgagcgcctccagaggcaacttaagcaggagcgcgactatctggtgtctctgcagcaccagcggcaggagcagcggcctgtcgagaagaagccattataccattataaagaaggaatgtctccatccgagaaacccgcctgggccaaagaaattccacacctggtcgcagtaaagagccagggccccgctctcacagccagccaaagtgtccacgaacagcccactaaaggactgagcgggttccaggaggctctgaacgtgaccagccacagggtggagatgcccagacaaaactccgatcccacctcagaaaaccccccactgccaacacgaattgagaagttcgaccgcagtagttggcttcggcaagaagaggacattcccccaaaagttccacagcggactaccagtatcagcccagcacttgcccgtaaaaattcccccggcaacggctctgctctcgggccgcgcttgggttcacaaccaataagggccagtaaccccgatttgcgccgtacggaacctattctggagagccccctacagcgcacctcttctgggagcagcagtagcagctccaccccctctagccaaccttcgtctcagggtgggtcccagcctggctcccaggcggggtcttccgagagaaccagagtcagagccaacagcaaatctgagggaagccccgtgcttccacacgagcctgctaaggttaaacccgaggagagtcgcgacatcacaaggcctagtcgacctgcatcatacaaaaaggcaatcgacgaggatttgacagctttggcaaaggagctgagagagctgcgcattgaagagacgaaccgccccatgaaaaaggttacagattattcgagctcaagcgaggagagcgaatcaagtgaggaagaggaggaagacggagagagcgaaacgcacgacggaacagttgctgtaagcgatatcccacgcctgattccaacaggcgccccagggagcaatgagcagtataacgtagggatggttggaacccacggcctggagacttcccatgctgattcattctccgggagcatctcccgggagggcaccttaatgattagggagacgtccggcgagaaaaagcgatccgggcatagcgacagcaacggattcgccggccatattaatctcccggatttggtgcagcaatcccactctcccgccgggacacctactgaggggctcggcagggtgtctacacattctcaggagatggacagcggcactgaatacggtatgggcagctcaactaaagcctctttcacgccctttgtcgatcccagggtgtaccagacctctccaaccgatgaggatgaagaggacgaagagagctcagctgccgcccttttcacttctgaactgctcaggcaggaacaggctaagctgaacgaggcacggaagatttcagttgtgaacgtaaatcccacaaatattcgcccgcacagcgacaccccagaaatcaggaagtataagaagaggttcaacagcgagatcttatgcgccgctctatggggagtcaatctgctggtgggaaccgaaaacggactgatgctcttagacagaagcgggcaaggtaaagtgtataatttaataaatcgtcggcgattccagcagatggacgtcctggagggtctaaatgtcctggtaacgatttccggtaagaagaataagttaagagtttactacctctcttggctccgcaatagaatactgcataacgaccccgaggtagagaagaagcagggatggataacagtaggagatctagaagggtgtatccactataaagtcgtgaagtatgagagaatcaagtttctggtgattgccttgaagaatgccgtggagatatatgcctgggctccaaaaccataccacaagttcatggcattcaaatcatttgccgatctgcagcacaaaccattgctggtcgatctgacagtcgaagagggccagcgcttgaaggttattttcggcagccatacaggctttcacgtgattgatgttgattcaggcaactcctacgacatttatattcccagccatatacagggaaacatcacaccacatgccattgtgattctccccaagaccgacgggatggaaatgttggtgtgctacgaagacgaaggcgtgtacgtgaatacatacggtcggattacaaaggacgtggttctgcagtggggagagatgcctaccagcgtggcttatattcacagcaaccagatcatgggatggggagagaaagctatcgagatccggagtgtcgaaactggccaccttgacggagtgttcatgcacaagagggcccaaagactgaagttcctgtgtgaacgcaacgataaggtgttctttgcctcagtacgaagcggaggttcttcacaggtcttttttatgactcttaataggaattcgatgatgaattggtag

SEQ ID NO: 208869 - DNA, 3939 bp, Artificial Sequence
  Description of Artificial Sequence: Synthetic coding sequence
atggccagcgacagccccgcccggagcctggacgagatcgacctgtcggccctccgagaccctgccggaattttcgagctggtggaactggtgggaaatggaacatacggacaagtctataaggggaggcacgtcaaaaccggccaattagcagctatcaaggtgatggatgtcacgggggacgaggaagaagagataaaacaggaaattaacatgttgaaaaaatattcacatcacaggaacattgccacttactatggagccttcatcaagaagaaccctcctgggatggatgaccagctctggctggtaatggaattctgcggagccggttctgtaaccgacctcatcaaaaacacaaagggtaacaccctcaaggaggaatggatagcttacatttgcagggaaatcctgaggggactgtctcaccttcatcagcacaaggtgatacacagggacattaaaggacagaacgtgctcctgaccgaaaacgcggaggtgaaaatcgttgacttcggcgtgagtgcacaactcgataggacagtgggcagacgcaatacttttatcgggactccttattggatggcaccagaggtgatcgcctgtgatgagaacccggacgccacttatgatttcaaatcagacctttggagcctggggatcactgcaatcgaaatggccgagggggccccccctctatgcgatatgcaccctatgagagccctctttctcataccaaggaatcccgccccaagactgaagtccaagaagtggtctaagaagtttcagtcatttatagaatcctgcctagtaaagaatcactctcagcgccccgccaccgagcaactcatgaagcatcctttcattagagatcagcctaacgaaagacaagtccgcattcagctgaaggatcacatcgaccgaacgaagaagaaaaggggagaaaaggacgagacggagtacgagtattcagggtctgaagaagaggaagaggagaacgactctggagagccaagttcaatcctgaatctcccaggagaatccactttgaggagggacttcctgcggctacagttggccaacaaagagaggagtgaggccttgcgccgccagcaactggagcagcaacagagagagaacgaagaacataaacgccagcttctcgctgagcgtcagaaacgtattgaggagcaaaaagaacagcggagaagattggaggagcagcagagacgggaaaaggagcttagaaaacaacaggagcgagaacagaggcggcattacgaagaacagatgcggagggaggaagagcgccggagagccgagcatgaacaggaatacatcaggagacaattggaagaagaacagcgacagctggaaattctgcagcagcagcttcttcacgaacaggcactgctgctcgagtataagcgtaagcagctggaagagcagcgacaggctgaaagacttcagcggcagcttaagcaggagcgggattatttagtgtccctccagcaccagagacaagaacagcgacccgttgagaaaaagcccttgtaccattataaggaaggaatgtcaccatcagagaagccggcgtgggctaaggagatcccgcatttagtggccgtgaaaagtcagggcccggccctgactgcctcccagtccgttcatgaacaacccaccaagggactgagtggctttcaggaagcgctcaatgtgaccagtcacagagtggaaatgccaaggcagaattccgatcccaccagcgagaacccgcccctgcccacacgaatcgagaagtttgatagaagtagctggctgaggcaagaagaagacatccctcctaaggtccctcagaggacaacatcaataagccccgcactagcccgcaagaattccccaggcaacggaagcgcccttggcccccgcctcgggtcccaacctattcgagcctcgaatccagacttgaggcggaccgagccaattctcgagagtcctctacaaagaacttccagcggatccagtagctcttcaagcacgccttctagccaacctagcagccagggcggcagccagcccgggtcccaggcgggttcttccgagagaaccagggtgagagcaaatagcaagtcagaagggtcacccgttctcccacatgaacccgctaaagtgaaacccgaggagtcgagagatatcactcgcccgagccgccctgccgtgtcggctttcctctcaaaatcgtttgaattgctgatttaccaggacctgactgctctggccaaggaactgcgcgaactgaggatcgaggagaccaacaggccaatgaagaaagtgaccgattattcctcttcctctgaggaatccgagtcttctgaggaagaggaggaggacggcgaatctgagacccacgacggcacagtggccgttagcgacatcccccgtcttatcccaaccggcgcgccagggtccaacgaacagtacaacgtggggatggtcggaacccacggcctagaaacctcccacgccgacagtttttcaggcagcatcagccgggaaggaacacttatgatcagagaaactagcggagaaaagaaacggtctggacacagcgattccaatggatttgccggccatataaacctgccagacctcgttcagcagtcacacagccccgctggaactccaactgagggattagggagggtttcgactcactctcaggagatggactcagggacagagtacggcatgggatcatccaccaaagcgtcatttacaccatttgtggatcctcgggtctaccagacctcacctacagatgaggacgaggaggatgaagagtcatccgccgccgctctgttcacttccgagcttcttcgacaagaacaggcaaagctcaatgaagcccggaaaatctcagtggtcaatgttaaccctacaaatattcgcccccattctgacacgccggaaatcaggaagtataagaaacgctttaactccgagatactgtgtgccgctctttggggagtgaatcttctggttgggacagaaaatggactgatgctgctcgatcgcagtggacagggtaaagtctacaaccttatcaatcgccgcaggtttcagcagatggatgtgcttgagggcttgaatgtgctggtcaccattagcggtaaaaagaataaacttagagtctattacctctcgtggcttagaaacagaatcttacacaatgatcctgaggtcgaaaaaaagcaagggtggatcacagtgggcgatcttgaagggtgtatccattataaagtggtgaagtacgagcgaatcaaattcctggttatagctctaaagaacgcagtcgaaatatatgcttgggcgcctaagccatatcacaagtttatggcatttaagtccttcgccgatctgcaacataagcctttattagtggatttgacagtggaagagggccagcgactcaaggtgattttcggtagccataccggatttcacgtgatcgacgtggattcaggcaattcttatgatatatacattccgagccacattcagggtaatattacaccacacgctatcgttatcctgccaaagactgacggcatggaaatgcttgtgtgttacgaggatgaaggcgtttatgtaaacacctacggtaggattaccaaggacgtggttctgcaatggggagagatgcccaccagcgtggcatatattcacagcaatcaaatcatgggctggggcgagaaggctattgaaattcggagcgtcgagaccggacacctagacggggtatttatgcacaagcgtgcacaaaggttaaaattcctgtgtgagagaaatgataaggtattctttgcatcagtgaggagtggtgggagcagccaagtgttctttatgactctcaacagaaacagtatgatgaactggtag

SEQ ID NO: 208870 - DNA, 1725 bp, Artificial Sequence
  Description of Artificial Sequence: Synthetic coding sequence
atgcccccccagctgcaggagacccggatgaaccggagcatccccgtggaagttgacgaatctgaaccctatccaagccagctcctcaaacctatccctgagtacagccctgaggaggaaagcgagcctcctgcccccaatatccgtaatatggccccgaacagcctgtccgcccctaccatgctccacaactcttctggagatttttcccaggctcactctacactcaaacttgctaaccaccagcggcccgttagtaggcaggtcacgtgtctccgtacccaagtgcttgaagatagcgaggattccttctgccgcagacaccccggcctgggaaaggctttccctagtgggtgtagtgcagtttccgagccagcttcggaaagcgtcgtgggcgccctgcccgccgaacatcaattttcatttatggagaaacggaatcaatggctcgtgtcacaactcagtgccgcgtctccagacaccggccacgatagcgataaatcagaccaatcactccctaatgcaagcgctgacagcctcggtggctctcaggaaatggtgcagaggccccagccacaccgcaacagggcagggttggaccttcccacgatcgatacagggtacgactctcagccccaagacgttctgggtattcggcagcttgaaaggccactcccccttacatcagtttgttatccccaggacctgcctcgtccacttcgatcccgcgaattccctcaattcgaaccccagcggtacccagcttgcgcacagatgctgccccctaacttgtccccgcatgccccctggaactatcactaccactgcccaggctcaccagatcaccaggttccttatggacacgactatccacgggccgcctaccagcaggtcatccaacccgcattgcccggacagcccctccccggtgcaagcgtgcggggactgcaccctgtgcagaaagtgatcctgaactacccctctccctgggaccatgaagaacgacccgcgcagcgggactgctctttcccgggcctcccaagacatcaggatcaaccccaccatcagcctcccaatagggccggcgcccccggagaatccttggagtgccccgcagaacttagaccacaggtgcctcagcctcctagcccagcagcagtgccccggcccccatcaaatccacctgcacggggaactctcaagacctcaaacctccctgaggagctgcggaaagttttcattacctactcaatggatacagctatggaagtggttaaatttgtgaatttcctactggtgaatggatttcagacagccatagatatttttgaggataggatccgcggtattgatattattaaatggatggaaagatatttgcgggataaaacggtgatgataatagtcgccatcagtcccaaatacaagcaagatgttgagggagcagagagccaactggatgaggatgagcacggcctgcacacgaaatacatacatcgcatgatgcagattgagtttatcaagcagggtagtatgaacttccggttcatccctgtgctcttccccaacgctaagaaggagcacgtacccacctggctgcaaaacactcacgtctactcctggcccaagaacaagaagaacattcttttgcgcttactccgtgaagaagaatatgtggctcccccccgaggtccactgccaacactccaggttgtgcctctatag

SEQ ID NO: 208871 - DNA, 1695 bp, Artificial Sequence
  Description of Artificial Sequence: Synthetic coding sequence
atgaaccggagcatccccgtggaggtggacgagagcgagccctacccgtcacagctgctgaagcccatccccgaatattccccagaagaagaatcggaaccccctgctccaaacattaggaatatggctcccaattcgctcagtgccccaaccatgctgcacaattctagcggtgatttctcacaggctcactcaaccctcaaactggcaaaccatcaaaggcctgtctctcgtcaggttacatgcctccgcacgcaagtcttagaggactctgaggacagcttttgcagaaggcaccctggattaggtaaagcctttccgtccggctgtagtgccgtgagcgaaccagccagcgagagcgtggttggggcgctgcctgcagaacaccagttttctttcatggagaagaggaatcaatggctagtgtcccagctctcggcagcctctcctgatactggccacgactctgataagtccgaccagtccctgcccaacgcatctgctgattccctcggggggtctcaggaaatggttcagcggccacagccacacaggaaccgagcaggattggacttgcccactatcgatactgggtatgacagccagccgcaggatgtgctaggtatccgccaacttgaaagaccactcccactgacttcagtatgctatccccaagacctgcctcggcctctgcgatcccgggagttccctcagttcgagccacaaagataccctgcctgtgctcagatgctgccccccaacctgagcccacatgccccctggaattaccactatcattgcccaggatcacctgatcaccaggtgccctatggacacgattaccctagagccgcatatcagcaggttattcaacccgctctgcccgggcagcctctacctggcgctagtgtcaggggcctgcacccggtacagaaagtcatactaaattatccgtctccctgggatcacgaggagaggccggcccagagagactgctcctttcccgggttacccagacatcaggaccagccacaccaccagccacctaatcgcgctggtgcgccgggcgagtcactggagtgtcctgcagaattacggcctcaggtgccccagccaccttcgcctgctgccgtgccccggcctccgagtaaccctcctgcccgaggcactctcaaaactagcaaccttcccgaggaactacggaaagtgttcataacttactccatggataccgctatggaagtcgtcaaattcgtgaacttccttctcgtgaacggctttcaaacagctatagacatttttgaagatcgcatccgtggcattgacattattaagtggatggagcggtacctgcgcgacaccgtgatgattatagttgccatctctcccaagtataaacaggatgtggagggcgccgagagccaactcgatgaggacgagcatggactgcacaccaagtatatccatcgcatgatgcaaatcgagttcatcaagcagggctcaatgaattttcgctttatcccagtgctgttccccaacgcaaaaaaggaacatgtccccacatggctgcagaatacacatgtatacagctggccgaagaataagaaaaacattctgctgagactgctccgcgaggaggaatatgtggctcccccccgcggacctctgcccacgttgcaggtggtgcctctctag

SEQ ID NO: 208872 - DNA, 1698 bp, Artificial Sequence
  Description of Artificial Sequence: Synthetic coding sequence
atgaaccggagcatccccgtggaggtggacgagagcgagccctacccaagtcagctcctaaaacccatcccagagtactccccagaagaagagtctgagccccccgcccctaacatacggaacatggctccgaactccctgtcagctcctactatgctccacaattcctctggtgacttttctcaggcacactctaccctaaagctggccaatcaccagcgacccgtgtcgagacaggtgacatgcttaaggactcaggtgcttgaagattcggaggacagcttttgtcgaagacaccctgggctaggaaaggccttcccaagtgggtgtagcgctgtctccgaaccagcttccgagagtgtggtaggcgcattgccagcggagcaccagtttagctttatggagaaaagaaaccagtggcttgtctcgcagctgtccgccgcctcccctgataccgggcacgattccgataaaagcgatcagtctttacccaatgccagcgccgattcactcgggggctcccaggagatggtgcagcgaccgcaaccacatcgcaatcgtgcaggcctcgacttaccaacaatcgatacaggttatgacagccagcctcaagacgtcctgggcattaggcagttagagaggccactgcctctcacctcagtgtgctacccacaagacctccctcgtcccctccggagcagggagttcccacagtttgagccccaacgttatccggcgtgcgcccagatgctacctccaaacctgtccccccatgccccgtggaattaccattaccattgtccaggatctcccgaccaccaagtcccctatggtcacgactaccctcgggcggcttatcagcaagtgattcagcctgctctcccaggccaaccacttccaggcgccagcgtccggggcttacatccagtgcagaaagtaatccttaactacccgagcccgtgggaccatgaagagaggccagctcaacgggactgttctttcccaggactgccacggcaccaagatcagcctcatcatcagccacccaacagggcaggggcacccggtgaatcccttgaatgtcctgccgaactgcgtccacaggtgcctcagcctcccagccctgccgctgttccccgcccaccctctaatcccccggcccggggtaccctgaagacatctaacctgccagaagaacttagaaaagtgttcatcacctatagtatggatactgctatggaagtggtgaaattcgtgaactttctactcgtgaacggcttccagacagctatcgacatattcgaagaccgaataagaggtatagacattatcaaatggatggaacgatatctgagagataaaacagtgatgatcatcgtagcaatttcaccaaaatacaagcaggatgttgaaggcgctgagagccagctggatgaagatgaacacggcttgcataccaaatacattcataggatgatgcaaattgagtttataaagcaaggaagtatgaattttcggtttattcccgtcttatttcccaacgctaagaaagaacatgtgccgacttggttgcagaatactcatgtttactcctggcctaaaaacaagaagaatatactcctgaggctgctgcgcgaggaggagtatgtggcaccacctcgagggcctctgcctacgctgcaggtggtgcctttgtag

SEQ ID NO: 208873 - DNA, 1725 bp, Artificial Sequence
  Description of Artificial Sequence: Synthetic coding sequence
atggccccccagctggaggagacccggatgaaccggagcatccccgtcgaggtggacgaatctgaaccttacccaagtcagctgctcaaacctattcccgagtattccccagaggaagagagcgagcccccagcacccaatatcagaaatatggcccccaactcactctccgctcctacgatgctgcataattccagtggcgactttagccaggctcactctaccctcaagctcgctaaccaccagagacctgttagtaggcaggtgacttgcttgcggacccaggtcctggaggacagcgaagattccttttgccgccggcacccaggcttgggcaaagcctttccctccggatgtagcgctgtttccgagccagccagtgagtcggtggtgggggctctgcccgctgaacatcagttctcattcatggagaaaagaaatcagtggctggtttctcagttatccgcagcttccccagataccggacacgactccgataaatcggaccagtcccttccgaacgcaagtgcggactccttgggcggtagccaggagatggtgcagagacctcagccgcaccgcaatcgcgccggtttagatctgcctaccatcgacactggttatgactcacaaccccaggatgtactggggattaggcagctggaacgcccactcccacttaccagtgtgtgttacccgcaggatctaccacgccccctccggagtagggagtttccccagtttgaaccacagcgttaccctgcatgtgcacagatgctcccacccaatctctcccctcacgctccctggaactaccactaccactgcccaggttcacctgatcaccaggttccctacggccatgattacccgcgggccgcatatcagcaggtcattcagcctgccctcccagggcagcccctgcctggtgcatccgttagggggctccatcctgtgcaaaaggtgatcttgaactacccatctccatgggaccatgaggaacggccagcccagcgggattgtagcttcccaggactgccccgacaccaggaccagccacaccatcagcctcctaatcgcgccggagcgcctggtgagagcctggaatgtccagccgagttacgtccccaggtgccacagcccccatcccctgccgccgtgccaagacctccttctaatcccccagctaggggcacactaaaaactagcaacctccctgaagaactccgcaaagtattcattacctactctatggacacggcaatggaggtggttaagttcgtcaacttcctgctggtcaatggttttcaaacagccattgatattttcgaggaccggatcaggggtatcgacattatcaagtggatggagcggtacctacgggataagaccgttatgatcatagttgccattagccctaaatacaagcaggatgtggagggggcagagtcccagctggacgaagacgaacatggcctgcatacaaagtacatacacagaatgatgcagatcgagtttattaaacagggcagtatgaatttccgattcattccggtgctgtttcctaatgccaaaaaagaacacgtgccgacatggctccaaaatactcacgtttacagttggccaaaaaataagaaaaatatcctcctgcgcttactgagagaggaggagtatgtagctcctcctcgcggtcctctgcctaccttgcaggttgtgcccctgtag

SEQ ID NO: 208874 - DNA, 462 bp, Artificial Sequence
  Description of Artificial Sequence: Synthetic coding sequence
atggaggtggtgaagttcgtgaacttcctgctggtgaacggcttccagactgccatagatatttttgaagatcggattcgggggatcgatatcatcaagtggatggagagatatttgcgagataaaaccgtcatgataattgttgccattagtccaaagtacaaacaggatgtggaaggagcagagagccagttggacgaggacgagcacgggctgcacactaagtacatccacagaatgatgcagatagagttcatcaagcagggctctatgaatttccggtttatccctgtcctctttcctaacgctaaaaaagaacatgtccccacctggcttcagaacacccatgtgtacagttggcccaagaacaagaagaacattctgcttcggctgctcagggaggaagagtatgtggctccccccagagggcccttaccaacactgcaagttgtgcccctctag

SEQ ID NO: 208875 - DNA, 330 bp, Artificial Sequence
  Description of Artificial Sequence: Synthetic coding sequence
atgatcatcgtggccatcagccccaagtacaagcaggacgtggagggtgcagagagccagctggacgaggacgaacatggtttgcatacaaagtacatccaccggatgatgcagatcgagtttattaagcagggttcaatgaacttcagattcattcctgtgctttttcccaacgcaaagaaggaacacgttcctacttggctccagaatactcacgtgtacagctggcccaaaaacaagaagaatatcctgcttaggttgctgcgagaggaggaatatgtggctccgcctcgcggtcctcttccgacgctgcaggtggtgccgctgtag

SEQ ID NO: 208876 - DNA, 1596 bp, Artificial Sequence
  Description of Artificial Sequence: Synthetic coding sequence
atgatcagccccgacccccggcccagccccggcctggcccggtgggcagaaagttacgaggcaaagtgcgaacgtagacaggagattagagaaagtcgccggtgccgcccgaacgtcactacatgtcgacaggttggaaagactctccggattcagcagagagaacagctgcagagggcccggctgcagcagttctttcgtcggcgcaatttagagctagaagaaaagggtaaagctcagcacccgcaggcgcgggaacagggcccgagcaggcggccaggccaggtgacagggacaagcagcgaggtgttcccggcccaacatccccctccctcgggaatctgcagggatttgtctgaccacctctcgtctcaagccggagggctgcctccccaggacacgcccatcaaaaagccgccaaaacatcatcgtggtacccagacaaaggctgaggggcctacgatcaaaaacgacgccagtcagcagacaaactatggcgtcgcggtcttggataaagagattatacagctgtctgattatttaaaggaggccctccagcgggaactggttcttaagcagaaaatggtcattctgcaagatttattgagcaccctaatccaggctagtgattcttcctggaaaggtcaactaaatgaggacaagctgaaaggcaaattacgcagccttgagaaccaactttatacttgtacccagaagtatagcccatggggtatgaagaaggtgctgttagagatggaagatcagaagaacagttacgaacagaaggctaaagaatcgctgcagaaggtgttggaggaaaaaatgaacgcagagcagcagctgcagagcacccagaggtcattagccttggccgagcaaaagtgtgaagaatggcgaagccagtatgaagctcttaaggaggattggcggactttgggaacccagcatcgggaactcgagtcgcagctccacgtgctgcaatccaaattacagggggctgattcgagggatctgcagatgaaccaagcactgaggttcctggagaacgagcaccagcagttgcaggccaaaatagagtgcctgcaaggagatagagatctgtgttccctggatacccaagacttgcaggaccaactgaaacgctctgaagctgagaagcttacgctggtgactcgcgtgcaacaactacagggccttctgcagaaccagtctctgcagttgcaggaacaggagaaactgctgaccaaaaaggaccaggccctgcccgtgtggtcccccaaatcttttcctaatgaagtcgagcctgagggcaccggaaaagagaaggattgggacctgagggatcaactccagaagaagaccctccaactgcaggccaaagaaaaagagtgcagagaactccatagtgaactcgacaatctgagcgacgagtacctctcttgcctgagaaaactccagcactgtagagaagaacttaaccagagccaacaactccctccaaggcgccagtgtggccgctggcttcccgtcctgatggtggtaattgcagcagccttagctgtgttcctggcaaacaaggacaatctgatgatctag

SEQ ID NO: 208877 - DNA, 549 bp, Artificial Sequence
  Description of Artificial Sequence: Synthetic coding sequence
atgaagaaggtgctgctggagatggaggaccagaagaacagctacgaacagaaggccaaggagtccctacagaaggtgctggaagagaagatgaacgcagaacaacagctacaaagcacgcagagatcccttgcgctggccgaacagaagtgcgaggagtggagatcacagtacgaagctctcaaggaagattggaggacgttggggacccagcaccgagaactagagagtcagcttcacgttttgcagtcaaaactacaaggggctgatagtagggacctgcaaatgaatcaagctttgcgttttctcgagaacgagcatcaacagctgcaagccaaaattgagtgcttacagggggatcgagatctgtgttcacttgacacacaagatttgcaggatcagttgaaacgctcagaggcagaaaagctgaccctggttacaagggtgcagcagctccagggcctgttacagaaccagtcactccagctgcaggagcaagaaaagctcctcacaaagaaagggcaacagatctactatcataagttctag

SEQ ID NO: 208878 - DNA, 1656 bp, Artificial Sequence
  Description of Artificial Sequence: Synthetic coding sequence
atgatcagccccgacccccggcccagccccggcctggcccggtgggctgaaagctacgaagcaaaatgcgagcgtaggcaggagatcagagaatcccgccgctgccgccctaacgtgacaacctgccgacaggtgggcaagaccctgcgcatacaacagcgagaacagctccagcgggccaggttacagcagttctttagaaggaggaacctggaactggaggagaagggcaaagcacagcacccacaggcccgcgagcaaggcccgtcgaggagacctggccaggtgactgtactcaaggaacccctatcttgtgctcgcagaatcagctctccacgagagcaggtgaccggaaccagctccgaggtatttccggctcagcaccctccaccctctgggatctgtcgcgacttgtccgaccatttatcttcacaggctggcgggttaccaccacaagacacacccatcaaaaagcctccgaagcatcaccgcggcactcagactaaggcggagggccctaccattaaaaacgacgcttcccaacagactaactacggcgtggctgtgctggataaggagatcatccagttgtccgactacctgaaagaggccctgcaacgagagttagttcttaaacaaaaaatggtgatcctgcaggatcttttgtctacgctgatccaggcttctgactcctcttggaagggtcagcttaatgaggataagctcaagggaaagctgagatcactggagaatcaactctatacttgtacccagaaatactctccttggggaatgaagaaagtattgctggagatggaagaccaaaaaaattcttatgagcaaaaggcaaaagagtccctccaaaaggtcctggaagaaaaaatgaatgctgagcaacagctgcagtccacacagcggagcctggcattagccgaacaaaagtgcgaggagtggaggtctcagtatgaagccctgaaggaggattggaggactctgggcactcagcatagagaactggaaagtcagctgcacgtcctgcagagtaaattacaaggagctgattcccgcgacctgcagatgaatcaagccctgcgattcttggaaaatgagcaccagcagctgcaagctaaaatcgaatgtctgcaaggcgaccgggatctatgttccctggacacccaggacctccaggaccagcttaagcgaagcgaagctgagaagctgacccttgttacacgcgttcagcagttgcaggggctattacagaaccaatccctgcagttgcaagagcaggaaaagttgctgacgaagaaagatcaggcactgcctgtttggagcccgaagagctttcccaatgaagttgaaccggaagggacaggcaaagaaaaggactgggatcttcgcgatcaactgcagaaaaaaaccttgcagctgcaggccaaagaaaaggaatgcagggaacttcactcagaactagacaatctgagcgacgaatatctgtcctgtctcaggaaactgcagcattgccgcgaggaattgaatcaaagccagcagttgcctccacgtcgccaatgcgggaggtggctgcctgtcctcatggtggtaatagctgccgccctggcggtgtttctagcgaacaaggataacctgatgatttag

SEQ ID NO: 208879 - DNA, 1656 bp, Artificial Sequence
  Description of Artificial Sequence: Synthetic coding sequence
atgatcagccccgacccccggcccagccccggcctggcccggtgggcagaaagctacgaagctaagtgtgagaggaggcaggagatcagggaatccaggcggtgtaggccgaacgtaacaacctgcaggcaagttggtaagactttaagaatccagcagagagaacagctgcagcgggccagactgcagcagttctttcggaggcgcaacctggaactggaagagaaaggaaaggctcaacacccacaggcaagggagcaggggccatccaggcgacctgggcaggtgacggtcctcaaagaacccttgagttgtgcccgcaggattagcagcccacgagagcaggtgacaggtacatcgtctgaggtattcccggcccagcaccccccaccctctggtatctgtcgagacctgtccgatcacctctcatcacaggccggggggctgcctccacaagatactcctattaaaaaacccccaaaacatcaccggggtactcagactaaggctgaggggccaaccatcaagaatgatgcatcacagcaaactaattacggcgtggcagttctcgataaggaaatcatccagttgtctgactacctcaaagaagccctgcaacgcgaactggtgttgaagcagaagatggtcatcctgcaggatcttctgtcaacactgattcaggctagcgactcttcttggaaagggcagctgaatgaggataaactgaaaggcaagctgcggagcctggaaaaccagctgtatacatgcacccagaaatactctccatggggcatgaagaaggtcctcttggagatggaggaccagaagaattcttacgaacaaaaggccaaggagtcactccagaaagttttagaggagaaaatgaacgcagaacaacagctgcagtccacacaacggtcacttgctctcgccgagcaaaaatgtgaagagtggaggagccagtacgaagcgttgaaggaggactggcggaccctggggactcaacatcgggagctcgaatcccaactccacgtcctgcagtctaagctacagggggctgactctcgcgacctgcaaatgaaccaggcattgagatttttggaaaacgagcaccagcagttacaggctaagatcgaatgtctgcagggggacagggacttgtgttcactagacactcaggacctgcaggaccagctaaaaaggtccgaggccgaaaagctcaccctggtgaccagggtgcagcagttgcagggtctcctacagaatcaaagcctccagttgcaggagcaagagaagttgctcaccaagaaggaccaagccctccctgtctggagccccaagagcttcccgaacgaggtcgaacccgagggaaccggtaaagaaaaggactgggatctcagggatcagctccagaagaagactttacaactccaagccaaagagaaagaatgccgtgagctccacagtgagttagataacctgtccgacgagtatctgagctgtttacgtaaactgcagcactgtcgcgaagagctgaaccagtctcaacagttaccacctcggaggcagtgtgggaggtggctgcccgtgctcatggtggtaatagccgcagccctcgcagtcttccttgcaaacaaggacaaccttatgatctag

SEQ ID NO: 208880 - DNA, 1596 bp, Artificial Sequence
  Description of Artificial Sequence: Synthetic coding sequence
atgatcagccccgacccccggcccagccccggcctggcccggtgggccgagagctacgaagcaaagtgcgagcgcagacaggaaatccgggaatcccggcggtgtaggccgaatgtaacgacctgtcggcaggttggcaagacactgcgaatacagcagcgagagcagctgcaaagagcaaggttgcaacagtttttccgacggaggaatctggagttagaagagaaaggcaaagcccagcatcctcaggccagagaacagggccccagtagacggcccgggcaggtgactggtaccagtagtgaggtgttcccagctcaacatccaccgccctcggggatttgtagagacttgtcagatcacctgtcgtcccaagccggcggactccccccacaagacacccccatcaaaaaaccgccaaagcatcaccgtggcacccaaaccaaggcagagggacctacaatcaagaacgatgccagccagcagactaattatggtgtggcagtattagacaaagaaataatccagcttagcgactatctaaaggaagccctgcagagggagcttgtactgaagcagaagatggttattctccaggatttactctctacactgattcaggcctctgattcttcctggaaaggccagctgaatgaagacaagttaaagggcaaactgcgcagtctggagaaccagctgtacacctgtactcaaaagtattccccttggggcatgaaaaaagtcctgctggagatggaagatcagaaaaattcttacgagcagaaggcaaaggagtcccttcaaaaagtacttgaggaaaagatgaacgcggagcagcaactgcagtcgacgcagcggtctttggccttggctgagcagaagtgcgaggaatggcggtctcaatacgaagccttgaaagaggactggcgcactctgggcactcagcatagggagctggagtcacaactgcacgtgcttcaatctaaacttcagggcgcagatagtcgggaccttcagatgaaccaggctcttcgcttcctcgaaaacgagcaccagcagttacaagctaaaatcgaatgtctgcaaggtgatagagatttatgctcccttgatactcaggacctacaagatcagctcaagaggtcagaagccgagaaactcaccctcgtgaccagggtccaacagctgcaggggttactgcagaaccagagccttcagttgcaggagcaagaaaaactgctgactaagaaagaccaggctttgccagtctggagccccaaaagtttcccgaacgaggtggagccagaagggaccggtaaggaaaaggactgggaccttcgggatcagctgcagaaaaagacactgcagttgcaggcaaaggaaaaggagtgtagggagctgcatagcgaacttgataacttatctgatgagtatcttagctgcctgaggaagctgcaacactgtcgcgaggaactgaaccagtcccaacagctgcctccacgtagacaatgcggcagatggctaccagttctcatggttgtaattgctgccgcgctggccgttttcctcgcaaataaagacaacctgatgatatag

SEQ ID NO: 208881 - DNA, 1215 bp, Artificial Sequence
  Description of Artificial Sequence: Synthetic coding sequence
atgatcagccccgacccccggcccagccccggcctggcccggtgggcggaaagttacgaggctaaatgtgaaagaagacaagagatccgagagtcccggagatgcaggccaaacgtgacaacatgccggcaagttgggaaaacattgcgtatccagcagagagaacagctccagcgcgccaggctgcagcagttttttcgccgtagaaatttagagctggaggagaaaggtaaggcccagcacccccaggcgcgggaacagggcccctcaagaagaccagggcaagttacaggtacctccagcgaagtattcccagcccagcaccccccaccttctggaatatgccgggatctcagtgatcacctgagctctcaagccggcggactgcctccacaggacactccaatcaagaagccaccaaaacaccatagaggtacgcagacgaaggctgaagggcctactattaagaatgatgcttctcagcagactaattacggagttgccgtgttagacaaggagatcatccagctctctgattatctgaaggaggcactccagagggagctagtgctgaagcagaaaatggtgattcttcaagatttgctgagcaccctgattcaggccagcgattcttcctggaaggggcagctcaatgaagacaagctgaaaggcaaactgaggagcctggaaaatcagctgtacacttgcacacagaaatatagtccatggggcatgaaaaaagtcctgctcgagatggaagaccagaaaaactcttacgagcagaaggctaaggaatccttacagaaggtcttagaggagaagatgaatgccgaacaacagctgcaatcaacccagaggagtctcgccctcgcagaacagaagtgcgaggaatggcgcagccagtacgaggccctcaaggaggattggcggaccttaggaacccaacaccgcgagctggagtcacaacttcatgtgttacagagcaaactgcagggagccgacagcagggacctgcagatgaaccaggccctgcgttttcttgagaacgagcaccaacagttgcaagcaaagatcgagtgtctgcagggagacagagatctgtgtagccttgacacccaagacctgcaagatcaactcaagcgtagcgaggccgaaaaactcactctcgtgactcgggtacagcagttacaggaagctgcagggtggacgacttag

SEQ ID NO: 208882 - DNA, 963 bp, Artificial Sequence
  Description of Artificial Sequence: Synthetic coding sequence
atgatcagccccgacccccggcccagccccggcctggcccggtgggcagaatcttacgaagccaagtgtgaacggcgccaggagatcagggaaagcagacgatgcaggccgaatgtcactacttgtaggcaggtggggaaaactttgcggatccaacaacgcgagctcgaggaaaaggggaaggcccagcacccccaagcaagagagcagggcccgtctcggaggcccggccaggtgacagtgctgaaagaaccactgagttgcgcacgccgaatcagctcaccaagggagcaagtcaccggaacatcttctgaggttttcccagcacagcatccaccaccttccgggatttgtcgagatctgtctgaccacctttccagtcaggccggcggacttccccctcaggacaccccaatcaaaaaaccacccaagcatcataggggaacccaaacaaaggctgaggggccaaccattaaaaatgacgcttcccagcaaacgaattatggtgtcgccgttctcgataaggagatcatccagctttcagactatctgaaggaggccctgcagcgggagctcgttctcaagcagaaaatggtcatccttcaagacctcctctcaacacttatccaggcttcagactcatcctggaagggacagctgaacgaggacaaacttaaaggaaagctgcggtctttagagaaccagctttatacatgcactcagaagtactcgccgtggggaatgaagaaagtcctgctcgagatggaagatcagaaaaactcgtacgaacagaaggccaaagagtctctccagaaggtgcttgaagagaaaatgaatgctgaacagcaactccagtccacccaagtgtggggttgccacatagacatgggcctcgggacccccggaagcttgggaaacaaggggagtcagctgcacaactcactggagccctcacctttatag

SEQ ID NO: 208883 - DNA, 81 bp, Artificial Sequence
  Description of Artificial Sequence: Synthetic coding sequence
atgatcagccccgacccccggcccagccccggcctggcccggtgggccgagtcatatgaagccaagtgtgagcgacggtag

SEQ ID NO: 208884 - DNA, 1671 bp, Artificial Sequence
  Description of Artificial Sequence: Synthetic coding sequence
atgcagaagttcatcgaggccgactactacgagctggactggtactacgaggaatgctcagacgtcctttgcgccgagagagtgggacagatgactaagacctacaacgatatcgatgctgttactagacttctagaggaaaaagaaagggaccttgagctggcggcaaggatcgggcaatctctgcttaagaagaacaagacactcacagagagaaatgagcttctggaggagcaagttgagcatatcagagaagaagtcagccagctgcgccacgagctcagcatgaaggatgaactgctacaattttatacatctgctgccgaggagtccgaacccgagagtgtatgttccacacctctgaaaagaaacgagagctctagctctgtacagaactactttcacctggattcactgcagaaaaagctgaaagacctcgaagaggagaacgtcgtactgcgttcagaggctagccagctgaaaactgaaacaataacatatgaggaaaaggagcagcagctagtaaacgactgtgttaaggaactgagagacgccaacgtgcagatcgcaagtattagcgaggagctggccaagaaaacggaagacgcggccagacagcaggaagagatcacacacctcctgtcgcaaatcgtcgacctgcaaaagaaagcaaaagcttgcgccgtggagaacgaggaacttgtgcagcatctaggggccgctaaagatgctcagcgtcagttgactgcagaactgcgcgaactggaggacaagtatgccgagtgtatggaaatgttgcacgaggcccaagaagagcttaaaaatctgagaaacaagacgatgccgaacactacttcaagaaggtaccacagtttgggcctctttccaatggacagtttagctgctgaaatcgagggcactatgcgtaaagagctccagctggaggaggcagaatctccagacatcacgcatcagaaacgcgtcttcgaaaccgtgaggaacatcaaccaggtcgtgaagcaacgttccctcactccaagccccatgaatatacccgggagcaaccagtcctcagctatgaactccctcttgtcttcttgcgtaagcacaccgaggagctctttttacgggtcagacatcggaaacgtcgtcctggacaataaaacgaattctatcatcttagagactgaagctgctgaccttggcaacgacgaacgaagtaagaaaccgggcacccctgggacacctggtagtcacgaccttgagacagcactacgccgcctgtctttgagaagagagaattatctgagtgaacggcgcttctttgaagaggaacaggagcggaagttacaggagctggctgagaagggtgaactgcgctcggggagcctgacacccaccgagagcattatgtccctcgggacacattcgcgcttctcagaattcactggctttagtggcatgtccttctccagccggtcttatctacccgagaagttacagatcgttaagccccttgagggcgaccatgccggaccgcgtcccctcagcgttctgttgggggacagtctctggagtcttatccacctgcggaaggcggggcacctgtgtcacgcctactccttctttttcagagactcccacccccgctgttggtttgagttcttatag

SEQ ID NO: 208885 - DNA, 438 bp, Artificial Sequence
  Description of Artificial Sequence: Synthetic coding sequence
atgaccgtgcacaacctgtacctgttcgaccggaacggcgtgtgccttcactattccgagtggcataggaagaagcaggctggaatccctaaggaggaagagtacaagctcatgtacgggatgcttttctccatacgcagtttcgtctctaaaatgtccccgttggatatgaaagacggttttctggcctttcagacaagcagatacaaactgcactattacgaaacccccactggtataaaagtggtgatgaacaccgatttgggcgttggacccatacgggacgtccttcatcacatctactctgctttgtacgtggagctggtcgtcaagaacccactgtgtcccctgggacagacagtccagtccgaactgttccgatcacgactcgacagttacgttcggtctctgccattttttagtgcaagggccggttag

SEQ ID NO: 208886 - DNA, 438 bp, Artificial Sequence
  Description of Artificial Sequence: Synthetic coding sequence
atgaccgtgcacaacctgtacctgttcgaccggaacggcgtgtgccttcactatagcgaatggcaccgcaaaaagcaggcaggaataccaaaagaagaagaatataaactcatgtatgggatgttgttctcgatcaggtcctttgtcagcaaaatgtcccctctggacatgaaagacggcttcctggcattccaaacctctaggtacaagttgcattactatgagactccaacaggaatcaaggttgtcatgaataccgaccttggcgtcggtccgattcgcgacgtgttgcaccacatttacagcgcgctgtacgtcgagcttgttgtcaagaatcccctgtgtccgctgggtcagacagttcaatccgagttattcagatcccgattggatagctacgtgcgcagcctgcccttctttagtgcacgcgccggctag

SEQ ID NO: 208887 - DNA, 3402 bp, Artificial Sequence
  Description of Artificial Sequence: Synthetic coding sequence
atgagccccacccagtgggacttccccgtggagctgtgctgccggccaatggcattcgtgactctgaccggtctggacgtggtctacaatgccgtgcatagggccgtttgggatgccttttgcgccaaccgacgcgcagatagagttccaatttcatttaaggttctgcctggtgatcacgagtatccaaaatgccgcccaaaacggacatcttacgagtggtacatccctaaaggtattctgaagactggctggatgaataagcatttgaatctggtcccggctctcgtggtcgtattttacgaactcgattgggacgaaccacagtggaaggagaaacagtctgagtgtgccacaagagtagagatcgttagacaatcccttcagggaagaaacactaaggttgccgtggtactgattcaaaagaagactcccctcccccccggcgaagacgttatcgcttcagagcgggctgccgcgctgtgcaacgcctgtgagctgtctggcaaatctctcttcgtgctccctcacacggaccatctagtgggttacattattcgtctggagaacgccttctacgagcacgcacagacatactactacacagaaatcagacgcgtgaagagtcacaaggagtttctaaataaaacaacccaccagctgctgtttgtgaggcaccagtttaaaatcgctttctttagcgagttgaaacaggatactcagaacgccctgaaaaactacaggactgcttataacctggtgcacgaactacgggcgcacgagactaatatcctcgagataaaaactatggccggatttattaactacaaaatctgccgattatgtttccagcataacaccccgctggacgcaatcgcacagtttaggaagcatatcgacctttgcaaaaaaaaaatcgggagcgctgaactaagctttgaacatgatgcttggatgtccaagcagtttcaagccttcggggatctcttcgacgaagctatcaagttaggtctgactgctatccagacacagaacccagggttctactaccagcaggccgcctactatgcccaggaacgaaaacagttggccaaaacactgtgcaatcacgaggctagcgtgatgtaccctaatccagatcccctcgagacccagactggggtgctggacttctacgggcagcggtcctggaggcagggtatcctgagctttgacctctcagacccagaaaaagaaaaagttgggatattagctatccaactgaaagagaggaatgtagtgcattctgagataatcatcactctcctgtcaaacgctgtggcccagttcaaaaagtacaagtgccctcgcatgaagtcccacttgatggtccagatgggcgaagaatattactacgctaaggattacaccaaagctcttaaacttctggattacgttatgtgcgattaccgatctgagggatggtggacactgttaaccagcgtgttgactacagctttaaaatgctcctatttgatggcccagctcaaagactacattacctacagtctggaacttctcgggagggcttctacactcaaggatgaccagaagagcagaattgaaaagaatctgatcaacgtgctgatgaacgaaagtcccgatccggaaccagactgcgacatactggccgttaagaccgcccaaaagctctgggccgatcgcatctcattggccgggagtaacatcttcaccatcggggtccaggattttgttccttttgtccagtgtaaagctaagttccatgcaccatcctttcacgtcgatgtgcctgtccagttcgacatctatctgaaggcagactgccctcacccaatcagattcagtaagctttgtgtcagcttcaacaatcaggaatacaaccagttttgtgtgatcgaagaggcatcgaaggctaatgaagtgctggaaaatttaactcagggcaagatgtgtctggtcccaggcaagacccggaaactgctgttcaaattcgtcgccaaaacggaggacgtgggcaagaagatcgagattacttcagtcgatcttgccctgggcaacgagacaggccgctgtgtggttctgaattggcaaggaggcgggggggacgcagccagctctcaggaagcactgcaggcggcaaggagtttcaagagacggccaaagctgccagataatgaagtgcattgggatagtataattatacaggccagcactatgatcatctctagagtacccaacatatcagtacacctgctgcacgaacctccggccctgactaatgagatgtactgcttggttgttacagtgcaaagccacgaaaagacccagatccgcgacgtgaaactgaccgccgggttgaagccggggcaagatgccaatctcacccaaaaaacccatgtgacccttcacggtacggagctttgcgatgaatcctatcccgcccttctcaccgacatccccgtcggggatctgcatcccggcgagcagcttgagaagatgttatacgtgcgctgtggcaccgtgggttcaaggatgtttctggtgtatgtgtcctatctgatcaacacaaccgtggaagagaaagagatcgtttgcaaatgccacaaagatgagaccgttacaatcgagactgtcttccccttcgatgtcgccgttaagtttgtgtccacgaagttcgagcaccttgaacgagtctatgctgatatcccattccttctgatgaccgacctattgagcgcttccccctgggctttaacaatcgtctcctcagagttacagctagccccgagcatgacgaccgtagaccaactggagtcccaggtggataatgtgatcttacagaccggtgaatcggcctctgaatgcttctgtctacagtgcccgtctctgggcaatattgaagggggagtcgccacgggccactacatcatttcctggaaaagaacatcggccatggagaatatccctataattacgacagtgatcacgcttccccacgtgatcgtcgagaatatccctctccatgtcaatgctgacctcccgtctttcggcagagttagagagagtctccctgtgaaatatcacctgcaaaacaagactgatctagtgcaagatgtggaaatttccgtggagccgagtgatgcttttatgttctcaggcctgaagcagattcggttgcggatcctacccggaacagaacaggagatgctttataatttctatccattgatggcgggatatcagcagttgccgtccctgaatataaatttgctcaggtttcctaactttactaatcaactgcttcggagattcataccgactagtattttcgtgaaaccccaggggagactgatggatgatacgtccatcgccgccgcttag

SEQ ID NO: 208888 - DNA, 3261 bp, Artificial Sequence
  Description of Artificial Sequence: Synthetic coding sequence
atgagccccacccagtgggacttccccgtggagctgtgctgccggccaatggcatttgtgacactgactggcctggatgttgtgtacaatgccgtccacagagccgtgtgggacgctttttgcgccaaccggagggcagacagggttccgatctctttcaaagtccttcctggcgatcatgagtatcctaaatgcaggccaaagaggacctcatacgaatggtatatccctaaggggattctgaagactggctggatgaacaagcacctgaacttagtgcccgccctggtcgtggtgttttatgagcttgactgggatgaacctcagtggaaagaaaaacagagtgagtgtgccacgagagtcgagatagtaagacagtcactccagggaagaaacacgaaagtggcagtggtccttatccagaagaagaccccactgccccccggcgaagacgtgatcgctagcgaacgggctgccgctctctgcaatgcatgtgaactcagtggcaaaagcctgtttgtactccctcacaccgatcatctggtcggatacatcattcgcctggaaaacgcgttttatgaacatgcccagacctactactacacagaaatacgccgcgtaaaatcccataaagaattcttgaataagacaacgcaccagctgctgtttgtccgacatcagttcaaaatcgcctttttctctgagttgaagcaggacactcagaatgcactgaaaaactatagaaccgcttacaacctggtccatgagctgagagcccatgagaccaacatactggagattaagacaatggctgggtttatcaattacaaaatatgcagattgtgtttccagcataatactcccctggatgctatcgcccaatttcgcaagcacatcgatctgtgtaagaaaaagatcggatctgccgagcttagctttgaacacgacgcctggatgagcaagcagttccaggcgtttggcgacctgtttgacgaggcaatcaaactcgggctgaccgcaatccagacccagaaccctgggttctattaccaacaggcagcctactatgcccaggagcgaaagcaactggcgaagactctgtgtaaccatgaggcatccgtgatgtatccaaatccagaccctttggaaacccagaccggagtgctcgatttctacggacagcgaagctggaggcagggaatactgagctttgacctgtctgatcctgaaaaggagaaggttggcattttggcgattcagctcaaggaacgaaacgttgtgcactctgagatcatcatcaccctgctctccaacgccgtggctcagttcaaaaaatacaagtgtcctagaatgaaatcccatctcatggtgcagatgggagaagagtactattacgctaaggactacaccaaagccctcaagcttttagactacgtcatgtgtgattacagatctgaaggttggtggaccctgcttacatctgtgcttactacagctttgaagtgctcctatctaatggcccaactgaaagattacattacctactctctcgaactgctaggcagagcgagtacactgaaagatgaccaaaaaagtcggatagagaagaatcttatcaacgtgctcatgaacgagtccccagaccccgaacccgactgcgacatcctcgccgtgaaaaccgcgcagaagttgtgggcagaccgcatcagtctcgctgggtcaaatatcttcaccattggagtacaggatttcgtgcccttcgttcagtgcaaggctaaatttcatgccccttctttccacgtggacgtgcccgtacagtttgatatttacttgaaagcagattgcccccaccccattcggttcagcaagctttgcgtgagttttaacaatcaggaatataaccagttctgcgtgatcgaggaagccagcaaggccaatgaagttttagagaacctgacccaggggaagatgtgcttggttccaggcaagacacgcaagctcctgttcaaatttgtggccaagacagaagacgtgggaaagaagatcgaaattacaagcgtcgacctcgccttgggaaatgaaacaggtagatgcgtggttttgaattggcaaggtggagggggagacgcggcctcttcacaggaggccctgcaggctgcacgctcattcaagcgtcgaccgaagctccctgataacgaggtgcactgggactctatcattatacaagcaagcaccatgattatctctagggttcccaacatatctgtgcacctgctccatgagccacctgccttgacaaatgaaatgtactgcctagtagtgacggtacaaagccacgagaagactcagattagagatgttaaactgacagcaggactgaagccaggccaagatgcaaacctgacacaaaagacacatgtgacactgcacgggactgaactgtgcgatgaatcttacccggctctgctcacagacatccctgtgggcgatctgcatcccggcgaacagttagagaaaatgctttacgtcagatgtggcacagtaggaagcaggatgttcttagtctacgttagttatctcatcaacaccaccgtggaagaaaaagagatagtctgtaagtgtcacaaagatgaaactgtgaccattgagaccgttttcccctttgacgtggccgtgaagttcgtatctacaaagttcgagcacctggagagggtgtatgccgatatcccatttttgctcatgaccgatctgctctctgcctcaccatgggctctgacaatcgtctcaagcgaactgcaactcgcaccttccatgacaacagtggaccaactggaatcgcaggtggataacgtgattttgcagaccggcgaatctgcatccgagtgtttttgtctgcaatgtccgagtttagggaacatcgaaggcggtgtggccaccggacactacattatttcctggaagcggaccagtgcgatggagaacattcctattataaccaccgtgatcacccttcctcacgtgatagtggaaaatattcctttgcacgtgaatgccgaccttccgagcttcgggcgggtgcgcgaaagtctccccgtcaaataccatttgcagaacaaaacggacctggtgcaggatgtcgagatctccgtcgagccatcagatgccttcatgttcagtggtcttaaacagatccgcttaccagcccaagcattttatacttatcagtacttctgccaagccaccgggtctacccacgggtag

SEQ ID NO: 208889 - DNA, 3057 bp, Artificial Sequence
  Description of Artificial Sequence: Synthetic coding sequence
atgagccccacccagtgggacttccccgtggagctgtgctgccggcccatggcgttcgtgaccttgaccgggctggatgtcgtttataacgcggtacaccgagccgtttgggacgctttctgcgcaaatcgcagggcggatagagtgccaatatcattcaaggtgcttcctggggatcatgagtacccaaagtgccgtcccaagcgaacctcctatgagtggtatatccccaagggcattctgaaaactggttggatgaacaagcatctcaacttggtgccggccctggtggtcgtcttttatgagctggattgggacgagccccaatggaaagaaaaacaaagcgagtgcgctactcgagtcgagattgtgaggcagagcttgcagggacgcaacactaaggtagcagtggtgctcatccaaaagaagactccccttccacctggagaagacgttatcgcttctgagagggctgcagccctgtgtaatgcatgcgagctctcgggcaagtcactatttgtcctcccccacacagatcatctcgtgggctacattatcaggctggaaaacgctttttatgaacacgcccaaacgtattattacactgaaatccgcagagtcaaatcacacaaggagtttttgaacaaaactacacatcagctgttatttgtgcggcaccaattcaaaatcgccttctttagcgaactcaaacaggatacgcagaacgccctgaaaaactaccggaccgcttataacctagttcacgagctcagggctcacgaaactaatatactggagattaagactatggccggattcataaactacaagatctgccgactctgcttccaacacaacacccctttggatgccattgcccaattcaggaagcatattgacctctgcaaaaaaaaaatagggtctgccgagttgagctttgaacatgatgcgtggatgagcaaacagttccaggcattcggagacctgttcgatgaggcaatcaagctggggttaaccgccattcaaacccagaatcccggcttttattatcagcaggctgcttactacgcgcaagagaggaagcaactggcaaagactctgtgcaatcacgaggcttctgttatgtatcccaacccggatccgctcgaaacgcaaactggggtcctcgatttttatggacagagatcgtggcggcagggcatcttaagttttgatctgtctgatccagaaaaggagaaagtaggtatcttagccattcagctcaaggagaggaatgttgtgcattcagagatcattatcactcttcttagtaacgcagtggcccagtttaagaaatataagtgccctaggatgaaatcccatctcatggtgcagatgggcgaagagtactattatgcgaaggattacactaaagccttgaaattgctggattatgtcatgtgcgactaccgtagcgagggctggtggaccctcctgacgtccgtgctgacgaccgcgctcaaatgctcatacctcatggcacagctgaaggattacatcacatactcgctggaactgctcgggagagcatccacactgaaggatgaccaaaaaagtcggatagaaaagaatcttataaacgtgctcatgaacgaatcaccagaccctgagccagattgtgacatattggcagtaaagactgctcagaaattgtgggcagaccggatctctttggcagggagcaatatctttaccattggtgttcaggattttgttcctttcgtgcagtgcaaggccaagtttcacgcaccatcgtttcacgtcgatgttcctgtccagttcgacatttacctgaaagccgattgtccccatcctattaggttttcaaagctgtgcgtctcatttaataatcaggaatataatcaattctgtgtgatagaagaagcctctaaagccaacgaagtccttgaaaatctcacccaaggaaagatgtgcctggtcccaggcaaaacccgtaaactactattcaagtttgttgccaagaccgaagacgtgggcaaaaaaatcgagataacatctgtggacctggccctaggcaacgagaccggtagatgtgtggtcctgaactggcaagggggcggcggagacgcggctagctcccaagaggcccttcaggccgcccgaagtttcaaacggcgcccaaagctgcctgataacgaggtgcattgggattccatcatcattcaagcctccacaatgataatctcaagggtacctaacatcagcgtccatcttctccacgagcccccagcccttaccaatgagatgtattgccttgtggtgacggtccagtctcatgagaagacccagatcagggacgtgaaacttaccgcggggctgaagcctggccaagacgctaatctcactcagaagacacacgtaacgctgcacggtacggagctgtgcgacgaaagctatccagccctcctcaccgatattccggtgggcgatctccatcccggagaacagctggaaaaaatgctctatgtgcggtgcggcacagtgggatcacgcatgttcctggtgtacgtctcttacctaatcaacactactgtggaggagaaagagatcgtgtgtaaatgccataaagatgagactgtgacaatcgagaccgtttttccgttcgatgtagctgtgaagttcgtcagcaccaaattcgaacacctggagcgagtgtacgcagacattccctttctcctgatgacggacctcttatcagcctcgccctgggccctgaccattgtctctagcgagcttcagttagccccttccatgacaaccgttgatcaattagagtcacaggtggataacgtcatcctgcagacaggggaatctgcttctgctttgtattatctattggaaaaggacttgtccaatggcgagtacccccaccaccacaattgccaccattccgcggctagggattgtggggagtacccttctccatgtgagtgtcggagtgccgtaatctgggcatgccagcgcgtggtgacctgtcaggtgtcgcctaccgagtag

SEQ ID NO: 208890 - DNA, 2091 bp, Artificial Sequence
  Description of Artificial Sequence: Synthetic coding sequence
atggaggacgccggcggcggcgaggagcagggcctgctgttccaggaagagacaattgacctgggcggagacgagtttggttcagaggagaatgagactgcgtctgagggttcgagtccactggctgacaagctgaatgaacatatgatggagtcggtcctgatttctgatagcccaaactccgagggtgacgccggagatctggggcgcgtgcgcgacgaggcggagcctggtggggagggagatccgggtccagagccggcagggacaccatcgcccagcggcgaagcagacggcgactgtgcccctgaggatgccgccccctcttcgggtggagcccctaggcaagacgctgcaagagaagtgcccggtagcgaagccgccaggccagaacaagaacctcctgtggcggaacccgtaccagtatgtaccatattctcccaacgcgctcctcccgcatcgggcgatggcttcgaaccgcagatggtcaagtctcccagtttcggcggcgcctcagaggcgagcgctagaacccccccacaggtggttcagccctctccctccctgagcacgttttttggcgataccgcagccagccactctctggcctcagacttttttgattcattcactactagtgcattcatttcagtgtccaatcctggggctggctctcctgccccagcttcacctcctccgctcgctgttcctggtactgaaggccgccccgagcccgtcgcgatgcgggggcctcaggctgctgcacccccagcctcccccgagccatttgctcatattcaggcagtattcgctggatccgatgaccccttcgccaccgccctgtccatgtctgagatggatagaagaaatgacgcatggctgccgggggaggcaactcgcggagtcctgagggcagttgccacccagcagcgcggggctgtgtttgtggataaggagaacctgacaatgcctggcctgcggttcgacaatatccagggcgacgctgtgaaggacctgatgctaaggtttctgggagagaaggcagctgcgaagcgccaggtcttgaacgctgacagtgtggaacagagctttgtgggcttaaaacagttaatctcatgccggaactggagagcagcagtggacctctgcgggaggctcctcactgcacacggtcaggggtacggcaaaagcgggttgttgacctctcacacaaccgactccctgcagctgtggtttgttcgactggcacttctggtgaagctagggctgtttcagaacgctgagatggagttcgagccttttggcaatttagaccaacccgacttatactatgaatactatcctcatgtttacccaggccgacgcggttcaatggttcctttcagcatgagaatactccatgcagagctccaacaatacctgggaaacccccaggagtcacttgataggctgcataaggtgaaaaccgtgtgttcgaagatattagcaaacctggagcagggcctggctgaggatgggggcatgtcatccgtcacccaagaaggccgccaaggctgctcgtacctggtggcatccattagactatggagaagtcgcttgggaagagtgatgtactccatggccaattgcctattgctcatgaaggactatgttctggcagtagaggcttaccactctgttataaaatactacccagagcaggagccacaactgctctctggcattggtcgcataagtttgcagattggggatattaaaaccgcagagaagtatttccaggacgtggagaaagtcacccagaagctggacggactacaggggaaaatcatggtcctgatgaacagcgcatttctgcacttgggccagaacaactttgccgaagcacaccgattttttactgagatattgcgcatggatcccagaaacgctgtgcagatgctgtctgctagccacccaaccggtaaggagccaagcccgaaagacgctgaagaacacccggaggggcacagggacagcgcagagcctggccctgctcgacctatggtgcctcaacgggccccccctggtcccgccctgtgcgctcaaccatag

SEQ ID NO: 208891 - DNA, 2208 bp, Artificial Sequence
  Description of Artificial Sequence: Synthetic coding sequence
atggaggacgccggcggcggcgaggagacccccgcccccgaggcccctcacccaccgcagctggcgccccctgaagagcagggactgttgttccaggaagagactatagatcttggcggcgacgaattcgggtccgaggaaaacgagaccgcctcagaaggctcttcacctctagcggacaagctgaatgagcatatgatggagtctgttctgatttcagatagtcccaattccgagggagatgcgggagacctgggacgagtaagggatgaggccgagccaggcggagaaggagaccctgggcccgaaccggccggcacccctagtcccagcggagaagctgatggcgactgtgctccagaggacgcagctccctcaagcggcggggctcccaggcaggacgcagcaagagaggtgccgggcagcgaggcggcacgacctgagcaggagccccccgtggcagaacctgtacccgtgtgtaccattttttcgcagcgagccccacctgcctccggcgacggtttcgagccacagatggttaaatctcctagtttcggcggcgcatccgaagcctctgccaggaccccgccacaggtcgtccagccctccccttctctcagtacatttttcggggatacggccgccagtcactccctcgctagcgacttttttgattcctttactaccagtgcattcattagcgtttctaacccaggcgcaggcagcccagccccagcaagccctcctcctctggctgtgccgggaactgaggggcgccccgagcccgtcgctatgagaggtccccaggccgcggcaccgccagctagtcccgaaccgttcgcccatattcaggctgtctttgcaggatccgatgacccgttcgccaccgccttatctatgagcgaaatggatcgtcgcaatgacgcatggcttccaggggaagccaccagaggagtattacgcgctgtcgccacccagcagaggggagccgtgttcgtagacaaagaaaacctcactatgcccggactgaggtttgacaatatacaaggcgatgctgtgaaagacctaatgttgcgatttttgggcgagaaggccgctgccaaaaggcaggtgctgaacgccgattccgtggaacaatcttttgtaggattgaagcagttaattagttgtagaaactggcgggccgccgtggacctctgcggcaggctgctgacagctcatggccaaggttacgggaagtcaggattgttgacctctcacacaaccgacagtcttcaattgtggttcgtcagattggcactcctggttaaattgggcctgttccagaacgctgagatggagtttgagcccttcggcaacttagaccaacctgatctgtactatgaatattaccctcatgtgtacccaggccgccgcggctctatggtcccattctctatgagaattctccacgccgagctgcagcagtacctcgggaacccccaagagtcactcgatcgcctgcacaaggtgaagactgtgtgtagtaaaattttagctaatctcgagcaggggttagcagaagacggggggatgtccagtgttacccaagaagggagacaagcttctatccgtttgtggcggtctcgactgggacgggttatgtatagcatggcaaactgtctgctgctcatgaaggactatgtgttagcagtggaggcatatcactccgtgataaaatactacccggagcaggaaccccaattgttgagtgggatcgggcggatctctctgcagattggagatatcaagacggccgaaaagtatttccaggacgtcgaaaaggtgactcagaagctggacggacttcaggggaagatcatggtgctgatgaactcagcattcctacacctgggacagaataatttcgccgaagcccatcggttcttcaccgaaattctccgcatggacccccgaaacgccgtagccaacaacaacgccgctgtgtgtcttttatacctgggtaagctgaaggatagcttgagacaacttgaggccatggttcagcaggaccccagacactaccttcacgaatccgtcctctttaacctgaccactatgtacgaactggaaagctcacggtcaatgcagaagaagcaagcgcttcttgaagccgttgccgggaaagagggggactccttcaacacacaatgcttgaagctcgcttag

SEQ ID NO: 208892 - DNA, 2208 bp, Artificial Sequence
  Description of Artificial Sequence: Synthetic coding sequence
atggaggacgccggcggcggcgaggagacccccgcccccgaggccccgcaccccccgcaattagcccccccagaagaacagggcctgcttttccaggaggaaactattgatttaggtggtgacgagttcggaagcgaggagaacgaaacagcaagcgaagggtcaagtcccctggcagataagctcaatgagcacatgatggaatccgtgctgatatctgactctcccaattctgagggagacgccggggatctgggccgtgtaagagacgaggctgaacctggtggcgagggtgatcccggcccagagccggcgggcaccccttctccctccggggaagccgatggtgattgcgccccagaagacgcagcgccctcttccggtggagctcctcggcaggatgcagctagagaagtccccggaagcgaagccgctagaccagagcaggagcctccagtggctgaaccagttccggtttgtaccatcttcagccaacgggctccaccggctagcggcgatggatttgagcctcagatggttaaatcacctagctttggcggagcatcagaagcttccgcccgaacccctcctcaggttgttcaacccagccccagtctttctacatttttcggcgacaccgccgcgtctcattccctggccagtgacttctttgattcattcaccacctccgcatttatttctgtgagcaaccccggggctgggagcccagcccctgcgtcccctcctccactcgcagttcctggcacagaaggccgccccgaacccgtggcaatgagaggcccccaggccgcagcgccgcctgccagccctgagccttttgcccatattcaggccgttttcgctggatccgatgaccctttcgccaccgccctctcgatgtcagaaatggaccgccgcaacgacgcctggcttccaggagaggcaacccgcggagtcttgcgcgccgtagcaacacagcagaggggggccgtcttcgtagataaagagaacctgacgatgccgggactacgcttcgacaatatacagggggatgcggtgaaagatttaatgctccgttttctgggtgagaaagcggccgcaaagagacaggtgcttaatgctgactcagttgaacagagctttgtcggactcaagcagttgatctcctgccgaaattggagggcagccgtggacctgtgcggccggctactgaccgctcacggccaagggtacggaaaatctgggctgttgacatcacataccacggactctctgcagctgtggttcgtgcgcctcgccttactagtgaagctgggcttatttcaaaatgccgaaatggagttcgaacctttcggtaacctggaccaacctgacttatactacgagtattatccacatgtgtatcccgggagacggggctcaatggtgccttttagtatgagaatcctccacgccgagctgcagcagtacttggggaacccacaggaaagtttggatcggctgcacaaggtgaagaccgtctgctcaaaaattctcgccaatctggaacagggtctggccgaggacggcgggatgagcagcgtaacacaggagggtcggcaagcatcgataaggctgtggcggtctcgacttggcagagtcatgtactcaatggcaaactgtctactgctgatgaaggattacgttttagccgtggaagcctaccactctgttatcaaatattatcctgagcaggagcctcagctcctgagcggcataggaagaatctccttacagatcggggacatcaagacggctgagaagtactttcaggacgtggaaaaagtgacgcagaagttggatggcttacagggcaaaatcatggttctaatgaatagcgctttcctacatctcggccaaaacaattttgctgaagctcacaggtttttcacagagatcttgaggatggacccgaggaatgcagttgctaataacaatgctgctgtgtgtcttctctacctgggcaagctaaaagactccctccgacagctcgaggctatggtgcaacaggacccaaggcattacctgcacgaatctgtgctgttcaacctcacaaccatgtacgaattagaatccagccggagcatgcagaagaagcaggccttgttggaagcggtggccggcaaagagggcgattctttcaatacccagtgccttaagctagcctag

SEQ ID NO: 208893 - DNA, 423 bp, Artificial Sequence
  Description of Artificial Sequence: Synthetic coding sequence
atgagcggcagcttctacttcgtgatcgtgggccaccacgacaacccagtgtttgagatggagttcctccccgcgggcaaagccgagagcaaagacgaccaccgtcatctgaaccagtttattgctcacgcggccctggacctagtggatgagaatatgtggctcagcaataacatgtacctgaaaactgtggataagttcaacgagtggtttgtatcagctttcgtcactgcaggtcacatgcgctttatcatgctgcacgacatccgacaggaggacggcatcaaaaattttttcacagacgtgtacgatttgtatataaagttttctatgaacccattctatgagccaaatagtcctatcaggtcttcagcctttgaccggaaggtccagttccttggcaagaaacatcttctgtcttag

SEQ ID NO: 208894 - DNA, 423 bp, Artificial Sequence
  Description of Artificial Sequence: Synthetic coding sequence
atgagcggcagcttctacttcgtgatcgtgggccaccacgacaacccagtcttcgagatggaatttctacctgcagggaaggccgagagcaaggatgatcaccgacacctgaatcagttcatcgcgcatgcggccctggatctggttgacgaaaacatgtggctcagcaacaatatgtacctgaagaccgttgataagtttaatgaatggtttgtgtcagcctttgtcactgcaggccatatgcggttcatcatgctgcacgatattaggcaggaggacggaatcaagaactttttcaccgacgtttatgacctttacataaaattctccatgaatcccttctatgagccaaattctcccatccggtcatctgccttcgacaggaaagtgcagttccttggcaagaaacatttactttcttag

SEQ ID NO: 208895 - DNA, 423 bp, Artificial Sequence
  Description of Artificial Sequence: Synthetic coding sequence
atgagcggcagcttctacttcgtgatcgtgggccaccacgacaacccggtctttgaaatggaatttttgcccgcagggaaagctgagtccaaggacgatcaccgccacctcaaccagttcatagcccacgctgcattagacctggtcgatgaaaatatgtggctgagcaacaatatgtaccttaaaaccgtagacaaattcaatgagtggtttgtcagcgcctttgtgaccgcgggacacatgagatttatcatgcttcatgatatccggcaggaggacggaatcaaaaacttcttcactgacgtgtacgacctgtatatcaagttctccatgaacccattttatgagcccaactctccaattcggagctcagcattcgacaggaaagtgcaattccttggaaagaaacaccttctcagctag

SEQ ID NO: 208896 - DNA, 423 bp, Artificial Sequence
  Description of Artificial Sequence: Synthetic coding sequence
atgagcggcagcttctacttcgtgatcgtgggccaccacgacaaccctgtctttgagatggagttcctaccagcaggtaaagccgaatctaaagatgatcatcggcacctgaaccaattcatcgcccatgccgcactggatctggtggacgaaaatatgtggctttctaataatatgtacttgaagaccgtagataagtttaacgagtggtttgtgagtgcctttgtaacggcaggccacatgagattcatcatgctgcacgacattaggcaggaagacggcatcaagaatttctttactgacgtttatgacctctacatcaagttctccatgaacccattctacgagccaaacagtccaatcagatcctcagcattcgaccgtaaagtccagttcctgggaaaaaagcacctgcttagttag

SEQ ID NO: 208897 - DNA, 444 bp, Artificial Sequence
  Description of Artificial Sequence: Synthetic coding sequence
atgagcggcagcttctacttcgtgatcgtgggccaccacgacaaccccgtgttcgagatggagttcctgcctgcggggaaggctgaatcaaaagacgaccatcgtcacttaaaccagttcatcgcccacgccgctctggatctggtcgacgaaaacatgtggctctctaacaatatgtacctgaagaccgtggataaattcaatgaatggtttgtgagcgccttcgtaaccgccgggcatatactgacattccttgtgaagatgcggttcattatgctacacgacatcaggcaggaggatggaatcaaaaattttttcacagacgtttatgacttatacattaagtttagtatgaaccccttttacgagcctaattcgccgattcggagttccgcattcgaccggaaggtgcagtttctcggaaagaagcaccttcttagctag

SEQ ID NO: 208898 - DNA, 525 bp, Artificial Sequence
  Description of Artificial Sequence: Synthetic coding sequence
atgagcagctggaagcaggaccggagcggcctgcggagcaccgagctgaacgtgttggagtaccagccactatgcgccgtgaggagccacattctgaagaccatgtctggctcattttatttcgtgattgtaggtcaccacgataaccccgtgttcgaaatggagttcttaccagccgggaaggctgagtccaaagatgatcacaggcatctaaaccagttcatagcacacgccgctctcgatttggtggacgaaaacatgtggctcagcaataacatgtacttgaagaccgtggataagttcaatgagtggtttgtgagtgctttcgtaaccgctggtcacatgcggtttattatgctccacgacatccggcaggaggatggcatcaagaacttttttaccgatgtctatgatctctacattaaattttccatgaatccgttttatgagcctaattcacctatccgcagctcagctttcgacagaaaagtccagttcctgggcaagaaacacttgttgagctag

SEQ ID NO: 208899 - DNA, 225 bp, Artificial Sequence
  Description of Artificial Sequence: Synthetic coding sequence
atgagcggcagcttctacttcgtgatcgtgggccaccacgacaaccccgtgtttgaaatggagttccttcctgctggcaaggcggagagcaaagacgaccaccgccacctgaaccagtttattgcacatgccgcccttgatcttgtggatgagaatatgtggttatccaataatatgtacctgaagacggttgacaagtttaacgaatggttcgtgagcgcatag

SEQ ID NO: 208900 - DNA, 423 bp, Artificial Sequence
  Description of Artificial Sequence: Synthetic coding sequence
atggccgtgtgcatcgccgtgatcgccaaggagaactaccccctgtatatcaggagcactccaaccgagaacgaactaaagtttcattatatggtacacactagtctggacgtcgtcgacgaaaagatttccgcaatgggtaaggccctggtcgatcaaagggagctttatctggggttgttgtatccaactgaggattataaggtgtacgggtatgtcaccaactccaaagtgaaatttgttatggttgtagatagttcaaacactgcattgagagacaatgaaatccggtccatgtttcgcaagctgcacaattcgtacacagacgtcatgtgcaaccctttctataaccccggagaccgaatacagagttccagagcgttcgacaacatggtgacaagcatgatgatacaggtctgctag

SEQ ID NO: 208901 - DNA, 357 bp, Artificial Sequence
  Description of Artificial Sequence: Synthetic coding sequence
atgagccggcaggccaaccggggcaccgagagcaagaagatgagctccgagcttttcaccctgacctatggagccctggtgacgcaactgtgcaaagattacgaaaacgatgaagatgtcaataaacaactggataagatgggattcaacatcggtgttcggttaatcgaagactttctagcccggtccaatgtaggtaggtgtcacgacttcagggaaacagctgacgtcatcgctaaagaaagaaaaatgtttctggggaagcaaaacaagactaagcggcaggctaaactgtacgacgctgtaaaggagcgtggggctgcttcttgtaccgacgcctcccctctgctttcatag

SEQ ID NO: 208902 - DNA, 405 bp, Artificial Sequence
  Description of Artificial Sequence: Synthetic coding sequence
atgggcttcaacatcggcgtgcggctgatcgaggacttcctggcccggagtaacgtcggccgctgccacgactttcgggaaaccgccgacgtgatagcaaaggtcgcgtttaagatgtaccttggcattaccccctctattaccaattggtcacccgcaggtgatgagttctcgctcattcttgaaaacaatccactggtggatttcgtggagctgcccgataaccattctagcttaatctatagtaacctactgtgtggagtgctacgtggtgccctggagatggtccaaatggctgtggaggctaaattcgtgcaggataccttgaagggcgacggcgtgacagagatcagaatgaggttcatcaggcggatcgaggacaatctgcccgctggggaggaatag

SEQ ID NO: 208903 - DNA, 405 bp, Artificial Sequence
  Description of Artificial Sequence: Synthetic coding sequence
atgggcttcaacatcggcgtgcggctgatcgaggacttcctggcccgctccaatgtaggccggtgtcatgacttccgggaaacagctgatgtaatcgccaaggtcgcgtttaaaatgtacctcggtatcaccccctccattacgaattggtctccagccggagatgaatttagcctgatcctggagaataaccccctggtcgactttgtagagttacccgacaatcacagttctttgatctattctaacctgttgtgcggggtactccgcggagcacttgaaatggtgcagatggctgtggaggctaagttcgtgcaggacaccctcaagggggacggcgtgacagagatacgtatgagattcatccggagaatcgaggacaacctccctgcaggagaggagtag

SEQ ID NO: 208904 - DNA, 543 bp, Artificial Sequence
  Description of Artificial Sequence: Synthetic coding sequence
atgagccggcaggccaaccggggcaccgagagcaagaagatgagcagtgaactttttaccttgacttacggggccctggtgactcagctgtgcaaagattatgaaaacgatgaagatgtcaataagcagctcgacaagatgggttttaacattggtgtacgtctgatcgaagatttcctcgcaaggtcaaatgtcggcagatgtcacgatttcagggagacagccgacgtgatcgcaaaggtggcttttaaaatgtatctaggcattacgcccagcatcactaattggtcacccgccggcgacgagttttcactgatcctcgagaacaatcctcttgtagattttgtggagcttcctgacaaccacagctccctcatctactctaatcttctatgcggtgtcctgagaggggctctggagatggttcagatggcggtggaggctaagttcgtgcaagatacactcaagggggacggggttactgagattcgtatgcgcttcatacgaagaatcgaagacaatctgcctgccggtgaagaatag

SEQ ID NO: 208905 - DNA, 498 bp, Artificial Sequence
  Description of Artificial Sequence: Synthetic coding sequence
atggccatcttcagcgtgtacgtggtgaacaaggccggcggcctgatttaccagcttgatagctatgcccctcgggccgaagccgagaaaacattcagctatcccctcgatcttctcttgaaacttcacgatgagcgggtgcttgtggcctttgggcaacgtgacggcattagagtggggcacgccgtcttagcaatcaacggcatggatgtgaacggtcgttacacagcggacggcaaggaaatgctggagaccgacaccttcaagttacattgttaccagaccctcacggggatcaaattcgtcgtcctcgctgatcctcggcaggccggcattgactccctgctgcgaaagatttacgagatctattcagattttgcactgaaaaaccccttctatagcttggagatgccaatcaggtgcgagctcttcgaccagaatctgaagctggcattggaagtcgcagaaaaggcggggaccttcggtcctggctcttag

SEQ ID NO: 208906 - DNA, 660 bp, Artificial Sequence
  Description of Artificial Sequence: Synthetic coding sequence
atggccatcttcagcgtgtacgtggtgaacaaggccggcggcctgatctatcagttggattcttatgcccctcgtgccgaggccgagaagaccttcagctatccccttgacctgttactcaagcttcacgatgagcgggtgctcgtcgccttcgggcagagggacggcattcgagttggtcatgccgtgctagcgattaatggtatggacgtgaacggccgctataccgccgatggcaaagaagtgctcgaatacctagggaacccagctaactatccagttagcatacgctttggccggccgagacttactagcaatgagaagctgatgttggcctcaatgttccactcgctcttcgccatcgggtctcagctgtctcctgagcagggtagtagtggaatcgaaatgctggaaactgacaccttcaaactgcactgctaccagacattgaccggcatcaagttcgtggttctagccgatcctagacaagccggcatcgactcactgctccgcaaaatttatgaaatttattccgattttgccctgaagaatcctttttactcactggaaatgcccattcgctgcgaattgttcgaccagaatctgaagctcgccctggaagtcgcagagaaagccggcaccttcggccctggaagctag

SEQ ID NO: 208907 - DNA, 4308 bp, Artificial Sequence
  Description of Artificial Sequence: Synthetic coding sequence
atggcccagtgcgtgcagagcgtgcaggagctgatccccgacagctttgtgccttgcgtggctgcattatgtagcgatgaggctgagagactcactcgcctaaaccacctctcattcgcagaactactcaagccattcagccgcctgactagcgaggtacatatgcgggatccaaacaatcaactgcacgttattaaaaatctgaaaatcgctgtcagcaatatcgtgacccagcctccccagcccggtgcaattcgtaagttgttaaacgacgtcgtctcaggtagtcagcccgccgagggactggtggcaaatgtcatcactgctggagactatgatctcaacatttctgccactacaccatggtttgagtcgtatcgagagaccttcctgcagtctatgcctgcactggatcacgaatttctgaaccactatcttgcctgtatgttggtcgcaagcagctcagaagctgagccggttgagcaattttctaagctgagccaagagcagcatcggatccagcacaacagtgactactcctatccaaagtggtttattcccaataccctgaagtattatgtgctcctccatgacgtctccgcaggcgacgagcagcgggccgaatcgatatatgaagagatgaaacagaaatatggaacacaggggtgctacctgctaaaaatcaacagcaggaccagcaatcgggccagcgatgagcagattcccgacccctggtctcaatatctccagaaaaatagcatccagaaccaggaatcctacgaagatgggccgtgtacaatcacctcaaacaaaaacagcgataataacctcttgagcctggatggattggataatgaggtcaaagatggattgcctaacaacttcagggcgcaccctctccaactggaacagtcttcggacccttcaaatagcatagacgggccagatcaccttaggtccgcttccagtctgcacgaaactaaaaaaggcaatactggcatcattcacggagcttgtctaaccctcacagatcatgaccggatccgacagtttatccaggagtttaccttccgtggcctactgccgcatattgagaaaactattcggcagttgaacgatcaactaattagccgaaagggtttaagtaggagtctgttttccgctacaaaaaagtggttctcaggaagcaaagtaccagaaaaatcgattaacgatctgaaaaatacgagcgggctgttgtatcctcccgaagccccagaattacaaatccgcaagatggcggatctatgttttctcgtgcaacattacgatttggcatacagctgttatcacaccgctaaaaaagactttcttaacgatcaggctatgctttatgccgcaggtgccctggagatggccgctgtatctgcgtttctgcagcccggcgccccacgcccataccctgctcattacatggacaccgccatccagacataccgcgatatttgtaagaatatggttttggccgaaagatgtgtactattaagtgcagaactgctcaagtctcagtcaaaatatagcgaggctgccgctctgctgatcaggctgaccagtgaggattcagacttacggagtgctttgctgttggagcaggccgcccattgtttcattaacatgaagtcccccatggtgcgcaagtatgcctttcacatgatcctggctggtcatagattttctaaggctgggcagaagaaacatgccctgagatgctattgccaggcaatgcaggtttacaaggggaaggggtggtctctcgcagaagatcacatcaactttacaatcggtaggcagagctacaccctgagacagctggataatgcagtttcagcctttcggcacatattaatcaacgaatctaagcaaagcgccgctcagcagggcgcttttctacgcgagtatctctacgtctacaagaatgtcagtcagctatctcctgatggccctctgccgcagttgccgcttccatatatcaactctagtgccactcgcgtcttcttcggtcatgatcggcgacccgccgatggggaaaagcaggccgctactcacgtctctctggatcaggaatatgacagcgaaagtagccaacagtggagggaactggaagaacaggtagtgtcagtggtaaataaaggtgtgataccctcgaatttccacccgactcagtactgcctcaactcctacagcgacaacagcaggttccccctggccgtagtggaggaacctatcaccgttgaagtcgccttccgcaatcctctcaaggtgctgctgctgctcaccgatttgagcttgctgtggaagtttcatccaaaggatttctccggaaaggataatgaggaggtgaaacaactggttacaagcgaacccgagatgattggggccgaggtcatatccgagtttctaatcaatggcgaggagtctaaggtcgcacggttgaagctattcccgcatcatataggcgaactccatattctgggagtggtgtataatttaggcacgatccagggatcaatgacggtggatgggattggggcactcccaggctgccataccgggaagtattcactgtctatgtccgtgagggggaaacaggaccttgaaatccagggaccgcggctaaacaacacaaaagaagagaaaaccagcgtcaaatacggcccagatcggagactcgacccaatcatcaccgaggagatgcccctcctcgaggtctttttcatccattttccaaccgggctgctgtgtggagagattcgtaaagcatatgttgagtttgtgaacgtttccaagtgccctctgactggcttgaaagtggtcagcaagcgacccgagttttttacgtttggcggcaacacagctgtgcttacaccactcagtccttccgccagcgaaaattgctctgcctacaaaaccgtggtaaccgacgccacatccgtctgcacagcgcttatttcatccgcctcctccgttgattttggtattgggaccgggtcccagccagaggtaatacccgtcccactgcccgacactgtccttctgcccggagccagcgtgcagctgccgatgtggttgcgagggcccgacgaagagggcgttcatgagatcaactttttgttctattatgaatcagtcaagaagcaacccaagatcagacatagaatcctgaggcacaccgccatcatttgtacgtctaggtctttgaatgtgagagcgaccgtgtgtcgcagcaatagtctagagaacgaagagggtcgcggaggcaacatgctcgtctttgttgacgtcgagaatactaacacatccgaggctggggtgaaagaattccacattgtgcaagtctcatcctcgtccaaacactggaagctgcagaaatctgtcaacctgtctgaaaacaaggataccaagctggcatcaagagagaagggcaaattctgcttcaaggccatccgctgcgaaaaagaggaagcggcgactcagtcttctgaaaaatacacatttgcagacataatttttggaaatgagcagatcattagctcagctagtccatgcgccgatttcttttacagaagcctatcctcagagttgaaaaagccccaggcacacctccccgttcacacagagaaacagtctacagaagacgccgtccgccttatccaaaagtgtagtgaagtggatctgaacattgtcatactgtggaaagcctacgtcgttgaagactccaagcaattgatcctggagggccagcatcacgttatactacgcaccatcggcaaggaggctttctcatatcctcagaagcaggaacctcctgaaatggaacttctaaagttctttagacccgaaaatattaccgtatcatctagaccttcagttgaacaactttcctctctgattaaaacatccttgcactatcccgagtccttcaatcaccccttccatcaaaagtctctgtgtctggtgccagtgaccttgctgttgagtaattgttctaaggccgacgtggatgtaatcgtggatttgcggcataaaacaacatccccagaagcactcgaaatacacggctcctttacttggctggggcaaactcagtacaaactgcagctgaaatcccaggagatccactcattacagctcaaggcgtgtttcgtgcataccggagtctacaacctgggaacccccagagttttcgctaaactatccgatcaggtgacggtctttgagaccagccagcagaacagtatgcccgccctgatcattattagtaacgtgtag

SEQ ID NO: 208908 - DNA, 3420 bp, Artificial Sequence
  Description of Artificial Sequence: Synthetic coding sequence
atgagcgtgcccgactacatgcagtgcgccgaggaccaccagaccttgttggtcgttgtgcaacccgtggggattgtgagcgaggaaaacttttttcgaatatacaaaagaatctgctctgtgtcacagatcagtgtccgggattctcagcgggtgttgtacatacgttataggcaccactatccgcctgagaacaatgagtggggagattttcagactcacaggaaggttgtgggactgatcaccatcactgattgttttagtgccaaggattggcctcagacgttcgagaagttccatgtgcagaaagaaatctatgggagcaccctctatgactcacgcctatttgtgttcggtctccagggcgagattgtcgagcaacccagaaccgacgtggcattttatccaaattatgaggactgtcagaccgtcgagaaaagaatcgaagactttatcgagagtctcttcatcgttctagaaagtaagagactggatcgggccaccgacaagagcggcgacaaaatcccccttctatgtgtacccttcgagaagaaggacttcgtcgggctagacaccgactcacggcactacaaaaagcgttgtcaggggcgtatgcgaaagcacgtcggagatctgtgccttcaggccgggatgctccaggattccctggttcattatcatatgagtgtggagctgcttcgtagcgtcaacgacttcctgtggctgggggccgccctggaaggactctgctccgccagcgtgatctaccactatcccggaggaacgggcggtaaaagtggagcacgtcgcttccagggatcaactcttccagcagaagcagcgaaccgccatcggcccggagctttaacgactaacgggatcaacccggacacttcaacggagataggccgggctaaaaattgcctcagccctgaagacatcatcgataagtacaaggaagcgatcagctattactctaaatacaagaatgctggggtcatcgaactcgaagcttgtattaaggccgtgcgcgtcctggccattcagaagcgcagtatggaagctagcgagtttctgcaaaacgccgtctacatcaacctgcgccagttgagtgaggaggaaaagatccagcgttactcaatactttcggagctctacgaactgattggttttcatagaaagagcgccttctttaagcgtgtggcagctatgcaatgcgtagccccctcgatcgccgagcccgggtggcgagcttgctataagttgctcttagagaccctcccagggtatagtctgagcttggatcccaaagacttcagccggggtacacacaggggctgggccgccgtgcagatgagactattacacgaactagtatacgcgtcccgtcgaatgggcaatcctgcacttagtgtgagacacctcagtttcctgctgcagactatgctggattttctgtctgaccaagagaagaaagatgtggcccagtcattggagaactacactagcaagtgtcccggcactatggagcccattgcgctgcctggcggcctcactctgccccctgtcccgttcacaaagctgcccattgtgcgtcacgtgaagctgcttaacctgcctgccagcctgcgtccgcataaaatgaagtctcttctgggtcagaatgtatccacgaagtcccccttcatctatagtcccatcatcgcgcacaataggggagaggagcgcaacaagaaaatcgactttcagtgggtccagggtgatgtttgtgaggtccagcttatggtgtacaatcctatgccctttgagttgcgagtggagaatatgggactcctcacatcaggcgtggaattcgagtctttgcccgctgctctcagtctgcccgcggaaagtggcctttacccagtaactctggtgggtgtgccgcagaccaccgggactattaccgtgaacggttatcacacgacagtcttcggtgtcttctctgactgtctgctagataacctgcctgggattaaaacatcaggctcgacagtagaagtcataccagccctgcctagactgcagatctctacatcgcttcctcggtctgcccattccctgcagccctcttccggggatgagatctccactaacgtttcagttcagctttacaatggcgaatcccaacagctgatcatcaaactcgaaaacattggtatggagccacttgaaaagcttgaagtaacaagcaaggtgctgacaaccaaggaaaagctctatggggacttcctttcctggaaactggaggagacgctggcccaattccctttacagcctgggaaagtggctaccttcaccatcaatattaaggttaagctcgacttctcatgccaggaaaatctgcttcaggacctctcagatgatgggatctctgtgagtgggtttccgctttcctctccatttcgacaggtggtacgaccccgcgtggaggggaaacccgtgaacccaccagagtcaaataaggctggggactactcccatgtgaagacactagaagccgtgcttaatttcaagtacagcggcggacccggtcacactgaaggctattaccgcaatttgagcttaggcctgcacgtggaagtggagccatccgttttcttcacccgcgtgtctaccctgcctgcgacaagcacccgccagtgtcatttgcttctggatgtattcaattcaacagagcacgagctgaccgtcagtactcgctccagcgaagccctcattctgcacgcaggcgagtgtcagcgtatggccattcaggtggataagtttaatttcgagagcttccctgaatcaccaggggagaagggacagttcgccaaccctaaacagctggaagaggagaggcgggaggcgcgaggcctggagatccatagcaaactgggtatatgttggcgaatccccagcctgaagcgcagtggcgaagcttccgtcgaaggcctgctgaaccaactagtgctcgaacacctgcagcttgcacctctgcagtgggacgtgctggtggacggtcagccctgtgatcgcgaggccgtcgcggcttgtcaagtgggcgacccggtgcgtctggaggtgaggctaactaaccgatccccaagatcggtggggcctttcgcgctgaccgttgtacccttccaggatcatcagaatggcgttcataactacgatctccatgatactgtaagcttcgtcgggagcagtaccttctacctagatgctgtacagccatccgggcagtccgcatgcctgggggccctactctttctgtatacaggcgatttctttttgcacatcagattccatgaagattccaccagtaaggaattgcctcccagctggttttgcttgcccagcgtgcatgtgtgtgcactggaggctcaggcctag

SEQ ID NO: 208909 - DNA, 3741 bp, Artificial Sequence
  Description of Artificial Sequence: Synthetic coding sequence
atggtgcccgccggcgaccaggaccgggccccccaccggggcaagccagcacaggctggggctagaaccagtcgggcctctcgcgctctgaggtcttggaggcggtctcaggctgctcgagccactgtgacccatccacgcggtggccacgatagaggcagccacggcggataccgggagggccacagaggttgcagacgtgacccgcagtgggcttccgccggcccgccacctctttcatttaccgaagaagttaagttcgaactgcgggcattgaaggattgggattttaaaatgtccgtacccgactacatgcagtgcgccgaggaccaccagaccctgctggtggtggtccaacccgtcgggattgtctcagaggaaaactttttcaggatatacaaaagaatttgctctgtgtcacagattagcgtgcgagacagccaaagagtgctttatatccgctacagacatcactatcctcccgaaaataacgaatggggggactttcagactcaccgtaaggtggtaggactcatcacgatcacagattgctttagcgctaaagactggcctcagacctttgagaagtttcacgtccagaaagagatttacgggagtaccttatacgatagtcgcctatttgtctttggcctgcagggtgagatcgttgagcagccccgcacagatgtagcgttttaccccaactacgaagactgtcaaacagtggagaagcgcattgaggactttatcgagagcctgtttatcgttttggagtcaaaacgcttggaccgcgcgaccgacaaatctggcgacaagatccctctcctgtgtgtcccattcgagaagaaggattttgtggggttggatacagactctagacactataaaaaacggtgccagggaagaatgcgcaaacacgtgggtgacctgtgtctgcaggccgggatgctgcaggacagtctcgtgcactaccacatgtcagtggagcttttaaggtctgtgaacgattttctttggcttggagctgctctggaaggcctgtgctctgcgagcgtgatttatcactacccggggggtactggcggcaaaagcggagcacgacgttttcaggggtccaccctgccggctgaggccgccaatcgtcacaggcctggcgcccaggaggtgcttatagaccctggcgccctaaccaccaacggtattaatccagacacctccacagagatcggtagagccaaaaactgtctttcccccgaggacattattgacaagtataaggaagctatcagctattactcaaaatacaagaacgccggagtgattgagctcgaggcctgtatcaaggcagtcagggttctggcgatccagaaaagatccatggaggcctccgagttcttgcaaaatgctgtctacataaacttgcgccagcttagcgaagaggagaaaatccagcgatacagcatactgtctgaactctatgagctgatcggtttccatcgcaagtctgcctttttcaaacgggtggcggccatgcagtgtgttgcaccttctatcgccgaaccaggctggcgggcatgttacaagctcctgcttgaaactttgcccggatactctctcagcctggaccctaaagatttcagcaggggcactcatcggggttgggcagcagtgcaaatgcgattactgcacgaactcgtgtatgcatcacgcagaatgggaaacccagcactgagtgtacggcacctgagtttcctgttgcagaccatgcttgatttcctttccgatcaggagaagaaagacgttgcacagtcactggaaaactatacttctaagtgcccaggtaccatggaaccaatcgcacttccgggtggactcactctccccccggttccattcactaagctgcccatcgtgcggcacgttaaactcttgaacctgccggcttccctacgcccacacaaaatgaagagtttgctaggacaaaacgtttctacaaagagcccattcatctattcacccattatcgctcacaaccgtggagaggaacggaacaagaagattgacttccaatgggtgcaaggagacgtgtgtgaggttcagctcatggtttacaatcctatgccgttcgaattacgcgtcgagaacatgggactgctgaccagtggcgtggaattcgagagcttgccagccgcactcagcctccccgccgaatccggactatatccagttacccttgtcggggtgccacagacgactggtaccatcaccgttaacggataccatacaacggtgtttggtgtgttcagcgactgcctgctggataatctgccggggataaaaacatctggcagtacggtggaagtgattcctgcactaccccgcttacagatcagtacctcactccctcgctccgcccattcactgcagccatcttctggtgatgaaatatccacaaatgtcagcgtccagctgtacaatggcgaaagtcagcagcttataatcaaactcgagaatatcggcatggagcctcttgagaaactcgaggtcacttccaaggtgctgacgactaaagagaagctctatggcgattttctttcctggaaactggaggagacactggcccaattccctctacagccggggaaagtggctaccttcacaatcaacattaaagtcaagttagacttttcgtgccaggagaatctgctccaggatctcagcgacgacggcatatctgtcagtggctttcctctaagcagtcctttccgccaggtagtccgcccccgggttgaaggcaagcccgtgaacccaccggaaagtaacaaggccggagattattcgcatgtaaaaactctcgaagctgtactgaacttcaagtacagcggcggccccggccacaccgaaggctattatcgtaacctgtctctgggactgcacgtcgaggttgagccctccgtgtttttcactagggtgtcaacactgccagctactagcaccagacagtgtcacctgctgctggacgtgtttaattctactgagcatgagttgactgtgagcactcgttcatctgaagccctcatcctgcacgcaggggagtgccagagaatggcaatccaggtggacaaattcaacttcgagtctttccctgagagccccggcgagaagggacagttcgctaatcctaagcagttagaagaggaaagaagagaggcccggggtctggagatccacagtaagctgggcatctgctggcggattccttctctgaaacgttctggcgaggcctcagtcgagggacttctgaatcaactggtgctggagcaccttcagttggcacccctgcagtgggatgtcttggtcgatggtcagccatgcgaccgggaggcagtggcagcctgccaagttggagaccctgtcaggcttgaggtcaggctgaccaatcgttcgcccaggagcgttggcccgtttgcgctgacggtcgtgcctttccaggaccaccagaacggggtgcacaactatgaccttcatgacacagtctcatttgtcggcagttccaccttttacctggacgcagtccagccatctggacagagcgcctgcttgggggcacttctgttcctttacacaggcgacttcttcctgcacattcggtttcatgaagactccactagcaaggagcttccaccgagctggttttgtttaccttcagtgcacgtctgtgcgctggaggcccaggcatag

SEQ ID NO: 208910 - DNA, 3447 bp, Artificial Sequence
  Description of Artificial Sequence: Synthetic coding sequence
atgagcgtgcccgactacatgcagtgcgccgaggaccaccagaccctgctagtagtcgtccagccagtcgggatcgtgtccgaggaaaacttcttccgtatctacaagagaatctgcagcgttagccagatttccgtgagggactcccagcgtgtactgtacatccgctatcgccaccattatccacccgagaacaacgaatggggagatttccagactcaccggaaggtggtcgggctgatcactattacagactgcttttcagccaaagactggcctcaaaccttcgaaaagtttcacgtccagaaagagatttacggaagtactctgtacgatagccgattgttcgtgtttgggttgcaaggagaaattgttgaacagccacgtacagacgtggctttttaccccaattatgaggattgtcagactgtcgaaaaaagaattgaagatttcatagagtctttattcatcgtgctggagtctaaaagactggaccgcgcaaccgataaaagcggcgacaagatcccactgctgtgtgtacccttcgaaaagaaggacttcgttggccttgacactgacagcaggcactacaagaagagatgtcaaggcagaatgcgcaagcacgtcggagatctgtgtctccaggccggtatgttgcaggatagcctagtccattaccacatgtccgttgagcttctgcggtcagtgaatgacttcttgtggctgggggcagctctcgaggggctttgtagcgcttccgtgatctatcactatcccggcggtacaggcgggaagtcgggcgcgagacgtttccaagggagcactttaccagctgaggccgctaaccgccaccggccaggggcacaagaagtacttattgaccccggcgctcttaccaccaatggtattaatccagacacctctactgagatagggcgagcaaaaaactgtctgagtcccgaagatataattgacaaatacaaagaggccatctcctactatagcaaatataaaaacgctggggtgatcgagctagaggcatgcatcaaagcagttagggtgctcgccatacaaaagcgaagcatggaggccagcgaatttctgcaaaatgctgtctacattaatttacgccagctctcagaagaagagaaaatccaacgctactccatccttagcgagttatacgaactcattggcttccatcgcaagtctgcattctttaagcgcgtcgctgcaatgcagtgcgtggctccaagcattgcagagccaggctggcgggcatgctacaagcttctgctcgagaccctgcccgggtactctcttagccttgacccaaaggacttctctcgtggtactcaccgggggtgggcagcagtgcagatgcggctcctccatgaactggtgtatgcctccagacgaatggggaatccagcccttagtgtaaggcacttgagcttcctgctccagacgatgctcgacttccttagtgaccaggagaagaaggatgttgcacagtctctggagaactatactagcaaatgtccaggcacaatggagcctatcgcacttcctggcggcctgacactgcctccagtgccgttcacgaagctcccaatcgtgagacacgtgaaactcctaaacctacctgcttcgctgaggcctcacaaaatgaaaagtcttctgggacagaacgtttccactaaatctccattcatctattcacccataattgcccacaaccggggagaagaacgcaacaagaagattgactttcagtgggtccagggggacgtgtgtgaggtgcagctgatggtctataacccaatgcctttcgaacttagagtggaaaacatgggactactgacttccggcgttgagttcgaatcacttcctgctgcgctctcactacctgcggagagtggattgtacccagtgaccctcgttggcgtcccccagaccactgggactatcacggtgaacggataccacactactgttttcggtgtattcagtgactgtcttctcgacaatctgcctggcattaaaacttccggctccaccgtggaggtaattccagctctgccgaggttgcaaatttcaactagcctcccccggtcagcccactcattgcagccaagctcgggcgacgagataagtaccaacgtgtccgtgcagttgtataacggagaaagccaacaattgattattaaactggagaatatagggatggagccccttgagaaactggaagtaacaagcaaggtgttgactacaaaggaaaaattatacggtgacttcctttcgtggaagctcgaggaaacgctggcccaattcccccttcagcccggtaaagtagcaacatttaccattaacataaaggttaagctggattttagctgtcaggaaaatctgctacaggaccttagcgatgacggaataagtgtgtccggattcccactgagttctccattccgccaagtggtgagacccagagtcgaaggaaagcctgtgaacccacctgagagtaacaaggctggcgattactcgcacgtcaagacccttgaggctgtattgaatttcaagtactcgggcggccccggacacacagaaggttactatcgcaacctctcactgggtctgcatgtcgaggtcgaaccctctgttttcttcacgcgagtgagcacgcttcctgctaccagcacgagacaatgccatttactgctcgacgttttcaactctaccgagcacgaactgaccgtgtctacccgctctagcgaagctctcatcctgcatgctggcgagtgccaaagaatggcaatccaggtcgataaatttaatttcgaatcttttcccgaatcaccaggcgaaaaagggcagtttgctaacccaaagcaacttgaggaggaacgacgtgaggctaggggcctcgaaatacacagcaagctggggatctgctggcgcatacccagcttgaaacgtagcggggaagccagtgtggaggggctcttaaaccagctggttttagagcatctgcagttagcacccctccaatgggatgtcctcgttgacggtcagccttgcgatagagaggctgttgccgcgtgccaggtgggggatcccgtccgtctcgaagtccgacttacaaacagaagcccgcgcagtgtcggtcctttcgcactgaccgttgttccatttcaggaccatcagaacggagtgcacaactatgatctccacgataccgtgagttttgtcgggtcatccacgttctaccttgacgccgtgcagcccagtggtcagtccgcttgtctgggcgctttgctttttctgtatacgggcgatttcttcctccacatccggtttcacgaggactccacttcaaaggaactccctccgtcatggttctgcctacccagcgtccacgtttgcgccctggaggcacaggcatag

SEQ ID NO: 208911 - DNA, 2862 bp, Artificial Sequence
  Description of Artificial Sequence: Synthetic coding sequence
atggccctggtgttccagttcggccagcccgtgcgggcccagcccctacccgggctttgccacggtaagctgatacgaaccaacgcttgcgacgtttgcaattcaacggatctcccagaagtcgagatcatcagtctgctcgaagaacagctcccacattacaaacttcgcgctgacacgatttacggctacgatcacgacgactggttacatacccctctgatctcgcccgatgccaatatagatttaaccaccgaacaaatcgaggagacactgaagtactttctcctgtgcgctgagcgtgtaggacagatgactaaaacttataacgatatcgacgccgtaacaaggttgctggaggagaaggagcgggatctcgagctcgccgcacgtatcggccagagcttgctgaagaaaaacaaaaccctcactgagaggaacgaactcctggaggagcaggtggagcacatcagagaggaagtttcccagctgaggcatgaactgtcaatgaaggatgagctcttgcagttttacacgtccgctgccgaagaaagtgagcccgaatcagtgtgtagcacacccctgaagaggaatgagtccagcagttctgtacagaattacttccatctggactcgctgcagaagaagctgaaagatctggaagaagagaacgtggtgctgaggtccgaggcaagccaactgaagacagagacaataacatatgaggagaaggaacaacagcttgtgaatgactgtgtgaaggagctgagagatgctaacgtgcaaatcgccagtatatcggaggagctcgccaagaaaactgaagatgccgctcgtcagcaggaggagattacccacctcctgagtcagattgtggatttacagaagaaagccaaggcctgtgcagtcgaaaacgaagagctggtgcagcacttgggagccgccaaggacgcccagaggcagttgaccgcagaactgagagagttggaagacaagtatgccgagtgcatggaaatgctacatgaggcccaagaagagcttaagaatctgcggaacaaaacaatgcccaacacaacgagcagaaggtatcactctctgggactgtttccaatggactcgcttgccgccgaaattgagggcacaatgaggaaggagctgcagctggaggaggccgagagtccagacattacgcaccaaaagagagttttcgaaacggtgaggaacatcaatcaagtagtgaaacaacgtagcctgaccccatctcccatgaacattccaggcagtaaccaaagtagtgccatgaactcactgctgagcagctgcgtttctaccccccggagctccttctatggatctgacattgggaacgtagttttagacaataagaccaactctattatcctcgagacagaggctgccgacttgggcaacgacgagagaagcaagaagcccggaactccggggactcccggttctcatgacttggagaccgccctccgccgcctgtctctccgacgagaaaattacctctcggagcggcggttctttgaggaagagcaggaaagaaagcttcaggaactggccgagaaaggggagctccgctctgggtccctcacccccacggaatctatcatgtcccttggcacgcactcacgtttctccgagtttactgggttctcaggcatgtccttttctagccggtcatacctgcctgagaagctgcagatcgtaaagcctttagagggaagtgcaacactgcaccattggcaacagctggcccagccccacctgggcggcatcctggacccaaggccaggcgtggttactaaagggtttcggaccctcgacgtcgacctggacgaggtctactgtctgaatgatttcgaggaagatgataccggagaccacatctcactaccgagacttgccacgagtacccctgttcagcaccctgagactagtgcccaccatcctgggaaatgcatgtcccaaacgaacagcaccttcacattcaccacgtgtaggattcttcatccctcagatgagctgactcgagtgacaccttctctgaattcggccccgactcccgcttgcggcagcacatcccacctgaagagcacccctgtggctactccttgcacccccaggagattgtccctcgcagagtcctttaccaacacacgggagagtactaccaccatgtctaccagcctagggctcgtgtggctgctaaaagagagaggtatctccgcagccgtgtatgatccccagtcatgggaccgggcagggaggggcagtctgctgcacagctacacacccaaaatggccgtcatcccctctaccccacctaactcccccatgcagacaccaacgtcaagtcccccttcattcgaatttaaatgtacgtcccccccatatgacaacttcctggcatccaaaccggcgagcagcatactgcgggaggtcagagaaaagaacgtgcgcagctccgagtctcagaccgatgtctctgttagcaatcttaacctcgtcgacaaagtgagaagatttggcgttgcaaaggtcgtgaatagcggcagagcgcatgtgccaactttaactgaggagcagggacctcttctttgcggacccccagggcccgcccccgccctagtgcccagaggtctggtacctgaagggttaccgctgagatgccccaccgtaacatctgccataggtggacttcaacttaactccgggattcggagaaatcggagcttcccaacaatggttggaagctctatgcagatgaaggctccagtgacccttacgtcaggcattctgatgggagccaagctgtccaagcagacttcacttcgatag

SEQ ID NO: 208912 - DNA, 2061 bp, Artificial Sequence
  Description of Artificial Sequence: Synthetic coding sequence
atgagcctgcgggacaagggcggcgaggaggagtgcttcgagtacgactgtcaagacgaagaacgtaaacctacacaccgccagcacgatacccaggatcttcttgaagaggttttatgcgcagaaagagttggccaaatgaccaaaacttacaatgacatcgacgccgttacacggctactggaggagaaggagagagatctggagctcgcagcacgtatcggacagtctctgcttaagaagaataagaccctgaccgagcgaaatgagttactcgaagaacaagtcgaacacattagggaggaagtgagtcagctacgccatgaattgtctatgaaggatgagctgctgcagttctacacaagtgctgccgaggagtcagagcctgagtccgtgtgctccacacctctcaaacggaacgagtcttcttcaagtgttcagaactactttcacctggatagtctgcaaaagaagctgaaggacctggaagaagagaacgtggtgcttagatctgaggcgtcccagttaaagacggaaaccatcacatatgaggagaaagagcagcagcttgtcaatgactgtgtaaaagagctcagagatgccaacgtgcagatcgcctctatcagcgaagaactggcaaaaaagacagaggacgcagcgagacagcaggaagagatcacacaccttttgtcccagatcgtggacctccagaagaaagctaaggcatgcgcggtggaaaacgaggagttggtgcagcacctgggcgccgcgaaggatgcacaacgccagctcaccgctgaactgagagaattggaggacaaatatgccgagtgcatggaaatgctgcatgaagctcaggaggaacttaaaaacctgcgaaacaagacgatgcccaacacgacctctagaaggtatcactcactggggctgtttccaatggacagcttggccgctgagattgagggcacaatgcgtaaggagctgcagctggaggaggccgaatctccagatataacccatcagaagcgggtgtttgaaactgtaagaaacattaatcaggttgtgaaacagaggtctctcaccccgtcaccaatgaacattcctggcagcaatcagtccagcgccatgaactctctgttatcgtcttgtgtcagtacaccccgctcaagcttctacggctccgatatagggaatgtggtcctggacaacaagacaaacagcattatcctggaaaccgaggccgccgatctggggaacgatgaaagaagtaagaagcctgggacgcccggaacacccgggtcccatgatctcgagacggccctcaggcggctctctctccggcgcgagaattacctttctgagcggcgcttttttgaggaggagcaggaaagaaagctccaggagctggccgagaagggtgagttacgctctggcagcttgacacccactgagtcaataatgtcgctcgggacccactccaggtttagtgagttcactggcttttctggtatgtctttttcttctagatcttacttacccgaaaaactgcagattgtaaaacctttggaaggatccgctactcttcaccattggcagcagctggcccagcctcatctgggaggaatcctggatccccgtcctggggtagtcaccaaggggttccggactcttgacgtggatctggatgaggtatattgcctcaatgattttgaagaagatgacactggagaccacatcagcctgcctagactggcgacgagcactccggtacagcatcccgagacatccggggaaagaagtcaagctcgtgtgactgtgagtggatcccgcagctatccatccaggccacaagcctcacccgaggaaatgcaagagcctccggccgccacagaagaagaggaggaggaagaggaagaggaaggtagcggtgaagggactacaatttccccagtaaacctggcccctttccccgaggcagaattttgggcgatattgacttcggtgcccggaaccattcggtcagggagcctgtccgtcgcctcggcccgactgtgcggctag

SEQ ID NO: 208913 - DNA, 2688 bp, Artificial Sequence
  Description of Artificial Sequence: Synthetic coding sequence
atgagcctgcgggacaagggcggcgaggaggagtgcttcgagtacgactgccaggatgaggaacggaaacccactcatcgccagcatgacacacaggacttattggaggaagttctctgtgcagaacgagtgggccaaatgaccaagacctacaatgatatagacgcagtgacacgtttgctggaagagaaggagcgtgacctcgaattggctgcccgaatcggccaatccctgcttaaaaaaaacaaaaccctgactgagcgaaacgagctgcttgaagagcaggtggaacacatacgcgaagaggtctcacagctgaggcacgagctgtcaatgaaagacgagttgctgcaattctacacaagtgctgcggaagagtctgaacctgaaagtgtgtgttccacacccctcaaaagaaacgaatcaagctcgagcgtgcaaaattactttcatctggattccctgcagaagaaactcaaagacctcgaagaggagaatgtcgtgctacgcagcgaggcgtctcagctcaagaccgaaaccataacatatgaggaaaaagagcagcagcttgtgaatgattgtgtcaaggaactgcgcgacgctaacgtgcaaattgccagcattagcgaggagttagctaagaagacggaagatgctgcacggcaacaggaggagataacccacctgctgtcgcaaattgtggatcttcaaaaaaaagccaaagcgtgtgccgtcgagaatgaggaattggtgcagcacctgggtgcagcaaaagacgcccagcgacaattgactgccgagctgcgcgagttggaggataagtatgctgagtgcatggagatgcttcacgaggcacaagaggaactcaaaaatttgagaaataagacaatgcctaatactacaagccgccgctaccacagcctagggctgttcccaatggactccctcgccgccgagatcgaggggactatgaggaaagagctccagctcgaagaagcagagtcacccgacatcacacatcagaagcgggtgtttgagaccgtgagaaacatcaatcaggttgtcaaacagcgttctctgacccccagcccaatgaacattccaggcagtaatcaaagctccgcaatgaattcattgttgtcgtcctgtgtttcaacccccagaagcagcttttacggatctgatattggaaacgtggttttagacaacaaaaccaacagcattatcctggagacagaggcagctgatctcggaaatgatgagcgatcgaagaagccaggtacaccaggcactccagggtcccacgacctggaaactgctcttcggcgtctgagcctgcgccgagagaattacctcagcgagcgaaggtttttcgaagaggagcaggagcggaaactgcaggagttagcagagaagggtgagttgcgcagcggctccctcactccaactgagtccataatgtcccttggaacgcacagcagattttcagagtttacaggcttttctggaatgtctttcagctctcggagctatcttcctgaaaagcttcagattgtgaaaccgcttgaagggtcagcgacattacatcactggcaacagctcgcccagccacacctcggcggcatcctggacccgagacctggagttgttaccaagggctttaggactctagacgtcgacctggacgaggtatattgcctgaatgacttcgaggaagatgacaccggggatcatatttcgctgcctcgactggctacaagcacacctgtccaacaccccgaaactagcgcacaccaccccgggaaatgtatgtctcagactaactccacatttacattcactacctgtcgtattctccatcctagtgatgagctgactagagtcactccatcattaaatagcgcacccacgccagcatgcggcagtacatctcatctgaaatctaccccagtggctacaccgtgcaccccacgacgcttgagtctggccgagtcctttacaaacacccgcgaatccacaactaccatgagcacatcgctgggtttagtctggctcctgaaagagaggggcatctctgcggccgtctacgacccccagtcatgggaccgggctggcagaggcagtctcttacattcttacacaccaaagatggccgtcattccatctaccccaccaaacagcccaatgcaaaccccgaccagtagtccacccagtttcgagttcaaatgtacttcgcccccatacgacaatttcctagcgtccaagccggccagctccattctgagagaggtccgtgagaagaacgtccgaagcagcgaaagccagaccgatgtgtccgtttccaaccttaacctcgtagacaaggtacggcggtttggcgtggccaaggtagtgaattcaggacgagcccacgttcccacacttactgaagagcagggaccgttgttatgtgggcctcccgggccggctccagctcttgtgcctcgagggctggttcctgaaggcttaccgctgcgctgccctacagtgacaagcgcaatcggcggcctccagctgaatagtggtatcaggcgtaaccgatccttccccaccatggtgggatctagtatgcaaatgaaggctcccgtgactctgaccagcggaattctgatgggagccaagctgagcaagcagacgagtttgcgatag

SEQ ID NO: 208914 - DNA, 2361 bp, Artificial Sequence
  Description of Artificial Sequence: Synthetic coding sequence
atggccctggtgttccagttcggccagcccgtgcgggcccagcccctgcccggactttgtcacggaaaactcatccgcaccaacgcatgtgatgtgtgcaactccactgatctaccggaggtggaaattatttccctgttagaagaacaattgccccattataagctgcgggctgataccatatacgggtatgaccatgatgactggctgcacacaccgctgatcagtcctgatgctaacatagaccttacgactgagcagatcgaagaaactctaaagtattttctcctgtgcgccgaaagggtcggacaaatgacgaagacctacaacgacattgacgcagttacacggttgcttgaagaaaaggagcgagacctggaacttgcggcccgcataggacaaagtctactgaagaagaacaagaccctgactgagcgtaatgaactgctggaagagcaagtcgaacacataagagaggaggtcagtcagctgcggcatgaattgtcaatgaaggacgagctgcttcagttctatacctctgccgctgaggagagcgagccagaaagcgtgtgttccacacctttgaagcgcaatgagtcctcttcatctgtgcaaaactatttccatcttgattcacttcagaaaaagctcaaggacctcgaagaggaaaacgtggtacttaggagtgaagccagtcagctgaagaccgaaaccatcacatacgaagaaaaagagcagcagctcgtcaatgactgtgtgaaggaactcagggacgccaatgtgcagatcgcatctatttcggaggaactggcaaagaagacagaagatgctgcccgtcagcaggaggaaatcacgcatttgttaagtcaaatcgtggacctacaaaaaaaagctaaggcatgtgcagtggaaaatgaagaattagttcagcatctgggtgcggccaaggacgcacagcgccaactgaccgccgaactacgtgaactcgaggataaatacgctgagtgcatggagatgttacacgaggcccaggaggagttgaaaaacctgcgcaataagacaatgccaaacacgacttctcgccgataccactctctgggcttgttccccatggactctctcgccgccgaaatcgaaggaaccatgagaaaagagctgcagctagaggaggccgaatccccagacatcacgcaccaaaagcgagtattcgagacagtccggaacattaatcaggtggtgaagcagcgttctttgaccccctccccaatgaatattcctggctctaaccagtcctccgcaatgaactcgttactgtcctcatgtgtatccacccctcgatccagcttctacgggtccgacataggcaacgtcgtcctcgacaacaagactaactctattatcctggaaactgaggctgcagatctgggtaatgatgagagaagtaagaagccagggacccccggaacgcccggcagccacgatctcgagactgccttgaggcgactgagcctaaggcgggaaaactacttaagcgaaagaagattttttgaggaggaacaagagagaaaactgcaggagctggctgaaaagggcgagctgaggagcggctccttgacgccgactgagtccatcatgtcacttggtacacattcccggttttcggagttcaccggcttctctgggatgtctttttcctcacggtcctatttgccagagaaactacagatcgttaaacccctggaaggaagtgcaaccctgcaccattggcagcagctggctcagccccacttagggggcatcttagatcctaggcccggtgtggttaccaagggattcagaaccctcgatgtggatctcgatgaggtctactgtctgaatgactttgaggaagatgacacagcacaccatcccgggaaatgtatgtcacagacgaactcaacatttacgtttaccacctgtaggatcctgcacccctctgatgagcttacaagagtgacgcctagcctgaattctgccccaacaccagcctgcggttctactagccatttaaaatcaacccctgtcgcaacaccatgcacccctagaaggctgagcctagccgagtcctttacgaatactagggaatccaccactactatgtctacatctctaggcctggtatggctcctcaaggaacgagggatctctgccgctgtgtatgacccacagtcctgggacagagctgggcgcggctcactgttgcatagtcatgaagatgtgacatgcgcaaatcttggcgagggaggcgtcctcagtagctttctcctgaggtcaacagagaccccgaagtgtgtgttaataccctggatcgggaatcagtag

SEQ ID NO: 208915 - DNA, 2745 bp, Artificial Sequence
  Description of Artificial Sequence: Synthetic coding sequence
atgagccagagccagaacgccatcttcaccagccccaccggcgaggagaacctcatgaactccaaccaccgcgacagtgagagtattacggatgtatgctcaaacgaggacttaccagaagtggagctcgtctcgttactggaggaacagctgcctcagtacaggctaaaagtcgacaccctgttcctctatgagaatcaggattggacacagtcccctcatcagcggcagcatgcctccgacgcactttcccccgtgctggctgaggaaacctttaggtacatgatcctgggtactgacagggtggagcagatgacaaaaacttacaacgacatcgacatggtgacgcacctcttggccgagcgtgatcgtgatctggagctggctgctcggattggccaggctctgctaaagcgtaaccacgtccttagcgaacagaacgagtccctggaagagcagttagggcaggcgttcgaccaggtcaatcaattacaacatgaactgtgtaaaaaggacgaactcttaaggattgtctctatagcctcagaggaatccgaaacagatagtagttgttccacaccgctccgtttcaacgaatccttttctctttcacaaggactgctgcagcttgagatgttgcaggaaaagctaaaggagctggaagaggaaaacatggccctgaggtccaaagcctgccatatcaaaacagaaactgtgacctacgaggaaaaagagcaacaattagtttccgactgtgtgaaggaactgagagagacaaacgcccagatgtcacgcatgacagaggagctcagcggcaagagcgacgaactcatccggtaccaggaagaactgagcagtctgctgtcacagatcgtcgatttgcagcacaaactcaaggagcacgtgattgaaaaggaggaattaaagttacacctgcaggcatccaaggacgcacagcgccaactcacaatggagttacatgagctccaggatcgcaatatggaatgcttagggatgcttcatgagtcacaggaggaaataaaggagcttcggtcccgatctggtcctactgctcacctgtattttagtcagtcatacggagcatttacaggtgaaagcttggctgcagagatagagggaaccatgaggaagaagttgtcccttgacgaggaatcctccctgtttaaacaaaaagcccagcagaaacgagtgttcgacaccgtcagaatcgccaacgataccagagggcgctctatcagttttcccgcactacttccaatacctggatcaaacagatcgtctgtgattatgacggccaagccgtttgaaagcggtttgcagcaaactgaggataagagcttgctgaatcagggtagctcttctgaggaggtggctgggtcgagccaaaaaatgggacagcctggcccttccggtgacagtgatttggcgaccgctttgcacagactcagcctcaggcgacagaactacctctcggagaaacagttttttgcggaggagtggcagcgaaaaattcaagttctggccgatcagaaggagggcgtgtccggatgtgtcacgcccaccgaatcacttgcaagtctctgtacaacccagtccgagatcaccgacctgtcgtctgccagttgcctccgaggcttcatgccagagaagctgcaaattgtcaagcccctggaggggtctcagaccctataccactggcagcagttggcccaaccgaatcttggcacaattctcgacccccggccgggcgtgattacaaaaggattcacccaactaccgggggacgccatctatcatatcagtgacctcgaggaagacgaagaggaaggcattacgttccaggttcagcagcctctggaggtggaggaaaaattgagtacatctaagcccgtcactgggatatttctgcctccgatcactagtgccggcggccccgtcactgttgccacggccaaccccggaaagtgtttgagctgtactaacagtacatttacatttactacatgccgcatccttcacccgagcgacatcacccaagtaacacccagctcgggatttccgagcctgtcctgcggaagcagtggaagttcctcctcaaacaccgccgtcaattctcccgcactcagttatcgcctctcgattggagagtctatcacaaaccggcgcgatagcactaccacgtttagctcaactatgagtcttgctaagctgctccaggagcggggcatcagtgccaaagtgtaccatagtcccatttcggagaacccattgcagcccctccccaaaagccttgctattcccagtaccccaccaaactcaccctcgcattcgccttgtccttctcctctccccttcgagccacgagtgcacctttccgaaaatttcctggcctcgcgccccgccgagactttcttacaggagatgtacggcctgagaccgtcgaggaaccccccagacgtcgggcagcttaagatgaacctggtagacagactgaaacggctgggcatcgcccgcgtcgtgaaaaatccgggtgcccaggaaaatggaaggtgtcaggaggccgaaattgggccgcagaaacccgattcagccgtgtatttaaactccgggagctctctgctggggggactgcggagaaaccagtcattacccgtaatcatggggtcattcgcagcccctgtgtgcacctcgtcacctaagatgggcgtgttaaaagaagattag

SEQ ID NO: 208916 - DNA, 936 bp, Artificial Sequence
  Description of Artificial Sequence: Synthetic coding sequence
atgagccagagccagaacgccatcttcaccagccccaccggcgaggagaatcttatgaattccaaccatcgtgactctgagtctatcacagacgtttgcagtaatgaggacctgcccgaggtagaactggtgtctctgctggaagagcagcttcctcagtataggctgaaggttgatacattgttcctgtacgagaaccaagactggacccagtctcctcatcaacgacaacatgcttcggacgcgctcagccccgttctggcagaggagacttttaggtacatgatactaggcaccgatagggtggagcagatgacgaagacctacaatgacatcgacatggtgacacatctgctcgccgaaagagatagggatctcgagttggccgcacggatcggccaagcgctgttaaagcgcaatcacgtgctgtcagaacaaaacgagagcctggaggagcagttaggccaagcatttgatcaggttaatcagctgcaacacgaactgtgcaagaaggacgaactcctgagaatagtgagtattgcaagtgaagagtccgaaacagatagctcctgctcaacaccgcttagattcaatgagagcttcagcctttcacaagggctgctgcagctggagatgctccaagagaagctgaaggagctagaagaagaaaacatggccttgaggtcaaaagcctgccatataaagaccgagaccgttacatacgaagagaaagaacagcagctggtcagcgattgcgtgaaagagctccgagagaccaacgcgcaaatgagtcggatgaccgaggagctgtctgggaagagtgatgaactcattagataccaggaagagctgtcttcgttgctgagccagatcgttgacctccaacacaaactgaaagaagttggactcttcatacattcgaccgacatctgttag

SEQ ID NO: 208917 - DNA, 93 bp, Artificial Sequence
  Description of Artificial Sequence: Synthetic coding sequence
atgagccagagccagaacgccatcttcaccagccccaccggcgaggagaatctgatgaatagcaaccatcgcgactcagagtctattacatag

SEQ ID NO: 208918 - DNA, 2340 bp, Artificial Sequence
  Description of Artificial Sequence: Synthetic coding sequence
atgatcctgggcaccgaccgggtggagcagatgaccaagacctacaatgatatagacatggtgacacatctgttggctgaacgtgatagagaccttgaactggctgcccgcattggacaggccctattgaagcggaaccacgttctaagtgaacaaaatgagtcgcttgaggaacagctaggtcaggccttcgaccaagtgaaccagctgcagcacgaactctgtaaaaaggacgagctgctgagaatcgtgtccattgccagcgaggaatcagaaaccgacagctcctgctccacaccactgcgcttcaacgaaagcttttccctcagccagggcctgcttcagttggaaatgttgcaggaaaaactaaaagaactggaggaagagaacatggctcttagaagcaaggcatgccatattaaaacggaaaccgtaacctacgaagaaaaggagcagcagttagtctcagactgtgtcaaggagcttagagagaccaacgcccagatgtcaagaatgacagaggagctgtccgggaagagcgacgaactcatcagatatcaagaagaattgagcagcctcctgtctcagattgtcgatctacaacacaaactgaaggagcacgtgatcgagaaggaggaacttaagctgcatctccaagcaagcaaagacgcccagcggcagttgactatggagctgcatgagctccaggaccgcaacatggaatgcctaggaatgttacatgaaagccaggaggagatcaaagaactgcgttctcgctcgggccctactgctcacctgtacttttcacaaagttatggcgctttcactggcgaaagccttgctgccgaaatcgagggcactatgagaaaaaaactgagtctggacgaggaaagtagccttttcaaacagaaagctcaacagaagcgcgtgttcgatactgtgcgcatcgccaatgatactaggggtcgatccatctccttccccgctctgcttccgattccgggatcaaatcgcagttcagttatcatgacagcaaagcccttcgaaagcggtcttcagcagacagaggataagtctttgctaaatcaggggtcatcaagcgaggaagtagcaggatcgagtcaaaagatgggccaacccgggccatctggtgactccgatcttgccacagcgttgcatcgcctgagtttaaggaggcagaactacctgagtgaaaagcagttcttcgccgaagaatggcagagaaaaattcaggtactggccgaccagaaagagggtgtcagcggctgtgtcacccctaccgaaagcctggcttcactatgcacgacacagtctgaaattactgacctctcatccgcctcgtgcctccgaggcttcatgcctgaaaaactccagattgtcaaacctttagagggttcacaaaccttgtaccactggcagcagttggcacagcctaacttggggacaattctggacccacggcccggcgtcatcactaaaggcttcacacagttacccggtgacgcaatttaccatatcagcgatctggaagaagatgaagaggagggtattaccttccaagttcaacagcctttagaggtagaggaaaaactgagcacgtctaaacccgtcactggcatcttcctgccgcccatcacaagcgcggggggcccagtgacagtggcgaccgccaatcctgggaagtgcttgtcttgtacgaattccacattcacttttacgacatgtcgaatcttacatccaagcgatatcactcaggtgacaccctctagcgggttccctagcctgtcctgtgggagcagcgggtcttcaagttctaatactgcagttaactcacccgcattgagctatcgcctcagcatcggtgaatctattaccaatcggagggacagcacaaccacattcagttctaccatgtcgctggccaagttgctgcaggagagagggatatctgccaaggtgtatcacagccctattagcgagaatccactccaaccgctgcccaaatccctcgccatccccagcacaccacctaacagtccttcccatagcccctgtccgagccccctgccctttgagccacgcgtccacctttctgaaaattttctggcctctcgtcctgcggaaacttttctgcaggagatgtacgggttgcgtccctcccgaaatccgcctgatgtgggtcagctgaaaatgaatctggttgatcgattgaagagactggggatagctagagtcgtgaagaacccagtcccaaaaagaatggaagacgcacggcgacaaaagcttgtgctgaagaaccaaattctgctttttatctag

SEQ ID NO: 208919 - DNA, 486 bp, Artificial Sequence
  Description of Artificial Sequence: Synthetic coding sequence
atggagaagcccctgaccgtgctgcgggtgagcctgtaccaccccactcttggtccgagcgcctttgccaatgtgccaccccggctgcagcacgacacctctcccctgcttctgggccgggggcaggacgcccacctgcagctgcagttgccgcgcttgtccagaagacacctctcgctggagccctatctggaaaagggctcagcccttctggccttttgtctgaaagctctctccaggaaaggctgcgtttgggtgaatgggcttaccctgcgctatctggagcaggtacctctgtccaccgtgaatcgcgtatcattcagtggaatacagatgttagtgcgagtggaagaaggcacgagcctcgaagcctttgtgtgttacttccacgtttctccatctcctctcatctataggcccgaggccgaggaaacggacgagtgggagggtatctcccaggggcagccaccgccaggctccggatag

SEQ ID NO: 208920 - DNA, 1749 bp, Artificial Sequence
  Description of Artificial Sequence: Synthetic coding sequence
atggccgagttcctggacgaccaggagacccggctgtgcgacaactgcaaaaaggaaatccccgtgttcaactttacaatccacgaaatacattgtcagcgcaacatcgggatgtgtcccacatgtaaggagccgtttcccaagtcagatatggaaacacatatggccgcggagcactgccaagtgacctgtaaatgtaacaagaagctggagaaaaggctattgaagaaacacgaagagaccgaatgccccctccggctcgcagtatgccagcattgcgacttagaattaagcattctgaagctgaaagagcatgaagactactgtggagcaaggacagagctgtgtggaaactgcgggaggaacgttcttgtgaaggacttaaagactcatcccgaagtatgtggacgcgaaggcgaggagaaacgaaacgaagtggccatacctccaaatgcgtatgatgaatcctggggacaggatggaatttggatcgctagtcagctgctgcggcagatcgaggcattggatcctcccatgcgactgcctcgacgcccactaagagcatttgagagtgatgtgttccacaataggaccaccaatcagcgcaatatcactgcccaagtctccattcagaacaacctgtttgaagaacaggagcggcaggaaaggaaccggggccagcagcctcccaaggaagggggggaagaatctgcaaatctggacttcatgctggctctcagcctgcagaacgagggccaggctagctccgtcgccgaacaggatttttggcgcgccgtgtgcgaggctgatcagtctcacggtgggcctagatctctctccgacatcaagggagcggctgatgagatcatgctgccgtgcgagttctgcgaagaactgtacccggaggaactgctgatcgaccaccagaccagttgcaacccaagcagggctctcccgtcgctcaacactggcagcagttcccctaggggggtggaggagccggatgtgattttccaaaacttccttcagcaggcagctagtaatcagttagatagtctgatggggcttagcaattcacatccagtggaggaatcaatcattataccttgcgaattttgtggcgtccaactggaggaagaggtcctgttccaccaccaggatcaatgtgaccagcggcccgctacggccactaatcatgtgactgaggggatccctagacttgattctcaaccacaggaaacttccccagagcttccaagaagacgcgtccgacatcaaggcgacctgagctccggctacctcgacgacaccaagcaggagaccgctaatgggcctacatcttgcctgcctccctcccgccccatcaacaacatgaccgccacttacaatcaactcagtcggtccacttccggcccgagaccaggatgtcagccttcctccccatgcgttccaaagctgtcgaattctgattcccaggacatccaaggccgtaacagagactctcagaacggcgccatcgcccctggacatgtttctgtgatccgtccaccccagaatctgtatcctgaaaatatagtaccctcctttagccccggccccagcgggaggtacggtgcttccgggcgaagtgaaggcggccggaacagccgggtgacaccggccgcagcgaattataggagccgtaccgctaaggccaaacctagcaaacaacagggagccggcgacgccgaggaagaagaagaagagtag

SEQ ID NO: 208921 - DNA, 1749 bp, Artificial Sequence
  Description of Artificial Sequence: Synthetic coding sequence
atggccgagttcctggacgaccaggagacccggctgtgcgacaactgtaagaaagaaattcccgtcttcaactttacaatccacgagatacactgtcagagaaatattggtatgtgcccaacctgcaaagagccatttcccaaatccgatatggagacacacatggccgccgagcattgccaggttacctgtaaatgtaacaagaaacttgagaagagacttcttaaaaaacatgaggagacagagtgccccctgagactcgccgtgtgtcaacattgcgatctcgagctttcaattctgaagttgaaggaacatgaagactactgtggcgcacggaccgaattgtgtggaaactgtggacgtaatgtactggtcaaggacctgaaaacccatcctgaggtgtgtggcagagagggggaggaaaaaagaaatgaagtggccatccctcctaatgcctacgacgaaagttggggacaggacggtatctggatagccagtcagctgctgcgacagatcgaagctctagatcctcccatgcggctgcctcggcggcccctaagggcatttgagagcgatgtgttccacaatagaacaaccaaccagagaaacatcaccgctcaggtgagcatacagaacaatctgttcgaggagcaagaaaggcaagagcgcaacaggggccagcagcctcccaaggaaggtggtgaggagtcagccaacttagactttatgttagccctatctctccagaacgaggggcaagctagtagtgtcgccgagcaagatttctggcgggccgtgtgcgaggccgaccagtctcacgggggacctaggtctctgagcgacatcaaaggcgctgcagacgaaattatgctgccatgcgagttctgcgaagaactctaccccgaggagctgctcatcgaccaccagacaagttgtaatccctcaagggcacttccttctctcaatacaggctctagtagcccaaggggggtggaggagccagacgttatcttccagaacttcctgcaacaggctgcgtctaatcagctagacagtctgatggggctgagcaacagtcatcccgtggaggagagcatcatcattccctgtgaattctgtggcgtgcaacttgaggaagaggtcctgttccatcaccaagatcaatgcgatcagagaccagccactgctacgaaccacgtgacagaaggtatccctagacttgactctcagccacaggagacttccccggaactgcctcggaggcgcgtaagacaccaaggcgatttgtcaagtggctacctagacgacaccaagcaggaaacagctaacgggccaactagctgcctgcccccctctaggccgattaacaatatgaccgctacgtataatcagctctcacgcagtacttcgggccctcgacctggatgtcaaccttcttccccgtgcgtccctaaactatccaactccgattcgcaggatattcagggccggaaccgggacagtcagaatggagcaatcgcacccggccatgtgtcggtgatccgacctccacaaaatctgtatccagagaacatcgtgccatcctttagccccggacccagtggaagatatggcgcttccgggcggtccgaggggggaagaaatagcagggtcacccccgccgctgccaactaccgatccagaacagcaaaggccaagccctccaagcagcagggggccggtgatgcagaggaggaggaagaggaatag

SEQ ID NO: 208922 - DNA, 408 bp, Artificial Sequence
  Description of Artificial Sequence: Synthetic coding sequence
atggccgagttcctggacgaccaggagacccggctgtgcgacaactgcaagaaagaaatccccgtctttaacttcactatccacgagatacactgtcaacggaacattgggatgtgcccaacatgtaaagaaccatttccaaagagtgacatggagacacacatggcagctgagcactgtcaggttacgtgcaagtgtaacaaaaagcttgaaaagcggctgctcaaaaaacatgaggagaccgaatgtcccctccgcctcgcagtatgccagcactgcgatcttgaactcagcatcctgaagctcaaggagcatgaggattattgtggcgccaggaccgagttatgcggaaactgcggcaggaacgtccttgtaaaggacctcaagactcaccccgaggtgtgctag

SEQ ID NO: 208923 - DNA, 495 bp, Artificial Sequence
  Description of Artificial Sequence: Synthetic coding sequence
atggccgagttcctggacgaccaggagacccggctgtgcgacaactgtaaaaaggaaatcccagtgttcaactttaccatccacgagattcactgccagagaaacattggaatgtgtcccacatgtaaggaaccctttcccaaatcagatatggagactcatatggccgctgaacattgtcaggtcacatgtaaatgcaataaaaagttggagaagcgacttttgaagaagcacgaagagaccgagtgtcctctaaggctggcagtatgtcaacattgtgacttggagctctctatcctcaagctgaaagaacatgaagactactgcggagcaagaacagagctgtgcggcaactgtggcagaaacgtactggtgaaagatttaaagacccatccggagctgaaaaataaacgcgggaggaagggaatcgaagccaactcacctcctaagcgcgtggtcaagcgcgtgcagacctggacctcctgctggccctag

SEQ ID NO: 208924 - DNA, 852 bp, Artificial Sequence
  Description of Artificial Sequence: Synthetic coding sequence
atggccgagttcctggacgaccaggagacccggctgtgcgacaactgtaagaaggaaatacccgtgttcaactttaccatacacgaaattcactgccagcgaaatatcgggatgtgccctacatgcaaggaaccattcccgaaatcagacatggaaacccatatggcagcagaacactgccaggtaacctgcaaatgtaacaagaaactggagaagagacttctgaaaaaacatgaagaaaccgagtgtccccttaggctggccgtctgccagcattgcgaccttgaactcagtatcctgaagctgaaggagcatgaggattactgcggggcccgtactgagctctgcgggaactgtggacggaacgtactcgtgaaggatctaaagacacatccggaggtttgtggccgggagggcgaggaaaaacgaaatgaggtcgccattcctcctaatgcatacgatgagtcctggggacaggacggcatttggattgctagtcagcttctgcgccagattgaggccctggacccgccaatgagattacccaggcgacctctccgcgccttcgagtccgatgtgttccacaatcgcacgaccaaccaaagaaacattaccgctcaggtctcaatccagaacaatctgtttgaggagcaggagcggcaggaaaggaacaggggccagcaaccccccaaagaaggcggggaagagtcggcaaatctagattttatgttagcgctgagccttcagaatgaggggcaggcttcctccgtggcggagcaggacttctggagagccgtgtgtgaggctgaccagtcacacggtggcccaagaagcctcagcgacatcaagtag

SEQ ID NO: 208925 - DNA, 414 bp, Artificial Sequence
  Description of Artificial Sequence: Synthetic coding sequence
atgggcgcccacctggtgcggcggtacctgggcgacgccagcgtggagcctgatcccctgcaaatgcctacatttcctcccgactatgggttccctgagcgcaaagaacgtgagatggtcgccactcagcaggaaatgatggatgcccaacttcggctccaattacgggattattgcgcccaccacttgattcgtctgctcaaatgcaagcgcgactccttccccaatttcctagcttgtaaacaggaacgacacgactgggattactgcgagcatcgcgactacgtaatgcgcatgaaagagttcgagcgcgaaaggagacttctgcagcgaaaaaaacgcagggagaaaaaagcagccgagctagctaagggccaggggccgggggaagtggaccccaaagtcgcgctttag

SEQ ID NO: 208926 - DNA, 972 bp, Artificial Sequence
  Description of Artificial Sequence: Synthetic coding sequence
atgatcctgcaggagaccaaggccgcctgcggcatccccgccatcccacattgttcccgggtggagatcctggatgctaagaccagggagaaattgtgctttctggacaaagtggagccgcacgcaactatcgctgaaattaagaacctattcacaaaaacacacccacagtggtaccccgccagacaaagcctgagattggaccccaaaggcaaaagcttgaaagacgaggacgttctgcagaaactccccgtcggcactaccgcaacactatacttccgcgatctgggggcccagataagttgggttacagtctttctaaccgagtacgcgggccctctctttatttatctgctcttctatttcagagtgcctttcatttatggacacaaatacgacttcacctcaagtaggcatacagtggtgcacctggcctgtatctgccactcctttcattacattaagaggctgctggaaacgctgtttgtgcaccggttctcccacggtacgatgcccttacgcaacatcttcaagaactgtacatattactggggcttcgcagcatggatggcctactacatcaatcaccccctttatacccctcctacttacggcgcccagcaggtaaagctcgctctggcaatttttgtcatttgccagttaggcaactttagcatccatatggccctgagagacctacgccctgccggcagcaaaacaagaaagatcccataccctacgaagaaccctttcacctggctcttcctgctagtcagttgccctaactacacctatgaagtaggttcatggattggcttcgctatcatgacccagtgcctaccagtggccttgttttctctggttggcttcacccaaatgacgatctgggccaagggcaagcatagaagctacctgaaagagttccgcgactatccaccactcagaatgcctatcattccttttttactctag

SEQ ID NO: 208927 - DNA, 1014 bp, Artificial Sequence
  Description of Artificial Sequence: Synthetic coding sequence
atgagcagcagccccgtgaagcggcagcggatggagagcgccctggaccagttaaagcaattcaccactgtcgtggctgataccggggatttccacgcaatcgacgagtataaaccgcaggacgctaccacaaaccctagcttgatcctcgccgccgctcagatgcctgcatatcaagagctggtggaggaggctatcgcatatggacgaaaactggggggcagccaggaggaccagataaaaaacgccattgataagctgtttgttttatttggagctgagatcctcaaaaagatcccaggtcgggtctctaccgaggtggatgcccggctcagtttcgacaaagacgccatggtcgcacgtgcccgcagactgattgaactgtacaaagaagctggaattagtaaagatcgcattctgataaaattgagttcaacctgggaaggcattcaggcgggtaaggagcttgaagaacagcacgggattcattgcaacatgacactcctgtttagcttcgcccaggccgtggcgtgtgcagaggccggggtcaccctgatctcaccattcgtgggaagaattttggattggcacgttgcgaatacagataagaagtcttacgagccactggaggatccgggtgttaagagcgtcacaaaaatctacaactactacaagaaatttagttataagaccattgtaatgggcgcatccttcaggaacacaggagaaatcaaagccctcgccggctgcgatttccttacaattagccccaagttactgggagaactcctgcaggacaatgccaagcttgtgcccgtgctgagtgcaaaggccgctcaggccagtgacttggagaagattcacctggacgaaaagtcctttagatggctgcacaatgaagaccagatggcagttgagaagctcagcgacggcattcggaagtttgccgccgatgcagtgaaacttgaaaggatgctcaccgagagaatgttcaatgccgagaatgggaagtag

SEQ ID NO: 208928 - DNA, 957 bp, Artificial Sequence
  Description of Artificial Sequence: Synthetic coding sequence
atgagcagcagccccgtgaagcggcagcggatggagagcgccctggaccagctgaagcagtttaccacagtggtcgctgacacaggcgatttccacgcgatcgacgaatataagcctcaagacgcaacaacaaatcctagccttatattggccgcagcccagatgcccgcctatcaggagctggtagaagaagcaattgcctacggcagaaaactggggggcagtcaggaagaccagattaagaatgccatcgacaagctttttgtgctatttggcgcagagatattgaaaaagataccagggagagtgagtactgaggtggacgcacggttgagctttgataaggacgctatggtggcccgagcacggaggctgattgagctctacaaggaggctgggatctctaaggatcggatcctcattaagttgtcctcaacatgggaaggcattcaagctgggaaagagctggaagagcagcacgggattcattgcaatatgactcttcttttttctttcgcacaggccgtggcctgcgccgaggctggcgtgacccttatctccccattcgtcggccgaatcctcgattggcacgtggcaaatacagacaagaagtcatacgaacccctggaagatccgggagtgaaaagcgtgactaaaatttataattattataagaagttttcctataaaacaatcgtcatgggcgcctcctttaggaacacgggcgaaatcaaggccctggcaggctgcgatttcttaacaatctcacctaaactgctcggcgaacttctccaggacaatgcaaagctggtgccagttctttcagctaaaccgaagccagtgacttggaagaaatctacctggatgagatcattgagcgtaggttgtaccacacgcacgagatggttgtggcgctcttcgctgactggatccgcctccttaccattgatgcagtag

SEQ ID NO: 208929 - DNA, 1302 bp, Artificial Sequence
  Description of Artificial Sequence: Synthetic coding sequence
atgcggcagagccaccagctgcccctggtgggcctgctgctgttctccttcatcccttctcaactgtgcgaaatttgcgaggtgagcgaagagaactacatacgcctgaaacctcttctaaatactatgatccaaagtaactacaatcgtggcacgagcgcggtgaatgtggttctcagcctgaaactagtggggatacagattcaaaccctgatgcagaagatgattcagcagataaagtacaatgtgaagagcaggttgtccgatgtgtcgtcaggcgagctggccctgatcatacttgccctcggagtgtgccgaaatgccgaggagaacttgatctacgactaccacctgattgacaaacttgagaacaaatttcaagccgagattgaaaatatggaggcacacaacggaactcctctgaccaattattaccagctctcattggacgtgttagcactgtgcctgtttaatggtaactatagcactgccgaagtggtcaaccacttcacccccgaaaacaaaaattattattttggctcccagtttagcgtcgataccggcgccatggcggttctcgctctgacttgtgtgaaaaaaagcctaattaacgggcagatcaaggccgacgaaggtagtctgaaaaacattagcatttataccaaaagcctcgtcgagaaaattctgagtgaaaaaaaggaaaatgggctgatagggaacacgttctctactggagaagccatgcaggccctgtttgtatctagcgactactataacgaaaatgattggaactgccagcagacactgaataccgttttaactgaaatcagtcaaggcgcttttagcaacccaaacgccgccgcacaggtgctgcccgcgctgatgggaaagacttttttggacatcaataaagatagctcttgtgtgtcagcgagcggcaacttcaatatttctgccgatgagcccattaccgtgactcctcccgattcacaaagttatataagcgttaactatagcgtccggattaacgagacctatttcactaacgtcacagtgctcaatgggtccgtgttcctctccgtgatggaaaaggcccagaagatgaatgacactatcttcggctttaccatggaagaaagaagctggggaccctacatcacctgtatccaagggctgtgtgcaaataataacgaccgcacctactgggagctgttatccgggggtgaacccctcagtcagggagccgggtcatacgtggttcgtaatggcgaaaatctggaagtccggtggagcaagtattag

SEQ ID NO: 208930 - DNA, 1083 bp, Artificial Sequence
  Description of Artificial Sequence: Synthetic coding sequence
atggccgccgccgccgccgccggcgccggccccgagatggtgcgggggcaagtcttcgacgtcgggcctaggtacacaaacctgtcatacataggagaaggggcttatggaatggtgtgttctgcttatgacaatgtcaataaggtcagagtggccattaaaaaaatcagcccttttgagcatcagacttattgtcagcggacgctccgcgagattaagattctgctgcgttttagacatgagaacattatcgggatcaacgatatcatcagagcacccacaattgagcagatgaaggacgtatacattgtgcaggatttaatggagaccgacctgtacaaattgctgaagacccaacatttgtcaaacgaccacatctgctacttcctgtaccaaattcttcggggactgaaatatattcacagtgcaaacgtgctccaccgcgacttgaaaccatccaacctgctgctaaacacaacttgtgatcttaagatctgtgacttcggcttggctcgcgtagccgaccctgaccacgatcataccgggttcctgaccgagtatgtagccaccaggtggtacagggcacccgagattatgcttaattcgaagggttatacgaaaagcatcgacatatggtctgttggatgtattttggccgaaatgctcagcaaccggcccatcttcccagggaagcactacttggaccagttaaatcacatcctcgggatcttgggctccccttctcaggaagatctgaattgcattattaacctcaaagcaagaaattatctactgtctcttccacataaaaataaggtcccatggaacaggctcttcccgaacgccgacagcaaggccctcgatctgctcgataagatgcttacgtttaatccacataagagaattgaagtggagcaagctctggcacacccctatctggagcagtactacgacccctctgatgaacctatcgccgaagccccattcaaattcgatatggagctggatgacctccccaaggaaaagctcaaagaactaatctttgaagagaccgctcgcttccagcctggctacagatcatag

SEQ ID NO: 208931 - DNA, 1203 bp, Artificial Sequence
  Description of Artificial Sequence: Synthetic coding sequence
atgcggcacctgggcgccttcctgttcctgctgggcgtgctgggcgctttgaccgaaatgtgtgaaatcccggaaatggatagccacttagtggagaaattgggacagcaccttttgccatggatggaccggctctccctggaacacctcaatccctcgatatatgtaggccttcgcctctcaagtctgcaggctgggactaaagaggacctgtatctgcactccctaaaactgggctaccaacaatgcctattagggagcgctttttcagaggacgacggggactgtcaaggcaaaccttccatgggtcagcttgctctttacctgttggcgttgagggcaaattggcacgaccacaagggtcacccccatacaagctattaccagtacggccttggtatcttggccctgtgcctgcaccagaagcgagtgcacgactcagtggtggataagctcctgtatgctgtcgagccctttcatcaagggcatcactccgtagataccgccgctatggcaggactggccttcacgtgtctgaagagatccaattttaacccagggcgccggcagcggataaccatggccatacgcacagtgagagaagagatcctgaaagctcaaacccctgagggacatttcggaaatgtgtactctacaccattggcgctgcagttccttatgacatctcctatgcgcggggcagagctaggcacagcatgtctgaaagctagggtcgcccttctggcttcactacaggacggggcttttcagaatgcactcatgattagccagctcctgcccgtactgaatcataagacgtacattgacctgatcttcccagactgtctcgctcctcgggtgatgttggagccagctgcagaaactattccccagacacaggaaatcatctcagtaacgctgcaagtgctcagccttctgcctccctaccgccagagcatcagtgtgctggccggcagtaccgtcgaagacgtacttaaaaaggcccatgaactgggcgggttcacatatgagacacaagcatcactgagtgggccataccttactagtgttatgggaaaagcagctggggagcgcgaattttggcagctgctccgggaccccaacacgcccctgttacagggaatcgcggactaccgacccaaggatggagaaacaatcgaattacgactcgtctcctggtag

SEQ ID NO: 208932 - DNA, 843 bp, Artificial Sequence
  Description of Artificial Sequence: Synthetic coding sequence
atggaggacgaggtggtgcggttcgccaagaagatggacaagatggtgcagaagaagaacgcctctacccgcatcggcatgtcagtcaacgcgatcagaaagcagtcaactgatgaagaggtaacctcacttgccaaatcattgatcaaaagttggaagaagctcttggacggtccttctaccgagaaggatctggacgaaaaaaaaaaggaacctgcaatcaccagccagaatagccctgaagctagagaagagagtacaagctccgggaacgtcagcaacaggaaggacgaaactaacgccagagacacttacgtctcgtcctttccacgtgccccgagcaccagtgattctgtgcggctcaaatgtcgcgagatgctggcggctgcactcaggactggggatgattatatcgccattggggcggacgaagaggaactcggctctcagatcgaggaggcaatctaccaggagatacggaacacagatatgaagtataagaaccgggttcgtagcagaatctctaacctgaaggatgccaaaaatccaaacctcagaaagaacgtgctctgtggcaacatcccacccgaccttttcgcccgcatgacagcagaggaaatggcatcagacgagctcaaggagatgaggaagaacctgaccaaagaggcaatacgcgaacatcagatggctaaaacaggaggaacacaaacagatctgtttacatgtggtaagtgcaagaagaagaactgcacatatacacaggtccagacaaggtctgcagacgagcctatgactactttcgtagtctgcaatgaatgtgggaatcgctggaagttctgctag

SEQ ID NO: 208933 - DNA, 906 bp, Artificial Sequence
  Description of Artificial Sequence: Synthetic coding sequence
atggaggacgaggtggtgcggttcgccaagaagatggacaagatggttcagaagaagaacgccgccggtgctctggatctgctcaaggaactcaagaacataccgatgaccttggagctgctccagtcaacgcggatcgggatgagcgtgaatgcaatccgcaaacagtccaccgatgaggaggtgacttctctggccaagtctctcattaaatcatggaagaagctgctggacggtccaagcactgagaaggatctggacgaaaagaagaaagaacctgcaatcacttctcagaacagtcccgaagcgcgagaggagagtacttcaagcggcaacgtgagtaaccggaaggatgagaccaatgcccgcgatacttacgtgtcctccttcccccgagctccttcgactagtgactcagtaagactgaaatgcagagagatgctagccgcagccctccgtactggcgatgattatatcgcaatcggagccgatgaggaggaactggggtcacaaatcgaggaggcgatttaccaggaaatccgaaatactgacatgaagtacaagaaccgtgtgcgcagtagaatcagcaatttgaaggacgcgaagaaccccaacttgcgcaaaaatgttttatgtgggaacatccctcccgacctgttcgctaggatgacagcagaagagatggcaagtgatgagctaaaagaaatgcgaaagaatcttacaaaggaggcgatacgggagcatcagatggccaagactggggggacccagaccgacctgttcacctgtgggaaatgcaagaagaagaactgcacatatacgcaggtgcaaacccgctcagcagacgaacccatgaccacctttgtcgtgtgtaatgaatgcgggaatcggtggaaattctgctag

SEQ ID NO: 208934 - DNA, 354 bp, Artificial Sequence
  Description of Artificial Sequence: Synthetic coding sequence
atggaggacgaggtggtgcggttcgccaagaagatggacaagatggttcagaaaaaaaatgctgccggagctctcgatctgctcaaagagctgaaaaacatcccaatgaccctcgagctgcttcaggagatggcttccgatgagctgaaggagatgcgaaaaaaccttaccaaggaggccatacgggagcaccagatggccaagaccggggggactcagacagacctcttcacttgtggtaagtgcaagaagaaaaactgtacttatacacaggtacaaactagaagtgctgacgagcccatgacgacctttgtagtctgtaacgaatgcggaaataggtggaaattctgttag

SEQ ID NO: 208935 - DNA, 480 bp, Artificial Sequence
  Description of Artificial Sequence: Synthetic coding sequence
atggacaagccccggaaggagaacgaggaggagccccagagcgcccccaaaaccgatgaggagaggcccccagtggaacattcccctgaaaagcagtcccccgaagagcagtctagtgaagagcagagcagtgaggaagagttttttcccgaggaactcctgcccgaattactgccggaaatgctgctctccgaagagagacccccccaggaaggactgtctaggaaagacctgttcgaaggcagacctccaatggagcagcccccctgtggagttggtaaacataagctggaggagggttcttttaaggagaggcttgcccgcagccgcccccagtttcggggggacatccacgggcggaacctgagtaacgaggagatgatccaggcagctgatgagcttgaggaaatgaagagggtacggaataagttgatgatcatgcattggaaagctaagcggtcccgcccctatcctatttag

SEQ ID NO: 208936 - DNA, 480 bp, Artificial Sequence
  Description of Artificial Sequence: Synthetic coding sequence
atggacaagccccggaaggagaacgaggaggagccccagagcgcccccaagaccgatgaagagcgccctcccgtggagcactcaccggagaaacagagtccagaagagcaatcatcagaggagcagtcttccgaagaggaatttttcccggaagaactactcccggaactcttgcctgaaatgctcttgtccgaggaacgccctccccaggagggcctgtcccgcaaagatctcttcgaagggcgcccgcccatggaacagcctccctgtggggtcggaaagcacaaattagaggaaggttcctttaaggagcgcttagctcgtagtaggccccagttcagaggggatatccacgggcgaaacctcagtaacgaggaaatgatccaggctgccgacgagctcgaagaaatgaagcgcgtgaggaataagctgatgataatgcactggaaggccaaacgatctcgaccttatcccatctag

SEQ ID NO: 208937 - DNA, 480 bp, Artificial Sequence
  Description of Artificial Sequence: Synthetic coding sequence
atggacaagccccggaaggagaacgaggaggagccccagagcgcccccaaaaccgatgaggagcgccctcccgttgagcatagccccgagaaacagagcccagaagagcagagctctgaggagcaaagttccgaagaggaattctttcctgaagaacttctgcccgaactattgcccgagatgcttctgagcgaggagaggccaccccaggaaggtctgtcccgtaaggatttattcgaagggaggcctcccatggagcagccaccttgcggagttgggaagcacaagttggaggagggtagctttaaagaacggctggcacggtcccgcccccagttccgcggtgatatacacgggaggaatttaagtaatgaagaaatgatacaggcggcagatgagttagaagagatgaaaagggtgcgaaataagttaatgatcatgcactggaaggccaaacggtcacggccttaccctatttag

SEQ ID NO: 208938 - DNA, 471 bp, Artificial Sequence
  Description of Artificial Sequence: Synthetic coding sequence
atggacaagccccggaaggagaacgaggaggagccccagcggccccgaccaatgaggcggggactgaggtggtcaaccctccctaagagcagccctcctcgctcctctctgcgccgcagttcaccccgccggcgcagttcattcctgaggtcatcctgcttgtctagttgtttgagatgctcatcccggagaagcccacaggaggggctgagcagaaaagatttgttcgaggggaggcccccaatggagcaaccaccttgtggggtgggaaagcataaactagaggaggggtcctttaaggagcgcctcgcaaggtcaagacctcagtttagaggcgacattcatggccgaaacctgtctaacgaagaaatgatccaggctgccgatgaactcgaggaaatgaagcgggtgaggaacaaattgatgattatgcactggaaagctaagaggtccaggccataccctatatag

SEQ ID NO: 208939 - DNA, 303 bp, Artificial Sequence
  Description of Artificial Sequence: Synthetic coding sequence
atgcagaagccctgcaaggagaacgagggcaagcccaagtgcagcgtgcccaaacgggaggaaaaacggccatacggcgagttcgaaaggcagcagacagagggcaatttcagacaacgcctgctccagtcactggaagagttcaaggaagacattgactacagacatttcaaagatgaagagatgacacgggagggagacgaaatggagcgttgtctggaggagatcagaggcttacgcaagaaatttcgggccctccattccaaccatcgccattctagagacagaccttaccctatctag

SEQ ID NO: 208940 - DNA, 303 bp, Artificial Sequence
  Description of Artificial Sequence: Synthetic coding sequence
atgcagaagccctgcaaggagaacgagggcaagcccaagtgcagcgtgcccaagagggaagagaagaggccatatggcgagtttgagaggcagcagactgaaggaaatttccgacagcggcttctgcagtcccttgaagagtttaaagaagacatcgattataggcactttaaggatgaagaaatgacccgtgagggtgatgagatggaacgctgcctagaagagataagagggttgaggaaaaagtttcgcgcccttcactctaaccaccgccatagtagagacaggccgtaccccatctag

SEQ ID NO: 208941 - DNA, 291 bp, Artificial Sequence
  Description of Artificial Sequence: Synthetic coding sequence
atgtacgtgaagctgatcagcagcgacggccacgagttcatcgtgaaaagagagcacgcccttaccagtgggactatcaaggcaatgttgtcgggtccaggacagttcgccgaaaatgagaccaacgaggtgaatttcagagaaatacctagccacgtgctcagtaaagtgtgtatgtatttcacttacaaagtcagatacactaattcttccacagagataccggaatttccgatagctccagagattgcacttgagctgcttatggcggccaacttcctggactgttag

SEQ ID NO: 208942 - DNA, 339 bp, Artificial Sequence
  Description of Artificial Sequence: Synthetic coding sequence
atggacggcgaggagaagacctacggcggctgcgagggccccgacgctatgtacgtgaagttgattagctcagacggtcatgaatttattgtgaaacgcgagcacgcccttacatctgggaccatcaaagcgatgcttagcggaccaggccagtttgctgaaaacgagacaaatgaagtaaattttcgagagatcccatctcatgtattatctaaggtatgcatgtactttacttacaaggtccgatatacaaattcaagcactgaaatccccgagtttcccatcgctcccgagatcgcgctcgagctcctcatggctgccaactttctggattgttag

SEQ ID NO: 208943 - DNA, 339 bp, Artificial Sequence
  Description of Artificial Sequence: Synthetic coding sequence
atggacggcgaggagaagacctacggcggctgcgagggccccgacgctatgtatgtgaagctgatcagcagtgacggacacgagtttattgtgaaacgagaacacgcactaacgtctggaacaatcaaggcaatgttatctgggccaggacaattcgcagaaaatgagactaatgaagtcaattttcgggaaatcccttcccacgtgctatcaaaggtgtgtatgtattttacatacaaggtgaggtacaccaattcctcaactgagatcccagagttccctatagcaccggagattgctttggagctgctgatggccgctaattttctggactgctag

SEQ ID NO: 208944 - DNA, 339 bp, Artificial Sequence
  Description of Artificial Sequence: Synthetic coding sequence
atggacggcgaggagaagacctacggcggctgcgagggccccgacgctatgtacgtgaagttgatcagcagtgatggtcatgagttcattgtgaaaagggaacatgcgctgacttcaggtacaattaaggctatgctcagtggcccaggacagttcgcagaaaacgagacgaacgaagtgaactttcgggagattccaagccacgtccttagcaaggtctgcatgtattttacctataaggtccggtatacgaatagctccactgagatccctgaatttcccatcgctcctgagattgccttagaactgcttatggctgctaattttctggattgctag

SEQ ID NO: 208945 - DNA, 339 bp, Artificial Sequence
  Description of Artificial Sequence: Synthetic coding sequence
atggacggcgaggagaagacctacggcggctgcgagggccccgacgccatgtatgtgaaacttatttcctcagatgggcacgaatttattgtaaagcgtgagcatgcactcaccagtgggacaattaaggccatgctgtccgggccaggacaatttgcagagaacgaaacaaacgaggtgaacttccgcgaaataccatcacacgtgctatctaaggtgtgcatgtacttcacttacaaagtcaggtacacaaatagctcgaccgagattcccgaattcccgatcgcaccagagattgccctggaattactgatggccgctaacttcctcgattgctag

SEQ ID NO: 208946 - DNA, 339 bp, Artificial Sequence
  Description of Artificial Sequence: Synthetic coding sequence
atggacggcgaggagaagacctacggcggctgcgagggccccgacgctatgtatgtcaagctcatttcctccgacggacacgaattcattgttaagagagaacacgcactgacctctggcacgattaaagcaatgctttctgggcccggccagtttgcagagaatgaaacaaatgaggtgaatttcagagagatcccttcgcacgtactgtcaaaagtttgcatgtacttcacctataaggtgaggtatactaactcttcaaccgagatacccgaatttcctattgccccagagatcgcattggagttactgatggccgccaactttctagattgctag

SEQ ID NO: 208947 - DNA, 339 bp, Artificial Sequence
  Description of Artificial Sequence: Synthetic coding sequence
atggacggcgaggagaagacctacggcggctgcgagggccccgacgcaatgtacgtgaaactcatatcctccgacgggcatgagtttattgtgaagcgtgagcatgcgttaactagtggtacgattaaagcaatgctctcggggcctggacagttcgctgaaaacgagacaaatgaagtaaactttagagagatccctagccacgtgttaagcaaagtgtgtatgtatttcacgtacaaggttagatacaccaatagtagcactgaaatccccgaatttccaattgcccctgagattgccctggaactactcatggctgcaaactttcttgactgctag

SEQ ID NO: 208948 - DNA, 2397 bp, Artificial Sequence
  Description of Artificial Sequence: Synthetic coding sequence
atgcacggcggccggagctgcggcccccggacccggcgggagccctccagcggggaggaagctgctccagtgacagcaatggctgctgagagtgcccttcaggtggtggaaaaacttcaggcacggctggcagcaaatccggaccctaaaaaacttttaaaatatctgaaaaaacttagcactctgccaataaccgtggacatactcgcagaaactggggtcggaaaaactgtcaatagtcttcggaaacacgaacacgtcgggtcctttgcaagagacttggtcgctcagtggaagaaactagtgccagtagaaagaaacgccgaaccagacgaacaggatttcgaaaaaagcaattcccgtaagcgtcctcgggatgcattgcagaaagaggaagaaatggaaggggattatcaggagacctggaaagctaccggctccaggtcatactcgcccgaccacaggcaaaagaaacacagaaaattgagtgagctggaacgaccccacaaggtcagccatggccacgagaggcgagatgaacgcaagagatgtcatcggatgagccccacatactccagtgatcccgaaagttccgattatggtcacgtccagagccctccctcatgtacctctccacatcagatgtatgtcgaccactacagatccctcgaagaagatcaagagcccatcgtgtcccaccagaaacctggtaaagggcattctaatgccttccaggaccgacttggcgccagtcaggaacgtcacctgggggagccacatggcaaaggcgtcgtgagccagaacaaggaacacaaaagcagccacaaggacaaacgacctgtcgatgccaaaagcgacgaaaaggcctccgtggtcagtcgagagaaatcccataaagccctgagtaaggaggagaacaggcgcccaccctccggtgataatgcaagagagaaacccccttcctctggagtgaagaaggaaaaggatagggaagggagcagtctgaaaaaaaaatgcctcccgccatcagaagcagcttccgacaaccacctgaagaaacccaagcacagagacccagaaaaagctaagcttgacaaaagcaaacagggcctggattcctttgacacggggaaaggagcgggcgacctcctccccaaagtaaaagaaaaggggagcaataacctaaagaccccagaaggaaaggtgaaaacaaatctcgatcggaaatccctggggagccttcccaaggtcgaagagaccgacatggaggacgaatttgaacaacccaccatgagcttcgaatcttaccttagttacgatcagccccggaaaaagaaaaagaaaattgtgaagacctccgctacagccctgggggataaaggattgaaaaagaacgatagtaagtcaactggcaagaacttggactccgtacagaaactccctaaagtgaacaagacaaagtcagagaaacctgcgggtgccgatttagcgaaactgcgtaaggtgcccgatgtcctcccagttctgccagacctcccgctgcctgcaatacaagctaactatcgacctctaccctccctggaacttattagttcatttcagcctaagagaaaggcgttttcctcacctcaggaagaggaggaggctggtttcacaggccggcggatgaattctaagatgcaggtctatagtggctccaaatgcgcatacttgcctaagatgatgactcttcaccagcagtgtattcgagtgctgaaaaacaatatagacagcatctttgaggttggaggagtgccttattccgtactcgagcctgtcttggagcgctgcacgcctgatcagctctacagaatcgaggaatacaatcatgtgctgatagaggagacagaccagctgtggaaggtacactgtcaccgggacttcaaagaagaaaggcccgaagaatacgagtcttggagagagatgtacctgagactgcaggatgctcgggagcaacggctacgggtgctgacgaaaaacatccagttcgcgcatgccaacaaacccaaaggacgacaggcaaaaatggcgttcgtgaacagcgtggccaaaccgcctcgagacgtgaggaggcgccaggagaagttcgggactggaggggcagctgtccctgaaaaaattaaaatcaagcccgcgccttatcccatgggaagttcgcatgcgagcgccagctcaataagcttcaatccctcccccgaagagcctgcctacgacgggccttcaacgtcgagcgctcacttggcgcctgtagtgtcttcaaccgtgtcatatgatccccgtaagccaacagtgaaaaaaattgccccaatgatggcaaagacgatcaaagcattcaaaaaccgcttctcgcgcagatag

SEQ ID NO: 208949 - DNA, 3297 bp, Artificial Sequence
  Description of Artificial Sequence: Synthetic coding sequence
atggccgagcggggcggcgacggcggcgagagcgagcggttcaacccaggcgagctccggatggctcagcagcaggcactgaggttccgtgggcctgcaccccccccaaatgccgtgatgcgcgggccccctcccctcatgagaccacccccccctttcgggatgatgagaggaccccccccgcctcccagaccaccttttgggagaccaccctttgatcccaacatgccaccaatgccaccaccaggcggaattccacctcctatggggcctcctcacctgcaaagacccccatttatgcctccgccgatgagctctatgccgcccccacccggcatgatgttcccacccggaatgccacccgtgaccgcccccggtaccccagcactgccccctaccgaagagatctgggtcgaaaacaaaacccccgatggcaaagtatattactataatgctagaacccgcgagtcagcttggacaaagcctgacggagtcaaggttatacagcagagtgagttaactccaatgctggccgcccaggcacaggtccaggctcaggcacaggcccaagcccaagctcaggcacaggctcaagcccaggcacaggcccaggcccaggcacaggcccaggcccaagcccaagcccaggcccaagcccaggcacaagcacaggctcaggcccaggcacaggctcaggcacaggcccaagcccaagcacaggcacaggtccaagcacaggttcaggcccaggtccaggcgcaggctgtcggtgcctctactcccaccaccagcagtccggccccagccgttagcaccagcactagctcatcaactcctagttctactacctccacaacgaccacagccacatcagtagcacaaactgtgtccactcccacaacccaggaccagacccctagttcagccgtgtctgttgcaacaccaactgtgagcgtgtcaaccccagcccctactgctactccagtacagaccgtgccccaaccacacccccaaacgctgcccccagcggtgccacattcggtgccccagcccaccaccgcgataccagcattccctcctgtgatggttcctccttttcgcgtgcctctgcccgggatgcccattcctcttcctggcgttgcaatgatgcagattgtgtcatgtccttacgtgaagaccgtggctacaaccaaaactggggtactgccaggaatggcgccaccaatcgttcctatgatccacccccaggtggccattgccgcttcaccagccaccctggccggggctacggcagtgagcgagtggactgagtacaaaacagctgacggcaagacttactactacaacaacagaacactcgaatcgacgtgggagaaacctcaggagctgaaagagaaagaaaaactggaagagaaaattaaagagcccatcaaagaaccatccgaagaaccactgccaatggagaccgaagaagaggatccaaaagaagagcccataaaagagatcaaggaggagccgaaggaggaggagatgaccgaggaggaaaaagccgctcagaaagctaagccggtggccacagctcccatccctggcacgccatggtgtgtggtgtggaccggcgacgagagggtgttcttttacaatccgactacccgcttgtctatgtgggatagacctgacgacctgatcggccgagctgacgtggataaaatcatacaggagcctccacataaaaaaggcatggaagaattgaagaaactgcggcatccaacaccaactatgctctcaatacagaagtggcagttttccatgtcagctatcaaagaggagcaggagctcatggaggaaattaacgaagatgagccggtgaaagcaaaaaagcggaaaagagatgacaacaaagatatcgatagcgagaaggaagccgctatggaggctgaaatcaaagctgctcgggaaagagctatcgttccattagaggctcgcatgaaacagttcaaggacatgttactcgagcgcggcgtgtctgctttttccacatgggagaaagagcttcacaaaatcgtttttgatccaaggtacctcctgttaaatcccaaggagcgtaagcaagtatttgatcagtatgtcaaaacccgagccgaggaggagaggagggaaaagaaaaataaaatcatgcaggcaaaggaggacttcaagaaaatgatggaagaggctaagttcaaccctcgggccacattcagcgagtttgcagcaaagcacgcaaaggacagccggttcaaggcaattgagaagatgaaggatcgggaggcactgttcaacgaattcgtcgctgcagccagaaaaaaagagaaggaggattcaaaaaccagaggagagaaaattaaaagcgacttcttcgagctactttctaatcaccatctggactctcagagccgatggagcaaagtgaaggataaggtcgagagcgacccacggtacaaggcagtggacagttcttcaatgcgggaagacctcttcaaacagtacatcgaaaagatagcaaagaacctggatagtgagaaagagaaagaacttgagcggcaagcacgtattgaggcttccctccgcgagcgggagcgggaggtgcagaaggcaaggtctgagcagactaaggagatcgacagagagcgagagcaacacaagagagaagaagccatccagaacttcaaagccttgctttccgacatggtgcggagctcagatgtctcttggagcgacacaagaaggaccttgagaaaggatcataggtgggagagcggttccttgctcgagcgagaggagaaagaaaagttgttcaatgaacacattgaggctctaacaaagaaaaagagggagcatttcaggcaactgctcgacgaaactagtgccataaccctaactagcacctggaaggaagttaaaaagattatcaaggaggacccgagatgtatcaaattctcatcatctgacagaaagaaacagcgcgagttcgaagagtacatcagagataagtatatcaccgcaaaagcagactttcgtacgctgctgaaggaaaccaagttcataacttacaggtccaagaaactgatacaggagtccgatcagcatttaaaggacgtcgagaagatactgcagaacgacaagaggtatttggtactggattgcgtaccagaggagaggcgtaagcttatagtagcctatgttgatgatttggacagacgcggcccaccaccaccgcctaccgcgagtgagccgacaagaaggagcactaagtag

SEQ ID NO: 208950 - DNA, 3234 bp, Artificial Sequence
  Description of Artificial Sequence: Synthetic coding sequence
atggccgagcggggcggcgacggcggcgagagcgagcggttcaaccccggcgaactgcgcatggcccagcagcaggctcttcgctttagaggtcctgcaccaccccccaacgcagtgatgcggggcccaccccccctaatgcggccgccacccccctttggaatgatgcgcggaccaccaccacctccccggcccccattcggacgtcctcctttcgatcccaacatgccacctatgcctcccccagggggaatccccccacctatggggccccctcacctgcagagacctccctttatgccaccacccatgtcgtctatgccccctcctccaggcatgatgttccccccgggcatgcccccggtaaccgctcccggcacccccgcactgcctcctacagaggagatttgggtggagaacaagacacccgatggaaaggtgtactactacaacgcccgaacaagggaaagcgcctggaccaagcctgacggggtgaaagttatccagcagagtgagttaacgcctatgctggccgcgcaggctcaggtgcaggcccaggctcaggcccaagctcaggcccaggctcaagcccaggcacaggcccaggcccaagcgcaggcacaggcgcaggcccaggcccaggctcaggcgcaggcccaggcccaggcccaggctcaggcgcaggctcaagctcaggctcaggcccaggcccaagcccaggcacaggtgcaggcccaagtccaggcccaggtccaagcgcaggcggttggcgcttcgacgcctacaacttcctctccagccccagcagtttctacctcaacaagctccagtactccttcatcaactacctccaccacaaccacagctacttctgtggctcaaaccgttagcacacccaccactcaggatcagactcccagcagcgcagtctccgtcgcaacgcccacagtaagtgtttctacacccgccccgacagccactcccgtgcagacagtgcctcagccgcatcctcagacacttccacccgcagtcccccacagcgtgccgcagcccacaaccgccatccctgctttcccacctgttatggtcccacccttccgtgtaccccttcctgggatgcctatcccgcttccaggggtactccctggaatggccccacccattgtccctatgattcatccgcaggtggcaatcgccgccagtcctgccacccttgcgggcgcgaccgctgtctccgagtggacagaatacaagaccgctgacggaaagacctactactataataaccgcacgcttgagagcacttgggagaagcctcaggaactgaaggagaaggaaaaactggaggagaaaataaaagaaccgattaaggaacctagcgaggagcccctccccatggaaacagaagaggaagacccaaaggaggaaccaattaaagaaattaaagaggagcctaaggaggaagagatgacagaggaagagaaggcagctcagaaagccaagcctgtggccactgcccccatacccggcaccccatggtgtgttgtatggacaggggatgagcgcgtgttcttctataaccccactacccgcctgtctatgtgggacagacccgacgatcttatcggccgcgctgatgtggacaaaattatacaagagccccctcataagaaaggtatggaagaactgaaaaaactccggcatccaaccccaacaatgttgtctatacagaaatggcagttctccatgtccgcgatcaaggaggaacaggagctcatggaggagattaatgaagacgaacctgtgaaggccaagaaacgcaagagggatgacaataaggacatagatagcgagaaggaggccgctatggaggctgaaataaaggcggcccgcgagcgggccattgtgccccttgaggcccggatgaagcaattcaaggacatgctactggaacgcggagtgtccgctttctctacatgggaaaaggaactgcacaagattgtgtttgatccacgctatcttttgctcaatcctaaggaaagaaagcaggtcttcgatcagtacgtgaagacaagagccgaggaggagcgtcgagaaaaaaagaacaagattatgcaggctaaggaggactttaaaaagatgatggaagaggccaagttcaatccacgcgcaacattctctgagttcgctgcaaaacacgctaaggattcccgttttaaggcaattgaaaagatgaaagatagagaggctttgtttaatgaatttgtggccgctgctaggaagaaggaaaaggaagacagcaagacccgtggtgagaagattaaaagcgattttttcgagctcctcagcaatcatcatctggattcccagagccggtggagcaaagtgaaggacaaagtggagtctgatcctaggtacaaggcagttgatagctctagcatgcgtgaggatctctttaaacaatatattgagaaaatcgccaagaatcttgattctgaaaaggagaaagagctggagaggcaggctcgcatcgaggctagcctgcgagagcgagaaagggaagtccagaaggctcgaagtgaacagacaaaggagattgacagggagcgcgaacagcataagcgagaggaggctatccagaatttcaaggccctactaagcgacatggtgcgcagctccgacgtgtcttggtcagacaccagacggacattaagaaaggatcaccgctgggagtctgggtcactcctggagagagaagaaaaggagaagttattcaatgaacacattgaggcgctcaccaaaaagaagagggaacattttcgtcagctactggacgaaacttctgcaattactctgacctctacatggaaggaggtgaaaaaaatcataaaagaggaccctagatgcattaaattttcttccagtgataggaagaagcagcgggagtttgaagaatatattcgagataaatacattactgctaaggctgatttccggaccctgctgaaagagaccaagttcataacgtacaggtccaaaaaactgattcaggaatcagatcaacatctcaaggatgttgagaaaatcctgcagaacgataagcggtacctagttctcgattgcgtgcctgaagaaaggaggaaacttatcgttgcatatgtagacgacctagaccgccgtggccccccccctccccctacagcttccgagccgactcggcgcagtaccaagtag

SEQ ID NO: 208951 - DNA, 2049 bp, Artificial Sequence
  Description of Artificial Sequence: Synthetic coding sequence
atgaacccccagcagcagcggatggccgccatcggcaccgacaaggaactgtctgatctcttggatttctctgcgatgttttcgccccccgtgaactccggtaaaacccgaccgaccacactgggcagttcccagttttcaggatccggaattgacgagcgcggcggcacgacttcatgggggacttcaggacagccctccccctcctacgactccagcagaggatttaccgattcgccccactactccgaccaccttaacgattcccggctcggggcccacgagggcctctctccaaccccctttatgaatagcaatttaatgggaaagacaagcgagaggggttctttttcactttatagcagagacactgggctccctggatgtcagagcagcctgctgcgacaagatcttggcctgggttcaccggcccagctgagctctagcggtaagcctgggactgcgtactattccttctcagcaacgtcttctagacgaaggcctctgcatgacagcgcagcactggatccactccaggccaagaaagtccggaaggtcccgccggggcttccaagtagtgtctatgcacctagccccaattctgatgatttcaaccgcgagtcacccagctatccctcccccaagccgccaacgtcaatgttcgcatctacttttttcatgcaggacggcacacataattcctctgacctttggagcagcagcaacggaatgagtcagccaggcttcgggggcatcctcggaacaagcacatcccatatgtcccagtcgtctagctacggcaatctccattctcacgatcggctgtcttatccaccacattccgttagtcccactgatatcaatacctctctcccccccatgtcttcctttcacagaggctcgacctctagtagtccatatgtggcagctagccacacacctcccattaacgggagcgactccatcctcggcacccgaggaaacgcagctggaagcagccagacaggtgacgccctgggtaaggccttggcctccatctattccccagaccacactagctccagcttcccatctaatcctagtacccctgtaggctcgccctctccactgactggcaccagtcaatggcccaggccaggaggccaagctccctccagccctagctacgaaaatagcttacactctctccagtccaggatggaagatcgacttgaccgactcgatgacgccatccatgttctgcgcaaccacgctgttggcccttccaccagcctgcccgcggggcactccgacatccactcactgctcggcccctctcataatgcccctatcgggtctctgaactccaattacggcgggagcagcctcgtggcaagtagtcggagcgcgtccatggtggggactcaccgcgaagattctgtgtccctgaatggaaatcattcggtactatcgagtaccgtgacaacctctagcacagatctaaatcataaaacccaggagaattatcgcggcggcctgcagtcccaaagcggaaccgtcgttactactgagataaaaacggaaaacaaggagaaggacgaaaacctgcacgagccccccagctctgatgatatgaaatctgacgatgaatcttcccagaaagatataaaggtgtcttctagaggaaggacctccagcactaacgaggatgaggatctgaaccctgaacagaaaatcgaaagagagaaggagagacggatggccaacaacgcacgggagcgcctcagggttagggatattaatgaagcctttaaggagctcggtcggatgtgccagctgcacctaaaatccgaaaaacctcagacaaaacttctgatcctgcatcaggcggtggctgtgatattgagtttagaacagcaggttcgtgagcggaacctgaacccgaaagccgcgtgcctgaagaggcgggaggaagagaaagtgtctgccgtgtccgctgaaccgcctaccacacttcctgggacacatcctgggttgtccgaaactacgaatcccatgggccacatgtag

SEQ ID NO: 208952 - DNA, 2121 bp, Artificial Sequence
  Description of Artificial Sequence: Synthetic coding sequence
atgaacccccagcagcagcggatggccgccatcggcaccgacaaggaacttagcgacctccttgacttctcggccatgttcagtccaccagtcaatagcggcaagacccggccaaccaccttgggcagctcccagtttagtggcagcggaatagatgagaggggggggacaacttcctggggcaccagcgggcagccgagtccaagttatgacagttcccggggattcaccgatagccctcactactcagaccacctgaacgattcgcggctgggcgctcatgagggcctgtccccgacgccctttatgaactccaatctgatgggaaaaactagcgagcggggctcgttttcattatatagccgggacaccgggctgcctggctgtcagagcagcctcctgcgccaggatttgggacttgggagccccgctcagctgtcgagctcagggaaacccggcaccgcctattactcctttagcgctacatcatccaggaggcgccccctgcatgactctgccgcactggaccctcttcaggcgaagaaagtgagaaaggtgccacccggacttccctctagcgtctatgccccttcccctaactctgacgatttcaacagggaaagtccctcgtatcctagcccgaaaccgcctacctccatgtttgcatccacgttcttcatgcaggacggcactcacaacagtagtgatctttggtcatctagcaacggaatgtctcagccaggttttggaggcatcttagggacaagcacctcacatatgtcacagtcctcctcgtacggaaacctccatagccatgaccgtttaagttacccaccacattccgtgagtcccacggacatcaatacatcactgcctcccatgtcctctttccaccggggttctacatcctcctcaccctacgtcgcagcatcacacacaccaccaatcaacgggtcagattcaatccttggcacccgagggaatgccgcgggctcctcccaaacaggagacgctctgggaaaggctctcgcatcaatctatagccccgaccacacgtcttcttccttcccatctaatccatcaaccccagtgggctccccttccccccttaccggaactagccagtggcctcgcccaggtggccaggcgccatcctcccctagctacgagaatagccttcactccttaaaaaaccgggttgaacagcagctccatgaacacttgcaggacgccatgagcttcctaaaggacgtatgcgagcaatccagaatggaggacagactagataggttggacgatgcaatccacgtacttagaaaccacgcagtcggtcctagtactagcctacccgccggacattcagatattcattccctcctcgggccatctcacaacgctcctatcgggagtctaaatagtaactatggaggaagttccctcgtcgcatcgagcaggtcagctagtatggtgggcacacacagagaggattctgtctccctgaatggcaaccatagtgttctcagttcaactgtcaccacttctagcaccgacttgaaccacaaaacacaggagaattacagagggggtctgcagtcacagtcagggaccgtcgttaccaccgagattaaaaccgagaacaaggagaaggacgagaacctgcacgagcccccatctagcgatgatatgaagtcagatgacgaaagttctcaaaaagacataaaggtttcaagcagaggaagaaccagctcgaccaacgaagatgaggacttaaaccctgaacagaaaatcgagcgcgagaaggagcgaagaatggcgaacaacgctcgagagcgcctgagagtaagggacataaatgaggccttcaaggagttgggccgcatgtgccagttgcatctgaaatcagagaaaccccaaactaaactgttaattcttcatcaggccgtcgccgtcattctctcacttgagcagcaggttcgcgagcggaatcttaatccaaaggctgcatgccttaagcggagggaagaagagaaggtgagcgcagtcagcgctgaacctcccactacattgccagggacgcacccgggcctctctgagacaacgaacccgatgggccacatgtag

SEQ ID NO: 208953 - DNA, 2109 bp, Artificial Sequence
  Description of Artificial Sequence: Synthetic coding sequence
atgaacccccagcagcagcggatggccgccatcggcaccgacaaggagctgtcagatctgctagatttctccgctatgttttctcccccggtgaatagtggtaagacaaggcctacaacgctcggaagctcacagttctcaggctctgggaccatccatgaaatgaaacaacttaactccaaagcaagacagaagggacaacgcatcaagggttttactgactccccccattactccgatcatttgaatgacagccgcctaggcgcccacgaggggctgtctcccaccccattcatgaattcgaatctcatggggaaaacgagtgagaggggttccttctcactctatagtcgcgataccggcctgcccggttgtcagtcaagtttgttgcgacaggacttagggttgggcagtcccgcacagctctcatctagcggtaagcccgggaccgcgtattattctttttcagcgactagctcaagacgcaggccactgcatgattccgcagccctggaccccctgcaggctaagaaagtgagaaaggtccctccaggtttaccttcatcagtgtatgctccctcccccaactccgacgacttcaacagggaatccccaagctatccaagtccgaaaccccccacttcaatgttcgcatcaacttttttcatgcaagacggcacgcacaacagttccgacctttggagcagttcaaacggaatgagtcaacccggttttggcggcattctcgggacgtccacctcccacatgagccagtcttctagctacggcaatctacattctcacgaccggctgagttatcctccacacagcgtgtcccctaccgacataaatacaagtctccctcctatgtcgagtttccaccggggtagtacatcctcaagcccatacgtagctgcctcccatactccacctatcaacggctcggattctatcctaggtacacgcggcaatgctgctggctcttcacagacaggtgacgccctcggcaaggccttagcctcaatctattcccccgatcacacttcttcgagctttccgagcaaccccagcacccctgtgggctctcccagcccactgacaggcacttcacagtggcccagacccggggggcaggcgccctcatccccctcttacgagaacagcctccacagcctgaaaaatcgggtggagcaacagctgcacgaacatctccaagacgcgatgtcattcttgaaagacgtgtgcgagcagagtaggatggaggacagactggaccgtctcgacgacgccatccacgtgctgcgcaatcatgctgtcgggccttccactagcctgcctgccggtcatagcgacatccactctcttctgggtccttctcacaacgctcccatagggtccctgaattccaattacggcgggtctagcctggttgccagctcacgaagcgcttctatggttggcacacacagggaggattcagtgagcctgaatggcaaccacagtgttttgagctctaccgtgaccacatcgtcgaccgatctgaaccacaagacccaagagaattatcgcggtggattgcagtcgcagagtggcacagttgtaactactgaaataaaaacagaaaataaagagaaggacgagaacctccacgaacccccaagctccgacgatatgaaatccgacgatgaaagctcacagaaagatattaaagtcagcagccggggacggactagtagcactaatgaggatgaagatttgaaccccgaacaaaaaatcgaacgtgagaaagaacggcgaatggccaacaacgcaagagagcgcttgcgcgttcgggatataaatgaggcattcaaggagcttggccgaatgtgccaattacaccttaaatccgagaaaccccaaaccaaactgttaattttgcaccaagctgtagcggtgatccttagcctcgagcaacaagtgagggagcgcaacctgaatccaaaagcagcctgtttaaaaagacgagaagaagaaaaggtgtctgccgtcagtgccgagcctccaaccactttgccagggacccatcctggactttccgaaactactaacccaatgggccacatgtag

SEQ ID NO: 208954 - DNA, 1341 bp, Artificial Sequence
  Description of Artificial Sequence: Synthetic coding sequence
atgggcaagcggtacatgcaccacccccagatccagatgatcagcacggtgaacttgcttgttatacatctcctgagccatcaacccgtttgttccttggctctctccttgtgtaagtcatatcctccccatagtgtgtctccaaccgatattaatacatccctgcctcctatgtctagttttcaccgagggtcgacatcatctagcccttacgttgctgcctcacatactcctccaataaacggtagtgattcgatactcggcacgagaggaaatgcagccgggagcagtcagaccggcgatgctctcggtaaggctttggcatccatctactccccagaccacacgagctcctctttcccatccaacccttccacccccgtgggctccccgtcaccgctgacaggcacatctcagtggccgagacctggtggccaggccccctcctccccaagctatgagaattcccttcactctctacaatcgcggatggaggatcgcctggaccgcttggacgacgccatacacgtcctcagaaaccacgccgtgggcccctcaacctcactgcctgccggccactcagatatacattcattactaggtcccagtcataacgcgcctatcggctctctcaatagcaactatgggggtagctcactcgttgccagtagcaggtccgcatctatggtcggtacccatcgcgaagacagtgtgagcctgaacggcaaccacagcgttctctcatctacagtcactacctccagcacagaccttaaccacaaaactcaggagaattaccggggcggactgcagtcccagagtggtacagtggtgaccactgagattaagactgaaaacaaagagaaagatgaaaatctgcacgagcctccctcctcagatgacatgaagtcagatgacgaaagctcacagaaagacattaaggttagttcaaggggtcgaaccagctccacgaatgaagacgaggacctcaaccctgaacagaagattgagcgtgagaaagagagacgcatggcaaacaacgcgcgcgaacggctgcgtgtgcgggacattaacgaagcgtttaaagagctgggtaggatgtgccagctccacttgaagtccgagaagcctcaaaccaagttgctcatcctccatcaggcagtggccgtgatcttatccctggagcagcaggtgagagagagaaacctcaatccaaaggccgcatgccttaagagaagggaagaggaaaaagtgagtgccgtgagtgccgagccaccaacaactttgcccgggacccatcccggtttatctgaaactacgaaccctatggggcatatgtag

SEQ ID NO: 208955 - DNA, 2046 bp, Artificial Sequence
  Description of Artificial Sequence: Synthetic coding sequence
atggccgccttcagcgtgctgcggccccgggtgcccggcagcagcgggacgtgggccgccgaccccgacgcatcaacagcggtgagcccctctttgaggtttggcgggcgcgagccagctcgccctacccggggtggtgcaacaaagtggcctaaaatgaatccccagcagcaacgaatggccgcgatcggcacagacaaggaactatctgacttactggactttagcgccatgttttccccccctgtgaacagcggaaaaaccaggcccactacactaggttcaagtcagttctctgggtcaggaattgatgaaagaggaggaaccacgagttggggtacatccggtcagccaagcccatcttatgacagcagccgagggttcacagactcaccccactacagcgatcacctgaacgattcacgcctaggcgcccatgaaggcctttcccctaccccttttatgaactctaatttaatggggaagaccagcgagagaggctcattttccctgtactcacgagatactgggttacctggctgccagtcaagtctgcttcgccaggatctgggactcgggtctccagctcaactctctagctccggtaagcctggcaccgcttattattcattcagtgctacctccagccggcgtagacccttgcatgactccgctgctctggacccactccaagccaagaaggttaggaaggtaccgccaggtctgccctcctcagtttacgctccgagccctaattccgacgacttcaatcgggaatctccgtcatacccttcaccaaagccgccgacctcaatgttcgcatctaccttctttatgcaggatggcacccataattcatcagatctgtggtctagttctaacggaatgagccagccagggtttgggggtattctgggaacgtcaacaagtcacatgtcccagtccagctcgtacgggaacttgcattcccacgatcgactgagctacccaccacactcggtgagtccaaccgatattaacacttccttgcctccaatgtcttcctttcaccgcgggtctacatctagctccccatatgttgctgcctctcacacacctcccatcaatggatcagacagcatcctagggactaggggcaacgctgctggctcatctcagactggcgacgctctaggcaaggcccttgctagcatttactcgcctgaccatacaagtagctcctttccttctaatccaagcacccccgtgggatcccccagtccccttaccggaacttcccagtggcccaggccgggggggcaggcacccagcagcccatcatatgaaaatagtttgcacagcctgcagtcacggatggaggacagactcgataggttggacgatgccatccatgtgctgcggaatcacgccgtggggccctccacttctttaccagcaggccattccgatatccactccttgctcggccctagccacaatgcacctatcggatcactgaattccaattacgggggtagcagcctggtcgcgtcttccaggtcagccagcatggtgggaacgcatagagaggacagcgtgtcactgaatggaaaccattctgtcctgagtagtaccgtcaccacatcgtctacagatcttaaccataaaacccaggaaaactacaggggaggcctgcagtctcaatccggcactgtggtcacgacagagatcaagacggagaataaggagaaagacgagaatctccacgagcccccctcctctgacgacatgaaaagtgacgacgaaagtagccaaaaggacattaaggtgtccagcaggggccgtacttcatcgactaacgaggatgaggacttgaatccagaacagaaaatcgagcgcgagaaggaacgaaggatggcaaacaatgccagggaaagactacgcgtaagggacatcaacgaagcttttaaagaactcggccgtatgtgccagttgcatctaaagtcagagaaaccgcagacaaaactgctgatcttacatcaagccgttaccactattggcccttag

SEQ ID NO: 208956 - DNA, 885 bp, Artificial Sequence
  Description of Artificial Sequence: Synthetic coding sequence
atgagcttcctgaaggacgtgtgcgagcagagccggatggaggacaggctggacaggcttgatgacgccattcacgttttgcgaaatcacgctgtggggccaagcacgtctttgcccgctggccatagtgacatacattctctgttagggccttcgcataacgctcccatcggatctctgaatagcaactatggcgggtctagcctggttgcgagctctcgatcagcctccatggtgggcactcaccgcgaggactcggtgagcttgaatgggaatcactcagttctctcatccacggtgactacttcaagcacagatttgaatcataaaacacaggaaaactaccggggtggccttcagtctcagagcggcaccgtcgtgaccacagagattaagactgagaacaaagagaaagatgagaaccttcatgagcctccatcttccgacgacatgaagagtgacgacgagagctcccagaaagatataaaggtttcttccaggggtagaacctcgaccaatgaagacgaagacctaaacccagagcagaagattgagagggaaaaggaacggcgaatggcgaacaatgctagggaacgactaagagtgagagatattaacgaggccttcaaggagctaggccgcatgtgccagctgcatctgaagtcggagaagccgcagactaaactgctcatcctgcatcaggccgttgcggtaatactgagcctcgaacagcaggtgcgggagaggaaccttaatccaaaggcagcatgcttaaagaggcgggaagaagagaaagtcagtgctgtttctgcagaacctcctactaccttgcccgggacgcaccccgggcttagtgaaacgacgaatcccatgggtcacatgtag

SEQ ID NO: 208957 - DNA, 1611 bp, Artificial Sequence
  Description of Artificial Sequence: Synthetic coding sequence
atgtactgcgcctaccccgtgcccggcatgggcagcaacagcctgatgtactactataatggaaaaaccgtgtacgcgcccagcccaaactccgatgatttcaatcgggaatcaccctcttaccctagcccaaagccgcctaccagcatgtttgctagcacgttttttatgcaagacggaacacacaattcgtccgacctgtggtcctctagcaacggaatgtcccagccaggattcggggggattctcggcaccagcacaagccacatgagccaaagttcatcttatggcaacctacactcccacgaccgcctttcctaccctccgcatagtgtgtcccccactgacataaacacgtcactgcctcctatgagctccttccacaggggatctacctctagctccccctacgtcgcagcgagccacaccccacccatcaatggctcagattctatcctcggcaccagaggcaatgcagcagggagcagccagaccggagacgccctgggaaaagccctggcctccatctacagtcccgaccacacaagcagtagctttcccagcaacccatccactccggttggatccccttcccctttaacagggaccagccagtggcctcgaccaggaggccaggcccccagctctcccagttacgaaaacagtctgcattctcttaaaaaccgtgtggaacagcagctgcatgagcacctgcaggatgctatgtcctttctcaaagatgtgtgtgagcagagccggatggaggatagattggacagattggacgacgccatccacgttttacgtaatcatgccgttggtccatcaactagtcttcctgccggccatagcgatattcatagtctcctgggccctagccacaacgctcctatcggttctctcaactctaattatggcggtagcagcttagtcgctagtagccggagtgccagcatggtcggcacacatagggaagattccgtgtcgctgaatggaaatcacagcgtccttagtagtacagtcacgacgtcgtctactgacctcaaccacaagacacaagaaaactacaggggaggtctacagagccagagtggaacagtggtaacaaccgagataaagacagagaataaggaaaaggacgagaacctgcacgagccgccctcatctgacgatatgaaaagtgacgacgagtcgtcccaaaaagacatcaaggtgtcctccagggggcgtacgagttctacaaatgaagacgaggacttgaatccggaacagaaaatcgaacgtgagaaggagcgtagaatggcaaacaacgcccgggagagattgagagtgcgagacatcaacgaggcctttaaagagcttggtcggatgtgtcaactccatctcaagtccgagaagcctcagaccaagttgcttatcctgcatcaggctgtcgcggttatactttctctcgaacaacaggtgagagagaggaacctcaacccaaaagccgcttgcctaaagaggcgcgaggaagaaaaggtctcggccgtcagcgcagaaccacctaccacactcccaggaacacacccaggtctctctgagaccacaaatcccatgggacatatgtag

SEQ ID NO: 208958 - DNA, 2049 bp, Artificial Sequence
  Description of Artificial Sequence: Synthetic coding sequence
atgaacccccagcagcagcggatggccgccatcggcaccgacaaggagctgtctgacctgttggacttttcagctatgttttcccccccagtgaactcaggcaaaacgagaccgactacactcggctcctcccagttttccggtagcggcatcgacgagagaggaggaaccaccagctgggggactagcgggcagccctcacctagctacgattccagtcgcggattcacagatagtccccactactctgaccacctgaatgatagtaggctcggggcccacgagggactgtccccgaccccatttatgaactccaacctaatgggtaagactagcgaacgaggatcattcagcctttattcaagagacacaggcttacccggctgtcagagctccctgcttcggcaggacttaggcctggggagccctgcccagctgagctcttctggaaaaccaggtacagcctactacagctttagcgccaccagcagcaggcgacgaccgctgcatgactccgccgcattggaccctttacaggctaaaaaggtccggaaagtccccccaggcctgccgtcctcagtctatgcacctagcccaaacagcgatgattttaatagagaatcaccatcatatcctagccccaaaccacctacttccatgttcgcttccaccttcttcatgcaagacggtacccacaacagctcggacctttggtctagcagtaacggtatgtcacagcctggtttcggtggaatccttggaaccagcacttcacacatgtctcaatcttcatcttatggcaacttgcattcgcacgaccggctgtcctaccctcctcatagtgtatctcccactgacatcaatacctccctacctcccatgtcaagtttccacagaggctcgacaagcagttccccctacgtggccgcctctcataccccaccaatcaatggatccgatagcatcctgggcacacggggaaatgctgccgggagtagtcagacgggagacgccctgggaaaggcgctggcgagcatttacagtcctgatcatacaagctccagtttcccttccaacccttctacacctgttgggtcgccatcacccttgacaggtactagccagtggccccgacctggcggccaagctccaagcagcccaagctacgaaaattcgctgcatagcctgcaatctcggatggaagatcgactggatagattggacgatgccatccatgtcctgcggaatcacgccgtcggtccctccaccagcctgccagccgggcattccgacattcacagtctgctcggacccagtcacaacgctccaataggcagtctaaactctaactacggaggaagttcgctcgtcgcatccagtcggtccgcctccatggtggggacgcacagagaggattcagtgagccttaatggaaatcactctgtgctttcatccactgtcactacttcctcgacagacctgaaccacaagacacaggaaaattatagaggtgggttgcaatcacagtctggcacggtagttactacagaaattaaaaccgaaaataaagagaaagatgagaatttgcacgagccaccttccagtgacgatatgaagagcgacgacgagtccagccaaaaggacattaaagtgtcttcccgagggcggacttctagcaccaacgaggacgaggatctgaaccctgaacagaaaatcgagcgggagaaagaaagaaggatggcaaataatgccagggaacgcctccgcgtgagggatatcaatgaggcattcaaagagctggggcggatgtgccagctgcacctcaagtcggagaagccacagactaagttacttatactgcaccaggctgttgctgtcattctgtcactggagcagcaggtaagagaacgtaatcttaaccccaaggctgcttgcctgaagagacgggaagaagaaaaagtttccgcagtatccgctgaacctcctacgaccctgcctggcacacaccccgggctaagcgaaaccaccaaccctatgggtcacatgtag

SEQ ID NO: 208959 - DNA, 1020 bp, Artificial Sequence
  Description of Artificial Sequence: Synthetic coding sequence
atgagcagcaacagcagcaccagccagtggccccggcccggcggccaggcaccttcctcaccctcctatgagaactctctgcactccttaaagaatcgcgttgagcagcagctccacgaacatctgcaggacgccatgagttttctgaaagatgtatgtgaacagagcagaatggaagaccggctggataggctcgacgatgccatccatgtactacggaatcacgccgttggacctagtacaagcctccccgccggccactcagacattcactctctgctgggaccaagccacaacgcgcccattggctcacttaattctaactacggaggcagcagcctggtggcatctagccgctcggcctccatggtcggtacacacagagaagatagcgtatctctcaatggtaaccatagcgtgctgtcctccaccgtgaccaccagctccactgacttaaaccataagacccaggagaattatcgcggcggtctccagtcccaaagcggcacagtcgtgacaacagaaataaaaaccgaaaataaggagaaggacgaaaatttgcacgagcctccttcctccgatgacatgaagtcggatgatgaatcatcccagaaagatatcaaggtatcatctcggggcaggacaagcacgaatgaggacgaggatctgaatccggagcagaagatagagagagaaaaggagaggcggatggccaataacgcaagagagcgtctacgcgtccgcgatataaacgaggccttcaaagagctggggcgcatgtgccagcttcacctgaaatcagagaaaccacagacaaagctgctcatcctgcaccaagcagttgctgtcatcctgtcactggaacagcaggtgcgagagcgcaacctgaatccaaaggcagcttgtctcaagagacgcgaggaggaaaaggtgagcgccgtaagcgctgagcctccaacaaccttacccggcacacaccccggattatccgagacaaccaatcccatggggcacatgtag

SEQ ID NO: 208960 - DNA, 1341 bp, Artificial Sequence
  Description of Artificial Sequence: Synthetic coding sequence
atgggcaagcggtacatgcaccacccccagatccagatgatcagcaccgtaaacctgctggttatccatcttctgtcacaccagccagtgtgctcattggccctgagcctgtgtaagtcttatccaccacatagcgtcagtccgaccgacatcaatacatcccttccaccaatgagcagcttccaccgcggttctacctcttctagcccttacgttgctgcctcccacaccccaccaatcaatggcagtgactccattttgggtacacggggcaatgccgcgggctcctctcaaactggagatgcattgggcaaagcacttgcctcaatctatagccctgaccacactagcagtagctttccttccaatccgtccacccccgtgggctctcccagccccctgactggaacttcacagtggccacggccaggtggccaggcaccaagctctccctcatacgagaatagccttcactccttacagtcacgcatggaggacaggctggaccggttggatgacgcaatccatgtcctacgtaatcacgccgtggggccgtcaacttccctccctgctggccattcagacatacattccctgctcgggcctagccataatgctcctattgggtccctgaactcgaattacggcggtagcagcctggtcgcttcatcccgatccgctagtatggtgggaacccaccgggaagacagcgtttcactgaacggtaatcattctgttctgagttccactgttacaacctctagtactgatctgaatcacaaaacgcaggagaattaccgcggcgggcttcaatcgcagtctggaacggttgtcactactgagataaaaacggaaaataaggagaaggatgagaatttacatgagcctccaagctctgacgatatgaaatctgatgacgagtcgtcccagaaagatatcaaggtgtcctccagaggtaggacaagttcaaccaacgaagacgaggacttgaaccccgaacagaagatcgaacgggaaaaagagcgccgaatggccaacaatgcccgggaaagactcagagtcagggatattaacgaggcctttaaagaactaggccgcatgtgccagctacatctcaagtccgagaagccacagacaaagctgctgattttgcatcaggccgtggctgttatcctgtctctcgagcagcaggtgcgtgagaggaatctcaaccccaaagctgcctgtttgaaaagacgagaggaagaaaaagtatccgccgtgtcagccgaaccccccactactcttcccggcactcacccggggttgagtgagacgacaaaccctatgggacacatgtag

SEQ ID NO: 208961 - DNA, 1539 bp, Artificial Sequence
  Description of Artificial Sequence: Synthetic coding sequence
atgtactgcgcctaccccgtgcccggcatgggcagcaacagcctgatgtattattacaatggaaaaaccgtgtatgcacctagccccaactctgacgatttcaacagggaatcaccatcctacccttccccaaagcccccaacttctatgttcgcttccaccttctttatgcaggacggaacccacaacagtagtgacctgtggtcatctagcaacggaatgagtcagccgggcttcgggggaatactgggcacctctacctctcacatgtcccagagcagcagctatggcaatctgcacagtcacgaccggctgagttatccccctcatagcgtctcacctactgacattaacacttctctcccccctatgagtagctttcatcgtggatccactagcagttccccatacgtggctgcgtcccatactcccccaataaatggctccgatagcatcttgggtacaagaggaaatgcagcgggaagctcacagaccggggatgcattaggaaaggctttggcgtctatctacagccctgaccacaccagcagcagcttcccgtcaaatccatccacacccgtggggagtccatcgcccctaactggcacctctcagtggcctcgcccaggtgggcaggcgccatcctctccttcatatgagaattctctgcattcactgcagagcagaatggaggatcgtctcgaccgcctcgacgacgccatacacgtgctgcgtaaccatgcagtaggaccgagcacctctttgcctgccggtcattcagatatacacagcttgctgggtcccagccacaacgctccaatcggtagtcttaacagcaactacggggggagtagcctggtcgcttcctctcgaagcgcctcaatggttggcacccacagagaggattccgttagccttaatggaaaccactcagttcttagctctacagtcactacctcgtcaacagacctgaatcacaaaacacaggaaaattacaggggagggctgcagtcgcagtctggaactgtggttaccacagaaattaagactgaaaacaaagaaaaagatgaaaacctgcacgaacccccgagctccgacgatatgaagagcgatgacgagtcctcacagaaggatattaaggtctcttcaaggggtcgcacgtccagcacaaatgaagacgaggatctgaatcctgaacagaaaattgagagagaaaaggagaggagaatggcaaataatgccagggaacggcttagggtcagggatatcaatgaggccttcaaagaattaggcagaatgtgccagttacatctgaaatccgaaaagcctcagacgaagctccttatcctgcatcaagctgtggcggtgattcttagcctagaacagcaggtgcgtgagaggaacctcaacccaaaggctgcctgcctgaaacggcgcgaggaagaaaaagtgagcgccgtgtccgccgagccccccacaaccctccctggcacccaccctggcctgtcagagactaccaatcctatgggccatatgtag

SEQ ID NO: 208962 - DNA, 600 bp, Artificial Sequence
  Description of Artificial Sequence: Synthetic coding sequence
atggccttcgccctgctgcggcccgtgggcgcccacgtgctgtacccggacgtccgtctgttgtctgaggatgaagaaaatagatctgagagtgatgcctccgatcagtccttcggatgctgcgaaggacccgaggccgcacgccgaggccctgggcctggcgggggaaggcgagctggaggtggcggcggcgcaggaccagtcgtggtggtgcggcagcgccaggccgcgaacgctcgcgagagggatagaacccagagtgtgaacaccgcctttactgctctgaggacacttatccccacggagcccgttgaccgaaagctgtctaaaatcgagaccgtgcgactggccagctcctacattgcccatctcgccaacgtgcttctccttggggattcagccgacgatggccaaccgtgtttccgagccgcaggaagcgctaagggcgctgttccagccgctgctgatggggggcggcagcctcggtcaatctgtaccttctgcttgtctaatcagcggaaagggggagggcggagagatctggggggaagctgccttaaagtcaggggagtcgcccccctccgtggtcctagaaggtag

SEQ ID NO: 208963 - DNA, 1038 bp, Artificial Sequence
  Description of Artificial Sequence: Synthetic coding sequence
atgctgccctgcttccagctgctgcggatcggcggcggccggggcggggacctgtatacctttcaccctccggcaggagccgggtgtacttacaggctgggacacagggccgacttatgcgatgtagctctccgcccccagcaggagcccggattaatcagtggaatccacgccgagcttcacgcagagccacggggcgacgactggcgggtttcactggaggaccactcttcccagggcaccctggtcaacaacgtgcgtctcccccgagggcaccggctcgagctctctgacggggatttgctgaccttcggaccagagggaccacccggcactagcccaagcgaattctattttatgtttcaacaggtgagggttaaaccccaggactttgcagccataaccattcctagatccagaggcgaagcaagagtgggagctgggtttcgcccaatgctaccctctcagggtgcgccccagaggccgctgtctacgtttagtccagctccaaaagctactctgatactgaacagtatcggctccctatctaagttgaggccccagccacttacattcagccccagttgggggggccctaagtctctgccagtacctgcgcctcccggcgaaatgggaaccaccccatccgcccccccgcaaaggaaccggcggaaaagcgtgcaccgagtcctggctgaactggacgacgagagcgagcccccggagaatccccctccagtgctgatggagccccgaaaaaagctccgcgtggataaggcccctctgacaccaaccggaaataggagggggagacccagaaaatacccagtctctgccccaatggcgccccctgcagtgggagggggcgaaccttgtgccgctccatgctgttgcttaccccaggaggaaacagtcgcgtgggttcagtgcgacgggtgcgacgtctggtttcatgtggcgtgcgtggggtgttccatccaggcagccagggaggccgatttccgctgccctggatgtcgcgctgggatacagacatag

SEQ ID NO: 208964 - DNA, 1038 bp, Artificial Sequence
  Description of Artificial Sequence: Synthetic coding sequence
atgctgccctgcttccagctgctgcggatcggcggcggccggggcggagacctgtacacgtttcatcccccggcgggggctgggtgcacatatagactgggccatagagcagacttgtgtgatgtggccctgcgcccccagcaagagcccggtctaatctctggcattcatgccgaactccacgccgagcccaggggcgatgattggagagttagtttagaagaccattcctcgcagggaacactagtgaacaacgttcggctgccccgaggccatagactggagctgagtgacggtgatctgctgacgttcggaccggaagggcctcccggcaccagtccttcagagttctacttcatgttccagcaggtcagggtcaaaccccaagatttcgcggccattacaataccccggtctcggggcgaagctagagtaggcgcggggttcaggccaatgctcccttcgcaaggggctcctcagcgccctctgtcgacgttctcacctgcaccgaaggccaccttgattctcaatagcattggctcccttagcaaattacggccacagcctctcacgtttagcccttcatggggaggaccgaagtctttacccgtccctgccccgcccggcgaaatgggtacaacacctagtgctccccctcagcgcaacagaaggaagtccgttcatagagtgctcgcggagcttgacgacgagagcgaacctcccgagaacccaccacctgtgctcatggagcctcggaagaagctgcgtgtggataaagccccattgactcccactggcaaccgacggggcagacctagaaaatatccagtttctgcccctatggctccacctgccgtcgggggcggcgaaccttgtgctgctccgtgttgttgcctcccacaagaggagacagtggcatgggtgcaatgcgacggatgcgacgtatggttccacgtggcatgcgtggggtgcagcattcaagctgcccgcgaagctgacttccgctgccccgggtgtcgcgcaggtattcaaacatag

SEQ ID NO: 208965 - DNA, 1038 bp, Artificial Sequence
  Description of Artificial Sequence: Synthetic coding sequence
atgctgccctgcttccagctgctgcggatcggcggcggccggggcggcgacttgtacacgtttcatcctcctgccggggcgggttgcacatataggcttgggcaccgagcagatctgtgtgacgttgccttaaggccacagcaggagcccggcctgatcagtggtatccatgcagagcttcacgctgagccccgcggcgatgactggagagtgtccctggaggatcactcatcccaggggaccttggtgaacaatgtgcggcttcctaggggacatagactcgagttgagtgatggggacctgttaacgttcgggcccgagggccctccggggacaagcccctcggaattctattttatgttccagcaggtgagagtcaaaccacaggactttgcagcgattacaattcccagatcccggggcgaagccagagtgggcgccggctttcgaccaatgctccccagtcaaggcgctccccaaagacccctcagtactttttcccccgcaccaaaggcaaccctgattctgaactctataggcagcctgtctaaattgaggccccaacctctcacctttagcccaagctggggcgggcctaaatcactgcctgtgccagccccacccggagaggtcggtacaacaccctcagccccaccccaaaggaatcggcggaagtctgtacaccgggttctagctgagttagatgacgagtccgaacctcccgagaaccctcctcctgttctgatggaacctaggaaaaaactgcgagtagacaaggccccactcactccgactgggaaccgaagaggcagaccgcgaaaatatcctgtgtctgcccctatggcacctcccgctgttggcggaggcgagccttgcgcagcaccttgctgttgcctcccacaagaggaaaccgtggcttgggtacagtgcgacggatgcgacgtgtggttccatgtcgcatgtgtgggctgctcaatacaagctgcccgagaagccgacttcagatgtccaggatgccgggctgggatccagacctag

SEQ ID NO: 208966 - DNA, 1038 bp, Artificial Sequence
  Description of Artificial Sequence: Synthetic coding sequence
atgctgccctgcttccagctgctgcggatcggcggcggccggggcggtgacctgtatacttttcatccaccagccggcgctggctgcacctatcgccttggtcatcgcgcagatctatgcgatgtggcacttcgcccacaacaggaacccggccttatctcagggatccacgcagagttacacgccgagccacgcggcgacgattggagagtgtcactggaggatcattctagccagggaacccttgtgaataatgtgaggctgccgaggggtcatcgtctggagctttctgatggcgacttactgacatttggtcccgagggacccccgggaacatcacccagcgaattctatttcatgtttcagcaggtgcgcgttaaaccccaggattttgctgccattaccatcccacgcagtagaggcgaggctagggtgggagctggcttcagacctatgcttccgtcacaaggggcaccccaacgccccttgagcaccttttcacctgctcccaaggcaacactaatcctgaactctatcggttccctttccaaactgcgaccacagcctctgacttttagtccctcttggggcggccccaagtcactgcctgttcccgcaccccctggcgaagtcggcacaactcctagtgcgccaccacagaggaaccgccggaaatctgtgcatcgggtcctcgcagaactggacgacgaaagcgaacccccggagaatcccccacccgtactgatggagcctcggaaaaagctccgcgtggataaggccccactcacccccaccggaaaccggcgaggacgccctcgtaaataccctgtgtctgcccccatggctcctcctgcggtgggggggggcgagccatgtgcagccccctgctgctgcctgccacaagaggaaaccgtcgcctgggtacagtgtgatgggtgtgatgtttggttccacgttgcctgcgtggggtgctcaattcaggctgccagagaagcagatttccgttgccccggttgccgcgcaggcatccaaacctag

SEQ ID NO: 208967 - DNA, 1038 bp, Artificial Sequence
  Description of Artificial Sequence: Synthetic coding sequence
atgctgccctgcttccagctgctgcggatcggcggcggccggggcggagacctctacacatttcatcccccagctggagccggttgtacctaccgcctgggtcatcgggctgacttgtgcgacgtggccttacgcccacaacaagaacctggactcatcagcggtattcatgcagagttgcatgccgaacctcgcggggatgattggcgtgtgtccctggaggatcacagtagtcaaggcacgctcgtgaataatgtgaggctgccacgtggccaccggttggaactatctgatggcgacctcctaacctttggtcccgagggcccgccaggcaccagtccctcggagttctactttatgttccagcaggtgcgcgtgaagcctcaggattttgctgcgataacaatccctagatcccgaggcgaggcgcgcgttggcgctggtttcaggcctatgctcccttcccagggagctcctcagaggcccctctctacctttagtcccgccccaaaggctaccctcatcctcaactccatagggtcgctgagcaagctacggccgcagcctctgactttcagtccttcttggggagggcctaagtcacttccagtgcccgccccgcccggagaggtgggcaccaccccctctgctccaccccaaaggaatagacgaaaaagtgtgcatagagtgttggctgagctggatgacgaaagtgaaccacccgaaaaccccccccctgtcttgatggagccgcggaaaaagctcagagtggataaggccccgctgaccccaacgggcaacagaaggggacgacctcggaaatatcccgtctccgcgcctatggcacctcccgccgtgggcggaggtgagccctgtgccgctccttgctgctgtctacctcaggaagagacggtggcatgggttcagtgtgatggctgtgacgtatggttccatgtggcctgtgtcgggtgttctatacaagcagccagagaggccgactttcggtgtcctggctgcagagcaggcatccagacctag

SEQ ID NO: 208968 - DNA, 1038 bp, Artificial Sequence
  Description of Artificial Sequence: Synthetic coding sequence
atgctgccctgcttccagctgctgcggatcggcggcggccggggcggcgacctgtacacctttcatccccctgccggcgcgggctgcacgtataggctggggcacagggccgatttatgtgacgttgcgctgcgtccacagcaggaaccaggcctgatcagtgggattcatgctgaattacacgccgagcccaggggagatgattggcgcgtgtctctggaagatcatagcagtcagggaacactggtgaacaatgtccgcctgcccagagggcatagactcgagctctccgatggagatttgctgacctttggtcctgagggcccgcctgggaccagtccttccgagttctactttatgtttcagcaggtgcgcgtaaagccgcaggatttcgccgctattaccataccccgttccaggggtgaggccagggttggcgcaggcttcaggccaatgctgccatcccagggggcacctcaacgcccgctctctactttcagcccagccccaaaagcaactttaattctcaatagcataggatcattgtccaagctgcggccccagccgctgacctttagcccttcatggggtggccccaaaagtttgccggtgccagctccaccaggtgaagtcggcactacccctagtgcccctcctcagaggaatcggagaaagagcgtgcaccgggtcctggccgagctagatgatgagtcggagcctccagagaacccgccaccagttctgatggagcccagaaagaagctcagggtggacaaggccccactgacacccaccggcaaccgccggggacggccgcggaagtatcccgtgtccgccccaatggccccccccgctgtgggagggggcgagccctgtgcagcaccatgctgttgcctccctcaagaggagaccgttgcgtgggtgcagtgtgatggatgtgatgtgtggtttcacgtcgcgtgcgtaggctgctcaatccaggctgcccgggaggccgattttcgttgccctggctgcagagcaggaatccaaacttag

SEQ ID NO: 208969 - DNA, 1038 bp, Artificial Sequence
  Description of Artificial Sequence: Synthetic coding sequence
atgctgccctgcttccagctgctgcggatcggcggcggccggggcggggacctctatacttttcaccctcccgcgggtgcaggatgcacataccgcctgggacatcgcgcagacctgtgcgacgtggccttgcgcccccaacaggaacctgggctgatcagtggtatccacgccgagctgcatgcagaaccccgtggcgacgattggagagtatcgctggaagatcattcttctcaaggtaccttagtcaacaatgtccgcttgccgaggggccaccgtttagagctatctgacggcgatctgctcacattcgggccagagggacccccaggaacatcccccagtgagttctactttatgtttcagcaggtgagagtcaaaccacaggatttcgccgccattacaatacctcgcagccgcggcgaagcaagggtgggcgcaggatttcggccgatgctgccttctcagggtgctccccaaaggcctctctccactttctcaccagcacccaaggcgaccctcatcctcaactctataggtagcctaagtaagctgcggccccaaccactgacattttcacctagctgggggggaccgaagtctctgcctgtccctgcgcctccaggcgaagttggaaccactccgtcggcaccaccgcagaggaatcgacgcaagtcagttcatcgggtcctggctgaactggacgatgaatccgagccaccagagaatcctcctcctgtgttgatggagcctagaaaaaagctgagagtcgacaaggcgccccttacgccaaccggcaacagacgtggcaggcctcgcaagtatcctgtgtctgcacccatggccccaccagctgtcggcgggggcgagccatgtgcagcaccctgttgctgtcttccccaggaggaaactgtggcatgggtccagtgcgatggttgtgatgtgtggtttcacgtcgcttgtgtggggtgttctatacaggcggcccgggaggcagacttcaggtgtcccggttgtcgagccggcatccagacctag

SEQ ID NO: 208970 - DNA, 1038 bp, Artificial Sequence
  Description of Artificial Sequence: Synthetic coding sequence
atgctgccctgcttccagctgctgcggatcggcggcggccggggcggggacctttacacatttcaccccccagccggagctggttgtacgtatcgtctggggcacagggctgatctctgcgatgtcgccttgcgcccccagcaggaacccggactgatttccggaattcacgccgagcttcatgcagaaccacgaggggatgactggagggtttcactggaagatcacagcagccaggggactcttgtgaacaacgtgcgcctgcctaggggacatagacttgagctctctgacggcgatctgctaacctttggccccgagggctccccgggtacctctcccagcgagttctactttatgtttcagcaagtgcgggtgaagccacaggatttcgcagccattacaattcccagatctagaggagaggctcgcgtgggtgctgggttcagacctatgctgccatcccagggagcgccccagcgacctctgagcacatttagtccagcacctaaggctacactgattcttaactcgattggctcgctgagtaagttgcgaccacagcctctgactttttctccatcttgggggggccctaagtccctccccgtgccggccccgccaggcgaggtaggcaccactccctccgcaccgccccagcgaaatcgaagaaaaagcgtgcatagagttctggccgaactggatgacgagtcggagcctcctgagaaccctccgccggttctgatggagcctcggaagaagctccgtgtagacaaggcacctcttacccccacaggcaatagacgtggaaggcctaggaagtatccagtgtccgcccctatggctccacccgctgttggtggcggcgagccctgtgccgccccttgctgctgtttgcctcaggaggagactgttgcctgggtccaatgcgatgggtgtgacgtttggtttcacgttgcgtgcgtgggatgtagcatacaggcagctcgggaggcagacttccggtgtccaggctgtagggcaggtatacaaacctag

SEQ ID NO: 208971 - DNA, 1038 bp, Artificial Sequence
  Description of Artificial Sequence: Synthetic coding sequence
atgctgccctgcttccagctgctgcggatcggcggcggccggggcggtgatctgtatactttccatccaccagcaggcgctggctgcacttaccgcctcggacatagagctgacctttgcgatgtcgcactccgcccccagcaggaaccgggcctcatcagtggcatccatgcagagcttcatgcggaacctaggggggacgactggcgtgtgtctctcgaggaccactcctcacagggcaccctggtcaacaacgtgagactacctcgaggtcatagattagagctgtcggatggcgacctattgacattcggccccgagggcccccctgggacatctccttccgaattctacttcatgtttcagcaggtccgagtgaagccacaagatttcgccgctataaccattcctagatctcgcggcgaagcgcgggttggcgccggatttcgacctatgctgccctctcaaggagctcctcagaggcccctgtccactttttctccagcgcccaaggctacgctgatccttaacagcatcggctccctttccaagctacggcctcagccgcttacattcagccctagctggggagggcctaagtcactgccagttcccgcaccaccgggagaagtggggacaaccccttctgcccctcctcagaggaaccggcgaaaaagcgtacaccgcgttttggctgaattagacgacgagtcagagcccccagagaatcctccccccgtcttgatggagccccgaaagaagctgagggtggataaggcccccctcacccccacggggaaccggcggggacgccctaggaaatacccggtctccgcccctatggcacctccagccgtgggtggaggtgagccatgtgccgcgccatgttgctgtctcccccaggaggaaaccgtggcctgggtgcaatgcgacgggtgcgacgtgtggttccatgttgcctgtgtgggctgctctattcaggccgctagagaggcagacttccgctgtcctgggtgtagagctgggatccagacttag

SEQ ID NO: 208972 - DNA, 1038 bp, Artificial Sequence
  Description of Artificial Sequence: Synthetic coding sequence
atgctgccctgcttccagctgctgcggatcggcggcggccggggcggagatctgtatacctttcacccaccggccggtgctggatgtacctatcgactgggccatcgtgcagatttgtgcgatgtggccctccgcccacagcaagaacccggcctcatttccggaatacacgccgagcttcacgccgaacccagaggcgacgattggagggtgtcgctggaggatcacagctcccaggggactctggttaataacgtcagactgccacgcggccacaggcttgagctcagtgatggcgacttgctgacattcggtccagaaggaccccctggcaccagccctagcgaattttattttatgttccagcaggtcagggtgaagccccaggacttcgcagccattaccatccccagaagccgtggtgaagctagagtgggcgcaggttttcgacctatgctgccctctcagggggctcctcagagaccactctccactttctcacctgctccaaaagccaccctgattctcaatagcatcggctccctgagcaaactgagacctcagcctctgacattctccccttcatggggcggtcctaagagtcttcctgttcctgcccctccgggagaggtggggacgacaccatctgctccccctcagcggaaccggcgcaaaagcgtacatcgcgtgctggcagagcttgacgatgaatccgaaccccccgagaatccgcctccagtgctgatggaacctcggaaaaagctgcgcgtggacaaggcacctctcaccccaacagggaacaggagaggacgccctcgcaaatatcctgtgtctgccccaatggcccccccagcagtcggaggcggggagccctgtgctgcgccatgctgttgtttgccccaggaggaaacggtggcttgggtccagtgtgatggctgcgatgtgtggtttcacgtggcctgtgtgggatgttcaattcaagccgcaagggaagccgacttcagatgcccaggctgccgcgcaggcattcagacctag

SEQ ID NO: 208973 - DNA, 1038 bp, Artificial Sequence
  Description of Artificial Sequence: Synthetic coding sequence
atgctgccctgcttccagctgctgcggatcggcggcggccggggcggtgatttgtacactttccatccacccgccggcgcaggatgtacatatcggctgggccatagagccgatctctgtgatgttgccctgcggccccagcaggagcctggcctgatctccggtatccacgctgagctccatgctgagccaagaggggatgactggagggtctccctggaggatcactcatcccaggggacattggttaataacgtgaggttgcctcgcgggcacagactggagctgtccgatggtgatctcctgacctttggccctgagggacctccaggtacttccccctcagagttctattttatgttccagcaagtcagggttaaaccccaggatttcgctgcaataacaattcccagaagtcggggagaggcgagggtcggggcaggctttcggccgatgctgcccagtcaaggagctccccagcgcccactcagcacattttccccagctccgaaggctaccctgatcttgaattccatcggctctttgagtaaattacgaccccagcctctgacctttagcccgtcctggggagggccgaagtctctgcccgttcccgccccaccaggcgaagtaggaacaaccccttctgcacccccccagaggaaccgtcggaaatcagttcatagggtgctagcagaactggacgacgagagcgaacctcctgagaacccgccgccagtactgatggagcccagaaaaaaattaagagtcgacaaggcaccgctgaccccgaccggcaatagacggggccgccctagaaagtacccagtgagtgcccctatggccccaccagccgtaggaggcggggagccctgcgctgccccttgttgctgtcttccccaggaggagactgtggcctgggtgcagtgcgacggctgcgatgtgtggtttcatgttgcttgtgtcggctgctctattcaagccgcccgggaagccgatttccgctgtcctggttgtagggctggcatccagacttag

SEQ ID NO: 208974 - DNA, 1038 bp, Artificial Sequence
  Description of Artificial Sequence: Synthetic coding sequence
atgctgccctgcttccagctgctgcggatcggcggcggccggggcggggacctatacaccttccatccccccgccggggcgggatgtacctacagacttgggcatcgagcagacttgtgtgatgtagcactgcgtccacaacaggagcctggtctcatctctggaatacatgccgagctgcacgccgagccccgcggagatgactggcgagtgagccttgaggatcattccagtcaaggcaccctcgtgaacaatgtgcggctcccacggggacatcgactcgaactgtcagacggagatcttttgactttcgggccagaggggccaccaggtacaagtccaagtgagttctacttcatgtttcagcaggtgagggtgaagccgcaggactttgcagcaatcactattccaagatcacgcggagaagcccgggtcggcgcagggtttcggccaatgctgccaagccaaggagccccccagcgaccattgagcacatttagccctgcccctaaggcaacactgatcctgaactcaatcggtagtttatccaaacttagaccccagcccctgactttttctccctcttggggcggcccaaaatccctgccagtccccgccccgcctggtgaggtgggcacaactccttctgctcccccccagaggaataggaggaaatctgtgcaccgtgtactcgctgaactcgatgacgagtctgaacctcccgaaaaccctcctcctgttctgatggagcctcgcaagaaattaagggtggacaaggcaccactgaccccaactggcaaccgcagggggcgcccgcgcaagtacccagtgtccgccccaatggcaccccctgcagtgggaggaggggagccatgcgctgccccttgctgttgtctgccccaggaggagacagttgcatgggtgcaatgtgacggttgcgacgtctggtttcacgtggcttgcgtggggtgcagcatccaggcagctcgtgaggccgatttccgctgccccgggtgtcgcgccggcattcagacctag

SEQ ID NO: 208975 - DNA, 1038 bp, Artificial Sequence
  Description of Artificial Sequence: Synthetic coding sequence
atgctgccctgcttccagctgctgcggatcggcggcggccggggcggcgacctgtacacctttcacccgccagcgggcgccggctgtacgtacaggctgggacaccgcgcagacctgtgtgacgtagctctaagaccacagcaggagccaggacttatctccggaatccatgccgagctgcatgccgagccccgcggagacgattggagggtcagcctggaagaccacagctctcaaggaacattagttaacaatgtgcgcctgcccagggggcaccgactagaactttcagatggagacctactcacgtttggtcctgaaggtcctccgggaacttcaccaagtgaattttattttatgtttcagcaggtcagagtcaaaccccaagatttcgcagccatcaccatcccccggagccgaggtgaggccagagtcggcgcaggctttagacccatgctgccttcccagggggctccccaacggcccctgtctactttctcaccggcacctaaagccacgctaattcttaactccattggatccctcagtaaactaagaccacagcctctaactttttccccctcatggggtggccccaagtctctgccagtacccgctccccctggcgaggttgggactacccctagcgccccgccacagcggaacaggagaaagtctgtacatagggtattggcagagctggatgatgagagtgaaccccctgaaaatcctcctccagtcctgatggagcctaggaaaaagcttcgcgtggacaaggcccctctgacgccaactgggaaccgaagggggaggcctcggaagtatcccgtctcagctcccatggctccccccgccgtgggaggcggggaaccatgtgccgcaccctgctgctgtttgccacaggaggagacagtagcatgggtgcaatgtgacggctgtgatgtgtggttccatgtggcttgtgtgggctgctcgatacaagctgcccgcgaggcagacttcaggtgccccgggtgcagagccggaatacagacctag

SEQ ID NO: 208976 - DNA, 1038 bp, Artificial Sequence
  Description of Artificial Sequence: Synthetic coding sequence
atgctgccctgcttccagctgctgcggatcggcggcggccggggcggagatttgtatacctttcatccacctgccggggcgggttgcacataccggcttggacaccgggccgacctgtgcgacgtggcactgagaccacaacaggagcccggcttgatttccggtattcacgccgaactccatgctgaacctcgtggggacgattggagggtcagtctagaggatcactcttctcaggggaccctggtcaataatgtccgcttaccccggggtcatagacttgagttgagtgacggcgatttgcttacattcggaccagaaggctccccagggacatcgccatccgagttctacttcatgttccagcaggtgcgcgttaaaccccaggacttcgcagcaattacaataccgagaagtaggggagaggctcgggtgggagctggcttcaggcctatgcttcctagccagggcgccccccagcgacccctgtcgacattctctcccgcccctaaagcaacattgatcctgaatagcattgggtccctcagcaagctgcgccctcaacctttgacattttctccttcatggggcggcccgaaaagcttgccggttcccgccccccccggtgaggtagggacgacccctagtgctcccccccagcgcaatcgccgcaaaagcgttcatagagtcctagccgagttggacgatgagagcgagccacctgagaaccctcctccagtgctgatggaacccaggaagaaactgcgcgtggacaaagctcctttgacaccaactggaaatcggcgcgggcgccctcggaagtacccggtaagcgctccaatggctcccccggccgtgggtggtggggagccctgcgctgccccttgctgctgcctccctcaagaagaaactgttgcctgggtccagtgtgacgggtgcgacgtctggttccatgttgcatgtgtgggatgtagcattcaggccgcacgagaagctgactttaggtgcccaggctgtcgggctggaattcagacctag

SEQ ID NO: 208977 - DNA, 654 bp, Artificial Sequence
  Description of Artificial Sequence: Synthetic coding sequence
accctggtgaacaacgtgcggctgccccggggccaccggctggagctgtcagatggagacctcctgaccttcggacccgagggcccccccggcacatcaccctctgagttttactttatgtttcagcaggttagggtgaaacctcaggatttcgctgccatcactatccctagatcaagaggcgaggccagagtgggcgcaggcttccgtccgatgttgccgtctcagggggcgcctcagcgtcccctgagcaccttctcacctgccccaaaagccacactcatactgaactcaatagggagtctctcaaagctgaggccacagccactgactttttccccttcttggggtggtccaaaatccctgcctgttccagctccacctggagaaatgggtactactcctagcgctcctccccagcgaaaccgcagaaagagcgtccatagggtgctggccgaactggatgatgagtcagagccacccgaaaatcctccacctgtcctgatggaaccaaggaaaaagctccgcgttgacaaggccccccttactccaactggtaattggcacattcaagggatgcaatccatagtgaagggtcagaaggagagaccctggccacgcgaacacttgtccggttacgaggaggccagctag

SEQ ID NO: 208978 - DNA, 645 bp, Artificial Sequence
  Description of Artificial Sequence: Synthetic coding sequence
atgagccagcggaaggcccggggcccccccgccatgcccggcgtgggtcattctcaaacccaggccaaggcccgactgttaccaggcgctgataggaaacggtccagactcagccgaaccagacaggacccttgggaagagcgtagctggtccaatcaaaggtggagcagagcaactccaggccctagaggaaccagggccgggggcctcgcacttggcaggtctgaggccagccctgagaacgctgctcgagaacggagtcgagtcaggacccttaggcaagctttcctggccttgcaggccgccttacccgccgtgcctcctgacacaaaactgtcaaaattggatgttctggtgttggcagcctcgtacatagcccacctcacgcggaccctgggacatgagctgcctgggccagcctggcccccattcttgagggggcttcgatacctgcacccgctgaagaaatggcctatgagatcccgtctgtacgccgggggtctagggtactctgacctggactccacaaccgctagcacacccagccagcgaacaagggacgctgaggtcggcagccaggtcccaggggaagcagacgctctcctttctacgaccccactgagtccagccttaggagacaagtag

SEQ ID NO: 208979 - DNA, 2031 bp, Artificial Sequence
  Description of Artificial Sequence: Synthetic coding sequence
atgagccggcgggccctgcggcggctgcggggcgagcagcggggccaggaaccccttggcccaggcgccctgcattttgacctacgggacgacgacgatgccgaggaagaaggacccaagagagagctgggggtgcggcgacccgggggggctggaaaagaaggtgtgcgagtaaacaacagatttgagctgatcaacatagacgacctggaagacgacccagtggtcaatggcgagaggagtggctgcgcactgactgatgctgtcgccccagggaacaagggtcgaggtcagcgcggaaataccgaatccaagacagacggggatgacacagagacagtgccatctgagcagtctcacgccagtggaaagttacgcaaaaaaaagaaaaaacagaaaaacaagaagagttccactggtgaagcttccgagaacgggcttgaagatatcgaccggatcctggagcggattgaagattctaccggactgaataggccaggaccagctcctctctcctccaggaaacacgtactttatgtggagcatcgacacctgaacccggacaccgaactaaagcggtactttggcgcccgggcaatattgggggagcagaggcctcgtcagcgacaaagagtctaccctaaatgcacctggctaaccacgccaaagtctacctggccccggtactccaagcccggactgagcatgaggctgttggagtctaagaagggactgtcatttttcgcttttgagcatagcgaagagtatcagcaggctcaacacaagttcctggtcgctgtggaatcgatggagccaaataatattgtggtcctcttgcagaccagcccctatcacgtggattcgctgctgcagctcagcgatgcatgccgcttccaagaagatcaggagatggcacgggatctcgtggagcgagcactttactctatggagtgtgccttccaccctttgttctccctgacttccggcgcctgtcgcttggattaccggagacctgagaatcgctctttctaccttgctctgtacaaacagatgagtttccttgaaaagaggggatgtcctcgaacagctcttgagtactgtaaattaatcctcagcctggagcctgacgaggaccctctgtgcatgttactgcttatcgaccacttggccttacgcgcccggaattatgagtaccttatccggctgtttcaggaatgggaagcccaccgtaatttgtcccagctccctaacttcgccttttcagtgcccttagcttatttcctgctgagtcagcagaccgaccttccagaatgcgaacagagctctgcgaggcagaaagcttccttactcatccagcaggctctaacgatgttccctggcgtgctattgccactgttggaaagctgcagcgtgcgcccagacgcctctgtgtcttctcatcgatttttcggacctaatgcagagataagccaaccccccgctctgtctcaattagtcaatctgtacttgggtcgaagccattttctatggaaggagccggcaaccatgtcatggcttgaggagaacgtgcatgaggttttgcaagccgtcgacgcaggcgaccctgcagtggaggcttgtgagaaccgcaggaaagttctgtatcagcgagccccccgcaacatccaccggcacgtcatcctcagtgagataaaagaagccgtggccgctcttccaccggacgtgacgacgcagagtgtgatggggttcgacccactacctccgtccgataccatttattcttacgtgaggcctgaacgattaagccccataagccacgggaacacaatcgctttgttcttcagatctctgttgcctaactacacaatggagggagaacgcccagaggagggagtcgccggaggtttgaatcgaaaccaaggactgaaccggctcatgctcgcagtcagagacatgatggctaactttcatctgaacgacctggaagctcctcatgaggacgacgcagaaggggagggcgagtgggattag

SEQ ID NO: 208980 - DNA, 1422 bp, Artificial Sequence
  Description of Artificial Sequence: Synthetic coding sequence
atgcggctgctggagagcaagaagggcctgagcttcttcgccttcgaacactcggaggaatatcagcaggcacagcataagtttctggtggccgtggagagcatggaaccaaacaatatcgtcgtgttacttcagacttcgccatatcacgttgatagtctactccagctgagtgacgcatgccgatttcaggaagaccaggagatggcaagggatctggtggaaagagcgctttatagcatggagtgtgccttccatcccctcttttcattaacgtctggagcttgtcgcttagattaccggcgccctgagaaccggtccttttacctcgctttgtataagcagatgagcttcttggagaagcgcgggtgtccgcgcaccgccctggagtattgcaagttgatcctaagcttggaaccagatgaagacccgttgtgcatgctcctcttaattgatcacctcgccttaagagcacggaattatgagtatctgatccgtctctttcaagaatgggaagcacatcggaatctgtctcagcttcctaattttgcctttagtgttccactcgcgtattttttgctttcacagcagacagatctgccagagtgtgagcaaagcagtgcgagacagaaagcttcccttctgatccagcaggcactcactatgttcccgggcgtcctgttacctctcttagagtcttgttccgtccgaccagatgcatcagtgtcatcacaccgcttttttgggccgaatgcggagattagccagccacccgctcttagtcagctcgtgaacctgtacttgggccgaagtcacttcttgtggaaagaacccgctacaatgagttggcttgaagaaaacgtgcacgaggtgttgcaagccgtggacgcaggagaccccgctgtggaagcctgcgagaatcggagaaaagtgctgtatcaacgcgctcctagaaatattcacaggcatgtgattctgagcgaaatcaaggaggctgtcgctgcattgccacctgatgtaaccactcagtcagtgatgggatttgacccactgccgccatccgatacaatatattcttatgtcagacctgagcgcaagggggaggaagagagaaactcagtcatctggggttcacagctgtgcgtgtgtcggccgaggtcttttccctcaccgccaaacgtccaggctctggcttgtagacccctgtggcaggcaaaaagctaccaaccttggaagcaccactgctctcttctccctgtcactgtggcgaagttatatcacggcgggggtgaagcccgcgggagaagcggttggggctctgaaccccagcccgggccagagcaggctgatgcaggctgcgcgcgacatgacggccagcttcccccgcagagaccagggggggccgcccgcgggaggaggtag

SEQ ID NO: 208981 - DNA, 651 bp, Artificial Sequence
  Description of Artificial Sequence: Synthetic coding sequence
atgagccggcgggccctgcggcggctgcggggcgagcagcggggccaggaacccctcggacctggtgctctgcacttcgacctacgggatgacgacgatgctgaggaggaagggccaaagagggagctcggagtccgacggcccggtggagcaggtaaagagggcgtgagggtgaacaaccggtttgagctgattaatatagacgatctggaggatgatcccgttgtgaacggagagaggtccggatgtgccctgacagacgctgtcgcacccggcaacaagggaagagggcagaggggcaatacagagagcaagacagacggcgatgacacagagacagtcccatccgaacagagccatgcctctggcaaactcaggaagaaaaagaagaagcagaagaacaagaaaagttctactggcgaagccagtgaaaatggtctggaagacatcgatagaatcctggaacgcatcgaagattctaccggactgaaccgtccgggtcccgcccccttgagttcccggaaacacgtcctctacgtggagcatcgccacctgaatccagacaccgagctcaagcggtatttcggagctcgcgccattctcggtgaacaaagagatcgagtactgctgggctgccccgtttggttttag

SEQ ID NO: 208982 - DNA, 624 bp, Artificial Sequence
  Description of Artificial Sequence: Synthetic coding sequence
ctgaccgtgaacgccagcatgagccggttccccccccacatggtgcccccacatcacacattacacacgacaggcatcccccacccagcaattgtaacacccaccgtgaaacaagaatcttcccagtccgacgttgggagcctgcactcctccaagcaccaggacagcaaaaaggaagaagagaaaaagaaacctcacattaagaagcccttaaatgccttcatgctgtatatgaaggagatgcgggccaaagttgtcgccgagtgtaccttgaaggagtccgccgcaataaaccaaatcttgggtcgacgatggcacgctctcagtagggaggagcaggcaaaatattacgagctggccaggaaggagagacagctgcacatgcagctgtacccaggatggagcgccagagacaactacggcaagaaaaaaaaaagaaaacgcgataagcagcccggggagacgaacgatctcagtgcaccaaagaaatgcagggccagattcggccttgaccaacagaacaattggtgtggcccatgtcgccgcaaaaagaaatgtgttagatacattcagggagagggctcatgtctttcacctccctcgtctgatgggtctttgttatag

SEQ ID NO: 208983 - DNA, 669 bp, Artificial Sequence
  Description of Artificial Sequence: Synthetic coding sequence
accaaccagaacagcagcagcgacagcgaggccgagcggcggcccccaccaagatccgagagctttagagacaagagcagggagtccctggaagaagctgctaaacgccaggatggcgggctgtttaaaggaccaccataccctggatatccctttattatgatcccagatctcaccagtccctacctccccaacggatcattgagccccactgcccgtactctgcactttcagtccggatcaacacactattccgcatacaaaactatcgaacatcagatcgctgtgcagtatctgcaaatgaaatggcctctgcttgatgttcaggcagggtctctgcagtcccgccaagctctgaaagatgctaggagcccaagccccgcccacattgtaagtcctcttccctgttgcacccaaggtcacgactgccagcatttttatccaccttcagactttacggtgtccactcaggtattcagagatatgaaacggtcccactcacttcagaaagtgggcgagccttggtgcatcgaatccaacaaagtccccgtggtgcagcaccctcatcatgtacaccctctgaccccactcataacttacagcaacgaacacttcactcctggcaatcctcccccccacttgcctgccgacgtcgatcccaagacctag

SEQ ID NO: 208984 - DNA, 867 bp, Artificial Sequence
  Description of Artificial Sequence: Synthetic coding sequence
atgccccagctgaacggcggcggcggcgacgacctgggcgccaacgatgaactcatatctttcaaagacgagggcgaacaggaagaaaaatcgtcggagaattcaagcgccgagcgggacctggcagacgtcaagtcttcgttagttaatgagagtgagacaaaccagaatagctccagcgattcagaagcagaacggagacctcccccacgaagcgagagttttcgggataaatctcgagagtccctggaagaggccgcgaagcgccaggatggcggattatttaaggggcctccatacccagggtacccattcataatgattcctgatctcacttcaccctacctgcccaacggtagcttgagcccaacagcccggactctgcatttccagagcgggtctactcactacagtgcctataagacgattgaacaccagattgctgtgcagtacctgcagatgaagtggcccctgctggatgtacaggccggatctctgcagtctaggcaggcgctcaaagacgctagatcaccctcccctgctcatatcgtatctaataaggttcccgtggtgcagcatccacatcatgtgcatcctctcactccccttattacatactcaaacgagcacttcacgcccggcaatcctccacctcacctgcccgccgacgttgatcctaagacagggatccccaggccgcctcaccccccggacatttccccatactatcctttgagtcctgggaccgtgggacagatacctcacccactggggtggcagggacagcctgtatatcctatcaccaccggcggtttcagacacccgtaccctacagctctgacagtgaacgcttctatgagtcgatag

SEQ ID NO: 208985 - DNA, 1380 bp, Artificial Sequence
  Description of Artificial Sequence: Synthetic coding sequence
atgccccagctgaacggcggcggcggcgacgacctgggcgccaacgacgaactcatctcatttaaggacgaaggcgagcaggaggagaaaagctctgaaaatagctctgcagagcgcgacttggccgacgtcaagtcctcgcttgttaacgagtctgagaccaaccagaatagctcctccgatagtgaagccgagagaagacccccccctcgatccgaatctttccgggataagtcaagagaatcactagaagaggcagcaaaaagacaggacggcgggctcttcaaaggccccccttatccaggctacccatttatcatgataccagaccttaccagcccttacctccctaacggaagtctgagcccaacagcaaggacatatctccagatgaaatggccattgctggacgtgcaagcaggatctttgcagtccaggcaggccctgaaggatgcccgttcccctagtccagcccatatcgtgtcaaataaggtgcctgtcgtccagcatccccaccatgtgcacccacttacccccttaataacctactcaaatgagcatttcaccccaggcaatcctcctccccacctaccggcggacgttgatcccaagacggggattcctcggcctccgcatcccccggacattagcccctattaccctctttcgccaggtacggtgggacagatcccacatccactgggctggctggttccccagcagggccagccagtttatcctattactacaggggggtttcgacatccctatccaaccgcccttacggtgaacgcgtcaatgagcaggttccccccgcacatggtgcctccccatcatactctgcacacaaccggaattcctcatccagctattgtgacacccacggttaaacaggagtctagtcagagcgatgtcggcagcctgcacagtagcaaacaccaggactcaaaaaaggaggaggaaaaaaagaagccccacattaaaaagccacttaacgcatttatgctttacatgaaggagatgagggcgaaggtggtggccgaatgtacattgaaggaaagcgctgcaatcaaccagatcctggggaggcgttggcatgctcttagcagagaggaacaggccaaatattatgaactggcacgtaaggaaagacaactgcatatgcagctataccccggctggtccgcccgtgataactatggcaaaaaaaaaaagaggaagagggacaagcagccgggtgaaacgaacgaacacagcgagtgcttcctcaatccttgtctgtcccttccgcctatcaccgacctctctgcccccaaaaagtgccgtgctagattcgggttggatcagcagaataattggtgtggcccttgttctctctag

SEQ ID NO: 208986 - DNA, 1470 bp, Artificial Sequence
  Description of Artificial Sequence: Synthetic coding sequence
atgccccagctgaacggcggcggcggcgacgacctgggcgccaacgatgagctgatatctttcaaagatgagggtgaacaggaggagaagagctctgaaaatagcagcgctgaacgggatctggccgacgtgaaatcttccttagtgaacgaatcagaaactaaccaaaactcctcctccgattcagaagcagaacgccgtcctcctccccgttctgagtcatttcgggataagtccagggagtctctggaagaggccgccaaacgccaggatggcggtctgttcaagggcccgccttacccaggataccccttcatcatgattcctgacctgacctctccttatctgccaaacggttccctctcacctaccgcacgtacctacctccaaatgaagtggcctcttctggatgttcaagcaggaagtctgcagtcccgacaggccctaaaggacgccagaagcccctcgcccgcccacatcgtgtctccgcttccttgctgcacgcaaggccacgattgccagcacttctatcctcctagcgattttacagtgagcactcaagtcttcagggacatgaagaggagtcactcgctgcagaaggtcggcgagccttggtgtatagagtctaacaaggtgcctgtggtacaacaccctcaccatgtgcacccgctcaccccgttaattacttactcaaacgaacacttcactcccggtaatccacccccgcatctgccagcggatgtcgaccctaaaactgggattccacggcctccccatccacccgacattagtccatattacccactcagccctggaactgtcggccagattccacaccccctcggctggcttgtcccgcagcaggggcaacctgtgtacccaataacgaccgggggtttccgacacccatacccaacagctttaacggtgaacgccagcatgtctagattccctccgcacatggtgcccccacaccataccctgcacacaacgggtatccctcaccccgcgatcgtgacgcccaccgtgaaacaggagtcatcgcagagcgacgtcggctcccttcacagttccaagcaccaggactctaaaaaggaagaagaaaagaaaaaacctcacattaaaaaacctctgaatgccttcatgttgtacatgaaggaaatgagagccaaggtcgtggctgagtgtacccttaaggagtccgctgccattaatcagatactgggtcggagatggcacgctttgtcccgcgaggagcaggccaagtactatgagctggcgcggaaagagagacagctgcacatgcagttgtacccaggctggagtgcaagggataactacggaaagaagaaaaagcggaagcgcgacaagcagcctggcgagactaacggcgagaaaaagagcgcctttgcaacctacaaggtgaaagcggccgcctctgcccatccactgcaaatggaggcttattag

SEQ ID NO: 208987 - DNA, 1860 bp, Artificial Sequence
  Description of Artificial Sequence: Synthetic coding sequence
atgccccagctgaacggcggcggcggcgacgacctgggcgccaacgatgagctaatctccttcaaggatgagggtgaacaagaggagaaatcatccgagaactccagtgccgagagagacctggccgatgtcaaatcatcactggtgaacgagtccgagaccaaccaaaactcctcatcagatagtgaggctgaacggcgccctcctcctcggagcgaaagtttccgggataaatcaagagagtcactagaagaagccgcgaaaaggcaggatgggggactgttcaagggtcccccgtatcctgggtatccatttattatgatccccgatctgaccagcccgtatttaccaaacgggtctctctcacccacagccagaacactccatttccagtccgggtctactcactactcagcttataagacgatcgagcatcagatcgccgtccagtatctgcagatgaagtggcccctgttagatgtccaggccggatctctacagagccgacaggcactcaaggacgctcggtccccatctccagcacacatcgttagcaataaggttccggtagtccagcacccacatcatgtgcatcctctgacccccctgatcacttattcaaatgaacattttactccaggcaacccacctcctcatctcccagccgacgtggatccaaagaccggaatccccagacccccacatccacctgatatatctccctattaccctctgagtcccggcactgtaggtcagatcccccatcccctggggtggttagtcccccagcagggacagcccgtgtatcctataacaaccgggggctttcggcatccttacccgactgccttaaccgtgaacgccagtatgtccagatttccaccgcatatggtcccaccgcaccacacactgcacacgacaggcattccacaccccgctattgtgaccccaactgtgaagcaggaaagtagccagagcgatgtggggagtctccatagctcaaaacaccaggatagcaaaaaggaggaagagaagaaaaagccgcatatcaagaagccactcaatgcattcatgctatacatgaaggagatgagagccaaagtggttgcagagtgtacattgaaagagtccgccgccataaaccagatcctgggacggcgctggcacgccctatctagggaagagcaggccaagtattatgagctcgcgcgcaaagaaagacaattacacatgcaactttaccctggatggtccgcgagagacaattatggtaagaagaaaaagcgaaagcgcgataagcaacctggagagacgaacgagcattccgaatgctttctgaatccctgtctgtcgctgcccccaataacagacctaagtgcacctaagaaatgtcgagctcgattcggcttggaccagcagaataactggtgcggcccttgtaggcgcaagaaaaaatgtgttaggtacatacagggcgagggctcttgtctatcgccaccatccagcgacggatccctgctagactccccaccgccctctcctaacctcctgggctctcccccccgtgatgcaaagtcccagactgaacagacccagcccctgagtctgtcccttaagcctgaccctctcgcccatttgagtatgatgcccccgccccctgcattgctgcttgcagaggcgactcacaaggcttccgctctttgtccaaatggggctctcgacctcccccctgctgcccttcagccagccgcgccgagctcttccatcgctcagccaagcacctcctctctgcacagccacagttccttggccgggactcaaccccaacctctgtccctggtcacaaagtccctcgagtag

SEQ ID NO: 208988 - DNA, 363 bp, Artificial Sequence
  Description of Artificial Sequence: Synthetic coding sequence
atgctgtacatgaaggagatgcgggccaaggtggtggccgagtgcaccttgaaagagtctgctgccatcaatcagatacttggcaggaggtggcacgcactctctcgggaggagcaggctaagtactatgagcttgctagaaaggagagacaattgcatatgcagctgtatccaggatggtctgcccgggataattacggaaagaaaaagaagagaaaacgcgataagcagcccggagagaccaacgatctcagcgcccccaaaaagtgccgagctcggttcggtctggatcaacagaataattggtgcggaccttgcaggtgcaaatactcgaaggaagtttcaggcacagtgcgtgcttag

SEQ ID NO: 208989 - DNA, 531 bp, Artificial Sequence
  Description of Artificial Sequence: Synthetic coding sequence
atgagccggttccccccccacatggtgcccccccaccacaccctgcacaccactgggataccccatcccgccatagtgaccccaaccgtgaagcaggagtcctcacagagtgacgttggctcactacatagctccaagcaccaggactcgaagaaggaagaagagaagaaaaagccgcacattaagaagcccctgaacgcctttatgctctacatgaaagagatgcgcgcaaaagtggttgcggagtgtacgcttaaggagagcgccgccatcaatcagattctgggtcgccgctggcatgctttgagtagagaagaacaagcaaaatactacgagttagcgagaaaagaacgccagctccatatgcagctgtacccagggtggtccgcacgtgataactatggcaagaaaaagaaacgaaagcgtgacaaacaaccaggcgaaacgaacggtgaaaagaagtccgccttcgctacatacaaggtgaaagctgcggcgtcagcccacccactacagatggaggcttactag

SEQ ID NO: 208990 - DNA, 954 bp, Artificial Sequence
  Description of Artificial Sequence: Synthetic coding sequence
atgccccagctgaacggcggcggcggcgacgacctgggcgccaacgacgagctgatctctttcaaggacgagggggaacaggaggaaaagtcctcggaaaattcctctgccgagagggaccttgccgacgttaagtcctcactggtgaatgaaagcgaaactaatcaaaactcttcaagtgatagcgaggcagagaggcgacccccccctcgcagcgaaagctttagagacaaaagccgcgagtcgctggaagaggcagccaagagacaggatggaggactattcaaaggtcccccctatccaggatacccattcatcatgattcccgaccttacatctccgtatctcccaaatggatcattatcacccactgccaggacttatttacagatgaaatggcccctacttgatgtccaggcaggatcccttcagagtcgccaggcgcttaaagacgcaagatcgcctagtcccgcacacatagtgcagtcaccgttaccttgctgtacacaggggcacgactgtcagcatttttacccgccgtctgattttaccgtgagcactcaggtgttccgagatatgaaaagaagccatagtctccaaaaagttggcgagccctggtgtatagagtctaacaaagtgcccgtcgtgcagcatcctcaccatgtgcacccactgacaccactgataacctactctaatgagcactttacacccggaaaccctcccccacacctccccgccgatgtagatccaaaaaccggaataccgagaccaccacaccctccagatatttcaccctactatcctttaagtcctggaaccgtggggcaaataccccaccctctcggatggctagttccacagcagggacagccagtgtatccaataactacaggaggctttagacatccgtacccaacagcgctgactgtaaacgcctctatgtcccgctag

SEQ ID NO: 208991 - DNA, 1791 bp, Artificial Sequence
  Description of Artificial Sequence: Synthetic coding sequence
atgccccagctgaacggcggcggcggcgacgacctgggcgccaacgacgagctgataagttttaaggacgagggggaacaagaggagaaatcctcagaaaattcttctgcagaaagggacctggctgatgtgaagtcaagcctggttaatgagtccgaaacaaaccaaaattcgagctctgattcagaggccgaaagacggccacccccaaggagcgagtcatttcgcgataagtcacgtgaatctcttgaggaagccgcaaaacgacaggacgggggcctttttaaaggtccaccataccccgggtatcccttcattatgattccagacttaaccagtccctatttacccaacgggagcctgagtccaacggcccggacttacctgcagatgaaatggcccttgcttgatgtccaagcagggtccctccagagtagacaggcgctgaaggacgcccggtccccctcaccagcccacatcgtctccaataaagtgcccgttgtccagcatcctcatcacgtgcatcctctcaccccacttatcacttatagcaatgaacactttactccaggaaatccaccacctcatcttccagcagacgtggaccccaagaccgggattcccaggcctccccatccacccgatatctccccctattatcctttaagtccaggtactgttggccagatcccccacccattagggtggctggtgccccagcagggacagccggtgtacccaatcacgacgggcggcttcagacatccttatcccactgcactaactgtgaacgcatccatgtctaggttcccaccccatatggtgccccctcatcacactctccacactacgggcatccctcacccagccattgttactcccactgtaaagcaggaaagttctcaatcagacgtagggagcctacactcaagcaaacaccaagacagtaaaaaggaggaggagaagaaaaaaccccatatcaagaagccgctgaacgcctttatgctctacatgaaggagatgcgtgcaaaggtcgtggcagaatgcaccctgaaggaatctgcagctattaaccaaatcctgggaaggagatggcacgctctgtcccgcgaagagcaggctaagtactacgagttagccagaaaagaaaggcagttgcatatgcagctgtacccaggctggtctgcacgggataattatggaaagaagaaaaagagaaaaagagataaacagccgggcgagacaaatgagcacagcgagtgcttcctgaacccctgcctttccctgccccctattacggatctctccgctccaaaaaaatgccgagcacggtttggacttgatcaacagaataattggtgtggcccttgtagaagaaaaaagaaatgtgttcgttatattcagggagagggatcttgtctttcccctccatcctccgacggtagcctccttgacagtcctccccccagtcccaacctcctcgggagccctcctagggatgctaaatctcagaccgaacagacccaacccttatcgctctctctcaaacctgacccattagcccacttgtcaatgatgcccccgccacctgctctactcctcgctgaagcaacccataaggctagtgcgctgtgtccgaacggtgcgttggacttaccaccagcagcgctgcagccagctgccccttcatcctccattgcccaaccttctacatcaagtctgcattctcactcttccctggccggaacgcagccacagccgttgtccctggtgactaagtctctggaatag

SEQ ID NO: 208992 - DNA, 1485 bp, Artificial Sequence
  Description of Artificial Sequence: Synthetic coding sequence
atgccccagctgaacggcggcggcggcgacgacctgggcgccaacgacgagctcatatcctttaaggacgagggagaacaagaggaaaaaagctcagaaaatagctccgcagagagggacctcgctgatgtgaagtcatctctcgttaacgagagtgaaacgaaccaaaattcatcaagtgactcagaggccgaaaggcgacccccgccacgctccgaaagcttcagggacaagagtagggagtccctcgaggaagctgcaaagcggcaagacggagggctgtttaaaggaccgccttatcccggctatccctttatcatgattccagacctaacaagtccctatctacccaacggctccctcagcccaacggcccgcaccctgcatttccaatccggctctacccattactccgcttataaaaccatagagcaccagatcgcagtccaatatcttcagatgaagtggcccctgctggatgtacaagccggcagtctgcaaagccgacaagcacttaaggacgcccggtctccttccccggcccatatcgtgtcaaacaaggtcccagtggtgcagcatccccaccatgtgcatcccctgacgcctctgatcacgtattcaaatgaacattttacgccaggtaaccctccaccacacctccctgcagacgtcgaccccaaaacgggaatacctcggcctccccatcctccagatatcagtccttactatcccctgtcacctggaaccgtgggccagatcccgcatcccttgggctggctggttcctcagcaaggacagccggtctaccctatcacgactggtgggttcaggcatccataccctactgccttgacagtaaacgcctcaatgagcagattccccccacacatggtgcccccacaccacacattgcatacaacgggaattccccaccccgccatcgtcactcccacagtcaagcaggagtccagtcaatccgatgtaggatcgctccattcctcgaaacatcaagattcaaaaaaggaggaggagaaaaaaaaaccacatataaaaaaaccattaaacgctttcatgctgtatatgaaagaaatgagagctaaggtcgtggctgaatgtacactaaaagaaagcgctgctatcaatcagatactcggccggaggtggcacgccctgtccagagaagaacaggcgaagtactacgagctggccagaaaggaacgacagctgcacatgcagctgtaccccggatggagcgcacgggacaactacggaaaaaagaaaaagagaaagagggataagcaacccggcgagaccaacgaacactcagagtgcttcctcaacccttgcttatccctcccaccgatcacggatctgagcgctcctaaaaagtgtcgggcccggtttggcctagatcagcagaacaattggtgcggcccctgccgctgcaagtactctaaagaggtgtctggaaccgttcgggcctag

SEQ ID NO: 208993 - DNA, 1809 bp, Artificial Sequence
  Description of Artificial Sequence: Synthetic coding sequence
atgccccagctgaacggcggcggcggcgacgacctgggcgccaacgacgagctgatcagctttaaagatgagggagagcaggaagagaaatcttcggaaaacagttcagctgaacgtgatcttgctgatgtcaagagcagcctcgtaaacgagagcgagaccaaccagaattcttcttctgattcagaggcggagcgccgtcccccccctcgttcagaaagctttagggacaaatctcgcgagtccctggaagaagccgcaaagaggcaggatggtggcttgttcaaaggaccgccctacccggggtatccgtttataatgatcccagatctgacctctccataccttcctaacggatcactgtcaccaaccgccaggacactacatttccagagcggatccacccactatagcgcctataaaacaatcgagcaccagattgccgtgcagtacctgcaaatgaagtggcccttactcgatgttcaggcagggtccctccagtcacgccaagcccttaaggatgccaggtcacccagccctgcacatattgtcagcaacaaagtgccggttgtgcaacacccccaccacgttcaccccctgactccacttattacctatagcaatgagcattttacccccggtaaccctccaccccatttgcccgccgacgtggaccccaagaccgggatacctcgccccccgcaccctccagacatttctccttactaccccctctcgccagggaccgtgggccagattccacaccctctggggtggctggtcccccagcagggccaaccagtgtacccaatcacgacaggcggctttcgacatccctacccgacggcactgactgtaaacgcttctatgagtcggttcccccctcacatggttcctccccatcacactctccacacaaccggcatccctcatccagcaattgtgactccaaccgtaaaacaggagagctcccagagtgatgtgggtagtctgcattcctccaagcaccaggacagcaaaaaggaagaagaaaaaaagaaaccccacattaaaaaaccattaaacgcgttcatgctatacatgaaagaaatgcgcgcaaaggtggtggccgaatgtaccttaaaagagtctgccgctattaaccagattctggggagacgctggcatgcactttctcgagaagagcaggccaagtattatgaactggccagaaaggaacgacaactgcatatgcagttatatcccggatggtctgccagagataactatggtaagaagaagaaacggaagcgggataagcaaccgggtgaaaccaacgaccttagtgcacccaagaaatgcagggctagattcggcttggaccaacagaataattggtgtggcccctgcagaaggaagaagaagtgtgtgaggtatatccagggggagggtagttgcctatcaccgccatcctccgatggaagcttgctagatagtcctcctccttcacccaaccttctcggcagtcccccaagagatgccaagtcacagactgagcagacacagccgttgagcctctctctgaaacccgatccactggcccacttatcaatgatgccccccccccccgccctcctacttgccgaggccacacataaggctagtgccctctgcccgaatggagctctcgatttgccgccagccgccctccagcctgcagcgccgagttcatccatcgcgcagccaagcacctcgtctctacattcgcattcctccctcgccggaacgcagcctcaaccactgagccttgtgactaaaagcctggaatag

SEQ ID NO: 208994 - DNA, 1449 bp, Artificial Sequence
  Description of Artificial Sequence: Synthetic coding sequence
atgccccagctgaacggcggcggcggcgacgacctgggcgccaacgatgaactgatcagctttaaagacgagggcgagcaggaagagaaatccagcgaaaactcctccgctgagagggatctagccgatgtcaagtctagcttagttaacgagagtgagacaaaccagaactcctctagcgattcggaagcagaaagacgccctcctcctcggtctgagtccttcagggacaaaagccgagagagcctagaggaagccgccaagcggcaggacggagggttatttaagggacccccttacccaggctacccctttattatgatccctgatctcaccagtccttacctgcctaatggttcactttccccaacagctcgaacattacacttccaatccggcagtacacactactcggcatacaagactatcgaacaccaaattgccgttcagtacctgcaaatgaaatggccccttctcgacgtccaggccgggtcacttcagtctagacaggccttgaaggatgctcgcagtcccagtccggcacacatagtgtcaaataaggtgccagtggtccagcacccccaccacgttcaccctctgacacctctgataacctactctaacgaacacttcacacccgggaacccccctccgcacttgcccgcagatgtggaccctaagacaggaataccaaggccgcctcatccaccagatatctctccctactacccactctcacccggaacagtcggtcagatcccgcacccgctcggttggcttgttccacagcagggccagcctgtgtatccaattacgacaggtgggttcagacacccataccctacagcacttaccgtgaatgcttccatgagcagattcccccctcacatggtaccaccacaccatacactgcacaccaccggcattccccacccagcaatcgtaacgcctaccgtcaagcaggagtccagtcaatccgacgtgggctcattgcacagctctaagcaccaggatagtaagaaagaggaagagaagaagaagccacacattaagaagcccctgaacgccttcatgctttatatgaaggaaatgcgcgccaaggtagtagccgaatgtaccttgaaggagtcagccgcaatcaatcagatcctgggcaggcgctggcacgccctgtcaagggaggagcaagccaagtattacgaattagccaggaaagagaggcaactgcatatgcagttgtacccaggatggtcggccagagataactacggaaagaaaaaaaaaaggaagagagataaacagcccggagaaaccaacgaacattccgagtgtttccttaacccatgtctgagcctacctccgatcaccggtgagaaaaagtccgcattcgcgacatataaggtaaaggctgctgcaagtgcgcaccccctgcagatggaagcatactag

SEQ ID NO: 208995 - DNA, 1008 bp, Artificial Sequence
  Description of Artificial Sequence: Synthetic coding sequence
atgagcagcttcctgagcagccggttccccccccacatggtgcccccacatcacaccttgcataccacaggaattcctcatccagctattgttacacccactgtgaaacaggagtcaagtcagtccgacgtcggtagcctgcactcttctaaacaccaggattcaaaaaaggaggaagagaaaaagaaacctcatattaagaagcccctgaacgcatttatgctgtacatgaaagagatgcgcgctaaggtggttgcagaatgtaccctaaaagaatctgccgcaatcaaccaaatattaggacgtcgctggcacgcactgtcacgcgaggagcaggccaagtactacgagctagcgagaaaagaaagacagcttcatatgcagctgtacccggggtggtccgccagagacaattacggcaagaagaaaaagcggaaacgcgataagcagcccggcgagaccaacgagcattcagaatgttttctcaatccgtgcctgtcattgccaccgattacagacctgtcggctcctaagaaatgtagggctcggttcggcctggaccagcagaacaattggtgcggaccctgcagaagaaaaaagaaatgcgtgagatacattcagggcgaaggttcatgtctgagcccccccagcagcgacggcagtctcctcgactcgcctcctcccagtccaaacctattaggatcccctcctagagatgcaaaatctcagacggagcagacgcagccactttccctttccttgaaaccagacccacttgcacatctgagcatgatgccccccccccccgctctgctgttagctgaagcaactcataaagcctctgcactgtgtccaaacggcgctctcgatctaccacccgctgctctgcagccagccgctccctcttcatctatagctcagccatctactagttctctccacagtcactcgtctttagcaggaactcaaccacagccactttcactggtaacaaaatcactggaatag

SEQ ID NO: 208996 - DNA, 1809 bp, Artificial Sequence
  Description of Artificial Sequence: Synthetic coding sequence
atgccccagctgaacggcggcggcggcgacgacctgggcgccaacgacgagctgatttcattcaaagacgagggtgagcaggaagagaaatcaagtgagaattcaagcgccgagcgcgatctcgctgacgtgaaatccagtctcgtgaatgaaagcgagacaaatcaaaacagtagctcggacagcgaagcagagcggcggcctccaccacggtccgagagttttcgggataaatcccgggaatctctcgaggaagccgctaaacgacaggacggcggactattcaaggggcccccttaccccggatacccttttatcatgatccctgatctgacttcaccttatcttccaaatggctccctcagtcctacagcccgcacactgcatttccagagcggttccactcactattcggcctacaaaacgatcgaacatcagatcgccgtccaatacctacagatgaagtggcccttactcgatgtgcaggccggaagcctacaatccaggcaggccctcaaggacgcccgatctccatctccagctcatatcgtgagcaacaaggtgccagtggtgcagcatccacatcatgttcaccccttaacacctctgatcacctattccaacgagcactttactcccggaaacccccctccacacctccctgccgacgtggatccgaaaacaggcattcccagaccaccacatccacctgacattagcccttattacccactgtcccctggtaccgtgggacagattcctcacccactgggctggctggtgcctcaacagggacagcccgtctatccaattacgactggcggcttcaggcacccatacccaaccgcccttacggtgaatgcatccatgtccaggttcccaccgcacatggttccaccccaccataccctgcatactactggcattccccacccagccattgttacaccaaccgtgaagcaggaaagttcacagtccgacgtggggagcctgcacagttctaagcatcaggattctaaaaaagaggaggaaaagaagaaacctcacataaaaaagccattgaacgcctttatgctgtatatgaaggagatgagagccaaggttgttgccgaatgcacgcttaaagaatcagctgcaattaatcagatcttgggtaggcgctggcacgccctctcacgtgaggaacaggccaagtattacgagctcgcacggaaggagcgtcagctccacatgcagctgtatccgggctggtcagcccgtgataactatggcaagaagaagaagaggaaacgggataagcagccaggtgagacaaacgatgccaacactccgaagaaatgcagagccctgtttggtctcgatcgccaaaccctatggtgtaagccctgccggcggaagaaaaagtgtgttagatacattcaaggtgaaggcagttgcttgagtcccccctcctcagatggcagtctgctcgactcacctcctcccagcccaaatctccttggaagccccccacgcgatgcaaagagccagacagaacagacccaaccgctctccctatctctgaaacccgatcctctcgcacacctgtccatgatgcccccacccccggccctattattggccgaggccacacataaagccagcgctctgtgccctaacggagcccttgatctgcccccagccgcgctacagccggctgctcccagctcttcgattgcgcagccctcaaccagttctctgcatagtcattcttccctggcaggcacacaaccccaacctttgagtctagttacaaaatccctggagtag

SEQ ID NO: 208997 - DNA, 1860 bp, Artificial Sequence
  Description of Artificial Sequence: Synthetic coding sequence
atgccccagctgaacggcggcggcggcgacgacctgggcgccaacgatgaactgattagtttcaaggatgaaggcgaacaggaagaaaaatcttccgaaaacagctccgcagagagggacttggccgacgtcaaatcaagtctggtgaatgaatccgaaacaaaccagaatagttctagcgactctgaggctgagagaaggccaccaccgcgatcggagtcttttcgggacaaaagtagagaatcactagaagaagctgccaagagacaggacggcggcctcttcaagggcccaccttaccctggctaccctttcatcatgattcccgatttaacaagcccgtacctgcctaacggttccctgtcccccaccgctaggacgctccacttccagtctgggagtacccactatagtgcgtataaaacaattgaacaccaaattgcggttcagtacctgcagatgaaatggcctcttctcgacgtccaggccggtagcctccagtccaggcaggcactcaaagacgcacggagcccaagccccgctcatatcgtaagtaacaaagtgccggtggttcaacacccgcaccacgtgcacccgttaacccctttgattacatattctaatgaacatttcacgcctggaaacccgcctccgcatcttccagccgatgtagatcccaagaccgggattccccgcccgcctcaccctccagacattagcccttattatcccttaagtcctggcaccgttggacagattcctcacccgttgggatggttggtgccacagcagggccaaccagtttaccctataaccacagggggcttcagacatccatacccgaccgcactcactgtgaacgcgtctatgagcagatttccacctcatatggttcccccacaccacacactgcacacaacaggaattccacatccagccatagtcacccccacagtaaagcaggagagcagccaatcagatgtggggagtctccactccagtaagcatcaggactcaaaaaaggaagaagaaaagaaaaaacctcatataaagaagccactgaatgcatttatgttgtatatgaaagagatgcgcgcaaaggtggttgctgagtgtacgcttaaagaaagcgccgctattaatcagatcttaggacgccggtggcacgccctgagtcgcgaagaacaagccaaatactacgaattggctcgcaaagagcggcagctccatatgcagctttatccagggtggtccgcacgagacaactacgggaaaaagaagaaaagaaagcgcgacaagcagccaggggagactaatgaacattctgagtgttttctcaacccgtgcctgtcccttcctccaatcactgatgctaacacgcccaagaagtgtcgagctctgttcggcttagaccggcagactttatggtgcaagccatgccgccgcaaaaagaagtgtgtgcggtatatccagggtgaaggatcatgtctgagccccccatcctctgacgggtccctattagactctccccccccttcacctaatttgttgggctccccgcctcgtgatgccaagagccaaacagaacagactcagcccctgagcttgtctcttaaaccggaccctctggcccacttgtccatgatgccacctccaccagctttgctgcttgctgaggctactcataaggccagcgcactgtgtcctaacggggcgctcgacttgccccctgcagctctccagccggccgctccaagctcgtctatagcacaaccgtcaacatcgagcctccactctcactccagccttgccggaacccagccacagccgctctctctggtcacgaaatcactcgagtag

SEQ ID NO: 208998 - DNA, 645 bp, Artificial Sequence
  Description of Artificial Sequence: Synthetic coding sequence
atggccttcctgcggagcatgtggggcgtgctgagcgccctgggccgctccggagcggagctgtgtacgggatgtgggtcaagactgcggagtcctttctccttcgtctacctgcctaggtggttctcctccgtgctcgcgagttgtcccaagaaaccagtcagtagttaccttagattttccaaagaacagctgccaatttttaaggcccagaaccccgacgccaaaaccaccgaactgattcgacggattgcgcagcgatggcgcgagcttcccgactcgaagaagaagatctaccaggacgcataccgcgcagagtggcaggtgtataaggaggagatatcccggtttaaggagcagctgacgccttcgcagattatgagtctggagaaggagataatggataagcatctgaaacggaaagccatgacgaaaaagaaagaaaaactgaaaaccgtgaaagaaaactggaaaaacctgtcagactccgagaaggaactgtacatacagcacgcaaaggaggacgagactaggtaccacaatgaaatgaaaagctgggaagaacagatgattgaagtggggcgcaaggacctcctgcggcgaacgatcaagaagcagaggaagtatggagctgaggagtgttag

SEQ ID NO: 208999 - DNA, 660 bp, Artificial Sequence
  Description of Artificial Sequence: Synthetic coding sequence
tgagagctgtgcaccggctgcggcagccggctgcggagccccttcagctttgtctatctcccacggtggtttagctcagtgcttgccagctgccccaagaagccagtctcaagctacttacggttctcaaaggagcagctcccgatctttaaggcgcaaaatcccgatgccaaaacaacagaactcatcaggagaatcgctcagcgttggagggagctgccagatagcaagaaaaaaatctaccaggacgcatatagggccgagtggcaggtatacaaagaggaaataagtcggtttaaggagcagcttacacctagccagatcatgtcacttgaaaaggagattatggacaagcacctcaagcggaaggccatgacaaagaagaaggaactgaccctgctgggaaagcctaagcggccgcgctctgcttataacgtttacgtggctgaacgattccaggaggccaaaggcgacagccctcaggagaagttaaaaactgtcaaagagaattggaagaaccttagtgacagtgagaaagaggtttcgatcacagtggtgagtctcaaatgcctgctgcggatcagcgtgagagagtgcataagagcaagattagacagctgtgaggacaacctggtgctgctgatcatacaagtgttctag

SEQ ID NO: 209000 - DNA, 741 bp, Artificial Sequence
  Description of Artificial Sequence: Synthetic coding sequence
atggccttcctgcggagcatgtggggcgtgctgagcgccctgggccgctcaggagctgagttgtgcaccggctgcggctcacggctgaggagtccattctcctttgtttacttaccacggtggttctcgtcagtcctggcatcttgcccgaagaaacccgtgtcttcgtatctgagattcagcaaagagcaattacccatattcaaggctcagaatccggacgccaaaaccaccgaactcattcgcaggattgctcagcgatggagagagctgccggattccaaaaagaagatttaccaggacgcatacagggctgaatggcaagtatataaggaggagatcagccgctttaaagaacagctgacaccctctcagatcatgtccttggaaaaggagattatggacaagcatctgaagaggaaggcaatgacgaaaaagaaagagttaacattgctcggtaagccaaaacgcccaaggagtgcatataatgtgtacgtggccgaacgttttcaagaggcaaaaggtgatagcccccaagagaaactcaaaacagtcaaagagaattggaagaatcttagcgatagcgaaaaggagctctatattcagcacgccaaggaagatgagactagatatcacaacgagatgaagagttgggaggagcagatgatcgaggttggccgaaaggatctccttagacggaccattaaaaaacaacggaagtatggtgctgaggagtgctag

SEQ ID NO: 209001 - DNA, 1302 bp, Artificial Sequence
  Description of Artificial Sequence: Synthetic coding sequence
atgagcatcctggccaagatgggcgactggcaggaccggcacgacggaacatctaatggcacagctagactccctcagctgggaacagtcggtcagagtccctatacctcagctccccccttgtcacacacgcccaacgccgatttccaaccaccatactttccccccccttatcaacctatttatccacagtcccaggacccatattcacacgttaatgatccttactccttgaaccccctccacgctcagcctcagccacagcatccaggctggccggggcagcgccagagccaggagtctgggctgctccatacccacagaggcctccctcaccagctgtccggcctggacccccgaagggattaccgccgtcatgaggacctgttgcacggacctcatgctcttagttctggtcttggggatctgtctattcattcactcccccacgctatcgaagaggtgccacacgtagaagatcccggaatcaatatccccgaccaaacagtgattaagaaagggcctgtgagcttgagcaaaagcaactctaatgcggtatccgcaatccccatcaacaaagataatctcttcgggggcgttgttaatcccaacgaggtattttgctctgttccaggccggttgtcgctgctcagctctacctccaagtacaaagtgaccgtggcagaggtgcaacgccgcctgagtcctcctgagtgtctgaatgcctcccttcttggcggtgtactaaggagagcaaaatctaagaacggggggcgctcacttcgggagaagctcgacaaaattgggcttaaccttccggccgggaggcggaaagccgcgaatgtgactctactgacaagtttggttgagggcgaggctgttcatctggcacgcgatttcggctatgtctgcgagaccgagtttccagctaaggccgttgcagagtttctgaaccgccagcactccgaccccaatgagcaggtcaccaggaagaatatgctgctggccaccaagcagatctgtaaagaattcactgacctcttggcccaggatagaagcccattgggtaattcccggccgaatcctatcctggaacctggcattcaatcctgtctaacgcactttaacttaatatcccatggatttggttcacctgctgtttgtgctgctgtgactgctctgcagaactatctcactgaagctcttaaggccatggataaaatgtacttaagtaacaacccgaacagtcatacggataacaatgcaaaatctagtgataaagaggagaagcatagaaaatag

SEQ ID NO: 209002 - DNA, 1314 bp, Artificial Sequence
  Description of Artificial Sequence: Synthetic coding sequence
atgctgtggaagctgaccgacaacatcaagtacgaggactgcgaggatcgacacgatggtactagtaacggaaccgcgagacttccccagctcggcaccgtgggacaaagtccttacacctctgctccaccactgagccacaccccgaatgcagatttccaacctccttacttcccccccccttaccagccaatctatccccagtctcaagacccgtactcccacgtgaacgacccctacagcttaaatcctctccacgcccaacctcagccgcaacaccctgggtggcccggccagcgtcagtcccaggaatcaggtctactccacacccacagaggcttgccccatcaactcagtggactggaccctcggagagattacaggcgacatgaggatctccttcatggtccgcacgccctctcctcaggcctaggggacttgtccattcattctctgccccacgccatcgaagaagttccccatgttgaagatccaggtattaatattcctgatcagacggtcattaagaagggacctgtgtccctttcaaagtcgaatagcaatgccgtctcagccatacctataaataaagacaatctgtttggaggtgtcgtgaatcccaacgaggtattctgctccgtccctggaagattgtctttgctgtcgagtacctccaagtacaaagtcaccgttgcagaggtgcagcgcagactgtcccctccagagtgccttaatgcctcgcttctgggcggcgtactgagaagagccaagtctaaaaacggaggacggagtctccgcgagaagctcgataaaattgggcttaacttgcctgctggccgacgaaaagccgcgaacgtgacactgctgacatcattggtggagggcgaggccgtccacttggcaagggactttgggtatgtgtgtgaaactgaattccccgccaaggccgtcgcagaatttttgaaccggcagcactccgaccctaatgaacaggtgacacgaaagaacatgctgttggctacaaagcagatatgcaaggagtttaccgacctcctggctcaggataggtcgccgctaggcaacagcagaccaaatcccatccttgaacctgggatacaaagctgtctgacccattttaatctgatttcacacggtttcggttctcctgctgtttgcgcagccgtgaccgctcttcaaaattatcttactgaggctttaaaagcgatggacaagatgtatttgtctaataacccgaatagccacaccgacaataacgctaagtcttccgacaaagaagaaaagcatcgcaagtag

SEQ ID NO: 209003 - DNA, 1296 bp, Artificial Sequence
  Description of Artificial Sequence: Synthetic coding sequence
atgctggtgcacagcttcagcgccatggaccggcacgacggcacctccaacggaacagctcgactgcctcagctaggcaccgtcggccaatcaccgtatacctccgcacctccccttagccacacacctaacgctgattttcaacctccctattttcccccaccgtatcaacctatttatcctcagtcgcaagacccctacagccacgtgaacgatccttactccttaaatccacttcacgcccagcctcagcctcagcatcctggctggcctggtcagcgacagagtcaggaatccggcctgttacacactcatcgaggtctaccccatcaactcagtggcctagatcctcgtcgggattatcgacgccacgaggatctcctgcacggaccccacgcactttctagcggactgggcgatctgagtatccatagcctgcctcacgcaattgaggaagtgccgcatgttgaggacccaggcataaacattcccgatcagactgtgatcaagaaggggccagttagcctgtccaagtctaattctaatgccgtgtcagcaatccccataaataaggacaatctcttcggtggggtagtaaacccaaacgaagtcttttgctctgtcccaggtcggctcagtctcctctcatccacatccaaatacaaagtaacagtcgccgaggtccagcgccggttgagcccgcctgagtgtctcaatgcttctctgttgggcggcgttcttaggcgagctaagtccaaaaatgggggccggagccttagggaaaaactggacaagatcgggttaaatttgccggcggggaggaggaaggccgcaaatgttactctgctcacaagcctggtggagggagaggctgtgcatttggcaagagattttgggtatgtgtgtgagaccgaattccctgctaaggcagtcgcggagttcctgaacagacagcacagcgaccctaacgaacaggtgacacgcaaaaacatgctgctcgccacgaagcagatttgtaaagagtttactgacctactggcccaggacaggagccctctgggcaattcccgtcctaatccgattttagaacctggtattcagtcgtgcctgacccactttaacctcatctcacacggctttgggagccctgccgtgtgcgctgctgttactgccctccagaactacctgactgaagctctcaaagccatggataagatgtatctatcaaataatcctaatagtcatactgacaataacgccaagagctcagacaaagaggaaaagcataggaagtag

SEQ ID NO: 209004 - DNA, 1320 bp, Artificial Sequence
  Description of Artificial Sequence: Synthetic coding sequence
atgaagatgctgtggaagctgaccgacaacatcaagtacgaggactgtgaggatcggcacgatggcacaagcaacggcacggccaggctgcctcagctgggaaccgtcgggcagagtccctacacctccgcccccccattatctcacactcctaacgccgattttcagccgccttatttcccccccccatatcagcctatttatccccagtcacaggatccttacagccatgtgaatgacccatactctctcaatcccttgcatgctcaaccacagccccagcacccagggtggcctggacagcgccagagtcaagagagcggccttctgcacacccacaggggcctcccgcatcagctgtccggtttggacccaaggcgagactaccgtaggcacgaggatctcctgcacgggccacacgccctgagctccggtctaggggacctctcgatccactcactccctcacgctattgaggaagtccctcacgtcgaggatcctggtatcaacatacccgaccagacagtgatcaagaaaggacccgttagcttgtccaaatccaacagtaacgccgtcagcgcaattcctatcaacaaagacaatctgttcgggggggttgtgaatcccaacgaagtcttttgcagcgtaccggggagattatccctgctaagcagcacaagcaagtataaggtcaccgtcgctgaggttcagagaaggttaagcccacccgagtgccttaatgcgagcttactaggaggtgtgctccggcgcgccaagtcaaagaacggcgggcgtagcctaagagagaagctcgataagattggtctaaatcttccagctggccggcggaaggcagcaaatgtgactcttctcacttccctggtggaaggtgaggccgtccacctggccagagatttcgggtacgtctgcgaaacagagttcccggcaaaggccgtggcagaattcctgaatcggcagcatagcgaccccaacgaacaggtcacccgaaaaaatatgctgctcgctaccaagcagatctgtaaagaattcaccgatctgctggcacaggataggtctcctttagggaacagcagacccaaccctatcctcgagccaggaatccagagttgcctgactcactttaacctgatatcccacggtttcggatctccggccgtctgtgctgcagtaaccgccctgcagaactatctgacagaggcactcaaggctatggataagatgtacctgtcgaacaatcctaattctcataccgacaataatgcaaagagttctgacaaggaagagaaacatcgcaagtag

SEQ ID NO: 209005 - DNA, 987 bp, Artificial Sequence
  Description of Artificial Sequence: Synthetic coding sequence
atgctgtggaagctgaccgacaacatcaagtacgaggactgcgaggaccggcatgacggaactagtaacggaacggctaggttaccacagctgggtaccgttggtcaatcgccatatacttcagcccctccgctaagtcatacgcccaatgcggatttccagcctccctacttcccgcctccttaccagcccatttatcctcagtcccaggacccatactcacacgtgaacgatccttactcccttaatccactccacgcacaaccacagccgcagcacccagggtggccagggcagaggcagtctcaggagtccggcctcctgcacactcatcggggcctcccacaccaattgtcaggtctggacccaagacgagattatcgtcgccacgaggacctgctacacggcccacacgccctgagcagcggcctgggggatctctctatccactcccttcctcacgcaattgaagaagttccccatgtggaggatcctggtattaacatcccagatcagaccgtgatcaagaaaggccccgtaagtctgagcaaatctaacagcaatgctgtgagcgccattcccatcaacaaagataacttattcggaggcgtcgtgaaccccaatgaggtcttctgttctgtgccaggtcgcctaagcttgttaagctccacctccaaatataaagtgacggtggccgaagtgcagcgcagactctccccccctgaatgccttaatgctagcctgttggggggagtgcttcggcgcgctaaatctaagaacggtggacgcagcctccgagaaaaactggataaaataggcctcaatttacctgcgggaaggcgtaaagccgcaaatgtcactcttcttacgagcctggtggaagaccgctacgcgaaaagttctcctacctgctggctgagaactgatctgccctggggcactcatggccctacgccctcctggtcgcccgcctcacgggctgcctag

SEQ ID NO: 209006 - DNA, 1314 bp, Artificial Sequence
  Description of Artificial Sequence: Synthetic coding sequence
atgctgtggaagctgaccgacaacatcaagtacgaggactgcgaggatcggcacgatggcacgtctaatgggacagcaaggctgcctcaattaggcacagtcggccaatccccctacacgagcgctccccctctgagccatacacccaacgcagattttcagcctccctacttcccgccaccctaccagcctatttatcctcagtctcaggatccctactctcacgtgaacgacccgtacagcctgaatcccctgcacgcccaaccccaaccacaacaccctgggtggccaggccagaggcagtcccaggagagcggattgcttcacacccaccgcgggctgcctcaccagctcagcggtttagacccccggcgtgattatcgtcggcatgaagacctgctgcacgggccgcacgctttgagctcgggtttaggtgatctgagcattcatagccttccccacgcaattgaggaggtcccacatgtggaggatcccggaattaatattcccgaccagacggtgatcaagaaagggccggtctctctctccaagtccaattccaacgcggtgtccgcgattccaatcaataaggacaatcttttcggaggagtcgtaaatccaaacgaggtgttctgttcagtcccggggcggctgagcctcctgtcttcaactagcaagtacaaggtaaccgtggccgaggtccaacgccgcctgagtcctcccgagtgtctgaatgcttcacttttagggggggtcctcaggagagcgaaatctaagaacggcggcagatctttgagagagaaactcgataagatcggcctcaacctgcctgccgggaggcggaaagcagccaatgtgactctgctgaccagtctagtggagggcgaggctgttcatcttgccagagactttggctacgtgtgcgagaccgagttccctgccaaagcagtggcagaattcctgaaccgacagcactccgatcccaatgaacaggtcacaaggaagaacatgctgctggcgaccaaacagatttgcaaagagtttaccgatctcttggcgcaggaccgatccccccttgggaacagcagacccaatcccatcctagagccaggcatacagtcttgccttacccactttaatttgatttcacacggattcggttccccggcggtctgtgctgctgttacagccttgcaaaactaccttactgaggcactcaaggctatggacaagatgtatctttccaacaatcctaatagccacacagacaataatgctaaatcatctgacaaggaggagaaacaccggaaatag

SEQ ID NO: 209007 - DNA, 1410 bp, Artificial Sequence
  Description of Artificial Sequence: Synthetic coding sequence
atgcacagccccccccgggaccaggccgccatcatgctgtggaagctggtcgaaaacgtaaagtacgaagatatctacgaaatgttggtgcacacgtactcatctatggatcgtcatgacggcgtccccagtcactccagccggttaagtcagctgggtagtgtgagtcaagggccctattcatccgcccctccactgtctcataccccttccagtgatttccagcctccatactttcccccaccataccagcctctgccttatcaccagagtcaggacccctacagtcatgttaacgacccgtactccctgaatccgctgcaccagccacaacagcacccttgggggcaaagacagcgacaagaggtcggaagcgaggctggctccctccttcctcagccgcgtgctgccctgccccagttgtccgggctcgaccccagacgcgattaccactctgtccggcgcccagatgtgctcttgcattctgcacaccacggacttgacgccggaatgggggattcccttagtctgcacggactgggtcatcccggaatggaggatgtccagtcagtcgaagacgcaaataacagcggaatgaatctccttgatcagtctgttatcaaaaaggtacccgtgccgccaaaaagcgttaccagtcttatgatgaataaggacggtttcctggggggtatgtctgtcaataccggggaggttttttgctcagtgcctggacggctctccctgctgtcaagtacatccaagtacaaggtgaccgttggtgaggtgcagcgtcggttaagcccgcccgagtgtttgaatgctagcctcttgggcggagtcctgcgaagagctaaaagcaagaacggcgggcgatccctccgggaacgtctcgaaaagatcggactgaatctacctgcaggccgccggaaggcggcaaatgttacactgcttacgagtctggtcgaaggggaagcagtgcacctggcccgcgacttcgggtacatctgtgagactgaattccccgccaaagcagtgagtgagtatctcaataggcaacacactgacccgagcgacctgcactcccgaaagaacatgttactggccaccaagcagctgtgtaaagagtttaccgatttgttagcccaggacagaaccccaatcgggaactcaagacccagtcccattctcgaaccaggaatccaatcatgtctgacccacttctctcttatcactcacggattcggcgcccccgctatttgtgccgctttaacagctctccagaattacctcaccgaagccctcaaagggatggataagatgttcctcaacaatacaaccacaaataggcacactagtggtgaaggcccgggctccaagaccggtgataaagaggagaagcacagaaagtag

SEQ ID NO: 209008 - DNA, 597 bp, Artificial Sequence
  Description of Artificial Sequence: Synthetic coding sequence
atgctgtggaagctggtggagaacgtgaagtacgaggacatctacgaaatgctcgtgcacacgtattcttccatggaccgccacgatggagtaccatcccactctagtcgtttatctcaacttggtagcgtctcgcagggtccatattcctcagcaccaccacttagccacacccctagctccgattttcagccgccctactttcctcctccataccaaccactcccgtaccaccagtctcaggatccctactcacatgtgaacgacccatacagtttaaaccccctgcatcaaccccaacaacacccttggggacagcggcagcgccaggaggtgggaagtgaggctgggagcctcctgccacagcccagagctgctctcccacaactgtctggcctggacccaagacgggactaccacagcgtcagacgcccggatgtcctcttgcatagcgctcaccacggcctagatgctggtatgggcgacagtttgtccctgcatgggctcggacaccctgggatggaggacgtgcagtcggtcgaggacgccaataatagcggtatgaatttattggaccaatcagtgattaaaaaatag

SEQ ID NO: 209009 - DNA, 1383 bp, Artificial Sequence
  Description of Artificial Sequence: Synthetic coding sequence
atgcacagccccccccgggaccaggccgccatcatgctgtggaagctagtggagaatgtaaaatacgaggatatctatgaagaccggcatgacggagtgccaagtcacagcagccgactttcccagctgggaagcgtttcccaggggccttatagtagcgcaccaccactatctcacacaccctccagcgatttccagccaccatactttccaccaccttaccagccgctcccctatcatcagtcacaggacccctattcccatgtgaatgacccttattcgctgaaccccctccatcagcctcaacagcacccctggggacaaagacagagacaggaagtgggctcagaggctggctcactgctgccacagccccgcgccgcactgccccagttgagcgggcttgatccaaggagagattatcacagcgtgcgaaggcccgatgttctgctgcacagtgcccaccatggtttggatgccggcatgggggactctttgtccttacacgggctcggacatccaggaatggaagatgtgcaaagcgtggaagacgccaacaactcaggtatgaacttgttggatcagtcggttatcaagaaggtgcccgtaccaccaaagtctgtaaccagcttgatgatgaataaagacggatttctcggtggaatgtccgtcaacactggggaagtgttctgttccgtgcctggccgcttgtcactgctgtcatcaacatcgaaatacaaagtcacagtgggggaagtccagcgccggctatccccgcctgagtgtttgaatgcctcacttctcgggggagtattgagaagagccaaatctaagaatggaggcagatctttacgcgagcgcctggagaagatcgggttaaacttgcctgctggcagacgaaaagcagccaatgtgaccctcttaacatcactcgtggaaggagaagctgtccacctcgctcgcgacttcgggtacatatgtgaaacagagtttcctgctaaggcggtgtctgaatacctcaatagacaacacaccgacccaagtgacctccatagccgaaagaatatgctgttagcgactaaacaactgtgcaaggagttcacagatttattagcccaagacagaacccctatcggcaatagcagaccaagcccaattttggaaccggggatccaatcctgtcttactcatttcagtctgattacgcacggattcggcgcccctgcaatttgtgccgccctgacagcacttcaaaactatttgaccgaagccctcaagggtatggacaagatgttcctgaataacactaccactaaccggcacacatctggcgagggccctggaagcaaaactggggacaaggaagagaaacacaggaagtag

SEQ ID NO: 209010 - DNA, 1359 bp, Artificial Sequence
  Description of Artificial Sequence: Synthetic coding sequence
atgagcaccaccttccccggcctggtgcacgacgccgagatccggcacgatggtagcaactcctacaggctgatgcagttgggctgccttgagtctgtcgcgaactctactgtagcctactccagcagctctcctctcacatattccactaccggcaccgaattcgcgtcgccatatttctcaactaaccatcaatacactccactccaccaccagtctttccactacgagttccagcactcccatccagcggtcacacctgatgcttatagtctgaatagtctgcatcattcccagcagtattatcaacagatccaccacggggaacctacagactttattaacctgcacaacgcccgcgctctgaaaagttcatgcctggatgaacagaggagagagctcggctgtctagatgcttataggcgtcatgatctgtccttgatgagtcacggcagtcagtacggcatgcatcctgaccagagactgctgcccggccctagccttggcctggccgcagctggagccgatgatctacaaggcagcgtggaagcccaatgcggcttagtcttaaacggccagggaggggtcatccggcgcgggggcacctgcgtggtgaaccccactgaccttttctgtagtgtgccaggtcgactgtctctcctgtcaagtacttctaaatataaagtcactattgccgaggtaaagcgacggctctcaccaccagagtgcctcaatgctagtttactgggaggcatcctgcggcgcgcaaagagcaagaacgggggacggtgtctgagagagaaacttgatcggctcggccttaaccttccagccggtcgtcgaaaagctgcaaacgtaacgctactgaccagtctcgtcgaaggagaagcgctccatctcgcaagagattttggatatacttgcgaaacagagtttccagccaaagcggtgggcgagcacctagcaaggcagcacatggagcagaaagaacaaaccgcgcgcaagaaaatgattttagcgaccaagcagatttgtaaagaattccaggatctcctgtcccaggaccggagccctctcggaagctctcgacctacgccgatcttagatctggatatccagcgccatctgactcacttttcccttattacgcatggtttcggaacccctgcgatctgtgcagcgttgagtacttttcagaccgtcctgtctgagatgttaaattatcttgagaagcatacgacccataaaaatggcggtgccgccgacagtggccagggccacgcgaactcagagaaagcacctcttcggaagacgtccgaagccgccgtcaaggaggggaagaccgaaaagacagattag

SEQ ID NO: 209011 - DNA, 1329 bp, Artificial Sequence
  Description of Artificial Sequence: Synthetic coding sequence
atgctggtgcacacctacagcgccatggagcggcccgacggcctgggagcggctgccgggggtgcgcgtctgtccagcttaccccaagcagcctatgggcctgcaccccctctgtgccatacgcctgcggccactgctgctgcagaatttcagcccccctactttccccccccatatccccagccacccttgccttatggtcaggccccggatgccgccgcggcctttcctcaccttgctggagacccttacgggggattggctcctctggcacagcctcagccacctcaggcggcctgggccgcgcctcgtgctgccgcacgcgcacacgaggaaccaccaggcttgctcgccccccctgcgcgggccctaggcctggatccccgacgagactacgctaccgctgtcccccggcttcttcacggtctggctgatggagcccacgggctcgccgatgctcctctgggcctgccaggactggcagctgctccaggcctggaggacttgcaggccatggacgaaccgggaatgtccctgctcgaccagtccgtaatcaagaaagtgcccattcctagcaaagctagtagcctctcagctttatcactggccaaggacagcttagtgggcgggattaccaaccctggcgaagttttttgctcggtccccgggcgacttagcctgctgagttccaccagtaagtacaaagtaacagtaggtgaggttcaaagacgcctgtccccgccggagtgtctgaacgcctccctcctggggggcgtgctgcgcagagcgaaaagtaagaacggaggaaggtgccttagagaacggctggagaaaattggcttgaacctgccggccgggaggcgcaaagcggcaaacgtgactctgcttacttccctagtggagggtgaggccgtgcacttggccagggacttcggctacgtatgtgagacagagttccctgcaaaggcagccgctgaatacctgtgtcggcagcacgctgatcccggcgagttgcactctagaaagtctatgcttctggctgctaagcagatttgtaaagagttcgctgatctcatggctcaggacaggtcgccactggggaattcgcgcccagccctaattcttgagcctggcgtccagtcttgtttgacccatttctccctaatcacacacggattcggaggccccgccatatgtgctgcccttactgccttccagaattatctcctggagtccttaaaaggtctggacaaaatgtttctctcttccgtggggagtggccacggggagacaaaggcttccgagaaggacgccaagcatcgcaaatag

SEQ ID NO: 209012 - DNA, 1353 bp, Artificial Sequence
  Description of Artificial Sequence: Synthetic coding sequence
atgctgtggaagatcaccgacaacgtgaagtacgaggaggactgcgaggataggcatgatggatcctctaatggcaaccccagagtcccccacctgagttcggccggacagcacctttactcccctgccccaccattatctcatactggggtcgccgaatatcaaccaccaccctactttcctcccccgtatcagcagctggcttatagtcagtccgccgatccctactctcacctcggggaagcctacgcagccgcaatcaaccccctgcatcagcccgcaccaactggatcccagcagcaggcttggcccggtaggcagtctcaggaaggagccgggcttcctagccatcatgggcgccccgccggccttctcccacacctctccggactagaggctggagccgtatccgctcgtcgagacgcataccgacgttccgacctgctgttaccccacgcacatgcgttggatgctgcaggtctcgctgagaacctgggactccatgacatgccccaccagatggacgaagtgcagaatgtcgacgaccagcacctcttgttgcacgaccagaccgttatccgcaagggacctatttccatgacaaagaaccccttaaatcttccttgccagaaagaattggtcggagctgtcatgaatccaaccgaagttttctgtagcgtgcccggaagactgtctttgctgagctcgaccagcaagtataaagttacggtcgcagaagtgcagcggaggctctcaccgccggaatgcctgaacgcgagcctcttagggggggtattacgccgggctaagtccaagaatgggggaagatcgctgagagaaaagctggacaagattggcctcaacctccctgcaggcagacgcaaagctgctcacgttacacttctcacgagtctggtggaaggggaagcagtacaccttgcacgggacttcgcctatgtctgtgaagcggagttccccagcaagccagtggcagagtatcttacaaggcctcatttaggaggcaggaatgaaatggctgcaaggaagaatatgctgttggcggcccagcagttgtgtaaggaatttacagagctgctgtctcaggatcggacaccccacggaacttctcgccttgcccccgtactggagaccaacatacagaattgcctcagtcacttcagcctaattacccacgggtttggctcccaggctatttgtgctgcggtcagtgctctccaaaattacataaaagaagccttaattgtgatagataagtcttacatgaatcccggagaccagagcccagctgactcaaataaaactctggagaagatggagaaacacagaaaatag

SEQ ID NO: 209013 - DNA, 357 bp, Artificial Sequence
  Description of Artificial Sequence: Synthetic coding sequence
atgttcctgcaggaccggcacgacggcagcagcaacggcaacccccgggtacctcatttgagctctgcagggcagcatctgtactctcccgccccaccactctcacatacaggcgttgctgagtaccaacccccaccctacttcccccccccttatcagcagcttgcctactcccagagtgccgacccctactctcatctgggcgaggcttatgctgccgcaatcaacccgttacaccagccagccccgaccgggtctcagcagcaggcttggcccggtaggcagtcacaggagggtgctgggctccctagccatcacggccggcctgctggcctcctgccacatctgagcggatag

SEQ ID NO: 209014 - DNA, 846 bp, Artificial Sequence
  Description of Artificial Sequence: Synthetic coding sequence
atgccccaccagatggacgaggtgcagaacgtggacgaccagcacttgctcttgcacgaccagaccgtgatcaggaagggaccgattagtatgactaagaaccccctgaatctgccttgccagaaggaattggtgggggctgtgatgaaccctacggaagtcttctgttccgtgcctggaagactgtctctgctgtcctccacgtctaaatacaaggtaactgtggccgaggttcagagaagactctcaccccctgagtgtctgaatgccagcttgctgggaggagtgctccggcgcgcaaagagcaaaaatgggggccgatccctcagagaaaagctggacaaaatcgggctgaacctgccagcgggaaggcggaaggcagcccacgtgacactgctaacatcgctggtggaaggcgaggcagtgcacctggcaagagatttcgcatacgtgtgtgaggccgagtttccgtccaagccagttgccgaatacctaacaagaccccacctcggtggccgcaatgagatggctgcccgtaagaacatgctcctagccgcacagcaactttgcaaggagtttacagaactcctgagtcaggacaggacaccccatggcacgagtagactcgcgcctgtgctcgagactaatatccagaattgcctgtcacatttttctctgatcacccatggcttcggatcacaagctatttgcgcggccgtaagcgccttacagaattatattaaagaggccctgatcgtgatcgataaaagttacatgaaccccggagatcagagtcctgctgactccaataagaccctcgaaaaaatggagaagcaccggaagtag

SEQ ID NO: 209015 - DNA, 1041 bp, Artificial Sequence
  Description of Artificial Sequence: Synthetic coding sequence
atggccgccagcggcaagctgagcacctgccggctgccccccctgcccaccataagggaaattatcaagctcctgaggctgcaagcagccaaacagctaagccaaaacttccttctcgacttgaggctgaccgacaagatcgtgaggaaggcaggaaacctaaccaatgcatacgtatatgaagtgggccccgggcccggaggtataacacgatccatcttgaatgcagatgtggccgaacttcttgtggtggaaaaggatacccgtttcatccctgggctacaaatgctcagcgacgccgcccccgggaagctgaggattgtgcatggtgatgtactgaccttcaaagtagagaaagcctttagtgaatcgctcaagcgaccttgggaggacgatccaccaaatgtccatataataggcaacctgcctttttccgtctctacacccctcatcatcaaatggctggagaatatttcctgtagagatgggccgtttgtttacggccgaactcagatgaccctgactttccagaaggaggtagcagaaagattagcggccaacacagggagtaagcagagatcacggcttagtgtcatggctcagtacttgtgcaatgtaaggcacatctttacaatccctgggcaggcttttgtgcccaaacccgaagttgatgtgggcgttgtccactttacaccattaattcagccaaagatcgaacagcccttcaagctggtggaaaaggttgtgcaaaacgtgttccaatttcgaagaaaatattgccatagaggcttgaggatgctgtttcctgaggcacaacgcttagaatccactgggcggcttctggagctggctgatattgatcccactctgcgcccaagacagctcagcatatcacatttcaagtctctttgtgacgtgtataggaagatgtgcgatgaagatccacaactgttcgcttacaatttccgggaagagttgaaaaggaggaagtcaaagaatgaagagaaggaggaggatgatgccgagaattatagattgtag

SEQ ID NO: 209016 - DNA, 1728 bp, Artificial Sequence
  Description of Artificial Sequence: Synthetic coding sequence
atgagccacgccgccgagcccgcccgggacggcgtggaggccagcgccgaaggccccagagccgtctttgtacttctggaggaaaggcggcccgcagactcagcccagctactgagcttgaattccctgctccctgagtctgggatcgttgctgacattgagctcgaaaatgttctggatcccgattctttttatgaattgaagagccaacccttaccactccgctcgtcacttccaatatcactgcaagccacacctgctacaccggctacactaagtgccagctcgtcggccggcggaagcaggacgcctgcgatgtcctcttctagctcttcaagagtgttgctgcggcagcaactaatgagagctcaagcccaggaacaggaaagaagagagcggagagagcaagcggcggcagccccattcccaagcccagctcccgctagcccagctatctccgtggtgggggtttctgcagggggacataccttgagccgccccccaccggctcaagtgccccgagaagtattgaaggtccagacccaccttgagaaccccacaagatatcacttacaacaggctcgtagacaacaagttaaacagtatttgtctacaacactgggcccgaaattagcctcacaagcccttaccccaccgcctggacccgcatccgctcaaccgctgcctgcccccgaggcagcgcataccacaggtcctactggcagcgctcctaattctcctatggccttgctaaccattggctcaagtagcgaaaaggaaatcgacgacgtgatcgacgaaataatctctctggaatcttcctataatgacgagatgctgtcgtatcttccaggagggacaaccggcctccagctcccaagcactctgcctgtgagtggcaacctgcttgatgtgtacagctctcagggcgtggccactcccgccattacagtgtccaactcttgtcccgctgaattgcctaatatcaaaagggaaatctcagagacagaagctaaagctctgctcaaggagagacagaaaaaagacaaccataacctgatagagagaaggcgccgcttcaacattaatgacagaattaaggagcttggaaccctgatccccaaatcttcagacccagagatgaggtggaacaaagggacaattctcaaagcttcagttgactacataagaaagctacagaaggagcagcagcgatcaaaggatcttgagagccggcagcgcagcctggagcaggctaaccgatccctacaattaagaattcaggaactggagctccaggcccagatccacggactcccagtcccgccaacccccggcctgctctccctggctacgaccagtgcctcagactctttgaagcccgagcaacttgacatcgaggaggagggccgacccggagctgccacattccatgtcggaggaggtcccgctcaaaacgccccccaccaacagcccccggcccccccttccgacgctctgttggatttgcactttcccagcgaccatctgggggatctgggggacccctttcatctgggactggaggacattctgatggaggaagaagagggtgttgtaggaggccttagtggaggtgccctttctcccctgagagcagcctccgatcccctcctgtcctcggtgagtcctgccgtgtccaaagcctcttctcgaaggtcatccttctcaatggaggaggaatcatag

SEQ ID NO: 209017 - DNA, 1509 bp, Artificial Sequence
  Description of Artificial Sequence: Synthetic coding sequence
atggcctgggccctgaagctgcccctggccgacgaggtgatcgagtccggactggtgcaagatttcgacgcaagtctgtcagggatcggccaagagctcggcgccggcgcttatagtatgtccgacgtccttgccttgcctatttttaagcaggaagagtccagccttccgccagataatgaaaataaaattctccccttccagtacgttctttgcgccgcaacctcaccggctgtgaaactgcacgacgagacactgacgtatctgaaccagggccagagttatgagatccgcatgctggacaacagaaagctcggcgaactcccggagataaatggaaaactggtgaagagcatctttcgggtcgtgtttcacgaccggaggctgcaatataccgaacatcagcagttggaggggtggcgttggaaccgccccggcgaccgtatcctggacatcgacattccgatgtccgtgggtatcatcgacccaagggccaacccgacacagctgaataccgttgagtttctgtgggatccggccaagcggacctccgtgttcatccaggttcattgcatatccacagagttcaccatgcgcaagcatggaggggaaaagggggtcccatttcgggttcaaatcgatactttcaaagagaatgaaaatggggagtacacagagcatctgcacagcgcctcctgtcagattaaagttttcaagcctaagggggcagatcgcaaacaaaagaccgacagggagaagatggaaaagaggacacctcatgaaaaagagaaataccaaccctcctatgagactaccatcctgaccgaatgcagcccctggcccgaaatcacctatgtcaacaacagtcccagccccggctttaacagctcccactctagcttcagcctgggcgagggaaacggaagcccaaatcaccagccagaacctccaccacctgtaactgacaatttgctgccaaccaccacccctcaggaggcacagcagtggctccataggaaccgattttccacattcactcgcctgttcaccaatttcagcggggccgatctactgaaactcacgagggatgatgtcatccagatttgcgggcccgccgacggcattcgactcttcaatgctcttaaaggcagaatggtgcgcccacgcctaactatttatgtatgccaggagagcctccagctccgggagcagcagcagcagcaacagcaacaacagcagaaacacgaagatggagactcaaacggcactttctttgtttatcacgccatttacctagaggaattgacagcggtggaactgaccgagaagattgcccagctctttagcatcagcccttgccagatcagtcagatttataagcaaggcccgactggcatccacgtgttgattagtgatgagatgatacagaactttcaagaggaggcctgcttcatacttgatacaatgaaagccgaaactaacgacagttatcatatcatactgaagtag

SEQ ID NO: 209018 - DNA, 1356 bp, Artificial Sequence
  Description of Artificial Sequence: Synthetic coding sequence
atggcctgggccctgaagctgcccctggccgacgaggtgatcgagtcaggccttgtgcaggattttgatgcttccttaagtggcataggccaggaacttggtgccggtgcctactccatgtccgacgttttagctctgccaattttcaagcaagaagaatcttccctcccaccggacaatgagaataaaatcttgccctttcaatatgtcttgtgcgccgctaccagccccgctgtaaagctccacgacgagacactaacctatctgaaccaagggcaatcctacgagatccggatgctcgataatagaaaattgggcgaattgccagaaataaatggaaaattggtgaaatccatctttcgcgtagtcttccacgaccgccggctgcaatacacggaacatcagcagctggagggatggcgatggaaccgaccaggtgatcgaattcttgatatagacattcccatgagcgttggtatcatcgaccctcgagccaatcccactcagcttaacactgtcgagttcctctgggatcccgcgaagcgaacatctgttttcattcagccaaagggagctgacagaaaacagaagactgatagagagaaaatggagaagagaacaccacatgagaaggaaaagtaccagccgtcctacgagactacaatactgaccgagtgtagcccatggcccgagataacgtacgtgaataattctccaagtcctggctttaacagctctcactcttcattttcattgggagagggaaacggatcaccaaatcaccagcccgagccgccaccacctgtgacggacaatctactacctactactactccgcaggaagcacagcaatggctccatcgcaatcgcttctcaacatttacacgattgttcaccaatttttccggcgcggacttgttgaaactgactcgggatgacgtgatccagatctgtgggcccgccgatggaatcaggctgttcaatgcactgaaggggcgaatggtaaggccaagactgacaatctacgtgtgccaggaatctttgcagctccgagagcagcagcagcagcagcaacagcagcagcagaaacatgaagatggtgactcgaacggcacattctttgtgtatcacgcgatctatctcgaggagcttacagccgtcgagctgactgaaaaaattgctcagttatttagcatcagtccctgtcaaattagccagatatacaaacagggaccgactggcatccacgttcttatatccgacgaaatgatacagaatttccaggaagaggcctgcttcatactggataccatgaaggctgagacaaacgatagctaccacataatcctaaaatag

SEQ ID NO: 209019 - DNA, 1353 bp, Artificial Sequence
  Description of Artificial Sequence: Synthetic coding sequence
atggcctgggccctgaagctgcccctggccgacgaggtgatcgagtcaggactcgtccaggacttcgacgcctctctgtccggcattggccaggagcttggcgcgggcgcttacagtatgtcagacgtacttgctctcccgatcttcaagcaggaggagagcagtctccctcctgataatgagaataagattctgcccttccagtacgtgctatgcgcagctacatcccctgccgtgaaactccatgatgagaccctgacgtatttgaatcagggtcagagttatgaaattagaatgctcgacaaccgcaagcttggggaattaccagagattaatggtaagctcgttaaaagcattttcagggtggtgtttcacgacagaagattgcagtacacggaacaccagcagttagagggatggcgatggaatcggcctggagaccggattttggacattgatattcctatgtctgtaggaattattgatccgcgcgcaaacccaactcagctaaatactgttgagttcctgtgggatcctgctaaacgaacttctgtgttcatacagcctaagggtgcggacagaaaacagaaaacggaccgcgagaagatggaaaaacgcactccacacgaaaaagaaaagtaccagccttcgtatgagacaaccattcttactgagtgctcgccttggcccgaaattacttatgtgaataactccccaagccctggcttcaatagctcacattcaagcttttctttaggggaggggaacggaagccctaatcatcagcctgagcctcctccaccagtgaccgataacctgctgcctaccaccacgcctcaggaagcacagcagtggctgcacaggaaccgcttcagtacattcaccaggttatttaccaacttctctggtgctgatctccttaagctgacacgggatgatgttattcagatttgcggccccgcagacggcattaggctgttcaacgcattaaaaggccggatggtgcggccacggttgaccatttatgtgtgtcaggaatcactgcaactgcgcgaacagcagcagcagcagcagcaacagcagcagaaacacgaagatggtgattccaacggcactttctttgtgtaccacgctatctacctggaagagttgacagcggtcgagctaacagagaaaatcgctcagctgttttccatctcgccatgccagataagccagatttacaaacagggtcccactggaattcatgtcttgatcagcgatgagatgatccagaactttcaagaggaagcatgttttattcttgacaccatgaaagagaccaatgattcttaccatataatacttaaatag

SEQ ID NO: 209020 - DNA, 1440 bp, Artificial Sequence
  Description of Artificial Sequence: Synthetic coding sequence
atgctgttctggcacacccagcccgagcactacaaccagcacaactccggcagctatctccgcgatgttttggctcttccaatatttaagcaggaggaaccccagctgtcacccgagaacgaagcccggcttcctcctttgcagtacgttctctgtgcagccacatctcctgctgtgaagttgcatgaggagacactcacttacctgaatcagggacagtcatatgagatacgactgctagagaatagaaaacttggtgacttccaggatctgaacaccaaatacgtcaaatcaataattagggtggtgtttcacgacaggagactccagtatacagagcaccaacaactggaaggatggagatggtccaggccaggtgaccggattctggacatcgacatacccctgtctgtcggcatccttgacccaagggcttcccctactcagttaaatgctgtcgaatttctttgggatccagccaagagagcttcagcgttcatccaggtccactgtatctccacagagtttacaccccgaaagcacgggggtgaaaagggcgttccattccgagttcagatagacacattcaagcagaacgagaacggagaatataccgagcacctccactctgcttcctgccagatcaaagtgttcaagccgaaaggagccgaccgcaagcagaagacagaccgggagaagatggagaaacggaccgcccaggagaaggaaaagtaccaaccatcgtacgaaaccaccattctgactgagtgctcaccctggccagacgtcgcataccaggttaactctgcaccgtccccttcttacaacggcagccctaattccttcgggctaggtgagggcaatgcatctcccacacatccagtcgaagctctgccagtcggttccgatcatctgttaccctccgcatctatccaggatgctcagcagtggttgcaccgaaaccggttctctcagttctgtaggctgttcgcaagttttagcggagccgatcttctgaagatgagccgggatgatctggtgcagatatgcggtcctgcggacggcatcagactcttcaacgccataaaaggacgtaacgtcagacctaaaatgactatctatgtgtgccaagagctagagcagaatcgcgtgcccctccagcaaaaacgagatggttcaggcgactcaaatttgagtgtgtaccacgccatatttctagaggaactgacaacactggagttgatcgagaaaattgctaacctctacagcatttctccccaacatattcaccgagtgtatcggcagggaccaaccggtattcacgtggtggtcagtaatgaaatggtgcaaaattttcaagacgagtcttgctttgtgctgtccaccattaaggccgagagcaatgacggttatcacatcatccttaagtgcggcctgtag

SEQ ID NO: 209021 - DNA, 99 bp, Artificial Sequence
  Description of Artificial Sequence: Synthetic coding sequence
atggtgcagaacttccaggacgagagctgcttcgtgctgagcaccatcaaagctgaatctaacgacggttatcacataatcctcaaatgcggcctctag

SEQ ID NO: 209022 - DNA, 1218 bp, Artificial Sequence
  Description of Artificial Sequence: Synthetic coding sequence
atggccaagtacgtgagcctgaccgaggccaacgaggagctgaaggtactgatggacgagaaccagacctccagaccagtggcagtgcatacctcgacagttaatccactgggaaagcaactgttacccaagaccttcggtcagtccagcgtgaatattgatcagcaggtggttatcgggatgccacagcggccagctgctagcaacattcctgtggtggggtctcccaacccaccctcaactcatttcgcatcccagaatcagcactcctacagtagtcccccgtgggcaggccaacacaatcggaaaggagaaaaaaatggtatgggtctgtgccgcctctccatgaaagtttgggaaacagtccagcgaaagggaaccacgagctgtcaggaggtcgttggcgagctcgtggcaaaattccgcgcagcgagtaatcacgccagtcccaacgaatcggcttatgacgtgaagaacataaaacggcggacctacgatgctctcaatgttctgatggccatgaatattataagtagagaaaaaaagaaaatcaaatggattggactgactaccaacagcgcacagaactgtcaaaatcttcgcgttgaaagacaaaagcggctggaaaggataaaacagaagcagtccgagctgcagcagctgattttgcagcagattgctttcaaaaaccttgtcctgagaaaccagtatgtggaggagcaggtgagtcaaaggccattgcctaacagtgtaatccatgtaccatttattatcatatcctcgagcaagaaaacagtgatcaattgctccatcagtgacgacaaatctgagtacctgttcaaattcaactctagttttgaaattcatgatgatacagaggtgttgatgtggatgggaatgacatttggcctagaatcggggagctgcagtgccgaagatctgaaaatggcgcggaacttggtgcctaaggcactcgaaccatatgtgaccgagatggcccagggaaccttcggtggagtatttactaccgcaggatcaaggtcaaatggcacttggctttctgcctcagatcttacaaacatagcaataggtatgctcgcaacctcctcaggggggagccagtactctggaagtcgggtagaaacgcctgctgtggaggaggaagaggaggaagataataacgatgatgacctgagtgaaaacgatgaggacgattag

SEQ ID NO: 209023 - DNA, 2649 bp, Artificial Sequence
  Description of Artificial Sequence: Synthetic coding sequence
atggagggcgagagcagccggttcgagatccacacccccgtgagcgataagaaaaaaaaaaaatgtagtatacacaaggaacgtccccagaagcactcacatgagatttttagagattcctcgctggtgaacgagcaatctcagattaccaggaggaaaaaacggaaaaaagactttcaacacttgatctcttccccgctaaagaaaagccggatctgcgatgaaacagctaatgcaacaagcacacttaagaaacgtaagaagcgcagatattccgccctggaggtggatgaggaggcaggcgtcaccgttgtactagtggataaagagaacatcaataacacacctaaacatttccgtaaggacgttgacgttgtctgtgttgacatgtctattgaacagaaactgcctcggaagcccaaaacagacaaattccaggtgttagcgaagagccacgcacacaaatccgaagctttgcactctaaggtcagagaaaaaaaaaataaaaagcatcagagaaaagcagcttcttgggagagccagcgcgccagggacactctcccacaatccgaatcccaccaagaagagagctggctctctgttggaccggggggtgagataacagagctgccagcctctgcccacaagaataaatccaagaagaaaaagaagaagagtagcaacagggagtatgagaccttagccatgcctgagggatcccaggctggacgggaggctggtaccgatatgcaggagtcccagccaaccgtgggactggacgacgaaacgccgcagctcctaggccccacacataagaaaaagtccaaaaaaaagaagaaaaaaaagtctaaccaccaagagttcgaagccctcgcgatgcccgaaggctcccaggtgggtagcgaggtgggagccgacatgcaggagtctcgccctgcggtgggactccatggtgagactgccggaatcccagcgcccgcttacaagaacaagagcaagaagaaaaaaaaaaaatcaaatcatcaggaatttgaggcggttgcaatgcctgaatctctggagtcggcctatcctgagggttcacaggtgggcagcgaggtgggcacagtagagggatccacggcactcaagggttttaaggagagtaatagcacaaagaagaaatctaagaagagaaagttaaccagcgtgaagagggctagagtgagcggagatgatttttctgtgccttccaagaatagcgaatctaccctcttcgactccgtggagggagacggtgctatgatggaggaaggagttaaatctagaccccggcagaaaaaaacccaggcgtgcctcgcttcgaagcacgtccaggaagccccacgactggaaccagccaacgaggagcacaacgtcgaaaccgctgaagactccgaaataagatatttgtctgccgattcaggcgacgctgatgactccgacgccgatttgggatcagcggtgaaacagctgcaggaattcatccccaacataaaagaccgggccacgtctaccatcaaaagaatgtatcgagatgacctcgaacggtttaaagagtttaaggctcaaggggtcgcaatcaaattcgggaaatttagcgttaaagagaataagcagctggagaagaacgtcgaggatttcctggccctaaccggaatcgagtctgcagataaactgttgtatacagataggtaccccgaggagaagagtgttatcacgaacctcaagcggcgctattcctttcggctgcatattggacggaatattgccaggccctggaagctgatttattacagggcaaaaaaaatgtttgacgtcaacaactacaagggacggtatagcgagggtgacacagaaaaactgaagatgtatcactccctgctaggcaatgactggaagaccatcggagaaatggttgccaggtcatcactctctgttgccctgaagttcagccagatatccagccagaggaataggggggcctggtcaaagagcgaaacaaggaagctcatcaaagctgtagaggaggtgatccttaaaaagatgtctccccaggagcttaaggaggtagactctaaattacaggagaatcctgaatcttgccttagtatagtgcgggaaaagttatacaaaggcattagctgggtcgaagtagaggcaaaggtgcagacccggaattggatgcagtgcaagtcaaaatggacagaaattctcacaaagcgcatgaccaatggccgaaggatttactatgggatgaatgcccttagagcgaaggtgagtctgatagaacgcctgtatgaaattaatgtcgaggacacaaatgaaattgattgggaagacctggctagcgctattggcgacgtcccgccatcatatgttcagactaaatttagcaggctcaaggcagtctatgtgcccttctggcagaagaaaacttttcccgaaatcattgactacttgtatgagacgacactgccactactgaaggaaaagcttgaaaagatgatggagaagaagggtactaagatccaaactcctgcggcccctaaacaagtttttccattccgagacatattttattatgaggacgactcggagggcggtcacaggaaacggaagcggcgctag

SEQ ID NO: 209024 - DNA, 2718 bp, Artificial Sequence
  Description of Artificial Sequence: Synthetic coding sequence
atggagggcgagagcagccggttcgagatccacacccccgtgagcgacaaaaagaagaagaagtgttcaatacataaggaacgtccccagaagcacagccacgaaatttttagagattcttcactcgttaatgagcagtctcagatcactcgcaggaagaaacgtaaaaaggactttcagcatttaatttcttcgcccctgaaaaagagccggatttgcgatgaaaccgccaacgcgaccagcactcttaagaagcgtaagaagagaaggtacagcgctcttgaggtcgacgaggaggccggagtgacagtggttctggtggacaaagagaacatcaataacactcctaagcactttcgaaaggatgtggacgttgtgtgcgtggacatgtctatcgagcaaaagctcccgagaaagccaaaaacagacaagttccaggtcctcgcaaagtcacatgcacataagtctgaggccctgcatagtaaggtacgagagaagaaaaacaagaagcatcagcggaaagcggcctcatgggagtctcagagagccagggatactttgccacagtctgagtcccatcaggaggaatcgtggctgtcggtgggacctggcggcgagattactgaactccctgccagcgctcacaagaacaaaagcaaaaaaaagaagaagaaatccagtaacagggaatacgagactctggccatgcctgaaggaagccaagctggccgtgaggccggcacagatatgcaggagagtcagcctacagtggggttagatgacgagacaccccagctcctcggccccacccacaagaagaaaagcaagaagaaaaagaagaagaagagcaaccatcaagagttcgaagctctcgctatgcctgagggctctcaagtgggatccgaagtgggcgcggatatgcaagaaagccgacccgcagtggggctccatggcgagacggcaggcatccccgcacctgcttacaaaaataaaagcaagaagaagaagaaaaagagcaatcaccaggaatttgaggccgtggctatgcctgaatcacttgagagtgcataccctgaaggcagccaggtaggcagcgaggtcggaacagtggaaggcagcaccgcccttaaaggctttaaggagtctaattccactaagaaaaaatctaaaaagcgcaaactgacctctgtaaaaagagcccgtgtcagtggtgacgatttttccgtgccgtcaaagaattcagagtccacactcttcgatagtgtggagggggatggagcaatgatggaggagggcgtgaaatccaggcctcgccaaaaaaagacacaggcttgtctagccagcaaacatgtgcaggaggccccacggcttgagccggctaacgaagaacataatgtggagactgccgaggacagcgaaatcaggtatctaagtgcggatagcggcgatgctgatgactctgatgcagaccttggaagcgcagtcaaacaacttcaggagttcataccaaatattaaggatagggcaacctccactattaagagaatgtatagggacgatctggagcgtttcaaggagtttaaggcacaaggggttgccattaagtttgggaaattctcagtcaaagaaaataagcagctcgaaaaaaacgtggaggatttcttggcgctaacaggaattgaaagcgccgacaaactgctctatactgataggtacccagaagagaaatcagtaatcaccaatcttaagagacggtactcttttcgactacatatcgggagaaatatcgcaaggccatggaaattaatttattaccgggccaagaagatgtttgacgtgaataactataagggtaggtactccgagggcgacacagagaaactcaagatgtaccactctttgctgggcaacgactggaagactatcggcgaaatggtggctagaagcagtctgtccgtagctctcaagttcagccaaatcagttctcaaagaaatcggggtgcctggtcaaaaagcgagactcgcaaattgattaaggccgtagaggaggttatattgaagaagatgtctccccaagagcttaaggaggtcgactcaaaactgcaggagaaccccgaatcatgcctttccatcgtgcgggagaagctgtataagggtatatcttgggtagaggtggaagctaaggtgcagacacgtaactggatgcagtgtaaatctaaatggacagaaattctcaccaaaaggatgaccaatggcagaagaatctattatggtatgaatgcactgcgcgcgaaggtaagcctgatcgagcgactgtacgagatcaatgtcgaagataccaatgagatcgattgggaagacctggcttcggctattggtgacgttccccctagttacgttcaaaccaaattcagcaggcttaaggcagtatatgtgccattctggcagaagaaaacgttccctgagatcatcgactatctatatgagactacgctaccattattaaaggagaaactggagaaaatgatggagaagaagggtactaaaatacaaactcccgcagctcccaagcaggtgtttccgttcagagacatcttttattacgaagacgatagcgagggtgaggacatcgagaaggaaagtgaaggccaagccccttgtatggcccacgcttgtaactcatcaactttggggggacaggggcgatggataatttag

SEQ ID NO: 209025 - DNA, 3489 bp, Artificial Sequence
  Description of Artificial Sequence: Synthetic coding sequence
atggaggaggtgcggtgccccgagcacggcaccttctgcttcctgaaaaccggggtccgggacggacccaataaaggaaaatcattctacgtgtgtcgtgctgatacttgctcattcgtcagggctaccgatattcccgtttcccattgcctgctgcacgaggacttcgtggtcgagttgcagggcctgctgttacctcaagataaaaaggagtatcggctgttctttcgctgtattcgcagtaaagccgaagggaaaaggtggtgcggctctataccgtggcaagaccctgattccaaggagcatagtgtgagtaataaatcccagcacgcttctgaaacgtttcatcactcttctaactggctgcggaacccattcaaagtgctggataagaaccaggaaccagcactctggaagcagttaatcaagggggagggcgaggaaaaaaaagcagacaagaaacagagggagaaaggcgatcaactgttcgaccagaaaaaagaacagaagcccgaaatgatggaaaaggacctatcatccggcctggtgcccaaaaaaaagcagtcagtcgttcaagaaaagaaacaggaagaaggggctgaaatccagtgtgaggctgaaaccggcggcacacacaagcgggatttctcagaaatcaagtcacagcagtgtcaggggaatgagctgacacgaccatcagcatcttcacaggagaagtcatccgggaaaagccaggacgtgcagcgtgaaagcgagcccctgagagagaaagtcacacagctgttgccccagaatgtacattcgcacaattcaatatctaagcctcaaaagggcggccctttgaacaaagagtacacgaattgggaggcaaaggagacaaaggctaaggacggaccttctattcaagctacacagaaatccctgcctcagggacatttccaggagcgtccggagacccacagcgtgccagcccccggaggtccagcagcccaggcagccccagctgccccaggcttgagtcttggggaagggcgagaggccgccacttcgagtgacgatgaggaggaagatgatgttgttttcgtgtccagtaaaccaggctctccgctcctgtttgacagcacactagatctggagacgaaggagaacctgcagtttcctgatcggtctgtgcagcggaaggtgtcacccgcttcaggcgtgtccaagaaggtggaaccatccgatcctgtcgctcgaagggtttacttgacaacacagctgaaacaaaagaagagtacactcgcgtcagtgaacattcaggctttgccagacaagggacaaaaactgattaagcaaatccaagagctggaagaagttttgtctgggctgactctctctcctgagcagggcacaaacgaaaaatccaatagtcaagtgccccaacagagtcacttcaccaaaacgaccaccggccccccccatctcgtgcctcctcagccactcccgcggcgcggcactcagcccgttggttccctggaattgaaatctgcctgtcaggtcacagcaggtggatcgtcccaatgttatcgtggccacaccaaccaggaccacgtccacgctgtttggaaaattacatcagaggccattggacagctgcaccgctccttggaatcgtgtccaggtgagacggtggtggccgaagatcctgcaggactgaaagttcctcttttactgcaccagaagcaggctctcgcctggcttttatggagggagtctcagaagccccagggtggcattctggcagatgatatgggtctcggcaaaacactgacaatgatagccctgattcttactcagaagaaccaagagaagaaagaggagaaagagaaaagcacagcactgacttggctaagcaaagacgatagctgcgacttcactagtcacggtaccttgataatctgtccagcgtctctgatccaccactggaagaatgaggtggaaaaaagggtgaatagtaacaaactccgagtgtacctttatcacgggccaaaccgggactccagagctagagtgctgtccacttatgatatcgtgattacaacatacagcctggtcgcaaaggaaattcctacaaataagcaagaagccgagattccgggagcaaaccttaatgtcgagggcacgagtacacccctgttgcgtatagcttgggccaggatcattctggatgaggcccacaacgtgaagaacccacgcgtgcaaacgagtatagctgtgtgtaaactccaggcttgcgcacgatgggctgtgaccggaacccctattcaaaacaacctgctcgacatgtattcccttctgaagtttctccgctgctccccctttgacgaatttaacctgtggcggtctcaggtggacaacggtagtaaaaaggggggcgagaggctttcaattctgactaaatctctcttactgagaaggacgaaagaccagctggattcgacaggcaggcctctggttattctgccccaacgcaaatttcagctccatcatttgaaactctcggaggacgaggagacggtgtacaacgtgttttttgcacggtcccgctccgctttgcaaagctacctcaaaaggcacgagtcccggggtaaccagagcggcaggagccctaacaatcctttctctcgggtagccctggagtttggctcggaggagcctaggcacagtgaagcagccgattccccccgtagctctacagttcacatccttagccagctgctcagactgcgccagtgttgttgtcatctcagcttgcttaaatcagccctcgatcccatggagctcaagggagagggcctcgtgctttccctggaagaacagctgtccgccctgacactgagcgaattacgggactcagagccatcttcgaccgtgtcactaaacggcaccttctttaagatggaactcttcgaaggcatgcgtgaatcaactaagatctcaagtctactggccgagctcgaggctattcagaggaattcagcatcgcagaaatctgtcattgtgagccagtggacaaacatgctgaaggttgtggcacttcaccttaaaaaacacggtctgacctacgcaactatcgacggcagtgtgaatcccaagcagagaatggatctagttgaggcatttaatcactccagaggaccacaagtcatgctcatcagcctgctcgctggcggcgtggggctgaacctgacgggcgggaaccacttgttcctgctcgatatgcattggaatcctagcctggaagaccaggcctgcgataggatttaccgggtcgggcagcagaaagatgtcgtaattcaccgctttgtctgtgagggcactgtggaggaaaagatcttacaattacaggagaaaaagaaagacctggctaaacaggtccttagcggttctggcgagagcgtgactaagttaaccttagcagacttgagagtgctgttcggtatctag

SEQ ID NO: 209026 - DNA, 432 bp, Artificial Sequence
  Description of Artificial Sequence: Synthetic coding sequence
aacatgctgaaggtggtggccctgcacctgaagaagcacggcctgacttatgccactatcgacgggagcgtgaaccccaagcagagaatggacctcgtcgaagctttcaatcacagcagaggccctcaggtgatgctcatcagtctgctggcagggggcgtggggctgaatctgacggggggcaaccacctcttcttgttggacatgcattggaacccctccctagaggaccaggcgtgtgacaggatatatcgtgttggacagcagaaagatgtggtgattcatcgttttgtctgcgaggggactgtggaggagaagatactgcaactgcaagagaagaaaaaagacctcgcaaaacaagttctgtctggttcgggcgagagtgtgactaagttgacacttgctgacctaagggttctatttggtatttag

SEQ ID NO: 209027 - DNA, 1263 bp, Artificial Sequence
  Description of Artificial Sequence: Synthetic coding sequence
atggccgagctgggcaagaagtactgcgtgtactgcctggccgaggtgtcacctctgcgcttcaggtgtacagagtgtcaggacatcgagctgtgcccagaatgttttagcgcaggagccgagatcggacatcatcgtcggtatcacgggtaccagctggtggacgggggcaggttcacactgtggggaccagaagctgagggaggctggaccagccgagaggagcagttacttctggatgcaatcgagcagttcgggttcgggaattgggaggacatggccgcacatgtaggcgcttcccgaacgccccaggaagttatggagcactatgtttcaatgtatatacatggcaatctcggcaaggcatgtatcccggacacaatcccaaatcgggtcactgatcatacctgccccagcggcggcccgctgagtcccagtttaaccacaccactgccccctctcgacatatccgtggccgagcagcagcagctgggctacatgcctctgcgcgatgactatgaaattgaatacgatcaggatgccgagaccctaattagtggtctgtcagtgaactacgatgacgacgatgtggagatcgagctcaagagggctcatgtggacatgtacgttcgtaagttaaaagagaggcagcgcaggaagaatattgcccgtgactacaacttggtcccagcctttctgggaaaagacaaaaaagagaaggagaaggctcttaaaaggaagataaccaaggaagagaaagagcttagactcaagttacgcccgttgtaccagtttatgtcctgtaaggaattcgatgacttatttgagaacatgcacaaggagaaaatgctcagagcgaagattcgcgagctgcaacgctatcgtcgcaatggtatcaccaagatggaagaatccgccgagtacgaggcagccagacataaaagagaaaagcgtaaggagaataaaaatttggccggctcaaagcggggaaaggaggacggaaaggactccgagttcgcagcaatagaaaatctgcctggtttcgagctcctgagcgatagagaaaaggtcctctgctcctctcttaatctcagccccgcccgttatgtgaccgtcaaaaccattatcatcaaagaccatctgcagaagcgacagggcatcccttccaagtcgcggctgccctcttatctggataaggtcttgaagaaacggatattgaacttcctaaccgaatccggctggatctcccgcgacgcatcctag

SEQ ID NO: 209028 - DNA, 366 bp, Artificial Sequence
  Description of Artificial Sequence: Synthetic coding sequence
atggccgcccacgtgggcgccagccggaccccccaggaggtgatggagcactacgtcagcatgtatatccatggaaatctgggtaaggcctgcatcccagatactattccaaatagggtgactgatcatacatgcccatccggaggcccactgtctccaagcttaaccacacccctaccacctctcgacatctctgtggctgaacagcagcagctcggatacatgcccctccgggacgactacgagattgagtacgaccaagacgcagaaacattgatatctggcctcagtgtgaattatgacgatgacgatgtagagatagaattgaagagagctcacgttgatatgtatgtcaggaaactgtag

SEQ ID NO: 209029 - DNA, 390 bp, Artificial Sequence
  Description of Artificial Sequence: Synthetic coding sequence
atggccgcccacgtgggcgccagccggaccccccaggaggtgatggagcactacgtgtcaatgtatattcatgggaacttgggaaaagcatgcattcccgataccatccccaatagggtgaccgaccatacatgcccgtcaggtggccccctcagcccttcactgacgacccctctgccccctctggacatctcagtggccgagcagcagcagctgggctatatgcctttgagggacgattacgaaatagagtatgaccaggacgctgaaacgctgatctccggtctcagcgtgaattacgacgacgatgacgtggagattgagctgaaaagagcacacgtggatatgtatgttcggaagctgaaagagaggcaacgacggaagaactag

SEQ ID NO: 209030 - DNA, 1038 bp, Artificial Sequence
  Description of Artificial Sequence: Synthetic coding sequence
atggccgagctgggcaagaagtactgcgtgtactgcctggccgaggaagatatggctgcccatgtgggagctagccggacccctcaggaggtgatggagcactacgtaagcatgtacatacatggtaacctagggaaagcctgcatccctgataccattccaaatagggttactgatcatacttgtccatccggagggccactgagtccctctctgactacgccgctgccccccctcgacatctctgtcgctgagcaacaacagctgggctacatgcctctccgggacgattacgagatcgagtacgaccaggatgcagaaactttaatttctggcctttcagtgaattatgacgacgatgacgtggaaattgagttgaagcgagcacatgtggacatgtacgtgcggaaattgaaggagcggcagagacgaaagaacatcgcacgcgattataatctggtccccgccttcctaggcaaggataaaaaagaaaaggaaaaagcgttgaagcggaaaataacaaaggaagaaaaagagttaagacttaaactgcgacccctgtaccagttcatgtcttgcaaggagtttgatgaccttttcgagaatatgcacaaagaaaagatgctccgagcaaaaatccgcgaattgcagcgctaccggagaaatgggataactaaaatggaggaaagcgcagaatacgaggctgcacgccacaaacgggagaagcgtaaagaaaacaagaaccttgcgggttccaaacgcggcaaggaggacgggaaggactccgaatttgcagctattgaaaacctgccggggttcgagctgctgagcgacagagaaaaggtgctgtgctccagcctcaatttatctcccgcacggtatgtcactgtgaagacaatcataatcaaagatcacctccagaaaaggcaagggatcccctctaagtcccgacttcccagctatctggacaaggttctgaaaaaaagaatactgaactttttaacggagtccggatggatttcacgtgatgcctcttag

SEQ ID NO: 209031 - DNA, 987 bp, Artificial Sequence
  Description of Artificial Sequence: Synthetic coding sequence
atggccgcccacgtgggcgccagccggaccccccaggaggtgatggagcattacgttagtatgtacatccatggcaacctggggaaggcttgcatccctgacacaattcctaaccgcgtgaccgatcacacctgtccctcggggggccccctgagtccgtctcttactacaccccttccccccctggacattagcgtagccgagcagcagcagcttggctacatgcctttaagggatgactatgagatagaatacgatcaggatgccgaaaccctcatctcagggctcagcgtcaattacgatgacgatgacgttgaaatcgagctgaaacgcgcacatgtggacatgtacgtgaggaagctgaaggagcgccagcgccggaagaatatcgcgcgggactacaatctagtcccagcctttctgggcaaggataaaaaggaaaaagagaaagctttgaaaagaaaaataactaaggaagagaaggagctacgcctcaagctccggcccctttatcagttcatgagctgtaaggagtttgacgacctgttcgaaaacatgcacaaggaaaagatgctcagagctaaaatacgcgagctgcagaggtatcgacgcaatggcataacaaagatggaggagagcgcagagtacgaagccgccaggcacaaacgagaaaaacggaaggaaaataagaatctcgcagggtcgaaaaggggcaaagaggatgggaaggatagcgagttcgcggctatagaaaaccttccaggatttgagctgttgagtgatagggagaaagtgctgtgctcgtctctgaacctgtctcccgcgcgctacgtgacggtgaaaacaatcattataaaagaccacctacagaaacgtcagggaataccatctaaaagcaggctcccatcctacttagataaggtcctgaagaaacgcatcctgaatttccttacagaatctggatggatttctagggacgcgtcttag

SEQ ID NO: 209032 - DNA, 1299 bp, Artificial Sequence
  Description of Artificial Sequence: Synthetic coding sequence
atgagcgagctgaaggactgccccctgcagttccacgacttcaagtctgtggaccatttaaaagtgtgcccgaggtataccgccgtcttggcaagaagtgaagatgatggaatcggaatagaagaactggacaccttacagctggagctggagacacttctgtcatctgcatcccgtcggctgcgagtcctggaggccgagacccagatcctgaccgattggcaggataaaaaaggggatcggcgcttcttaaagttaggaagggatcatgagctgggggctcccccgaagcatggtaaacccaagaagcagaaacttgagggcaaagcaggccacggtccaggcccgggccccggcaggcctaaatcaaaaaatcttcagcctaagattcaggaatatgaattcacggacgatccgattgacgtgccgagaattcccaagaacgatgcccccaacaggttttgggcttccgtggagccctattgcgcagatataaccagcgaagaagtgagaaccttggaggagctgctgaaaccaccagaggatgaagccgaacactataaaatccctcccctaggcaagcactactctcagcgatgggcccaggaggacttgttagaggagcagaaagatggggctcgagccgcagccgttgctgacaagaaaaaaggcttaatgggacctctaaccgaactggacaccaaagacgtggacgctctcctgaagaagtcagaggcccagcatgagcagcctgaggatgggtgtcccttcggagctttgacccagagactgcttcaagccctggtggaagagaacattatttccccaatggaggattctccgattccggatatgtcgggtaaggagagtggcgctgatggggcctccactagtccccgtaaccagaacaagccctttagtgttcctcatacgaagagtttggagagtagaattaaggaagagttgatcgcacagggcctgcttgagagcgaggatcgccccgctgaggatagtgaggatgaggtcctcgccgagctccggaagagacaggcagaactgaaagcccttagcgctcacaacaggaccaaaaagcacgacttactacgcctcgccaaagaagaagtgtctaggcaggagttgcgtcagcgggttcggatggcagacaacgaagtgatggatgccttcaggaagattatggccgcccgccagaagaaacgaactcctacaaagaaggaaaaggaccaagcatggaagactttgaaagagcgagaaagtatacttaaactcctggacgggtag

SEQ ID NO: 209033 - DNA, 1110 bp, Artificial Sequence
  Description of Artificial Sequence: Synthetic coding sequence
atgagcgagctgaaggactgccccctgcagttccacgacttcaagtctgtggaccacttaaaagtctgcccccgttacacagccgtcctcgcacggtccgaagacgacggcatcgggattgaggagctcgacactttgcagcttgaacttgagacgttgctgtcctcagcctctcgacgcctgcgggttcttgaggcggagactcagatcctaaccgattggcaggacaaaaaaggggatcgccgatttctgaagctcggtcgtgatcacgaactaggggctcccccaaagcatggtaaaccgaagaagcagaagctagagggaaaagccggtcacggccccgggcctggccctggaagacctaaatccaaaaatctccagcccaagatacaggagtacgagttcactgacgatcctattgatgtgcctcggattcccaagaatgatgctcccaacagattttgggcctccgtcgagccctactgcgcggatattacatctgaagaggtgcgcacactggaggagctgctcaagccgcctgaagatgaggcagaacactacaagatcccgcccctcggaaaacactactctcagcggtgggcccaagaagatttactggaggaacagaaggatggggcgagggcagctgctgtcgccgataagaagaaaggtctgatggggccgctgacagagctagacaccaaggacgtggacgcactgctcaaaaaatccgaggcgcaacatgagcaaccagaggacggatgtccgtttggcgctctgactcaacgtttgctacaagcattggtagaggagaatattatctcacccatggaggattcccctatccctgacatgtctggtaaagaatctggtgccgatggtgcaagtaccagtccccggaaccagaacaagccgttctctgtcccccatactaagtcactcgagtcaaggattaaggaggagctcatagcccagggcctactggaatcggaggacagaccagcggaggattcagaggacgaggttctggcagagctacgaaagcgccaggccgaactcaaggctctgtctgcacacaaccgcacaaagaagcacgacctgttaagatag

SEQ ID NO: 209034 - DNA, 288 bp, Artificial Sequence
  Description of Artificial Sequence: Synthetic coding sequence
atgagcgagctgaaggactgccccctgcagttccacgacttcaagagcgtggatcacctgaaagtctgcccacgctacacagcagtcctggccagaagtgaggacgacggcattggaatcgaggaacttgataccttacaactagagctcgagacacttctgagctcagcaagccgccgcctccgagttctggaggctgagacacagatcttaacggattggcaggataagaaaggcgatcggaggtttttaaaacttggacgagatcacgaactcggtgccccgtag

SEQ ID NO: 209035 - DNA, 1299 bp, Artificial Sequence
  Description of Artificial Sequence: Synthetic coding sequence
atgagcgagctgaaggactgccccctgcagttccacgacttcaagtccgtagaccacctcaaagtatgtccgcgctacaccgcggttctagcccgtagtgaagatgacggcatcgggatcgaggagctggacacgctgcagctcgagctggaaactctacttagcagcgcatccaggcggctgcgggtgctagaggccgaaacacagatcctgaccgattggcaggacaagaaaggagaccgcagatttctgaaactgggccgcgaccacgagctgggagccccgcccaaacatggtaagcctaagaaacagaagctcgaaggcaaggccggtcacgggcccgggcccgggccgggacggcccaagagcaagaacttgcagcctaaaattcaagagtacgagtttacagatgatcccattgacgtgcctcgaatcccgaaaaatgatgctccaaatcggttttgggcgtcagtggagccctactgtgctgatataacctctgaggaggtccgaacattggaagaactgctgaagccccccgaggacgaagctgagcattacaagattcctccattgggaaaacattactcacagaggtgggcacaggaagatctgcttgaagagcagaaagacggggcaagagccgccgccgttgcagataaaaagaaaggactgatgggaccactgacggaactcgacactaaggatgtggacgctcttttgaagaagtctgaggctcagcacgaacaaccagaagatggttgccctttcggggctctgacccagaggctgctccaggccctggtcgaggaaaatatcatttctcccatggaggattctcctatcccggatatgtcaggaaaagaaagcggcgctgatggagcctctacctcccctagaaatcagaacaaaccattctccgtgcctcatactaaaagtctcgagagtcggattaaggaggagctgattgcacaaggactgttggaaagcgaagaccgtcctgccgaggatagcgaggatgaggtgctggccgagctgagaaagaggcaagccgaactgaaggctctatccgcacataaccgcacaaagaaacacgacctgctcaggctggcgaaagaagaggtctccaggcaggagctgcggcagcgcgtgcgcatggcggacaacgaagtgatggacgccttccgcaaaataatggctgctcgccagaaaaagagaaccccaaccaagaaagagaaagaccaggcctggaagacccttaaggagagagaaagtattctcaagctgctggacggatag

SEQ ID NO: 209036 - DNA, 1038 bp, Artificial Sequence
  Description of Artificial Sequence: Synthetic coding sequence
atgcagctggagatccaggtggccctgaacttcatcatcagctacctttacaataagctgcctcgaaggagggtgaacatctttggcgaggaattagaacgattgctcaagaagaagtatgaggggcattggtatcctgaaaaaccatataaaggcagtggatttcggtgcattcacattggcgaaaaggtggatcccgtaattgagcaggcatccaaagaatccgggcttgatatcgatgacgtgcggggaaatcttccccaagacttgtctgtctggatagacccgtttgaagtgtcttaccagatcggggagaaaggcccagtgaaggtgttatacgtggacgacaacaacgagaatggttgtgagctagataaggaaattaaaaacagcttcaatccggaggcccaggtctttatgcccatctctgaccctgcttcctccgtgtcctctagtccttcaccaccttttggacacagcgccgcagtgagtccaacttttatgcctagaagtacacagcctctgacctttacaacggcaacattcgcggccaccaagtttggctcaactaaaatgaagaactccggtcggtccaacaaggtcgcacgaacttctcctatcaatcttgggttgaatgtgaatgacctgcttaaacagaaggctattagttcatccatgcactctctctacggcctaggcctgggctcacagcaacagcctcagcagcagcagcagccggctcaaccacctccacccccaccaccccctcagcaacagcagcagcagaagacgtcggctctgtcaccgaatgccaaagagttcatcttcccaaatatgcagggacaggggtctagcactaacgggatgttccctggagattctcccctgaacctgagccccctgcagtacagcaacgcttttgacgtctttgctgcctatggcggcctgaatgaaaagagtttcgtcgatggactgaatttctccttaaataatatgcagtatagtaatcagcagtttcagccagtgatggcaaactag

SEQ ID NO: 209037 - DNA, 1038 bp, Artificial Sequence
  Description of Artificial Sequence: Synthetic coding sequence
atgcagctggagatccaggtggccctgaacttcatcatcagctacctttataacaaactgccacgaagacgcgtgaacatcttcggagaggaattagagcggctgctcaagaagaaatacgaaggccactggtacccagagaaaccttacaagggcagtgggtttaggtgtattcatatcggggagaaagtcgatcccgttattgagcaggcctctaaggagtcaggacttgacattgacgatgtgcgaggaaatctgccccaagatctctccgtctggatagacccttttgaagtgtcataccagatcggcgaaaaaggaccagtcaaagttctttatgtcgacgataacaatgagaacggctgtgagttagacaaggagattaagaacagcttcaacccagaagcccaggtgttcatgcctatttcggaccctgccagtagtgtgagttctagccctagccctcctttcggccacagtgccgccgtgtcacctacgttcatgccaaggtcaactcagcccctgaccttcaccaccgctacattcgctgccaccaagttcgggagcacgaaaatgaagaactctgggcgctctaataaggttgcgagaacctctcccatcaaccttggattgaatgtcaatgatctgcttaaacagaaggccatatcttcaagcatgcacagcctctatgggctgggtctgggatcccaacaacaaccccaacagcagcagcagcccgcgcagcctcctcctcctcccccaccaccacagcagcagcagcaacagaagacttccgctctgagcccaaatgcaaaagagtttatcttccccaacatgcagggccaaggttcctcaaccaacggaatgttccctggcgactcccctctcaatctgtcaccactgcaatactccaacgcgttcgacgtctttgctgcctacggcggactcaatgagaaaagctttgtggacggcctcaatttttctctcaataacatgcagtattccaatcagcagtttcaaccagtgatggcaaactag

SEQ ID NO: 209038 - DNA, 1035 bp, Artificial Sequence
  Description of Artificial Sequence: Synthetic coding sequence
atgcagctggagatcaaggtggccctgaacttcatcatcagctacctgtacaataaactcccgagacgcagggctgacttatttggcgaagagctagagcgcttgctgaaaaagaagtacgagggacactggtatccagagaagccactgaagggaagcggctttcgctgtgttcacatcggtgagatggttgatcccgtagtcgagctggccgctaaacgctccggtctcgccgttgaggatgtgcgcgctaatgtccctgaggaactgagtgtctggattgatccgttcgaagttagctaccaaataggggagaaaggagccgtgaaggttctgtacctggacgattccgaaggctgcggtgctcctgagctcgacaaggaaataaagagttcattcaacccggatgcccaggtatttgtgccaatcggctctcaggatagcagcctgagtaacagcccttctcccagcttcggccagagcccatcccccactttcatcccacgctctgcacagcccattactttcactacagcctcctttgctgccaccaaattcgggagcactaagatgaaaaaaggaggcggggcagcctcgggggggggtgtggcctcctcaggggctggcggccagcagccaccacagcagccgagaatggctcggagtcccacaaactcactgcttaagcacaaatcactgagtctttccatgcactccctcaactttatcaccgccaaccccgcacctcagagtcagctgagccctaatgccaaagaattcgtatacaatggcggaggctcacccagcttgtttttcgacgcagcagatggccagggaagtgggacaccaggtccattcggtggttcaggagccggtacatgcaacagctcaagctttgacatggctcaggtcttcggagggggggcaaatagcctgtttctggagaagacacccttcgtagagggcctctcctacaacttgaacacaatgcaatatccttcgcaacagttccagccagtggtattagctaactag

SEQ ID NO: 209039 - DNA, 306 bp, Artificial Sequence
  Description of Artificial Sequence: Synthetic coding sequence
atgcagctggagatcaaggtggccctgaacttcatcatcagctacctgtacaataagctgcctagaaggagggcggatctgtttggtgaggaattggaaaggctgctgaagaagaaatatgagggacattggtacccagaaaagcccttaaaaggttctggctttagatgcgtccatatcggggagatggtggatccagtggttgagctcgccgcaaagcgatcaggactggccgtggaagacgtgagggctaatgtgcccgaagagctctctgtctggatcgatccctttgaggtgagttattag

SEQ ID NO: 209040 - DNA, 1569 bp, Artificial Sequence
  Description of Artificial Sequence: Synthetic coding sequence
atgagcatcaccagcgacgaggtgaacttcctggtgtaccggtacctccaggaaagcgggtttagccatagcgccttcactttcgggatcgaatcacacataagccagtcaaacatcaacgggactttggtgccccctagcgcactgatcagcatattgcagaagggtctccagtatgttgaagctgaaatctcgattaataaggatgggacagtatttgactctcgaccaatagagagtctctctctcatcgtcgccgttatacctgacgtggttcagatgcggcaacaggcctttggtgagaaactgacacagcagcaggcatctgctgccgccacagaagcttccgcgatggccaaggctgctacaatgactccagctgccattagtcaacagaatcctcccaaaaaccgagaagccaccgtcaacggggaggagaacggcgcccatgagattaataatcactctaaacccatggagatcgatggcgacgtggagatcccgccaaataaggcaactgttctgcgcgggcatgagagtgaggtctttatttgcgcatggaaccctgtgtctgatctgctcgctagtggatcaggcgattccacggcccggatctggaatctgaatgagaactccaacggcggctcgacccaacttgtcctcagacactgtatccgcgaaggtggtcatgatgtgccttcaaataaagatgtgacatctctggattggaactctgacggcacgctgctggcgatgggctcatacgacggatttgcccggatttggactgaaaacggaaatctcgctagtacgctgggtcagcataaaggcccaatattcgccctgaaatggaacaagaagggaaattacgtgctgtccgctggagtggataaaacaacgattatatgggatgcccataccggtgaggcaaaacagcaatttccattccattcagcaccagctctagatgtcgactggcagaataacatgacgttcgcaagttgcagcacagacatgtgtattcacgtgtgccgacttggctgcgaccacccggtcaaaaccttccaggggcataccaacgaggttaatgccataaaatgggatcccagtggtatgctgctggccagctgcagcgatgatatgacgcttaaaatttggtcgatgaagcaggacgcatgtgtgcatgacttgcaggcacactctaaagaaatctacaccatcaagtggtcccctactggtccagcaacctccaaccctaacagcagcatcatgcttgcatccgcgtcttttgattccaccgtgcggctttgggatgtggaacagggggtctgtacacacaccttgatgaagcatcaggaaccagtttacagcgtggcatttagccctgacggaaagtacttagcttcaggctcttttgacaagtacgttcacatatggaatacccagagtggttccctcgttcattcatatcagggcactgggggcatcttcgaggtctgctggaacgccagaggtgacaaggtgggggcctcggcatctgacggatctgtgtgtgttctggatttgtag

SEQ ID NO: 209041 - DNA, 1569 bp, Artificial Sequence
  Description of Artificial Sequence: Synthetic coding sequence
atgagcatcaccagcgacgaggtgaacttcctggtgtaccggtaccttcaagagagtggcttcagccactccgctttcacttttgggatcgaaagccatatttcacaatccaacattaatggcactctagttcccccctcagctctgattagcattctgcagaagggattacaatatgttgaggctgagattagcatcaacaaagacggcactgtgtttgatagtcgacccatcgagtcgttgagcctgattgtggctgtgatacccgatgtcgtccagatgaggcaacaggcatttggggagaaactgacccagcaacaggctagcgcagcggccactgaggccagtgcgatggctaaggccgctacaatgacccctgccgcgatatcgcagcagaatcctccgaagaacagagaagccacagtcaacggagaggaaaatggggctcacgaaatcaataaccactccaaacctatggaaatcgacggggatgtcgagatcccccctaacaaagccaccgtcttacggggccacgagtctgaagtgttcatctgcgcctggaacccagtatctgatcttcttgctagtggtagtggcgactctaccgctagaatctggaatctgaatgaaaacagcaacggcggatccactcagctagtcctgcggcactgtatccgcgagggcggccacgacgtgcccagtaataaagacgtcacgagcttggattggaatagcgatggaacgttactcgctatgggctcctacgacggcttcgccagaatctggactgaaaacggcaatctggcctcaaccctgggacaacataaggggcctatatttgcgctaaagtggaataagaaaggcaattatgtcctttccgctggagttgacaagactaccattatttgggatgctcacactggggaggccaagcagcagttcccgttccactctgcgcccgctctggatgttgattggcagaacaacatgacatttgcttcctgcagtaccgacatgtgcatccatgtgtgccggctaggatgcgatcatcctgttaagacgtttcagggacatacgaatgaagttaatgctattaaatgggatcctagcgggatgcttctggcgtcgtgttcagatgacatgaccctgaagatatggtcaatgaagcaagacgcttgcgtccatgaccttcaagcacactccaaggaaatctacacgattaaatggagccccactggccctgccacctctaaccccaacagctccatcatgctggcgagcgccagcttcgactccactgtgcgtctgtgggacgtggaacagggggtgtgcactcacaccctaatgaagcaccaagaaccagtgtatagcgtggcgttcagcccagatggcaagtatctggcctccggttcctttgacaaatacgtccacatttggaatactcaaagcgggtccttagtccattcctaccagggaacagggggtatcttcgaggtatgctggaacgctcgcggcgacaaggtgggcgcaagtgcctccgatggatcagtctgcgtgttggatttatag

SEQ ID NO: 209042 - DNA, 1569 bp, Artificial Sequence
  Description of Artificial Sequence: Synthetic coding sequence
atgagcatcaccagcgacgaggtgaacttcctggtgtaccggtaccttcaggaaagcggattctctcattctgcctttactttcggtattgagtcccatatcagccagagtaatatcaatggcacactggttccccccagtgctctgatctcaatactgcagaaaggtcttcagtatgttgaagccgaaatcagcatcaacaaggatggtacggtgttcgactctagacctatcgaaagtctctctctcattgtggccgtgataccggatgttgtccagatgcggcagcaggccttcggcgagaagctgacccagcaacaggcttccgccgcagccactgaagccagtgccatggccaaagccgctacaatgacccctgccgccataagccagcagaaccctcccaagaacagggaggcgactgtcaacggcgaggagaatggcgctcacgagatcaacaatcatagtaaacctatggagatcgacggagacgttgaaatacccccgaataaagcgaccgtgctcagaggacacgaatctgaagtattcatctgcgcatggaatcctgtgagtgacctcctagcctccggaagcggagattccaccgcaaggatctggaaccttaatgagaactcgaatggcggctctacccagctcgtgctgagacattgtattagagaggggggccacgacgtacctagtaataaagatgttacgtcactggattggaacagcgatgggacattgttagcaatgggatcttatgacggatttgctcgcatttggaccgaaaatggcaacctagcttctacacttggacagcataaaggacctatcttcgcactgaagtggaacaagaaagggaactatgtgctgtcggctggagttgacaagactacgattatctgggacgcccatactggcgaggcaaagcagcaattcccctttcactcagcgccagccctggatgtcgactggcagaataacatgacatttgccagctgctcaacggatatgtgcattcatgtgtgtcggctggggtgcgatcatcctgtgaagacatttcagggtcacaccaacgaggtgaatgcaataaaatgggacccctccgggatgctattggcctcatgtagcgatgacatgacactgaagatctggtcaatgaagcaggacgcgtgcgtgcacgacctccaagcccatagtaaggagatttataccatcaagtggtctcctaccggaccagccacctccaatccaaacagcagcataatgctggctagcgcaagcttcgactccacagtgcgtctgtgggatgtagagcagggagtgtgtacacatacattgatgaagcaccaggagcctgtttattctgtggccttttcaccagatggcaaatacctcgcaagcggcagttttgataagtatgtgcatatatggaatactcaatcgggatccctggttcactcttatcaggggacaggcggcatttttgaggtgtgctggaacgctagaggcgacaaagtcggagcaagcgcatcagatggatcagtatgcgtactcgacttgtag

SEQ ID NO: 209043 - DNA, 1095 bp, Artificial Sequence
  Description of Artificial Sequence: Synthetic coding sequence
atggagatcgacggcgacgtggagatcccccccaacaaggccaccgtcctccgcgggcacgagagtgaggtgtttatttgcgcatggaaccctgtgagcgatttgctggcatccggatccggcgacagtacagcaagaatctggaaccttaatgagaattccaatggggggtcgacgcagcttgtgctgaggcattgcatcagggaaggggggcatgatgtgccatctaataaggacgtgacctctctggactggaactctgatgggacactgctggccatggggagctacgacggcttcgccagaatctggaccgagaacgggaacctggctagtaccttggggcagcataagggaccaatttttgccttgaaatggaataagaaggggaattatgtgctgagtgctggagtggacaagactacaatcatctgggacgcccacaccggggaggctaaacaacaatttccttttcattccgcccccgctctcgacgtggattggcagaacaatatgaccttcgcttcttgcagtacggacatgtgcattcacgtttgtcgcctgggatgcgatcaccctgtgaagaccttccagggccacaccaatgaggtcaatgcgatcaaatgggatccatcagggatgctcttagcttcatgttctgatgatatgacattgaagatctggtcaatgaaacaagatgcctgtgtgcacgacttgcaggcccactcaaaagaaatctacactattaaatggtcgcccacgggtccggcaacaagtaatcctaattccagcataatgctcgccagtgccagctttgactccaccgtgcgcttgtgggacgtggagcagggggtatgcactcacacgcttatgaagcatcaggagcccgtttactcagttgcattcagtccagacggtaagtatctcgccagtggatcatttgataaatatgtacacatctggaacactcagtcaggttcacttgttcattcctatcagggtaccggggggatttttgaagtgtgctggaacgcccgaggcgacaaagtcggtgcctcagccagcgacggttccgtgtgtgttctggatttatag

SEQ ID NO: 209044 - DNA, 1752 bp, Artificial Sequence
  Description of Artificial Sequence: Synthetic coding sequence
atgcccctgcggaagatgaagatccccttcctgctgctgttcttcctctgggaggcagagtctcatgctgcctcgcggcctaatattattctggtgatggctgacgatttgggaattggagatcctggatgctatggaaacaagactattcgcaccccgaacatcgatagattggcctccggcggagtgaagctgactcagcatctcgcagctagccctctttgtacaccttcccgggccgcttttatgacaggccggtacccggttcgatcaggtatggcctcttggtcacggacgggggtgttcttgttcactgcttcttccggtggactgccgaccgacgaaattacgttcgcaaagctgctgaaggatcaaggctatagcacagctctgatcgggaaatggcatcttgggatgagttgccatagtaagactgatttctgccatcatccactgcaccatggattcaattacttctatggaattagtttgaccaatttgagggactgcaagccaggggaagggagcgtgtttacaaccggtttcaagcgattagttttcctgcccctacagatcgtgggtgtgaccctgttgacgttagctgcgctgaactgcctgggattattgcacgtccctctgggcgtctttttcagcctgctgtttctggccgcgctgatcctgacactgttcctgggttttctgcactattttagaccccttaattgcttcatgatgaggaattacgagatcatccagcaaccaatgtcttatgataatctgactcagaggctaacggtcgaggcggcacagtttatccaacggaatactgagaccccattcctgttagtgctgtcttatcttcatgtgcacaccgctctattcagcagcaaggacttcgcaggcaagagtcagcatggggtgtacggagatgcggttgaggagatggactggagcgtcggacagattctgaatctcctcgacgagctgcggcttgcaaatgatacattgatctattttacgtctgatcaaggcgcccacgtggaggaagtaagtagcaaaggggaaatccatggaggatcaaatgggatatataaggggggtaaagcaaacaactgggaggggggaattagggttcccggcattctgcggtggccccgggtgatacaggcaggtcagaagatcgacgagcctaccagcaatatggatatattcccaacggttgctaagcttgctggggccccactcccagaagataggataatcgatggccgcgacttgatgccactcctggaggggaagagtcagcggagcgaccacgagttcctgtttcactactgcaacgcttatctgaacgctgtaagatggcatcctcaaaatagcacgtcgatctggaaagccttcttctttacacctaatttcaatcctgtggggagtaacggctgtttcgctacccacgtgtgcttttgttttgggagctatgttacacaccacgaccctcccctgcttttcgatattagtaaagatcctagggagaggaatccactgacccctgcaagcgagccccgcttctacgagatcctgaaggttatgcaagaagccgctgatcgccacactcagaccttgcccgaagttccggatcagtttagttggaataatttcctttggaaaccgtggctgcagctttgctgccccagcaccggactatcatgtcagtgcgacagagaaaaacaggataagaggctgtcccggtag

SEQ ID NO: 209045 - DNA, 1581 bp, Artificial Sequence
  Description of Artificial Sequence: Synthetic coding sequence
atgagcatcaccagcgacgaggtgaacttcctggtgtaccggtaccttcaggagtccgggttcagccattctgcttttacctttggcatcgaatcccatatctcacaaagtaacatcaacggcactttggttcctccagccgcccttatctctattctgcaaaaaggcctacagtatgtggaggccgagatcagcatcaacgaagacgggacagtcttcgacgggagaccgattgagagtctgagcctgatcgacgctgttatgcccgatgtggtccagacaagacaacaggcatttcgggaaaagctcgcccagcagcaggcctctgcagccgccgccgctgctgcggccacagccgcagcaactgcagcgacaacaacttcggccggcgtatcacatcagaaccccagtaagaaccgggaagccaccgttaatggagaagaaaaccgagcacacagtgtgaataatcacgcaaagcctatggagatagatggcgaagttgagatcccctcatcaaaagctactgtactccgcgggcacgaatcggaagtgttcatctgcgcctggaatccagtgtccgatctgttagcgagcgggagcggagactccacggcccggatctggaaccttaacgagaatagcaacgggggctccacccagcttgtactgagacattgcatcagagaggggggccatgatgttccgtctaataaggatgtgactagcctcgattggaatacaaacggcactctcctggcgactggatcttatgacggctttgcccgaatttggactgaggatgggaacctggcttccactctggggcaacataaaggccccatattcgcactcaagtggaatcgcaaggggaattatattctctcagccggcgtggataaaactactattatatgggatgctcatacaggtgaggcaaagcagcagttccctttccattcggccccagctctggacgtagattggcagaataacaccacatttgctagctgcagtacagatatgtgcatacacgtgtgtcgtttgggctgtgaccgccccgttaagacttttcagggtcacacaaatgaagtcaatgctattaagtgggacccctcaggcatgttactggcatcctgctctgatgacatgactctgaagatctggtcaatgaaacaggaagtttgcatccacgatctccaagctcacaacaaggaaatatatacaatcaagtggagtcccaccggtcccgccacttcaaatccgaattcgaacattatgttggcttctgcctcattcgactccaccgtccgattgtgggatatcgaaagaggagtctgcacacacactctgactaagcatcaggaacctgtctattcagtggcattcagcccagacggtaaatacctcgccagcggatcatttgacaagtgcgtccacatttggaatactcagagcgggaacttagttcactcctataggggtaccggtggcatatttgaggtgtgttggaatgctagaggcgataaagtgggcgcttccgcaagcgacggatcagtgtgtgtgctggatttacggaagtag

SEQ ID NO: 209046 - DNA, 1734 bp, Artificial Sequence
  Description of Artificial Sequence: Synthetic coding sequence
atgaccgagctggccggcgccagcagcagctgctgccaccggcccgccgggcgcggagccatgcagtctgtcctgcaccatttccaaaggctgagggggcgtgagggaggcagtcattttatcaatacctcatcccctaggggggaggccaaaatgtctataacgtcagatgaggtgaacttcttagtgtacaggtatctgcaagaaagtggtttcagtcactctgctttcacattcggcattgagagccatatttcccagtcaaacatcaatggcacattggtccctccagctgcgcttatttcaattttgcagaagggactgcagtacgtggaagctgagatctcaataaacgaagatggtaccgtcttcgatggccgccctatcgaatcgctgtccctaatcgatgccgtaatgcccgatgtggtccagacacgacagcaggctttcagagagaagcttgctcagcagcaggccagtgctgccgctgccgccgccgctgcaaccgccgctgcaactgccgccactacaacttcagccggcgtgtcccaccagaatccctccaagaatcgcgaggctacggtgaacggagaggagaacagggcccatagcgttaacaatcacgcaaagccaatggagatcgatggggaggtggaaatcccctccagcaaggccaccgtgctcagagggcacgaaagcgaagttttcatctgtgcctggaaccccgtttccgatctcctggcttccgggtctggggatagcacagcccggatttggaatctcaacgaaaatagtaatgggggaagcacacaactcgtgctcaggcactgcatcagggagggaggacacgacgtgccgagcaataaagacgtgactagcctggattggaacacaaacggcacactgctggcgacaggtagctacgatggatttgccaggatttggaccgaagatggcaatcttgcaagtacactcggccaacacaaagggcccatcttcgcgctgaagtggaataggaagggcaactacattctttcagcaggggtggacaagactaccatcatctgggacgcccacactggtgaggccaagcaacaatttccattccactccgctcctgcgctggacgtcgattggcagaacaacacaacctttgcctcctgctccactgatatgtgtattcatgtgtgccgactggggtgcgacagacccgttaaaacgtttcaagggcacacaaatgaagttaacgccattaagtgggatccttcaggaatgctgcttgcgagctgtagtgatgatatgacactcaaaatttggagcatgaagcaggaagtgtgtatccacgacctgcaggcacataataaagaaatatatactataaaatggtcgccgactgggcccgcaacgagcaatcccaactcaaacattatgctcgcctcagcctcatttgactctacagtgcgactctgggacatagagcgaggcgtctgtacccacaccctgactaaacaccaagagccggtatatagcgtggccttcagccctgatggcaaatatctggcatccggctctttcgacaagtgcgtccatatctggaatactcagagcggtaatctggttcattcttatcgaggcacggggggcatcttcgaagtctgctggaacgccagaggtgacaaagttggcgctagcgctagtgatggatccgtgtgcgtgctcgacctgagaaaatag

SEQ ID NO: 209047 - DNA, 228 bp, Artificial Sequence
  Description of Artificial Sequence: Synthetic coding sequence
atgagcatcaccagcgacgaggtgaacttcctggtgtaccggtaccttcaggagtctgggttctctcactcagctttcaccttcgggatcgagtctcacatctcacagagcaacattaacggcacactggtcccgcctgctgcgttgatttcgatcctgcagaaaggcctacagtatgtggaggcagagataagtatcaacgaggatggtaccgtgttcgatggctag

SEQ ID NO: 209048 - DNA, 138 bp, Artificial Sequence
  Description of Artificial Sequence: Synthetic coding sequence
atgagcatcaccagcgacgaggtgaacttcctggtgtaccggtacctgcaagagagcggattttcacactctgctttcacattcggcatcgaatcgcacatcagccagagcaacataaacggaaccctggtcccgtag

SEQ ID NO: 209049 - DNA, 1581 bp, Artificial Sequence
  Description of Artificial Sequence: Synthetic coding sequence
atgagcatcaccagcgacgaggtgaacttcctggtgtaccggtacctgcaggaatccgggtttagccacagcgcttttactttcgggatcgaaagccacatctcccagagcaatattaatggaacacttgtcccaccagcagccttgataagcatactgcagaaaggactgcagtacgtggaggcagagattagcatcaacgaggatggtacggtgtttgacggtcgacccatagaaagcttgagtcttatcgatgcggtcatgccggacgtcgtccagactcgtcaacaggcattccgtgagaaattggcacagcagcaggccagtgcggccgctgccgccgctgccgctacagcggctgccactgcagcgacaacaaccagcgctggggtgtcccaccagaatccctcaaaaaatcgggaggccaccgtcaatggcgaagagaaccgggctcactctgttaacaatcatgctaagcccatggaaatcgatggagaggtggaaatccccagctccaaggccacagtgctgcgtgggcacgagagtgaagtgtttatatgtgcatggaatcccgtaagcgatctcttggcatccgggagcggagactctacagcgcgaatctggaatctgaacgagaattccaacggggggtccacacagctggtattacggcattgcatacgggaaggtggacacgatgtgccctctaataaagatgtcactagcttagactggaatactaatggaacactgctggccaccggtagctacgacggctttgcacgcatttggaccgaagacggaaatcttgcttccaccctcgggcagcacaagggtcctatttttgccctgaagtggaataggaagggcaactacattctgtcggcaggcgtggacaagacaacaatcatctgggacgcccatactggcgaagcaaagcagcagtttccatttcacagcgcgccagctttagatgtcgattggcagaacaacaccacattcgctagttgcagcactgacatgtgtatccacgtatgcagattgggatgtgatcgacctgtgaagacttttcagggacatacaaacgaagttaacgccattaagtgggatccatcaggcatgttacttgcatcctgtagtgacgatatgactcttaagatctggagcatgaaacaagaggtctgtatacatgacctgcaagctcacaacaaggagatttacaccattaagtggagccccactggccccgctacttctaatccaaattccaacattatgctcgcttccgcatcatttgactctactgttaggctttgggacatcgaacggggcgtatgcacgcacacgctgaccaaacatcaggagccggtgtatagcgtcgcattctcccccgatggcaaatatctcgctagcggtagctttgacaagtgtgtgcatatttggaatacgcagtccggaaacctggtgcactcttatcggggcaccggtggaatattcgaggtgtgctggaacgcacgcggcgataaggttggggcctcagcctcagacggcagcgtgtgcgttctcgacctccgaaaatag

SEQ ID NO: 209050 - DNA, 180 bp, Artificial Sequence
  Description of Artificial Sequence: Synthetic coding sequence
atgaccgagctggccggcgccagcagcagctgctgccaccggcccgctggtcgcggtgcaatgcagtctgttttacatcatttccaacggctcagagggagggaaggcgggagtcatttcattaacacaagcagcccccgcggcgaagctaaaatgtccattacgtctgacgaggtctag

SEQ ID NO: 209051 - DNA, 243 bp, Artificial Sequence
  Description of Artificial Sequence: Synthetic coding sequence
atgaccgagctggccggcgccagcagcagctgctgccaccggcccgctggccgcggcgctatgcagtccgttctgcaccatttccagcggcttagaggccgggaagggggatcccactttattaatacctccagccctcggggtgaagcaaaaatgtccatcacttcagacgaagtgaacttcttggtgtatcgatacttgcaggagtcaggcttctctcattccgccttcactttcggctag

SEQ ID NO: 209052 - DNA, 1581 bp, Artificial Sequence
  Description of Artificial Sequence: Synthetic coding sequence
atgagcatcaccagcgacgaggtgaacttcctggtgtaccggtacctgcaggagtctggctttagccacagcgcttttactttcggaatcgaatcacacatatctcaatcaaatataaatgggaccctggtccccccagccgccctgattagcatcctgcagaagggactccagtatgtcgaagcggaaatctctattaatgaggatggaaccgtgttcgatggcaggcctatcgagagtctctcactgatagacgctgtgatgcccgatgtggtgcaaactaggcagcaagcattcagagagaaactcgcacagcagcaggccagcgccgccgctgccgccgccgctgcaacagctgctgcaacggctgccaccacaacatccgctggcgtttcccatcaaaaccccagtaagaaccgggaagcaacagtcaatggggaggagaatcgcgctcatagcgtgaacaaccacgccaagccaatggaaatcgacggcgaggtggagatcccaagtagcaaggcaaccgtcttgcgagggcacgaatccgaagtgttcatatgtgcttggaacccagtgtctgacctattagcttccggcagcggggattcaactgcacgaatatggaatttaaatgaaaattccaatggagggagcacgcagctggtcctgaggcattgcattcgggaagggggccatgacgtgccatccaataaggacgttacttccttagattggaacacaaacggcacactgctcgctactggatcatatgacggcttcgccaggatttggacagaggatggcaacctggctagcaccctgggacagcacaagggtccgattttcgccctgaaatggaatcgaaaaggcaattatatcctgtcagccggcgttgacaagaccactatcatatgggatgcccatactggggaggcaaaacagcagttccctttccacagcgcccccgcactggacgtcgactggcagaataatactactttcgctagctgttcgactgacatgtgcatacacgtgtgtcgtcttggatgcgaccggcctgtgaagacatttcagggccacaccaatgaggttaatgcaatcaagtgggacccctctggcatgctcctggccagttgctccgatgacatgaccctgaagatctggagtatgaaacaggaggtctgtatccacgacctacaggcccataacaaagagatttacacgataaaatggagcccaactggcccagccactagtaacccaaactcaaacattatgcttgcctccgccagttttgacagtacagtccgcctgtgggatatcgaaaggggagtctgtacgcatacattgactaagcaccaggaacccgtctacagcgtggccttcagccccgatggaaagtatttggccagcgggagcttcgacaagtgcgttcatatctggaatacacagtcaggaaatctcgtgcattcataccgtgggaccggcggaatctttgaggtgtgctggaacgccaggggagacaaggtgggagcatcagcgtcagacgggtctgtatgcgtgctggatcttagaaaatag

SEQ ID NO: 209053 - DNA, 1344 bp, Artificial Sequence
  Description of Artificial Sequence: Synthetic coding sequence
atggagctgagccagatgagcgagctgatgggcctgagcgtgctgctgggcctgcttgcacttatggctactgccgcagtcgcacgaggctggctgcgggccggagaggagcgctccggaaggcccgcctgtcagaaagccaacggctttcccccagataagagctcggggtccaaaaagcaaaagcagtaccagagaatccgtaaggaaaagcctcagcagcacaattttactcacaggctgctggctgcagcacttaaatcacattccggtaatatttcctgtatggactttagctcaaatggaaagtacctagccacctgcgctgatgatcgaaccatacgcatatggagcaccaaggactttctgcaacgagagcatagaagcatgagagccaacgttgagctggatcatgcgactctcgtcaggttctccccagactgcagagcttttatagtgtggcttgcgaacggagacaccctgcgcgtgttcaagatgactaagagagaggatggcggctacacctttactgcgactcctgaagactttccaaagaagcacaaggccccagtgatcgacatcggcatcgccaacactggcaaattcatcatgaccgcgtcatccgataccaccgttcttatctggagtctcaaagggcaggtactctcaacaatcaacaccaaccaaatgaacaacactcacgccgccgtctccccatgcggccgtttcgtggcttcctgcgggtttacccccgatgtgaaagtgtgggaagtgtgcttcgggaaaaaaggcgaatttcaggaagtcgtccgcgctttcgaactcaagggtcactctgcagcagtccactcattcgccttttccaacgatagccgaaggatggctagcgtgtctaaagatggtacatggaagctatgggataccgacgttgagtataaaaagaaacaagacccatacctgctgaaaacagggagatttgaagaagccgccggggccgctccctgcaggctcgctctgagcccaaatgcacaggtgcttgccctggccagtggaagttccatccatctgtacaatacccgacgaggcgagaaggaagagtgctttgagcgcgtgcacggagaatgcattgctaatctgtccttcgatatcacaggtagattcctggcctcctgcggagaccgagcagtccggttgttccacaacactcctggtcatagggcgatggttgaggagatgcaaggccacctaaaaagggcctcgaatgaaagtactagacagagactacaacagcagcttacccaggcacaagaaaccctcaagagcttgggcgcccttaaaaagtag

SEQ ID NO: 209054 - DNA, 1341 bp, Artificial Sequence
  Description of Artificial Sequence: Synthetic coding sequence
atggagctgagccagatgagcgagctgatgggcctgagcgtgctgctcggtctcctggcacttatggctactgcagccgtcgccagagggtggcttcgggctggtgaagaacgaagtggtaggccagcctgccagaaggccaatgggtttcctccggataagtcaagcgggtccaagaaacagaagcagtaccagagaattcgaaaggagaaacctcagcagcacaacttcacccaccgcttacttgccgcggcactcaagtctcacagcggcaatatcagttgtatggacttttcctcaaatgggaagtatcttgcaacatgcgccgacgatcggacaattcgaatttggagcacaaaggattttcttcagcgcgaacacaggagcatgcgggccaacgtggaacttgatcatgccaccttggtgcgattttccccagactgtagagccttcatagtgtggttggccaacggggatacactgagagtcttcaagatgaccaaaagggaggacggaggctatacgttcactgcaactccggaagatttccctaagaaacataaagctccagtgattgacatagggattgctaacactggcaaatttattatgacggcgagctctgacacaacagtgctgatctggagcctcaaaggccaggtcctaagcactattaacacaaaccagatgaataacacgcatgctgcagtgtctccttgcggaaggttcgttgcctcctgcgggttcacgccagacgtgaaggtctgggaggtttgcttcggcaagaaaggcgagtttcaggaagtcgtgcgcgcattcgaacttaaagggcattctgcggcagtgcactcattcgccttttccaatgacagcagaagaatggcctcagtgagtaaggatggcacctggaagctatgggatacggacgtggaatacaaaaagaaacaggatccgtacctgctaaagacggggaggttcgaggaggctgctggggcagctccctgccggttggctctctctcctaacgcacaggtgttggccctggcctcaggctcttccatccatctgtataatacccgacggggagagaaagaggagtgcttcgaacgggtgcatggtgagtgtatcgcaaacctatcattcgatatcaccgggagatttcttgctagctgcggggacagggcggtgcgcttgttccacaataccccagggcatagggcaatggttgaggagatgcagggacatctgaagcgggcttcaaacgagtccactcgccaacggctgcagcagcagttgacccaggcccaagtgacactgggcggccctggtgcggaagactag

SEQ ID NO: 209055 - DNA, 2427 bp, Artificial Sequence
  Description of Artificial Sequence: Synthetic coding sequence
atggccgagaccgccgccggcgtgggccggttcaagaccaactacgcagtggaacggaagatcgaacctttctacaagggcggaaaagcccagctagaccaaactggtcagcatctgttctgtgtatgtgggactcgggtgaacattctggaggtggcatcgggcgccgtgctaaggagtctggagcaggaagatcaggaagatatcactgctttcgacctgtcacccgacaacgaagtactggtaactgcatcccgcgccttgttactggcacagtgggcttggcaagaggggtctgtgacacgcttgtggaaagctatccacaccgccccagtggcaacgatggcgttcgaccctacgtctacactgttggctactggcgggtgtgatggggccgtaagggtttgggacatcgtgaggcactacggcacacatcactttcgggggagcccgggagtcgtccatcttgtggccttccatccggatccaaccagactgttgttgttttcttcagccaccgacgcagcgatccgcgtatggagcctacaagatcgctcctgtcttgctgtcctaaccgctcattattccgctgtgacctcactggcattctcggcagacggccacactatgttatcttctggaagagacaaaatttgtatcatatgggacttgcagtcctgccaggccaccagaaccgtcccagtatttgagagcgtcgaggccgcggtgctgctccccgaagagccagtatcccagcttggcgtaaagtcaccaggactgtactttcttaccgctggcgaccagggaacattgagagtgtgggaggccgcgtccggacagtgtgtgtacactcaagctcagccccccgggcctgggcaggagttgacacactgcactcttgctcatacggcaggggtagtcttgaccgcgactgcagaccacaacctgctcctttatgaggcccgcagcttacgtctgcagaagcagtttgctggttatagcgaggaagtgctggatgtgcgctttttggggcctgaagatagccatgtggtcgtggcatcaaacagtccttgtctgaaagtgttcgaactgcagaccagcgcttgccaaatactccacggtcacacggatatcgtgttggcgcttgacgtgttccgcaaagggtggctctttgccagctgcgcaaaggaccagtccgtgaggatctggcggatgaacaaagccgggcaggtgatgtgtgtagcccaagggtcaggccacacccattccgtaggcaccgtgtgttgttccagactcaaggaatcttttttggtaaccggcagccaagattgcactgtgaagctctggccactccccaaggcgctgctcagtaagaacaccgcaccagataatggccccatattgctgcaagcccagacgacgcagcggtgtcacgacaaggacatcaactccgtggccattgcccctaacgataaacttctggccacaggctcgcaggacaggacagcgaagctctgggcgcttccgcagtgtcaactcctgggcgtcttctcaggtcatagacggggcctgtggtgcgtgcaattctccccaatggatcaagtgcttgccactgcatctgcagacggaactataaaactctgggcacttcaggacttctcctgtctcaagacattcgaggggcatgacgcaagcgtgctgaaggttgcgttcgtgagcaggggtacccagctgttaagcagtggatctgacggtctagtgaaactgtggactatcaagaacaacgaatgtgtccgcactcttgacgcccatgaagacaaagtatggggtttgcactgctcccggctagatgatcacgctctgacaggcgcatcagactctagagtgatcctttggaaggacgtaaccgaagctgagcaggcagaggagcaggctcgacaggaagagcaagtcgtgagacagcaggagttggacaatttgcttcatgagaaacgttatctgagagccctgggcctggctatcagcctagaccggccgcacacagtccttacagtgattcaggccatcaggagggatccagaggcctgcgagaaactggaagccactatgctacgtctgaggcgagatcagaaggaggctctgcttagattttgcgttacttggaacaccaacagcagacattgccatgaagcccaagctgtgcttggggtgctgctgcgacgggaagcgccagaggagttgctggcatacgagggcgtccgcgctgctctcgaggctctccttccatacactgagcggcacttccagcgactgtcaaggaccttacaggccgccgcctttctcgactttctctggcacaatatgaaactccccgttccagctgcagccccaactccatgggagacacataagggggccttgccctag

SEQ ID NO: 209056 - DNA, 2427 bp, Artificial Sequence
  Description of Artificial Sequence: Synthetic coding sequence
atggccgagaccgccgccggcgtgggccggttcaagaccaactacgccgtggagcgcaagattgaacccttctacaaaggcgggaaagctcaattggaccaaactggtcagcaccttttctgcgtgtgcgggacacgggtgaatatcctggaagtagccagtggtgccgtcctgcgttcactggagcaggaggatcaggaagacatcactgccttcgatctctccccagataacgaggtcctagtaacagcaagtcgggcgttactcctcgctcagtgggcatggcaggaaggatcggttacccgcctctggaaggctatacacaccgccccagtcgcaacgatggcttttgaccctacatcaaccttgttggcgacaggcggttgtgacggggctgtgcgcgtatgggatatagtgcgccattacggcacccaccattttcgcggtagcccaggcgtggtgcatctcgtggcgtttcaccccgaccccacgcggttgctacttttcagctccgcaacagacgcagcaatacgcgtttggagtcttcaggaccggtcttgcctggccgtgctgacagctcactatagtgccgtgacgagtttggccttcagtgcagacgggcacacaatgctgagtagcggtcgcgataaaatctgtatcatctgggatctgcaatcttgtcaggccacacgtactgtcccagtctttgaatcagttgaggcagcggttttactgcccgaagagccggtgtcccaactgggcgtgaaaagccccggactctactttttaactgcaggcgatcaggggacgctgagggtctgggaggcggcctctggacagtgtgtgtacacccaggcccagcctccaggacccggtcaggagctgacacactgcacattggcacatactgccggtgtggtacttactgcaacagctgatcataatcttctgctgtatgaggccaggtccctcagattgcagaaacagtttgctgggtactccgaagaggtccttgatgtgaggttcctggggcccgaagattctcatgttgtcgtggcttcaaattctccctgtctcaaggtctttgaactccagacatcggcctgtcagatcctccatggtcacaccgacatagtactggccctcgacgtattcaggaagggctggctgttcgccagctgcgccaaggaccagtctgtacggatatggagaatgaacaaagctggacaagtgatgtgtgtggcgcaaggctctgggcatactcatagtgtcggcactgtatgttgctcccgcctgaaggagagcttcctggtgacgggctctcaggactgtaccgtgaagctgtggcctctgcctaaagccttgttgagcaagaacaccgcacccgacaacggcccaatcctgctgcaggcccaaacaactcagcggtgtcacgataaagatattaatagtgtagctattgcgcccaacgataaactgttggccacgggctctcaagatcgcaccgcaaaactgtgggcactccctcaatgccaattgctgggtgtgttctcaggacaccgacggggactctggtgcgtgcagttcagcccaatggatcaggtgctggcaaccgcctccgctgacggcaccatcaagttgtgggccctgcaggatttcagctgcctgaaaactttcgagggccatgatgcaagtgtcctcaaagtggcgttcgtctctaggggtacgcagttgctgagctctggatcagacgggctagtgaagttatggacgatcaaaaacaatgaatgcgtgagaacgctcgacgcccacgaggataaagtctggggtcttcactgctcacgcctggatgaccacgcactgaccggagcatcggacagccgtgtgattctgtggaaagatgttacagaggcagagcaggctgaggaacaggcaaggcaggaggagcaggtggtcagacagcaagaattggacaatcttctacatgaaaagcggtatctgcgcgccttggggttggcaatttccctggatcggcctcacaccgtcctcacagtcattcaggctattcgaagggaccctgaagcttgcgagaagctggaggctacgatgctgagactgcgacgggatcagaaagaggcgctattgagattctgtgtaacttggaacactaactctcggcactgccatgaggcacaggccgtgctaggcgtgctcctgagacgcgaagcccctgaagagttactggcatacgaaggggttagggccgcactggaggcactgcttccatataccgagcgccacttccagcggttatcgagaactctacaggctgcagctttcctggatttcctctggcataatatgaagctgccagtgcccgcagccgcaccaaccccctgggaaacacataaaggcgccctcccttag

SEQ ID NO: 209057 - DNA, 729 bp, Artificial Sequence
  Description of Artificial Sequence: Synthetic coding sequence
atgttcccccagagccggcaccccaccccccaccaggccgccggccagccattcaaatttaccatccccgaatctctggatagaatcaaggaggaatttcagtttttacaagctcaatatcactccctcaaactggaatgcgaaaagttggcttccgaaaagacagaaatgcagcgccactatgtcatgtactacgagatgtcatatggactgaacattgagatgcataagcagacagaaatcgcgaaaagactgaataccatttgtgcgcaagtgattccttttctgtcccaggagcaccagcagcaggtggcccaggctgtcgaaagagccaagcaggtaaccatggccgaattgaatgcaattataggggtgcgaggcctgcccggactccctcctacgcagcagcagctccaggcccaacacctgagccacggccacggtcctccggtaccacttactcctcacccatctgggttgcaacccccaggtatccccccactaggcggctccgcagggctgcttgctctatctagtgccttgtcgggtcaatcgcacctggctataaaagatgacaagaagcaccacgacgccgaacatcaccgcggcgagcgcccagggaagtccaacagtttactcgtgcccgacagcctcagagggactgacaagcggcgcaatggccccgaatttagcaacgacatcaagaaaaggaaggttgacgacaagtag

SEQ ID NO: 209058 - DNA, 435 bp, Artificial Sequence
  Description of Artificial Sequence: Synthetic coding sequence
atgcagcggcactacgtgatgtactacgagatgagctacggcctgaatatcgagatgcataagcagacggagattgccaagagactgaacactatatgcgcacaggtgatcccattcctgtctcaggaacaccagcaacaggtggcccaggctgttgagcgggccaagcaagtaacaatggctgaactgaacgccataataggccagcaacagttacaagcccagcacctaagccacgggcacggcccaccggttcctcttaccccccacccctcaggcctccagccacctggaataccccccctgggggggagcgcaggacttttagccctgtcttccgcgttgtctggccagtcacatcttgccatcaaagacgataagaagcaccatgacgccgagcaccatcggggggagcgacctggcaagcctgattag

SEQ ID NO: 209059 - DNA, 384 bp, Artificial Sequence
  Description of Artificial Sequence: Synthetic coding sequence
atgcccacccccggcaccagcgccacccccggcctgcggcccggcctaggaaaaccaccagccattgatccacttgttaatcaggccgcggccgggctgcgaacccccctggcagtgccaggcccataccccgctccctttggaatggtgccccacgctggcatgaatggcgaactgacaagccctggtgcggcgtacgcgtcgctccacaacatgagcccccagatgtccgccgccgccgctgcagccgcagtggtggcctacggtcgctcgcctatggtgggattcgatcccccaccccacatgcgggtgccaactataccgccaaacttggccggaatccctggcggcaagccgagccttgttccggctcctgcccattag

SEQ ID NO: 209060 - DNA, 384 bp, Artificial Sequence
  Description of Artificial Sequence: Synthetic coding sequence
atgcccacccccggcaccagcgccacccccggcctgcggcccggcctgggaaaaccccccgcaattgaccctcttgtgaatcaggccgccgccgggctccgaacaccgctggcagtgcctggtccatacccagcaccattcggcatggtgcctcacgctggcatgaatggggaactcacctcccctggtgctgcctacgccagtctccataatatgtcccctcagatgtccgctgcagccgcagcggctgctgtcgtggcttacgggaggagtcctatggtcggttttgatccacccccacatatgcgggtccccacaatcccccccaatctggcaggaattcctgggggaaagccaagcttagtgccagcacctgcccattag

SEQ ID NO: 209061 - DNA, 2313 bp, Artificial Sequence
  Description of Artificial Sequence: Synthetic coding sequence
atgttcccccagagccggcaccccaccccccaccaggccgccggccagccctttaagttcacgattccagagtccctagaccggatcaaggaagagttccagttcctccaggcacagtatcactcattgaagctcgagtgtgaaaaattggcaagtgagaaaaccgagatgcagcggcactatgtcatgtattacgaaatgagttacggactgaatattgagatgcataaacagaccgaaatcgctaagcgcttgaacaccatctgtgctcaggttatccctttcctctcccaggagcaccagcagcaggtggcccaggctgtggaacgcgctaagcaggtcacaatggctgaattgaatgccataatcggccagcagcaacttcaggcacagcatctcagtcacgggcacggccccccagtgccactgaccccgcaccctagcggtttgcagccaccgggaatccctcccctcggaggcagtgctggacttcttgctttgagcagcgccttgagcggccagtctcatttggcaatcaaagatgacaagaagcaccacgatgcagagcaccaccgagatcgagaacctggcacgtctaatagcttattagttcccgactctctgcggggtactgataagaggcgcaatggacccgaattttcaaatgacattaaaaaacggaaagtggacgacaaggactctagccattacgattctgacggggataaatcagatgacaatttggtagtcgacgtcagtaatgaggatccaagttcaccaagagcgtctcccgcccatagtcctcgcgaaaacgggatagataagaacagactcctgaagaaggatgcctcttcgagtcccgcgtcgacagcctctagtgctagctccacctctctgaagagtaaggagatgagcctgcacgagaaggcatccacccccgtgctcaaaagctctacacctactcccaggtcagacatgcctacccccggcacaagtgcaaccccggggctcaggccagggctgggcaaaccccctgcaatagatccccttgtgaatcaggccgccgcgggcttacggacaccacttgccgttcccggaccttacccagctcccttcggcatggtgcctcatgccggaatgaacggagaactgacctcccctggcgcagcctacgcctccctgcacaatatgtccccacagatgtcagccgccgcggcagctgctgctgtggtggcatacgggcgatccccaatggtggggtttgaccccccccctcacatgcgcgtgccgacaataccgcctaacttggcagggatacccggtggaaagccagcctacagtttccatgtcaccgcggatggccagatgcaaccagtgcccttcccacccgatgccttgatcgggccaggcataccgcgacatgcgcgccagatcaacacccttaatcacggcgaagtagtgtgtgccgtgactatctcaaaccctacccgccacgtttacacgggaggaaaagggtgtgtaaaagtgtgggatatctcgcatccagggaacaagagtcctgtgtcacaactggattgtctgaacagggacaattatatccgctcgtgcaaactcctacctgatgggtgtacactgattgtgggtggagaagccagtaccctcagcatatgggacttggcagctcctacccctaggataaaggctgagctgacatccagcgctcccgcgtgttatgcgcttgcgatttcccccgactccaaggtctgcttcagttgctgcagcgacggtaatattgcagtgtgggatctgcataaccagacactcgtgaggcaattccagggacacacagacggggcaagctgcatagatatttctaacgatggcacaaaattatggaccgggggcctggacaacaccgttagatcttgggacctgagggaagggcgtcaactccagcaacacgatttcacctcacaaattttttcattgggctattgtcccactggcgagtggctggcagttggtatggaatcatccaatgtagaggtcttgcacgtcaacaagcctgacaaataccaactccatctgcatgaaagttgcgtcctttccctgaagtttgcttattgtggaaagtggttcgtctccaccggaaaggataatttactgaacgcctggaggacaccctacggggcatctatctttcaatcgaaagaaagctcctccgtgctgtcgtgcgacataagcgtggatgataagtatatagtgactggcagcggggacaagaaagcgacagtttacgaggtcatttactag

SEQ ID NO: 209062 - DNA, 729 bp, Artificial Sequence
  Description of Artificial Sequence: Synthetic coding sequence
atgttcccccagagccggcaccccaccccccaccaggccgccggccaacctttcaaatttacgattccagagagcctggatcgcatcaaagaggaatttcaatttctgcaggcccagtaccacagtctgaaactggaatgcgaaaaacttgcttctgaaaagacagagatgcagcggcattatgtgatgtactatgagatgtcctacggcctaaacattgagatgcataagcagactgaaatcgcaaaaagactcaacactatctgcgctcaggtcatcccgttcctctctcaggaacaccagcagcaggtggctcaggcagttgagcgagccaaacaggtcacgatggctgagctgaatgccataatcggggtccgcggcttgcctggacttccccctacacagcagcagctccaggcacagcacctgagtcatggacacggacctccagtgcccttaaccccccacccaagtggtctgcagcctcctggtataccccccctgggcggatcagcaggcctgcttgcactgagctctgccctgagcgggcagtcacacctggcgattaaggacgataaaaaacatcacgacgccgagcaccacagggacagagagcccgggacatccaactcgctgcttgtgccagactccctgcggggcaccgacaagaggagaaacggtcccgagttctccaacgacattaaaaaaaggaaggtcgatgataaatag

SEQ ID NO: 209063 - DNA, 2121 bp, Artificial Sequence
  Description of Artificial Sequence: Synthetic coding sequence
atggtgcagagccggctgaccgccaccagcgccagccaggacagccccgcatcaggcctgcagacccctctccagagtgggcagcccttcaagtttagtatcctcgagatttgtgacaggattaaagaagaatttcagttcctgcaagctcagtaccattcactgaagctggagtgtgagaagctcgccagtgagaagaccgaaatgcaacggcactacgtcatgtactacgaaatgagctacggactcaatatcgaaatgcacaagcaggccgagattgtgaaaagactgagcggtatctgcgctcagattatcccgttcctcactcaggagcaccagcaacaggtgcttcaggcagtcgagagggcaaagcaagtcacggttggagaacttaatagtctgattggccagcagcaactccagcctttatcgcaccacgcacccccagtcccactcactccacgacccgctggcctggtcgggggtagcgctactggactcttggccctgtcaggcgcactggctgcccaggcccaactggccgctgccgtgaaagaggaccgagccggcgttgaagccgagggctcgcgcgttgaacgggccccctcgaggtctgccagtccttctccaccggagagcctagtggaagaagaaagacccagcggacctgggggaggggggaagcagagggctgatgagaaggaaccaagtggtccttatgagagtgatgaagataaaagcgactacaatctcgtcgtggacgaggatcagccatcagagccaccctcccccgccaccacgccatgcggaaaggtcccgatttgcatccccgctaggcgggacttggtggattctccggcgtccctcgccagctcgctcggatctcctcttccccgggcaaaggaactgatcctgaacgatctgccagctagtactcccgccagtaagtcatgtgacagctctcccccacaagatgcctcgactccaggcccaagctccgcctctcacctttgccagctggccgcaaaaccagccccatcaactgactctgtagccttacgcagtcccctgacactgtccagtccctttacgacatcattttcactgggaagccacagcaccctgaatggtgatctcagcgttccttcttcttatgtttcacttcatctgtcacctcaggtctcctcttcagtggtctatggacggtctccagtgatggcctttgagtctcatcctcacctccgaggaagctccgtgagctcaagcctgcccagcatcccggggggcaaaccagcttattcttttcacgtatctgccgacggtcaaatgcagcccgtgcccttccccagcgatgcattagttggcgccgggattccccgacatgctcgccagctgcatacactggcccacggagaagttgtgtgtgcggtgacaatctctggcagtacccaacatgtgtacaccgggggaaaagggtgtgtgaaggtttgggacgtcgggcagcctggtgccaagactccagtggcccaactggattgtctgaaccgcgataattatatcagatcttgcaagctgcttcccgatggacgctcgttgattgtgggaggggaagcttccaccctgtccatctgggatctggcagctccaacaccaaggattaaagcggagctaactagtagcgcccccgcgtgctacgctctggccgtttcccccgatgcaaaggtgtgttttagttgctgcagtgatggaaacattgtcgtgtgggacctgcagaaccagaccatggttagacagttccagggacacactgacggcgcctcatgcatagacataagtgattacgggacaagactttggaccggcggcctggataatacagtgaggtgttgggatctgcgagaaggtcgccaactacaacagcacgatttctcctcacaaatcttttctttagggcactgtccaaaccaggactggctggccgtcgggatggagtcgagtaatgttgagatccttcacgttaggaaaccagagaaataccagctgcacttgcacgagagctgcgttctcagccttaaattcgcttcatgcgtccagggtgtcgtgctttcccccgaactctag

SEQ ID NO: 209064 - DNA, 2232 bp, Artificial Sequence
  Description of Artificial Sequence: Synthetic coding sequence
atgtacccccagggccggcaccccacccccctgcagagcggccagccctttaagttctctattctggaaatctgcgatcgcattaaggaagaattccagttccttcaggcccagtatcattcacttaagctcgaatgtgagaagttggcctcagagaaaacggagatgcagcgtcattacgtgatgtactacgaaatgtcttatggattgaatatagagatgcataaacaggcggaaattgtaaaaagactcagtggtatttgcgctcagattattccctttctgactcaggagcaccagcaacaggttctgcaagcggtggagcgggctaagcaggtgacagtgggggagttgaattccttgatcgggcaacaactgcaaccgttgtcacaccacgccccccccgtgcctctgacacctcgccctgctgggttggtgggtggatctgcaaccgggctcctggccctgtcaggcgctctcgccgctcaggctcaactggcagcagctgtgaaagaagatagggctggtgtggaggctgagggctcccgcgtggagcgtgccccctcacgtagcgctagcccaagccctcctgaatcacttgtggaggaagagaggccttcagggcccggaggggggggaaaacagagagcggatgagaaagagccctccggaccttatgaatcagatgaggacaagagtgactacaacctagtcgttgatgaggaccagccctccgagccccctagtcccgccactaccccatgcggcaaagtgccgatctgtattccagccagacgcgacttagttgacagtccagcctctttagcatcaagcctgggcagtcctctacctagagcaaaagaattgatcctgaatgatctacctgcatctacgcccgccagcaaatcgtgtgatagtagtcccccgcaagatgcttctactccaggcccctctagtgcctcccacctgtgtcagcttgccgcaaaaccggcccctagcaccgactccgtggccctccggtccccactgacgctctcttccccattcacaacttccttttccctgggttcccatagcaccctgaatggggacctgtcggtgccaagcagctacgtgtctctgcacctcagcccacaagtctcaagctccgtagtgtacggcaggtccccagttatggcgtttgagagtcacccacacctgagggggagttccgtcagctcaagcctcccatccataccagggggcaaacccgcctatagttttcatgtgtccgccgacggccaaatgcagccagtgccctttccgtcagatgctctggtgggtgccggaataccgcgtcacgcccgtcaacttcacacactggcacatggcgaagttgtctgcgctgtgaccatcagtggatcgacacagcacgtgtatacagggggaaagggctgcgtgaaagtttgggatgtggggcagcccggtgctaagactcccgtcgcccaattagactgtctgaacagggacaattatatccgctcatgcaagctactccctgacgggcgtagtcttatcgtgggcggggaagcctctaccctgtccatttgggatctggccgctccgacaccacgtattaaggctgaattaacatcctccgcacctgcatgttacgcattggcagtcagtcccgatgcgaaagtgtgtttcagctgttgcagcgatgggaatattgtggtatgggatcttcagaaccagacgatggtcaggcaattccagggccataccgacggtgcctcctgcattgacatcagcgactatgggacacgcctgtggacagggggcttagacaataccgtgagatgttgggacttgcgcgaaggtcgccaacttcagcagcatgacttcagttcacagatcttcagtttgggacattgcccgaaccaggactggctggctgtcggcatggagtccagcaacgtggagattctgcacgttcggaagcctgagaagtatcaactccatctgcatgaatcatgtgttttgagcctgaagtttgcctcttgcggacgttggtttgtctccactggcaaggataacttgctgaacgcctggcgtactccatatggcgctagcatattccagtcaaaggagagctcgtccgtcctctcgtgtgatattagtcgcaataacaagtatattgtgacaggctccggagacaagaaggctaccgtttacgaagtggtatactag

SEQ ID NO: 209065 - DNA, 879 bp, Artificial Sequence
  Description of Artificial Sequence: Synthetic coding sequence
ctggcccacggcgaggtggtgtgcgccgtgaccatcagcggcagcacgcagcacgtatatactgggggcaagggctgtgtcaaggtctgggatgtggatggtgctgtgtttgccggccagcgaggcggtgcacatcagcctatcagaaatagggacaactatatacgaagctgcaaacttctgccagacggacgttcactcatcgtgggcggggaggcttctaccctgagcatctgggaccttgccgctcccacgcccaggataaaagctgagctgacctcctccgcgcccgcctgttacgcactggccgtatcaccagatgcaaaggtatgtttcagttgttgtagcgacggtaatatcgtagtgtgggacttgcaaaaccagactatggtcaggcagtttcaagggcataccgacggagcttcctgcattgatatttcggattacggcacaaggctctggactgggggcttggataatacagtgcggtgttgggacctgcgggagggtcgtcaactgcaacagcatgacttctcatcacagattttctccctgggtcactgtcccaatcaggattggctggccgtgggaatggaaagcagcaacgttgaaatcttacatgttcgtaagcctgagaaataccagctccacctgcatgagtcttgcgtgctctctctgaaattcgcttcttgcggtaggtggttcgtgagcaccggcaaagacaacctcctaaatgcgtggagaacaccctacggcgcaagcatttttcagagcaaagaatcatcctcagtcctttcatgcgacataagtagaaacaataagtacattgtgaccgggagcggcgataagaaggcaactgtgtacgaggtggtctattag

SEQ ID NO: 209066 - DNA, 2121 bp, Artificial Sequence
  Description of Artificial Sequence: Synthetic coding sequence
atggtgcagagccggctgaccgccaccagcgccagccaggacagccccgcatcgggcctgcaaacacccctgcagtccgggcagccttttaagttcagcatactggaaatatgcgacagaataaaggaggaatttcagtttctgcaggcgcagtaccatagcctgaagctcgaatgtgaaaaactggcttcggaaaagactgaaatgcaaagacactatgttatgtactatgagatgagttatggactgaatatcgaaatgcacaagcaggctgagatcgtgaagcgcctgtctggcatttgtgctcaaataattcctttcctgactcaggaacaccagcaacaagtgctgcaggctgtggagcgtgctaagcaggtgacagtcggggagctgaatagtctaatagggcagcaacagttgcagcctctctcacaccacgcgccccccgtgccgctcactccaaggcccgcagggctggttggcggctctgcaaccgggttattggccctcagtggcgcactggccgctcaggctcagctggcagccgcagttaaggaagaccgggctggggtcgaggccgagggctcaagagtcgaaagggctccttcccggagcgctagtcccagtccaccagagtctctcgtggaagaggaacgaccctcggggcctgggggtgggggaaagcagagggccgacgagaaggaacccagcggaccatatgagtcggacgaagataaatccgactataacctggtggtagacgaagaccagcccagtgagccaccatcccctgcaaccacaccgtgcgggaaagttcctatttgcatcccagctcgtcgagatcttgtcgatagccctgcctctcttgcttcctctctgggctcccctcttccgagagctaaagaactcatcctgaatgatctgcccgctagtacacccgcctcgaagagttgcgatagttctcccccccaggacgcttctacacctggcccgagttctgcttcacacctatgccaactagcagctaagccagctcccagtactgatagtgtggcactacgcagccccctcacactgagctctcccttcaccacttccttctccctgggatcacatagcacattaaacggagacttgagtgtaccatccagttacgtgtcccttcacttatccccacaggtgagttctagtgtggtgtacggaagaagccccgtgatggcatttgagtctcatcctcatctgcggggctcgagcgtgagttcctcactaccttcaattcctgggggcaaacccgcttattctttccatgtcagcgcagacgggcaaatgcagcctgtccctttcccatccgacgcactcgtgggggcaggcataccacgccatgcccgacaattgcacactttggcccatggagaggtggtttgtgccgtaaccatctcaggtagcacccaacatgtctacaccggtggcaaaggctgcgtgaaggtttgggacgtggggcagccaggcgcgaagacgccggtcgctcagttggactgcttgaaccgcgacaattacatccgatcttgtaagctactgccagatggcagaagcctgattgtgggcggcgaggcttcaaccctgtcgatttgggacctggccgcccctacacctagaattaaggctgagctcacaagcagcgcacctgcgtgttacgcattggctgtgtcacctgatgcaaaggtctgtttcagttgctgttctgacgggaatattgtggtgtgggatttacagaatcagacgatggtgagacagtttcaggggcatactgacggagccagttgcattgacatcagcgactatggcacacgactgtggaccggaggactggataatacagtgaggtgctgggatctaagggagggcagacagctacagcagcatgatttttctagccagattttttcattgggtcactgccctaatcaggactggctggcagtcggcatggaaagcagtaacgttgagatactgcacgtccgcaagccggaaaagtatcagctgcatctgcacgagagctgcgtgctatcgttgaagttcgcctcttgcgtccagggagtggtcctgtcccctgagctgtag

SEQ ID NO: 209067 - DNA, 1083 bp, Artificial Sequence
  Description of Artificial Sequence: Synthetic coding sequence
atgtacccccagggccggcaccccacccccctgcagagcggccagcccttcaagtttagtattctggagatttgcgataggattaaagaggaatttcagtttctgcaggcccaataccattcactgaaactggaatgtgaaaaactggcatccgagaaaaccgagatgcaacggcactacgtgatgtattacgaaatgagttatggcctcaatatcgaaatgcataagcaggctgaaatcgttaaacgattatctggtatttgcgcacagatcatcccttttttgactcaggagtcagcaagcccgagtccccccgagtccctggttgaagaagagcggccatcagggccgggaggaggcgggaaacagagggccgacgaaaaagagccttctggcccctacgaaagtgacgaggataagagtgactataacctggtcgtggacgaggaccaaccctcagaacctccaagcccagctactaccccctgcggcaaggtgcccatctgtatacctgcccggcgggacctagtcgacagccctgccagcctggccagtagcctggggtctccactgccacgcgccaaagagctgatcctcaatgatctcccggcatccacaccagcttcgaagtcatgtgattcctcgccacctcaggatgcctctaccccaggcccgtcttcagcctcacacctgtgtcaattggccgccaagcccgctccttcgaccgactccgttgcgctccgctctcccctgaccctgtctagcccattcacgactagcttctctcttggatcgcacagcacccttaacggggacctgtccgtgccaagctcttatgtgagcctccatctgagccctcaggtatcttcctcagttgtgtatggtaggagccctgttatggcatttgagagccacccccacttaaggggaagctctgtatcctccagtctgccgtctataccagggggaaaacccgcgtattcctttcatgtgagcgccgatggacagatgcagcctgtgcccttccctagtgacgctttggttggtgctggtattcctccttggccttcatccactgcttag

SEQ ID NO: 209068 - DNA, 1866 bp, Artificial Sequence
  Description of Artificial Sequence: Synthetic coding sequence
atgcagcggcactacgtgatgtactacgagatgagctacggcctgaatattgaaatgcataagcaagccgaaattgttaaaagattaagcggcatttgcgcgcagatcattccatttctgacacaggaacaccagcaacaggtcctgcaagcggttgagagggccaagcaggtgacagtgggtgagcttaattcattgattgggagcgcctccccaagtccgcccgagagtctggtggaggaggaacgtccttctggccccggcggagggggaaagcagagagccgatgaaaaagagcctagtgggccatatgaaagcgacgaggataaatccgattacaatcttgtggtagatgaggaccaaccgtccgagccaccttcccctgccactacaccctgtggcaaggtgcccatatgtatccctgcccgccgcgaccttgtcgacagccctgccagcttggctagttcgcttgggtccccactcccacgagccaaggagttgatactgaacgatcttccggcttctactcccgctagcaagagctgtgatagctcacccccacaggacgcgagcacccccggaccaagcagcgcatcacacctctgccagcttgctgcgaagccggccccttctacggatagcgtggccctgcgtagcccgctcaccctctcgtccccattcaccacctctttcagtctcggttctcacagcacccttaacggagatttgtcagtcccctcctcctacgtgagtcttcacctgtcacctcaggtgtcaagcagcgtggtctatgggcgaagccctgtcatggcattcgaaagccacccccatcttaggggtagtagcgtcagcagtagtctgccatccataccaggcggtaaaccagcttactcgtttcatgtgtctgccgacgggcagatgcaaccagtgcctttcccctccgacgctcttgtaggggctggcatccctaggcacgcccgtcaactgcatactctcgcacacggcgaagttgtttgtgccgtaaccatctctgggtcaacccaacacgtatacaccggcggcaagggatgcgtaaaggtgtgggatgtcgggcaaccaggggcaaaaactccagtggcacagctggactgtctgaatagggacaattatattagaagctgtaagctgctgcccgacggtcgctccctgattgttggcggagaggcaagcactctgtcgatctgggacttggcggccccgacgcctcgcatcaaagccgagctgactagttccgctcctgcttgttatgccctcgccgtgtccccagacgcgaaggtgtgttttagctgctgctccgatgggaacattgttgtatgggatctgcagaaccagaccatggtccggcagtttcaaggccatactgacggggcatcctgtatcgacatttcagactacggtacgaggctatggactggcggtcttgataacacagtcaggtgctgggacctgagagaagggcggcaactccagcagcatgatttttcttcacaaatcttttccctagggcactgtcccaatcaagactggctagcagtggggatggaatcaagcaacgtcgaaattctgcacgtgaggaaacctgaaaagtaccagcttcacctccatgaaagctgcgtgctgtccttaaaatttgcgagttgtggccgctggtttgtatcaaccggaaaggataacctgcttaacgcgtggcggactccatacggggccagtatcttccagagtaaggagtcttcctccgtgctgtcatgcgatatttctagaaataacaaatacatagtcaccggctcgggtgataaaaaagcaacagtgtacgaggtggtatattag

SEQ ID NO: 209069 - DNA, 1233 bp, Artificial Sequence
  Description of Artificial Sequence: Synthetic coding sequence
atgaccttcccccccgccctgctgccccccaaccccgtgacccccccccggcctcgcacgctgcctcccccgggccctgcacggcccgtaacaagcgcttccttattaccaagtcagcacctcccacgaacagctagtgtgtcatcatctgtcgtgtatgggcgctcccccgttatggcctttgagtcacatcctcatctgcgtggctcgtctgtatctagcagcctacctagcatcccaggcgggaagcccgcctatagctttcacgtgtccgcagatggccagatgcagccggttccatttcctagtgatgcgctggtgggtgctggcattcctagacacgctcgccagctgcataccctagcccatggtgaagtggtctgtgcagtcactatttcagggagcactcagcatgtctacaccggaggcaaaggctgtgttaaggtttgggacgtgggacaacctggtgccaagaccccagtggcccagctggactgcttgaatcgggacaactacatcaggagctgcaagttgcttcccgacggccggagtctaatcgtgggcggcgaggccagcactctgagcatttgggacctggcagccccaacaccgcgcatcaaggcagaattgactagctcagcccccgcctgttacgctctggccgtgagccccgatgcaaaggtctgcttcagctgctgttctgacggcaatattgtggtgtgggacttgcagaaccagactatggtgagacaatttcaggggcacaccgatggcgccagctgcatcgacatttctgattacggaacccgactgtggacaggaggacttgacaacacagttcgatgctgggatctcagagaagggaggcaactacagcagcacgatttctccagccagatattttctctaggacattgtcctaaccaggattggctcgccgtgggtatggaatccagcaacgtagaaattttgcacgtgcggaaacccgagaagtatcagctgcacttacacgagtcttgcgtcctgagtctgaaattcgccagctgtgggaggtggttcgtctctacaggtaaggacaacctcctgaacgcctggagaacaccttatggggcttcaatctttcagagcaaagaatcaagctccgtgctgagttgcgatattagccggaataataagtacattgtcacaggttctggtgataagaaagccacagtatacgaggtggtctattag

SEQ ID NO: 209070 - DNA, 2061 bp, Artificial Sequence
  Description of Artificial Sequence: Synthetic coding sequence
cagacccccctgcagagcggccagcccttcaagttcagcatcctggaaatctgcgaccggattaaagaggagttccagttcttgcaggctcagtatcatagccttaaattggaatgcgaaaaactggcttctgagaagacagaaatgcaacgtcattacgtcatgtactacgagatgtcttatggactgaacatcgaaatgcacaaacaggccgaaatcgttaagcgcctttcaggcatatgcgcccagataattcctttcttgacccaggaacatcagcagcaggtcctccaggctgttgagagggcgaagcaggtcaccgtgggagagctgaatagtctgattggacagcagcagttacagcccctgagccatcacgctccccccgtgcctctgactcccaggcctgcaggcctggtcggaggtagcgcaactgggttacttgctctcagtggcgccctcgctgctcaggcccagcttgcagctgcggtgaaggaggatagagctggcgtggaagccgagggttcacgggtcgagagggctccatcacggagcgccagtccttctccaccagagagcctggtggaggaggagcgcccttcagggcccggcggcggcggtaagcagcgtgccgacgagaaggaaccttcaggcccctacgagtcagatgaggataaatcagattataacctggttgtggatgaagaccaacctagcgaacctcctagcccagccactactccatgcggcaaagtccccatctgtatccctgctaggagggatctggtcgattcgccagcctcccttgccagttcgttaggttctccactccccagagctaaggagctgatcttaaacgatcttcctgcgagtaccccagcctccaagtcctgtgactcctctccgccacaggatgctagtacccctggcccctcctccgcttctcatctttgccagttagcagccaaacccgccccgtctaccgatagcgtggcattgaggagcccactgaccttgtcttctccatttactacaagctttagccttggatcccactctacactgaatggcgacttatccgtgcccagtagctatgtgagcttgcatctgtcccctcaggtgtcatcctcagtcgtgtacggccgcagcccggttatggcattcgaaagtcatcctcatttacgcggaagctcagtgtcctcctctctgcccagtattcctgggggaaaacccgcttattctttccatgtgagcgccgatggtcaaatgcagcctgtgccattcccctccgacgctctggtaggcgctgggatcccacgtcacgccaggcagctccacacactcgcccacggggaggtggtttgcgcagtaaccatatccggcagcacacaacatgtgtatacagggggaaagggctgcgttaaggtgtgggacgtgggccagcctggggccaaaaccccagttgcacaactcgactgcctgaatcgcgacaattacatccgcagttgcaagctactcccagacggtcggtctctgattgtgggtggagaggccagcactcttagcatctgggatctcgctgctcccactccgagaattaaggcggaactcactagctccgctcctgcctgctacgcactcgccgtctcccccgacgctaaggtgtgttttagctgttgttccgatggcaacatcgtagtatgggacttgcagaatcaaacaatggtgcgtcagtttcagggccataccgacggggcaagctgcatcgatatcagcgactatggcactcggctgtggaccggcggcctcgataatacggttcgttgctgggacctgcgggaaggtcggcaactgcaacagcatgatttctccagccaaattttctccctcggacactgtccaaaccaggactggctggccgttggcatggaatcaagcaacgtcgagatattgcacgtccgcaagcctgaaaagtatcagctgcatctccacgaatcctgcgttttaagtctgaaatttgccagttgtgtccaaggcgtggtactctcccccgaactgtag

SEQ ID NO: 209071 - DNA, 1866 bp, Artificial Sequence
  Description of Artificial Sequence: Synthetic coding sequence
atgcagcggcactacgtgatgtactacgagatgagctacggcctgaacatcgagatgcataaacaggcagaaatcgtgaagcgcctaagtggaatttgtgctcaaatcatcccattcttaactcaggagcatcaacaacaggtcctccaggcagtcgagcgggccaaacaggtcaccgtgggggagttgaatagcctgattggcagcgctagcccttccccaccggaaagcctcgtagaggaagaaagaccaagcgggcctgggggggggggaaaacaaagggccgacgagaaggagcccagtggtccttacgagtcagatgaggataagtctgattacaatcttgtggtggatgaagaccagcctagcgagccaccctctccagccacgactccgtgtggaaaagttcccatctgcatccctgctcggcgagacctagttgatagccctgccagcttggctagcagcctcggctcacctctgccccgagccaaggagcttattctgaacgacctgccggccagtacaccagcgtctaagagttgcgattctagcccgccacaggacgcatctactccaggacccagctctgccagtcacctgtgtcagctagccgctaaaccagctccatccaccgattctgtcgctctcaggtctccacttacccttagctctccttttacaacctctttctctctgggctctcacagtactctgaatggagacctgtcagtgccgtcttcatacgtgagtctccacctctccccacaggtctcaagctcggtagtgtatggccgcagtcctgtgatggcctttgaaagtcatccacatttgagaggctcatctgtgtcttcgtctctcccatccattccagggggaaaacctgcctattctttccatgtttcagccgatggtcagatgcagcctgtgccttttccgtccgacgcgctcgtcggcgctggcattccccgccacgcccgccagttgcacaccctggcgcacggcgaggtggtctgtgccgtgacaatttcagggagcacccagcacgtctatacaggaggcaagggatgcgtcaaagtgtgggatgtggggcaacccggcgccaagacacccgtcgcacagctggactgccttaatagagataactatatccgcagctgtaagctgcttcctgatgggcgctctctgatcgtcggcggtgaagcatcgactctctccatttgggacctcgccgcccccacacctcgcatcaaagcggagcttacaagctccgccccagcttgctacgccctggcagtttcccctgatgctaaagtgtgttttagttgctgttccgatggaaacattgttgtatgggacctgcagaatcagactatggtgagacagtttcaggggcacaccgatggggcctcgtgcatagatataagcgattacgggacccggctgtggacgggcggcttggacaacactgttcgttgttgggatctgagagaaggaagacagctccagcagcacgacttctcatctcaaatattctcccttggccactgccccaaccaagactggcttgccgtcggtatggaatcgtcgaacgttgaaatcttgcacgtgcgcaaacccgagaaataccagttacacctgcacgaatcctgtgtcctgtccctgaaattcgctagctgcggtagatggttcgtatccacaggaaaagacaatctgcttaacgcctggaggacaccttacggcgctagcatatttcagtcaaaagaatccagctccgtactcagctgcgacatttcccgcaataacaagtatattgtgaccgggtcgggggacaaaaaggccacagtctacgaggtggtttactag

SEQ ID NO: 209072 - DNA, 2283 bp, Artificial Sequence
  Description of Artificial Sequence: Synthetic coding sequence
atgtacccccagggccggcaccccgccccccaccagcccggccagccagggttcaaattcaccgtggctgaatcctgcgacaggatcaaggatgaattccagtttctccaagcgcagtaccacagtctgaaagtcgaatatgacaagctggccaacgagaagactgaaatgcaaaggcattatgttatgtattacgagatgtcttatgggttgaatattgagatgcacaagcaaaccgaaatcgcaaaacggctgaacacaatccttgcccaaatcatgccatttctaagccaggagcaccaacagcaggtggcccaggccgtggagcgcgctaagcaagttaccatgactgagctgaacgctataataggacagcaacaactgcaggcccagcacttgagccatgccacgcatggccctcctgttcagctgcctcctcacccgtcgggactccagccacccggcatcccccctgttacgggcagctcctctggactcctggcactgggagcacttggcagccaggcccaccttaccgtgaaggatgaaaaaaaccatcatgagttagaccatagggagcgtgagtcaagcgcgaataattcggtttcccctagtgagtctctccgagccagtgagaagcaccggggtagcgccgattatagtatggaggccaaaaagcgcaaggccgaggagaaggactcactatcgcgatatgattccgatggcgacaaatctgacgatctggtggtggacgtctctaatgaagatcccgctactcctcgggtgtccccagcacattcccctcccgaaaacggccttgataaagcacgctcactgaaaaaggatgctcctacttcccctgcgagcgtggcctcctccagctccacaccaagtagtaaaacgaaagacctagggcataatgataagtcctcaacgccaggcctcaaatccaatacgcccactcccagaaacgatgcgcccacacctggaaccagtacaacacctggactgaggtccatgccggccagcgctctgaggacccccatctcgattacgagctcttacgccgcgccatttgcaatgatgagccatcacgagatgaatggctcgcttacatcccctggcgcttatgccggactgcacaatatcccccctcaaatgtcggccgcggccgcggccgcggccgcagcttacggtagatccccgatggtgtcctttggcgcagtgggctttgacccccatccacccatgcgagccacaggcttgcccagctccctggcatccatccccggaggcaagcccgcatacagcttccatgtgagtgccgatggccaaatgcagccggtgcctttcccacacgatgcacttgcaggccccggaattcctaggcacgcaaggcagatcaacacactgtcccacggggaagttgtgtgcgccgtgacaatatccaatcctacccgtcatgtctataccgggggaaaaggttgcgtgaaaatctgggatatatcgcagccgggatctaaatcacccatttctcaactggactgcctgaatagagacaattacattagaagttgtaagcttctccccgatgggcggaccctgatcgtcggtggcgaggcttctaccttaactatatgggacttggcaagccccacccccagaatcaaagccgagcttaccagcagtgcccccgcatgctacgccctggctatatcccccgacgcaaaggtctgtttctcttgctgttccgacgggaacatcgcagtgtgggacttacataatcagacgttagtccgacagttccaggggcacacagatggagccagctgcatcgacatcagccacgatggaacgaaactctggacaggcggtctggacaatactgtgagaagctgggacctccgcgagggaagacaactccaacagcatgacttcacctcacagatttttagcctcggctactgccctaccggggagtggctcgcggtgggcatggaatcctcgaacgtggaagtcctgcatcataccaagcccgataaataccagcttcatcttcacgagtcttgtgtgctcagccttaagtttgcctactgcggtaagtggtttgttagtacaggtaaagataatctgctcaacgcttggcgcactccatatggcgcatcaatcttccaaagcaaggaaagctccagcgtgctgagttgtgatatatccgccgacgacaagtatatcgtaactgggtctggcgataagaaagctactgtctacgaagtcatttactag

SEQ ID NO: 209073 - DNA, 2289 bp, Artificial Sequence
  Description of Artificial Sequence: Synthetic coding sequence
atggccccccaccagcccggccagcccggcttcaagttcaccgtggcagagtcttgtgacagaatcaaagatgagtttcaatttctgcaggcccagtatcattcactcaaggtggaatatgacaaactggccaacgaaaaaacagaaatgcaacggcactatgtcatgtactacgagatgtcctacggcctgaatatagagatgcacaaacaaactgaaatcgccaagcgcctcaatacaatcctggcgcagatcatgcccttcctttctcaagaacatcaacaacaggtcgcgcaagcggtggaaagggccaagcaggtcaccatgaccgagttaaatgccataattgggcagcagcagttacaggctcagcatctgagccacgcaacccacggcccaccggtccagctgcctccacacccctccgggctacagccgccgggaatcccccctgtgaccggatccagctccggactgctcgctctgggcgctttaggtagccaagcgcatcttactgtgaaagatgagaagaaccatcacgaactcgaccacagagagagggagtcttctgccaataactcagtcagcccaagtgaatcactgcgggctagtgaaaagcatcggggtagcgctgactactcaatggaggccaaaaagcggaaggctgaagagaaggacagcctgtcacgctatgattccgacggtgataaatcagatgacctggtggttgatgtgagcaacgaggacccagctacgcccagagtctctccagctcacagccctccggaaaatggtctcgacaaagccaggagtcttaagaaggacgccccgactagccccgcgtccgtggcttctagtagttccacacctagctccaaaacaaaggacctgggtcataacgataagtctagcacccccggactgaagtcaaacacccctaccccgcgcaacgatgcacccactcccggaacaagcaccacgccaggattgcggtcaatgccggggaagcctcccggtatggacccgatagcaagcgccttgcggacacctataagcatcaccagttcctatgcggccccctttgctatgatgtcacaccatgagatgaacgggagtcttacttccccaggagcctatgccggtctgcataatattccaccgcagatgagcgcagccgcagcagccgcagcagcggcctatggtcgcagcccaatggtgtcttttggagccgtcgggttcgatccacatccacccatgcgcgctacaggcctgccatcaagcttggccagtatccccggagggaagccagcctactcctttcacgtctccgccgacggtcagatgcaaccagtcccgtttccgcacgacgctctggcggggccaggcattccacgccatgcaaggcaaatcaacacactttcacatggtgaggtcgtctgtgccgtcactatatcaaaccctactcggcatgtgtataccgggggcaaagggtgtgttaagatctgggacatctcccagccaggctcgaagtcgcctataagccaattagactgcctgaacagggacaactacatcagatcgtgcaagctgcttcccgatggacggacactcatcgtgggcggggaagcatctactctgacaatatgggaccttgcttctcccacccccaggatcaaggctgagcttacatcatcggctcccgcatgctacgcactcgccattagccccgatgcaaaggtgtgtttcagctgctgctccgacggcaacatcgcggtttgggaccttcataaccagacccttgtccgccagttccagggccacactgacggcgcctcgtgcatagatatctcgcacgatggcactaagctgtggacaggcggcttagataatacggtgcgatcttgggatcttagagagggcagacagctgcagcagcatgattttacatcccagatcttcagtttagggtattgccctaccggggaatggttagctgtgggaatggaaagctctaacgtggaggtgctccaccatacgaaacccgataagtaccagctgcatttgcacgaaagttgcgtgttgtccctgaagttcgcttactgtggaaagtggttcgtctccaccggtaaggataatctcctgaacgcctggcggaccccgtatggagccagcatttttcaaagcaaagagtcatcaagcgtccttagctgtgacatcagtgctgatgacaaatatattgttacagggtcaggagacaagaaggctactgtgtatgaggttatttactag

SEQ ID NO: 209074 - DNA, 2295 bp, Artificial Sequence
  Description of Artificial Sequence: Synthetic coding sequence
atgtacccccagggccggcaccccgccccccaccagcccggccagccaggctttaaattcaccgtcgctgagagctgcgaccgtataaaagacgaattccagttcctgcaggcacagtatcatagtcttaaggttgagtacgataagttagcgaatgaaaagacagagatgcagaggcactacgtgatgtattacgagatgagctatggcttgaacatcgagatgcataaacagaccgagatagctaagagactgaataccatattggcccagattatgccatttttgagtcaggagcatcagcagcaagtagctcaggctgtggagagagcgaagcaggtgaccatgacggagttaaatgcaatcatcggtcaacaacagctacaggcacagcaccttagtcacgctacacatgggccccccgtgcagttgcccccccacccttcgggtttacaaccaccaggcattcctcccgttacaggcagctcgtcagggttgctcgctctgggcgcgctggggtcccaagcacacctgactgtgaaggacgagaagaatcaccacgaacttgatcaccgggaacgtagctcagcctccaataactcagtttcgccttctgagagcctgagggctagcgagaagcatagggggtctgccgattactcgatggaggctaaaaagcgtaaagcagaggagaaggatagtctgtcacgctacgatagcgacggggataaatcagacgacctggtggtcgacgtatccaatgaggacccagctacaccaagagtttcccctgcacattcccctcccgagaatgggcttgacaaggctcggtctttgaagaaagatgcacctacatcacctgcctctgtggcttctagcagctctacaccatcctcaaaaacgaaggatttgggacataacgataaaagtagcactccagggctgaaaagcaacacaccaacccctcggaatgatgcccccactccgggaacatccaccactcccgggcttagaagcatgccgggcaagcctccagggatggatcctatagcaagcgccctgcggacacccatctctatcactagctcctacgcagccccttttgcgatgatgtcgcaccacgaaatgaatggctcgcttactagccccggcgcatacgccggcctgcataatatcccgccgcagatgagcgccgctgccgccgcggcagccgcggcatacggacggtcaccaatggtggggttcgatccacatccgcctatgcgggctactgggctgccgtcaagtctcgcctctattcccggtggaaagccggcatattctttccacgtctccgctgatggacagatgcagccagttccttttcctcatgatgccttagcagggcccggaataccccgccacgcaagacagattaacacactgagtcacggagaggtggtctgcgctgttaccatcagtaacccaacaaggcacgtttacaccggcgggaagggctgtgtgaagatctgggacatcagtcaaccagggtccaagagccctatcagtcagcttgattgtctgaaccgtgacaactacattagatcctgtaaactgctgccagatgggcggaccctgattgtggggggcgaggcatccactttaaccatctgggacctggcgagtcctacaccacgaattaaggccgagttgacgtcgtccgcccccgcctgttatgcattggcaattagccccgacgccaaggtttgcttttcttgctgctccgacggaaacatcgcagtgtgggacctacataatcagacgctggtccgccagtttcagggtcataccgacggagctagttgtatcgatattagccatgacggcactaagctgtggacaggaggactcgataatactgtccgtagttgggatctccgagagggccggcaactccaacagcatgactttactagccagattttctcattgggatattgcccgaccggcgagtggctcgccgtgggcatggagtctagtaacgtagaggtcctgcatcacactaaacccgataaatatcaactgcacctgcatgagtcctgcgtattgagtctcaaattcgcctattgcgggaaatggttcgtaagtacaggcaaggacaacctgctgaatgcgtggaggactccatacggagcttccattttccagtccaaagaaagttcctcggtgctgagctgtgacatctccgctgatgacaaatatattgtaacaggttccggcgataagaaagccacagtgtacgaagtgatttactag

SEQ ID NO: 209075 - DNA, 2310 bp, Artificial Sequence
  Description of Artificial Sequence: Synthetic coding sequence
atgtacccccagggccggcaccccgccccccaccagcccggccagcccggctttaagttcactgtagcagagtcctgtgaccgtatcaaagacgagttccagttcctccaagctcagtaccacagcctgaaagtggaatatgacaaactagctaacgaaaagaccgagatgcagaggcattacgttatgtattacgaaatgtcctacggtctgaacattgagatgcacaaacaaaccgagatcgctaaacgacttaatacgattttggctcaaattatgcccttcctgtcccaggaacaccaacagcaagtggctcaagccgttgaacgagccaaacaggtgaccatgaccgaactcaacgccattataggtcagcagcaactccaggctcagcatttatctcacgccacacatggccctcctgttcaactgcctcctcacccatcagggcttcagccacccgggatcccgcccgtcacaggtagttcaagcggtctacttgccttgggggctctcggttcgcaggcccacctcacggtgaaagatgaaaaaaatcatcacgaactggaccatagggagcgtgaaagcagcgcaaacaactcagtctcaccctccgagtcactccgtgccagcgagaagcatagaggatccgctgattacagtatggaagctaaaaagcggaaggcagaggaaaaggattccttatccagatatgattccgacggagacaagagcgacgatttagtggtggatgtgagtaacgaagatcctgccaccccacgggtgtctcctgcccactcaccccccgaaaatggcctagataaggcacggagtcttaagaaagacgctcctaccagcccagcaagtgtcgcttcttcatcgagcacaccctcgagcaaaaccaaggacctcggtcataacgacaagtcttctacgcctggcctcaagtcgaacacacctacaccaaggaacgacgcgccaactcccggtacatccaccacaccgggactcaggagcatgcccggaaagccgcccggtatggacccaatcgcatctgctctccgcactcccatctcgatcacttcgtcctatgcggctccctttgccatgatgtcgcatcacgagatgaacggctccttgacctcccctggtgcctacgccggattacacaacattcccccgcagatgtctgccgcagcagcagccgccgccgccgcctacggacgtagccctatggtgtccttcggtgcagtgggtttcgatcctcaccctccgatgagggccactggcttgccatcctccctcgcttctatccccgggggaaaacctgcttatagttttcatgtctcagccgatggacagatgcagcctgtacctttcccgcatgacgcattagcaggcccgggcatacctcgtcacgcccgccagatcaacaccctgagtcacggagaagttgtgtgcgctgtgaccatcagcaacccaacacggcatgtgtacacggggggaaaaggctgtgtgaagatttgggacattagccaacctgggtccaaatccccaatttctcagttggattgcctgaaccgtgataactatatacgaagctgcaaactgctgcccgatggccgaacactcatcgtgggaggggaggcgagtactctgaccatttgggacctggcatcccctacccccaggatcaaggctgagctcacttcttctgcccctgcctgttacgccctcgcaatctctccagatgctaaagtgtgtttttcttgttgttcagacggcaacatcgccgtgtgggacctacacaaccagaccttggtgaggcagttccaaggacataccgatggggcatcctgtatcgacatcagtcatgatggcactaaactgtggaccgggggcctggacaatactgtgcgcagctgggatcttcgagagggaaggcagctgcaacagcacgactttacttcccagatctttagcctcgggtactgccccactggggagtggctggcagtggggatggaatcttcaaatgtggaagtgctgcaccacacgaaacctgataagtatcagcttcatttgcacgagtcatgcgttctgtcattaaaatttgcttactgcggcaagtggttcgtgtcaaccggcaaggacaatctactgaatgcctggaggaccccttatggcgcaagtatattccagtccaaagaaagttcttcggttttgtcttgcgatatatcggcggacgataagtatatagtgacaggaagcggagacaagaaagctaccgtatacgaagtgatttattag

SEQ ID NO: 209076 - DNA, 2295 bp, Artificial Sequence
  Description of Artificial Sequence: Synthetic coding sequence
atgtacccccagggccggcaccccgccccccaccagcccggccagcccggctttaagttcacagttgctgagtcttgcgatcgcatcaaggacgaatttcaatttctgcaggctcagtaccatagcttgaaggttgaatacgacaaacttgctaacgagaagacagagatgcagcgtcactacgtaatgtactacgagatgagctacggactgaacatagaaatgcataaacagactgaaatcgctaagagactgaacactattcttgcccagattatgccattcctaagccaggagcatcagcagcaagtcgcccaggccgtcgagcgggccaaacaggttaccatgacagagttgaacgcaatcatcgggcagcaacagcttcaagcgcagcatttatcacacgctacacatggacctccggttcaactcccacctcatccctccggcctgcaacctcctggtattccccccgtaaccggtagttcgagcggattgctggccctcggcgcccttgggagccaagcccatctcacagtgaaagatgaaaaaaaccaccacgagctggaccatagggaacgcgaatcctccgctaataacagtgtgagcccttcagagtctctcagggcatctgagaagcaccgcggctccgctgactactccatggaggccaagaagcgtaaggctgaggaaaaggattctctgagccgttatgattccgacggggataagtccgacgatctcgtggtggatgtgtcaaacgaggaccccgccacccccagagtttcccccgctcattcccctcccgagaacggacttgacaaagctaggtccttgaagaaagacgccccaacctcacccgcctcagtcgcctcttcttcttccactccgtcttcaaaaacgaaggatctgggtcacaacgataagagtagcacacccggattgaaaagcaatacccccacaccaagaaacgatgctcctacacccgggacatctacaacaccaggattaagaagcatgccgggtaagcccccaggcatggatcctatcgcgagtgccctccgaaccccaatcagtataacctctagttacgccgcacctttcgccatgatgtcacatcatgagatgaacggttctctgacgagtccaggcgcctacgcaggcctgcacaacattccaccacagatgagtgcagccgccgcagcagctgcggccgcgtacgggcgttctcccatggttggcttcgatccccatcctcctatgagagcaacgggcctgccttcttcactcgcgagcatacccggcggaaaaccggcctatagctttcacgtgagcgcggacgggcagatgcagcccgtgcctttcccccatgacgcgttggcgggccccgggatccccaggcatgcccgacagatcaatacattatctcacggggaagtcgtttgtgctgtgactatctccaaccccacaaggcatgtgtacaccggaggtaaggggtgcgtgaagatttgggacattagtcagccaggctcaaaatccccaatctcccagctcgattgcttgaatcgggacaattatatcagatcttgtaagcttctgccggacggtcggactctgatcgttggaggtgaagcaagcacactgactatttgggatctggctagcccaaccccgcggatcaaggcagagcttaccagttccgccccggcgtgctacgccctcgccatttctccggatgctaaagtgtgcttttcttgttgtagcgatggaaacattgccgtgtgggacctgcacaaccaaactttagtgcggcagttccaggggcatacagatggcgcctcatgcatcgacatctctcatgacggaacgaaactctggactggggggctcgacaatacggttcgctcctgggacctgcgagagggcagacagctgcagcagcatgatttcacctcccagatcttttctctgggatattgccctacaggagagtggcttgctgtggggatggagagttcgaacgtggaggtattgcaccacaccaaacctgataagtatcagttgcatctccatgaatcttgtgtgctgtccctgaagttcgcatactgcgggaagtggttcgtaagcactgggaaagacaacctcctgaacgcatggagaactccatacggcgccagcatattccagtccaaagaatcctcttccgttctctcctgcgacatctcagcagacgacaagtatatcgttacaggctccggggataagaaagccaccgtttatgaggttatttactag

SEQ ID NO: 209077 - DNA, 2319 bp, Artificial Sequence
  Description of Artificial Sequence: Synthetic coding sequence
atgtacccccagggccggcaccccgccccccaccagcccggccagcccgggttcaagttcactgtggcggaaagctgcgaccgaattaaagatgagttccagttcctgcaggcacagtatcactccctgaaggtggagtacgacaagctggccaatgaaaagacagaaatgcagaggcactatgtgatgtattacgaaatgagctacggactgaacattgagatgcataagcaaactgagatcgcaaagcgcctgaacacaatccttgcccagattatgccttttctttctcaagagcaccagcagcaggtcgctcaggccgtggaacgggcaaagcaggtgacaatgactgaactcaatgctatcattgggcaacagcaacttcaagcacagcacctcagtcatgctactcatggaccacccgtccaactgcccccccatccaagcggtcttcagcctcccggaatcccgcctgtcacaggatcgagtagcggcctactggcactaggggccctggggagtcaagcacacctcactgtcaaagatgaaaagaaccaccatgagctggatcaccgagagcgggagtcctccgctaacaattcagtgtctccgagtgaatctttacgagcttccgagaaacacagagggagtgctgactactcaatggaggctaagaaacggaaagcagaggagaaggacagcctatctcgttacgactccgacggtgacaagagcgacgacctggtcgtggatgtgtctaatgaagacccagctacaccccgcgtaagtcccgcacattctccgccagagaacggtctagacaaggcaagaagcctgaagaaagatgccccgacaagtcctgcctctgtggcctcatcctcctctactccctcatcaaagaccaaagacttaggacacaatgacaagtcctctacacctgggttgaagtctaataccccaacaccacgtaacgacgctcctactccaggcacgagtacaactcctggattgcgcagcatgcctggtaagcctcctggaatggatcctattggtatcatggcctctgcactgagaacacctatctctattacctccagttatgctgcaccctttgcgatgatgtctcatcatgaaatgaatggctccctgacgagcccaggcgcttacgctgggctgcataatatcccacctcagatgtccgcagccgccgccgcagctgcagcagcttatggtcgatctcctatggtatctttcggagccgtggggtttgacccacatccccccatgcgagcaacagggttgccatcttctctggcctcaatccctggtgggaagcctgcttatagcttccatgtaagcgcagacggccagatgcagccggttccatttccacatgatgcccttgccggtcccggaattcctcggcatgccagacagatcaatacgttatctcacggcgaggtcgtttgcgccgtcaccatttccaaccccacaagacacgtctacacgggaggtaaaggctgcgtgaagatctgggatatcagccagccgggttccaaatccccaatctctcagcttgattgtcttaacagagataactatatacgttcttgtaaacttctgcccgatggtaggacattgatcgtgggcggcgaggcctcaacgttaacgatctgggacctcgccagtcccactccgcgaatcaaggcggaactgacaagttcggcaccggcttgctatgcgctggctataagcccagacgctaaagtctgtttcagctgctgttcagatggtaacattgccgtctgggatctgcataatcagacactggtcagacagtttcaaggacacacggacggggcatcctgcatagacatttcccacgatgggactaagctgtggacgggggggctggataatacagtccgatcttgggatttgcgcgaaggcagacagctgcagcagcacgattttactagccagattttttccctcggctactgtcccacaggggagtggctagcagtaggcatggaatcaagcaacgtggaagtactccatcatactaaaccagacaagtaccaattacacctacatgagagctgcgtcctcagtctgaaatttgcgtactgcggcaaatggttcgttagcacgggcaaggacaatcttttgaacgcgtggcgcaccccctacggagccagtatcttccagtccaaggaatctagctctgtgctgagttgtgacatctccgccgatgacaaatatattgttaccggctctggggataaaaaggcgacagtgtatgaagttatctactag

SEQ ID NO: 209078 - DNA, 2319 bp, Artificial Sequence
  Description of Artificial Sequence: Synthetic coding sequence
atgcccccccccccccccctgagctgcctgcggggcctgcaggccccccatcagcccggccaacccggcttcaagttcacagtggcagagtcttgtgaccgaatcaaagacgaatttcaatttttacaggcccagtatcactcgctgaaagtggagtacgacaaacttgctaacgaaaagaccgaaatgcagagacactacgtgatgtattacgaaatgagttacgggcttaatatcgagatgcacaaacaaacagaaatcgctaagcgccttaacaccattcttgctcaaattatgccattcctctcccaagaacaccagcagcaagtcgcccaggccgtagaacgggccaagcaggtgaccatgacggaactgaatgccatcatcggacagcaactccaagcccagcacctgtcccacgcgacccacggcccaccagtgcagcttccgcctcatcccagcggccttcagcccccagggattccgccagtgaccgggtccagcagtgggctgctggcacttggcgctctgggtagtcaggcccatttgacagtcaaagatgaaaagaaccatcatgagctggaccaccgcgaaagagagagcagtgccaacaattccgtttcacccagcgagtctcttcgcgccagcgaaaaacacagagggtccgctgactatagcatggaggccaaaaaaagaaaagccgaagaaaaggatagcctctcacggtatgatagcgacggcgacaagagcgatgatcttgttgtggatgtcagcaatgaggatccagctacacccagagtaagccccgctcattccccccccgagaatggattggacaaggctaggagtctaaagaaggatgccccaaccagtccagcgagcgtagcatcctctagctcaacaccttcaagtaaaactaaggatcttggccataatgacaaaagttcaacgcccgggctgaaatctaacactccaacaccaagaaatgacgctcctacccctgggacctccaccacacccggcctgagaagtatgcccggaaaacccccgggaatggacccaattgggatcatggcaagcgccctcaggacccccatatccatcacaagctcttatgcggctcccttcgcaatgatgtcgcatcacgaaatgaatggttctttgacctcgccaggggcatacgcaggcctgcacaatataccacctcagatgagcgcagcagccgccgccgcggctgctgcatatgggcggagcccgatggtggggttcgatccacacccacctatgcgggcaacgggcctacccagcagcctcgcctctattcctgggggtaagcccgcctatagcttccacgttagtgctgacggacagatgcaaccggtgccatttccacacgatgccctagctgggcccggaattcctcgccatgctcgtcagataaataccctcagccacggagaagtggtatgcgccgtgacaatttccaatccaacgagacatgtgtacaccgggggaaaggggtgcgtcaaaatctgggacataagccagcctggtagtaaatcacctatcagccaattagactgtctaaaccgcgataactatattcgctcctgcaaactgctgccagacggcagaacactgattgtgggcggggaggccagtacactaaccatctgggatctcgcctctcccacgccaagaataaaggcagagctgacaagctctgcccccgcatgttacgcactggcgatctcaccggacgcaaaggtgtgttttagctgttgcagtgacggtaacattgccgtctgggatctgcacaatcagaccctggtaaggcaatttcaaggccatacagatggtgccagctgtatcgatatctcacacgatgggaccaagctgtggactggcggcttagacaatacagttcgctcatgggaccttcgtgaaggcagacagctacagcagcacgactttacttcacagatcttcagtctgggctactgtcctactggcgagtggctggcagtaggtatggaatccagtaatgtggaggtcctccaccacacgaagccggacaaataccagctgcatttgcacgagtcttgtgtgctgagtctgaaattcgcatactgcgggaagtggtttgtgagcacgggaaaggacaatctgcttaatgcatggcgtaccccctacggggcatccatatttcagtctaaggagagtagcagcgtcctgtcctgcgacataagcgccgacgataaatacatcgtgactggcagcggcgataagaaggccactgtgtatgaggtgatatactag

SEQ ID NO: 209079 - DNA, 2325 bp, Artificial Sequence
  Description of Artificial Sequence: Synthetic coding sequence
atgcccccccccccccccctgagctgcctgcggggcctgcaggccccacaccaacctgggcagccagggttcaaatttacagtggctgagagttgcgaccggattaaagacgagttccagttccttcaggctcaatatcatagtctcaaagtggaatacgacaagctcgctaatgagaagaccgagatgcagagacactatgtgatgtactacgagatgagttacgggttaaacattgagatgcataagcaaactgagatcgccaagcggctcaacaccattctggctcagattatgccattcctgtcccaggagcatcagcagcaggtggctcaggctgtggagcgagctaagcaggtcactatgactgagctcaacgccattatcgggcagcaactgcaagcccagcatctgtcgcacgccacccatggaccaccagtccagcttccccctcacccaagcggactccaaccgcctggcatacccccagtaacggggagtagtagcgggctcctagcactgggggccctgggttctcaggcgcatctcacagtgaaggacgaaaagaaccaccatgaactggaccacagggagagggaatcaagcgcaaacaattctgtctcccctagcgagtcgctgcgtgcaagcgaaaagcaccgcgggtctgcagattattccatggaagcgaaaaaacgaaaagctgaggagaaggactctctctccagatatgatagtgacggcgacaaatctgatgatttggtcgtggatgttagcaatgaggaccccgcgacacccagggtcagccccgcacactcacctccggaaaacgggctcgacaaggcaaggagtctgaagaaagatgccccaacgtctccagcctcagtggccagcagcagtagtaccccgagctctaagaccaaagaccttggccacaacgataaatcctccaccccgggtttgaaatctaacactcccacccctcgtaatgatgcacctacaccaggaacctcaacaacccccgggttacggtccatgccaggaaagccccccggaatggaccctatcgcaagcgcactgcgcacccccatctccattacctccagctacgcggctccattcgccatgatgtcccatcatgagatgaatggctccctaacgtctcccggcgcatatgccggtctgcacaacatcccaccacagatgtcagctgctgccgcagccgccgcagctgcttatgggcggtcacctatggtgtcctttggtgccgtcgggttcgaccctcacccccccatgcgggccaccggacttccctctagccttgcctcgatccctggtgggaaaccagcctattcattccatgtcagtgccgacgggcagatgcagccggtgccattcccccatgatgcactggcaggacctggaatccctcgccacgctcgccagatcaatacgttgtcacatggtgaggtggtctgtgcagtgactatttctaaccccacacgtcacgtctataccggcggaaaagggtgtgtgaaaatctgggatatatcgcagccagggtccaaatcccctataagccagttagactgcttaaaccgggataattatattcggtcttgcaaactgcttccagatggccggactctcatcgtcggcggcgaagcatccactctaaccatttgggacctcgcttccccaacaccccgtatcaaagcagaactaacgtcaagcgcccctgcatgctatgctttagcgatttcgccagacgccaaggtgtgcttctcttgctgctctgatggaaacatcgccgtgtgggacctgcacaatcagacactggtccgccagttccagggtcatactgacggtgccagttgcattgacatctcacatgacgggactaagctctggacaggtggacttgataacactgtccgcagttgggaccttagggagggtcggcagttacagcagcacgacttcacatctcagatcttttccctcggatattgtcctacaggggaatggctagccgtcggaatggagtcgtctaacgtggaggtactgcatcacaccaagcctgacaagtaccagctgcatttgcacgagtcatgtgtactaagcctcaaatttgcgtattgcggaaaatggtttgtgtcaacgggaaaagacaacctcttgaatgcatggagaacaccttatggcgcttccattttccaatccaaagaatcctcttctgtgcttagctgcgatattagcgccgatgacaagtacattgtgaccgggtctggggacaaaaaagccaccgtctatgaggtcatctattag

SEQ ID NO: 209080 - DNA, 1719 bp, Artificial Sequence
  Description of Artificial Sequence: Synthetic coding sequence
atgaccagccgggaccagccccggcccaagggcccccccaagagcacaagtccgtgccccgggatttcaaatagcgaaagttcaccaaccctgaactatcaaggcatcctcaaccgtctgaagcagttccctagattctctccacacttcgcagctgaactcgagtctatttattatagcctgcacaagattcaacaggatgtggcggaacaccacaaacaaatcggaaatgtcctgcagatagttgaatcttgcagtcaactgcaaggatttcagtctgaagaagtgtctccagccgagcctgcatcacctggcactccacagcaggtgaaggataaaacgctccaggagtcttcatttgaggacatcatggccacccgcagttctgactggctgagacgtcctctgggcgaagataaccagcccgaaacccagctattctgggataaggagccatggttctggcacgatactctcaccgagcagctgtggcgaatcttcgccggtgtgcacgacgaaaaggccaagcctcgggacaggcagcaggccccaggcctggggcaggaaagcaaggctcccggatcgtgtgatcccggtaccgatccttgccctgaggatgcttccactccaaggccccccgaggccagcagttcccctcctgagggttcccaggatagaaacacgtcctggggggtggtgcaggagcctccaggccgggctagccggttcttgcagagcatatcatgggatccagaggatttcgaggatgcttggaagcgcccagacgcactccctgggcaaagcaaaagacttgccgttccttgtaaactggaaaaaatgaggatcttggcccacggtgaactcgtgcttgctaccgcaatctccagcttcacaagacacgtgtttacatgtggacggaggggaattaaggtttggagccttacgggccaggtcgctgaagaccggttcccagagtcacacttgcctatccagacacctggggctttcctgaggacatgtcttctaagtagcaactcaagatctctgctgaccggcggatacaatctcgctagcgtgtccgtctgggacctcgccgccccttcactccatgtaaaggagcaactcccatgtgccggccttaattgccaagcactcgatgccaatctggacgccaacttggcctttgcgagttttacctctggcgtcgtgcggatatgggatctgcgggatcaaagcgtcgtgcgtgatctcaaaggttacccagatggcgtgaagagcatcgtggttaaggggtataacatctggacaggcggccctgacgcgtgcctgcgttgttgggaccagcgtactatcatgaagcccctggagtatcaattcaagagccagattatgagcctgtctcattcgcctcaggaggactgggtgctccttggaatggcaaacggacagcagtggctgcagagtacttcaggttctcaaagacatatggttggccagaaggactcggtaatcttgagtgttaagttcagcccgttcggccagtggtgggctagcgtaggaatggacgactttctaggcgtctactctatgcccgccgggactaaggtcttcgaagttcctgagatgagcccagtgacctgctgtgatgtgtcctccaataataggttagttgtaactggctccggcgaacatgcttccgtataccagattacttattag

SEQ ID NO: 209081 - DNA, 1251 bp, Artificial Sequence
  Description of Artificial Sequence: Synthetic coding sequence
atggccacccggagcagcgactggctgcggcggcccctgggcgaggataatcagccagagactcagctcttctgggacaaagagccatggttttggcatgatacactgaccgaacagctgtggaggattttcgccggtgtgcatgatgaaaaagcaaagcctagagatcgacagcaagcacctgggctcggacaggaatctaaggcacccggaagctgcgatccaggaacggatccctgcccggaggatgcctctacccctcgccctcctgaggcctcttcctccccccccgaagggtcccaggatcggaacacatcttggggtgtggtccaggagcccccaggtcgcgcctcacgcttcttgcagagtatcagttgggaccctgaagattttgaggacgcgtggaagcgacccgatgccttgcccggccagtccaaaagactggctgtaccttgtaaacttgaaaagatgaggatcttggcccatggtgaactcgtgctggctacagccattagttctttcacaagacacgtctttacttgcggaagacgcgggattaaggtgtggagcctcacaggccaggtcgccgaagaccggttccctgaatctcatctccccatacagacccccggtgcattcctgcgtacatgcctgttgtcttctaattcaagatcccttttgactggcgggtacaacttggctagtgtttccgtgtgggatctggccgcgccgagtcttcacgttaaggagcagttgccatgcgccgggctgaattgccaggccctcgatgcaaatttggatgcaaatttagccttcgcctcgtttaccagcggcgtcgtgaggatctgggacctgcgggaccagagtgtggtaagagacctcaagggctaccccgatggggtaaagtccattgtcgtcaaaggttataacatctggactggaggccccgatgcatgtctccgatgctgggatcagcgaaccatcatgaaaccactggagtaccagtttaaatcccagattatgtcgctgtcccatagtccgcaggaggactgggtgcttcttggcatggcaaacgggcagcagtggctgcagtcgacgtctgggtctcaaagacatatggtagggcaaagacagagacaccccgagagacaggttctccccctgtggcctgtggtcggcaaaagatggaacggcaggcttccttggcgccttcagcatgctgggggggacaaaagcgtgagaggcgcctag

SEQ ID NO: 209082 - DNA, 1719 bp, Artificial Sequence
  Description of Artificial Sequence: Synthetic coding sequence
atgaccagccgggaccagccccggcccaagggcccccccaagagcactagcccctgccccggcatctccaactcagagagctcccctacgctcaattaccaggggatcctaaaccgccttaaacagttccctcggttctctccacactttgcagcagaactcgagtcaatttattattccctacataaaattcagcaggatgttgcggagcatcacaaacagatagggaacgttcttcaaatcgtggaatcctgttcccagctccaggggttccaatccgaagaagtttcaccagctgagccggccagtccagggacgccacagcaggttaaagacaaaacgttacaagaatcttctttcgaagacatcatggctacccgctccagtgattggctgagaagaccactgggagaagataaccaaccggaaacacagctgttttgggataaggagccttggttctggcatgacactctgactgagcaattatggagaattttcgccggcgtacacgatgagaaggcgaagcccagagatcggcattttagcatttttcagggacaagagagtaaggcgcctggatcgtgtgacccaggcacagacccctgtcccgaggacgccagcacgcccaggcctccagaagctagcagcagtcccccggaaggaagccaggacagaaatacatcatggggtgtcgtccaggagccaccagggagggcctctcgcttcctccaatccatttcttgggaccccgaggacttcgaggacgcttggaagcgaccagacgccctgccaggccagtccaaacggctcgcagttccctgcaagctggagaagatgcgaattttggcccatggagaactcgttttagcaacggcaatctcttcattcacccgacatgtgttcacctgcggccgccgtggcataaaagtttggtctctcacaggccaagtggccgaagaccgatttccagagtcccacctgcccattcaaacccctggcgcttttcttcggacctgtttgctgtcatcaaacagtagatcacttctcactggcggatataatctagcatccgtgagcgtttgggacttggccgctccatctctgcatgtcaaagagcagcttccatgtgcaggcctgaattgtcaggccttggacgcaaacctggatgcaaatctcgcatttgcctccttcacctccggggttgtcaggatctgggatctccgcgaccagagcgtggttcgggacctgaagggttatcctgatggcgtgaagagtatagtagtgaagggttacaacatatggacaggaggccctgacgcatgcttgcgatgctgggatcagcgtactataatgaagcctctggagtaccagttcaaaagtcagataatgtctctctcccacagtccacaggaagactgggtcctgttagggatggctaacggccagcagtggctgcagtctacctccgggtcccaacggcacatggtgggccagaaggactcagtaattctgtccgtgaaattttccccattcggtcagtggtgggcttctgtcggcatggacgacttcctcggggtgtattctatgcctgcagggacgaaggtgttcgaagtgccagaaatgagccctgtgacatgttgcgatgtgtcttcaaataaccgccttgtggtgaccgggtctggcgaacacgcttccgtataccagattacgtattag

SEQ ID NO: 209083 - DNA, 1350 bp, Artificial Sequence
  Description of Artificial Sequence: Synthetic coding sequence
atggccacccggagcagcgactggctgcggcggcccctgggcgaggacaaccagcccgagacgcagctgttttgggacaaagagccctggttctggcatgacacactgaccgaacagctgtggcggatctttgcaggagtgcacgacgaaaaagcaaagccccgggatcggcagcaggcgcccggccttggacaagaatcgaaggcccccggaagctgtgaccctggtaccgatccctgtcccgaggacgcctctaccccccggcctcctgaagccagttctagccccccagagggttctcaggaccgcaatacgtcttggggagtcgtgcaggagccccccggcagagcgtccagatttctgcagtcgatcagttgggatcctgaagattttgaggacgcctggaagcggcccgacgccctgcccggacagagcaagcgactcgccgttccatgtaaactggaaaagatgagaattctggcccacggagagctagtccttgccaccgcaatcagttccttcacccggcacgtatttacctgcgggagacggggaatcaaggtttggtctctaaccggccaggtggccgaggaccgctttccagagagtcaccttccgattcagactcctggagcttttttgcgaacttgcctactgtcttctaacagcaggtccctcctgactggtggctacaacctcgccagtgtatccgtgtgggatttggctgcccctagcctacacgtaaaagagcagctgccctgcgccggtttgaactgccaggccctggatgccaatctggatgccaatctcgctttcgcttcctttaccagcggtgtggtgaggatttgggacctgcgagaccaatccgtggttagagacctgaagggctaccccgacggggtgaaaagtatcgtagtcaagggctacaatatttggaccgggggccccgacgcttgcctgcgttgctgggaccagagaacaattatgaagccattagaatatcaattcaagagccagattatgtcactgagccacagtccacaggaggattgggtgctcctcggcatggctaatggccaacagtggctgcaaagcacatccggctcgcagcgacatatggtggggcagaaagacagtgtcatcctatctgtgaaattcagcccgttcggtcagtggtgggctagcgtcgggatggacgatttcctgggggtgtatagtatgccagcaggaaccaaggtcttcgaggtgcctgagatgagtccggtgacatgctgtgacgtctcatccaataacagactggtagtcacggggtccggcgagcatgcttctgtttaccagatcacttattag

SEQ ID NO: 209084 - DNA, 1716 bp, Artificial Sequence
  Description of Artificial Sequence: Synthetic coding sequence
atgaaccagctgcggggcaagaagagctgccacaccggcctgggccggagcgctggttggaacatccctatcgggctgctctattgcgatctacccgaacctaggaaaccccttgaaaaggccgtggctaacttcttttcaggctcgtgcgccccatgcgctgatggaacagacttcccacagctttgccagctgtgccccggttgcggctgttccacgctgaatcagtattttgggtatagcggggcttttaagtgtctgaaggatggcgccggggacgtcgcatttgtgaaacattctaccattttcgagaatctggccaataaggcagatcgcgatcagtacgagctgctttgccttgataatactcgaaaaccagttgacgaatacaaggactgccacttggctcaggtccccagccatacagtcgtggccaggtctatgggtgggaaggaagacctgatctgggagctgctgaaccaagcccaggaacacttcggcaaggacaagtctaaggagttccagctatttagttcaccacacgggaaagacttgttattcaaggactctgcccacggcttcctgaaggttccgccgcgcatggatgccaagatgtacttaggatatgagtacgtgaccgccattaggaatctccgggaaggcacttgcccagaagcccccaccgacgaatgtaagcccgtgaagtggtgtgccctgtcccaccacgaacgcctcaagtgcgacgaatggtctgtaaattccgtagggaagattgaatgcgtctctgccgaaacgacggaagactgcatagcgaagattatgaatggtgaagctgatgccatgagtttggatgggggtttcgtctatatcgctggcaagtgcggactcgtgccagtattagccgagaactacaataagagcgacaattgcgaagacacccccgaggccggctattttgctatagctgttgtgaaaaaatccgcctcagacctcacatgggataatctgaaaggcaaaaagtcttgtcacacagcagttgggcggacagctggatggaatattcctatgggtttgttgtataacaagatcaaccactgccgcttcgacgaatttttcagtgaaggttgtgctcccggctccaaaaaagatagctccctctgcaagctgtgcatggggtcaggtctgaacctgtgcgagccaaacaacaaggaaggttattacggctatacaggagcattccggtgcctggtggagaagggcgacgtggcttttgtgaaacaccagacagtgccccagaacactggcggtaaaaatccagacccgtgggccaagaatctgaacgaaaaagattacgagctgctgtgccttgacggaacccgcaagcctgtggaagagtacgctaactgccacttggcccgagcgccaaatcacgcggttgtgacccgcaaggacaaggaggcctgtgtccacaagatccttcggcaacaacaacacctgttcgggtccaatgtgaccgactgttctggcaacttctgcctgttccgttctgagacaaaggatctgctctttagagatgacactgtgtgtctggcaaagcttcatgatcgcaatacctatgagaaatatctcggggaggagtatgttaaagccgtgggaaacctacggaaatgtagcacctcaagtctccttgaagcttgcacgttcagacggccgtag

SEQ ID NO: 209085 - DNA, 2097 bp, Artificial Sequence
  Description of Artificial Sequence: Synthetic coding sequence
atgcggctggccgtgggcgccctgctggtgtgcgccgtgctgggcctgtgccttgccgtgccagacaaaacagtccgctggtgtgcagtgtccgagcacgaggccacaaaatgccaaagttttagagaccacatgaaatccgtgataccttcagatgggccatccgttgcctgcgtgaagaaggcatcatacctggattgtatccgcgccattgctgcgaatgaagccgacgcagtgacactggacgccggacttgtgtatgacgcctacctggcccccaataaccttaagccggtcgtggctgagttttacggcagtaaagaggacccccagaccttctactacgccgttgccgtagttaaaaaggactccgggtttcagatgaatcagctgcggggtaagaaaagctgccacacagggctcggaagatccgcaggctggaacattcctatagggttactctattgcgatctgcccgaacctcggaagcccctggaaaaagccgtggccaatttcttttcgggatcttgtgccccctgtgcagacggaacagatttcccacagctgtgtcagttatgtcccgggtgcggctgctctaccctcaatcaatacttcggctattcgggcgccttcaagtgccttaaggacggggccggcgacgtggcctttgttaagcactctaccatcttcgagaacctcgcaaacaaagcggaccgggatcagtacgagctcttgtgccttgacaacacccgcaagccagtcgacgagtacaaagattgccatctggcacaggtgccatcccacaccgtggtcgcccgctctatgggcggtaaggaggatctcatctgggagctgctgaaccaggcccaagagcatttcggcaaagataagtcaaaagaattccagcttttcagcagcccacatggcaaggacctactgttcaaggactccgcacatggattcttaaaggttcccccacggatggacgctaaaatgtatctgggatacgaatacgtcacagccatacgcaacctcagagaaggaacgtgtcctgaggcccctacagatgaatgtaagcctgtgaagtggtgcgctctgagtcaccacgagagattgaagtgcgatgagtggagcgtaaacagtgtcggaaagatagagtgtgtaagcgctgagaccacggaagactgtatcgcaaagatcatgaatggtgaggccgacgccatgagcttggatggaggatttgtatacatagccgggaagtgcggtctcgtgccagtcctggctgaaaactataataaatccgacaactgcgaagacacacccgaagccggttatttcgccattgccgtggttaaaaaatctgcgagtgatcttacttgggacaacctgaagggaaagaagagctgccataccgccgttggccgaactgccgggtggaatatccccatgggcttactgtataacaagattaatcattgtcggttcgacgaattcttcagtgaaggatgcgcccctggttccaagaaagacagtagcctctgcaagctgtgtatggggagtggacttaacctatgcgaaccgaacaataaagaaggctactacggctacacaggtgccttcaggtgcctggtcgaaaaaggggacgttgccttcgtgaagcatcagaccgtgccacaaaatacgggcggcaaaaaccccgatccatgggccaagaatttgaacgagaaggactacgaactcctgtgcctggacggcacaaggaagccagtcgaggaatatgcaaattgccacctagctagggcacccaatcatgctgtggtcacgagaaaagacaaggaggcttgtgtgcacaagatcctcagacagcagcagcatcttttcgggtccaacgtaaccgactgcagtgggaatttctgcctgtttagaagcgaaacaaaagacctcctgtttagggatgacaccgtgtgcttggcaaagctgcatgaccggaacacgtacgagaagtacttaggcgaagaatatgtgaaggcggtgggaaatctcaggaaatgctctactagctcccttttagaagcgtgtactttcaggcgaccttag

SEQ ID NO: 209086 - DNA, 2283 bp, Artificial Sequence
  Description of Artificial Sequence: Synthetic coding sequence
atgatggaccaggcccggagcgccttcagcaacctgttcggcggcgagcccctgtcttacacacggttctccttggccaggcaggttgacggagataacagccacgtcgagatgaaattagccgtggatgaggaggaaaatgcagacaataataccaaggccaatgtgacaaagcccaagcggtgtagtggcagcatctgctatggcactatcgcagtgatcgtattcttcttgattgggttcatgatcggatacctcggctactgtaaaggggtcgaacccaagaccgagtgtgagaggctggcgggcactgagtctccagttagagaagagcctggggaggattttcccgctgcaaggaggctttattgggatgacctaaagcgcaaactatctgaaaagttggattccaccgacttcactggaacgataaagctgctgaacgagaactcttatgtgcccagagaagccggctctcaaaaagatgaaaatctcgccctctatgtggaaaaccagttccgcgaattcaagctcagtaaggtctggagggatcagcactttgtgaaaattcaagtcaaggattctgcacaaaacagcgtaatcattgttgacaagaacggcaggctggtgtacctggttgagaacccgggcggttatgttgcctactctaaggccgccaccgtgacaggcaagctcgtccacgccaactttggtaccaaaaaggattttgaagatttgtataccccagtgaatggatcaatcgtcatcgtacgggccggtaagatcactttcgctgagaaagtcgctaacgcagagtcactgaacgccattggtgtgttgatttatatggaccaaaccaagttcccgatcgtcaacgccgagcttagtttcttcggtcacgcacacttgggcacaggtgacccatacacacctggtttcccaagctttaatcacacccagtttccacccagtaggtcctccgggctcccaaacatcccagtgcaaaccatctcacgcgctgctgccgaaaagctctttgggaacatggagggggactgtccctcagattggaagactgactcgacttgccgaatggtgacctcggagtctaagaacgtgaagctcaccgtgagcaacgtgctgaaagagattaaaatcctgaatatcttcggcgttattaagggatttgtcgagcctgatcattatgtggtggtgggggcccagagggatgcctgggggcccggagccgcgaaaagcggcgtcggcactgctttactgctcaaactggctcaaatgttttccgatatggtgctcaaagacggattccaaccgtcacgttctatcatcttcgccagctggtccgcaggcgacttcgggagcgtaggggctactgaatggctagaggggtatctgtcaagtttacacctcaaagcattcacctatattaacttagataaggctgtgctgggcacctccaacttcaaagttagtgcatcccccctcctctataccttgattgaaaaaacaatgcagaacgttaagcaccctgtgaccggtcagttcctgtatcaggattccaattgggcttccaaggtggaaaaactcacacttgacaacgcggcctttccatttctggcttacagcggcatcccggcagtcagcttttgcttctgcgaagatactgactatccatacctgggcacaaccatggacacatacaaagaattgatcgagcggattccagaactgaacaaagtagccagagccgccgctgaggttgcaggacagttcgtgatcaaattaacgcatgatgtggagctcaacttggactatgaacgctataactctcagttgctgtcttttgtgcgcgaccttaatcagtatcgggcagatatcaaggagatgggacttagcctgcaatggctgtattctgcccgaggcgatttttttcgggctacctctcggctcaccaccgactttggtaacgccgagaaaacagaccgttttgttatgaaaaagttgaacgatagagtcatgcgcgttgagtaccatttcctcagtccctatgtgtcaccaaaggaaagcccttttaggcacgtcttctggggaagtggttcccacaccctaccggctctgttggagaacctcaagttaaggaaacaaaataatggagccttcaatgagaccctattccgcaatcaattggctctggctacgtggacaatccagggtgctgccaacgcactttccggcgacgtctgggatattgataacgaattctag

SEQ ID NO: 209087 - DNA, 2283 bp, Artificial Sequence
  Description of Artificial Sequence: Synthetic coding sequence
atgatggaccaggcccggagcgccttcagcaacctgttcggcggcgaaccattgtcctacactaggttcagtctggcacgccaagtggatggggacaatagccacgtcgagatgaagctcgcagttgacgaagaagaaaatgcagataacaacactaaggcgaatgttacaaaacccaagcgctgttctggaagcatctgttatggaactattgctgtcatcgtgttttttcttatcggattcatgatcggatacctgggctactgcaaaggggttgaaccaaagactgagtgcgaacggctggccggtaccgaaagtccagtgcgcgaggagccaggagaggacttcccagcagcccgcaggctgtattgggatgacctgaaacgcaagctgtcagaaaagttggatagtaccgatttcaccggtacgataaagctgctgaacgagaatagttatgtcccaagggaggccggctcacagaaggacgagaatctcgccctatacgttgagaatcaatttcgagagtttaagctgtcaaaagtgtggcgcgaccagcactttgttaaaattcaggtgaaggacagtgcccagaactctgttatcattgttgataagaacgggaggctggtatatctggttgagaatccaggaggctacgtggcatattcaaaagcagcgactgtgaccgggaagcttgtccatgcaaactttgggaccaagaaggactttgaagacctgtacacccccgttaacggcagcatcgtgattgttagagctggaaagatcaccttcgccgagaaggtagccaatgccgagtccctaaatgctatcggcgtcctgatttacatggatcagacaaagttcccaattgtgaacgcggagctgtcattctttggacacgcccacttgggcactggcgacccctatacccccgggtttcctagcttcaaccatacccagttccccccctccaggagctccggtttgcccaatataccagtccagactatatcaagggctgcagcggaaaaactgtttggaaacatggagggagactgcccttcagattggaaaacagactccacctgccggatggtaacttcagaatctaaaaacgtgaagcttaccgttagtaacgtcctgaaagagatcaagatcctgaatattttcggggtgattaagggattcgtagaacctgatcattatgttgtggttggagcccagagggatgcctggggaccaggggctgccaagagtggggtgggcaccgctctgcttctaaaattagcccaaatgttctccgacatggttctgaaggatgggttccaaccaagcagatccattatttttgcatcatggtcagcgggcgacttcgggtctgtaggagcgaccgagtggctcgagggatacctatcctctttacacctgaaggcgttcacttacattaatctggacaaggccgtgctgggtacttcgaactttaaagtcagcgcttcacctctactctacaccctcatagagaagaccatgcaaaacgtgaagcacccggtaactggacagttcttatatcaggacagcaactgggctagtaaagtggagaagctgacacttgataatgctgccttcccattccttgcatacagtggtatccccgctgtcagcttttgtttttgtgaagataccgattacccttatctcggcactaccatggacacatataaagagctgatcgaaagaatcccggaattaaataaagtggcccgagctgccgcagaagtggccggacagtttgtcattaaactgacccacgacgtggaattgaacctggattacgaaagatataattctcagttgttatccttcgtgagagatctcaatcagtatcgggcagacatcaaggaaatgggcctgtctctgcagtggctctactctgcaagaggcgatttttttcgggcaacaagtcgtctgacaactgattttggtaacgctgaaaagactgatcggttcgtaatgaagaagctcaacgaccgggtaatgagggtggagtatcatttcctgagtccatacgtcagtccgaaggagagtcctttcaggcacgtgttttgggggtcaggatctcataccctacctgctctccttgaaaatttaaagctaagaaagcaaaacaacggtgccttcaatgaaacgttattcagaaaccagctcgcactggccacatggaccatccagggcgcagcgaacgccttatccggcgatgtatgggacatcgataatgaattctag

SEQ ID NO: 209088 - DNA, 1437 bp, Artificial Sequence
  Description of Artificial Sequence: Synthetic coding sequence
atggaccagaccaagttccccatcgtgaacgccgagctgagcttcttcggacatgcacacctgggtacaggggatccttacacacccgggttcccctcctttaatcatacacaatttccgccttcccgaagttcaggactgccaaatattccggtccagacaattagccgggcagcagctgaaaaacttttcggaaatatggagggggattgtcctagcgattggaagacagactcgacctgcaggatggtcacctcagagagtaagaatgtgaaactgaccgtgagtaacgtgttaaaggaaatcaaaattcttaatatttttggggtgatcaagggcttcgtggagcctgatcactatgtggttgtcggtgcccaaagagacgcttggggaccgggcgccgctaagagcggagtggggaccgctctattgctaaagctcgcccagatgttttcagacatggtgttgaaggacggatttcagccctcaaggtctatcatatttgcatcatggtccgccggcgattttgggtcagtgggcgcaaccgaatggctggaggggtacctgagcagcctgcatttaaaggcatttacatatattaacctggacaaagcggtcctcgggacgtccaactttaaagtttccgcttcgccgctgttatataccctaattgagaagactatgcagaacgtgaaacacccagttacaggccaatttctatatcaggactcaaattgggcttccaaagtagagaagcttacgctggacaacgcagccttccccttcctcgcttactcagggatccccgctgtttccttttgtttctgtgaggacacagattatccttatctcggtaccaccatggacacatataaagagctcatcgagcggattcctgagctgaacaaggttgcccgggctgctgccgaagtcgcaggccaattcgttattaaactgacccacgacgtcgagctcaatctggactatgaacggtataacagccagttactctcctttgtgcgcgaccttaatcaatatcgggccgatatcaaggaaatgggactcagcctgcagtggctttacagcgccagaggggacttctttcgggcaacgagcagactgaccactgacttcggaaacgctgagaaaacagacagatttgtgatgaagaagctaaacgacagggttatgcgtgtggaataccacttcctgtcaccctacgtctcccccaaggagtctccattccgccatgtgttctggggcagtggctctcatactttgccagctttattggagaatctgaagctgaggaagcagaataatggagctttcaacgagacactttttaggaaccaattggccctggccacctggaccatacagggcgccgcaaacgctctctctggtgacgtatgggatatagacaacgaattttag

SEQ ID NO: 209089 - DNA, 42 bp, Artificial Sequence; identical to SEQ ID NO: 173691
  Description of Artificial Sequence: Synthetic coding sequence

SEQ ID NO: 209090 - DNA, 11493 bp, Artificial Sequence
  Description of Artificial Sequence: Synthetic coding sequence
atggccttcgtggccacccagggcgccaccgtggtggaccagaccaccctgatgaagaaatacctgcaattcgttgctgctttgacagatgttaacacccccgacgaaacaaagcttaagatgatgcaggaggtgtcagaaaactttgaaaatgtgacatcaagtccccaatactcgaccttcctcgaacacattattcctaggttcttaacctttctccaggacggcgaggtgcagttcctccaggaaaaacctgctcagcagctgaggaaactagtgctggagatcatacaccggatcccaaccaatgagcacctgaggccccacaccaaaaacgtccttagcgtgatgttcagattcctggaaacagagaatgaagaaaatgtgctgatttgcttacgcattattatcgagctccacaaacagttccggcctcctattacacaggagattcaccacttcctggattttgtaaagcagatctataaggaactccctaaagtcgtgaacagatactttgaaaatccccaggtgatccctgagaatacagttccaccacctgagatggtggggatgatcacgaccatcgcagtgaaagttaatccagagcgggaagactctgagactaggacccattctataatccctcgagggtctttgtcactcaaggtgctcgccgagttacccattattgttgtactgatgtatcagctgtataagcttaacatccataatgtcgtggccgaattcgtgccgctgattatgaacacaattgcaatacaagtgagcgcccaggcacgtcaacacaagttgtataacaaggagctttacgccgatttcatcgcagcgcaaatcaagaccttgagttttctggcctacattataagaatttatcaggagctggtcaccaaatacagtcagcaaatggtgaaaggaatgttacagctgctatcgaactgccccgcagaaaccgcacatctccggaaagagttgctgatagcagccaagcacattctcaccactgagctcagaaaccagttcattccatgtatggataagctgttcgatgaatcgatactgatcgggtccgggtacactgcccgcgaaaccctgagaccccttgcctacagcacactcgccgacttggtgcatcacgttcgacagcacttgcccctcagcgacttatccctggctgtccagctgtttgctaagaacatcgatgacgagtcccttcccagtagcatccagaccatgagttgcaagctactgttgaatctcgtggactgtatccgttcgaagtcagaacaggaaagcgggaatggaagagacgtacttatgagaatgctggaggtgtttgtgctcaagtttcacaccatcgcacggtaccaattgtctgctatctttaaaaagtgcaagccgcagtccgagcttggtgcggtcgaggccgctctgcctggcgtgccaaccgctcctgctgcccctggccccgcaccctctcctgctcccgtcccagccccccctccaccccctcccccacccccacctgctacgcccgtcaccccggctcctgtccccccatttgaaaaacaaggtgagaaggacaaggaagataaacagacctttcaagttacagactgcagatccttagtaaagaccctcgtgtgcggggtgaagacaattacctgggggataacgtcatgcaaggcccccggcgaagcgcagtttatcccaaataagcagcttcagcccaaggagacacagatctacattaagctggtgaaatacgctatgcaagcgttagatatttatcaggtgcagatcgctggcaatggacagacttatataagggtagccaattgtcagacagtgcgcatgaaagaagagaaggaggttcttgagcacttcgctggcgtttttacaatgatgaacccgctcacctttaaggagatctttcagacaaccgttccttacatggtggaaagaattagtaagaactatgccctccagatcgtagccaattctttccttgccaacccaacaacatctgcgttgtttgcaactatcttggtagaatatttactggaccggctgcccgagatggggagcaacgtggaactgagtaacctttacttaaaactgtttaagttggttttcgggagtgtttccctttttgctgcagaaaacgagcaaatgctaaagccccacctgcacaaaatcgttaacagttcgatggagctggcccagactgccaaggagccatataactacttcctgctgctgcgagcccttttccgtagcatcgggggcggatcccatgatctgttgtatcaggagtttctgcccctgctgcccaatctgctacagggcctgaacatgttgcagtctgggctgcacaagcaacatatgaaggacttgttcgtagagttatgtctgaccgtgcctgtgcgactgtcaagccttctgccttacctgccaatgctgatggatcctttggtctcagcgttgaacgggtcacagaccttggtaagccagggcttaaggacgcttgagttatgtgtggataatttacaaccagatttcctctacgatcatattcagccagtgcgcgctgagctgatgcaggcgctctggcgaaccctgcggaacccggcagacagcataagccatgtcgcctatcgcgttttaggaaagtttggcggaagcaatcgaaagatgttgaaagaatcccagaagttgcattatgtcgtgacggaggtccaaggaccttccatcacagtggagttctccgactgtaaggcctctctccagctacccatggagaaggccatcgaaactgcactagactgtctcaagagcgctaacactgaaccctattacaggcggcaagcgtgggaggtaatcaagtgtttcctcgtggccatgatgagtctggaggataacaaacatgcgctgtaccagctgctggctcaccctaactttactgagaaaactattcctaatgtcattatctctcacagatacaaagctcaagatactcccgccaggaagacgtttgagcaggctctgaccggtgccttcatgagcgctgtgataaaagatctgcgccctagcgcactgccttttgtggccagtttgatccggcactacacaatggtcgcggtggctcaacagtgtggaccctttctgcttccttgttaccaagtggggagtcagcctagtactgcaatgttccacagcgaagaaaatgggtctaagggaatggaccccctggtgttaatcgatgcaattgcaatatgcatggcttatgaggaaaaggaactttgtaagatcggcgaggttgcgttggccgttatcttcgacgtggcaagcattatcctgggttctaaagagcgcgcctgtcaactgcctttgtttagctacatcgtggaacgcctctgcgcatgctgttacgagcaggcatggtatgctaagctcggcggggtggtgagtatcaagtttctaatggaacggcttccactgacatgggtactgcagaaccagcagacctttttgaaggctctcctatttgtcatgatggatctcaccggagaggtctccaatggcgctgtagccatggccaagaccacactggaacaattgctgatgcggtgtgccacccctctcaaagacgaggagcgggccgaagagattgtagccgctcaggaaaagtctttccaccacgtgacccatgacctggtcagagaagtgacttcccccaactctactgtaaggaaacaggcaatgcattccctgcaggttctcgcacaggtgaccggcaagtctgtgaccgtgatcatggagccccacaaggaagtccttcaggacatggtgcccccaaagaaacacttactgaggcatcagcccgcgaacgcccagatcggcctgatggaaggtaatacgttttgtaccaccctccaaccaaggctgttcacaatggacctgaacgtggtggaacataaggttttctataccgaactgttaaacctgtgcgaagctgaggatagcgctctcaccaagctgccctgctataagagtcttccatcccttgtgccgttgcgaatcgctgccctgaacgccttggctgcttgcaactatttgcctcagagccgggagaagattatcgcggctcttttcaaggctctaaactctaccaatagcgagctccaggaggcaggcgaagcgtgcatgcgcaagttcctagagggggcaacaatcgaagtggaccagattcacactcatatgcgccctctcctcatgatgttgggagactatcgctccctgacgctaaatgtagtgaacagactcacctccgtcactaggctattccccaactccttcaatgacaaattctgtgatcagatgatgcagcatctcagaaaatggatggaggtggtggtaataacgcacaaaggggggcaacgtagtgatggtaacgagatgaagatatgcagcgccatcattaatctgtttcatttgattccagccgccccacaaaccctggtaaaaccattactcgaagtggttatgaaaaccgagagggccatgctcatcgaggcaggttcgcctttcagggagccactcattaagtttctgacaaggcacccatcacagaccgtggaactcttcatgatggaagccaccttaaacgacccacaatggtccagaatgtttatgagctttctgaagcataaggacgctcgtcctctgagagatgtgctggcggcgaaccctaaccgtttcattacgttgttactacccggcggggcgcagacagcggtgaggccggggagcccaagtacaagcaccatgcgattggacctgcagttccaggccatcaagattatcagtattatcgtcaagaacgatgattcctggctggccagccagcactcattggttagtcaactgaggcgcgtttgggtgagcgagaactttcaggaacggcaccggaaagagaatatggcagccacaaactggaaggaacccaagcttcttgcatactgtcttcttaattactgcaagcgaaattatggggacatcgagctgctttttcagctgctccgggcattcacggggcgatttctgtgcaacatgacctttctgaaggagtatatggaagaggagataccaaaaaattactctatcgcacagaaacgggcattgttttttcggtttgtcgattttaacgatccgaattttggcgatgagctgaaagccaaggtcttgcaacacattctcaatcctgccttcctgtacagttttgagaagggcgagggcgagcagctactgggacctccgaatccagagggagataatccagagtctatcacatcggtgtttatcaccaaagtcttggacccagaaaaacaagccgatatgcttgactctctgaggatttatcttctgcagtatgccaccctgcttgttgagcatgctcctcaccacattcacgataataacaaaaatcgcaacagtaagcttcgtcgcctcatgacctttgcttggccctgtttgctgagtaaagcgtgtgttgatcctgcgtgcaagtattctggccacctcttgttagcccacataatcgctaagtttgccatacacaagaagatcgtacttcaggtatttcacagtctgcttaaggcgcatgccatggaggcccgagcaattgtgagacaggccatggcgatccttacccccgccgtacccgccaggatggaggacggccatcagatgctgacgcactggactagaaagatcattgtagaagagggccacacagtgccacagcttgtgcacatcctccaccttatcgtccagcactttaaggtctattatcctgtgagacaccacctggtgcagcacatggtttccgcaatgcagcgtctcggtttcacccccagcgttaccatcgaacagcgcaggctggccgtggacttgtctgaagtagttataaaatgggagctccagcgcatcaaagaccagcagcctgattctgatatggatcccaactcttcgggggagggggttaatagcgtgagctcgagcatcaagaggggcctgagcgtcgactccgcccaagaagtaaagcgctttaggactgccaccggggcaatatctgccgtcttcggccggtcacagagcctgcccggagccgactcattgctcgctaagccaatcgacaaacagcacaccgacacggtagtgaacttcctcatacgagtcgcctgccaggttaatgacaacacaaacactgctggctcgcctggcgaagttctgagtcgcaggtgcgttaacttgctgaaaacagccctgcgacccgatatgtggcccaagtccgaacttaaacttcagtggttcgacaaattattgatgaccgtagaacagcctaaccaggtcaactatggaaatatttgtactggcctggaggtactgagttttctccttacagtgcttcagagtcccgccatcctcagctcattcaaaccgttgcagaggggtatcgccgcttgcatgacatgcggcaacactaaagtactaagagccgttcactcactgttgtcccgcttgatgtccatcttccctacggaaccaagtacaagcagtgtcgcctccaagtacgaggaactcgagtgtctctacgccgcggtgggcaaggtcatatacgagggccttacaaattacgagaaggcaaccaatgccaaccctagtcagctcttcggaacgctgatgattttaaagagcgcctgcagtaacaatccctcctacatcgaccgcctgatctctgtgtttatgcggagtctgcagaagatggtgcgcgaacatctcaaccctcaggcggcttccggctctactgaggccacatctggaaccagtgagttggttatgttgagcctcgagttggtgaaaaccagactcgccgtcatgtctatggagatgaggaagaattttattcaggcaatattgacttcactaatcgagaaaagtcccgatgcgaagattctccgcgctgttgtgaaaatcgtggaggagtgggttaagaacaacagtcctatggctgcaaaccagacacccacactccgcgagaaaagcattctgttggtcaagatgatgacctacatagagaaaaggtttccggaggacttggaactcaacgcccagttcctcgacctggtcaactacgtctatcgggatgagacactaagcggatcagaactaacagcaaaactggagcccgcatttctgagcggattacggtgcgcgcaacccctaatcagggctaagttctttgaagtcttcgataacagcatgaagcgaagagtgtacgaaagactgctttatgtgacctgctcacagaattgggaagcgatgggtaaccatttctggattaaacagtgtatagagcttctgctggccgtgtgtgaaaaatcgactcccatcggaactagttgccagggtgcaatgctgccctcaataacgaacgtgatcaaccttgctgatagccatgaccgtgcagctttcgccatggtcacacacgtgaagcaggaaccgcgtgagcgggagaatagtgaaagcaaagaggaggatgtggaaattgacatcgaattggctccaggggatcaaacatcaacccctaaaacaaaggagctgagcgaaaaagacatcggcaatcagttgcatatgctcactaataggcacgataagtttttggacactctacgcgaggtgaagacaggagccctcctgtcggcctttgtgcaactgtgccacatcagtacgactctcgcagagaaaacctgggtgcagctgtttccaagactttggaaaatcttgagcgatcggcagcagcacgcactggcaggggagatttcccccttcctttgttccggcagtcaccaagtccagcgcgactgtcagcctagtgctctgaactgcttcgtggaagctatgagccaatgcgttcccccaatccctatcaggccatgtgttctgaagtatttggggaagactcacaatttatggttccggagcactctgatgctagagcaccaggcgtttgagaaaggccttagcttgcagattaaacccaaacagacaacagagttttacgaacaggagtctatcaccccccctcagcaagaaattctcgattcactggctgaattgtattccctgctccaggaagaagatatgtgggctggtctctggcagaagcggtgtaagtattcagagactgcaacagcaatcgcatacgagcagcacggcttctttgaacaggctcaggaaagctatgaaaaggccatggacaaggctaagaaagagcacgagcgtagcaacgccagtcctgccatatttcctgagtatcagctctgggaggatcactggattaggtgctcaaaagagctaaatcagtgggaggcgcttacagaatacggacagtctaagggacacatcaacccttacttagtgctggaatgtgcttggcgtgtgtcaaattggacagccatgaaggaagccctggtgcaggtggaagtatcttgtcccaaggaaatggcgtggaaggtgaacatgtaccgggggtacctcgccatatgtcacccagaggagcaacagctctcattcattgagagactggtagaaatggcatcttctctagccattcgcgagtggagacgcctccctcacgtggtgtcccacgtgcatacacccctccttcaagccgcgcagcagatcatagaactacaggaggccgcccagatcaacgccggcctgcagcctactaatctcggaagaaataactctctccatgatatgaagacagtagtgaagacctggagaaatagactccctatcgtctccgacgacttgtctcactggtcgtctatattcatgtggagacagcaccattatcaggccatcgtcacggcctacgaaaattccagccagcatgacccgtccagtaataatgccatgttgggggttcatgcatctgcctctgctattattcagtatggtaagatagctcgcaagcaaggactggtcaacgtcgcgctcgacatcctgagtcgtattcacactattccgactgtgcctatcgtggactgtttccagaagattaggcaacaggtgaaatgctatctgcagctggccggcgtgatggggaagaatgaatgtatgcaggggctcgaggttatcgagtctaccaacctgaagtacttcacaaaggagatgactgctgagttttacgccttgaagggcatgtttctagctcagattaataagagtgaagaagccaataaggccttttctgcagccgtgcagatgcatgatgttctggtcaaggcttgggccatgtggggagattatctcgagaatatcttcgtaaaggaaagacagctgcacctgggggtgagcgccatcacctgctatctccacgcctgtcgacatcagaatgaatccaagagcagaaaatacctggccaaagtgctgtggctgctaagtttcgatgatgataagaacaccctggctgatgccgtcgacaagtactgcattggagtgcctcccatccagtggctggcctggatcccacagcttcttacatgcctggtcggtagcgaagggaaactgttactgaatctgatatcacaagtggggcgggtgtatcctcaagccgtgtactttccaattcgcactctgtacctgactctgaagatcgagcaacgggagagatataaaagcgatcccggacctatacgcgcaaccgcacccatgtggcgctgtagtcggatcatgcacatgcagcgggagttgcatcctaccctgctctcatccctggaggggatagtcgaccaaatggtttggtttcgtgaaaactggcacgaagaggtgctcagacagctgcagcagggtttggccaaatgttattcagtcgcatttgaaaagagtggtgcggtaagtgatgccaaaattaccccccacacgttaaacttcgttaagaaattggtgtcgactttcggagtggggctggaaaacgtgtctaacgtttctaccatgttttcttctgccgcttctgaatcactggctaggagagcacaggccaccgcccaggacccggtcttccagaagttgaagggacaatttacaacagacttcgacttttccgtgccaggctccatgaagctgcacaatttgatctcgaaactcaagaagtggattaagatcttagaagcaaagacaaaacaactccccaagtttttcctgatcgaagagaagtgtcgatttctgtctaacttttccgcgcagaccgccgaggtggagatccctggagagtttttgatgccgaaacccactcactattacataaaaatagctcgatttatgccccgcgtggagatagtccagaagcacaacactgccgcacggagactctacataaggggccacaatggcaaaatttatccatacttagtgatgaacgacgcctgtttaacagagtccaggagagaagaacgcgttctgcagctgttgcgacttttgaatccttgccttgaaaagcgcaaggaaacaactaagaggcatctcttcttcactgtcccgcgcgtggttgccgtgtcccctcagatgaggctggtagaagacaacccttcatccttgtctttagtagaaatatacaagcaacgctgtgccaaaaagggcattgagcacgacaatcctatttccaggtattatgaccggcttgcgaccgtgcaagcaaggggtactcaggcttcacatcaagtgcttcgcgacattctaaaagaagtgcagagcaatatggtgccccgaagcatgcttaaggagtgggccctccacacatttccaaacgcaaccgactattggactttccgcaaaatgttcacgattcaactggcgctgatcggtttcgctgagtttgtgttgcatctcaaccggctcaatcctgaaatgctgcagattgctcaggacactggtaaactgaatgtggcatactttagatttgacatcaatgatgcaacaggtgacctggacgccaacagacccgtgcctttcaggctgacgcccaacatttccgagttcttgaccaccatcggcgtgtctgggcccctgaccgcgagcatgattgctgttgcacgttgtttcgcacagcctaatttcaaggttgatggcattctgaagactgttcttcgagacgagattattgcctggcacaagaaaacccaggaggacacaagcagccccttgagcgcggcaggacagccagagaatatggacagtcagcagcttgttagcctggtgcaaaaggcagtcactgctatcatgacaagactccacaacctggcccagttcgaaggtggcgagagcaaggtcaatactcttgtagccgctgcaaacagtttagacaacctgtgtcgaatggatcctgcctggcacccctggttgtag

SEQ ID NO: 209091 - DNA, 11580 bp, Artificial Sequence
  Description of Artificial Sequence: Synthetic coding sequence
atggccttcgtggccacccagggcgccaccgtggtggaccagaccaccctgatgaaaaagtacctgcagttcgtggctgcgttgaccgacgtgaatactccagatgagacaaagttaaaaatgatgcaggaagtgagcgagaactttgaaaacgtcacctcctcaccccagtattccacgttcctggagcacattattccccggtttttgacttttctacaggacggagaagtgcaatttctgcaggaaaagcctgcccagcagctcagaaagctggtattagaaatcattcacaggatccccacaaatgaacacctcagaccgcataccaaaaatgtgctaagcgtaatgttccgtttcctggaaactgagaatgaagagaatgtgctaatctgcttgagaataataatcgaactccataagcagtttcgtcctcccatcactcaggaaatccatcactttctggacttcgtgaagcagatctataaagagctgcccaaagtcgtaaaccgttatttcgagaaccctcaggtgattcccgagaacactgtccctcccccggagatggtcgggatgattaccacaatcgccgttaaagtgaaccccgaacgggaggacagcgaaactaggacccattctattattccccgcggttccctatcattgaaggtcctggccgagctgccaatcatagtggttctgatgtatcaactgtacaagctgaacatccataacgtcgtcgctgaatttgtgcctctgattatgaacacgatagcaatacaggtatccgcgcaggccagacagcacaagctttacaacaaagaattgtacgcagactttattgccgcccagattaaaaccctgagtttcctcgcctacataatccgcatttaccaagagcttgttaccaagtatagccagcagatggttaagggcatgttacagttgctctcaaattgccccgctgaaactgcacatttacgcaaagagctgctgatcgccgctaaacacatcttgacaaccgaactcagaaaccagttcatcccatgtatggataaactcttcgatgagtctatcctgattgggtctggctatactgctcgggagacacttcgtcctcttgcctattctactctggccgacctggtgcatcacgtgaggcagcacttgcccctttccgacttgtcacttgcggttcaactgtttgccaaaaacatcgatgatgagtcgcttcccagtagcatacagacaatgtcatgcaagctcttactcaacctggttgattgtattcgctccaagagcgaacaagaatctggcaacgggagagatgtcctgatgagaatgctggaggtattcgtgctgaagttccacaccatcgctcgctaccaactatcagccatttttaaaaagtgcaagccccagtccgagctgggcgccgtggaggcggcacttccaggtgtgcctaccgcacctgctgccccgggacctgcccctagccccgctcctgtaccagccccaccccctccgccgccaccgccccctcccgctacaccagtgacacccgcccccgtacccccattcgagaagcagggcgaaaaggacaaagaggacaaacagacatttcaggttacagactgcaggtctcttgtaaagaccctggtgtgtggagtgaaaaccattacttggggcataacaagctgcaaggcccctggtgaggcccaatttatccctaataagcagttgcagccaaaggagactcagatctatatcaaattggtaaagtatgctatgcaggccctggatatataccaggtgcagattgccggaaatggccagacttatatccgagtcgccaattgccaaacggtgcgtatgaaggaagaaaaagaggtgctagaacactttgccggggtcttcaccatgatgaaccctctgactttcaaggaaatattccagactaccgtgccctacatggtcgagcggatcagcaagaactacgcattgcaaatcgtggcaaattcattcttagccaatccaactaccagcgccttgttcgcgacaatactggtcgaataccttctggacagactgcctgagatgggatcaaatgtggagctgtcaaacttgtatcttaaactgtttaagctagtgttcggatcagttagcctgtttgcagccgagaatgagcaaatgcttaagccacaccttcacaagatcgtaaactctagcatggaattggcccagactgcaaaggagccatacaattactttctgctgctccgcgctctgtttcggtctataggtggagggtcacacgaccttttataccaggagttccttccacttctccctaatcttcttcagggcttgaacatgctgcagagtggactgcacaagcaacacatgaaagacctgttcgtggagctgtgcttaacagtgcccgtgcggttgagtagcctgctgccttacctgcccatgctcatggatccactagtctcagcactgaacggatcccagacactggttagccagggcctgcgcactctcgaactgtgcgtagacaatctgcagcccgatttcctatatgatcatattcagccagtcagagccgagcttatgcaggccctgtggcggactctgagaaaccccgctgactctatctcacatgtagcataccgggtgttgggaaagtttggcggaagtaacaggaagatgctgaaggagtcccagaaactgcattacgtagtgactgaggtgcaaggcccttccatcacagtggagttctccgactgtaaagcctcccttcagttaccaatggaaaaagcaatagaaacagccttggattgcctaaaatcagccaacaccgaaccgtattaccgaaggcaggcgtgggaagtgattaagtgttttcttgtggccatgatgtccctcgaagataataaacacgccctgtatcagctactggctcatccgaatttcacggaaaagacaattcccaatgtgataatctctcatcggtacaaagcccaggacacccccgcgaggaagacatttgaacaggcccttaccggagctttcatgtccgcagtgatcaaggacctgaggccctctgcactgccattcgtcgcctccctgattcggcattacactatggtggccgttgcccagcagtgcgggccatttctcctgccatgttatcaggtggggtctcaaccctctactgctatgttccactctgaggagaacggctcaaaaggcatggacccgctggtgttgattgatgcgattgccatctgtatggcctacgaggaaaaggaactctgtaagatcggagaagttgcactggcggtcattttcgatgttgcctcgatcatcctcggcagcaaggagagagcatgtcagctgcctctgttcagttatattgtggagagactctgtgcttgttgctacgagcaggcatggtacgcgaagctcggcggagttgtgtctattaagttcctgatggagcggcttcccctaacttgggttctgcagaaccagcagacatttctgaaagctctgctgtttgtgatgatggatttgactggggaagtgagtaacggggccgtagccatggccaagacaacgctggagcagctgctcatgcgatgcgcaacacccttgaaagatgaggagcgggcggaagagatcgtggctgcccaggagaagtcttttcatcacgtcacgcacgacttggttagagaagtgacctcgcccaacagtactgtgcggaagcaggcgatgcattcactgcaggtgctggcccaggttaccggcaaaagtgtgaccgtcattatggagcctcataaggaggtgctgcaggacatggtgccccctaaaaaacacctgctgagacaccaaccagcaaatgcacagattggcttaatggagggaaacaccttttgtacgacactgcagccccgcctctttaccatggacttaaacgtggtggagcataaagtattctacactgagcttctaaacctttgcgaagccgaagatagcgcgttgactaaactgccatgctataagtccctgccaagcttagtgccattgaggattgccgccctgaatgccctcgcggcctgcaactatcttccccagtctagggaaaaaattatcgccgcactttttaaagctctcaatagtaccaattctgagttacaggaggcaggcgaggcttgtatgcggaagtttctggagggggccacgattgaggtcgaccagatacacactcacatgaggcctctgctaatgatgctgggggattatcggtcactgacattgaacgtcgtcaaccgattgactagcgtgacgcggctgtttcctaacagttttaacgacaaattctgcgaccaaatgatgcagcacctgaggaagtggatggaggtcgtcgtaatcacccacaaaggagggcagagaagtgatggcaatgaaagcatctcagaatgcggccgctgccccttgtctcctttttgccagtttgaggaaatgaaaatttgcagcgccatcatcaacctgtttcatctgatcccagccgccccccagactctagtgaagcctttgctggaggtcgttatgaagaccgagcgcgcgatgttgattgaggcagggagcccgtttagggagccactcataaagtttctgactcgccatccaagtcagactgtagaactcttcatgatggaggctactttgaacgaccctcagtggtctagaatgtttatgtcatttcttaagcataaagatgcaagaccactccgcgacgttctggccgccaatccaaacagattcatcaccctgctattgcctggtggagctcagacggcagtcagaccaggcagtccatcaacctcaactatgagattggacttgcagtttcaggccattaaaatcattagtattatcgtcaaaaatgatgacagctggctggcttctcaacattctttagtttcccagcttcgcagggtgtgggttagcgaaaactttcaggagaggcacagaaaagagaacatggcagctactaactggaaagaacccaaactgctggcttattgtttgttgaattactgcaagaggaattatggggatattgaacttctgtttcaactactgcgcgcctttaccgggcgattcctgtgcaacatgacgttcctcaaagagtacatggaagaagaaatcccgaaaaattattctatcgctcagaagcgggcgctcttcttccgattcgtagactttaatgatcccaatttcggagatgaactcaaggcgaaggtgctgcaacatattttaaaccctgccttcttatacagctttgagaagggagagggcgaacaactgctgggcccacctaaccccgaaggggacaaccctgagagcattacatccgtattcatcacaaaagtgctcgaccctgaaaagcaggctgatatgctggattccttgcgcatataccttctgcagtacgcaaccttactggtggagcacgctccccaccatatccacgacaacaacaagaatcgcaactccaaactgagacggctgatgacatttgcttggccatgtctgctgagcaaggcatgtgtggatcctgcatgcaagtacagcggtcatctgctcttagcacacatcatcgccaagtttgctatccataagaaaattgtcttgcaggtttttcattccctgctgaaagcgcacgcaatggaagccagagccattgttcggcaggctatggccatcctgacaccagccgtgccagcacggatggaggatggacaccagatgctgacacactggacacgtaaaatcattgtggaagagggacacacagtcccgcagctcgtccacatacttcatctgattgtgcaacattttaaagtgtactaccctgtcagacaccacttagtacagcacatggtgagtgctatgcagcgacttggcttcactccaagcgtcaccattgagcagcggcgcctagcggtcgacttatctgaggtggttattaagtgggagctacagcgcatcaaagatcagcagcctgactcagatatggatcccaattctagtggagagggggtgaactccgtttcatcaagcattaagcggggcctctcagttgacagcgctcaggaagtgaaaagatttagaactgcaactggcgcaatcagcgccgtctttggccggtcccaatccctgcccggggccgattcactcctggccaagcctatcgataagcaacacacagacacagtggtcaactttctaattcgggtggcttgccaagtgaatgacaataccaatacagcgggttctcccggagaagtgctgtccaggagatgcgtgaatttactgaaaaccgctctgcgtccggatatgtggcccaagtccgagctgaagttgcaatggttcgacaaactgcttatgacagtggagcagcccaaccaggtgaactatggtaatatatgtactggcctggaggtgctgagtttcttactgactgtgttgcagtcaccagcaattttgtcctcttttaagcctctgcaaaggggtatagccgcctgtatgacatgcggcaacactaaggtgcttcgtgcagtccacagtcttttgtcacgtcttatgtcgatctttccaactgagccctccacctctagtgttgcgagtaagtatgaggagctcgaatgtctctacgccgctgtcggcaaagttatctatgaagggctcactaactatgagaaagccactaacgccaacccgagccagttgttcggtaccctaatgatcctgaagagcgcctgcagcaataatccgagctacatagatagacttatctcggtgttcatgcggagcctgcagaagatggtaagggagcacctgaaccctcaggcggctagcggctcaacggaggccacatccggcacaagcgagctggtaatgctctccctggaattagtcaaaacaagacttgccgtcatgagtatggagatgagaaaaaacttcatccaggccatccttacctccctcattgagaagtctcccgatgccaaaatcctgcgggctgtcgtaaaaattgtggaggagtgggtaaaaaataattcccccatggccgccaatcagactccaaccctgcgcgaaaagagcatcctgcttgtgaagatgatgacctacatcgagaaacgctttccagaggatcttgaactgaacgcgcagtttcttgatcttgtaaactacgtgtacagggacgaaaccctgtccggatcagaactgacagcaaagcttgagcccgcctttttatcaggcctgaggtgcgcccaaccacttatcagagccaagttttttgaggtttttgacaattctatgaagcgccgggtctatgagcggttactgtacgtcacgtgcagtcagaactgggaggcgatgggcaatcatttttggattaagcagtgtatcgagctgcttctcgctgtttgtgaaaagtctacccccatcgggaccagttgtcaaggtgctatgctgccatcgatcacaaacgtaattaacctcgctgattcccatgaccgcgccgcatttgccatggttacacacgtgaagcaggaacctcgcgaaagagagaatagtgaaagtaaggaggaagatgtggagattgatatcgagcttgcgcccggtgatcagacttccacgccaaaaacgaaagagctctcagagaaggatattggaaaccagctgcacatgctgacaaaccggcacgataagttcctggacaccctcagggaggtcaagactggtgccctcttgagcgctttcgtgcaattatgccatatatcaaccaccctcgccgaaaagacttgggtacagctctttccaagactctggaagattctatcagaccggcagcagcacgctttggccggcgagatatcaccctttctgtgtagcggctcccaccaggttcagagggattgtcagcccagtgcactcaactgcttcgttgaggccatgagtcagtgtgtgccccccatcccgatcaggccctgcgtgctaaagtacttggggaagacccacaatttatggtttcgttccacattgatgctcgagcaccaggcatttgagaagggtctctcattacagattaagccgaagcagactaccgaattctatgaacaggagagtattactcccccacagcaagagatcctggactctctagctgaactatacagtctcctacaggaggaggacatgtgggctggtctgtggcagaagagatgcaaatactcagaaactgcaacagcaattgcttatgagcagcacggcttcttcgagcaggcccaggagtcgtatgaaaaggcgatggataaggccaagaaagagcatgagagatcaaacgctagccccgccatttttcccgagtaccagctttgggaggatcattggattcgatgttctaaggaactgaaccagtgggaggcattaacagagtatgggcagagcaagggccacattaatccctatttggtgctggagtgtgcttggagggtttccaattggaccgcaatgaaagaggcattagtccaggtggaggtttcctgccccaaagaaatggcatggaaggtgaatatgtaccgcggctatctcgccatatgccaccctgaagagcagcagctctcattcatcgagcggctcgtggaaatggcctcctcgttagccattagagagtggcgcagattgcctcacgtcgtgtctcacgtccacacaccgctgctgcaggccgcacaacagatcattgaactgcaagaagctgctcaaatcaacgctggtctccaacccacgaacttaggacgcaacaactcacttcacgacatgaagacagtggtcaaaacttggcgaaataggctaccaatagtttccgacgacctcagccattggtcttctattttcatgtggcgccaacaccactaccaaggcaagccaacttggtccggtatgcactcctcttccatagttacagcctacgagaatagttcccagcacgatcccagcagcaataacgctatgcttggagtccacgcttccgcgagtgcaatcatccagtacggcaagattgcccgtaaacaaggacttgtgaacgtggccctggatatcctctcacgcattcacacaatccccacagtacctatcgtagactgcttccaaaaaatccgtcagcaggtaaagtgctacctacagcttgctggagttatgggaaagaatgaatgtatgcagggtttagaggtgattgagtcaactaatcttaaatacttcacgaaagagatgaccgccgaattctatgcactgaaagggatgtttcttgctcagataaacaagagcgaggaggccaataaggctttcagcgctgccgtgcagatgcacgacgtgttggtgaaggcatgggcaatgtggggggactatctggaaaatatctttgtgaaagaacggcagctacacctgggggtctccgcgattacttgttatctgcacgcttgtaggcaccagaacgagtccaaatcgcgaaagtatctagccaaagtgttatggctcctttccttcgatgacgacaagaatacactggcagatgcagtggataaatactgtataggcgtgcctccaattcagtggctggcttggattccgcaattgctaacatgtctagtaggttccgaaggcaagcttctcctcaacctgatctctcaagttggacgggtttatcctcaagcggtttactttcccatcaggacgctctatctgacactcaaaattgagcagcgggaacgatacaaaagcgatccaggccccattagggctaccgcaccaatgtggaggtgttcgaggataatgcatatgcaacgagaactgcatcctactctcctgagcagcctagaaggcattgtggaccagatggtgtggtttcgggagaactggcacgaagaggtgctgaggcagttgcagcaggggctggctaaatgttatagtgttgctttcgaaaagtcaggcgctgtatcggatgcaaaaataactcctcatacattaaacttcgttaaaaagctagtgtctactttcggcgtgggactggaaaatgtcagcaacgtttcaacgatgttttcatccgcggctagcgagtctttggcacggagggcacaggctactgcccaggatcccgtgtttcagaaactgaaaggtcagttcactactgacttcgactttagcgtgcccggttcaatgaaactgcataacctgatctctaaactgaagaagtggatcaagatcttggaggccaagaccaagcagctcccaaagtttttcctcattgaagagaaatgcagattcctgagcaacttctcggcccagacagccgaggttgaaatccccggggaattcctgatgcccaaaccaacacactattacattaaaatcgcacgctttatgccacgagtggaaattgtgcagaagcataataccgcagcacggcgtctgtacatacgaggacacaacggcaaaatctacccctatttggtgatgaacgatgcttgcctgactgagtctagaagggaggaaagagtcctgcagttattgcgccttttaaatccatgcttagagaaacgtaaggagacaacaaagaggcaccttttttttactgtacccagggtcgtggccgtcagtccccagatgcggttggtggaggataatccttccagtctaagcctggtggagatctacaaacagcggtgcgcgaagaaaggcatcgaacacgacaaccccatttcaaggtactacgacagactcgcaacagtgcaggcccgtggtacacaggcaagccatcaagtgttgcgggatattctaaaggaggtgcaaagtaacatggtgcctcgctccatgctgaaggagtgggccctccacacctttcccaatgccactgactactggacgtttagaaagatgtttacaattcagctggcactgatagggtttgcagagtttgtgctgcaccttaatcgcctcaaccctgaaatgttacaaattgctcaggacactggcaagctgaacgtggcttactttagatttgatatcaacgatgccacaggggatttagatgcaaaccgtcctgtgccgttccgcctgaccccaaacattagcgaattcctgacgactattggtgtgtcaggccctctgactgcaagtatgatagccgttgcgaggtgcttcgcacaacccaactttaaggtggatggcatccttaaaacagttcttcgggatgaaatcatcgcctggcataagaagactcaagaagacacctcctcacccctgtctgccgccggccagcccgaaaatatggattctcagcagttagtgtcactcgtacagaaggccgtgacagccattatgactaggttgcacaacttggcccagttcgagggcggcgaatctaaagtcaacactcttgtagctgctgccaacagcctggacaatctgtgtcggatggaccccgcatggcacccttggctgtag

SEQ ID NO: 209092 - DNA, 216 bp, Artificial Sequence
  Description of Artificial Sequence: Synthetic coding sequence
atggccttcgtggccacccagggcgccaccgtggtggaccagaccacccttatgaagaagtatctccaatttgtggcagctctgaccgacgttaacacccctgacgaaacaaagctgaaaatgatgcaggaggtgagtgaaaactttgaaaacgttacaagttctccacaatactcaaccttcctggagcatatcatccctcggtttttgacctag

SEQ ID NO: 209093 - DNA, 117 bp, Artificial Sequence
  Description of Artificial Sequence: Synthetic coding sequence
atgagcgacagcggcgagcagaactacggcgagcgggtgaacgtggaggaagggaagtgtggcagtcgacacctgaccagcttcattaatgagtacttgaagctgcgcaacaaatag

SEQ ID NO: 209094 - DNA, 567 bp, Artificial Sequence
  Description of Artificial Sequence: Synthetic coding sequence
atgagcacccggcggcggcacgtgggcaaccgggccaaccccgaccctaactgttgcttgggggtgtttggactctctttgtacacgacagaaagagacctgagggaagtgtttagtaaatacgggcccatcgctgacgtgtctattgtatacgaccagcaatcccgtagatcccgaggctttgcgtttgtctattttgaaaatgtggacgatgctaaagaggcaaaagagcgggctaatggcatggaactggacggacgacgaattagggtagattttagtatcaccaagaggccccacacaccaacacccggaatctacatggggcgtcctacctatgggtcctctcgtcggagggattattacgaccgggggtatgatcggggatacgacgaccgcgattactatagtcgctcctatcgcggcggtggaggcggaggcggaggctggcgcgcggcacaggaccgggatcagatctatcggagaagaagcccttccccatactattcaagaggtggctacagaagccggtcgagatcccggtcttacagccctcggcggtactag

SEQ ID NO: 209095 - DNA, 867 bp, Artificial Sequence
  Description of Artificial Sequence: Synthetic coding sequence
atgagcgacagcggcgagcagaactacggcgagcgggagagccggtccgctagtaggtcaggctctgcacacggctccggaaaatcggcccgccacactccagcgagaagccgctcgaaggaagattcccgtaggtcccgctccaagtctcgcagccgctctgagtctcgctctcgtagtcggaggtccagccgtcgtcattataccagaagcagatcacggagcaggagccacagaagatccaggtcccgttcctattcacgtgattaccgccgcaggcactcgcatagccacagtcctatgtcaaccaggcgcagacatgtggggaatagagccaatccagaccccaactgctgccttggcgtgtttggtctatcactctacactaccgaaagagatcttcgggaagtattttccaaatatgggcctattgccgatgtgtccattgtgtatgatcagcagtcgcgacggtccagaggattcgcttttgtctacttcgagaacgtggatgacgcaaaagaggctaaagagagagctaacgggatggaactagatgggaggcgaattcgcgtcgattttagcatcactaagagaccacatactcctacacccggcatctatatgggcaggcctacttacggctcaagtaggagaagggactactatgacaggggatatgatcgaggctacgacgaccgggattattactccaggtcctatcgaggagggggaggtggtggaggcggctggcgggccgcacaggacagggatcaaatctataggaggaggtctccctctccatactattccagaggagggtaccggagccggtcccgctcaagaagctactcaccacgcagatattag

SEQ ID NO: 209096 - DNA, 483 bp, Artificial Sequence
  Description of Artificial Sequence: Synthetic coding sequence
atggtgcccagcgccggccagctggccctgttcgccctgggcatcgtgctagcggcttgtcaagcactggagaatagtacgtccccactgtcagccgaccccccagttgccgcggcggtggtgtcacatttcaatgattgccctgactcccatacacagttctgtttccacggtacgtgcaggttcctcgtacaggaagataaacccgcgtgtgtatgccactccggatacgtgggcgcccggtgtgagcacgccgatcttctcgcggtcgtggctgcaagccagaagaagcaggctatcacggcattggttgtcgtgtctatcgtcgccctggcagtactgataatcacctgcgtgctgatccactgttgccaagtgaggaaacattgtgaatggtgccgcgcactcatctgcagacacgagaaaccctcagcactgctaaaaggacgaactgcgtgttgtcactccgagacagtggtttag

SEQ ID NO: 209097 - DNA, 480 bp, Artificial Sequence
  Description of Artificial Sequence: Synthetic coding sequence
atggtgcccagcgccggccagctggccctgttcgccctgggcatcgttctggccgcctgccaggccctggagaactcaacctcccccctgtcagatccccctgttgcagcggccgtagtctctcactttaacgactgtcctgatagtcatactcagttctgcttccacggtacttgccgctttctggtacaggaggataagcctgcctgcgtttgtcactcaggatacgtgggggctcgctgcgaacacgccgacttactggccgtcgtggctgcgagccaaaagaagcaggcaattactgcactggtagtcgtttcaatcgttgcgctcgctgtgttaatcattacatgtgtgctgattcactgctgtcaggtgcgaaagcactgtgaatggtgcagagccctgatatgtcgccatgagaagccctccgcactgcttaaagggagaaccgcctgttgtcacagtgagaccgtggtgtag

SEQ ID NO: 209098 - DNA, 2583 bp, Artificial Sequence
  Description of Artificial Sequence: Synthetic coding sequence
atgatgagcatcaaggccttcaccctggtgagcgccgtggagcgggagcttttgatgggagataaagagcgggtgaatatcgaatgtgtagaatgctgcggcagggacctgtacgtgggtaccaatgactgctttgtataccacttcttgctggaagaaagacccgtgcctgccggcccggctactttcactgccaccaagcagctgcagagacacctgggcttcaaaaagcccgtaaacgaactgcgcgccgcaagcgcactgaatagactcctggtcctgtgtgacaattctattagtcttgttaatatgctgaaccttgaaccagtgcccagcggagcgcggatcaagggagcggcaacattcgctcttaacgaaaatcctgtgtcaggggatcccttctgcgtagaagtctgtattatcagcgtgaagcggcgtaccatccagatgttcctggtgtatgaggatagggtacagattgttaaggaagtgtccacagccgagcagccactggccgttgctgtggatggccacttcctctgtctcgctctgacgacccagtatattatccacaattactctacaggcgtcagccaggatctgttcccctactgctcagaggaacggccccctatcgttaagcggatcgggagacaggagtttctactcgccgggcccggtggtctaggaatgttcgctacagtggccggtatcagccaacgagcccctgttcattggagtgaaaacgtcattggcgctgcagtctcttttccgtacgtgatcgccctggacgatgaattcatcaccgtgcactccatgctcgaccagcagcagaagcagaccctgccatttaaggagggccatatcctccaagatttcgaagggcgcgtcatcgttgcgacttccaaaggggtgtacatcctggtccccctgcccttagagaagcagattcaggacctcctggcatctagaagggtagaggaagcactggtattagccaaaggcgccagaaggaacataccaaaggaaaagttccaggtgatgtaccgcagaattcttcagcaggccggtttcatccagttcgcccagctgcaatttttggaagctaaggagctgtttcgctctgggcagcttgacgtgagagaattgatttccctgtatcccttcctccttcccacatcctcaagcttcaccagatcccaccccccactccacgagtacgccgaccttaaccagctcactcagggtgatcaggagaaaatggcaaagtgtaaacgtttcctgatgtcttatctcaacgaagtgaggagcacagaagtcgccaacgggtacaaagaggatattgatacagccctgctgaaattatacgcagaagctgaccacgactcacttctggatctgttggttaccgaaaacttctgcctcctgactgactctgcagcatggttggaaaaacataaaaagtattttgccctgggactgttgtatcactataacaaccaggatgcagccgcagtgcagttatgggtcaatatcgtaaatggagatgttcaggatagcacccgttctgatctttacgagtatatcgtggacttcctcacgtactgcctggatgaagaactagtttgggcatacgctgattgggtgcttcagaaatcggaggaggttggcgtgcaggtcttcacaaaacgtccactggacgaacagcagaaaaatagttttaacccagatgatatcatcaattgtctgaagaagtatccaaaggcacttgtcaaatacctggagcacctggtcatcgataagcggctgcagaaagaggagtaccacacccacttagcggtactgtatctggaagaagtactcctacaacgggccagcgcctccggcaagggggcagaagcaacggagacccaggccaagctgcgaaggctcctccagaagagcgatctctaccgagttcattttctcctggagcgcctgcaaggagcagggctcccaatggaaagcgccattctccatgggaagctcggggaacatgagaaggccctgcacatccttgtgcatgagttacaggatttcgctgccgcggaggattattgcctgtggtgttcagaggggagagaccccccgcatcgccagcagctgttccataccctcctggcaatttatctgcacgcagggcccaccgcgcatgaattggctgtcgccgccgtggatttgcttaaccggcacgcaaccgagttcgacgctgcgcaggtgttgcagatgcttcccgatacgtggagcgtgcagctcttgtgcccctttctgatgggagccatgcgcgattccattcatgctcgcaggacaatgcaggtggctttgggcctggcacgctcggaaaacctgatatacacatatgacaaaatgaagctgaagggctcctctatccaactgagcgacaagaagttatgtcagatctgtcagaatcccttctgtgagccagtattcgttcgctaccccaatggcgggttagtacacacgcactgtgctgcttcgagacacaccaaccctagtagctcctctcctggaacacgcacatag

SEQ ID NO: 209099 - DNA, 2583 bp, Artificial Sequence
  Description of Artificial Sequence: Synthetic coding sequence
atgatgagcatcaaggccttcaccctggtgagcgccgtggagcgggagcttctgatgggcgacaaggagagagtcaatatagaatgcgtggaatgctgtggacgggatctctacgtggggactaacgactgcttcgtgtaccattttttgctcgaggaacgtcccgtgcccgctggcccagctacattcaccgcgacgaagcagctccaacgacaccttggatttaagaaacctgtgaacgagcttagggcagcgtctgccctaaatcgactcctcgtcctctgcgataattccatttcgttggtgaatatgcttaatttagagcccgtcccatccggcgcccgtattaaaggggccgccacattcgccctcaacgagaatcctgtctccggagatcccttctgcgtggaggtatgtataatctctgtgaagcgaaggacaatccaaatgtttctcgtgtatgaggatcgagtgcaaatcgtgaaggaggtttctactgccgagcaacctctggctgtcgccgtcgatggacactttctgtgtcttgcactcacaactcagtatattatccataactactcaaccggtgtcagtcaagacttgttcccgtactgctctgaggagcggcccccaatagtgaaaagaattggccgacaggagttcttactcgctggtcccgggggattaggcatgttcgctaccgtggccggaataagccagagggcgcccgtgcactggagtgagaacgtaattggcgctgcggtgtcctttccctacgtcattgcacttgacgatgaattcatcaccgtgcactccatgctggatcaacagcagaaacagaccttgccctttaaggagggacacatcctgcaggatttcgagggcagagtaatagtggccaccagcaagggggtctatattctcgtgcctctgccgctggagaagcagatccaggatctactggcatcccgcagggtggaggaggctctggtgttggctaagggggcaaggagaaacattcccaaagagaagtttcaagttatgtacaggagaatcctgcagcaggcaggattcatacagttcgcgcaactgcagtttctggaggccaaggaactgttcagatcaggacagctggacgtgcgggagctcatcagtctgtatccgtttctgttaccaaccagttcctccttcacccgctcccaccctccattgcacgagtacgctgacctgaatcaactgacgcagggagaccaggagaaaatggcgaagtgtaaaaggtttctgatgtcctacctcaatgaggtgaggtccacggaggttgcgaatggctataaggaagacattgacaccgccctgctcaaactgtatgcggaggccgaccacgattcactgttggacctcctggtgacggagaacttctgcctcctaacagactcagcagcttggctggagaagcacaagaaatattttgcccttgggctcctctatcactacaataaccaggatgctgcagccgttcagctctgggtgaacatcgtgaatggagacgtgcaggattctacacggagcgatctgtacgaatatatagttgacttcttgacctactgtcttgacgaggaactggtgtgggcatatgcggattgggtccttcagaaaagcgaggaggtaggtgtgcaggtgttcaccaagagaccactcgacgagcaacaaaagaactcttttaatccagacgacattatcaattgtttgaaaaaatatcctaaagcactcgtgaaatatctggagcatctagtgatcgacaaaagattgcagaaagaggagtaccatactcatctcgccgtgttatatctggaagaagtgctgctgcaacgtgcctccgctagtggaaagggggccgaggccacggagacacaggccaaactgaggcggctgctccagaaatccgacctataccgggtccacttccttttggaaaggttacagggggctggcctgccaatggagtccgcaatcttgcacggaaagcttggcgaacacgaaaaggccttacacatattggttcacgaactccaggacttcgcagccgctgaggactattgcttatggtgtagtgaggggcgtgatccaccccaccggcagcaattgttccacaccctactcgccatctacctgcatgcaggacctacggcccacgagttagcagtggccgctgtggatctcttgaacagacacgctacagagttcgatgcagctcaggtcctacagatgctgcctgacacatggtccgtccaactcctgtgccccttcctgatgggtgcgatgcgggattccattcatgccaggcgtactatgcaagtggcattgggcctggcacggtccgagaatctgatctacacttatgataaaatgaagctcaaaggatcatccatacagctgtccgacaaaaaattgtgtcaaatctgccagaaccctttttgcgaaccggtcttcgtaaggtaccctaacggcggcctagtgcacacacactgcgccgcgtccagacacacgaacccctcatcttcaagcccaggaacccgaacctag

SEQ ID NO: 209100 - DNA, 948 bp, Artificial Sequence
  Description of Artificial Sequence: Synthetic coding sequence
atgctgatcggcagctgccggaaggtgaagcggagcgtgcaggtgtttactaaaagaccactggatgaacaacagaagaactccttcaatcctgacgacatcatcaattgcctgaaaaagtatcccaaggccctggtgaaatatcttgagcacttggtgattgacaagcgactgcagaaagaagagtaccacactcacctggctgttctgtacttagaagaggtcctgttgcagcgcgcctcagcatccggaaagggggccgaagcaaccgagactcaggcaaagctcagacgcctcctgcagaagtcagatctgtatagggtacacttcctgctggagcgcctgcaaggcgcggggctacctatggagtcggcgattctccacggcaaattgggagagcatgagaaggctttacacatcctggtccacgagctccaggactttgctgccgcggaagactactgtttgtggtgttccgaggggcgcgaccctccacatcgccagcagctgtttcataccctgctcgcgatatacctccacgccggtcctactgctcacgaattggctgtggccgccgtcgatctcttgaatagacacgccacggagtttgatgcggctcaggtgctccagatgcttccagatacttggtcagttcagttgctgtgccccttcttgatgggggccatgagagactcgattcatgctaggagaacaatgcaggttgccttgggtcttgctaggtccgagaatctcatatatacgtatgacaagatgaaactcaaaggatcatctattcagctttctgacaagaaactttgccagatatgtcaaaatccattttgtgagcccgtgtttgtgcgctatcccaacggcggtctagtgcatactcactgcgctgcgtctaggcacaccaacccctctagctcatccccgggaaccagaacatag

SEQ ID NO: 209101 - DNA, 1704 bp, Artificial Sequence
  Description of Artificial Sequence: Synthetic coding sequence
atgggccggggcctgctgcggggcctgtggcccctgcacatcgtgttgtggactaggatcgcttcaacaattcctccccatgtacagaagtccgtcaataacgatatgatagtgaccgataataacggagctgttaaatttccgcagctctgcaagttttgtgacgtgcgtttttccacttgcgacaatcaaaaatcttgcatgtcaaattgcagtattaccagtatttgtgaaaaaccacaggaggtgtgcgtagccgtctggcgaaaaaacgacgaaaacattacccttgaaaccgtgtgccacgacccaaagctaccataccacgacttcattctggaagacgccgcttcacctaaatgcataatgaaagagaagaaaaagcccggtgagacctttttcatgtgcagctgctctagcgacgagtgtaacgataatataatatttagcgaggaatataatacgagcaatccagacttgctgctggttatctttcaagtcactggaatctctctgttgccacctctcggggtggctattagcgtgatcattattttttattgctatcgggttaatcggcaacagaaactctcctccacttgggaaacgggcaagactcgtaagttgatggaattcagtgagcactgtgccatcattctggaggatgatcggagtgacatttcttcaacctgcgccaacaacatcaatcacaacacagagttgcttcctatagagctggacacacttgttggcaaaggacggttcgctgaggtgtacaaagctaaactgaaacagaacaccagtgagcaattcgagactgtggccgtaaaaatttttccatacgaggaatacgcctcatggaaaactgaaaaggacatcttttctgacatcaatctgaaacacgagaatattttgcagttcttgacggcagaagagcgaaagaccgaattggggaagcaatactggttgattactgcctttcacgccaaagggaatctgcaagaatacctgactcgacacgtcatcagctgggaagacctccgcaagctcggatcatcactggccagaggaattgcacatcttcacagtgatcatacaccttgcgggaggcccaagatgcccatcgtgcacagggatctgaagagttccaacatcctcgttaaaaatgatcttacttgttgtctgtgtgattttggactctctctgcggcttgatcccactctcagcgtcgacgatcttgccaactccggccaggtcggcactgcaaggtacatggcacctgaggttctggagagcagaatgaatctagaaaacgttgaatcgttcaaacaaaccgacgtgtattccatggccttagttctatgggagatgacttctagatgcaatgccgtcggagaagtgaaggattatgaacctccatttggcagcaaagtccgagaacacccctgtgtagagtctatgaaggataatgtcctgcgcgatcgcggacggccagaaatcccatctttctggctgaaccaccagggaatccagatggtctgtgagacactgaccgagtgttgggatcatgacccagaagcccgcttgaccgcccagtgtgttgccgagcggttcagcgagctagagcacctggaccgcctcagtggtcgaagctgtagcgaggagaaaatacctgaggatggcagcttgaataccactaagtag

SEQ ID NO: 209102 - DNA, 1779 bp, Artificial Sequence
  Description of Artificial Sequence: Synthetic coding sequence
atgggccggggcctgctgcggggcctgtggcccctgcacatcgtgctgtggacccgaatcgcaagcacaatcccacctcacgtacagaaaagtgacgttgagatggaagcacagaaggatgagatcatttgccctagctgtaataggacagcacacccactcaggcatataaacaatgacatgatcgtgacggataacaatggcgcagtgaagtttccccagctgtgcaagttctgtgatgtacgattctctacctgtgataatcaaaagagttgcatgtctaattgcagtattaccagtatctgcgaaaagccccaggaagtgtgtgtcgccgtatggaggaagaacgacgagaatatcactcttgagaccgtgtgccacgaccccaaactgccttatcacgactttattttggaagacgccgcaagccccaagtgtattatgaaggagaaaaagaagccaggagagacatttttcatgtgcagctgttcatcagatgaatgcaacgacaacatcatatttagtgaggagtacaacacaagtaatccagatctcttgctggtgatctttcaagtcacaggcatcagtctccttcctccactgggcgtggccatcagcgttattattattttttattgttatagggttaatagacaacaaaagctctcatccacttgggaaacaggcaagacgcggaaactaatggagttcagcgagcactgtgcgatcattcttgaggatgaccgatctgatatttccagcacatgcgccaataatatcaatcataatactgaattgttaccgatcgagctcgatacactcgttggcaaggggcggtttgccgaagtttacaaggccaaactgaagcagaacaccagtgaacagttcgaaaccgtagccgtaaagatattcccttacgaggaatacgcctcctggaagactgaaaaggatatcttttcagacattaacctgaagcacgaaaatattctacagtttctgaccgccgaggaacggaagactgaattgggcaaacagtattggctgattaccgcttttcacgcaaaaggcaatttacaggaatatttaacacgccacgtgatctcgtgggaggatctgcgcaaactgggatcatctctcgcccgcggcatcgctcaccttcattccgatcatacgccatgtggaaggcccaaaatgcccatcgtgcacagagatctcaagtcttctaatattttggtcaaaaatgacctgacctgctgcctctgtgattttggcctatccctgcggctggacccaaccctttctgtcgatgaccttgccaatagcggacaggtcggaaccgctcgctacatggcacctgaggtgctggagtcacgcatgaacctggaaaacgtcgagtcgtttaaacaaacagatgtgtatagcatggccctagtgctgtgggagatgaccagtcgctgcaacgccgtgggcgaagtgaaagactatgaaccaccattcgggtctaaagtgcgggaacatccttgtgtggagagtatgaaagataacgtacttagagatcgtggccgacctgaaattccttccttctggctgaaccatcagggcattcaaatggtttgcgaaactctcacagaatgctgggaccatgaccccgaagccaggctgaccgcccagtgtgtagcggagaggttctctgaactggaacatctggaccggctctcggggcgctcttgctcagaagagaagatacctgaggatggctcactcaacacgacaaagtag

SEQ ID NO: 209103 - DNA, 339 bp, Artificial Sequence
  Description of Artificial Sequence: Synthetic coding sequence
atgtgcagctgcagcagcgacgagtgcaacgacaacatcatcttctccgagggcagatgtaagattagacatataggaagcaacaatcggctgcaacggagtacctgccagaacaccggatgggagtccgcgcatgttatgaagaccccaggatttagagagtacaacacttccaaccccgacttgctcttagtcatctttcaggtgaccgggatcagtctccttccccctctgggagtggcaatctcagttattatcatattttattgctaccgtgtcaacagacagcaaaaactctcttcgacctgggaaacagggaagactcgcaaactgatgtag

SEQ ID NO: 209104 - DNA, 1194 bp, Artificial Sequence
  Description of Artificial Sequence: Synthetic coding sequence
atgtgcagctgcagcagcgacgagtgcaacgacaacatcatcttctctgaagaatataatacgtctaacccagatctgttgctggtgatattccaggtgaccgggatcagcctgctgccccccctcggggtggcaatatccgttattatcatcttctactgttaccgagtgaatcgccaacaaaagttgtcctcaacctgggaaacagggaaaacaagaaaactcatggaattttcagagcactgtgccattatccttgaggacgacagatccgatatctcctcaacttgcgccaacaatatcaaccacaacacagagcttttacctattgagctggatactcttgtgggtaaagggcggttcgctgaagtatataaagctaagctgaagcatgagaacattctccagtttcttaccgccgaagagcgcaagacagaactcgggaagcagtactggcttatcacagctttccacgcaaaaggaaacctgcaagagtatttgacccggcacgtgatttcgtgggaagacctgagaaagcttggtagttcgcttgcccggggcattgcacacttacactcggatcataccccctgtgggagaccaaaaatgccaatcgtgcatcgggacttgaaatccagtaacatattggtgaaaaatgacctcacctgttgcttatgcgatttcggcctctcacttaggctcgacccgacactgtccgtggatgatcttgctaacagtggacaagttggtaccgcgagatacatggcaccagaggtgctggagagcagaatgaacttggagaatgtggagtcctttaaacagactgacgtgtatagcatggcgctcgtcctttgggaaatgacttcgcgctgcaatgccgtgggggaggtgaaagactatgagcccccgttcggtagcaaggtgagagagcacccctgcgtggaaagcatgaaagataatgtcctcagagacagaggcaggcccgagattccaagtttttggctgaaccatcagggaatccagatggtctgcgaaacgctcacggagtgctgggaccacgatcccgaagcccggctgaccgcccagtgcgtagctgagagatttagcgaattggaacacctcgataggctgtccggacgtagctgttctgaagaaaaaataccggaagacgggagcctgaataccactaaatag

SEQ ID NO: 209105 - DNA, 2244 bp, Artificial Sequence
  Description of Artificial Sequence: Synthetic coding sequence
atggccgacgaggccgccctggccctgcagcccggcggcagcccctctgccgccggagctgatcgcgaggctgcaagcagcccagctggggagcctctcaggaagcgcccccggcgagacggaccaggactggaaaggtccccaggggagcccggaggcgcggcgccagagcgggaggttcccgctgcagcacgaggatgtcctggcgcggcggctgccgcactatggagagaagccgaggccgaagccgccgcagccggcggagagcaggaggcccaggcgaccgcagccgccggcgaaggagacaacggaccgggcttacagggccccagcagggagccgccactggctgataacctgtatgatgaggacgacgatgacgagggcgaagaggaggaggaggcagcagccgccgccataggctaccgggataacctgctcttcggggacgagataattacaaacggctttcattcctgcgaatccgacgaagaggatcgggcatcacacgcttcatcatcagactggaccccccgaccgaggatcggtccatataccttcgtccagcagcacctcatgattggcactgacccaaggaccattttgaaggatctccttccagaaacgatccctcccccagagctcgacgatatgacgctttggcagatagtgataaacatattgtctgaacccccgaagagaaagaaaagaaaggatatcaataccattgaggatgcggtgaagcttcttcaggaatgcaagaaaatcatcgtcctcaccggggcaggagtatcagtttcatgtgggatccccgatttccggtctcgtgatggcatttacgccagactagccgttgacttccctgacctccccgacccccaagcgatgtttgatattgaatattttcgtaaagaccccaggcccttttttaagttcgcaaaagaaatctaccctggacagtttcaaccaagtctgtgtcacaaatttatcgccctgtccgataaagagggaaagttgctaagaaactacacgcaaaacatagatactctggaacaggtggccggcattcaacgcattatacagtgccatggtagtttcgctacagccagttgtctgatatgcaaatataaagtcgattgcgaggccgtccggggcgatatattcaaccaagtggtgcctcggtgtcctagatgccccgccgacgaacctcttgcaatcatgaagcccgagattgtgttcttcggggagaatctgccagagcagttccatcgggccatgaagtacgataaggatgaagtggatttgctgatagtaatcggaagttcactcaaggtgcgaccggtggctctcatcccgagctctattccgcatgaggttccacaaatcctgattaacagagagccgctgccacatctccactttgatgttgaacttcttggtgattgcgacgtgataatcaatgaactctgccacagactcgggggggaatacgccaaactgtgctgtaaccccgtgaagttgtcagagatcacagaaaaacccccacgcacacagaaagaactggcatacctgagtgagcttcctccaacacctctgcacgtaagtgaagattcatcttcccccgaaaggacgtcgccccctgactcttcagtgattgttacgctgctggatcaagctgcaaagagtaacgatgacttagacgtcagtgaatccaagggatgtatggaagagaagcctcaggaggttcagacatcacgcaatgtcgagagtatagctgagcagatggaaaacccggacttaaagaacgtcgggagctccaccggagagaagaatgagaggacctctgtcgctggaacggtccgtaagtgttggccaaaccgcgtggcaaaggaacagattagccggcggctggacggcaaccaatatctgttcctcccccccaacaggtacatctttcatggcgccgaggtgtatagtgattcagaagacgatgttctctccagctccagctgcggatcaaacagtgacagcggcacttgtcagagtccaagcctagaggagcccatggaggatgagtcagaaatcgaggagttttataacggccttgaagatgaacccgatgtacctgagagggcaggtggtgctggcttcgggaccgacggtgacgatcaagaggccatcaatgaggccattagtgtgaagcaggaggttaccgatatgaattatccatccaacaagtcttag

SEQ ID NO: 209106 - DNA, 2553 bp, Artificial Sequence
  Description of Artificial Sequence: Synthetic coding sequence
atgaccagccactacgtgatcgccatcttcgccctgatgagcagctgtctggccacagcaggacccgagcccggagctctgtgtgagctatcgcccgtgtccgcgtcccacccagtgcaggccctgatggaaagctttaccgtcctgtccgggtgcgccagcaggggcacgaccggattaccccaagaagtacacgtgctgaatttgcggaccgctggacagggaccgggccagctccagcgcgaggtaaccctgcacctcaatccgatatcctcagtacatatccaccataaatccgtagtgtttctcttaaattctccccaccccctggtgtggcatctgaagaccgaacggttagctactggggtgtctcgcctgttccttgtctccgaagggagtgtggtccaattttcttccgctaatttctcgttaaccgctgaaaccgaggagcgcaactttccccacgggaatgagcacttactcaactgggctcggaaggaatacggcgccgtaacttcctttaccgaactcaagatcgcccgaaacatatacatcaaggtcggcgaggaccaggtgttccctccgaaatgtaacatcggcaaaaatttcctgtcacttaattacctggccgaatatctccaaccaaaggccgccgaagggtgcgtcatgtcttcacagcctcagaatgaggaagtgcatatcattgaattaataacccctaactcaaacccttattctgccttccaggtcgatattacaatcgacataagaccaagccaggaggatctagaggtagtaaagaaccttatcttgatcctgaaatgtaagaaaagtgtaaattgggtgatcaaatccttcgatgtcaagggttctctgaagataatcgcgccaaacagcatagggtttggtaaggaaagcgaacgtagcatgaccatgaccaaatccatcagggacgacatcccaagcacccagggtaacttggtcaagtgggctctggataatggctacagcccaatcacgtcctatactatggcccctgtggcaaatagattccacctgcggctcgaaaacaacgaggaaatgggcgacgaggaggtgcatactatcccccctgagctgcgcatcttactcgaccccggggccctccctgcgctgcagaatccgcctattagggggggggaaggacagaacggcgggttaccatttcctttccccgacatatcacgcagagtctggaatgaagagggtgaagacggactccccaggccaaaggaccctgtgattccctctatacagctctttcctggtctgagagagcctgaagaggtgcagggaagtgtcgatatcgcgctgagcgtgaaatgcgataacgagaaaatgatagtcgcagtggaaaaggactcctttcaagcatctggatattcaggcatggacgtaacgctgctggaccccacgtgtaaagccaaaatgaacgggacccacttcgtactcgaatcaccactcaatggctgcggcacccgaccccgctggtcggcattggacggtgtcgtctattataactccatcgtcattcaggtcccggctctgggtgattcctccggttggcccgacggatacgaagatttggaaagtggagacaacggattccctggtgacatggatgaaggagatgctagcctgttcaccaggccagagattgtcgtttttaattgttccctgcagcaggtgcgcaatcccagctcctttcaggagcagcctcatgggaacatcacttttaacatggagctctacaatacagatctgttcttagtaccaagtcagggagtgtttagcgtgccggagaatggccacgtctacgtcgaggtatcggtcaccaaggcagagcaagagctgggtttcgccatccagacctgttttattagcccttacagcaatcctgatcggatgtctcactatacaattatcgagaatatttgccccaaggacgagagcgttaagttctactctcctaagcgagtacacttccctatcccccaggcagatatggataagaagagattctctttcgtgttcaaacctgtcttcaacactagtctccttttcctgcaatgcgaactgactttgtgcaccaaaatggagaagcatccacagaaactcccgaagtgcgtgcctcccgatgaagcctgcaccagccttgacgccagtattatctgggcaatgatgcagaataagaagaccttcaccaagccgctggccgttattcatcacgaggcggagtcgaaagagaagggtcccagtatgaaagaacctaatccgatcagtccacccattttccacggccttgacaccctcacggttatgggaattgcctttgccgcattcgttatcggcgccctgttaacaggggccctgtggtacatctactctcatactggcgaaaccgctggccgtcagcaggtgcccaccagccccccagcctctgagaattccagtgcagctcacagtatcggcagtacacagagcactccgtgctcgagctcatccaccgcatag

SEQ ID NO: 209107 - DNA, 108 bp, Artificial Sequence
  Description of Artificial Sequence: Synthetic coding sequence
atgaccagccactacgtgatcgccatcttcgccctgatgagcagctgtctggcgaccgccgggccagagcccggggccctttgcgaattgtcacccgtttccgcttag

SEQ ID NO: 209108 - DNA, 2553 bp, Artificial Sequence
  Description of Artificial Sequence: Synthetic coding sequence
atgaccagccactacgtgatcgccatcttcgccctgatgagcagctgtctggctacagccgggcccgagcctggcgcgctttgcgaactaagtccagtctccgcatcacaccccgtgcaggccctgatggagagtttcaccgtgctgtccggctgcgcctctcgggggactacgggactcccacaggaggttcacgtgctcaatctgcgcaccgccgggcaggggcctggacagctccaacgtgaagtgaccctccacttaaatcccattagttcagtgcatatccaccacaagtctgtggtattcctgctcaactctccccatcccctggtatggcatttgaagaccgaaaggcttgccacaggcgtctcgcgccttttcctggtaagcgaggggtccgttgtccagttctcctctgctaattttagtcttactgcagaaacagaagagcggaactttccccatggtaacgaacatcttctgaattgggcgcggaaggaatacggggcggtgacctcgtttacagagctgaagattgccagaaacatctacatcaaagttggtgaagatcaggtgtttcctcctaaatgtaatatcgggaagaatttcctgagcctcaactacttggctgagtatctgcagccaaaagctgctgaaggatgcgtaatgagctcacagccccagaatgaagaagtccacattattgaattaataactcccaattcaaacccttacagcgctttccaggtggacatcacgatagatataaggccgtctcaagaagatctggaagtagtcaagaacctcattctgattctcaaatgtaaaaagtctgtgaactgggtgatcaaatcttttgacgttaagggatccctgaaaattatcgcgcctaacagcatcgggtttggcaaggaatctgagcgatccatgaccatgaccaagagcatcagggatgatatacccagcacacagggaaatctggtaaagtgggcgctggataacgggtattcccccatcacaagttacacgatggcccccgtcgcaaatcgctttcatcttaggttggagaataacgaggagatgggggatgaagaggttcatactatcccaccagagctcagaatcctcctcgaccccggagcactgcccgctctgcagaatcctccaatccgcgggggagaagggcagaatggaggactgccttttcccttcccagatatcagtaggcgtgtgtggaacgaagaaggggaggatggcctgccaaggccaaaggatcccgtcatacccagcatccagctctttccggggctgagagaacctgaggaagtccagggctcagtcgatatcgccctgtctgtgaagtgcgacaacgagaaaatgatcgtcgcagtggagaaggactcttttcaggccagtgggtactcaggaatggacgtgaccctgctggatcctacatgtaaggcgaaaatgaatggcacgcacttcgtgctggaatcccccctgaacgggtgcggaacaagaccaaggtggagcgctttggacggagttgtctactataatagcatcgtaattcaggtgcctgcactgggtgactctagcggatggcccgacggctatgaagatctggagtctggtgataatgggtttccaggagatatggacgagggggacgcttcgcttttcacaaggcctgagatcgtcgtgttcaattgctcgttgcagcaggttcggaatccgagttcattccaggaacaacctcatggcaacattacctttaacatggagctgtataacactgaccttttcctcgtgccttcacagggcgtgttcagcgtgcccgagaatggtcacgtgtatgtcgaggtgagtgtgactaaggcagaacaggaactcggatttgcaattcagacgtgctttatttcaccttactctaatcccgatagaatgagccactacaccatcattgagaacatctgccccaaggatgaaagtgtaaagttttatagcccgaaacgagtccacttccccatcccacaggctgacatggataaaaaacgctttagctttgtcttcaaacccgtgtttaacaccagcctcctctttcttcaatgtgaattaactctgtgcacaaagatggagaagcatccccagaagttgcctaaatgtgttccaccagacgaagcttgcacatccctggacgcctcaataatctgggcgatgatgcagaacaagaagaccttcacaaaaccactggccgtgatccatcacgaggctgaaagtaaagagaagggacctagcatgaaggaacccaacccaatttctccacccattttccatggtctggatactttaactgtgatgggcatagctttcgcagcctttgtgatcggagcactacttacgggcgccctgtggtacatttactcacacactggggaaacagcgggacggcagcaggttccaacctcccctcctgccagtgagaactccagtgccgcacatagtattggaagcactcaaagtaccccgtgctcatctagctcgactgcttag

SEQ ID NO: 209109 - DNA, 2556 bp, Artificial Sequence
  Description of Artificial Sequence: Synthetic coding sequence
atgaccagccactacgtgatcgccatcttcgccctgatgagcagctgcctggctactgctgggccagagcccggcgccctgtgtgaactgagccccgtgtctgcttcacatccagtgcaagcactcatggagtcttttacagtactgtccgggtgtgcaagccggggtacaaccggactcccccaggaggtccatgtgttaaatttgcgcaccgccgggcaaggaccaggccagttgcagagggaagtaacactgcacttgaaccccatctcatcagtacatatccatcataagtccgttgtctttctcttgaatagtcctcaccctctcgtgtggcacctgaaaacagaacggctggctaccggggtctcgcgcttatttcttgtttctgaaggttcggttgtgcagttcagcagtgccaacttctccctgactgcggaaaccgaggagcggaatttcccacacgggaatgaacatctactgaattgggctcggaaggaatacggcgcagtgacatctttcaccgagctcaagatcgcaagaaatatctacatcaaggtgggggaagaccaagtctttcccccgaagtgtaacatcggcaagaatttcctgtcgcttaactacctggccgaatacctgcagccgaaggcggctgaagggtgtgtaatgtcctcccagccccagaacgaggaggtgcacatcatcgaactgattacccctaactccaacccctactctgcctttcaggtggacattacaatcgatattcggccctcacaggaggacctcgaagtcgtcaaaaacctgattctgatactcaagtgcaaaaagtctgtgaattgggtgatcaaatctttcgatgttaaaggttcactgaaaataatagcccccaactctatcggctttgggaaagaaagtgagagaagcatgaccatgaccaaaagcatccgggatgacatccccagcacacaaggtaacctcgttaagtgggccctcgacaatggatacagcccaattaccagctacaccatggcccccgtggctaaccgctttcacctgcgtctggagaacaatgcagaagagatgggagatgaggaggtgcataccatcccccctgagctgcgcattttactcgaccccggcgccttgcctgccctccagaacccacccatccggggcggagagggccagaacggcggtctaccatttcccttcccagacatcagcaggagggtctggaatgaggaaggggaggatggcctcccccgaccaaaggatccagttataccttctatccagctcttcccgggcctgagagaacccgaagaggttcagggtagtgtggatatcgcactttctgtgaagtgcgacaatgagaagatgattgtcgcagttgaaaaagactcctttcaggcctcagggtattcaggtatggatgtgactcttttagatcccacctgtaaagctaagatgaacggtacgcacttcgtcctcgaaagccctctgaatggctgcgggacccgccctcggtggtccgccctagatggtgtggtgtattataactctatcgtgatccaggtgccagccctgggagattcctctgggtggcccgatggttatgaagatttggaatcaggcgacaacggatttccaggggatatggacgagggggatgcatctctctttacccgccccgagatcgtggtgttcaactgctcactgcagcaggtaaggaacccctcctcctttcaggaacagcctcacgggaacatcacattcaatatggagctgtataatacagacctgttcttagtcccctcccagggtgtgttctctgtacccgaaaatggacacgtgtacgttgaggtgtccgtgacaaaggcagaacaagaattggggttcgcgatccagacctgcttcatctctccttactccaacccggatcggatgtctcactacaccattattgagaacatatgccccaaagacgagagcgttaaattctacagccctaaaagagtgcacttccccattccccaggccgatatggacaaaaaaaggttcagcttcgtatttaagccggtttttaatacttccctcttgttccttcagtgcgaattgaccctgtgtactaagatggagaagcatccccagaagttaccgaaatgtgtccctccagacgaagcctgcactagccttgacgcgtcaatcatatgggcgatgatgcagaacaagaagactttcaccaagcccctcgccgtgattcaccatgaggctgagagcaaagaaaaagggcccagtatgaaagagcccaatccaatcagtccacctatctttcatggcctggacacgctgaccgtgatgggcatcgccttcgccgccttcgtgatcggcgctttgctgacgggcgccctgtggtacatctacagtcatacgggtgagacggcaggccgacagcaggtgccaaccagtccacccgccagcgagaacagctccgcagctcattccatcggcagtactcagtccaccccctgcagttcttcttccacggcttag

SEQ ID NO: 209110 - DNA, 2052 bp, Artificial Sequence
  Description of Artificial Sequence: Synthetic coding sequence
atggccctgttcgtgcggctgctggccctggccctggccctggccctcgggcctgccgccacgctcgccggtccagccaagagtccctatcaattggtcctgcagcactcaagactccggggccgccaacacggccctaacgtttgtgctgtgcagaaggtaatcggcacaaatcggaaatactttaccaattgcaaacagtggtatcaaaggaaaatctgtgggaagtctacagtcatctcttacgaatgctgcccgggatatgagaaggtccctggggaaaaaggctgcccagctgctctgccactcagcaacctatatgagacgctaggagtagtgggtagcacaaccacccagctgtacaccgatcgcaccgagaagctccggccagaaatggaaggccctggcagttttaccatctttgcaccctccaatgaggcatgggcatcactaccagccgaagtgctggactcgttggtttccaacgttaatattgaattgttgaatgctctccgctaccacatggttggtcgtagggtgctgactgatgagcttaagcatgggatgacattaacatcgatgtatcagaattcgaatatacaaatccatcactatccgaatggaattgtcaccgtgaactgcgcccgtcttctgaaggcagatcaccacgctacgaatggggttgtccatctaatcgacaaagtcatcagcacaattacaaacaatatccagcagattattgagatagaggatacatttgagactctgagggccgcagtcgccgcaagtggcctgaataccatgttggagggcaatggtcagtacaccctgctcgctccaacaaatgaggcatttgagaagattcctagtgagactctgaaccgcatcctcggcgatccagaagcacttcgcgacttgcttaacaaccatatcctaaagagcgccatgtgcgccgaagctattgtcgcagggttatcagttgagacactagagggcacgaccctggaagttgggtgttccggggacatgctgaccattaatggaaaagctattatctccaacaaggacatactggccaccaatggggtgatccattacattgacgagctgttgattccagattcggccaaaacactctttgagcttgctgcggaatcagatgtatctaccgcaattgatctgttcagacaggcaggcctgggaaatcacctctcagggtcagaacgtttgacgcttctggccccgctgaactcagtgttcaaggacggaactcctcctattgatgctcacaccagaaacttattacggaatcatattataaaagaccaactagcttctaaatatttgtatcacggtcaaactttggagaccctgggcggcaagaaattgcgcgtgtttgtgtacaggaattcactgtgcatcgagaactcttgcattgctgctcacgacaagcggggacgatatgggactctgttcacaatggacagagttcttactcctcctatggggacagtcatggacgtactcaagggcgataaccgcttttccatgctcgtggctgccatccagtccgccgggctcaccgagaccctgaatagggagggagtttacacagtgttcgccccgacgaatgaggctttccgcgccctaccccctagagaaagatcaaggctattgggtgacgccaaggaattggcaaacattctgaaataccacataggagatgaaatcctggtgtctggcggaatcggcgccctggtgaggctgaagtctctccagggtgacaagttggaggtgtcgctgaagaataatgtggtgtctgttaataaagaacccgtggctgaacccgatattatggcaaccaacggagtggtgcacgtgattaccaatgtactccaacctcccgctaatcgcccccaggagagaggagatgagctcgctgacagtgctctggagatttttaagcaggctagtgcattcagcaggccggagcaaccgcaagtgttgtgctcaccagtctaccaaaagctcctcgaacggatgaagcactag

SEQ ID NO: 209111 - DNA, 1251 bp, Artificial Sequence
  Description of Artificial Sequence: Synthetic coding sequence
atgctggagggcaacggccagtacaccctgctggcccccaccaacgaggctttcgaaaaaatcccttctgaaaccttgaacaggatccttggcgacccagaggccctcagggacctccttaacaatcatatactcaagagtgccatgtgtgctgaagccatcgttgcagggctctctgtagagacgttagaaggtaccaccctcgaagtgggctgctctggggatatgctcaccatcaatgggaaggcaataatatcaaataaagacattttagcaacaaacggcgtgatacactacatcgatgaattgctgataccagacagtgcaaagactttattcgaactagctgccgagtcagacgtgtccactgctattgatttgttcaggcaagctggactcgggaatcacctgtccggctcggagcggctgaccctgttggctccacttaattccgtgttcaaggatggcactccccctatcgatgctcatacacggaatctattgaggaatcatatcatcaaagatcagctggcctccaagtacctctatcatggccaaaccctcgagacactcggcggaaagaagttgagagtcttcgtgtaccgaaactctctctgcatagagaactcctgcattgccgctcacgataagaggggtcgctatggtacactgttcaccatggaccgggtcctaactccgcctatgggcactgtaatggatgtgctgaaaggcgacaaccgcttcagcatgcttgtggccgcaatacagtctgctggattgacagagacacttaatcgcgagggcgtgtatacagtattcgcaccaaccaacgaagcttttcgcgcacttccaccgcgcgaaaggtctcggttgctgggtgacgcgaaagaattggctaacatcctaaagtatcacatcggggacgaaatactggtgtccggcggaattggtgccctagttcggctcaagtcccttcagggagacaagctggaggtctccctcaagaataatgtggtgagtgtcaataaggagccagtggccgagccagatatcatggctactaatggcgtggtgcatgtcattacgaatgttctccaaccacccgccaacaggcctcaagagagaggcgatgaactcgccgactccgctcttgagatcttcaaacaggctagcgccttctcgcgggccagccagagatccgtcaggttagctccagtgtatcagaagctcctcgagcgcatgaaacactag

SEQ ID NO: 209112 - DNA, 2052 bp, Artificial Sequence
  Description of Artificial Sequence: Synthetic coding sequence
atggccctgttcgtgcggctgctggccctggccctggccctggccctcgggcctgcagccacactagccggacccgccaagtctccctatcagctggtgttgcagcactcccggttgcggggccgtcagcatggcccaaacgtgtgtgctgtccaaaaagtcattggaactaatcgtaagtattttactaactgcaaacaatggtatcagagaaagatttgtggaaaatctacagttattagctacgagtgctgtcccggctacgaaaaggtacccggggaaaaaggatgccctgctgccctgcccctgagtaatctctatgagacgcttggcgtggtcgggagtacaaccacgcaactgtacacagacagaacagagaaacttcggcctgaaatggagggtccaggctccttcacaatcttcgcaccttctaacgaggcttgggcaagcctgccagcagaggtgctggacagcctggtctccaacgtgaacattgagctcctgaatgccctgagatatcacatggtgggccggcgggtgctgaccgacgaattaaaacacggcatgaccctgaccagtatgtaccagaatagtaatattcagatccaccattacccgaacggtattgtgaccgtcaattgtgccaggcttctcaaggcggaccatcatgccactaatggagtggtccatctgatagacaaggtgataagcacaatcaccaataatattcaacaaatcattgagattgaagacactttcgaaactttaagagctgcggtggctgcaagcggactgaatactatgcttgagggcaatggccaatatactctcctcgcccccacgaatgaggccttcgaaaagattcctagcgagacgctgaaccgcatcctgggggatcctgaagctctgcgggatttactgaacaatcacatcttaaagtcagcaatgtgcgctgaagccattgtggctggactgtccgtcgaaacccttgaggggactaccctggaagtgggctgttccggcgacatgctaaccataaacgggaaggctataataagcaacaaggacatcctcgccactaacggtgtaattcactacatagacgaattgcttattccggacagcgccaaaactctgttcgaactagcagccgagagcgacgtgagcaccgctatagatctttttcgccaggcaggtttgggaaaccacctgtccggaagcgaaaggctgacactgctagcgccgttaaatagcgttttcaaggatggtacgcctccaatcgacgctcacacccgaaacctcctgcgcaaccatatcatcaaagaccagctggcaagtaagtatctttatcatgggcagactctggagacactgggagggaagaagctgagggtcttcgtctaccgaaattctctgtgcatcgagaactcatgcatcgctgctcacgataagaggggccgttacggcacacttttcaccatggatcgtgtccttacaccacccatgggaaccgtgatggacgttttgaaaggagataacaggttttctatgttggtggcagccatacagtccgctggactgaccgagacactaaaccgtgagggagtgtatacagtgttcgctcccacgaacgaggcctttcgagccctccctccaagagagcgtagccggctcctcggcgacgccaaagagctggctaatattctgaagtaccatattggcgatgaaattctcgtttctggaggcataggcgcactagtcaggctgaaatcactccagggagacaaacttgaggtctctttgaagaataatgttgtatctgtcaacaaggaacctgtagctgaacctgatatcatggctactaatggagttgttcacgtcattacaaacgtgctgcagcctcccgccaaccgcccccaggaacgcggagacgaactggccgattctgctctcgaaatcttcaaacaggcctctgcattttctcgcgcatctcagcggtccgtgagacttgcccccgtgtatcagaagctgcttgaaagaatgaagcactag

SEQ ID NO: 209113 - DNA, 1188 bp, Artificial Sequence
  Description of Artificial Sequence: Synthetic coding sequence
atggccttcagcccctggcagatcctgagccccgtgcagtgggccaagtggacttggagtgccgtgcgtggtggggccgcaggggaggacgaggcaggaggaccagaaggcgatcccgaggaggaggattcacaggcagagaccaaaagcttgtcctttagaagcggctgcaaagtgaagaaacatgaaactcaatccttagcattggacgcttgttcccgcgatgagggggccgtaatttcgcaaatcagcgacataagcaatcgggacgggcacgctactgatgaggaaaaactggcctccacatcatgtggccagaaatctgctggcgccgaagtaaaaggtgagccagaagaagatctggagtacttcgaatgcagtaatgtgcctgtctctaccataaatcacgcttttagttcctctgaggctggcattgaaaaagaaacatgccaaaagatggaggaggatggcagcacggtgctgggattattagaaagctccgccgaaaaggcccccgtttccgtttcctgcggcggagagtctcccctcgacgggatctgtctgtccgagtccgataagacagcggtcttaacattgatccgggaggaaattatcacaaaggaaatcgaggcgaatgaatggaaaaagaaatatgaggagactagacaggaggtgctcgaaatgcgcaagattgttgcggagtacgagaaaactatcgcacaaatgatcgaagacgagcaaaggacaagcatgacctcacagaaatcttttcagcagctcactatggaaaaagaacaggctctcgccgatcttaacagtgttgaacggagcctatctgacctcttccggcggtacgagaacctgaagggtgtgttggagggcttcaagaagaatgaggaagcactgaaaaaatgcgcacaagattacctggccagagtgaagcaagaggagcagaggtaccaggctctaaaaattcacgcagaagaaaaattagacaaggcgaatgaagagattgcacaggttagaacaaaggcgaaagccgagagtgcagccctgcacgcagggctgcggaaggagcagatgaaggtcgaatctctggagagggcattacagcaaaaaaaccaagagattgaggaattgaccaagatttgtgatgaattgatcgctaaactgggcaagaccgactag

SEQ ID NO: 209114 - DNA, 2418 bp, Artificial Sequence
  Description of Artificial Sequence: Synthetic coding sequence
atggccttcagcccctggcagatcctgagccccgtgcagtgggccaagtggacatggtccgccgtccgaggcggagcagcaggggaggacgaagctggcgggccagaaggggatcccgaagaggaagactctcaggccgagaccaagtcgctctcattcagcagtgattctgaggggaacttcgagacccccgaagccgagactcctattaggtctccattcaaagagtcatgtgacccgtccctgggcctggcagggcctggcgctaagagccaggagtcccaggaagcagatgagcagctggtcgccgaagtcgtagagaagtgttcttccaagacctgctccaagcccagcgagaacgaagtcccccagcaagccatagattctcatagcgttaagaatttccgtgaagagccagaacatgacttcagcaaaatctcaatcgttaggcctttttctattgaaaccaaggattccacggacattagtgccgttctgggcactaaggccgcccatggatgcgtcacagcggtgtctgggaaggctctgccctcttcgccaccagacgctcttcaggacgaggcaatgaccgaaggatccatgggtgtcaccttagaagcctctgcagaagcagaccttaaggcaggcaactcttgtcccgagctggttcctagcaggcgttccaaattaaggaaacctaaacccgtgccactgcgcaagaaggcgatcggaggggagttctctgataccaatgctgcagtagagggaacacccttacctaaggcttcttaccacttcagtccagaagaattggatgaaaacacctcacccctgctgggtgatgcaagattccagaagagtccgccagatcttaaggaaactcctggcactctttcatctgataccaatgacagcggggtggaactgggggaggaatcccggagttcccccttgaagctggagttcgactttactgaagacaccgggaacatagaagctcgcaaagcgctgcccagaaagctcggaagaaagctgggcagcaccctgacccccaagatacagaaagatggaatctccaagtctgccggtctggagcagccgactgatcccgtcgctagggatgggcctctgagtcagacttccagcaagcctgatcctagccagtgggagtcacccagcttcaacccgttcggatcacattccgtcctccaaaactctcctccgcttagcagcgagggcagttaccacttcgatccagataatttcgacgagtctatggatccatttaaacctaccaccacgttaacctcctccgatttctgctccccgaccggcaatcacgttaacgagattcttgagagccctaagaaagctaagtccaggttgatcacgagcggctgtaaggtgaagaagcatgagacccagtccctcgcgctcgatgcgtgctctagggacgaaggcgctgtaatttctcaaataagcgacatctccaatagagacggccatgcaaccgacgaggagaagcttgctagtacatcatgcggacagaaaagtgccggcgccgaggtgaagggtgaaccggaggaggatctggagtatttcgagtgctccaatgtgcccgtgagcactatcaatcacgccttctcgtcaagtgaagcagggatcgagaaggagacctgccagaaaatggaggaggatggcagcaccgttcttggcctgttggaatcctcggcggaaaaggcaccggtatctgtgtcttgtggaggggaaagtcctctggatgggatttgcctgtctgaatctgacaagacggcagtgctgacactgatccgcgaggagattattaccaaggagattgaggccaatgagtggaagaagaaatatgaagaaaccagacaggaagtgctcgagatgcggaaaattgtagcagagtatgaaaaaactattgcccagatgattgaggatgagcagagaaccagtatgacatcacagaagtcttttcaacagctgacaatggagaaggagcaggcacttgctgatctaaactcagttgagcggtctctgagtgacctgtttaggcggtacgagaatctaaagggcgtacttgagggcttcaaaaaaaatgaggaggcattgaagaagtgtgcgcaagattacctggctcgggtcaaacaggaggaacagaggtaccaagcactgaagatacatgcggaagaaaagctggataaagctaatgaagaaattgcgcaagtgaggaccaaggctaaagcggagagcgccgcactgcacgccggcctgcgaaaggaacagatgaaagtggagtctctggaaagggcactgcagcaaaaaaatcaggagattgaagaactaactaagatctgcgatgagttgatagccaagctgggaaaaaccgactag

SEQ ID NO: 209115 - DNA, 1140 bp, Artificial Sequence
  Description of Artificial Sequence: Synthetic coding sequence
atgggcggcagccacagccagaccccccggggccgggagcccgccggggagcggcaccccagaccaactgaaactgctactaccgagcaagtgaagttcttgtgtttcttgttatccgggtgtaaagtgaaaaaacacgaaacacagagtttagcactggatgcatgttcccgggacgagggcgctgtaatcagccagatttccgatatcagcaaccgggacggacacgctacagacgaggagaaactggccagcacatcatgcggacagaaaagtgcaggcgcagaagttaagggtgaacctgaagaagatctggagtatttcgaatgctctaacgtgcctgtgagtactataaaccacgcattttccagttccgaggctggaatcgagaaggagacttgccagaaaatggaagaagatggctcaaccgtcctcggcctgctggaatccagcgccgaaaaggccccagtgtccgtttcttgtggaggtgagagtcctctcgacggaatctgcctttccgaaagtgacaaaaccgcagtgctgacccttatccgggaagagattattacaaaagaaatcgaggcaaatgagtggaagaagaagtatgaggaaacccgtcaggaagtcctcgagatgagaaagattgtcgctgagtatgagaaaacaatcgcccaaatgattgaggacgagcagaggactagtatgacttcacaaaagagcttccagcagctaacgatggagaaggaacaggccctagctgacttgaactcagttgagagatctctctcagatctatttcggcggtatgagaacttgaagggggtactcgaaggatttaagaagaacgaagaagccttaaagaagtgtgctcaggactatttggccagagtaaagcaagaggagcagcggtatcaggctctgaaaatacacgctgaagaaaagcttgacaaggcaaatgaggaaatcgctcaagtgcgcacaaaggcaaaggccgaatccgccgccttgcacgcagggcttcgtaaggaacagatgaaagtcgagtcccttgaaagggccctgcagcagaaaaaccaggaaattgaggaactgaccaagatttgcgacgagctgattgcgaaactaggtaagacagattag

SEQ ID NO: 209116 - DNA, 1104 bp, Artificial Sequence
  Description of Artificial Sequence: Synthetic coding sequence
atgggcggcagccacagccagaccccccggggccgggagcccgccggggaaaggcacccgcgaccaaccgagaccgctagtggatgcaaggtaaagaagcacgagacgcaaagtcttgcactggatgcctgctctcgagacgagggagccgtaatttctcagatcagcgatatttcgaatcgagatggccatgctaccgacgaggaaaagctggcttcaacgtcgtgcgggcagaaaagcgccggggctgaagttaagggtgaacctgaagaggatttagaatactttgaatgctccaacgttccagtgtccaccatcaaccacgccttttccagctctgaggccggaattgagaaggagacgtgccagaagatggaagaggacgggagtaccgtgctggggctgttggaaagctcggccgagaaagcccccgtttccgtgtcctgcgggggagaatcacctttggatggaatttgcctcagtgaaagtgataaaacagccgttctcaccctgatccgagaagaaataatcactaaagagatcgaagcaaatgagtggaagaaaaagtacgaggaaacgaggcaagaggtcctggagatgagaaagattgtggctgagtatgaaaagactattgcacaaatgattgaagatgaacagagaacgtctatgacgagtcagaagtcatttcagcagctcaccatggagaaggaacaggccttggccgatctgaattcagtggagagatcactctctgatctcttcaggcgttatgagaatcttaaaggcgtattggagggattcaagaagaatgaggaggccctcaaaaaatgcgcccaggactacctggctcgggtgaagcaggaggaacagcgttatcaggctttaaaaattcacgccgaagagaagctggacaaggctaatgaggagatcgcgcaggtacgcaccaaagccaaggctgaatctgccgcgctgcacgccggactgaggaaggagcagatgaaagtggaatctctggagcgggctctacagcaaaagaaccaggagatagaggaactgacaaagatttgcgacgaactgatagcgaaactgggcaaaaccgattag

SEQ ID NO: 209117 - DNA, 2454 bp, Artificial Sequence
  Description of Artificial Sequence: Synthetic coding sequence
atggccttcagcccctggcagatcctgagccccgtgcagtgggccaaatggacttggagtgccgtcagaggcggcgccgccggcgaggatgaggccggcggtcccgaaggtgatcctgaggaagaagattcccaggccgagacgaagagcctgagtttctcctccgactcggaaggcaattttgagactccagaagccgagaccccaatcagatcaccatttaaggaatcttgcgatccctcattggggttggccggccctggggctaaaagtcaggagtcacaggaagcggatgagcagctggttgccgaggtcgtcgaaaagtgctccagcaaaacatgctcaaagcccagcgagaacgaagtgcctcagcaggccattgatagtcattccgtgaaaaacttccgggaagagcctgaacacgacttcagcaaaatcagcatcgtgcgccccttctcgatcgaaactaaggattcaaccgatatctctgccgttttaggcactaaagctgcgcatggctgtgttaccgctgtgtccggcaaggcccttcctagcagtccccccgatgcgctacaggatgaggccatgactgaggggtcaatgggtgtgaccctggaggcgagtgcagaagccgacctaaaagctggaaacagctgcccggaactggtaccaagtcgaaggtccaaactgaggaagccaaagccagtaccccttaggaaaaaagctattggaggagagttttccgataccaacgccgctgtggagggcacccccctgccaaaggcttcataccacttttcacccgaagaacttgacgaaaacacttcacctctgctgggtgatgctcggttccagaaaagtccccctgatctcaaggagacacccggaaccctgagcagcgatactaacgacagcggcgttgagctgggagaagagagtaggtctagccccttgaagctagaatttgacttcacagaggatactggtaacattgaggcaagaaaagcactgccaaggaagcttggacgtaaattgggaagcactttaactcctaaaatccagaaggatgggatctcaaagtccgctggactggagcagccaacggatcccgttgctagagatggtcccttgagtcagacatcctccaagcctgatccctcccaatgggagtccccttctttcaatccgtttggatctcactctgtcctacagaactcaccccccctgagctcagagggatcctaccactttgaccctgacaacttcgacgagagtatggaccctttcaaacctaccaccactctgaccagtagcgacttctgtagtcccacagggaaccatgttaacgagatactcgaatctcccaaaaaggctaagtctaggctcatcaccacaaccgaacaagtaaaattcctctgttttctcctctccggatgcaaagtcaagaaacacgaaacacaatcactggccctcgacgcctgcagccgagatgaaggcgccgtgatttcacaaatctcagacatctccaatcgcgatggccatgccaccgacgaggagaagctggcgagcacatcctgtgggcagaagtcggctggcgcagaggtgaaaggcgaaccagaggaagatcttgagtactttgaatgcagcaacgtgcctgtgtctacaatcaaccacgcattcagttcttccgaagccggaatcgaaaaggaaacttgtcagaagatggaagaagatggctcaactgtgctaggtctcctcgaatcgagtgcagagaaagcccccgtatcagtatcatgcgggggggagagcccactggacgggatatgtctatcagagagcgataaaaccgccgttctcactctgattcgggaagaaatcattaccaaagaaatcgaagcaaacgaatggaagaagaagtatgaggaaacacgacaggaggtgctggaaatgcgcaaaatagtggctgaatatgagaagaccatcgctcagatgattgaagacgagcagaggactagtatgacttctcagaagtcctttcagcagctaacaatggagaaagagcaagcgctggctgacttaaactccgtggagcgatccctttccgatctttttaggagatatgagaatttgaagggtgtgctagaggggttcaagaaaaacgaggaggcgttgaagaaatgcgctcaggattatctcgcgagggttaaacaggaggaacagaggtaccaggctctgaagatccacgctgaggaaaagcttgacaaggccaatgaagagattgcccaggttagaacaaaagccaaggcagagagcgcggcacttcatgccgggctccggaaagaacagatgaaggtggagagcctcgaacgcgctctgcagcagaagaaccaggagatcgaagaactcacaaagatctgcgatgaacttattgccaagttagggaagactgattag

SEQ ID NO: 209118 - DNA, 2379 bp, Artificial Sequence
  Description of Artificial Sequence: Synthetic coding sequence
atgcagcggcagaccatcaagggcgccggcgccggcggcgccgccctaatggctttcagtccgtggcaaattctctcccccgtccaatgggctaagtggacgtggtcagctgttagaggcggtgctgcaggtgaggatgaggctgggggacctgaaggcgaccctgaggaggaggatagccaggcagagaccaagtccctctctttcagttcagattcagaaggcaatttcgagactcccgaggctgaaacgcctattcggtctccattcaaagaaagttgtgatccgtcattagggctcgctggtcccggcgctaagagccaggaaagccaggaagcggatgagcagctcgtggccgaagtcgttgaaaaatgttcctctaaaacctgctccaaaccttcagaaaacgaggtaccacagcaggccatcgactcccacagcgtcaaaaattttcgggaggagcctgagcacgacttcagcaaaatatcgatcgtaagaccatttagtatagaaaccaaagactctacagatatcagcgccgtccttggaaccaaggccgcgcacggatgtgttaccgcagtgtccggaaaagctctccctagctctcctccggacgccctacaagacgaggctatgaccgaggggtccatgggagtgaccctcgaggctagcgcagaggctgatttgaaggctggaaacagctgtccggaacttgtcccaagccggcgctccaagctccgcaagcccaagcccgtccccctgagaaaaaaagctataggcggcgaattcagcgacacaaatgctgctgttgaaggaaccccattacccaaggccagctaccactttagtccagaagagcttgacgagaacacatccccccttctcggcgatgctagatttcagaaatcaccgcccgacctgaaggaaactccagggacgctgtccagtgacactaatgacagcggtgttgaattaggagaggagtctcgttcgtccccactgaagctggaatttgatttcactgaggatacaggtaacatagaagctcgcaaggcactccctcgcaaactgggaaggaaattaggaagtacactgacgcccaagattcagaaggacgggatctccaaaagcgccgggttggagcagccaaccgatccagtcgctagagacgggccacttagtcaaacaagcagcaagccagaccctagtcagtgggagtcccccagctttaatcccttcggcagtcactccgtcctgcaaaacagccccccgctgtcatcagaaggctcctaccactttgatcccgacaactttgacgagagtatggatccgtttaagccgaccactacactcacctcttcagacttctgcagccccaccggaaatcatgtcaatgagattctggagtctcccaaaaaggctaagagccgactgatcactagcggctgtaaggtaaagaagcatgagacacagagcctggctctcgacgcctgctctagagacgagggagctgtgatcagtcagatcagtgatatctccaaccgggacggtcatgctactgacgaggagaagctggcttccacctcatgtggacagaagtccgccggagccgaggtcaaggggatagagaaggaaacttgccagaagatggaggaagatggttctacagtcctaggcttactcgaatcaagcgccgaaaaggcccctgtgtctgtgtcgtgcggtggtgaatcaccacttgatggcatctgcctgtctgaaagtgacaaaacagcggtcctgaccctgatccgggaagaaatcatcaccaaagagatcgaggccaatgaatggaagaaaaaatacgaagagacccgccaagaggtgctggaaatgcgcaagatcgtggccgaatatgagaagacaattgctcagatgatcgaggacgagcagagaacctctatgacctcacagaaatcctttcagcagcttaccatggaaaaggaacaggctttggctgacctgaattccgtggagcggagtctcagcgaccttttccgtcgttacgaaaacctcaagggtgtcctggagggattcaagaaaaacgaggaggcactgaagaagtgcgctcaggactacctagcgcgcgtgaagcaggaggaacagcggtaccaggctctaaaaatacacgctgaggagaagttagataaggccaatgaagaaattgcgcaggtgcggactaaggctaaggccgaaagcgcagcactccacgcagggctgaggaaagaacagatgaaagttgagtctctggaaagggcccttcagcagaaaaaccaggagattgaggaactgacaaaaatctgtgatgagttgatcgcaaagctgggcaaaaccgattag

SEQ ID NO: 209119 - DNA, 1431 bp, Artificial Sequence
  Description of Artificial Sequence: Synthetic coding sequence
atgaccgagggcagcatgggcgtgaccctggaggccagcgccgaggcggacttaaaggccggcaatagctgccccgaactcgtacccagccgacgatccaagttacgtaagcccaagcccgttcccttgagaaagaaggccattggtggcgaattttcggacaccaatgctgcagttgaaggcactcctctgcctaaggccagctatcatttctccccagaagaactcgacgagaatacgagccccctgctgggcgatgcccgatttcagaaaagcccccctgacttgaaggaaacccctggtactctgagcagcgacactaacgattccggagtggagctcggagaagagtctaggagcagcccgttgaagttagaattcgattttaccgaagacaccgggaatatcgaagccagaaaagcgttgccaagaaaacttggtcgtaaactcggaagtactctgaccccaaagattcagaaagacggaataagcaaaagtgctggcctggagcaaccaacggacccagtagctcgggatggacccctgagccagacgagcagtaagcctgatccatctcaatgggaatcacccagctttaacccttttggctctcacagtgtcctccagaactctccacccctttcctcagaggggtcttaccatttcgacccagataacttcgacgagtctatggacccatttaaacccactaccaccctcactagctccgatttttgctcgcccactgggaaccacgtaaatgagattctcgaatcgccgaagaaggccaaatcccggctgatcaccagcggttgcaaggtgaaaaaacatgagacacagtcgctggccttggacgcctgcagtcgcgacgaaggcgctgtgataagccagatttcggatataagtaatcgagacgggcacgccaccgatgaggagaagctggcctccacctcttgtggccagaaatctgccggggccgaagtcaagggtgagcccgaagaggatttggagtacttcgaatgctctaacgtcccagtgtcaaccatcaatcacgcttttagtagcagcgaggccggtattgagaaagagacatgccaaaagatggaggaagacggaagtaccgtgcttggcctccttgagtcctccgctgagaaagcaccagtcagtgtgtcctgcggtggagagagccccctggatggcatttgcctcagcgagtccgacaaaaccgccgttctgacattgattcgggaggaaatcatcaccaaggagatcgaagcaaacgagtggaagaaaaagtattttaataaggaggtttttaggggcgatatatgccccaaacggttcggcctgcagatccccgtgatctttaaaaaacagctaacaactaaatctctctccctacatagagtgacagtaaaaaagttgatgtag

SEQ ID NO: 209120 - DNA, 2196 bp, Artificial Sequence
  Description of Artificial Sequence: Synthetic coding sequence
atgaacaacatcctgaagctgaagagcagcgacagcgagggcaactttgagacgccagaggcggaaacacccattcgtagtccattcaaggaatcctgtgatccatctctcgggctggctggaccaggcgccaagagccaggagtcccaggaagctgacgagcagctcgtggcggaggtagtagaaaagtgcagctctaaaacatgttccaaacctagcgagaacgaggtgcctcagcaagccattgactctcactccgtcaaaaacttccgagaggagcccgagcatgatttttccaaaatctcgatagtgaggccctttagcattgagacaaaggattcgaccgacatctccgccgttttgggaaccaaagctgcccacggatgtgtgacagccgtctcaggaaaggccctgccttccagtcccccagatgcactccaggacgaagccatgaccgaagggtcaatgggcgtcacactggaagcttccgctgaggcagacttgaaggccgggaacagctgtcccgagctcgttccttcccggcgttcaaaactgaggaaacccaagccagtacccctgcggaaaaaggcaattgggggggaattttctgacaccaatgccgctgtagaaggcacacccctgccgaaggcctcgtatcacttttctccagaggaattggacgaaaacaccagtcccctccttggggacgcgagatttcagaaatctccacctgatctaaaagagacccctggcacactgagctccgacaccaatgattccggggtcgagttgggggaggagagtcggtcaagccccctgaagctggaatttgacttcacagaagacactggaaatattgaagcccggaaagctctccctcgcaaacttggccgcaagctggggagcaccctgacaccgaagattcaaaaagacgggatttccaaatctgccggcctggagcaaccaaccgaccctgtggcacgcgatggcccacttagccagacctcttcaaaaccagacccgagccaatgggaaagcccttcctttaacccattcggctctcacagcgtgctacagaatagtccccccttaagttcggaggggtcctaccacttcgaccccgacaatttcgatgagtctatggaccccttcaaaccaaccaccacccttaccagtagcgacttttgcagtcctactgggaatcacgtaaatgagatattggagtcccctaagaaagctaaaagcaggctaatcacttctggttgtaaagtgaagaaacacgagacccaaagtctcgctctggacgcctgtagcagggacgaaggcgccgttatctcccagatatccgacatcagcaatcgagatgggcatgcaaccgatgaggaaaagctggcatccaccagctgcgggcagaaaagcgccggtgctgaggtcaagggaattgaaaaagagacatgtcagaaaatggaagaggacggatcaaccgtgttgggactcctggagagttctgccgagaaggcgcctgtttcagtgtcatgtggaggcgagagcccccttgacgggatttgcttgtccgagtctgacaagaccgccgtccttacccttattagagaggaaatcattacgaaggagattgaagccaacgagtggaaaaaaaagtatgaggaaacacgccaagaagtgctggagatgaggaaaattgtcgctgagtacgaaaaaacgattgcacagatgatcgaagacgaacagcgaactagtatgacctcccaaaaatcctttcagcaattgacaatggaaaaagagcaggctttggccgacttgaacagtgtagaaagatcgctgtctgacctgttccggaggtacgagaatctaaagggtgtgttggaaggctttaagaagaacgaggaggccctgaagaaatgtgctcaagattaccttgcacgagtaaagcaggaggagcaaaggtaccaggccttaaaaattcacgcggaggaaaaactggataaggcaaatgaagagatcgcgcaggtaaggaccaaggccaaggcagagagcgcggccttgcacgccggtttgcggaaagagcagatgaaggtggaatcgctggagagggcattgcagcagaagaaccaggagattgaagaactgaccaaaatctgcgatgaactcattgcgaagctcggaaaaaccgattag

SEQ ID NO: 209121 - DNA, 1833 bp, Artificial Sequence
  Description of Artificial Sequence: Synthetic coding sequence
atgaccgagggcagcatgggcgtgaccctggaggccagcgccgaggccgacctaaaagccggtaatagctgtccagaactggtgccttcacgaaggtctaaacttaggaagccgaaaccagttcccttacgtaagaaggcgattggaggtgagtttagcgacaccaatgctgctgtggaaggaaccccccttcctaaagcttcataccatttctctcctgaggaattagatgagaacacaagtccactgttaggagacgccaggttccagaagtcaccccctgatctgaaggagactcccggaactctaagtagcgataccaatgattcaggagttgagctgggagaggagtccagaagctccccgctgaagctggaatttgacttcacggaggacacagggaatatcgaggccaggaaggctctcccacgcaagctagggagaaagctcggtagcacacttactcctaaaatccagaaggatggcatttcgaagtcagctgggctggaacagcccacagatcccgtggcccgcgatggcccactcagtcagaccagtagcaaaccggacccctctcagtgggaatcaccatcttttaacccattcggctctcacagtgttcttcaaaatagcccaccgctgtcctccgaaggaagttaccattttgaccctgataatttcgacgagtcaatggaccctttcaagccgacaacaactctcaccagctccgatttttgttcacctacaggaaaccacgtgaacgaaatcctagaaagcccaaagaaggcgaagtctcggctgatcacatcaggatgtaaagtgaaaaagcacgaaacacagagcctggccctcgatgcctgctccagagatgaaggagccgtgatctctcaaatctccgacatatccaacagggacggccacgccaccgatgaggagaaactggcctcaacatcctgtggtcagaagtctgccggagccgaggttaaaggagagcctgaggaggatttggagtacttcgagtgctctaatgtgcctgtctccactataaatcatgccttctcaagttccgaggctggtattgagaaagaaacgtgtcagaaaatggaggaggatggatccacagtacttggattgctcgagtcaagcgccgagaaggcgccagtgagcgtaagctgcggaggtgagagtcccctagacggcatctgtcttagcgagtcagacaagacagcagtgcttacactcattcgggaagagatcattaccaaggagatcgaggcaaacgagtggaaaaaaaagtatgaggagacaagacaagaggtgttggagatgcggaagatcgtagccgagtatgaaaagacgattgcacaaatgatcgaggacgagcagaggaccagcatgacatcgcagaagagctttcaacaactgaccatggagaaggaacaggctctagccgatctcaattccgtggagcggagcctctccgatttgttcaggcggtatgagaacctaaaaggagttctcgagggattcaagaaaaacgaggaggcacttaagaagtgcgcgcaagactatcttgcacgcgtaaaacaggaggaacaaagataccaggccctcaagattcatgcagaggagaagcttgataaggcaaacgaggagattgcccaggtgcgaaccaaagcgaaggccgagtccgctgcgttacacgctggcttacgaaaggaacaaatgaaagttgagtcgctcgaacgtgcacttcaacaaaaaaatcaagaaatcgaggagctgaccaaaatctgcgatgaactgattgccaagctcggaaaaacggactag

SEQ ID NO: 209122 - DNA, 1746 bp, Artificial Sequence
  Description of Artificial Sequence: Synthetic coding sequence
atgaccgagggcagcatgggcgtgaccctggaggccagcgccgaggctgacctgaaggccggcaatagttgtcctgaactggtgccatcccggcggtccaaattgaggaagccaaaacctgtacctttgcggaaaaaggccatcggcggcgaattctcagatactaacgccgccgtggaaggaacaccccttcctaaagcaagttaccactttagccccgaagaattggatgagaacacatccccactgctgggggatgctagattccaaaaatctcctccagacctcaaggaaacacccggaacactgtcctcagatactaatgactctggagtggagctgggcgaggaaagtaggtcatctcccctcaaactcgagttcgacttcaccgaggacacgggaaacatcgaggcccgcaaagcgctgccaaggaagctcggacgcaagctcggctccactttgacaccgaagatacagaaagacggcatcagtaaaagtgctggtctcgaacagcccacggatccagtagcacgagatgggcccctctcccagacatcaagcaagccagatccttcacagtgggagagcccatccttcaatcctttcggctcacactctgtcctccaaaatagcccgccccttagctccgagggatcctaccatttcgaccctgacaacttcgatgaatcaatggacccattcaagccaacgacaacactgacatcatccgacttctgttctccgaccgggaaccacgtgaatgagatcctggaaagtccgaaaaaagcgaagtcacgccttattacttcagggtgcaaggtgaaaaagcacgagacccagtctcttgccctggacgcttgtagccgcgacgagggagcagtgatttcacagattagcgatattagcaatcgagacggtcacgccaccgatgaggagaaactggctagcacttcttgcggccagaagtcagcaggagccgaggtcaagggaatcgagaaagagacctgtcaaaagatggaagaagatggaagtactgtgcttggccttcttgaatcctcggctgagaaagctccagtgtcagtgtcatgtggaggcgaaagccccctagatggaatctgcctgtccgaatcagacaagactgcggtgctcaccctcattagggaggagattattaccaaagaaatcgaggctaacgagtggaagaaaaagtatgaggaaacacggcaggaagtgctggagatgcgtaagattgtcgcagaatacgagaagactatcgcacaaatgatcgaggacgagcagcgcacctctatgacctctcagaagtcgttccagcaactgaccatggaaaaagaacaagcacttgccgacctcaatagtgtcgagaggtctctgtctgatctgtttaggaggtatgaaaacttaaaaggcgtgctcgaaggctttaagaaaaacgaggaggctttgaagaagtgtgcacaggattacctagccagggttaagcaggaggaacagcggtaccaggcactgaaaattcacgcagaggaaaaactggataaggctaacgaggagattgcacaggtcaggactaaagcaaaggcggaaagcgctgccctccacgctggtttaagaaaagaacaaatgaaggtagagtccctggagcgcgccttacagcagaagaatcaggagattgaagagttgaccaaaatctgtgacgaactcatcgccaaactgggtaagaccgattag

SEQ ID NO: 209123 - DNA, 93 bp, Artificial Sequence
  Description of Artificial Sequence: Synthetic coding sequence
atgaccgagggcagcatgggcgtgaccctggaggccagcgccgaggccgatctgaaggccgggaatagctgccccgagctggtgcctagttag

SEQ ID NO: 209124 - DNA, 417 bp, Artificial Sequence
  Description of Artificial Sequence: Synthetic coding sequence
atgaccgagggcagcatgggcgtgaccctggaggccagcgccgaggccgacttgaaggctggtaattcctgccccgagctggtcccctctagaaggtctaagctgcgaaagcccaaaccagtccctctaagaaagaaggcaatcggaggggagttcagtgatactaacgccgccgtggaaggtacaccgctgcctaaagccagttaccacttctcgccagaggaactagatgagaatacctctccactgttgggtgatgcacgtttccagaaatctcctcctgacctgaaagagacacccggcacactgagcagtgacaccaatgattccggagtggagcttggagaggagtcccgctcgtctcccctcaagctggagttcgactttacggaagacacggggaatatcgaagcatag

SEQ ID NO: 209125 - DNA, 186 bp, Artificial Sequence
  Description of Artificial Sequence: Synthetic coding sequence
atgaccgagggcagcatgggcgtgaccctggaggccagcgccgaggccgacctgaaagccggcaattcctgcccggaacttgtccccagccggcgatccaaactacgcaagccaaaaccagttcctctgagaaagaaggcaataggcggcgagttctcagacacaaatgctgccgttgaaggctag

SEQ ID NO: 209126 - DNA, 390 bp, Artificial Sequence
  Description of Artificial Sequence: Synthetic coding sequence
atggccttcagcccctggcagatcctgagccccgtgcagtgggccaaatggacatggtctgccgtgaggggcggagcggcgggtgaagacgaggcgggtggtcccgaaggcgatcctgaggaagaagactcccaggccgaaaccaagtctctaagtttctcctcagatagcgaaggaaattttgagacccccgaggccgagactccaatacgatcgccttttaaagagtcctgtgatcctagcttaggattggctgggcccggagcaaagagccaggaaagtcaggaggccgacgaacaactggtggctgaggtcgtggaaaaatgctcttccaagacatgtagtaaacctagcgagaacgaggtgccccaacaggctatcgattcatag

SEQ ID NO: 209127 - DNA, 3081 bp, Artificial Sequence
  Description of Artificial Sequence: Synthetic coding sequence
atgggcggcagccagagcctgcagcccgcccccgccagcgacctgaatttagaggcatccgaagcaatgtcttcagactcagaggaggccttcgagacccctgagtctaccactcccgtgaaggcgccacctgcccctcccccgccaccccccgaggtgattccagagcccgaagtttcaacccagcccccacctgaagaacctggttgtggatccgaaaccgtgccagtcccggacggccctcgctccgattctgtggaaggcagtcccttccgccccccttctcattcattcagcgcagtgtttgatgaagataagccaattgcatccagcggcacctacaacctggattttgacaatattgagctagtggacacattccagacgctggagccacgcgccagtgatgccaagaaccaggaaggaaaggttaatactcgtaggaaatctactgacagcgtgcccatttccaagtcaactctctctcgttccctgtcgttgcaagcatctgatttcgatggagcctcatctagtggcaatcccgaggcagttgcactcgccccagacgcatattccaccgggtcctcctccgcatcctctactctaaaaaggaccaaaaaaccgaggccaccttctcttaagaagaagcagaccacgaaaaaaccaacggagacgccaccagtgaaagagacccagcaggaacctgacgaggagtcactggtgccaagcggtgagaacctcgcatccgagacaaagactgaatccgctaagaccgaggggccatctccagcgctactggaggaaacccctctggaacccgcggttggcccaaaagctgcctgtccccttgattctgagagcgctgaaggcgttgttccaccggcctcagggggcggtcgcgtgcagaacagtccccctgtcggtcggaagacgctccctctgacaaccgcgcccgaagccggagaggttactccgtccgactcgggcggacaggaggactccccggccaagggactgagtgtcagactcgaatttgattattcagaggacaaatctagctgggacaatcaacaggaaaatccaccccctactaagaagattggcaagaagcctgtggcaaagatgcccctgcgacggcctaagatgaaaaaaacaccggaaaagttggacaacacacccgcttctcctccgaggtcccctgctgaacctaatgacatacctatcgcaaaaggcacatatactttcgacattgacaaatgggacgaccctaactttaaccccttctcctcaacgtcgaaaatgcaggagtctcctaaattaccccagcagtcttacaattttgatcctgatacgtgtgatgaatcggtagatcctttcaagacgagtagcaagacccctagcagtccttcaaaatccccagcttcatttgagatccccgcttctgccatggaggctaacggggtggatggagacggacttaataagcccgcgaaaaagaagaaaacaccactcaaaacggacacgttccgcgttaagaagtctcctaagagatcgcccctgagtgacccgccatcgcaggaccctaccccagcagcgactccagaaactccacccgtcatcagcgctgtggtccatgcaaccgacgaggaaaaactggccgtgacaaatcagaaatggacttgtatgactgtggacctggaggccgataagcaggattacccacagccctctgacttgtcaacattcgtgaacgaaacaaaattctcctctcctaccgaagaactcgactaccgaaactcctatgaaatcgagtacatggaaaaaatcggtagtagccttccccaggatgacgacgcccccaagaagcaggcactctatcttatgttcgacacgtcccaggagtccccagttaaatcctcccccgttcgtatgtcagagtcccctactccttgcagcggcagtagcttcgaggagacagaggcccttgtgaatactgctgcaaaaaaccaacaccccgttcccagaggactcgccccaaatcaggaatcgcatctccaggttcccgagaaatctagccagaaagagctggaagccatgggcctgggcactccttcagaggcaatcgagataactgcgccagaaggttctttcgcctctgctgacgccctgctgagcagactggctcatcccgtgtcactgtgtggggcactggactatcttgagccagatctggccgaaaaaaatccacctttatttgcacaaaaactgcaggaggaactagaatttgctattatgagaattgaggcactcaagctggcccgccagatcgccctcgcctcacgctctcaccaggacgccaagagggaagctgcccatcccaccgatgtatccatctcaaagacagccttatattcccgtatcgggaccgccgaagtggaaaaacccgcaggattgctttttcagcagcccgacttagattcagccctgcaaattgctagggcagagattattacaaaggagcgggaggtgtctgaatggaaggacaagtatgaagagtccaggcgggaggttatggagatgcgcaagatcgtcgccgagtacgagaagacgatcgcacagatgatagaggacgaacagcgcgaaaaatctgtgagccaccagaccgttcagcagcttgtgctcgaaaaggagcaggcactcgcagacctgaattcagtggaaaagtcactggccgacctctttcggcgctacgaaaaaatgaaagaagtcctggaaggatttcgaaagaacgaggaggtactgaaacggtgcgcgcaagaatacctcagccgggtcaagaaagaagagcaaagataccaagccctgaaggtgcacgcagaggaaaagctcgatagggccaacgctgagatcgcacaggttcggggcaaggcgcaacaagaacaggcggcccatcaagcaagtttgaggaaggaacaactgcgcgttgatgccctagaacggactctggaacagaagaataaagaaatcgaagagcttacaaaaatttgcgacgagttgatcgctaagatgggaaagtcatag

SEQ ID NO: 209128 - DNA, 8847 bp, Artificial Sequence
  Description of Artificial Sequence: Synthetic coding sequence
atgggcaacgagaacagcaccagcgacaaccagcggaccctgagcgctcaaacaccaagatcagcgcagccgcctgggaattcgcaaaatataaagcggaagcagcaggatacgcctggatcccccgatcaccgggacgcctccagtataggttccgttggtctcggcggtttctgcaccgcttctgaatcctccgcgtccttggacccatgtctggtaagtcctgaggtgaccgagcctagaaaagatcctcaaggagctcgtggacccgagggttcccttctgcccagcccgccacctagccaggagcgagagcatccgagttcatccatgccttttgctgagtgcccccccgagggctgcctggcaagccctgctgccgccccagaggatgggcctcaaactcagtcccctaggcgcgagccagcacctaacgcgcccggcgacattgccgctgcattccctgctgagagggattcctccacaccctatcaggaaatcgccgcggtcccttcagctggacgcgaaaggcagccaaaagaggagggccagaaatcatccttctcttttagcagcggcattgaccagtcacctgggatgagtccagtccctctgcgagagcctatgaaggcgccactgtgtggcgagggggaccagcctggcgggtttgagtcacaagagaaagaggctgcgggggggtttcctcccgccgagtctaggcagggagtggcttccgtgcaggtcacccctgaagctcctgctgcggctcagcaggggacagagagcagcgctgtgctggagaaaagccctctcaagcccatggcccctattccccaggaccccgccccgagggcttctgaccgcgagcgcggccagggtgaggccccaccccagtacctaactgatgacctagaattcttaagggcctgccacctgccgcgttcaaattccggagcagccccggaagccgaggttaacgcagcatcacaggagagctgccagcagcctgtgggagcctacttaccccatgccgaactgccgtggggcctcccttcccctgcactggtgcctgaggccggagggtccggcaaagaggctcttgacactatcgatgttcaaggccacccccaaacaggcatgagaggcacgaaacctaaccaggtggtctgcgtggctgccggcggacagcccgaaggaggtctgcccgtttcaccagaaccaagcctcttgactcctactgaggaggcccacccagcatcttcacttgccagctttcctgccgctcagatccccatcgctgtagaggagccaggctcctcctccagagagagcgtgtccaaagctgggatgcccgttagcgctgacgccgccaaagaagtggtcgacgcggggcttgtgggcctcgagcgtcaggttagcgatctcgggtcaaagggcgaacacccggagggtgatccaggagaggtgccggcccctagcccgcaggagcgtggtgagcacctcaacaccgagcaaagccacgaggtgcagccgggcgtgccccccccaccacttccgaaggagcagagccatgaggtgcaacccggagccccccctcccccacttcctaaggcccccagcgagagcgcccgggggccacctggacctacagatggcgccaaagttcacgaggattccacgtcgcccgctgtggccaaagaagggtcccggtcacccggcgacagccccggaggcaaagaagaggcacctgaaccccccgatggaggagatccagggaacctccagggggaggactcccaggctttttcaagcaaaagagatcctgaggttggtaaggatgagctctctaaaccaagtagcgacgccgaatctcgggaccacccgtcatcacactcagcacagcccccacggaagggtggtgccgggcacaccgacgggcctcattcacagactgccgaggccgacgcttccgggctgccacataagctgggagaagaggacccagttttgcctccggttcctgacggagccggggaacctaccgtccctgagggcgctatttgggagggctctggactgcagccaaagtgcccagacacactacagtcccgcgaaggcctggggcgaatggaatctttcttaacgctggagagtgagaagtccgatttccctccaacacctgtggcagaggtggcgcccaaggcccaagagggcgagtccaccctagaaatacggaagatgggtagttgtgacggtgaggggctactgacgagcccggatcagccaagaggccccgcctgtgacgcgagcagacaagagttccacgccggcgtgccacatcccccccagggcgagaacttggccgccgacctggggcttacagctctaattctggaccaagaccaacaggggatcccctcttgtccaggggagggatggattcgcggtgccgccagtgaatggcctctcctctcctccgagaagcatctgcaaccctcacaggcccagccagagacaagcatctttgatgttctgaaagagcaggcacagccacctgagaatggtaaagaaacctctccctcccatcccggattcaaagaccagggcgctgactcctcccagatacatgttcctgtggagccacaggaagataacaacttgcccactcatgggggccaggaacaagccctgggctctgagcttcagtcacaactcccaaagggtacactttctgacacacctacatctagtcctacggacatggtgtgggagagctcattaacagaagagtccgaattgtctgccccgacgcgccagaagttgccggcgctcggggagaagagaccggaaggggcttgcggggacggccaatcgtcacgagtgagcccgcccgccgccgatgtactgaaagacttcagcttggctggaaattttagcagaaaagagacctgttgtactggtcagggccccaataagtcccagcaggccctggcagacgcccttgaggagggctcacagcatgaggaggcgtgccaacgccatcctggggcttccgaagctgccgatggctgttccccactctggggcttatctaagcgcgaaatggcatccgggaacaccggcgaggcccccccctgccagccggattccgttgcgctgctagacgccgtgccgtgccttccagctcttgcacctgcgagccccggtgttactcccacacaagatgcccccgaaacggaagcgtgtgatgagacccaggaggggagacaacagcctgtcccagccccccagcagaagatggagtgctgggctacttctgacgccgagtcccccaagctccttgcgtcgttccccagcgccggagagcagggcggggaggcaggagcagctgaaaccggcgggagtgcaggcgctggggacccagggaaacagcaggctccagagaaacccggggaagcgacactctcttgtggcctgctccagactgagcactgtctgacatcaggggaggaagcttctactagcgcacttcgagaaagttgtcaggcagaacaccctatggcttcatgccaggacgctctgttgccggcaagagagctgggtggcataccacggtcgactatggacttctcaacccaccaggccgtgcctgaccccaaggagctgctcctctctggtcctccagaagtggcagctccagacactccttacttacatgtggattcagccgctcagcggggggccgaggattctggagttaaggcggtttccagcgccgacccacgagctccaggggaatccccttgtccagtgggggagcccccattggcactggaaaacgccgcttccctcaaacttttcgccgggagcctcgcgccccttttacagccaggcgctgccggtggtgaaatacctgctgtgcaggctagttcgggcagccctaaggcacgtaccacagagggtcctgtggactctatgccctgtttggacagaatgcccctgctggccaagggcaaacaggcaacaggcgaagaaaaggcagccaccgctcccggggcaggagccaaagcatcaggggaggggatggccggcgacgcggccggcgaaacagagggcagtatggagaggatgggggagcctagccaggaccctaaacaaggaacgtctggcggtgtcgacacaagctcagaacagatagcaacattgacgggatttcccgatttcagagagcatattgccaaaatctttgagaaaccagtgctgggcgcccttgcgacaccaggggagaaggctggcgccgggcgtagtgcggtaggaaaggatctcaccagacccctcggccctgagaagttgttagacggacccccaggggtcgacgtgactctcctccccgcaccccccgcacggttgcaggtggaaaaaaagcagcaattagccggtgaggcagagatctcccacctggctttgcaggatccagcttcggataagctgctgggccctgcaggacttacctgggagaggaatctccccggggctggcgtgggtaaagagatggcgggggttcctcccacacttcgagaagacgagcgtcctgaaggccccggcgccgcatggccgggtttggaagggcaggcatattcacaacttgaacggagccggcaggagttagcttccgggctcccttcacctgcggcaacgcaagaactgccagtggagcgggccgccgcatttcaagtggctccacattcccacggcgaggaggccgtggcccaagatcggataccatcgggaaagcagcatcaagaaaccagtgcctgcgactcaccacacggagaggacggaccaggcgattttgcccacacaggcgtacccggacacgtccctcgttctacctgcgctccaagcccacagcgagaggtcttaacagtgcctgaggccaattcagaaccctggaccctggacacactgggaggtgagagaagacccggtgtgacagctggcatcctagaaatgaggaacgccctgggaaaccagagcacgccagcccctccaacaggggaggtagccgacactcctcttgagcctgggaaggtcgctggtgctgctggcgaagcagagggtgatattaccctgagcacagccgaaacacaagcctgtgctagcggagatctgcctgaggcaggtacaacccgtaccttctctgtcgtggctggggatctggttctgcccgggtcctgccaggaccctgcctgcagcgataaagctcccggaatggaagggacagctgccctgcatggcgattcacctgcacggccgcagcaggccaaagaacaacccgggcccgagcggcccattccagccggcgacggaaaagtgtgtgtctccagcccacctgagccagatgaaacccatgatcccaaacttcagcaccttgcgcctgaagaactgcacaccgatcgagaatctcctcgtcccgggccctcaatgctgccatccgttcctaaaaaggacgccccgagagtcatggacaaagtgacaagtgacgaaaccagaggagcagaagggaccgagagtagccctgttgctgatgatatcatacagcccgctgctccagcggatctggaatctcccacccttgccgcctccagttatcacggggatgtggtgggccaggtgagcactgatttaatcgcccagagtatttctcctgcagcagctcacgcaggattgcctccctcagccgcagagcacattgtaagtccctccgctcctgctggggaccgggtggaagcctccactcctagctgtcctgatccagccaaggacttaagccgatcttcagactccgaggaggcctttgagacccctgagagtacaactccagtaaaggcgcccccagcgcccccacctccaccgcctgaggtgattcccgagcccgaggtctccacacaacctccacctgaggagcctggatgtggttccgagactgtacctgtgccagacggacctaggagtgacagcgtcgaggggtcgccttttaggcctccctctcactccttcagcgcagtcttcgatgaagataagccaattgccagttctggtacgtacaatcttgacttcgataatatcgaattagtggacaccttccaaaccttggaaccacgggcaagcgacgccaagaaccaagagggaaaggtaaacacacgccgcaaatctaccgactccgtgcccataagtaaatccactttgagtcgtagtctgagtctccaagcttcggacttcgatggggccagttcctcgggtaaccccgaagcagtggccctagctcccgacgcctacagcacaggcagcagctccgcttcatctactctcaagagaaccaaaaaacctaggccaccctcattgaagaaaaagcagaccactaaaaagcctactgaaacccccccagttaaggagacccagcaggaaccagacgaggaaagtctggtgcccagtggagaaaatctggcctcagaaaccaagacagagagtgcaaaaacagaagggcctagccccgccttgctggaggaaaccccactagagcccgctgtggggccaaaagcagcctgcccacttgattctgagtccgcggaaggggttgtgccaccggcctctggagggggccgcgttcaaaacagtcctcctgtgggacggaagacattgccactgaccactgcccccgaagcgggcgaggtgacaccttccgacagtggtgggcaggaagattcacccgcaaagggcctcagcgttaggctggagtttgattatagcgaagataaatcttcatgggacaaccagcaggaaaacccccctcctacaaaaaagatcgggaaaaagcccgtggctaaaatgcccctccggagacccaagatgaaaaagacccctgagaaactagataatactccagcttcaccccccaggtctcctgcagaacccaacgatattccaatcgccaaaggaacatacacctttgatattgataaatgggatgaccctaacttcaacccatttagcagtacatctaagatgcaggagtcaccaaaattgcctcagcagtcctataacttcgatccggacacatgtgacgagtccgtagacccctttaagacctcaagtaagacaccctcgagcccatccaagagcccagccagcttcgagatccccgcatccgccatggaggcaaatggcgttgatggagatggactgaataaaccggccaaaaagaagaaaaccccactcaagacagacacgtttagggtgaagaagagccctaaacgttcccccctgtctgaccctccgagtcaggatccgactcctgcagctaccccggagactccgcctgtgatctcagctgtcgttcacgccaccgatgaggagaagttggccgtgacgaaccaaaagtggacatgtatgacagtcgatctggaggcggataaacaggactatccacagccatcagacctttccaccttcgtcaatgaaactaaattcagtagcccgactgaagagctcgactacagaaactcatatgaaatcgaatatatggaaaagatcgggtcgtcgctccctcaggacgacgacgcacccaagaagcaggcactgtatttgatgttcgatacaagtcaggagtcccccgtaaaatcgagtcccgttaggatgagtgagtcccctacgccttgttcgggctcttcctttgaagagacagaggcacttgtcaacactgccgccaaaaaccaacatcccgtgccgcgcggcctggcacctaatcaggagagccacctccaggtgccagaaaagagtagtcagaaagagctggaggcaatgggcctggggacaccgagtgaagcgatcgagattactgcaccagaaggatcatttgcttctgcagacgctctactgtctcgattggcgcatcccgtaagtttatgcggagcacttgattacctcgagccggatctggccgaaaagaaccccccattgtttgcacagaaattgcaggaggaattggagtttgctataatgaggatcgaggcgctaaagctagcaaggcaaattgctctggcaagtcggagccaccaggacgcaaagcgggaagccgcccaccctactgacgtgtctatttctaaaaccgcactttattccagaattggaactgccgaagtggaaaagcctgctggcctgttgtttcagcaacccgacttggactccgctttacagatcgcccgcgcggagatcatcacaaaagagagggaagttagcgagtggaaggacaaatacgaggagagtaggcgggaggtcatggaaatgcgcaagatcgtggccgagtacgaaaaaaccatcgctcagatgattgaagatgaacagagagagaagagcgtctcacaccaaaccgtgcagcagctggtgttagaaaaggaacaggcgctcgcagacctcaactccgtggaaaaaagcctcgctgacctgtttaggcgctacgagaaaatgaaggaggtgctagaagggtttcgaaaaaatgaagaagtgctaaagagatgcgcccaggagtacttgagtagggtgaaaaaagaggagcagcggtatcaggcccttaaggtgcatgctgaggagaagctagacagggccaacgccgagattgcacaagtacgtggcaaggctcagcaggaacaggccgcacatcaagcctccttgaggaaggaacagctgcgggttgatgccctagagagaactctcgagcagaagaacaaagaaatcgaagagctgactaagatctgcgatgagctcatcgcaaaaatggggaagagctag

SEQ ID NO: 209129 - DNA, 8586 bp, Artificial Sequence
  Description of Artificial Sequence: Synthetic coding sequence
cagcggaccctgagcgcccagaccccccggagcgcccagccccccggtaattcgcagaacattaagcgcaagcagcaagacacgccgggctcacccgatcatagagatgcctctagtattggtagcgtgggactgggcgggttttgcaccgccagcgaatctagcgcaagtttggatccttgcctcgtgagccctgaggttaccgaaccccggaaggatccccagggtgcccgaggacccgagggctcgctgctaccctcgcctccacctagtcaagaacgcgagcacccttcttcatctatgcccttcgccgaatgcccacccgagggctgtcttgcctctccagccgccgcaccggaggatggaccacaaactcagtctcccagaagagagcctgccccgaatgcgccaggcgacattgcggcagcgtttccagctgagcgagactcgagcaccccctatcaggagattgccgccgtgcctagcgcgggtagggaacgtcagccgaaggaggagggacaaaagtcaagcttctccttttcaagcggaattgaccagagccctggcatgtctccggttccactaagagagccaatgaaagctccgctctgtggtgaaggtgatcagccaggcggtttcgagtctcaggaaaaggaagcagcaggcggattcccccctgctgagtcacgacagggtgtggcaagcgtgcaagtgacccccgaggccccggccgcagcgcagcagggcaccgagtcgtctgccgttctcgaaaaatcccctctcaagcctatggccccaatcccccaggaccctgcccccagggcctccgacagggagagaggccagggagaagcaccgccccagtacctgaccgacgacctcgagtttctgagagcatgtcacttacccaggagtaattccggggccgcccctgaggccgaagtgaacgcggcctctcaggagagctgccagcagcccgtaggtgcctacctgcctcatgctgagctcccctgggggctgccctcaccagcccttgtccctgaggccggtggtagtggtaaagaggcacttgatacgatagatgtgcaaggccacccacagaccggcatgcgtggcacaaaaccgaaccaggtagtttgcgtagccgccggaggtcaacccgaaggcgggttgcctgtgtctccggagccatcgttgcttaccccaacggaggaagcccatcccgcctcctccctcgcttcattcccagccgcccagatccccatagccgtggaagagcccgggtcatcaagtagggaatcagtgagtaaggctggaatgcccgtttccgctgatgctgcgaaagaagtggttgacgccggattagtcgggctggagaggcaagtcagcgacctgggtagcaagggcgagcaccctgaaggcgatcctggtgaggttccagccccctctcctcaggaacgaggcgagcacttgaatactgagcagtcccacgaagtacaacccggcgtacctccccctccgctaccaaaggaacagtcccacgaggtgcagcccggcgctcctccacccccattacccaaggctccgtccgagtctgctcgcggtcctcctggcccaaccgacggggcaaaggtccatgaagattcaacttctcctgctgttgctaaagaggggagtagaagccctggcgacagtcctggcggaaaagaggaagcccctgaacctccggatggtggggacccaggtaatctgcaaggcgaagattcccaggctttctcttcaaagcgggaccccgaggtcggcaaagacgagttgtccaaaccatccagtgacgctgagtccagggatcacccttcctcgcacagtgctcagccccctaggaaagggggggctgggcacacggacgggccccactcacagacagccgaagctgacgccagcggtctgcctcacaagctcggagaagaggatcccgtcctgccgccagtgccagacggtgccggggagcctacagtccccgagggggccatttgggaaggctcaggcctccaaccaaagtgccccgatacactccaatcccgcgaaggcttgggcagaatggaaagtttcctcaccttagagtcagaaaaatccgactttccccctacacccgtcgccgaggtcgctccgaaggcccaagagggagaatctactctggaaattcggaagatgggatcgtgcgatggagaaggtctcctgacttcaccagaccagccgaggggaccagcatgcgatgctagccggcaggagttccatgctggggtaccgcatcctccccagggcgaaaatctcgcagcagatctgggtctaaccgccttaatactggaccaggatcaacagggcattcccagctgccccggcgagggctggattcgcggagcggcaagtgagtggccactactgagctccgagaaacaccttcagcctagccaggcccagcctgaaaccagcattttcgacgtgctgaaggagcaggctcagccaccagagaacggcaaggagacatcaccttcccacccaggtttcaaggaccagggagctgactccagccagatacacgttccagtggaacctcaggaagacaacaacctgccaacacatggcggacaggaacaggctctaggctctgaacttcagagtcagctgcccaagggaaccctctctgacactccaacatcctcacccaccgacatggtttgggaatcaagcttgaccgaggaatccgaactgagtgctcctacaagacagaagctacccgccctcggtgaaaaacggcccgagggggcttgtggggatggacagtcctccagagtgtcaccacctgccgctgacgtactcaaggatttctcactggccggaaactttagccgtaaggagacatgctgtactggccaaggtcccaataagagtcaacaggccctggccgatgccttggaggaggggtctcagcacgaggaggcgtgtcagcggcatcccggcgcgtctgaagctgcggatggttgttcacccctctggggattgagcaaacgcgagatggcctcagggaatactggcgaagcccccccttgtcagccggattccgtcgcactgcttgacgccgtcccttgtctgcctgccttggctcccgctagcccaggcgtcacacccacacaggatgcgccagagactgaggcttgcgatgagacgcaggaaggtcggcagcagccagttccggctcctcagcagaagatggagtgctgggcaacctctgacgccgaaagccccaagctactggcctcattcccgagtgctggagaacagggaggggaggctggggcagccgagactggcggatcagccggcgcaggcgatcccgggaaacagcaggcacccgagaagcccggagaggcaacattgagttgtggtctactccagactgagcattgcctgacttcaggagaggaagcgtccacttccgctctgcgagagtcctgtcaggccgagcaccctatggcatcctgccaggacgcactgctcccagcccgtgagttggggggaattccccggagcactatggacttttccacccaccaagccgtcccagacccaaaggaactcctcctctccggcccgccggaggtcgctgcccctgacaccccatatctccacgttgacagtgctgcccagcgcggagctgaggacagcggcgtgaaagctgtttcctctgccgatcctcgagcacccggcgagtccccgtgtccagttggggagccgcccttggcgctggagaatgctgcaagtctcaagctgtttgctggaagtctcgcaccccttttacaacctggggccgcgggaggagaaatccctgcggtccaagcttcctccgggtctcctaaagctcgtaccacagaaggaccggtggacagcatgccatgcttggacagaatgccgctgcttgctaaaggcaaacaggctaccggggaggaaaaggccgcaacagctccaggcgcaggggccaaggcctcaggggagggaatggctggcgacgccgccggcgaaactgaaggttcgatggaacgtatgggggagcccagtcaggacccaaaacaaggtacttccggtggggtagatacctcaagtgagcaaattgctactctgaccggtttccccgactttagagagcacattgctaaaatttttgagaagcccgtcctgggcgccctggctacacctggagaaaaggctggggccggccgcagtgctgtcggaaaagacctgacaaggcccctcggaccagagaagctgctggacgggccaccaggagtggatgttactctgcttcctgcccctcctgcacgcctgcaggtggagaagaaacagcagctggcaggggaagccgagatttctcacctagccctgcaggaccctgcttcagataagctgctgggccccgcagggctcacatgggaaagaaatctgcccggcgcaggagtagggaaggaaatggccggcgtccctccaactctacgagaagatgaacgaccggagggtccgggcgccgcctggcctggtctggagggccaggcctattctcagctggagcgatccagacaggaattagcaagtggcctgccctctcccgccgctacccaggagttgcccgtggaaagggcagcagccttccaagtcgcaccacactctcacggagaagaggccgttgcccaggacagaatcccctctggaaaacagcaccaagagacaagcgcctgcgacagccctcacggcgaagatgggccaggcgacttcgcccacacaggcgtgcctgggcatgttcctagatccacatgtgctccctcccctcaacgggaagttcttactgtaccagaggccaatagtgagccttggacactcgatactctgggcggcgagaggcggcctggcgtcactgcaggtatcctggagatgaggaatgccctgggcaatcagtctacacctgccccccccacaggggaggtcgccgataccccccttgagcccggtaaggtggccggagccgctggagaggcagagggcgatattacacttagcacggcggaaacccaagcctgcgctagcggggacttgccggaggccggcacgactcggacctttagcgtggtggccggcgacctcgttttgccagggtcctgccaggaccctgcatgcagcgacaaggcccctgggatggaaggcactgcagcccttcacggggactcccccgccaggccacagcaagctaaggagcagcccggacctgagaggccgatccccgctggagatggaaaagtgtgtgtatcttcccctcccgaaccggacgaaactcacgaccccaaactccagcatcttgcaccagaagagctgcatactgaccgcgagtcgcctaggcccggcccatccatgctgccgagcgtgcctaagaaagacgctcctagggtgatggataaggtaactagcgatgagacccgaggggccgagggtaccgagtcctcgccagtggccgatgacattattcaacctgccgccccagccgatttagagtcacccacgttagcagctagctcgtaccacggggatgtagtaggccaggttagtaccgacctgatcgcacagtcaatttccccagctgcggcccacgcaggcttgcctccgagtgccgccgagcatatagtaagcccatctgccccagccggtgaccgggtggaggcgtccacaccatcttgccccgatcccgccaaggacctctcaagatctagtgactctgaggaagccttcgaaactcctgagagcacaactcccgtgaaagcgccacccgctccccccccacctccgcccgaagtgataccagagccagaggtatccactcagcccccaccagaggaacctgggtgcggctcagaaacagtcccagtccccgatggcccccggagcgattcagtagaggggtcgccttttaggcccccctctcactcattcagcgctgtttttgatgaagacaagcctatagctagttcaggcacatacaacctggatttcgataacatcgagctggtggatactttccaaacacttgaacccagagccagcgatgctaaaaaccaggaaggaaaggtcaacacaaggaggaaatctacagactccgtcccgatctctaaatcaacattatcaaggagtcttagtctgcaagctagcgactttgacggggcttcaagctccgggaatcccgaagcagtcgctctggcccccgacgcctactccactgggtcctcttcagcttctagtaccctaaagaggaccaaaaagcccagacctccaagtttgaaaaaaaaacagacgaccaagaagcctaccgaaacccctcccgtgaaagagacccaacaggaaccagacgaggaatccctggtgcccagcggtgagaacctggcatctgaaacaaaaactgagagtgccaagaccgaaggacccagtcctgctctcctggaagagaccccattagaaccggccgtgggcccaaaggctgcatgtccactggattctgaatcagcagaaggtgttgtcccccctgcatcaggaggcgggcgggtgcagaactccccaccagtcgggcgaaagacacttcccctaactaccgcccctgaggctggagaggtgaccccctctgacagcggaggccaggaggacagccctgccaaaggcctttccgtgcgcctcgaattcgattactccgaagacaagtccagctgggacaaccagcaggagaaccctccccctaccaagaaaattggaaagaagccggtggccaagatgcctctgcgccgcccaaagatgaagaaaacgcccgaaaagttggataatactcccgcgagcccaccacgatcgccagccgagcctaatgacatacccatcgcaaaggggacctatacatttgatattgataagtgggatgatcctaactttaaccccttctcgtcgaccagcaaaatgcaggagagcccaaagctgcctcagcaatcctataactttgaccccgacacgtgcgatgagtcggtggatcccttcaaaacatcctctaagactcctagtagtcctagcaaatccccagcgtcttttgagatccctgctagtgccatggaggcgaatggcgtggatggcgatggcttgaacaaacccgccaaaaagaagaagacaccactcaagacagatacctttcgtgtgaaaaaatccccaaagaggtcacccctttcagatcctccctcacaagaccccactccggctgccaccccagaaacccctcccgtgatctcagcagtggttcatgccacagacgaagaaaaactcgccgtgaccaaccagaaatggacttgcatgactgttgacctggaggccgacaaacaagactatcctcagcccagcgacctgagcacttttgtgaatgaaaccaagttctcctcaccaacagaggaactcgattatcggaatagctatgaaattgaatacatggagaagatcgggagctcccttccccaggatgacgacgctccaaaaaagcaggctctgtatctgatgtttgacacatcgcaggagagccctgtcaagtccagtcccgtcagaatgtcggaaagtcctacaccatgctctggatcttcttttgaggagacagaggccctcgtgaatacagccgcaaagaatcagcatcctgtcccaaggggtttagcacccaaccaggagtctcatcttcaagtccctgagaagtcatcccaaaaggaattagaggcaatgggcttaggtaccccttccgaggccatcgagattagagaggccgcacatcccaccgacgtctccatttcgaaaaccgccctgtatagccggattggtacagcagaagtggagaaaccagccggtcttctttttcagcagccggatcttgactccgccctccaaattgcaagagccgaaatcattaccaaagaacgcgaagtgtctgagtggaaagacaagtacgaggagtcaagacgagaagtgatggagatgcggaaaattgtggcagagtacgaaaagacaattgcccaaatgattgaggatgagcaacgagagaaatcagtgagccaccagaccgtgcaacagctggtgctagagaaggagcaagctcttgccgacctcaatagcgtagagaaaagcctggcggacctgtttagacgttacgagaagatgaaagaggtgctggagggcttccggaagaatgaagaagtgctgaagcgctgcgcccaagaatacctgagtcgagtaaaaaaggaggaacaaagataccaggcattgaaggttcacgctgaagaaaaactcgacagggcaaatgccgagattgctcaggtgcgtggcaaagcccagcaggagcaggccgcccaccaggcctccttgaggaaggagcaactgcgggtggatgcactggaacgcactctggagcaaaaaaataaggaaattgaggagctaaccaagatctgcgacgaattgatagcaaagatgggcaagagttag

SEQ ID NO: 209130 - DNA, 3285 bp, Artificial Sequence
  Description of Artificial Sequence: Synthetic coding sequence
atgggcaacgagaacagcaccagcgacaaccagcggaccctgagcgcccaaacccctaggagcgcccaaccacctgggaatagtcagaatataaagcggaagcagcaggatacgcccgggtccccagatcacagagatgccagcagctcgcctgtggccgacgatatcattcagcccgcagctcccgccgaccttgaatcgcctactcttgcggcaagctcgtaccacggagacgtggtgggccaagtctctactgatctcatcgcacagaggtctagtgactctgaagaggcatttgaaacacccgaatcaacaacacccgtcaaggcccccccagcaccacctcccccacccccagaggtaattcccgaaccagaggtatcaacccagccacctcctgaagaaccaggttgcggttctgagacggtcccggttcctgacggcccgcgttctgactctgtggagggctcgccttttagacctcctagccactcattcagcgcagtgttcgatgaggataaacctattgcaagttccggcacctacaatctggattttgataacattgaactggtggatacgtttcaaacactagagcctcgggcctctgatgctaagaatcaggagggcaaagtcaacaccagacgaaagagtacagactctgtgcccatcagcaagagcacacttagccggtctctgagtctgcaggctagcgacttcgatggtgcatcatcctcaggcaaccctgaagcagtcgccctcgcccccgatgcctactctactggcagctcctccgcctctagtacactcaagagaactaaaaaaccccgccccccctcactaaagaaaaagcagacaaccaaaaaacctacggaaacaccgcctgtgaaggaaacacaacaggaacctgacgaggagtcactggttccttccggggagaacctcgcctccgaaaccaagacagagtccgccaaaacagaagggccatctccagcacttttggaagagacacctctggaaccagccgtggggcctaaagccgcctgtcctctggatagcgagagcgcagagggggtggtgccacctgcctccgggggtgggcgcgtccagaatagcccccctgtggggcgcaaaaccttgccccttactaccgcccctgaggccggggaggtgactcccagcgacagtggaggacaggaggattcccctgccaaggggctcagtgtacggttagagtttgactatagtgaggataaatccagctgggataaccaacaggagaacccgccccctactaaaaagatcgggaagaaacccgtggccaaaatgccattgcgccgccccaagatgaaaaaaacccctgaaaaactggataatacacccgcatccccccctaggtcaccagccgaaccgaacgatatacctatagccaaagggacatacacttttgacatcgataagtgggatgaccctaatttcaaccccttctcaagcacatcaaaaatgcaggaaagtccgaaactgccccagcaatcctataatttcgaccctgatacctgtgacgaaagtgtcgatcccttcaagaccagctctaagactccttcttcaccctctaagtcacctgcaagctttgaaattccagcctccgcaatggaggcaaacggggtggacggcgatgggctgaataaaccagccaaaaagaaaaaaacccccctgaagacagatacatttagagtgaagaagagtccaaaaaggtcaccattgtcagatcccccctcccaagacccaacccctgccgccacaccagaaacccctcctgtcatttcagctgtggtgcacgccactgacgaggagaaactggctgtgactaatcagaagtggacgtgtatgacagtcgacctggaagccgataaacaggactatcctcagccttctgacctgtccacctttgtgaatgaaacaaaattttcatcaccgactgaggagctggattacagaaattcttacgaaatagagtacatggagaagataggtagctcactgccccaagatgatgatgcaccaaagaagcaagccctgtacctcatgttcgatacctcacaggaatcccccgtcaaatcgagccccgtacgtatgtcagaaagtcctactccttgttccgggtcctcttttgaagagaccgaggcattggtgaataccgcagcgaaaaaccagcatccagtgcctcgcggtctggctccaaatcaggagtcccatctacaggtccccgagaagagtagtcagaaggaactggaggctatgggtcttggcaccccctctgaggccattgaaatcacggctcctgaaggcagctttgcttctgccgacgccctgttatctagactggcccatccagtgtctttatgtggcgcgctagattatctggagccggatttagccgagaagaatccacccctttttgcccagaaactgcaggaagaacttgaattcgctatcatgcggattgaggctcttaagcttgccagacagattgctttggctagcagatcgcaccaggacgctaagcgggaggccgctcaccctacggacgtgtcaatcagcaagacggccctgtacagccgcattggaactgccgaagtggaaaaaccagcaggcctgctgtttcagcagccggacttagattcagccctacagatcgccagagctgagatcattaccaaagagcgagaagtttctgaatggaaggacaagtatgaggaatcccgtagagaggtaatggaaatgaggaagatcgtcgctgagtacgaaaaaacaatagcccagatgattgaggatgagcagagggaaaaaagtgtttctcatcagaccgttcaacagctagtcctcgagaaagagcaggcgctggccgacctgaactctgttgaaaaaagcctggcagatctttttcgacgctatgagaaaatgaaggaagtcctggaagggttccgcaagaacgaggaggtgctgaaacggtgtgcccaggagtatctgagccgtgtcaaaaaagaagaacagcgttaccaggccctgaaagtgcacgctgaagaaaagctagaccgagccaatgcggagatcgcccaagtccgcgggaaggctcagcaggagcaagctgcccaccaggcatcactccgaaaggagcagcttcgcgtcgacgccctggagagaacattggagcagaagaacaaggaaatagaggaactcactaagatctgcgatgagctaattgctaaaatgggtaagagctag

SEQ ID NO: 209131 - DNA, 2991 bp, Artificial Sequence
  Description of Artificial Sequence: Synthetic coding sequence
atgggcggcagccagagcctgcagcccgcccccgccagcgacctgaatctagaagcaagcgaggcaatgtcttccgatagtgaggaagcattcgagacccccgagagcaccacaccagtgaaagccccacctgcaccgccccctcccccacccgaggttatcccggagcccgaagttagcacacagcccccccccgaggaacccggatgtggaagcgagactgtcccagtcccagatggccccagatccgatagcgtagaagggagtccctttcgccccccctcccacagtttcagtgccgtcttcgatgaagacaagccgattgccagctcaggcacttacaatcttgactttgataacatcgaacttgtggacacatttcagacactcgagccccgggcatccgacgcaaaaaaccaagagggtaaagtgaatacacggagaaagagcaccgattccgtgccaatctctaagagcacactgtctcgaagtttaagtctgcaagcatctgacttcgacggcgccagcagctcgggcaaccctgaggccgtggccctcgcaccagacgcctactccactggatcttccagcgctagttcgactctgaaaaggactaaaaaaccacgacctcccagtctgaagaagaagcagactactaagaagccaaccgaaacaccccctgtgaaggagacgcagcaggagccagacgaagaatcccttgtgcctagcggagagaatctagcctctgaaaccaagacggagtccgccaaaaccgaaggaccttcgcctgcactattagaagaaaccccactggagcctgccgtcggtcccaaggcagcctgccctctggattcagaaagtgctgagggagtggtacctcccgcctcgggcggcggacgcgttcagaactccccaccggtcgggcggaaaaccctccccctgacgactgcacccgaggccggcgaggtcaccccaagtgactcggggggacaggaagattcccccgctaaagggctctccgtcagactggagtttgattactctgaagacaaatcatcttgggacaaccaacaggagaatccacccccaacgaagaaaataggtaagaaacccgtggccaagatgcctctccggagacccaaaatgaagaaaacacctgagaaactggataacaccccggcctcccccccaagatcccctgctgaacctaatgatatccccattgctaagggcacctacaccttcgacatcgacaagtgggacgaccccaactttaaccctttcagttccacttctaaaatgcaggaaagccccaagctcccgcagcaaagctacaattttgaccctgatacatgtgacgagagcgtggacccttttaaaacctcgtcaaagactccttcatcgcctagtaaaagtcctgcgagcttcgagatccctgctagcgccatggaagcaaatggtgtggacggagacggtttgaataagccagcaaagaaaaaaaagaccccactcaaaaccgacacttttcgggttaagaagtcccctaagaggagtcccctctccgacccccctagtcaggaccccactcctgccgctaccccagaaacaccccctgtgatatccgctgtggtacacgctactgacgaagagaaactggcagttacaaaccagaagtggacttgtatgacagtagatctagaggctgacaagcaggactatccgcagcctagcgacttgtcaacattcgtgaacgaaacgaagttttcatcaccaactgaggaactcgattatcggaactcttatgagatagagtacatggaaaagatcgggtcttccctgccacaagacgatgacgcacctaaaaagcaggcactgtacctgatgtttgatacaagccaggagtccccagtaaaaagctctcccgttaggatgtcagaatcgcctactccctgttccggctccagcttcgaagaaactgaagcactggttaacacagcagccaagaatcagcaccctgtcccacgtggacttgccccaaatcaagagtctcacctgcaggttccggagaaatccagtcagaaagaattagaggcaatgggtttagggacgccaagcgaagcgattgagataaccgctccagagggctcattcgcctcagctgacgcccttctgtcccggctggctcacccagtgtccctgtgcggcgccctcgactatctagagcctgacttggccgagaagaatcctccactgtttgctcagaagctacagcgcgaggccgcacaccccacagacgtgagtatttctaaaactgccctctatagtcgaatcggcacagccgaggtggagaagccagcaggactgctgttccaacagcccgacctggattccgctctccagattgcaagagctgaaatcattactaaagaaagggaagtttcggagtggaaagacaaatatgaagaatctcgccgagaggtgatggaaatgcgcaaaatcgtggcggaatatgagaagacaatcgctcagatgattgaggacgagcaacgcgaaaaatcggtgtctcatcagacagtgcaacagttagttttggaaaaggagcaagctctggctgacctgaacagcgtggaaaagtcactggccgatctgttcaggcggtacgagaaaatgaaagaagttcttgagggattccgcaaaaacgaggaggtcctcaagcggtgcgcccaggaatatctgagtagagttaagaaggaggagcagcgctaccaggccctcaaagtgcacgcggaggagaaactggaccgcgctaatgctgagattgcacaggtcagaggcaaagcacagcaggagcaggctgctcatcaagcctctctgcgcaaagaacagcttagagtagacgcactagagcgcacccttgaacagaaaaataaggagatcgaggagcttaccaaaatttgcgacgaactcattgctaagatgggtaagtcctag

SEQ ID NO: 209132 - DNA, 1716 bp, Artificial Sequence
  Description of Artificial Sequence: Synthetic coding sequence
atgcccctgcggcggcccaagatgaagaagacccccgagaagctggacaatacacccgcttctccgcctcggtcccctgctgagcccaatgatattcctattgcaaaaggaacatacaccttcgatatagataagtgggacgaccctaacttcaatcccttcagctccacatcaaaaatgcaagaatccccgaaactgccccagcaatcctacaatttcgatccagatacctgtgatgagtctgtggacccttttaaaactagtagcaaaacccctagcagcccttccaagtcgccagcctcattcgagattcctgccagcgctatggaagcaaacggggtcgacggggacgggctcaataaacccgctaaaaaaaaaaagacgcccttgaagaccgtcaagaagtcaccgaaaagatctcccctctccgaccctccatcccaggaccctacccccgcagcaactcccgaaacgcctcctgtcatctcggctgtggtgcacgctactgatgaagaaaaactcgccgtgaccaatcagaagtggacctgcatgaccgtggatctagaggcggataaacaagattatccacaaccttcagacctctctacatttgtgaacgagacgaaatttagcagtcctaccgaggagctggattatcggaattcatacgagatcgaatacatggagaagattggctccagtctgcctcaggatgacgacgctcccaaaaagcaagccttgtacctgatgttcgacaccagccaggagagccccgtgaaaagctctcccgtgcgaatgtccgagtcaccaacgccctgctcaggatcctcttttgaggagacagaggcgctggtgaacactgccgctaagaaccaacatcctgtccccagggggctcgcccccaaccaggagtctcatctccaagttcccgaaaagtcatcccagaaagagcttgaagcgatgggtcttgggaccccatccgaggctattgaaattagggaggctgcgcaccccaccgacgttagtatctcgaagacagcactgtattcacggattggaacagccgaggtagaaaagccggccggactgctcttccagcaacctgatctcgactctgctttgcagatagcacgagccgaaattattacaaaagaacgggaggtgagcgaatggaaggataagtacgaggagagtcgaagggaagtgatggagatgcgtaaaatcgtggccgaatatgagaaaacaatcgcccaaatgatcgaagacgagcagagggagaagagcgtgtctcaccaaaccgtccagcagctggtgctggaaaaggaacaggctctcgcagatctcaacagcgtggaaaagagcctcgccgacctgtttaggagatacgagaaaatgaaagaagttctggagggcttccgcaagaacgaggaggtgctgaaaagatgtgctcaggaatacctgtcaagagtcaagaaagaggagcagcgctatcaggcactgaaagtgcatgcagaggagaaactcgatcgagccaacgccgaaattgctcaagttagaggtaaagcccagcaggagcaagccgcccaccaggcttcactgcgaaaggagcagttgcgggtggatgctctcgagcgaacactcgagcaaaaaaacaaagaaattgaagaactaaccaaaatctgcgacgaactgatcgccaaaatgggcaaatcctag

SEQ ID NO: 209133 - DNA, 8847 bp, Artificial Sequence
  Description of Artificial Sequence: Synthetic coding sequence
atgggcaacgagaacagcaccagcgacaaccagcggaccctgagcgctcaaactccgagatcagcccagcccccaggaaatagccaaaatattaagcgtaagcagcaagacaccccaggttcacccgaccatagagatgcctcgagcattggctcagtggggcttggggggttctgcaccgctagtgaatccagcgcctccctggacccatgcctggtgtctccggaggtcacagagcccaggaaagacccgcagggggctaggggccccgaaggatcccttctgccttcacccccacccagccaggagagggaacacccttcaagcagtatgccctttgctgagtgccccccggagggctgtttagcaagccctgcggcggcccctgaggacggcccccagactcagtccccccggcgcgagccggcccccaacgcacctggggacattgcggcagctttccctgcggaacgcgactccagcactccctaccaagaaatagctgccgtgccatcagccgggcgggagagacagcctaaggaggaagggcaaaagtcatcattctccttctcctcaggtatcgatcaatcacccggcatgtcacccgtgccgctgcgcgaaccaatgaaggctcccctatgtggcgaaggggatcagcctggcggatttgagtcccaagaaaaggaggccgcaggcggctttccccccgcggaatctaggcagggagtagcttccgttcaagtcacaccggaggcacctgcagcggctcagcaaggaacagaatcctcagccgtcctcgagaagagcccgctgaaacctatggcacctatcccccaggaccccgccccgcgcgcctctgaccgcgaaagaggacagggcgaagcgcccccacagtacttgaccgacgacctggaatttctgcgcgcttgccatctgccacgatctaattcaggcgctgcgcccgaagccgaggtcaacgcggcatcccaggaatcttgtcaacagccggtcggcgcatatctgccacacgccgagctcccctggggtctgcccagccccgcactagttccggaggccggcggttccgggaaagaagccctcgacacaattgatgttcagggtcaccctcagacaggcatgcgcgggacaaaaccaaaccaagtggtgtgtgtggccgcaggaggtcaacccgagggcggcttgccagttagccccgagccctccttgcttacgccgaccgaagaggcccaccccgcaagctccctggccagctttccagccgcccagattcccattgccgtggaggagcctggatcttcttcccgggagagtgtctcgaaggcaggaatgcccgtgtctgcagatgccgctaaggaagtggtggacgcaggcttggtgggactggagagacaggtctccgatctgggatccaagggagagcacccggagggcgaccctggcgaagtgcctgcccctagccctcaggaaaggggggagcacctgaacaccgagcagtctcatgaggtccaacccggtgttcccccaccaccactccctaaggagcagtcacacgaagtacaacccggcgccccaccaccacccttaccaaaagctccgtctgagtccgccaggggccccccaggccccacggatggggctaaagtgcacgaggactcgacttcacctgcagtggctaaagaagggtcaagatctcctggagactccccaggggggaaagaagaagcacctgagccccctgatgggggggatccaggcaatcttcagggggaggattcgcaagccttttcctccaaacgggatcccgaggtgggcaaggacgagctcagtaaaccttcaagcgatgccgaatctcgggatcacccttcttctcacagcgcccaaccgccccggaagggaggcgcaggccatacagacggacctcattcccagactgccgaggccgatgcttccggtctgccacacaagcttggagaagaagacccagtattacctcctgtgccagacggggctggggagccaacggtgccggagggcgccatctgggagggctccggactgcagccaaaatgccctgatactttgcagtccagagaaggactgggtagaatggagtcttttcttaccctggaaagcgaaaagtcggatttccctccaacacctgtggccgaggtggctcccaaggcacaagagggagagagcacactggagataagaaagatgggcagctgcgatggtgaaggattgctgactagtcccgaccagccgcgagggccagcttgcgacgcctcccgccaagaattccacgcgggagttcctcacccccctcagggcgaaaatctggcagcggatctgggcctgacggccttgattctggaccaggaccagcagggcatcccctcttgtcccggcgagggctggattcggggcgccgccagcgagtggcctttgttgtccagcgaaaaacacctgcaaccttcccaggcacaaccagagacatctatatttgacgtgctgaaggagcaggctcaaccacccgagaatggcaaggaaacttctccttcacaccctggcttcaaagaccagggagctgattcttctcagatacatgttccggttgaaccacaagaggataacaaccttcctactcacggcggccaggaacaagccctgggatcagaacttcaatcccagctaccaaaaggtacacttagcgacactccaacgtctagtcccacagatatggtgtgggagtcgagcttgacagaggagagcgagctgagtgcccccacacggcagaaactccccgcattgggggaaaagcggcctgagggagcgtgcggcgatggccaatcttcaagggtctccccacctgccgccgatgtgctgaaagatttttcacttgccggtaatttcagcaggaaagagacgtgctgtactggccaggggcctaataaaagccagcaggctttagccgacgctctcgaggagggatcccagcatgaagaagcttgccagagacatcctggagcatcggaggcagcggacggatgctcacccttgtggggcctctctaagcgcgagatggctagcggcaacaccggagaggccccaccctgtcaacccgacagtgtggcactgctggacgccgtgccatgccttccagctcttgcacctgcctcacctggagtaacccctacacaggacgcgcctgagaccgaagcctgcgatgaaacccaggaggggagacagcagcccgtacctgcgcctcagcagaaaatggaatgttgggcaacgtcggacgccgagagtcccaagttgctggccagctttccaagcgccggggagcagggaggcgaagccggggcagccgaaaccggaggcagtgccggagcaggcgacccaggtaaacagcaggcgcctgaaaagccgggcgaagccacgctcagctgcgggttactgcagacagagcattgcttaacgagcggcgaggaagccagcacgagcgcactgcgcgagagttgccaggccgagcaccccatggccagttgtcaggatgcattactgcccgcccgcgaactggggggtattccccgctcaaccatggacttctccacccatcaggccgttccagaccccaaagagttactgctaagcgggcccccagaagtggctgctcctgacacaccttatttgcatgtcgactccgccgcacagcgcggagccgaggattcaggtgttaaggctgtgagctctgcagatcctagagcccctggcgagagtccatgtcccgtgggagaaccacctcttgctctcgagaacgctgcctctcttaaactgttcgctgggagccttgctcccctgctgcagcctggagctgccggaggcgagataccagcagtgcaggctagttccggaagccccaaggcgagaacgacagaggggcctgtcgacagcatgccatgcctagataggatgcccctcctcgctaaaggaaaacaggcaacaggagaggagaaagctgccacagccccaggcgctggcgcaaaagcctcgggcgaaggaatggccggagacgctgccggtgagactgaaggctccatggaacgaatgggcgaaccttctcaggatcctaagcagggcaccagcggcggcgtggatacctcttcagagcagatcgccaccttgacagggtttccagatttcagggaacatatcgccaaaatttttgaaaaacccgtgctgggcgccttggctacacccggcgaaaaggccggggctggtagatcggctgtcggcaaagacttgacacggcctctagggcctgaaaagttgttggacgggcctcccggtgtagatgtgaccttgcttcccgctccccccgcaagactgcaagttgaaaaaaaacagcagctggccggggaggcagagatttcccacctcgctctgcaggaccctgcttcagataagctcttgggcccggccgggctgacctgggaacgaaatctgccaggcgctggagtaggaaaggagatggcgggagtgccacctactctgagagaggacgagagaccagaaggtcctggtgcggcatggcctggcttggaaggccaggcctattctcagttagaaaggagccggcaggagctagcaagcggtctgcccagtcctgctgccacccaggagctgcccgttgaacgggccgccgccttccaggttgccccccattcacacggcgaagaagctgtggcccaggatcggattccatctggcaaacagcaccaggagacatccgcgtgtgatagtccacatggggaagacggccccggcgactttgctcataccggcgtgcctggacatgtgccaagatctacttgtgcaccatcaccccagcgcgaggtattgactgttcccgaggcaaattccgaaccttggactctcgatacactcggaggcgagcggcgtccaggagtcaccgccggcatcctggaaatgagaaacgccctggggaatcagagtactcccgcaccacccacaggcgaagtcgcagacactcccctggagccaggcaaagtcgctggggccgcaggtgaagcagagggggacattacactatctacagcagagacgcaagcttgcgcttcaggggaccttccggaggcggggaccactcggacgttttccgtagtggcgggcgatttggtgctgccaggaagctgccaagaccctgcttgttctgataaagcaccgggcatggagggcactgccgccctgcacggggactcaccagctcggccacagcaggccaaagagcagccaggccctgaaagaccaatcccagccggggacggcaaggtttgcgtgagttcacctcctgagccggatgagacgcacgatccaaaactgcaacacttagcaccagaggaactgcacaccgaccgcgagagcccacggcccggaccctcaatgctgccttcagtaccaaagaaggacgctccccgggttatggataaggtcacctctgacgaaactcgtggtgccgagggaacggagagcagtcccgttgccgacgatataatccaacccgcagcgcccgccgatctcgagtcccctaccctcgcagcatcatcctaccacggcgacgtggtagggcaggtttccaccgacttgatcgcccagtccatcagcccagctgctgcccatgccggcctgcctccatccgcagctgaacacatcgtgtctccctcagccccagcaggtgaccgtgtcgaggcttccacccctagctgtcccgaccccgctaaggatttgtctcgcagcagcgacagtgaggaagcttttgagactcctgagtccactacccctgtgaaggccccccccgctccccctcctccccctcccgaagtgataccagagcccgaggtctccacacagccaccccctgaggaacctggttgcgggtccgaaacggttcccgtcccagatggaccacggagtgattcagtggagggctcccccttccgtccgccttcacatagttttagcgccgtattcgacgaggacaagccgatcgcatctagcgggacatataacctcgattttgataacattgaacttgttgatacgtttcagaccttggagcccagggcaagcgatgccaaaaaccaggaagggaaagttaatacacgccggaaaagtaccgatagcgtccctatttcaaagagcacacttagtcgctctctgagcttgcaggcttcagatttcgacggagcctctagcagcggaaatccagaggctgtggccctggctcccgatgcatactcgaccgggagctcgtccgccagttcaaccctgaaacgtacgaaaaagccaaggcccccatcactcaaaaagaagcagactacaaagaagcctactgagacccccccggtgaaggagacacagcaggaacccgacgaagagagcctcgtcccgtctggagagaacctagcctctgaaacaaaaaccgagtccgctaaaactgaggggccctctcctgctctcttggaggagacccctctcgaaccagctgtagggcctaaggccgcctgtccactagactccgaatctgccgagggtgtcgtgccaccggcatccggcgggggcagagtgcagaattccccaccagtcgggcggaaaaccctccccttgactacagcccccgaggccggcgaggtgacgccaagcgattcaggcgggcaagaggacagtcctgccaaaggactgagcgtgaggcttgagttcgactattcagaagataagagttcctgggacaaccagcaggaaaatccaccccccacaaagaagataggaaagaagcctgttgcaaaaatgcctcttaggagacccaaaatgaagaaaactcctgagaagctggacaacacgcctgcgtctcctcctaggtccccggctgaacctaacgacatccctattgccaagggaacgtacacgtttgatattgacaagtgggatgatccaaattttaatccatttagctctacttctaagatgcaggaatctccaaagctgccacagcagagctataattttgaccccgatacctgcgatgaaagcgtggacccttttaaaaccagttccaagactccatcctcacccagcaagtctcctgcatctttcgagattccagcctcagccatggaggccaatggcgttgatggcgatggactgaacaagccagccaagaagaagaaaactccactgaaaacagatactttcagagtgaagaagtcacccaagcgtagtcctctgagtgacccgccgagtcaggatccaactcccgcagctacgcctgaaacacctccagtgataagcgcggtcgtgcatgctaccgacgaagaaaaactggctgtgaccaatcaaaagtggacttgcatgactgtggacttggaagccgataagcaggattatccacagccttctgatctaagcactttcgttaacgagactaagttctcttcaccaacggaagagcttgattataggaatagctacgaaattgagtacatggaaaaaattgggagcagcctaccacaggacgacgatgcacctaaaaagcaggcactgtatctgatgttcgatacttcacaggagtcacccgtgaagagctcacccgtcaggatgagtgaatcccccaccccatgttccgggagttctttcgaggagacagaggccctggtcaacactgccgcaaagaaccaacaccccgtgcctaggggccttgcgcctaaccaggaaagtcacctgcaagtcccagagaaaagttcacagaaggagctggaagccatgggcctgggcacaccaagcgaggccattgaaattacagctccagagggatcctttgcttcagccgacgccttattatcaaggctagcacatcctgtgtccttatgcggcgccctcgactatttggaaccagacctggccgagaaaaatccccctctcttcgcacaaaaactgcaagaagagttggagtttgcaatcatgcgcattgaagccctgaagctggcacgccaaattgcactggctagcaggagccatcaagacgccaagagggaggcagctcatcctactgacgtgagcatctccaagaccgccctgtactctcgcattggaactgccgaagtcgaaaaacctgcaggactattattccagcaaccagacctggactccgccctgcagatcgctcgggcagaaatcattacgaaagaacgtgaagtaagcgaatggaaggataagtatgaggaaagtcgccgggaagttatggagatgaggaaaatcgtggcagagtatgaaaaaaccatcgcacaaatgattgaggacgaacagagagaaaaaagcgtctcacatcagaccgtgcagcagctcgtgctggaaaaagagcaggctctcgccgatctcaatagtgtggagaaaagtctggctgacctgtttcggcggtatgagaaaatgaaggaggtgctggaagggtttagaaagaacgaggaggtgctgaagcgatgcgcgcaagagtatctttctcgagtgaaaaaggaggagcagcgttatcaggcactgaaggtgcacgccgaagagaagttggatcgggccaacgccgaaatcgcccaggttcgcggaaaggcgcagcaggaacaagccgcccaccaagcctcacttcgtaaggagcagcttcgcgtggacgccctcgagcgaactcttgagcaaaagaataaggaaattgaagagctcactaagatctgtgatgagctcatcgcaaagatgggaaagtcttag

SEQ ID NO: 209134 - DNA, 8628 bp, Artificial Sequence
  Description of Artificial Sequence: Synthetic coding sequence
atgggcaacgagaacagcaccagcgacaaccagcggaccctgagcgctcagacccccagatcagctcagccgcctggaaattcccagaatatcaagaggaaacagcaggacacgccagggtctcccgaccaccgtgacgcctctagtattggaagcgtgggactcggaggattctgcactgccagtgaatccagcgcctctctggatccctgcctcgtgtcacccgaggtcaccgagccccgtaaggatccacagggcgcccgtgggcccgagggctccctgctgccttcacccccccctagccaggagcgcgagcacccttcatctagcatgccattcgccgaatgcccgcccgaagggtgccttgcctcgcctgctgccgctcctgaagatggtcctcaaacccaatcaccccgcagggaacccgcccccaatgcacctggggacatcgctgcggccttccccgctgagcgcgactccagcaccccttatcaggaaatcgctgccgtccccagcgcggggagagagcggcaacctaaggaggaaggccagaagagctcattttccttctcctccgggatcgatcaaagccccgggatgtcacccgtccccctgcgtgagccaatgaaagccccattgtgtggcgaaggggatcagccaggcggctttgagagccaagagaaggaggcggctggaggctttccccctgcggaaagcagacagggagtcgcttctgtgcaagtcaccccggaggctcctgccgctgctcagcaggggactgagtcatccgcggtcttggaaaaatcgcccctgaagcccatggcccctatcccacaggacccagctccaagggcctccgacagagagcgggggcaaggagaagcccctcctcagtacttaaccgatgacctcgaattcctacgggcttgccacctgcctaggtctaacagcggtgccgcccccgaggccgaggtaaatgctgcaagccaggagtcatgtcagcagcctgttggtgcatacctcccacatgcagaattaccctggggcctcccttccccggcactggtgccggaagctgggggatccggaaaggaggcccttgatacaatagatgttcagggacacccacagactgggatgcgaggaactaagcctaatcaggtcgtgtgcgtcgccgccggtggtcaaccagaagggggtttgcctgtgagccctgagccctcactgctgacaccaacagaggaggctcatccggcgagttccctggcaagcttcccagccgctcagatccccatcgcagtcgaagaacctggctcctcatcccgagagagcgttagtaaagctgggatgcccgtcagcgcagatgcagctaaagaggtggttgatgctggcctggtggggttagagcgccaagtaagcgatctgggctccaaaggggagcaccccgagggcgacccgggagaagtgcccgctccatccccacaggagcgtggcgagcacctgaataccgagcaaagccacgaggtgcagcctggggtgccccccccccctttacctaaggagcaaagtcacgaggtgcagcctggggcacccccaccacccctcccaaaggctcccagtgaatccgcaagaggaccacctgggccaaccgacggcgccaaagtacacgaggatagtacaagcccggcggtcgccaaagaaggatccaggagccctggagacagtcctggtggcaaagaggaggccccggaacctccagacgggggcgatccagggaacctccaaggagaggactctcaagctttttctagtaagcgcgatcccgaagtagggaaggatgagcttagcaagccctcttcagatgccgaatccagagatcaccccagtagtcacagtgcccaacctccccgcaaaggcggagccggccataccgatgggcctcactctcaaaccgctgaggccgacgcaagtggcctaccacacaagctcggcgaggaagaccctgtgctgccacctgtgccagacggtgcaggggaacccactgttcccgagggagccatctgggagggctctggactccagccaaaatgtcccgatacactgcagtccagggagggcctgggccggatggaatcgttccttacgttagagtccgagaaatctgactttcctcccaccccagttgccgaggtcgctccaaaagcccaggaaggcgaaagcacactggaaattagaaaaatgggttcttgcgatggcgaaggattgctcaccagtcccgaccagcctagaggccccgcctgtgacgcatcaaggcaggagttccacgccggggtaccccaccccccgcagggcgaaaatcttgccgcggacctgggccttactgctttgatattagaccaggatcaacagggaatccctagctgtcctggagaaggctggatccggggagccgcctccgaatggccactgctttcttccgaaaagcacttgcaaccatctcaggctcagcccgaaacaagtatattcgatgtgctgaaggaacaagcccaacctccagaaaacggcaaggagacatcaccatcccatcccggattcaaggatcagggcgcagactcttcgcagatccatgtgccggtggagccgcaggaagataataatctccccacacatggcgggcaggaacaagcactcggaagcgaactccaatcccagctccccaagggcactctctcagacactccgaccagcagccccaccgacatggtctgggaaagctccctgacagaggagtcggaactctccgcaccgacacgacagaagctccccgcactgggcgaaaagagaccagagggagcatgtggtgatggccagtcttccagagtttcccccccggcagccgacgtgctgaaagacttcagtcttgctggaaatttcagcaggaaggaaacctgctgtacgggtcagggtccaaacaaatcacagcaggccctggccgacgcgttggaagaagggagtcagcacgaggaagcttgccaaaggcaccccggcgcctccgaagcagccgacggttgcagcccgttatggggcctctctaaacgtgaaatggcgtccgggaataccggcgaggctcccccatgtcagcccgattccgtggcactgctggacgccgtcccctgtctacccgccctcgcaccagcgtcacccggcgtcacccccactcaggatgctccagaaacagaagcctgtgacgagacccaggagggaaggcagcagcccgtgcccgcaccccagcaaaagatggaatgttgggccacaagtgatgccgagtcccccaagctgctggcttccttcccatcggccggggagcaggggggggaagccggcgcggctgagaccggcggctcagccggggcaggggatcccggcaagcagcaggctccagagaaacctggtgaggcaacactgtcctgcggactgcttcagaccgaacattgcctcacttcaggagaggaggcctctacgtccgcactgagggagagctgtcaagcggagcaccctatggcctcttgccaagacgccctactacctgccagggagctgggcggaatccccaggtcgactatggatttttccacgcaccaagctgtgcccgaccctaaggagttgcttctgagcggcccgccggaggtagccgccccagacactccctacctacacgtggattcagcagcccagcgtggcgccgaagactcaggagtcaaagccgtctcatcagctgatcctcgagccccgggggagtccccatgccccgttggcgaacctccccttgctcttgaaaatgccgcctccctaaagctgtttgctggctccctcgctccactcttgcagcccggcgcagccggcggggagatcccagctgtgcaggcttcttccgggtcgccgaaggctcgcaccaccgaaggacccgtggatagcatgccttgcctggaccggatgcccttattagcgaaaggaaagcaggccacaggagaggagaaagccgctactgcccctggcgcgggagcgaaggcatctggggagggtatggctggcgatgccgcaggcgaaacagagggctccatggaacgcatgggtgagccaagccaggatcccaagcagggcaccagtggcggtgttgacacgagcagcgaacagattgccacgttgacgggctttccagatttcagggaacatatagctaaaatttttgaaaaacccgttctcggcgctctagctacaccgggcgagaaggctggagcagggaggtctgcggtcgggaaagatctgacacgccctctgggaccggagaagctgcttgacggccctcctggagtggacgtcactttgttgcctgcgccacccgcccgcttacaggtggagaaaaagcagcagttggcgggtgaagcagaaatttcacatttggcccttcaagaccccgcctccgacaagctgttagggcctgccgggttaacatgggagcgcaatctgcccggggctggcgttggaaaggaaatggcaggggttccaccaacactgagggaggacgaacggcctgaggggccaggcgccgcttggcccggcttagaggggcaggcatattcacaattagaacgctctcgacaagaactagcaagtggcctgcccagccccgcagccacccaggagttgccggtggaaagagccgcggcattccaagtggccccacactcccatggcgaggaagccgtcgctcaggaccgtatcccctccggcaaacagcatcaggagacaagcgcttgtgatagtcctcatggggaagacggcccaggcgatttcgcccacacaggggtgcctgggcatgtgccgcgtagcacttgtgccccaagcccccagcgggaggtgctgaccgtcccggaggcaaattcagaaccttggaccctggatacgttagggggagagcgtcgaccaggggtgaccgccggtatcctggagatgcggaacgcactgggaaatcagagcacacctgcccctccaacaggggaggtggccgatactcctctagagcctggtaaggttgcaggggccgcgggagaagctgaaggcgatatcactctgtccacagccgaaacccaggcttgcgcatcaggcgatctgcctgaagccggtactactcggacattttccgtggtggcaggggatttagtcctccctggctcatgccaggatcctgcctgctccgataaagcaccgggaatggagggtacagccgcactccatggtgactcaccagctcggcctcaacaggccaaagaacagccagggcctgagaggcctataccagctggtgatgggaaagtatgtgtcagttctcctcctgaacccgatgagacccatgaccctaagctgcaacatctcgcacccgaggagctccacaccgacagggaaagcccacgccccggtccctctatgctgccaagtgtgcccaaaaaggatgccccacgcgtcatggataaggtcacaagtgacgaaacgcggggcgccgaggggacagaaaggagtgctaaagacataggattgtggaaggcaatgatgccgtccctggacacagacacgcttgatgtcctcgaacgcagggtcgtcctgatacaacacgagtttctgcacaaaaaagaagcgaatggacattcccgctttatgtactcctcacctgtagcggacgacataattcagcccgctgcccccgccgatttggagagccccacactggcagcttcttcctaccatggggatgtggtcggccaggtgagtacggatttgatagcccagcggagttcagactctgaggaggcgttcgagacgcccgaatccaccacgcccgtgaaagctccgcccgcaccacctcccccacctcctgaggttataccagaacccgaggtatcaactcagcccccaccagaggaacccggctgcgggagtgaaactgtgcctgtgcctgacggtccccggagcgattcagttgagggttcacctttccggcctccttcgcactcattctcagcggtctttgacgaagataagcctatagcgtcctcaggtacttataatctggattttgataatattgaactcgtagataccttccagacattagaaccgagggcatctgacgccaagaaccaagaagggaaagtgaatacacgccgaaagtccactgattcagtccctatttctaaatccaccctgtctcggtcgttgtctttgcaagcgagcgatttcgacggcgcaagcagttctggcaatccagaggctgtggctctagcaccagacgcctactcaacaggaagctcctcggcgtcctcaacactgaagaggaccaagaaaccaagaccaccgtccctaaagaagaaacagacaactaagaaaccgacggagactccacccgtgaaggagacccagcaggaacccgacgaagagtccctggtcccgtctggagagaacctggctagtgagactaaaacagagtccgctaagaccgaggggccatcacccgcactgctcgaggagacaccgctcgagcctgccgtcgggccaaaggccgcctgccccctggactcagagagtgccgagggagtggtgccgcccgcctctggcggcgggagagtgcagaattctcctccagtcggacgcaagacactccccctaactaccgcgcctgaggcaggggaagtcactccatctgattctggcggacaggaagattcacccgccaaggggctctccgtcaggctggaattcgattactcagaagacaagagctcctgggacaatcagcaggaaaacccccctccaactaagaaaattggtaagaaacccgtagcaaagatgcctctgcgcagacccaagatgaaaaaaactccagaaaagttggacaacacgcctgcctctcctccccgaagcccagccgaaccaaatgatattcccatcgccaagggaacctatacttttgatatcgacaagtgggacgacccaaacttcaacccttttagcagcacatctaagatgcaggagtcccccaagctgccacagcagagttacaatttcgatcccgacacctgtgacgagtccgtcgatccttttaaaacctcaagtaagacaccgagcagtccctccaagagccccgcgagcttcgagatccccgcttcagccatggaagccaacggagtagatggtgatggtttaaacaagcctgcgaaaaaaaagaagactccactaaagaccgatacattccgggtgaaaaaaagtccaaaacgaagcccactgtctgacccgccgtcccaggatcctacgcctgccgcaacgcccgaaacgcctccagtcatctcggctgttgtgcacgctactgacgaagaaaaacttgcagtgaccaaccagaaatggacttgcatgactgtcgatcttgaagccgacaagcaggattatccccagccatctgatcttagcaccttcgtgaatgagactaagttttcctcgccaactgaggagctggattacaggaattcctatgagatcgaatacatggaaaagatcggaagctcattgccgcaggatgacgatgcccctaagaaacaagcactctatctaatgtttgacacaagtcaggagtcccctgtgaagagctctccggtgaggatgtctgagtcccctaccccgtgtagtggctcaagctttgaagagacagaggcgctcgtcaacacagccgccaagaaccagcaccctgtgccaagaggactggcgcctaatcaggagtcccatttgcaagtcccagagaagagctcccagaaggaactggaagcaatgggtctcggaacaccctccgaagcgatcgaaatccgcgaagcagcccaccccacggacgtgtcaattagcaagaccgctctttacagtcggatcggcaccgcagaggtcgagaagccggcaggccttctttttcaacagccagacctggacagcgcccttcagatcgcccgcgcagagatcatcactaaggaaagggaggtctctgagtggaaggacaagtacgaagagtctaggcgtgaagtgatggagatgcgaaagatcgttgctgaatatgaaaaaaccattgcacagatgattgaggacgagcagcgggagaagagtgtctcccaccagaccgtccagcaactggtcctggaaaaagagcaggccttggccgacctgaacagcgtagaaaaatcattggctgacctattcagacggtacgagaaaatgaaagaggttctagagggcttcaggaagaatgaggaagttctgaaaagatgcgcccaggaatacttgagccgcgtgaagaaggaggagcagcgctaccaggccctgaaggtgcacgctgaagagaaattggatagagccaacgccgaaattgcccaggtgaggggaaaggcacaacaggagcaggccgcacaccaagcttccttaaggaaagagcagctccgcgtcgacgcactcgaaaggacgcttgaacagaagaataaggagatcgaggagttgaccaaaatttgcgatgaattgattgcaaagatggggaaatcctag

SEQ ID NO: 209135 - DNA, 3285 bp, Artificial Sequence
  Description of Artificial Sequence: Synthetic coding sequence
atgggcaacgagaacagcaccagcgacaaccagcggaccctgagcgctcagaccccaagatcagctcaaccccctggaaatagtcagaacattaaaagaaagcagcaggataccccaggctctcccgatcatcgtgacgcctctagcagccctgtcgccgacgatatcatccaacccgccgcaccggccgacctggaatctccaaccctcgcagccagctcttaccatggagacgtggtggggcaagtgagtactgatttaatcgcacagaggagctcagacagtgaagaggcattcgagacccctgagtccaccacaccggtaaaggctccccctgcaccccccccacccccccctgaagtcattccagaaccggaggtgagcacccagccccctcccgaggaacctgggtgcggatccgagacagtacccgtgccggacggcccaagatccgactcggtggagggttcgccatttcgaccaccatcacactccttttctgctgtcttcgacgaggacaagcccattgcttcttccggaacctacaatttggattttgacaacattgaactggtcgacactttccagaccctggagccaagggccagtgacgccaagaaccaggagggcaaggttaatacacggaggaaaagcaccgacagtgtcccgataagtaagagtacactatctagatcgttaagcctacaggcttccgacttcgatggggcctcctcttctgggaatcccgaagcagttgcccttgcgcctgatgcttactcaacgggaagctcaagcgctagcagtaccttgaagagaaccaaaaagccccgacccccctctctgaagaagaagcaaacaaccaagaagccgactgaaaccccccctgtgaaagagacacagcaggaacccgatgaggaatctcttgtgccttccggggaaaatctcgcatctgaaactaaaacggagtcagccaagaccgaggggccatcacctgccctgttggaggagaccccccttgagcctgcagtgggtccaaaggcagcgtgtccattggatagcgaaagtgctgaaggcgtggttcctccggcttctgggggcggaagggtccagaatagcccccctgtggggcgcaagaccttgccgcttaccacggcaccagaggcaggcgaggtgacaccatccgacagcggcggccaggaggattcgcctgcgaaaggactgagtgtgaggttagagttcgactactcagaggacaagagtagctgggataaccagcaggagaacccaccacctaccaagaaaattggcaaaaagcccgttgctaaaatgccactcaggaggcctaagatgaaaaagacaccagaaaagctggacaatacccctgcaagtccgccacgctcacctgctgaaccaaatgatattccaattgctaaagggacctatacgttcgatatagataaatgggatgaccccaactttaatcctttctcaagcacctcaaagatgcaagagagtcccaagctgccccagcagagttataatttcgacccagacacatgcgacgagtctgtggaccctttcaagacatcttctaaaactccaagctcacctagtaagagccctgcttccttcgaaattcccgccagcgccatggaggcaaatggcgtggatggagacggactgaataaacccgcaaagaaaaagaaaacacccttaaaaaccgacactttccgcgttaaaaaatccccaaaacggtcccccctgagcgaccccccctcccaggatcctacgccagcagccacaccagagactccaccagtcatctctgccgttgtccacgcaacagatgaggagaagctggcggtgaccaaccagaagtggacttgtatgacagttgatctggaggcggataaacaggactacccacagccctcagacttgtccactttcgtgaacgagacgaaattttcgtcccccacagaagaactggactacagaaatagttatgagatcgaatacatggagaagattgggtctagtttacctcaagacgacgatgcaccaaagaaacaagctctgtacttgatgtttgacaccagtcaagagagtcctgtgaaaagttcccccgtccgcatgagcgaatcgccaaccccatgcagtggcagcagtttcgaagaaaccgaagcactcgtgaacaccgccgcgaaaaaccaacatccagtgccacgcgggttggccccaaaccaggagtcacacctacaggtaccagagaaaagtagtcagaaagaattggaagcaatgggactaggcactccatccgaagccatcgaaatcaccgcccctgaggggtcgtttgcgagtgccgacgctctactatctcggctggctcatcccgtctctctgtgcggcgcactggactacctggagccggatctggctgaaaaaaacccccccctgttcgcgcagaaactgcaggaggagctggaattcgcaataatgaggatcgaggccctcaagctcgcacggcaaatcgctttggctagccgaagccaccaagacgccaaacgggaggccgcccaccccacagatgtatctatcagcaagacagccctgtatagtcggattgggacggccgaagtggaaaagccagcgggcctcttgtttcaacaacctgaccttgatagcgccctgcagatcgctcgggccgaaatcatcacgaaggagcgcgaggtaagcgaatggaaggacaagtacgaggagtcccgccgggaggtcatggaaatgcggaaaattgttgccgaatatgaaaaaaccattgcacagatgatcgaagacgagcagagggaaaaatcagtgagccaccagacagtccagcagttggttctagagaaagaacaggcactggctgatctgaattctgtggaaaagtcactggcggacctatttcggaggtacgagaaaatgaaagaggtgctcgaaggctttagaaagaacgaagaagttctcaagcggtgtgcacaggaatatctctccagggtaaaaaaagaggaacagcggtatcaggcacttaaggttcacgccgaagaaaagctcgacagagccaacgccgaaatcgcacaagttagagggaaagcccagcaggagcaggcagcacatcaggcaagtcttcgcaaggaacagctgagggtggacgccctcgaaaggactcttgagcagaaaaataaggagattgaggagctgacgaagatctgtgatgaactgattgcaaaaatgggcaagtcctag

SEQ ID NO: 209136 - DNA, 2517 bp, Artificial Sequence
  Description of Artificial Sequence: Synthetic coding sequence
atgagcctgcaggtgctgaacgacaagaacgtgagcaacgagaagaatacagagaactgcgacttcctctttagtccccctgaagtgacaggccggagcagtgttctgcgtgtcagccagaaggaaaacgtaccccccaaaaaccttgccaaggccatgaaggtgacattccagacccctttgagggaccctcaaactcaccggattttatccccaagcatggcgagcaaattggaagcaccctttacacaagacgataccctgggcttggagaattctcaccctgtgtggacacagaaagaaaaccagcagctgataaaggaagtggatgcaaaaactacgcacggcatcctgcagaaacccgtggaagctgacaccgatttgttgggagacgctagccccgcctttgggagtggatcttcctcagagtccggccctggagccttggccgatttggattgctcctcctctagccaatctcccgggtcctcggagaatcagatggtgagtccaggtaaagtgtcaggaagccccgagcaggctgtggaggaaaatctgagctcctatagcctagacagacgggtgactccagcttccgagacattggaggacccctgccgcaccgaaagccagcataaggccgagactcctcacggtgctgaggaggaatgcaaggctgagactccacacggagcggaagaagagtgtcgccatggcggcgtgtgcgctcctgctgccgtggccacatctcctcccggggccataccaaaggaagcgtgtgggggggcacccctacaaggcctcccaggagaggcactcgggtgcccggccggcgttggaacacccgtgcccgcagacgggacccagaccctgacttgcgcgcatacaagtgcccctgaaagtaccgcccctacaaatcacctcgtcgcaggaagggccatgaccctgtctcctcaggaagaggttgcagcagggcaaatggcctccagctcacgatctggccctgtcaagttggagtttgacgtgagcgacggcgctacgtccaaacgtgcccctcccccacgccggctgggagaaagatcaggactcaagcccccgctccggaaggcagccgtgcgccagcagaaagcccctcaggaagttgaagaagacgatggccggtcaggtgccggggaagacccccctatgcccgcatctaggggctcctatcatctggactgggacaaaatggatgaccctaattttatacctttcggaggagatacaaagtcagggtgctctgaggctcaaccgcctgaaagccccgaaacccgattgggccagccggcggctgagcaactacatgctggacccgccactgaggaacctggaccttgtctgtcgcagcagctccatagcgcttctgctgaggatacacctgtcgtgcagcttgccgcagagacaccaaccgcggagtccaaagagagagccctgaattctgcctcgacctcactgcctacatcctgccccggaagcgaaccagttccgacacaccaacagggacagccggccctcgagctgaaggaggaaagcttcagagaccccgctgaggtgctgggaaccggcgctgaggtggattacctagagcagttcggtacttccagctttaaggagagcgcactgagaaaacagagcttatatcttaagtttgacccattactgagggattcaccgggtaggcctgtgcctgttgctacagagacctcttcaatgcatggggccaacgaaacaccaagcgggcgcccccgggaagccaagctggtggagttcgactttttaggggccttggatattccggttcccggcccaccccccggtgtgcccgccccaggcgggccaccgctttcaacaggacccatcgtggatctgcttcagtatagtcagaaggacctcgacgctgtcgtcaaagctacccaagaagagaatagagaacttagatctcgatgcgaggagttgcacggcaaaaatctggagctcggcaagatcatggatagattcgaagaagtcgtgtaccaagccatggaggaagtgcagaaacaaaaggagcttagcaaagccgagattcagaaggtgctgaaggaaaaggaccagcttaccaccgatctcaattcgatggagaagtctttttctgacctgttcaaacgcttcgagaagcagaaggaggtcattgaaggttaccgcaaaaacgaagaaagcctgaagaagtgtgttgaggattatctagcccggattacacaggagggccagaggtatcaagctcttaaggcccacgcagaagaaaagctgcagctggctaatgaagagatcgcccaagtaaggtctaaggctcaagcagaagctttagccctgcaagcttccctgcgcaaggagcagatgaggattcagagtttggaaaagacagtggagcagaagaccaaggagaatgaggaactgacacggatatgtgacgacctcatctcaaagatggaaaagatatag

SEQ ID NO: 209137 - DNA, 438 bp, Artificial Sequence
  Description of Artificial Sequence: Synthetic coding sequence
atgagcctgcaggtgctgaacgacaagaacgtgagcaacgagaagaatacagagaattgcgacttcctcttttcaccacctgaagtcaccggccgttcctcagttctgcgcgtatcacagaaggaaaatgtaccgcccaaaaatctggcaaaggccatgaaggttaccttccagactcccctcagagatccccaaacacataggatattgtccccttctatggcatccaaactggaggcccccttcacccaggatgacacgctagggctggagaactcacacccagtgtggactcagaaagaaaaagccgccgccttcagcctgtcaggtggccatgcttgcggcgctgtcggatctagggacccaaactcccgggaacagggggagagtctggagttatgccaacatctggcgagccacaaactgagtagacagtag

SEQ ID NO: 209138 - DNA, 666 bp, Artificial Sequence
  Description of Artificial Sequence: Synthetic coding sequence
atgagcctgcaggtgctgaacgacaagaacgtgagcaacgagaagaacacggaaaattgtgatttcttgttctcccccccagaagttaccgggaggtcatcagtgctgagggtaagccagaaggaaaacgtaccaccgaagaacctcgccaaggccatgaaggttacattccagacaccattaagggatccacagactcaccgcatcctttcccccagcatggcatctaagttggaagcaccatttacacaggatgataccttagggctggaaaatagtcaccccgtgtggactcaaaaggaaaaccaacagctcatcaaagaggtggatgcaaagacaacacatggcattctgcagaagcccgtcgaggccgacaccgacctactcggggacgcgtcacctgcttttggtagcggcagctcttccgagagtggccccggcgccctggcggacttggactgctcctcaagctcacaaagcccgggatcctcagagaatcagatggttagcccaggcaaggtatcaggatccccagaacaagccgtggaggaaaatttgagcagttattctcttgataggcgagtaaccccggccagtgaaactctggaggacccatgccgtaccgaaagtcagcacaaagccgagactccccatggtgccgaatag

SEQ ID NO: 209139 - DNA, 696 bp, Artificial Sequence
  Description of Artificial Sequence: Synthetic coding sequence
atgagcctgcaggtgctgaacgacaagaacgtgagcaacgagaagaatactgagaattgcgactttctattttctccgcctgaggtgacaggaagaagtagcgtgctgagagtctcacagaaggagaatgtccctcctaaaaatctcgccaaggcaatgaaggtaactttccagacacctctgagggatccgcagacccacagaatcctcagtcccagcatggctagtaaactggaggccccattcacgcaggatgacacactggggctggaaaacagtcacccggtgtggactcaaaaagagaatcagcaacttatcaaggaggtggatgcaaaaactactcatggaattttgcaaaagcccgtggaagccgacacagacctgctgggagacgctagtcctgcattcggatcaggaagctcctcagaatctgggcccggggctctggctgatttggactgtagcagttcttcacaaagccctggaagtagcgaaaatcagatggtgagccctggaaaggtgtccggaagccccgagcaagctgtcgaagaaaatctcagtagttattctctggatagaagggtgaccccagcaagtgagacgctggaggatccctgccggactgagtcgcagcacaaggccgaaactccccacggcgcggaggaggaatgcaaggctgaaacacctcatggatag

SEQ ID NO: 209140 - DNA, 606 bp, Artificial Sequence
  Description of Artificial Sequence: Synthetic coding sequence
atggccaacaagggccccagctacggcatgagccgggaggtgcagagtaagatcgagaagaaatatgatgaagaactggaggagcgcctggttgagtggattattgtccagtgtggacctgatgttggccggccagaccgcggccgtctgggttttcaggtatggctcaaaaatggggttattctgagcaaacttgtcaatagcctgtaccccgacggatcgaagccggttaaagtccccgaaaacccaccaagtatggtctttaagcaaatggaacaggtagctcagttcctgaaggctgccgaagactatggcgtgattaagactgatatgttccaaaccgttgacctgttcgagggtaaagatatggcagcagtgcagcggacactcatggcattggggtctttggccgtgaccaagaatgacggtcattacagaggcgaccccaactggttcatgaaaaaggcgcaggagcataagcgtgagtttacagaaagtcaactgcaggagggtaaacatgttattgggctccaaatgggaagtaacaggggggccagccaagccgggatgacggggtacggccggccacggcaaatcattagctag

SEQ ID NO: 209141 - DNA, 108 bp, Artificial Sequence
  Description of Artificial Sequence: Synthetic coding sequence
atggccaacaagggccccagctacggcatgagccgggaggtgcagccatcacggcttgcatgcttaactcacacaagagtagtcccgtcagctttagccaagttatag

SEQ ID NO: 209142 - DNA, 606 bp, Artificial Sequence
  Description of Artificial Sequence: Synthetic coding sequence
atggccaacaagggccccagctacggcatgagccgggaggtgcagtccaagatcgaaaaaaagtatgatgaggagcttgaggagaggcttgtcgagtggatcatagttcaatgtggccctgatgtaggcagacctgatagaggccggctgggtttccaggtctggctcaagaatggcgtcatactgtccaaactggtgaattctttgtatccggacggctctaagcccgtcaaagtccctgagaatccaccttccatggtgtttaaacagatggagcaggtggcacagtttttgaaagcagccgaggattacggcgtaattaagacagacatgttccagacggtcgatctgttcgaagggaaagacatggctgcagtccagcgaacactgatggccctgggctcattggcggttactaagaatgatgggcactaccggggagatcctaactggtttatgaagaaagcccaagaacataagcgagaatttaccgagtctcaactgcaagagggcaagcacgtgattggactgcagatgggcagtaacaggggagcctcccaggcaggcatgactggctacgggcggccgcggcagatcattagctag

SEQ ID NO: 209143 - DNA, 606 bp, Artificial Sequence
  Description of Artificial Sequence: Synthetic coding sequence
atggccaacaagggccccagctacggcatgagccgggaggtgcagagcaagatcgagaagaaatacgatgaggaacttgaagaacggttggtggagtggataatagtgcagtgcgggcctgatgtgggccggccagatagaggtcgcctggggtttcaggtttggttaaagaacggtgtcatcctgagtaagctagtcaattctctgtaccctgatggctctaaacccgtgaaggtcccagaaaatcccccgtctatggtgttcaagcaaatggagcaggttgcacagtttctgaaagctgccgaagattacggcgtgatcaaaacagatatgttccaaaccgtggacctgttcgagggcaaggacatggccgcagtgcagcggaccctcatggctctaggaagtctggcggtgacgaaaaatgacggccactatagaggagatcctaactggtttatgaaaaaagcgcaggagcacaagagagagtttactgaatcccagcttcaggagggaaagcacgtaattgggctgcaaatggggtccaataggggcgcttcacaagctggcatgacagggtacggccgaccgcggcaaattatatcctag

SEQ ID NO: 209144 - DNA, 276 bp, Artificial Sequence
  Description of Artificial Sequence: Synthetic coding sequence
atggccaacaagggccccagctacggcatgagccgggaggtgcagagcaaaatcgagaaaaagtacgacgaagaattagaggaaaggctggttgaatggatcattgttcaatgtggacctgacgtgggacgacccgaccgcgggagattggggttccaggtgtggttgaagaatggtgtcatcctgagtaagttagttaattcactttatccagatgggtccaagcccgtgaaagtgccggaaaacccaccatcaatggtttttaaacagatgtag

SEQ ID NO: 209145 - DNA, 606 bp, Artificial Sequence
  Description of Artificial Sequence: Synthetic coding sequence
atggccaacaagggccccagctacggcatgagccgggaggtgcagtcaaagattgagaagaaatacgacgaggagttggaagagagactcgtggaatggatcattgtccagtgtggaccggatgtgggcaggccagataggggtcggctcgggttccaggtctggctcaagaatggagtgatcctctctaaacttgttaattccctataccccgatggaagtaaaccggtaaaggtcccggagaacccacctagcatggtctttaagcagatggagcaggtggctcagtttctgaaggccgccgaagactatggagtgatcaagacagacatgttccaaaccgtcgatctcttcgagggaaaagacatggcagctgtccagagaacactgatggccctgggctccctggcggtgacaaaaaacgacgggcattaccggggtgaccctaactggttcatgaaaaaagcccaggaacataaacgcgagttcactgagagccagctacaggagggcaaacacgtgattggactgcagatggggtccaatagaggcgcttcgcaggctggaatgacaggatatgggaggccccgtcagataatctcctag

SEQ ID NO: 209146 - DNA, 606 bp, Artificial Sequence
  Description of Artificial Sequence: Synthetic coding sequence
atggccaacaagggccccagctacggcatgagccgggaggtgcagtccaaaatcgagaagaagtatgatgaagagctggaagagcggctggtagaatggatcatcgtgcagtgtggacccgacgttggaaggcccgataggggacgcctcggctttcaggtttggttgaagaacggcgtgattctaagtaagctggtgaactccctgtaccctgacggatcgaaaccagtgaaagtgccagagaatccaccttcaatggtcttcaaacaaatggagcaggtggcccagtttctgaaagcagccgaggactacggagtcataaaaaccgatatgtttcagactgtagatctgttcgaaggaaaagacatggccgccgtacaacgcaccctaatggcactgggcagcctcgcagttaccaaaaatgatggtcattatagaggagaccccaactggtttatgaagaaagcccaagagcacaagagagaatttaccgaaagtcagctgcaagagggcaaacatgtgatcgggctccagatgggaagcaaccgaggcgcttcccaggcagggatgacaggctacgggaggccacgacagatcattagctag

SEQ ID NO: 209147 - DNA, 600 bp, Artificial Sequence
  Description of Artificial Sequence: Synthetic coding sequence
atggccaaccggggccccgcctacggcctgagccgggaggtgcagcagaagattgaaaaacaatacgacgcagaccttgaacagatccttattcagtggatcactacacaatgtcgcaaggacgttgggcggccgcaacctggtagggaaaattttcagaactggctgaaagacggaaccgtgctgtgcgaacttatcaatgcactttatcctgagggtcaggcgcccgtgaaaaagatccaggcttccaccatggccttcaagcagatggaacaaatctctcaatttcttcaggcagcggaaaggtacgggatcaataccaccgacatctttcagacagtggatttgtgggaggggaagaacatggcctgtgtgcaacggacacttatgaatctcggtggtttagccgttgcaagggacgatggcttatttagtggggaccctaactggtttcctaaaaagagcaaagaaaatccgaggaacttctccgataatcaattgcaggaagggaaaaatgtaattggactgcagatggggacgaacagaggagcaagtcaggccggaatgaccggatatggcatgcctcgccagattctgtag

SEQ ID NO: 209148 - DNA, 663 bp, Artificial Sequence
  Description of Artificial Sequence: Synthetic coding sequence
atgagcgccttcagcctggccctggccctggtgagcagcccccagcctcccccacccatcggaatggcgaatcgggggccagcctacgggctgtcccgtgaggttcagcagaagattgaaaaacagtacgacgctgatctggaacagatcctgatacaatggatcacaacccagtgccggaaggatgtgggacggcctcagccaggacgggagaactttcagaattggctgaaagacggcactgtgctgtgcgaactcatcaacgctctgtacccggaagggcaggcaccagttaaaaagattcaagcctcaacaatggcatttaagcaaatggagcagatatctcagttcctgcaggcggctgagaggtatggcatcaataccaccgacattttccaaaccgttgacctgtgggaaggcaaaaacatggcttgcgtgcagaggactttgatgaatcttggtgggctggctgtcgctagagacgatggtttgttttctggggatcctaattggttcccgaaaaaaagcaaagaaaatccccgcaacttctccgataaccagctacaagagggcaaaaacgtgatcggactgcagatgggcacaaacagaggtgcctctcaggcaggaatgacgggatatggtatgccaagacaaattctgtag

SEQ ID NO: 209149 - DNA, 600 bp, Artificial Sequence
  Description of Artificial Sequence: Synthetic coding sequence
atggccaaccggggccccgcctacggcctgagccgggaggtgcagcagaaaatcgagaagcagtatgacgcagacctcgaacagattctgattcagtggattaccacacagtgtcgcaaggacgtgggacgcccgcaaccaggaagagagaacttccaaaattggctaaaggacggcacagtcctgtgcgagttaatcaacgcgctgtatcctgagggccaggcccctgttaagaagatccaagcgtctaccatggcctttaagcagatggaacaaatctcccagttcttgcaggcagccgaaaggtatggaattaataccacagacatctttcagacagtggacctgtgggaagggaagaatatggcctgtgtgcagagaaccctcatgaacctagggggcctggcagtggcgcgtgacgacggtcttttctctggggatcccaattggttccccaaaaagtctaaggagaatcctcggaatttctccgataaccagttgcaggagggaaaaaacgtgatcgggctacaaatgggcacaaaccgcggtgcgagccaggcaggtatgacagggtacggaatgcccagacagattctgtag

SEQ ID NO: 209150 - DNA, 564 bp, Artificial Sequence
  Description of Artificial Sequence: Synthetic coding sequence
atggccaaccggggccccgcctacggcctgagccgggaggtgcagcagaagatcgaaaagcagtatgatgcggacttggagcagatcctcatacagtggattaccacacagtgccggaaggacgtgggccgcccccagcccgggcgcgaaaactttcagaattggttgaaggacggcaccgtactctgcgaacttatcaacgcactctatcccgaaggacaggcacctgttaagaagattcaggcgagtacaatggcctttaaacagatggagcaaatttctcagttcctgcaggctgcagagaggtacggtatcaataccactgacatctttcagactgttgatttgtgggagggcaagaacatggcatgtgtccagcgtactttgatgaatctgggagggctggccgtcgctcgcgatgacgggttgtttagtggagatcccaattggtttcctaagaagagcaaagaaaacccgcgcaacttctcggacaaccagctccaggaggggaaaaacgtcattggcctgcaaatgggcactaatcgtggagccagtcaggcatag

SEQ ID NO: 209151 - DNA, 3861 bp, Artificial Sequence
  Description of Artificial Sequence: Synthetic coding sequence
atgagccacctggtggaccccaccagcggcgacctgcccgtgcgggacatcgacgcaattccactggtgttgcctgcttcaaaaggcaagaatatgaaaacacaacctcccctgagccggatgaacagggaagagcttgaagactccttctttcgactgcgtgaagaccacatgcttgttaaagaactgtcctggaaacagcaggatgagattaagaggctgcgaacgacactgctgaggctgacagccgccggtcgagatttgcgcgtggccgaggaggctgctccactttcggagaccgctcgaagagggcagaaagccgggtggagacaaaggctgagcatgcatcagagaccacaaatgcatcggctccagggccacttccattgtgttggtccagcttctcccagaagagctcagccacgggttcaggtggggcatcggcaacttcatacagcaggtgccccggtacccgaaaaacctaagaggggtccacgcgatcgattgagttacactgcaccaccaagcttcaaggagcacgcaactaacgagaataggggcgaggtggcatctaagccaagtgaactcgtaagtggttccaactccataatctcctttagctctgtcatttccatggccaaaccaatcggactctgtatgcctaacagcgcacacatcatggcttccaacacaatgcaggtagaggagccgcccaaaagcccggagaagatgtggcccaaggatgaaaattttgagcagcggagcagcctggagtgtgctcagaaggccgcggaactgcgggccagcatcaaggagaaagtcgaactcattaggctcaagaagttgctccacgagaggaatgcatctttggtgatgacaaaggcccagctcacagaggtgcaggaagcctgcacttttttgctcacacagaatcagggtatcttatcagccgcacatgaggcgcttctgaagcaggtgaacgagctcagggcggagctaaaagaagaatcaaaaaaagccgtttcactcaaaagtcagctcgaagatgtgagcattctgcaaatgacactaaaagaattccaggaacgggtggaggacttggaaaaagaaaggaagctcttgaatgataattatgataagctgctcgagtcaatgttggatagttcagattcttcatctcaacctcattggtcgaatgaactcatagctgagcagttgcaacagcaggtatctcagctccaggatcagctggacgccgaattagaggacaagcgaaaggtattgttagagttgagcagggaaaaggcccagaacgaggatttgaaacttgaggtaacgaacatccttcagaagcacaaacaggaagtcgaactcctgcagaacgccgctacaattagtcagcctcccgaccggcaaagtgaaccagcgacccatccagcagtcctccaggaaaacactcaaatcgagccgagtgagcctaagaatcaggaagaaaagaagctgagccaagtcctgaacgaactgcaggttagccatgctgagaccacactggaattggaaaagactcgggatatgcttatcctccaaaggaagatcaatgtttgctatcaagaggagcttgaagctatgatgaccaaggctgacaacgacaatagggatcacaaggaaaagctcgagaggcttacgcgcttgctcgacctgaagaataacagaatcaaacagctggaagggattttaaggagccacgatttgccaacctctgagcagctaaaggatgtggcttacggaacaagacctctgagtttgtgcctggagaccctgccggcccacggtgatgaagataaggtcgatatatctctcctgcatcaaggagaaaacctcttcgaactgcacatccaccaagcatttctcacatctgccgcgcttgcccaggccggagacacccagcccactactttctgcacctatagtttctatgacttcgagactcattgtacgccgcttagcgtgggaccacagccgctgtacgattttaccagccagtatgtgatggagactgatagcctctttttgcattatctgcaggaggcctccgctagacttgatattcaccaggctatggcaagtgaacatagtacactggcagctggatggatttgcttcgatagagtcctcgaaactgttgagaaagtgcatggtctcgctacgctgatcggcgctggtggcgaagagttcggcgttctggaatattggatgagacttagatttcctattaagccctcccttcaagcttgtaataagcgaaagaaagctcaagtgtatctgagtacggacgtgctgggtggtcgcaaggctcaggaggaagagttcagaagcgaaagctgggagccacaaaacgagctgtggattgaaatcacaaagtgctgcggcctgaggagcagatggcttggcacacagccgtcaccctatgcagtttacaggtttttcacttttagcgaccatgacaccgccatcattcctgcatcaaacaatccctattttcgggaccaggcccggttcccggtgctggtcacctctgacctggatcactacctgcggagggaggccttgtctatccacgtcttcgatgatgaggatctggaacccggctcctatttggggcgcgctagggtccccctgctgcccttagcgaagaacgagtccatcaagggggattttaacttaacggatcccgcggagaagcccaacggtagtatccaggtgcagttggactggaaatttccttacatacctcccgagagcttcctgaagcctgaagcccagacaaagggtaaggatacgaaagacagctcaaaaatcagctccgaggaagagaaagcctcctttccgagccaggatcagatggctagcccagaggtgcccattgaagccggtcagtatagaagcaaacggaagccgccccacggaggcgagcggaaggagaaggaacaccaggtagtgtcgtattctcgccgcaagcacggtaaaaggatcggcgtgcagggaaaaaacaggatggagtaccttagcttgaacatactcaacggcaatactccagagcaggtcaactacactgaatggaagttttcggaaactaattctttcataggcgacgggttcaagaaccagcacgaagaggaggagatgactctctcccattctgccctaaaacagaaggagcctctgcatccagtgaacgacaaagagtcgtcagagcagggctcagaggtgtcagaggcccagacaaccgacagcgatgacgtgatagtgcctcctatgtctcagaaatacccaaaagcagattcagagaaaatgtgtatcgaaatcgtgtcgttggcattctacccggaggctgaagttatgtccgatgaaaatattaaacaggtatatgtggaatacaagttctatgatcttcctctgtccgaaaccgagactcctgtgagcctcaggaagcccagagccggcgaggagatccactttcacttttccaaggttatagatctggatccccaggagcagcagggaaggcgcaggtttctgttcgacatgctgaatggccaggatccagaccaaggccatctcaagtttaccgtcgtgagcgatccacttgacgaggagaaaaaggagtgcgaggaggtcgggtacgcctacctgcagttatggcaaattttggagtctggccgcgacattctggaacaggagttggacattgtatccccggaggacctggccacacccatagggagactgaaagtctctcttcaggccgccgccgtcctgcacgctatttacaaagagatgactgaggaccttttcagttag

SEQ ID NO: 209152 - DNA, 1128 bp, Artificial Sequence
  Description of Artificial Sequence: Synthetic coding sequence
atgaagcggcccgacctgcccagcggcttcgacggctggcaggtggtagatgcaacccctcaggagacctctagcgggattttttgttgtggcccctgcagcgtggagtcaattaaaaatggtttggtatatatgaagtatgacactccatttatcttcgcagaggtgaacagcgataaggtgtattggcaacggcaggacgacggttcattcaaaattgtgtatgtggaagaaaaagcaatcgggaccctgatagtcaccaaagctatctcatctaacatgcgcgaggacatcacatacttgtacaagcatcctgaagggagcgacgcagaacggaaagcagtcgagactgccgctgcacacggatcaaaaccgaatgtctacgccaacaggggcagcgctgaggacgtcgccatgcaagtggaggcacaggatgccgtgatggggcaagatctaatggtgtctgtgatgctgatcaaccacagttccagcagacgaactgtcaaattacacctctatttgagcgtgaccttctacacaggagtgagtgggactatctttaaagagaccaaaaaggaggtagagctagcacctggagccagtgacagagtgactatgcccgtcgcctataaggagtatcggccacacctggtcgatcagggcgcaatgctactgaacgttagtgggcacgtcaaagaaagtgggcaggtgttggctaagcagcacacctttcgcctgaggaccccggacttgtctctcaccctgctcggtgccgccgtggtgggccaggagtgcgaagtgcagatcgtttttaagaacccacttccagtcaccctgaccaatgttgtctttaggctcgaaggctcagggcttcaacgcccaaaaattttgaacgtgggtgacatcggcgggaatgagaccgtgactcttagacaaagtttcgtgcctgtgaggcccggcccaagacagctgatcgcttctctggactcaccacagctctctcaggtccacggcgtcatacaggttgatgtggccccagcccccggtgatggaggattcttctcggatgccggtggcgactctcatctaggagaaactattcctatggcttccagaggaggagcctag

SEQ ID NO: 209153 - DNA, 408 bp, Artificial Sequence
  Description of Artificial Sequence: Synthetic coding sequence
atgatggacggcccccggagcgacgtgggccggtggggcggcaaccctctgcagcctcccacgaccccctctccagaacccgaaccagaacccgacggaaggtctcgtcggggcggagggaggtccttctgggcgcgctgttgcggttgttgctcgtgccgaaatgccgccgacgacgactggggtccagagccctctgactctaggggcagagggtcctcatctggcacccggaggcctggcagtcgaggctcagacagcaggcgccccgtgtcccgagggtctggagtgaacgctgctggggacgggactattcgagagggaatgttggttgttaatggggtggacctcctgtcgagccgcagtgatcagaaccgcagggagcaccacaccgatgagtacgagtag

SEQ ID NO: 209154 - DNA, 129 bp, Artificial Sequence
  Description of Artificial Sequence: Synthetic coding sequence
atgatggacggcccccggagcgacgtgggccggtggggcggcaaccccctgcagccacccactacccctagtcccgagcccgagccagaaccagacggtcggtcgcgccgagggggcggccgcagctag

SEQ ID NO: 209155 - DNA, 198 bp, Artificial Sequence
  Description of Artificial Sequence: Synthetic coding sequence
atgatggacggcccccggagcgacgtgggccggtggggcggcaacccccttcagcccccaacaaccccctccccggagccggaacccgaacccgatggtagatccaggagaggaggtgggaggagcttctgggcacgctgctgcggctgctgctcttgcaggaacgcagctgacgatgactggggcccggaaccctag

SEQ ID NO: 209156 - DNA, 153 bp, Artificial Sequence
  Description of Artificial Sequence: Synthetic coding sequence
atgatggacggcccccggagcgacgtgggccggtggggcggcaacccactgcaacctcccacaactcccagcccagaaccagaacctgagccagatggccgctcccgtcggggcggaggccgatccttctgggctagatgttgtggttgttag

SEQ ID NO: 209157 - DNA, 30 bp, Artificial Sequence
  Description of Artificial Sequence: Synthetic coding sequence
atgatggacggcccccggagcgacgtgtag

SEQ ID NO: 209158 - DNA, 2064 bp, Artificial Sequence
  Description of Artificial Sequence: Synthetic coding sequence
atggccgaggagctggtgctggagcggtgcgacctggagctggagaccaacggcagggaccatcacacagccgacctgtgtcgggagaaactggttgttagaaggggccagcctttctggctaactcttcactttgagggaagaaactacgaagctagtgtcgactccttgaccttcagcgtggtgactggaccagcacccagtcaagaagccggcaccaaggctcgttttcccctgagggacgccgtggaggagggggactggaccgccacagtcgtcgaccagcaagactgcacgctcagtctccagctgactacacccgctaacgccccaatcggcctgtatcggctgagcctggaggcctccacaggatatcaaggctcgtcatttgtgttggggcactttatcttgctgttcaacgcctggtgccccgcagacgctgtctaccttgatagcgaggaagagagacaggagtacgttctgacacagcagggttttatatatcaaggctctgccaagttcattaaaaacatcccatggaatttcgggcaattcgaggacggcatactcgatatctgcttgatactgcttgatgttaaccctaaattcctaaagaacgcggggcgcgattgctctagacgcagctccccagtatacgtggggagggtcgtctcaggtatggtcaactgcaacgacgaccagggtgttctgctgggcagatgggacaacaactatggagatggggtttctcccatgtcttggatagggtcagtggatatactgcgcagatggaagaatcatgggtgtcagcgggtgaagtacggtcagtgttgggtgtttgccgccgtcgcctgtactgtcctccgttgcctcgggatcccgaccagagttgtgacgaattataattcagcccacgatcaaaactccaatttactgattgaatacttcagaaatgagtttggagagatacagggagacaaatccgaaatgatttggaacttccactgttgggtggagagctggatgacgcgtcccgatctacaaccgggttacgaggggtggcaggcactcgatcctactcctcaggaaaaaagtgagggcacctattgctgcggtccagtgccagtcagagccattaaggaaggagatttgagcactaagtacgacgccccctttgtatttgcggaggtcaacgctgacgttgtcgattggatacagcaagacgacggaagtgtgcataagagcattaatcggtctttgattgtggggcttaaaatcagcacaaaatctgtcggccgggatgaacgggaagacattactcacacttacaagtacccagagggctccagcgaggagagagaggcttttaccagagctaatcatttgaataaacttgccgaaaaggaggagaccggcatggcaatgaggatcagagtgggacagtctatgaacatggggagtgatttcgacgtgttcgcgcatatcactaataataccgctgaggaatacgtgtgcaggcttcttctctgtgcaagaaccgtgtcttataacggtatcctgggacccgagtgtggtaccaagtatttactcaacctgaacctggagcccttcagtgaaaagagtgttccactatgtattctgtatgaaaaatatcgggactgtctcactgagtcaaatctcataaaggtcagagcacttctggtggaacccgtgatcaactcctatttactggcagagcgggatctttacctggaaaatcccgaaattaagatacgcatccttggagaacctaaacagaagcgcaagctcgtagcagaagttagcctgcagaacccactacccgttgccctagaaggctgtacgttcaccgtggaaggagcgggacttactgaagagcagaaaaccgtggagatacctgatcccgtggaggcaggagaggaggtcaaagtgagaatggaccttctcccattgcacatgggcttgcacaagctggtggttaattttgaaagcgataaactcaaagctgtgaagggattccggaatgttatcatcgggcccgcctag

SEQ ID NO: 209159 - DNA, 846 bp, Artificial Sequence
  Description of Artificial Sequence: Synthetic coding sequence
atggccgaggagctggtgctggagcggtgcgacctggagctggagacaaacggacgagatcaccatactgctgacctctgcagagaaaagctggtggttcgccggggtcaacccttttggctgactctccattttgaaggacggaactatgaagcttccgtggattcactgacgtttagtgtggtgactggacctgccccatcacaagaggccggtaccaaggctcggttcccgctcagagacgcggtggaagaaggtgactggactgctacagtggttgaccagcaggattgcaccttgtccctgcaactgaccactcctgcgaatgcccctattggcctttaccgactgtctcttgaagcctccactggttatcaagggagtagctttgtgctagggcatttcattttgctcttcaatgcatggtgcccggcggacgcggtgtacctggacagcgaggaggagcgtcaagaatatgtgctgactcagcagggatttatttaccagggcagcgcaaaatttattaagaatattccttggaatttcgggcagtttgaagacggaatcctggacatatgtctcatcttgctggatgtgaatcccaaattcttaaaaaacgccgggcgtgactgctcgcggaggagctctcccgtatacgtggggagggttgtctctgggatggttaactgtaatgacgatcagggggtgttgctaggaaggtgggataacaactacggtgacggcgtgtctcccatgtcctggatcggttctgtggatattcttcgccgatggaagaatcatgggtgtcagagagtaaaatacggccaatgctgggttttcgcctag

SEQ ID NO: 209160 - DNA, 483 bp, Artificial Sequence
  Description of Artificial Sequence: Synthetic coding sequence
atggccgaggagctggtgctggagcggtgcgacctggagctggagactaatggacgggaccatcatacagccgatctctgtcgcgagaagctcgttgtccggcgaggtcagcctttttggctgaccttgcacttcgaaggaagaaattatgaggcttcagtggacagcctaactttctcagtcgtcaccggcccggctccttcccaagaagctggcactaaagccagatttcctttgcgcgatgctgtggaggagggcgactggacggccacagtcgtcgatcagcaggattgtacgctctctttacaactgaccacaccagcgaacgcacccattggactctacagactctccctggaagcgtctaccggataccagggcagcagttttgtactggggcacttcatactgcttttcaacgcctggtgtccagcagacgctgtgtaccttgatagcgaagaggagagacaggagtatgtctag

SEQ ID NO: 209161 - DNA, 1821 bp, Artificial Sequence
  Description of Artificial Sequence: Synthetic coding sequence
atggccgaggagctggtgctggagcggtgcgacctggagctggagacaaacggtagagaccaccacactgccgatttgtgtagagagaagctggtggtgcgaaggggccagccgttttggctgaccttacactttgagggtcgaaactatgaagcatccgtcgatagcctgacctttagtgttgtgactgcagatgcagtttatctggactccgaggaggaacgtcaagagtacgtcctgactcagcagggatttatttatcagggaagcgccaagtttatcaagaacatcccatggaacttcggccagttcgaagacggtatcttagacatttgccttattctgttggacgtgaacccaaagtttctcaaaaatgctggaagggattgttcgcggcgctcttctcccgtctacgtggggcgcgttgtgtctggcatggttaactgtaatgacgaccagggagtgctcctggggcgatgggacaacaattatggggacggcgtgtctcctatgtcatggataggatccgtggatattttacgtcggtggaagaaccatggctgccagcgggtgaagtatgggcagtgttgggttttcgcagccgtggcttgtactgtccttcgttgcctgggtatacccacgcgggtagtgaccaattataacagtgcacatgaccagaattccaatctgctcatagaatattttcggaatgaattcggagaaattcagggggacaaatccgagatgatctggaactttcattgttgggttgagtcctggatgacccgtccggacctccaaccgggttacgaggggtggcaggccctcgatccgaccccccaggaaaagtcggaaggaacatactgttgtgggcccgtgcccgtgagggccattaaagagggggatctgtcaacaaaatatgacgccccatttgtatttgcggaggtcaatgcagacgttgttgactggatccaacaggatgacggcagtgtgcacaagtctatcaataggtctctgattgttggtctgaaaatctccacaaagtctgttgggcgggatgagagggaggatataacacacacgtacaaataccccgagggctcttcagaggaacgcgaggccttcacgagagcaaatcatcttaataaactggccgaaaaggaagagacaggaatggcaatgcgcatcagggtaggccagtccatgaacatgggctccgattttgatgtatttgcacacattactaacaatactgccgaggagtacgtgtgccggctgcttctgtgtgcccgaacggtgagctataatgggattctgggtcccgagtgcggcacgaagtacctgctcaatcttaatcttgaacccttctctgagaagtccgtgccactctgtattctgtacgaaaagtatagggactgcctgactgagtccaatctgatcaaggtgagggccttgttggtcgaacctgtcattaattcatatctgttagcagaacgtgatctttaccttgagaacccagagataaagattaggatcctcggggagcctaagcagaaacgcaaactcgtggcagaagtgtctttgcagaaccccctccctgttgccctggagggatgtacattcaccgtcgagggggccggcctcaccgaagagcagaagaccgtggaaattccggatcctgtagaagctggcgaagaggtgaaggttagaatggacctgctgccccttcacatgggcctgcataaacttgtagttaattttgaatctgacaaactcaaagccgtgaaaggatttcgaaatgtgatcataggacccgcatag

SEQ ID NO: 209162 - DNA, 1884 bp, Artificial Sequence
  Description of Artificial Sequence: Synthetic coding sequence
atggccgagggccccgcccccagccaggaggccggcaccaaggcccgctttcccctgagagacgcagtagaggagggagattggactgcaactgtggtggaccaacaagactgtacactcagcctccagcttaccacccctgccaatgctcccatcggattgtacaggctttccttggaggcttccactggataccaagggtctagctttgttctaggccactttattctgctatttaacgcctggtgtccagcagatgctgtttatctggactccgaggaggagcgccaagagtacgtactaacacagcaggggttcatctaccagggatcagccaagtttatcaagaatattccatggaacttcggccaatttgaggatggcatcctcgacatctgcctgattttgctggatgtaaatccaaaatttctgaaaaatgctggaagagactgttctcgccgatcctcccctgtttacgttggaagggtcgtttccggaatggtgaactgtaatgatgatcagggagtcttgttgggccgctgggacaataattatggcgacggcgtgtctcccatgagctggatcggctccgtcgatatacttaggaggtggaagaatcacggctgccagagagtgaagtatgggcaatgctgggtctttgccgcagtggcgtgcactgtgctccgctgcctcggcattcccacgcgagtagtgaccaactacaactcagctcacgaccaaaattccaacctgctgatcgaatacttcagaaacgaatttggagaaattcaaggggacaaatccgagatgatttggaacttccattgttgggtagaaagctggatgacgcggcccgacctccagcccggctacgagggctggcaggctctggacccaacaccccaggagaagagcgaaggaacctattgttgtgggccagttcctgtcagagctatcaaggagggtgatctaagcactaagtatgacgcaccctttgtttttgcagaggtgaacgccgatgtggtcgactggattcagcaggacgatggtagcgtacacaaaagtattaaccggtccctgattgtgggcctgaagatctcaactaaatccgtaggacgggatgagagggaagacattacccacacttacaagtatccagagggttctagcgaagagagagaagcctttacccgcgccaaccatctgaacaaattagcagagaaagaagaaacaggtatggccatgaggattcgggttgggcagagcatgaatatgggttcagatttcgacgtgttcgctcacattactaacaacacagctgaagagtacgtgtgccgcctgcttctatgcgcacgaaccgtttcctataacggaatactggggcctgagtgcggaacaaagtatttgctcaatctcaatctcgagccttttagcgagaagtccgttcctctttgcattctgtacgagaaatatagagactgcctgacggaatccaatctcatcaaagtgcgtgctttgctagtggaacccgtgataaacagttacttgctggcggaaagagatttgtatcttgaaaacccggaaatcaagattcgcattctgggtgagcccaagcagaagcggaagctggttgccgaagttagcttacaaaatcccctgcctgtggccctcgaaggctgcacatttacagttgagggcgcaggcctgaccgaagaacaaaagacggtcgagattccggaccccgtagaagctggcgaggaagtgaaagtgcgcatggatcttctgcctctgcacatgggcctgcataagctcgttgtaaactttgagtcagataaacttaaagccgtgaaggggttcaggaatgtcattatcggccctgcatag

SEQ ID NO: 209163 - DNA, 2082 bp, Artificial Sequence
  Description of Artificial Sequence: Synthetic coding sequence
atggccgccctgggcgtgcagagcatcaactggcagaccgccttcaatcggcaagcccatcacaccgacaagttctctagccaggagcttattcttaggcgaggccaaaatttccaagtactgatgataatgaataaaggtttgggcagcaacgagcgtctggaatttattgtgtctacaggtccttatccctccgaatctgccatgacaaaggcggttttcccgctctctaatggctcttcgggcgggtggagcgcagtgctccaggctagcaacggaaatactctgaccatttccattagttccccagcctctgcccccatcggaagatataccatggcgctgcagattttcagtcaaggcgggattagctcggtcaagctaggcacctttattcttttgtttaacccgtggttaaatgtcgactccgtcttcatgggcaaccatgctgaacgagaggagtatgtccaggaagacgctggcataattttcgtaggtagcaccaatagaattggaatgatcgggtggaacttcggccagtttgaggaagatattctctcaatatgcctgtccatcttggacaggtccctgaatttccggcgcgacgctgcaacagacgtcgcctcccggaatgatccaaaatacgtcgggagagtgctgtctgccatgattaatagcaatgacgacaacggagtgcttgccggaaactggagcgggacctacaccgggggcagagatcccagatcatggaacggaagcgtggagatcctgaaaaactggaaaaaaagcggtttctctcctgtccggtacgggcagtgctgggtgttcgcggggaccctcaacactgcacttagatccttaggcattcctagtcgggtcattaccaactttaatagcgctcatgacaccgaccggaatctctccgtagacgtgtattacgatcctatggggaaccctctggacaaaggtagcgacagtgtgtggaactttcatgtgtggaatgagggttggttcgtacggagcgatctgggcccgagctatggagggtggcaggtgcttgatgccactccgcaggaacggtcccagggagtgttccagtgtgggccagcttctgttattggcgtgagagagggcgacgtgcagctgaattttgatatgccattcattttcgccgaggtcaacgctgatcggattacatggctttacgataacactaccggcaagcagtggaagaactccgtgaattcccacactatagggcggtacatatccaccaaagccgtaggctccaacgcacggatggatgtaacagacaagtacaaatatcctgaaggctccgaccaagaacgacaggtgtttcagaaggcacttggtaaactgaaacctaatacgccttttgctgccaccagtagcatgggcctggaaacagaagagcaggagccctctattatcgggaaactaaaagtggccgggatgctcgcagtgggtaaggaggtaaacttggtactcctgctcaagaatctatccagggacacaaagacggtgaccgtaaacatgactgcatggacaattatttacaacgggacactggtgcatgaagtctggaaggattccgctacaatgtcactggatccggaggaagaagccgagcaccccatcaagattagctatgcccagtacgagaaatacctgaaaagtgataacatgatcagaattaccgccgtatgcaaagtgcctgacgaatctgaagtcgttgtcgaacgagacattattttagataacccaacgctcaccctggaggtgctgaacgaggctcgcgtgcggaagcccgtgaatgtgcagatgttgttttccaacccactggacgaaccagttcgagactgcgtgctaatggtggaggggagcggcttgctcctggggaacctgaagatcgatgtgccaactctcggacccaaggagggcagtagggtccgcttcgatattcttccctctaggtctggcaccaaacagctgttagcagatttctcctgcaacaaattccctgcaattaaggccatgctatcaatcgacgtcgcagagtag

SEQ ID NO: 209164 - DNA, 1602 bp, Artificial Sequence
  Description of Artificial Sequence: Synthetic coding sequence
atggccgccctgggcgtgcagagcatcaactggcagaccgccttcaaccgccaggcgcaccatactgataaattttcttcccaggaactcatactcagacgtggccagaattttcaagtgctgatgatcatgaataaagggctgggctccaatgaacgcctcgaattcatcgtaagcacgggaccctatccctccgaatcagctatgacaaaagcagtgtttcctctgtccaatggttcttccgggggatggagcgccgtattgcaggccagtaacggtaataccctgacaatatcaatcagcagcccagcgtccgccccaattggccgctacactatggcattgcagatattctcacaaggagggatctcgtctgtgaaactgggcactttcatactgctttttaatccttggttaaacgtggacagtgtctttatggggaaccatgcagagagggaagagtatgttcaggaagatgcaggcatcatctttgtcggtagcaccaaccggattggcatgatagggtggaatttcgggcaattcgaagaggacattctgagtatttgtctctcaatcctcgataggtctctgaatttccgtcgcgacgccgccaccgacgtcgcctcaaggaacgatccaaaatacgtgggccgagtcctctccgctatgatcaatagcaacgacgataatggcgtgctggctggcaattggtccgggacctacacaggagggagagacccccgcagctggaatggctccgtcgagatactgaagaattggaaaaagagtggattttcacccgtaaggtacgggcagtgttgggtgttcgctggcacccttaataccgccttacgctccctcggcatccctagtcgagtcattactaactttaactctgcccatgacaccgaccgcaatcttagcgtggacgtgtactacgatccgatgggcaatcccctggataaagggagcgattctgtgtggaacttccatgtgtggaacgagggatggtttgtacgctcggatctggggcccagctacggcgggtggcaggtgttagacgctacccctcaggagagatcccagggcgtatttcagtgtggccctgcatccgtgattggagtaagagaaggggacgtccagctcaatttcgatatgcccttcatcttcgccgaggtgaacgcagatagaattacttggctgtacgataatacaaccggcaaacagtggaagaattccgtgaacagccataccatcgggagatatatttcgaccaaggcagttgggtctaacgcccgcatggatgttactgataagtataagtacccagaggggagcgaccaagagcggcaggtgtttcagaaggcactagggaaattgaagcctaatacccctttcgctgctacttcttccatggggctcgagaccgaagagcaagagccctctataatcggcaaactcaaggtcgccggaatgttggccgtcgggaaagaagtgaatttggtgctgctactgattccccatgccttgcagtgctgtcgaatggactggcccctcacacaagggctcagcaagcgggacactggggagaagctggtttag

SEQ ID NO: 209165 - DNA, 2055 bp, Artificial Sequence
  Description of Artificial Sequence: Synthetic coding sequence
atgatggacgccagcaaggagctgcaggtgctgcacatcgacttcctcaatcaggacaatgcagttagtcatcatacctgggagttccagacctcctcccctgttttccgacgggggcaagtgtttcacctgcgcctggtcttgaatcagccacttcagtcctaccatcagctgaagctggagttctcaaccggtcccaacccgagtatcgcaaaacacacccttgtggtacttgatccaaggacgccaagtgatcactataactggcaggcaacattacaaaatgaaagcgggaaggaagtgaccgttgcggtaacaagttcaccaaatgccatcctgggcaagtaccagctgaatgtgaaaacaggaaaccacattctgaaaagcgaagaaaacatcttatatcttctatttaacccgtggtgtaaagaggacatggtatttatgcctgatgaagacgagcgaaaagaatatatactgaacgatactggctgccattacgtgggagctgctcgtagcattaaatgcaaaccgtggaatttcggacagtttgagaaaaacgtgctggactgctgtattagcctcctcaccgagtccagcttaaagcccaccgaccgacgcgatccggtgctcgtgtgcagggctatgtgtgcaatgatgtcattcgaaaagggccagggtgtccttataggcaactggactggcgactatgaggggggaactgccccctacaagtggaccggatccgcgcccatcctgcagcagtactataataccaagcaggcagtctgttttggacagtgttgggtgtttgcgggtatactaaccactgtgttgcgcgccctgggcataccagcacgatccgtcaccggcttcgacagtgcacatgatactgaacgaaacttgactgtggacacttacgtaaatgagaacggtgagaagattacgtctatgacacatgactccgtgtggaattttcacgtgtggaccgatgcatggatgaaacggcccgatctgcctaaggggtatgacgggtggcaggctgtggacgccactccacaggaacgcagtcaaggcgttttctgttgtgggccttcccccctcaccgccataagaaagggggacatcttcatcgtttacgacacgcgcttcgtttttagtgaggtcaacggtgaccgtttgatctggctggtcaaaatggtgaacggccaagaggagctgcatgtgatctctatggaaacaactagtataggaaagaatataagcaccaaggcagtaggccaagacaggagaagggatatcacctatgagtacaagtaccccgaaggtagcagcgaagagagacaggtgatggaccatgcgtttctccttcttagctctgagcgggagcacagacgacctgtcaaggagaacttcctgcatatgtctgtgcagagcgatgacgtgctgctcggcaatagcgtgaacttcacagtaatcctgaaaaggaaaaccgctgctttacagaacgttaacattctcggatcctttgaactccagttgtacacgggaaaaaagatggccaagctttgcgatctgaataagacttcccagattcagggacaagtgtctgaggtgactttgaccctggactcaaagacctacattaattcacttgccattctggacgatgagcccgttattagaggctttatcatcgcagaaatagtggagagcaaagagattatggctagcgaagtttttaccagcttccagtaccccgaattctcaatcgagctgccgaatactggaagaataggccagctgctcgtttgcaattgtatttttaaaaataccctggcgattccattgaccgatgtgaagttcagcctggaatccctagggatcagtagccttcagactagcgaccacggtacagtgcagcctggcgagacgatccagagtcagataaaatgcacccccatcaagaccgggccaaaaaagttcatagtaaaactatcctcgaaacaggtaaaagaaataaacgcccaaaaaatcgttcttatcaccaagtag

SEQ ID NO: 209166 - DNA, 1626 bp, Artificial Sequence
  Description of Artificial Sequence: Synthetic coding sequence
atgttcagctggatgggccggcaggccggcggccgggagcgggccgggggggcagatgctgtccaaactgtcacagggggactgagatctctgtaccttcgaaaggttttacccctggaagaggcatatagattccacgaattccatagtcctgctctggaagacgctgacttcgagaacaagccaatgatcttactggtaggccagtattctacaggtaagactacattcattcgctatttgctggaacaggacttccctgggatgaggatcggtcctgaacccacaactgattcattcattgctgtgatgtatggtgagacagagggtagtactcccgggaacgccctggtggtggaccctaaaaagccatttaggaagctgtccagattcgggaacgcttttctgaaccgctttatgtgctctcagctgccaaaccaagtcttgaaaagtatcagcgtaatcgatagccctggcattctcagtggagaaaaacagaggatatcccgaggatatgatttctgccaagtgctgcagtggtttgcagagcgagtggaccgaatcatccttttgtttgatgcgcataaactagatatttccgacgagttctcagaagccatcaaagccttcagaggtcaggacgacaagatccgtgtcgttttgaacaaagccgaccaggttgacacgcagcagctcatgcgagtgtacggagccctcatgtggtctcttggaaaggttattaatacccccgaagtgttgcgcgtgtacatcgggtccttctgggctcaacccctgcagaacactgataataggagactttttgaagcggaagctcaggatctgttccgggacattcagtccctgccccagaaggccgctgtgcgaaagctgaatgacttgatcaaacgcgcacgcctggccaaggtccacgcatatattatttcgtatcttaagaaggagatgccaagcgtgtttggcaaagaaaacaagaaaagagaactaatctcccggcttcccgagatttacatccagcttcagagggagtaccagatttccgcaggcgatttcccggaagtgaaggccatgcaggaacagctggagaattacgattttacaaaatttcatagcctgaaacccaagttgattgaggccgtggataatatgctctcgaataagatatccccactcatgaacctgattagccaggaggagactagcacccccactcagttggtgcagggtggcgccttcgacggcacaactgaggggccatttaatcaggggtacggcgagggtgccaaggaaggtgccgacgaggaagagtgggtggttgcaaaggacaagcctgtgtatgatgaactgttttatacactttctcctatcaacgggaagatctcaggcgttaacgccaagaaggaaatggtaactagtaaattgcccaattccgtgctgggcaagatatggaagttggccgattgcgactgcgacgggatgctggatgaggaggagtttgccctcgccaagcaccttattaagataaaactggacggctacgaactgcctagctctctgccccctcatctggtaccaccttcgcatagaaaaagcctccccaaagcagactag

SEQ ID NO: 209167 - DNA, 1917 bp, Artificial Sequence
  Description of Artificial Sequence: Synthetic coding sequence
atggcccagggcctggaggtggccctgaccgacctgcagagcagccgcaataacgtgcggcaccacactgaggagattacggttgatcacctactggtgcgtcgcggacaggccttcaatctcactctgtacttcagaaataggtcatttcagccgggactcgacaatattatatttgtcgttgaaacagaggacgcagtgtatcttgacagcgaaccgcaacgccaggagtacgtaatgaatgactatggattcatataccagggatcaaaaaattggatcagaccctgcccttggaactacggacaatttgaggacaagattatcgatatatgtctgaagcttctagataagtctttgcattttcaaacggaccctgctacagactgcgcactgcgcggaagccccgtgtacgtgtcccgcgtggtgtgcgccatgatcaattctaacgacgataacggggtgcttaacggaaattggtcggagaactacaccgacggtgccaaccctgcagagtggactggttccgtggccatactcaagcaatggaatgcaaccggatgccagcctgtgcgctacggacagtgctgggtattcgcagcagtgatgtgtaccgtcatgcgttgtcttggcatacctactagagttatcaccaatttcgatagtggacacgacactgatgggaacttgattatagacgagtactatgacaacaccgggcgcatcttgggcaataagaaaaaggacaccatctggaatttccatgtgtggaacgaatgctggatggccaggaaagaccttccgcccgcttatggaggctggcaggtgctggatgcaacacctcaagaaatgtctaatggcgtgtactgttgtggcccagcatcagtgagagccatcaaagaaggcgaggtggatctgaactacgacacccccttcgtgttctctatggtaaacgccgattgtatgtcttggctagtccagggagggaaggagcaaaaactgcatcaggataccagctctgtgggtaactttataagcacaaagtccattcagtccgacgaaagagatgacatcacagagaactataagtacgaagaaggcagtctccaagagcgccaggtcttcctgaaggccctgcaaaaacttaaggcgagaagttttcatgggtcccagagaggggccgagctgcaaccatcacgccctacgtccctatctcaagactcgccccggtccctacacaccccatccctgcgaccttccgatgttgtgcaggtgtcattgaaatttaagctgttggatccccctaacatggggcaggatatctgctttgtgctgctggccctgaatatgtcctcgcagttcaaagatcttaaagtcaatctttctgcacagagcttgcttcatgacggatctcccctgagccccttctggcaggacacagcattcatcaccctttccccgaaggaggcgaaaacctacccctgtaaaatttcttactcccagtattcccagtacctctctaccgataaattgattcggatctcagccctgggggaggaaaagtcatctcccgagaagatccttgtgaataagattatcaccttgagctatccatccattacgattaacgtgctcggagccgccgtcgtgaaccagcccctgtctatacaagtaatattcagtaacccactctcagaacaagtagaggattgcgtgcttacggtcgaaggctctggactgttcaagaagcaacagaaagtctttctcggagtgctcaaaccacaacaccaagcttcgattattctggaaacagttccttttaagagcggtcagcggcagattcaagccaatatgcgcagcaacaaattcaaagacatcaaaggatacaggaatgtatatgtcgactttgcactctag

SEQ ID NO: 209168 - DNA, 2160 bp, Artificial Sequence
  Description of Artificial Sequence: Synthetic coding sequence
gcccagggcctggaggtggccctgaccgacctgcagagcagccggaataacgttcggcatcataccgaggaaattaccgtggaccaccttctggtacggcgagggcaggcatttaacttaaccttatacttccgtaaccgctcttttcagccaggcctcgataatatcatcttcgtcgtggaaacaggaccactcccagatctcgccctgggcacccgggccgtgttctctctggcgcggcaccactccccatcaccttggattgcctggctggagaccaacggagctactagcaccgaggtatcactgtgtgctccaccgactgctgccgtgggacggtatctcttgaagattcatatcgattcattccagggatccgtcactgcctaccaactgggcgagttcattctgctattcaacccttggtgcccagaggatgctgtttatttggacagcgagccgcagcggcaggagtacgttatgaacgattacgggtttatctaccaagggagtaagaactggatccggccctgcccctggaactatgggcagtttgaggataaaattattgatatttgccttaaattgctggataagagtctgcactttcagactgatccagcgaccgactgtgcacttcgcggcagccctgtttatgtctcccgcgtggtgtgtgcaatgataaactctaacgacgataatggcgtcttgaacggcaattggtccgagaattatactgatggcgccaaccctgcagagtggactggcagcgtggcaattctgaagcagtggaacgctactggatgccagccagtgagatatgggcaatgctgggtattcgccgctgtaatgtgcaccgtcatgagatgcctcgggatccctactcgggttatcaccaattttgattccggacatgacaccgacggaaacctgatcatcgatgaatactacgacaacactgggagaatcctgggcaataagaaaaaggatactatctggaatttccacgtatggaacgagtgctggatggctaggaaggatttgccgccagcttatgggggttggcaggtgttagacgctactccacaagagatgtcgaacggcgtatattgctgtgggccagcttccgtgcgcgcgataaaggaaggcgaggtcgacctgaattatgataccccgtttgtgttcagtatggtgaatgcggattgtatgagctggttagtacagggaggcaaggagcagaaactccatcaggacaccagcagtgtgggaaacttcatcagcacaaagagcattcagagtgacgagcgggacgacattaccgagaactataagtacgaggagggttccctacaggaaagacaagtcttcttaaaagccctacaaaagctcaaagcgaggagtttccatggctcgcagcggggcgccgaacttcaaccaagcagacctacctccctctcgcaagattcaccccgctccctgcataccccgagcttacggccaagcgacgtagtgcaggtgtcgctcaaattcaagttgctcgacccacccaatatgggacaggacatctgcttcgttctgttagcactaaatatgtcatctcagttcaaggacctgaaggttaacctgtctgcccaatcattgctacatgacggtagccctctctcccctttttggcaggacacagcgtttataacactgtcccccaaggaggcaaaaacgtacccttgtaaaatttcttactcccagtacagccaatacctgtctactgacaaattgataaggatctctgccttaggagaggagaaatcctcaccggaaaaaatccttgttaacaagattatcactttgtcatatccctctataacaatcaacgtgctgggagctgccgttgttaaccagcccctttccattcaggttatcttttctaatccccttagcgaacaggtggaagattgtgtgctgaccgtcgaggggagcggcctgtttaaaaaacaacagaaggtgtttcttggcgtcctgaaaccacagcatcaggcgtccattatactggagacggtaccttttaaatccgggcaacgccagatccaagccaatatgcgatcgaacaaattcaaagacattaagggctatcggaacgtgtatgtggattttgctctttag

SEQ ID NO: 209169 - DNA, 2121 bp, Artificial Sequence
  Description of Artificial Sequence: Synthetic coding sequence
atggccggcatccgggtgaccaaggtggactggcagcggagccggaatggcgctgctcatcatacccaggagtatccttgtcccgagctggtggtgcggagagggcagagctttagcctgacactggaattgtcccgggctttagactgcgaagagatccttatatttactatggaaacaggccctcgcgcctccgaagctcttcacacaaaggccgttttccagacttccgaactggaaagaggagaaggatggacagctgctcgggaagcccagatggagaagaccctcactgtgtcccttgccagcccaccatcggccgtgatcgggaggtacttgcttagtatcaggctgagctcgcataggaaacactcaaatcgaaggctgggggagttcgtgctgctcttcaatccttggtgcgctgaggatgacgtgtttctcgccagtgaggaagagcgacaggaatacgtgctttccgattccgggataatcttcagaggagtggagaaacacattagagctcagggctggaattatggccaattcgaggaggatattctgaatatctgtctgtctatcctcgaccgcagcccaggccaccagaacaatccagcaactgacgttagctgtcgccataacccaatttacgtcacccgggtgatctcagccatggtaaactcaaataacgacaggggggttgtgcagggtcagtggcagggcaaatacggcgggggtacctctcccctgcactggcgcggatctgtggcaatactccagaaatggctgaaggggagatataagcccgttaagtatggtcagtgttgggtcttcgcaggagtactgtgcacggtgcttcggtgcctcggaattgcaaccagagttgtctctaattttaattctgcgcatgacacagaccagaatctgtctgtcgacaaatatgtggatagctttggacgcaccttggaggatctgacggaggatagcatgtggaatttccatgtctggaatgagtcttggttcgccagacaggatctggggccttcttacaatggctggcaggtccttgatgccacacctcaagaagagagcgaaggcgtcttccgctgcggtcccgcctccgtcacggctatcagagagggcgatgtccatctggcgcacgatggtcccttcgtgttcgctgaagtgaatgctgactacattacatggctctggcacgaagatgagagccgggaacgggtgtattcaaacaccaagaaaatcgggaggtgtatatctactaaggccgttggctccgatagccgagtggatatcaccgatctctacaaatatcccgagggcagccggaaggagaggcaggtttactcaaaagcagtgaacagactcttcggcgtcgaggcctccgggcggaggatttggatccggcgtgctggcggtagatgcttgtggagagatgacttgctggaacccgccacgaaaccttctatcgcaggcaagttcaaggtgctcgagccaccgatgcttgggcacgacctccggcttgccctgtgcctcgctaacttaacctctcgggcccagcgcgttagggtgaacctgtccggtgccactatcctctataccagaaaaccagtggccgaaatattgcacgaatcccatgcagtgcggctgggcccacaagaagaaaaacgcatccccattaccattagctactcaaaatacaaggaggacctcacggaggataaaaaaatacttctggcagctatgtgccttgtgactaagggggaaaagttactggtggagaaggatataaccctggaggatttcatcacgattaaggtacttggtcccgccatggtgggtgtcgccgtgactgtggaagttaccgtcgtcaatccactcatagaaagggtgaaggattgcgcattaatggtggaaggcagtggactattgcaggaacaattatccattgacgtcccaacccttgagccccaggagcgtgctagtgtacagtttgacatcactcccagtaagagtggtccaagacaactgcaggtggacttggtgagcccccactttcccgatattaaaggattcgtcatcgtgcacgtcgctactgctaagtag

SEQ ID NO: 209170 - DNA, 1878 bp, Artificial Sequence
  Description of Artificial Sequence: Synthetic coding sequence
atggccggcatccgggtgaccaaggtggactggcagcggagccggaacggcgctgcccaccatacacaagaatacccatgtcccgagctggtcgttcgccgggggcagtctttttcccttaccttggaattgtctagagcccttgactgcgaggaaatcctgatctttacaatggaaacaggaccacgtgctagcgaagctttacacactaaggccgtatttcaaactagcgaactggagaggggagagggctggactgctgccagagaagcccagatggaaaagaccttgaccgtctctttggctagcccaccctcagcagtgatagggcgttacctcctttccatcagactttcctcccacagaaagcatagcaacagaagattgggcgagttcgtgttgctgttcaacccgtggtgcgcagaggacgatgtttttctagccagtgaggaggagcgccaggagtacgtgctgagcgacagcgggataatattccgcggcgtggaaaaacatattagagctcaaggatggaactatggccagtttgaagaagatattctcaatatttgcttgagcatcctggatagatctcctggacaccaaaacaatcccgctacagatgttagctgccggcacaaccccatctacgtaacaagagtaataagtgctatggtgaactccaataatgaccgaggcgtcgtgcagggacaatggcagggtaaatatggcggaggcacatcacctctacactggcgtggctctgtcgccattctgcaaaagtggctgaaggggcgctacaagcctgtcaaatacggacaatgttgggtgtttgctggagttctatgcaccgtactccgctgcttaggcatcgctacgagagtggtgtcaaatttcaattcagcgcacgacaccgaccaaaacctctccgtcgataagtatgtggactcatttggcaggactctcgaagatctaactgaggattcaatgtggaattttcatgtttggaacgaatcatggtttgcacgacaagacttgggcccatcgtacaacggatggcaagtactggacgctaccccccaggaagagagtgagggtgtttttcggtgtggacctgcttcggtcactgctattcgggagggcgatgttcacctggcccacgatggcccgttcgtgttcgctgaggtcaatgcagattacatcacctggctttggcacgaggacgaaagtcgtgaaagagtatactctaacaccaagaaaattgggcggtgcatttctaccaaggcagtcggctccgactcccgtgttgacatcacggacctctataaatatccggagggatccaggaaggagcgccaggtgtattcgaaggccgtcaacaggctgtttggggttgaggcttcgggtcgccgcatctggattagacgggctgggggccgatgcctgtggcgtgacgaccttctcgaaccagcaactaaaccaagcattgctggaaagttcaaggttcttgaaccacctatgctgggtcacgatctcaggttagccctttgtttagccaacttaacatcgagagctcagagggtgcgcgtgaatctgtcgggagctactatcttgtacacacgtaagccagtggccgagattttacacgagtcgcacgccgtgcgcctaggcccacaagaagagaaacgtatcccaattactatctcttacagcaagtacaaagaggacctgacagaggacaagaaaatcctattggccgctatgtgtctcgtgacaaagggtgaaaagttactggttgagaaggatatcaccttggaggacttcatcaccattaaacgggcctaccctggggcctctggggaagggctgtcacctgtgtag

SEQ ID NO: 209171 - DNA, 2133 bp, Artificial Sequence
  Description of Artificial Sequence: Synthetic coding sequence
atggaccaggtggccaccctgcggctggagagcgtggacctgcagagtagtagaaacaacaaggagcaccacacccaagagatgggcgtaaaaaggctgaccgttaggagaggtcagcccttctacttgagactaagcttctctcgtccattccagagtcagaatgatcacataacgttcgtcgctgagaccggccccaaaccctctgaactgcttggaacccgcgccacatttttcctgacacgggttcagcctggaaacgtgtggagcgctagtgacttcacaatcgacagtaatagtttacaggtcagcctctttacgcctgccaacgcggtaatcggacactatacactgaagatcgagatcagtcaaggacaggggcactctgtcacataccctttagggaccttcatcctcttgtttaacccctggtctccagaggatgatgtgtacttaccatctgagatccttcttcaggaatacattatgcgtgactacgggtttgtgtataagggacacgaaagattcattaccagctggccctggaactatggccagtttgaggaggatattatcgatatctgtttcgagatactcaataagtcattgtaccacctgaagaatccagccaaggactgctcacagcgaaacgacgtggtgtatgtctgccgggtggtttcagccatgatcaattccaacgacgataacggagtgttgcaaggcaactggggtgaggactactccaaaggtgtgtcgcccctagaatggaagggttcagttgccatcctccagcagtggtccgcgcgcggcgggcagcccgtgaagtacggacagtgctgggtgtttgcctcggttatgtgcactgtgatgaggtgcctcggtgtcccaacacgggtggtcagtaacttcaggagcgcccataacgtggaccgtaacttgacaatcgatacctactatgacagaaacgccgagatgctcagcacccagaaaagagacaagatttggaatttccacgtgtggaatgagtgctggatgatacggaaagatctacccccaggctataatggatggcaggtgctcgaccctaccccacagcagacttcttctggtctgttttgctgtggacccgcctctgttaaagcgatccgagagggcgacgttcacttagcttacgatactccttttgtgtatgccgaggtcaatgctgatgaagtaatttggctgctgggtgatggtcaagctcaggaaattctcgcccacaacacttcctcaatagggaaggagataagcaccaaaatggttggcagtgatcaacgccagagcattacgagttcctacaaatatcccgagggcagcccagaggaaagagccgtgttcatgaaggcctcccgcaagatgctgggcccacagcgcgcatcactcccttttcttgacttgctcgaaagcggaggacttcgcgatcagccagcccagctccagctgcatctggcccggatacccgaatggggccaagacctgcagctgttgctacgtatccagcgggtcccggactctacgcacccccgagggcccatcgggctggtggtgcgcttttgtgcgcaggcactgctgcacggaggagggacacagaaaccattctggcggcacactgtccgaatgaacctggactttgggaaagaaacacagtggcccctcttgctgccgtattcaaattataggaacaagctaacagatgagaagctgatccgagtcagtggtatcgctgaggtagaggagacgggtaggtctatgctagtgctgaaggacatttgcctggaacctcctcacttgtcaattgaagtgtcagaacgcgctgaggtaggcaaggctctaagagtgcatgtcaccttaacaaacacactgatggtggctctgtcgtcatgcactatggtgctcgaggggagtggcctcatcaatggacaaattgccaaagacctgggcaccctggttgctggacacacgttgcaaatccagctggacctgtacccaacgaaggcaggcccaagacagctccaagttctgatttctagtaatgaggtgaaggagataaaaggttacaaggatatcttcgtgacagttgctggcgctccctag

SEQ ID NO: 209172 - DNA, 846 bp, Artificial Sequence
  Description of Artificial Sequence: Synthetic coding sequence
atgcggttcgtggtggccctggtgctgctgaacgtggccgccgccggggcagtacccctcctggccaccgaaagcgtcaagcaggaggaagccggggtgaggccttcagcaggaaatgtttcgacacatcccagtctgagtcaaaggccaggcgggtctacaaaatctcatcctgagccacaaacaccaaaagattccccttccaaaagttcctcagaggcacagaccacaaaagacgtgcctaataagtccggcgcagacggccagacacctaaggacggctcttctaagagcggcgctgaggatcaaacccccaaggatgtccctaacaaatccggagcagagaaacagactcccaaagatggttctaataagtccggcgctgaggagcaagggccaatcgatgggccttctaaatcaggggctgaggaacagacgagcaaggacagcccaaacaaggaagaggtgaagagcagcgagcctacagaggatgtggagcccaaagaagccgaagacgacgacactgggcccgaagagggctccccccccaaagaagagaaggagaagatgtcgggatcagcgtcgtccgagaacagggagggtacgttaagcgattcaactggttccgagaaggacgatctctacccaaatggatctggcaacgggtctgcagagagcagccatttctttgcatatctggtgaccgccgcgattttggtagccgtgctgtacattgcccatcataataaacgaaaaattattgcctttgtccttgaaggcaagcgtagcaaagtgacaagacggcccaaggcttccgactaccagcgcctggaccagaagagttag

SEQ ID NO: 209173 - DNA, 1314 bp, Artificial Sequence
  Description of Artificial Sequence: Synthetic coding sequence
atgcggttcgtggtggccctggtgctgctgaacgtggccgccgccggagctgtgcccttgctcgccacggaatcagttaaacaagaggaagctggcgtgcgaccttccgcgggcaatgtgtcaacgcaccctagcttatcccaacgcccaggaggtagcaccaaatcccacccagagccgcagactccaaaagactctccttctaagagcagtgcagaagctcaaacacccgaggacacccccaataaaagcggcgcagaagcgaagacccagaaagattccagtaataagtccggggccgaggcgaagactcagaagggctctacatctaagagcggctccgaggcccagaccactaaggactccacgtctaagtctcaccccgaattgcagacccccaaagatagtacaggtaagagcggtgccgaggcacagacaccagaggattccccaaaccggtccggagcagaagcaaagacgcagaaagacagccctagcaaaagcgggtctgaggcccagacaacaaaggatgtgccaaacaaatctggggcagatggtcagacgcccaaggatggctcgtctaaaagcggggccgaggatcagacccccaaggacgtgcccaataagtccggagccgagaagcagactcccaaggatgggagcaataagtcgggcgcggaggagcaagggcctattgatggtccatctaaatctggggctgaggagcagacctccaaggacagtccaaacaaggtggtccccgagcagcccagccggaaggatcatagtaaacccattagcaacccgagcgataataaggagttgccgaaggccgataccaaccagctggccgacaagggaaaactcagtccccacgcttttaagacggagtcgggcgaggagacagacctgattagccctccccaggaggaagttaagagctccgagccaacagaagatgtggagcccaaggaggcagaggacgacgacactgggcccgaagaaggatcaccacccaaagaagagaaggaaaagatgtctggaagtgcttcctccgaaaatagggaagggacccttagcgactcgaccggctcagagaaagacgatctctaccccaacggaagcgggaatgggagcgcagagtcaagccacttttttgcctatctcgtgactgctgccatcctcgttgctgtgttgtatatcgctcaccataacaaacgcaaaatcattgcctttgtgcttgagggcaaaaggtctaaagtgactcgtagaccaaaggcgtccgattaccagagactggaccagaagagctag

SEQ ID NO: 209174 - DNA, 1140 bp, Artificial Sequence
  Description of Artificial Sequence: Synthetic coding sequence
atgcggttcgtggtggccctggtgctgctgaacgtggccgccgccggagctgtgccgctcctggctacagagtcagtcaaacaagaggaggcaggggtacgtccaagtgccggaaatgtttcgactcaccccagtctgagccagcggcccggcgggtccaccaaaagccatccggaacctcagacacccaaggatagccctagcaagtccagcgccgaggcacagaccccggaggataccccaaacaaatctggagcagaagctaagacccagaaagactcctcaaataagtctggagccgaggccaaaacacagaaaggatctacaagtaagtctgggtctgaagcacagactactaaggattccactagcaaatcccatccagagcttcagactcccaaagacagcaccggcaaaagtggcgcggaggcccaaacccccgaggactctcccaatcgatcaggtgcggaggccaagacacagaaggattccccatccaaaagcggctctgaggcccaaacaactaaggacgtacctaacaagtccggcgcagacgggcagaccccaaaggatggttcctccaaatccggtgctgaagatcagacgcccaaggacgtccctaataaatctggggccgaaaaacagacccccaaggacgggagcaataaatcaggcgcggaggagcagggcccgattgacggtccttctaagagcggggccgaagaacagacttccaaggattcgccaaataaagaagaggtgaagtcttcagaacctaccgaggatgtggaacccaaagaggcagaagacgacgatacaggcccagaagagggatctccgccaaaagaagaaaaggagaaaatgtctggaagtgctagcagcgagaatagggagggaactctgagcgacagcactggcagcgaaaaagacgatctgtaccccaacggatccggtaatggcagcgcggagtcttcccatttcttcgcctacttggtcactgctgcaatcctggtggccgtgttgtacatagctcatcataacaaaaggaaaatcattgcgtttgtgctggaggggaagcgatccaaagtgacaaggcgccccaaagcctctgattaccagcgcctggaccagaagtcgtag

SEQ ID NO: 209175 - DNA, 1362 bp, Artificial Sequence
  Description of Artificial Sequence: Synthetic coding sequence
atgcggttcgtggtggccctggtgctgctgaacgtggccgccgccggagccgtgcccttgctggcaaccgagagcgtaaaacaggaggaggcgggtgtccgaccttctgcgggaaacgtttctactcatccatctctgtcccagcggcctggcggctccaccaaatcccaccctgagcctcagactcccaaagattccccttctaaatcctccgccgaagcccagacgccagaggataccccgaacaagtcaggggccgaggcaaaaacgcagaaggactcaagtaacaaatctggcgctgaagctaagacgcagaagggcagcacatccaagagcggcagtgaggcgcagacaactaaggactccacatctaaatcccatccagaactgcagacaccgaaagattccacggggaagagcggagccgaggcgcaaactccagaagattcgccaaatagaagcggcgcagaggccaaaacacagaaggactctccctctaagtctggctccgaggctcaaaccaccaaagacgtgccgaataagagcggagcagacggacagacgccaaaagatgggagctctaagtcaggagcggaagaccagacccctaaagacgtacctaacaagtctggagccgaaaagcagactcctaaggatggtagcaacaaatcaggcgccgaagagcaaggacctatcgacgggccttcaaagagcggcgctgaggaacagacctccaaagattcgccaaataaggtcgtgcctgagcagccatcccggaaggaccactccaaacccatcagcaacccgtccgataacaaagaactgcccaaagccgataccaaccagctggccgataaaggaaagcttagcccacatgctttcaagaccgaatctggtgaggagaccgatttgatttcgcccccgcaggaggaggtaaagtccagcgagcctaccgaagacgtggagcccaaggaggccgaagatgatgatactggtccagaagagggatcaccccccaaagaagagaaagaaaaaatgtccggctctgcttcctctgaaaatcgggagggaacactgagcgactctacaggaagcgaaaaggacgacctgtaccctaatgggtccggcaatggcagcgccgagagctctcatttcttcgcttatctggtgaccgccgccatcctggtagcagtgctgtacatcgcccatcacaataaacggaagattatcgcgttcgtattggaaggcaaacggagcaaggtaacccgcagacccaaggcctctgactaccaacgtctcgaccagaagatcttcttcccactgagtcccaaccggatggtgtattcaagcggaaagcggtag

SEQ ID NO: 209176 - DNA, 693 bp, Artificial Sequence
  Description of Artificial Sequence: Synthetic coding sequence
atgtacgtgcgggtgagcttcgacaccaagcccgacctgctgctgcaccttatgaccaaggaatggcagctggaactgcccaagttgcttatcagcgtgcacggaggcctgcagaattttgaattgcagccaaagctcaaacaggtctttgggaaaggtcttataaaggctgctatgacaaccggagcctggatctttactggaggagtcaacactggggtaattagacacgtgggggatgcactcaaggaccacgcttcaaaaagtcggggcaagatctgcaccatcggaatcgctccgtggggtatcgtcgagaaccaggaggacctgattggtagagatgttgtgcgcccctaccaaaccatgagcaaccccatgtcgaaactaaccgtccttaacagtatgcattctcactttattctggccgacaacggaaccactggaaaatatggcgccgaggtgaagcttagaagacagctggaaaagcacatcagcttgcaaaagatcaacactcgaatcgggcagggggtacccgtggtcgccctcattgttgagggagggcccaatgtcatcagcatcgtattggaatatctccgtgatactccacctgtgcccgtcgtcgtgtgcgacggatctgggcgggcctcggacatactagctttcggccacaaatattccgaagagggaggctag

SEQ ID NO: 209177 - DNA, 2520 bp, Artificial Sequence
  Description of Artificial Sequence: Synthetic coding sequence
atgaagaagtggagcagcaccgacctgggcgccgccgccgaccccttgcagaaagatacctgcccagatcctcttgatggagatcctaattcaagaccacccccagccaagccccagttgtccacagcaaaaagccgcaccagactgttcgggaagggagattcggaagaagcttttcctgtcgattgccctcacgaggagggagaacttgactcctgcccgaccatcacggtgtccccagtgataacaatccagcgcccaggagacggtccgaccggcgcccggctcctgtcccaggactccgtcgctgcgagcacagaaaagactctaagattgtatgatagaagatcaatcttcgaagcagtcgcacaaaacaattgccaggatctggaaagtttattgctctttctgcagaagtctaagaaacacttaactgataatgagtttaaggacccagagactggcaaaacctgcctgttaaaggccatgctgaacctgcatgacggccagaacaccacaattcccctgcttctggagattgcccggcagacggacagcttaaaggagctcgtaaacgcttcatataccgattcgtactataaagggcagacagctctgcacattgctatcgagcggcgcaacatggctctggtgacacttcttgtcgagaacggagctgacgtccaggctgcggcgcacggggatttcttcaagaaaacaaagggtagacccggcttctactttggagaactgcctttatcactggccgcatgtactaaccaacttgggatcgttaagtttctcttgcagaactcatggcaaactgccgatatttccgccagggactccgtgggaaacaccgttttgcatgccctggtcgaggttgccgacaacactgcggacaacactaagtttgttactagcatgtataatgaaatccttatgctcggggctaaactccatcctacactcaaacttgaggaattgacaaacaagaaaggaatgactcccctcgctctcgcagccgggactggaaaaataggggtgctggcctacattctacagcgagaaattcaggaaccagaatgtcggcacctgtctcggaaatttacggagtgggcatatggccctgtccatagctcattatacgacctgagttgcatagatacttgtgaaaagaactcagtgctggaggttatcgcctactccagctccgaaacaccgaaccgccacgacatgttgctggtagagccactgaatcgcctgcttcaagataaatgggacaggtttgtgaagcggatattctactttaatttcctggtgtattgtctgtacatgattatatttacaatggctgcttattacaggcccgtggatgggctacctccctttaagatggagaaaacaggggactattttagagtgacaggcgaaattctttctgtcctcgggggtgtttacttctttttcagagggatccaatactttttgcagagaagaccttccatgaaaaccctgttcgtcgatagctattccgagatgctgttctttctgcagtccttgttcatgctggccacagtcgtgctgtatttttcccaccttaaggaatatgtggccagcatggtatttagcctggcactcgggtggaccaacatgctttattacacaagaggttttcagcagatgggcatttatgctgttatgatcgagaagatgattcttcgtgacctgtgtcgctttatgtttgtttacattgtcttcctctttggcttctccacggctgtcgtcaccctgatcgaagacggtaaaaacgacagtctgccaagcgagtccacatcacaccgttggaggggcccagcctgccggccccccgatagctcatataatagtctgtactccacatgcttggagctgtttaaatttaccatcggaatgggggatttggaatttaccgaaaactacgattttaaggccgtgttcattatcttactgctggcgtacgtgatcctcacctacatcctgttactgaacatgctgattgctttgatgggggaaactgtgaataaaattgctcaagaatccaagaatatttggaaactgcagcgggcaatcacaattttagacaccgaaaaatcttttttgaaatgcatgaggaaggcatttcgctctggcaagctgttacaggtgggatatacacctgacggcaaggatgactacagatggtgttttagggtcgacgaagtcaactggaccacgtggaacaccaacgtgggcatcataaacgaggaccctggtaactgtgaaggggtcaaaagaaccctgagttttagccttagatcttcgcgggttagcggtcgtcactggaagaattttgctctcgtccccctgctgagagaggcgagcgccagggaccgccaatccgctcagcccgaagaggtctatctgagacagttctctggatcccttaagcccgaggacgccgaggtctttaagtcacccgccgccagcggcgagaagtag

SEQ ID NO: 209178 - DNA, 2373 bp, Artificial Sequence
  Description of Artificial Sequence: Synthetic coding sequence
atgaaggcccaccccaaggagatggtgcccctgatgggcaagcgggtggccgccccatctggaaacccagccatattgcctgagaagcgtcctgcagagatcacccccacaaaaaagtctgcccacttctttctggaaattgaaggcttcgaaccaaacccaaccgtggctaaaacaagtccccctgtcttttcgaagcctatggattccaatattaggcagtgcatctctggaaactgcgacgacatggattccccccagagtcctcaagacgacgttactgagactcctagcaatcccaactctccttccgctcagctggctaaggaggagcagcggagaaaaaagagacgcctaaagaagcggattttcgcagctgttagtgagggttgcgttgaagagttggtagaactgctagtggaattacaggaactgtgcaggcgtaggcacgacgaggatgtgcccgatttcctgatgcacaagctgactgcttcagatactggaaaaacctgcctaatgaaagccttgttaaatattaacccaaatacgaaagaaatagtcagaatactcctcgcatttgccgaggagaacgacattctggggcggttcatcaatgcggaatacaccgaggaggcatacgaagggcagacggccctaaatatcgctatcgaacgccggcagggagacatcgccgccctcctcattgcagcgggggcggacgtcaacgcccacgctaagggtgccttttttaatcccaaataccagcatgaaggcttttatttcggagaaacgcccttggccctggctgcatgcacgaatcaaccggaaattgttcaacttctgatggagcatgaacagacagacatcacctcaagggacagtcgtggtaacaacattttacacgcactggtgaccgtcgcggaagattttaagacacagaatgacttcgttaagcgcatgtacgatatgatcctcctcagatcaggtaactgggagctggagactacccgcaataacgacgggctaacacccctgcagttagcagcgaaaatgggcaaggccgagatccttaagtacatactgtccagggagatcaaggaaaaacgcctccggagcctgtcacgcaaattcacagattgggcttacggacctgtctccagctctctgtacgaccttacgaatgtggatacgacaactgacaattctgtgctcgagattaccgtctacaacaccaacatagacaataggcacgaaatgcttactctggaacctctgcacaccctgctgcacatgaaatggaagaagtttgcgaagcacatgttcttcttgtccttttgcttctacttcttctacaatattactcttactttggtttcctactaccgacctcgcgaagaggaggccataccccacccactagcgctgactcataagatggggtggttgcagcttttgggaagaatgtttgtgctgatatgggcaatgtgtatctccgtgaaagagggcattgcaattttcctgctgagaccatccgacctgcagtcgatacttagcgatgcctggttccacttcgtgttctttattcaggctgtgcttgtgatcttgtccgtgtttctgtaccttttcgcctataaggaatacctggcatgcctagtgctggctatggctttgggctgggccaacatgctgtattataccagagggtttcagagtatgggtatgtacagtgtcatgatccaaaaagttatcttgcatgacgtcctgaaatttctatttgtctatattgtctttttgctgggattcggggtggctctggcatcgctcattgagaaatgtcctaaagacaataaagattgtagttcttacggctcgttttcagacgctgtattggagttgttcaagcttaccattggcctgggagacttgaacattcaacaaaatagcaagtaccccatcctttttctttttctccttataacctacgttatcctgacttttgtacttctgttgaacatgctgatcgccctgatgggtgaaacggtggaaaatgtatccaaagagagtgaacggatatggaggctgcagcgggcacgcaccatcttggaattcgagaaaatgttgccggagtggcttcgctcccgctttaggatgggtgagctctgcaaggttgctgaggacgatttccggctgtgtctccgcataaacgaagtgaaatggaccgaatggaaaacgcacgtctcttttcttaacgaagaccctggtcccgtgcgcaggaccgatttcaacaagatccaggactcatcgcggaataattcaaagaccactctcaacgctttcgaagaggttgaggagtttccagagacgagtgtgtag

SEQ ID NO: 209179 - DNA, 3360 bp, Artificial Sequence
  Description of Artificial Sequence: Synthetic coding sequence
atgaagcggagcctgcggaagatgtggcggcccggcgagaagaaggagccacagggggtggtgtatgaagatgtcccggatgacacggaggactttaaggaatctctcaaggtggtatttgaaggaagtgcttacggcctgcagaattttaacaagcagaagaaactgaagcgttgtgatgacatggataccttcttcctgcattatgcggccgccgaggggcaaattgagctgatggaaaaaatcacccgcgactcttcactggaagtcctccatgaaatggatgactatggtaatacccctcttcactgtgctgtggagaaaaaccagattgagtctgtgaaatttttgctctctagaggtgcgaatcccaacctgaggaattttaatatgatggcacctcttcacatcgctgttcagggaatgaacaacgaggtgatgaaagttctgcttgaacaccggacaatagatgtcaatctggagggagagaacgggaataccgccgtgattatcgcttgcaccaccaacaattccgaagctctgcagattctcctaaaaaaaggagcaaaaccgtgtaagtcaaataaatgggggtgttttccaatacatcaagccgcatttagtgggtctaaggaatgtatggaaattatccttcggttcggcgaagagcatggatactcccgccagctccatataaactttatgaacaacggaaaggcaacccctttacatttagccgtccaaaacggcgaccttgagatgatcaaaatgtgcctggacaacggggctcagatcgacccagtcgaaaaggggcggtgtaccgctatccattttgcagccactcaaggcgctacagagattgtgaagctgatgatcagcagttacagtggtagcgtggacattgtcaacacaacagacggctgtcatgaaaccatgctacatcgtgcctctctattcgaccatcacgaactggccgactatctgattagtgttggagctgatattaataaaatagactctgaggggcgctccccactgattctggccacagcttctgcctcttggaatatcgtgaacctgctgctgagtaaaggggctcaagtggatatcaaagacaacttcgggagaaactttctacatttgactgtgcagcagccgtacggcttgaagaatttgcgtccagaattcatgcagatgcaacaaatcaaggaattggtgatggacgaagataatgacgggtgcaccccgttgcactacgcttgcagacagggaggacccggctccgttaacaaccttctcggcttcaatgttagcatccattcaaagagcaaagataaaaagagcccccttcactttgcggctagctatggccgcatcaacacgtgccagagactcttacaagatatttcggatacccgtctactcaacgagggagatttacatggcatgactccactgcatctggcagctaaaaatggtcatgataaagtggtccagctgctactaaagaagggggctctcttcctgagtgatcacaatgggtggactgctctccatcacgcctcgatgggcggctatactcagaccatgaaggtgatcctggatacaaacctgaaatgcaccgataggctggatgaggatggaaacacggccctgcatttcgcagcgcgcgagggccacgcaaaagccgtcgccttgcttctgagtcacaacgccgacatcgtgctaaataaacaacaagcctcctttcttcatcttgccctgcataacaaaaggaaagaggtggttctgaccatcatacggtctaagcgttgggatgagtgcttgaagattttcagccacaacagcccgggaaacaaatgtcccattaccgagatgattgagtatcttcccgagtgcatgaaggtcctcctcgatttctgtatgttacacagtacagaggacaaatcgtgtagggactactacatagaatacaactttaaatatctccaatgcccgctagaattcaccaagaagaccccaacccaggacgtgatctatgaaccgctgacggccctgaacgcaatggtgcagaacaatcgcatcgaactgctgaaccatccggtatgtaaggaatatctgctaatgaaatggctcgcctatggatttagagcccacatgatgaaccttggatcttactgcctggggctcatccctatgacaatcctagtcgtgaacatcaaaccagggatggccttcaattctacagggataattaacgagaccagcgaccattctgaaatcctcgataccacaaatagctacctgatcaagacatgcatgattctggtttttctctccagcattttcggctattgcaaagaagccgggcagatctttcaacagaaacgcaattacttcatggacatttccaacgtgctggagtggatcatctatactactggcatcattttcgtgcttccgttgttcgtggaaattcctgcacacctccagtggcagtgcggtgcaatcgccgtgtacttctattggatgaactttttactttacctgcagaggtttgagaactgtggcatattcatcgtgatgctggaggtgattctgaagaccctgcttcggagcaccgtagtattcatttttctgctgctggcctttggacttagcttctacattttgctgaacctgcaggacccatttagctcccctctcttgagcatcattcaaactttctctatgatgctgggcgacatcaactatagggagtcattcttggaaccctatcttcgcaatgaactggcacaccccgtgctgtctttcgcccagctagtgtcctttaccatctttgtgccaattgtcctgatgaatttactaataggcttggccgtgggcgacatagctgaggtgcagaaacacgcctccctcaagcgtatcgccatgcaagtggaactgcacacaagtctggaaaagaagctgcctctgtggtttcttcggaaggtggaccagaagagcactattgtctatcctaacaagcctagaagtggtgggatgctattccacatcttttgtttcctcttctgcactggggagatcaggcaggagatacccaatgctgacaaaagtctggagatggagatcctgaagcagaaataccgactgaaagatctgactttcctgttggaaaagcagcatgaattaataaagctgatcatccagaaaatggaaattatctccgaaaccgaggacgacgactcgcactgttcctttcaggataggtttaagaaagaacagatggagcagaggaatagtcggtggaacaccgttcttcgcgctgtcaaggccaagacccaccatcttgagccatag

SEQ ID NO: 209180 - DNA, 2280 bp, Artificial Sequence
  Description of Artificial Sequence: Synthetic coding sequence
atgatggccgccctgtaccccagcaccgacctgagcggcgccagcagttcctcactgccaagtagtccgtcgagctccagtccaaacgaagtcatggcattaaaggatgtacgcgaagtcaaagaagagaacactctaaacgagaaactgttccttctggcatgcgataaaggagattattacatggtcaaaaagattctggaggaaaactcctcaggcgacctgaatatcaactgcgtcgatgttttgggacgcaacgctgtgaccattaccattgaaaacgagaacctggacatccttcaactgctgcttgactatgggtgccagaaactcatggagcgaatccagaacccagagtactctaccacaatggatgtagcacctgtaatacttgccgcacatcgcaacaattacgagattttaaccatgctgctcaaacaggacgtcagtcttccgaagccgcacgctgtgggctgcgagtgcacactctgttctgcgaagaacaaaaaagacagtctacggcatagccgattccgtctagacatttatagatgcctggcctcccctgccttgatcatgctaacggaagaggatcctatattgagggcttttgaactgagcgctgatctgaaagagctgagtctggtggaggtcgagttccgcaacgattatgaggagctagccagacagtgcaaaatgtttgctaaggacctgcttgcccaagccaggaacagtagggaactagaagttatcctgaaccatacctcttccgatgaaccgcttgacaagagggggctgctggaagagaggatgaaccttagcagattgaagttggccatcaagtacaaccaaaaagagtttgtgtcacagtcaaattgtcagcagttcctgaataccgtttggtttggccaaatgagtggctaccgacgtaaacccacctgtaagaaaattatgaccgtgttgaccgtggggatcttctggcctgtgctctctctctgctatctgatcgcccctaaaagccagtttggcaggataatacatactccattcatgaagtttattatccacggggcgagctacttcacgtttctcctattactgaatctgtattcactggtatataatgaggacaagaaaaacacaatgggccccgccctcgagaggatcgactatctattgattctgtggatcattggtatgatctggagcgacattaagcgattgtggtatgaggggctggaagattttctggaggagagccgtaaccagctaagtttcgttatgaactccctttatctagcaacattcgccctcaaggtggtggcccataacaagtttcatgactttgccgaccgaaaggattgggatgcatttcacccaaccctagtggctgagggcttattcgcctttgccaacgtcctttcctatctccgcctgttcttcatgtacaccacctcaagcatccttgggcctctccagatctccatgggccagatgcttcaggactttgggaagttcctgggtatgtttctgttggtcctttttagtttcacaatagggctgacccagctttacgataaaggatatacctccaaggaacaaaaggactgtgttggcatcttttgcgagcaacagtcaaacgacacattccactcatttatcgggacatgctttgctctgttttggtacatcttttcgctcgcgcatgtcgccattttcgtgactaggttctcatacggggaagagctacagagttttgtgggcgctgtgattgttggtacctacaatgttgtagtggtgatcgtcctgactaaacttttggtagcaatgctgcacaaatcttttcaactgattgcgaaccatgaagacaaagaatggaagttcgcccgggccaaactgtggttaagttacttcgacgataaatgtaccctgcctcccccctttaacatcatccctagtccaaaaacaatttgctatatgatctcatccctcagcaagtggatctgtagccacacatctaaaggaaaggtgaagcggcagaatagcctgaaggaatggagaaatctaaagcagaagagggatgagaactatcagaaagtgatgtgttgccttgtacaccggtatctcacaagtatgaggcagaagatgcagtccacggaccaggcaaccgtcgaaaacctcaatgagctccgtcaggacctgtctaaattcaggaatgagataagggacctcctgggcttcagaacttcaaaatatgctatgttttatccacgaaattag

SEQ ID NO: 209181 - DNA, 435 bp, Artificial Sequence
  Description of Artificial Sequence: Synthetic coding sequence
atgatctggagcgacatcaagcggctgtggtacgagggcctggaggacttcctggaggaaagtaggaaccagctgtcattcgtgatgaactccttgtatctcgcgacctttgctctcaaggtggtggcacataacaagatatctatgggacaaatgctgcaagattttggcaagttcctggggatgttcctgcttgtgctcttttcttttaccatcggactgacacagctgtatgacaaagggtacacttctaaggagcagaaggattgtgtggggatcttttgtgagcagcagagtaatgatactttccatagttttatcggcacctgtttcgcgctgttctggtatatcttttccctggctcacgtggccatctttgtgacccggttcagctacggggaagagctgcagtccttcgtgggcgcagtcatttag

SEQ ID NO: 209182 - DNA, 2382 bp, Artificial Sequence
  Description of Artificial Sequence: Synthetic coding sequence
atgatggccgccctgtaccccagcaccgacctgagcggcgccagctcatccagcttaccctcctccccctccagttcatcacctaatgaagtaatggccctgaaagacgtgagggaagtgaaagaagagaatactttgaacgaaaagctgttcctgttggcatgcgataagggtgattattatatggtgaaaaagattttggaagaaaattcttcgggagacctgaatattaattgcgtggatgttttgggccgcaacgccgtgaccattactatcgagaatgagaatttagacatacttcagcttctcctggattacggatgtcagtccgccgatgcgcttctcgtggccattgattccgaagtggtcggagccgttgacatcctgctcaaccatagacccaagagatcctcacgccccactatcgtcaaactgatggagagaatccagaacccagagtactccaccacaatggatgtggccccagtgatcctggctgcccatcgcaacaattacgagattttaacaatgttgttaaagcaggacgtatctctgcccaagccccacgcggtcggatgcgagtgtaccctgtgcagtgccaaaaacaaaaaggattccctgcgtcactcacgctttcgcctggacatttatcgatgtctggcctcccccgccctgattatgcttaccgaggaggaccctatcttgcgcgctttcgagctttccgcagacctcaaggagctgagcctggtcgaggtcgagttcaggaacgactacgaagagctagcgaggcagtgtaaaatgttcgctaaagacctgctggcacaggcccggaacagtagagaactggaagtgattctgaatcacacgagcagcgatgaacctctggacaaacgtggactgctcgaagaaaggatgaatctcagccggctgaagctagccataaagtataaccagaaggagttcgtgtcacagtcgaattgccagcagttcctgaacaccgtgtggttcggacagatgtccggctaccggagaaaacccacttgcaagaaaattatgaccgtactgactgtcggaatcttttggccggtactctccctgtgctacctgattgctcccaaatcccagtttggccgaatcatccacactccattcatgaagttcatcatccacggcgctagttattttaccttcctcctgctccttaacttgtactctcttgtgtacaatgaagacaagaagaacaccatgggacctgctctcgaacggatcgactatctcctgatcttatggattattggaatgatctggagcgatattaagcgcctatggtacgaagggcttgaggattttctggaagagagcaggaatcaacttagcttcgtgatgaactctctctatctcgcaacctttgccctcaaggtggtagctcacaacaaatttcacgatttcgctgatcgcaaggattgggatgctttccatcctaccctcgttgctgaaggcctgttcgcttttgccaacgttttgtcatacttacggctttttttcatgtacacaacaagctctatacttggaccactccagatctccatgggccagatgctgcaggacttcggtaaatttctcggcatgttcttgctggttctgttttcattcacgattggtctgactcagttatatgacaaagggtatacaagcaaggaacagaaagactgtgtcgggattttctgcgaacagcagtcaaatgataccttccatagctttatcggcacctgctttgctcttttctggtacatcttctccctcgctcacgttgctatatttgtgacgcggttcagttacggggaggagctgcagtcttttgtaggtgctgtcatcgttgggacatataatgtggttgtggttatcgttctgacaaaacttctggtggccatgctgcataagtcatttcagttgatagccaatcacgaagataaggagtggaaatttgcgcgggccaaactctggttatcatatttcgacgacaagtgcacactgccacccccctttaacattataccctcccctaagacaatctgttatatgataagttctctcagtaagtggatctgctcccacacctcaaaaggcaaggtgaaacgtcagaactctctgaaggaatggcgcaatctcaagcaaaagcgggatgaaaactaccagaaggtcatgtgttgcctggtgcacagatatttgacatctatgagacagaaaatgcaaagtactgaccaggcaactgtggagaacctaaatgagctccgtcaagacttatccaagttccgcaatgaaattcgggacctgctgggctttagaacttcaaaatatgccatgttctatccccgcaattag

SEQ ID NO: 209183 - DNA, 2415 bp, Artificial Sequence
  Description of Artificial Sequence: Synthetic coding sequence
atggcccagttctactacaagcggaacgtgaacgccccctaccgggaccgcatccccctgcggatagttagggcggagagcgaactgtcaccgtccgagaaagcttatctcaatgccgtagaaaagggcgactacgcttccgttaaaaagagcctagaggaagccgaaatctatttcaagattaacattaactgtattgacccgctggggaggacagcactgctcatcgccattgagaacgaaaacctggagctgattgagctgttactgtcattcaacgtgtatgtgggcgatgccctactgcacgccatcaggaaggaggtcgtgggcgctgtagaattgttgctgaaccacaaaaagccttcaggggagaagcaattcgtggcccagcctaattgtcagcagctcctggctagccggtggtatgatgagtttcctggctggcgccgtcgacactgggccgtgaagatggtgacttgtttcatcatcggcctcctgtttcccgtattctctgtctgctacctgatagctcccaaatccccgcttgggctcttcattagaaaaccgttcattaagttcatctgccacactgctagctatctgacattcctatttctgctccttcttgcttcgcagcatatagatcggtccgacctgaacagacaaggcccaccccctacaatcgtcgaatggatgatacttccttgggttctcgggttcatatggggcgagatcaaacaaatgtgggatggaggactccaagactacatccatgattggtggaacctgatggattttgtgatgaattctctgtacttggctacgatctcattaaaaatcgtggctttcgtgaagtacagcgccctgaacccccgtgagtcgtgggacatgtggcatccaaccctggtggccgaagcattgtttgcaattgccaacatcttcagcagcctgagactgattagtctgttcactgcaaatagccacttaggcccgctccagatcagcttaggcagaatgctcctggacatcctcaagttcctgttcatttactgtttagtgctgcttgccttcgccaacggcctgaatcagctatatttttactatgaggaaacaaagggccttacctgtaagggaattaggtgtgagaaacagaacaatgctttctcaacgctgtttgagaccctgcaatctttattctggtcaatctttggcctgattaatctgtacgtgacgaacgtgaaagcccagcatgaatttaccgaattcgtcggcgcaacaatgtttgggacttacaacgtcatcagcttagtggtgctcttaaatatgctgatcgctatgatgaataactcttaccagctgatagcagaccatgcagacatcgagtggaagtttgcccgcactaaactgtggatgtcctattttgaggagggaggcacactcccaacacccttcaacgtcatcccatccccaaagtccctgtggtacttaatcaagtggatatggacccatctgtgtaagaagaagatgcggcgcaagcccgagtccttcggcaccattggaagaagagcagcagacaatttgcgccgccaccaccagtatcaggaagtcatgcgaaatctagtcaaaaggtacgtcgcggctatgatcagagatgctaagacagaagagggccttacagaagagaacttcaaggagctaaagcaggacatcagctcattccggtttgaagtgctcggcctcctcagaggatccaaactgtcaacgatccagagcgccaacgcctcaaaggagagcagcaacagcgccgatagtgatgaaaagtcagacagtgaagggaatagcaaagacaagaagaaaaacttttcactgttcgatctgactacactaattcacccgcgtagtgccgcgatcgcctctgaaagacataatatcagcaacggctcagccttggtggtccaggagccccccagggagaagcaacggaaagtcaactttgtaacggatatcaaaaacttcggcctctttcatagaagatccaaacagaatgccgccgagcagaacgcgaaccagatattcagcgtgtctgaggaagtcgcacggcagcaggctgcaggcccacttgagagaaatattcagctagagtctcgtgggctggcctctaggggcgacttgtcgatccccggacttagcgagcagtgtgtcctggtcgaccatagagaacggaacaccgacaccctgggattacaggtggggaagagagtctgtcctttcaaaagtgagaaggtcgttgtagaggacacagtccctataatacccaaggaaaagcacgctaaggaagaagattcctccatagactacgatttaaatctcccagatactgttacacacgaggactacgtgacaaccaggttgtag

SEQ ID NO: 209184 - DNA, 2511 bp, Artificial Sequence
  Description of Artificial Sequence: Synthetic coding sequence
atggcccagttctactacaagcggaacgtgaacgccccctaccgggacaggattccactgcggattgtgagggcagaaagcgagcttagtccatctgaaaaagcttacctgaacgcagtggagaagggggattatgcgagcgtgaagaagtctctcgaggaggctgagatttacttcaagatcaacataaactgcatagatcccctcggtcgcactgccctgcttattgccatcgagaacgaaaacctggaattaatcgaattattactctcttttaacgtgtatgtgggagacgcccttctgcacgcgatacgaaaagaagtggttggcgccgtggaactgttactgaatcacaagaaaccaagcggggaaaaacaggttccaccaatcctgctcgacaaacaatttagtgaattcacacctgacataacgcccatcatattggccgcccacacaaacaattatgaaatcattaagttattggtgcagaagggggtctccgttcctaggcctcacgaggtacggtgcaattgcgtagaatgtgtctcctcttcagacgtggatagtcttcgccactcaaggagtcggctgaacatatataaagccctggcttcgccctctcttatcgctctgtccagcgaagaccctttcttgacagcctttcagttaagctgggagctccaggaactttcaaaggtggagaatgagtttaaatccgagtacgaggagctgtccagacagtgtaagcagtttgctaaagatcttcttgatcagacgcggagttcccgcgagctggagattattctgaactaccgcgatgacaatagcctcattgaagaacagagcggaaacgatctggcacgcctgaagttagccatcaaatatcgtcaaaaggaattcgtagcacagccaaattgccagcagctcctggccagcaggtggtacgacgaattccccggttggcgacggcgccactgggcagtgaaaatggtgacatgttttatcatagggcttctcttccctgtcttctccgtatgttaccttattgcccccaagagcccattggggctctttattagaaagccttttataaagtttatttgtcacaccgcatcttacctgacgtttttgttcctgctgttgctagcatcgcaacacatcgatagatcagacctgaacaggcagggcccaccacccacaatcgtcgaatggatgattctgccatgggtgttaggtttcatctggggagaaataaagcagatgtgggatggaggtctccaggattatattcacgactggtggaacctaatggacttcgtcatgaacagcctgtatctagccacaatcagcctaaaaatcgtggcattcgtgaagtatagtgctttgaaccctcgcgagagttgggatatgtggcaccccacactcgtggcggaagccctctttgctattgccaatatcttcagctctctccgcctgatctctttattcacagctaattcccacctagggcccctacagatttccctgggccgcatgctcctcgatattctcaagtttctttttatctactgcttggtgcttctcgccttcgcaaacggcctgaatcagctgtacttctattatgaagaaacaaagggccttacatgtaagggaattcgttgtgagaagcagaataacgccttctcaacactatttgaaactctccagtctttgttttggtccatttttggacttatcaatctctacgtgactaacgtaaaggcacagcacgagttcacagaatttgtaggcgcaactatgtttggaacatacaacgtgatttctttagttgtcctgcttaacatgctgatcgccatgatgaacaacagttatcagctaattgccgatcacgctgatatcgagtggaaattcgccaggaccaaactttggatgtcgtattttgaggagggcgggactttgcccacacccttcaacgttataccttctccgaaaagtctgtggtacctgatcaaatggatctggactcatctgtgcaagaaaaaaatgaggaggaaaccagagtcttttggcactatcggacggcgcgcagcggataacctgagaagacatcaccagtaccaggaggtgatgaggaaccttgttaagcgctacgtggcagctatgatacgggacgcaaagaccgaagaggtcgctaggcagcaagctgctggcccattagaaagaaacattcaactggagtcacgaggtcttgctagcagaggggacctctcaatcccaggcctctctgagcagtgcgttcttgtagaccatcgggaacgaaatactgacacactggggctccaggtgggaaaacgcgtgtgcccatttaagagtgaaaaagtagtggtggaggacaccgtaccaatcattccaaaagaaaaacacgctaaggaggaagatagttcaatcgactatgatttgaacctacctgatacagtgacccacgaagactatgtcacaacgaggctgtag

SEQ ID NO: 209185 - DNA, 2682 bp, Artificial Sequence
  Description of Artificial Sequence: Synthetic coding sequence
atggcccagttctactacaagcggaacgtgaacgccccctaccgggaccgcattcctctccgcatcgtgcgtgccgagagtgagctgtctccgtccgagaaggcctatctaaacgccgtggagaagggagattatgctagtgtaaagaagtcactggaggaagccgaaatttatttcaagatcaatatcaattgcattgatcctttggggcgaactgccctgctcatcgctatcgaaaacgaaaacctagagttgatcgaactcctgttgtcctttaatgtgtatgtaggcgacgcactgcttcacgctatcaggaaggaggttgtaggagccgtggagttgctcttaaatcacaaaaaacccagcggcgaaaagcaagttccccctattttgctggacaagcagtttagtgagttcactcccgacattactcctattattctggccgcacacacaaataattatgagataataaaactactggtgcagaagggggtctctgttcctcggcctcacgaggtgaggtgtaattgtgtagaatgcgtcagctcctctgacgtcgatagcttgcgacacagtcggagccgtctgaacatctacaaggctctagcctctccctctctgatagcgctgtccagcgaggacccctttctaaccgctttccagctgagttgggagctgcaggagctgagcaaggtggagaatgagttcaaaagcgagtatgaggagctttccagacagtgcaaacagtttgccaaggacctgctagatcagacacgcagtagtagggagctcgagatcattttgaattatagggacgataactctttgattgaggagcagtcaggcaacgacttggccaggttaaagctggccatcaaataccgccagaaggagttcgtagctcagcctaattgtcagcagctgctggcaagccggtggtacgacgagtttcccggctggagaagacgccactgggccgtaaaaatggtgacatgctttattataggactcctcttccctgtgtttagcgtgtgttatttgattgcacctaaatcaccgctgggcctgtttatccggaagccattcatcaagtttatctgtcatacagcctcctacttaactttcctgtttttgctactgctagcttctcagcatatcgataggtccgatctgaacaggcaggggcctccccctactatcgtggaatggatgattttgccttgggtgttgggattcatctggggtgagatcaagcagatgtgggacggaggactgcaggactacatacatgactggtggaacctgatggactttgtgatgaattcactgtacctcgcaacaatttccctgaaaatagttgctttcgtcaaatatagtgcactcaacccgcgagagagttgggacatgtggcaccctaccctcgtggctgaagccctgtttgccatcgctaacatcttttcctccctgaggctgatcagtctgtttaccgccaattcacacttgggtcccttgcaaatttccctcggcaggatgttgctagacatactcaaattcctgtttatttattgtctagtactgctcgcatttgctaatggcttgaatcagctctacttctactatgaggagaccaagggcctcacgtgcaagggcattcggtgtgaaaaacagaacaacgcattcagtactctgtttgagactctccagtcgcttttttggagcatttttggcctgattaatctctacgtgacaaacgtaaaggctcagcacgaattcacggaattcgtgggtgccacaatgttcgggacgtataacgtaattagcttggtggttctgctgaatatgctcattgcaatgatgaacaactcctatcagctgattgccgaccatgcagacatcgagtggaagtttgcccggaccaagctctggatgagttacttcgaggaagggggcacgctcccaactcccttcaacgttataccatcacccaagagtctctggtacctcatcaaatggatttggacacacctgtgcaaaaaaaaaatgaggaggaagccagaatcattcggaacaatcgggaggcgagcagccgataacctgcgaaggcatcaccaataccaggaagtaatgcggaatctcgttaagcgttatgtggccgccatgatccgggatgccaagaccgaggaggggttgactgaagagaacttcaaggagctgaaacaggatatctcctctttccggttcgaggtgctgggattgctcagggggtccaaactgtcaaccatccagtctgcaaatgcatccaaagaatcctcgaatagcgctgacagtgatgagaaaagcgatagcgaagaggaagtggcccgccagcaggctgcgggccccctcgagcggaacatccagcttgaatcaaggggcctcgctagccgcggagacctctctattccaggactttctgaacaatgtgtgctggttgaccatcgcgagagaaatacggacacgctgggcctacaagtggggaaaagagtgtgtcccttcaaatcagagaaagttgttgtggaagataccgtgcccattatccctaaggagaagcacgctaaggaggaggatagttctatcgactacgatctcaatctgcccgataccgttacgcatgaggattacgtcacaacccggctctag

SEQ ID NO: 209186 - DNA, 2487 bp, Artificial Sequence
  Description of Artificial Sequence: Synthetic coding sequence
atggcccagttctactacaagcggaacgtgaacgccccctaccgggaccgcattcccttgcgaatcgtaagagctgaaagcgagctgtctccttctgaaaaagcctatctgaacgctgtagagaagggagattacgctagcgtgaagaagagcttggaagaagcagagatctactttaaaattaacataaattgtatagacccccttggtagaactgcactgctgattgcaatcgagaatgaaaatctcgaactaatcgagcttctgcttagtttcaatgtgtatgtcggggatgctctgctgcacgcaatccgcaaagaggtggtaggcgcggtggaactgctgctcaaccataaaaaaccttccggggaaaaacaggtgccccctattttactggataaacagttttctgaattcaccccggatatcaccccgattattttagcagcacacaccaataactacgagatcataaagctgctggtgcaaaagggcgtctccgttcccagaccgcatgaagtgcggtgcaattgcgtagagtgtgtgagctcttccgatgttgacagcctgcgccatagtcgtagcaggctgaacatttataaggcgctggcatcgccttcgcttatcgctcttagcagcgaggacccattcctcacggctttccagctgtcttgggaactgcaggaactgtccaaagtggaaaatgaatttaaatcagagtatgaggagctgtcgagacaatgtaagcagttcgcaaaagacctgttggaccagacccgctcctcgcgggaactggaaattatcttgaactatcgtgacgacaactctctgatagaggagcaatctggaaatgatctggcccggcttaaactggctatcaagtataggcaaaaggagtttgttgcgcagcccaactgccagcaactgctggccagccgttggtatgacgaattccccgggtggagacggcggcattgggccgtcaaaatggtgacttgttttatcatcgggttactctttcctgtgttctcagtgtgttatctgatcgctcctaaatccccactgggactttttattcgaaagcctttcataaaattcatatgtcatacagcatcatacctgaccttcctctttctgcttctactggcatcccagcatattgatcgctctgatcttaaccgccagggaccccctcctacaatcgttgaatggatgatccttccatgggtcctcggatttatctggggggaaattaagcagatgtgggatggggggctccaagattacatccacgactggtggaatcttatggacttcgtaatgaatagcctttatctggcaacaatatccttaaagattgttgccttcgtcaaatattcggctctgaacccacgtgagagctgggacatgtggcaccctacactcgtagccgaagccctttttgcgatcgctaatattttttcttccttacggctgatatcattattcaccgctaactctcacctcgggcctcttcagatatcacttggacggatgctgttggatatcctgaagttcctttttatctactgtctcgtgctgctagcattcgctaacggactgaatcaactatatttttattatgaggagactaaaggcctgacctgcaaggggatccgctgcgagaaacagaataacgccttttcaactctgtttgagacactccagagtctgttctggtccatttttgggctgattaatttatacgttaccaacgtgaaggcacaacacgaattcacagagttcgttggagccactatgtttgggacatataacgtaatcagtttagtggtcttgctgaacatgttgattgcgatgatgaataatagctaccaacttattgctcggagagcagccgacaatttaagacgtcaccaccagtatcaagaagtgatgcggaatttggtcaaacggtatgtcgccgccatgatccgtgatgccaagactgaagaggggctgaccgaagaaaacttcaaggaattaaaacaggacatctcaagtttcaggttcgaggtgttgggcctgctcaggggcagcaagttgagcacaattcaatctgccaacgcctcaaaggagagctcaaatagtgcagatagtgacgagaaaagtgacagcgaggaggaagttgcaaggcagcaggcggctgggcccctagagaggaatattcaactcgagagccgggggttagcctctagaggcgatctcagtatccccggcctatccgagcagtgcgtcttagtggatcatcgcgagcggaatactgatacacttggcctacaggtaggaaagagggtctgcccatttaaaagcgaaaaagttgtggtggaggatacggtgccgatcataccaaaggagaagcatgccaaagaggaggactcctctattgattacgatctgaatctgccggacaccgtgacgcacgaagactatgtgaccacccgcctgtag

SEQ ID NO: 209187 - DNA, 2415 bp, Artificial Sequence
  Description of Artificial Sequence: Synthetic coding sequence
atggcccagttctactacaagcggaacgtgaacgccccctaccgggaccgtatcccactacgtatagtccgggccgagtccgagctctcacctagcgaaaaagcatacctcaacgctgttgagaagggcgattacgctagtgttaagaagagtcttgaggaggcagagatttactttaaaataaatataaattgtatagacccactggggcgtaccgcgctgctcattgcgatcgagaacgagaacctggaactgattgaacttctgctgtccttcaatgtttatgtgggagacgccctgctgcatgccattcgcaaggaagtcgtcggcgcagttgagttattgctcaaccacaagaaacccagtggcgagaagcagtttgtggcccagcctaactgccagcagttactcgcgtcaagatggtacgacgagttccctggatggcgccgacggcactgggcagtcaaaatggtcacctgcttcatcattgggttgctgttcccagtgtttagcgtgtgctacctgatcgctccaaagagccccctcggcttatttatacgcaaaccttttatcaaattcatctgccacactgccagttacctcacttttctgtttctgcttctgctagcgagccagcacatcgatagatcagacctcaaccgtcagggtcccccccccaccatcgtggaatggatgatcctcccatgggtcctcggattcatatggggggaaatcaaacagatgtgggacggcgggctgcaggactatatccatgattggtggaacctgatggacttcgtgatgaactcactgtatcttgccacaatatcactcaaaattgtggctttcgtgaaatattccgctctgaaccctcgggagagttgggacatgtggcaccctacactcgtggcagaggctctgtttgctattgccaacatcttcagctccctgcgcctgatttccctgttcactgccaactctcacctcggccctctacagatctccttaggcagaatgttgctggacatcctcaagttcctgtttatctactgcttagtactgctggcgtttgccaatggtctgaatcagttatacttctattacgaagaaaccaagggtctgacatgtaaaggaatccgttgtgagaaacagaacaatgcttttagcaccctgtttgaaacactgcagtcactgttctggtccatctttggtttgattaatttgtatgtgacaaatgtgaaggcacaacatgaatttaccgagttcgtgggcgcaaccatgtttggaacctacaatgtgattagcttggtcgtcctcttaaatatgctcattgctatgatgaataacagttatcagttgattgcggatcacgcagacatagaatggaagtttgcaagaacgaagctatggatgtcctactttgaagagggcggtaccttgcctacgccctttaacgtcattccaagtcccaagagtttgtggtacctgattaagtggatttggacccacttgtgcaaaaagaaaatgaggcgaaagcccgagagcttcggcacaattggccgacgcgccgccgacaatcttaggcggcaccaccagtatcaggaggtgatgcggaacctcgtgaagaggtacgttgccgccatgatacgcgacgcaaagacagaagagggattgacagaagaaaacttcaaagaactgaagcaggatatttcttcctttcggttcgaggtcctgggtctgttacgcgggtccaaactctctaccatccagtcagccaacgcaagtaaggagtcgtctaactctgctgattctgacgagaaatcagattccgagggcaattctaaggataaaaagaagaacttctcactctttgacctaacaaccctgattcatccgcgctcagcagctattgcctcggaaaggcacaacatctccaacgggagcgcacttgtggtccaggaacctccccgcgaaaaacaacggaaagtgaacttcgttaccgacattaaaaatttcggactatttcatcggcgctctaaacagaacgccgcagaacagaatgcgaatcagatctttagcgtctccgaggaggtagccaggcagcaggcggccgggcccctggaacgcaatatccagcttgaaagcagagggctggcgagccggggcgatctgagtattcccggcctgtcagaacaatgtgtcctggtagatcatagggagagaaacaccgacacccttgggctccaggttggtaagcgggtgtgtccgtttaaatccgagaaggtggtggttgaggatactgtgcccatcatccccaaagagaaacacgccaaagaggaggactcttccattgattacgacttgaacctgcctgacactgtgacgcatgaggattacgtcactaccagactgtag

SEQ ID NO: 209188 - DNA, 2949 bp, Artificial Sequence
  Description of Artificial Sequence: Synthetic coding sequence
atggcccagttctactacaagcggaacgtgaacgccccctaccgggacaggattcctctccgcattgtgcgggcggagtcagagctgtcaccgtcagagaaggcgtatctgaatgctgtggagaaaggagattatgccagtgtcaagaagtccttggaggaggctgaaatctatttcaagataaatattaattgcatcgaccccctggggcgcacggcactcttgattgccatcgagaacgaaaacctggagttgatagaactgctgttatcctttaacgtgtacgtcggcgatgcccttctccacgccattcgcaaagaagtcgtaggtgccgtcgagctgctgctgaaccataaaaagccatcaggcgagaagcaggtgcctcctatcttgctcgataaacaattttcggaatttacccccgacattaccccaatcatcctggccgcccacaccaataactatgagattattaagttgctcgtgcagaagggtgtgtccgtgcctcgcccccatgaagttcgctgcaactgtgtcgaatgcgtgagctcatccgatgtcgattcactaaggcatagccgctctaggcttaatatctataaagcactcgcttctccatctctcattgcactgtcctccgaggaccctttcctcacagcttttcagctgtcctgggaactgcaggaactgtcaaaggtagagaacgaattcaagtcagagtatgaagaactctcgcgccagtgtaagcaatttgcaaaagatctgctcgatcagacaaggtcatcccgtgaactggaaatcattctgaattaccgcgatgataacagcctgattgaggagcaaagtggcaatgatctcgctagattaaaactggctataaaataccggcagaaagagttcgttgcccagcccaactgtcagcagctcctggcttcccggtggtatgacgagttcccaggttggcgaagaagacattgggcagtgaaaatggttacatgtttcattataggccttctgtttcccgtgttctccgtctgttacctaatagcccccaaaagccctctcggcttgttcatccgcaagccctttatcaaattcatttgccataccgccagttacttaaccttcttgttccttctgcttctggctagtcaacacattgatcgatctgacctcaataggcagggcccgccccctacgattgtcgagtggatgatacttccatgggtgttggggtttatttggggggagattaagcagatgtgggacgggggactccaggattatattcacgattggtggaatctgatggacttcgtgatgaactccctataccttgccaccataagccttaaaattgtcgccttcgtgaaatactcagctctgaatcctagagagtcgtgggacatgtggcatcccactctggttgctgaggccttattcgcaattgccaatatcttttcaagcctgaggcttatttccctgtttaccgcaaatagccacttaggtccgttgcagatctctctggggcgcatgctgctggatattttaaaatttctgttcatttattgtcttgtcctgctggcattcgctaatgggctaaatcaactgtatttttactacgaggaaactaaagggttaacatgtaaaggcataaggtgcgagaagcagaacaacgctttcagtactctttttgagactctgcagagtctgttttggagtatctttggtctgatcaacttgtatgtgactaacgtgaaggcccagcacgaatttaccgaattcgtcggagccactatgttcgggacatataacgtgatcagcttggtggtgctcctgaatatgctcatcgccatgatgaacaattcctatcaactcatcgcagatcatgcagacatagagtggaaattcgctaggactaagctttggatgtcttatttcgaggaaggcggcactctgcctacaccgttcaatgtcatcccttccccaaaatccctgtggtacttgattaagtggatttggacccatctctgtaagaaaaaaatgcgacgcaagcccgaaagcttcgggacaattggtgtgaggacgcagcatcgaagggccgctgataatctccgtcgacatcatcagtaccaggaagttatgcgtaacttagtcaaacgatatgtcgcagctatgatacgcgacgctaagacagaagaagggctgacggaggagaacttcaaggagctgaaacaggacataagcagtttcagatttgaggttctgggactcttgcgcggatccaagctgagcacgatacagagcgcgaatgccagcaaggaatcatccaactccgccgactctgacgagaagtctgattccgaagggaattcgaaagacaagaaaaagaattttagccttttcgacctgacaaccctgattcaccctcgaagcgctgcaattgccagtgagagacacaacatcagcaatggaagcgcactcgtagtgcaggagccccctagggaaaagcagcggaaagtgaattttgtgactgatatcaagaattttgggctatttcacaggaggagcaaacagaacgccgctgaacagaacgctaatcagattttctcggtttcggaggaggtcgcgcgtcagcaggccgccggccctcttgagaggaacatccaactggagagtagggggttagcttctcgaggggacctaagtatccccggtttgagcgaacagtgtgtcttggtggaccaccgcgagcggaacacagacacactgggtctacaggtggggaaaagggtgtgtcccttcaagtcagagaaggtagttgtggaggacactgttcccataatccccaaggaaaagcacgccaaggaggaggacagttccatcgactatgacctcaatctgcctgacaccgtcacacatgaggactacgttaccactcgcctttag

SEQ ID NO: 209189 - DNA, 2934 bp, Artificial Sequence
  Description of Artificial Sequence: Synthetic coding sequence
atggcccagttctactacaagcggaacgtgaacgccccctaccgggatagaattcccctccggatcgtcagggccgagtcggagcttagcccatcagagaaagcctatcttaatgctgtggagaaaggcgactatgcaagtgtgaagaagtctttggaggaggcagaaatatactttaagatcaatattaactgcattgatccattgggcaggactgcacttctaatagcaattgagaacgaaaacttggaactgattgagctgctactgagcttcaatgtgtatgttggggatgctctgctacacgcaatcaggaaggaggtcgtcggcgcagtcgagcttcttctcaatcacaagaagcctagcggggagaagcaggtgccacctattctcttggacaagcagttctccgagttcacccctgacatcacacccattatattggcggctcacaccaacaactacgaaattatcaagctcctggtgcaaaaaggagttagtgtacccagaccacacgaggtgcgctgcaattgcgttgaatgcgtctcaagcagcgatgttgattcactgagacactctcgcagcagactgaacatctacaaagcgctggcttcacccagcctcatagctctgtccagtgaagatccattccttaccgcctttcagctttcgtgggagcttcaggagcttagtaaggtcgagaacgaatttaaatccgagtatgaggagctgtcccggcagtgtaaacagttcgctaaggacctactggaccagaccaggtcatcgagagagctggagattatactgaattacagagatgataatagccttatcgaggaacaatcgggaaacgatctggcccgtctgaaactggcaattaagtatagacaaaaggaattcgtcgcccaaccaaactgccagcagctcctggctagtcgctggtacgatgagttcccaggctggaggcgccgccattgggccgtgaaaatggtcacttgttttatcattggactgttgtttcccgtcttctctgtatgttatctcattgccccgaaaagcccccttgggctctttatccgtaaaccgttcatcaaattcatttgccacacagcttcttacctgacatttctgtttctcctcctgttggcgtcgcagcacattgacagaagcgatcttaaccgtcagggacctcctcctacgattgtggaatggatgattctgccttgggttctgggatttatttggggagagatcaagcagatgtgggatgggggtctgcaggactatatccacgactggtggaaccttatggatttcgtgatgaatagtttgtacttggctacaatttcattgaaaatagttgcattcgtgaaatattcagccttgaaccctcgggagtcctgggatatgtggcaccctacgttggtggccgaggccctgttcgctatcgccaacatcttcagttctctccggcttatttcactcttcacagcgaattctcacttaggcccactccaaatatcactgggccggatgctgctggacatcctaaagtttctcttcatttactgcctggtgctgttagcatttgcaaacggactcaaccagctgtacttttattatgaagaaaccaagggtctgacctgtaagggcatccgatgcgaaaagcagaacaatgctttctctacactgtttgagactcttcagagcttgttctggtcaatttttggactgatcaacctgtacgttaccaacgtgaaagcgcagcacgagttcaccgaatttgtgggggcaacgatgttcggcacctacaacgttatctctctcgtcgttcttctcaacatgctcattgccatgatgaataatagctatcagttgatagccgatcatgctgatatcgaatggaaattcgcacgcactaagttgtggatgtcatatttcgaggagggcggtactctgcctactccattcaatgtgattccgagcccaaagtccctatggtatcttatcaaatggatttggacacacctttgtaagaagaaaatgaggcggaagcctgagagttttggtaccattggccggagagcggcagataacctgcggagacatcaccaatatcaggaggtgatgcgcaatctcgtcaaaagatatgtcgccgcgatgatcagagacgcaaaaacggaggagggtctaacagaggagaattttaaggagctaaagcaggacattagctctttccgctttgaagtcttagggctccttcgaggaagcaagttgtccaccatacaatcggcaaatgcaagcaaagagtcaagtaactccgctgactcagacgagaaaagcgattcagaaggcaattcaaaagacaagaagaaaaatttcagcctgttcgacctcactactctgattcatccacggtctgctgcaattgccagcgagcggcacaacatctccaacggaagtgcattggtggttcaggagccgccgagggagaaacagcgcaaggtgaactttgtgactgacatcaaaaattttggcctttttcaccggcgctcaaaacagaacgctgcggagcagaacgctaaccaaattttttcggtctccgaggaggtagcaaggcagcaggctgccggccctctggaacgaaacatccagttagaatctcggggcctggccagtagaggtgacctgtcaattccaggccttagtgagcaatgcgtcctggtggatcacagggagcgcaataccgacacacttgggctgcaggtaggtaaacgcgtctgcccctttaagagcgaaaaggtggttgttgaggacactgtgcccatcatccccaaggagaaacacgcaaaggaggaagactccagcattgactacgacctgaatttgccagatacagtgacccacgaggactacgttactaccaggctgtag

SEQ ID NO: 209190 - DNA, 1383 bp, Artificial Sequence
  Description of Artificial Sequence: Synthetic coding sequence
atggcccagttctactacaagcggaacgtgaacgccccctaccgggatcgcattcctctgcgcatagtcagggctgaatccgaactgtcaccttctgaaaaagcctacctcaacgcagttgagaagggggattatgcgtccgtcaaaaaatcactcgaggaagcggaaatctatttcaaaattaatataaattgcattgatcccttggggaggactgcacttctcatcgccattgagaacgagaacttagagctgatcgagcttttactttctttcaacgtatacgtaggcgatgcattactgcacgcaatacggaaagaggtcgtcggagcggtggaacttttgttgaatcataaaaaaccgtccggtgagaaacaggtgccccccattctgcttgataaacaattttcagagtttacccctgatatcaccccaatcatcctggccgcccataccaataactacgaaatcatcaagcttctcgtgcagaaaggggtgagcgttccacgcccccatgaagtgaggtgcaactgtgtagagtgtgtgagttcatccgatgtcgacagcctgcgacactctaggagtagactgaacatctacaaagccctggcgagcccctcattgattgccctgagctcagaagatccattcttaacggctttccaattaagttgggagttgcaagagctcagcaaagtggagaacgagttcaaatctgagtacgaagagctcagcaggcagtgcaaacagttcgccaaggaccttttggaccagactaggtctagccgcgagctggagattattctcaattatcgagatgacaacagcttgatcgaggagcagagcggcaacgatctggcaagactgaagctcgctatcaagtataggcagaaggagtttgtcgctcagcccaactgtcagcaactactggcatctcgctggtacgatgaattccccgggtggcgcaggcgccactgggccgtcaagatggtcacgtgtttcataatcgggctgcttttcccagtgttcagcgtctgttacttgatcgccccgaagtctcccctgggcctgttcataaggaagcctttcataaagttcatttgtcatactgcgtcttatctgacattcttgtttctgttgcttctagccagtcagcatatagacagatcggatctgaaccgccagggccccccacccactatcgtggagtggatgatcttaccatgggtgctcgggttcatttggggggagataaaacagatgtgggacggtggactgcaggattacattcacgattggtggaatctgatggacttcgtcatgaatagtttgtacctggcaacaatctctttgaaaattgtcgcctttgttaaggttatttag

SEQ ID NO: 209191 - DNA, 2511 bp, Artificial Sequence
  Description of Artificial Sequence: Synthetic coding sequence
atggcccagttctactacaagcggaacgtgaacgccccctaccgggatcgcatccccctgcggatcgtgcgggccgagagtgaactgtctcccagcgaaaaagcatatctgaacgcagttgagaaaggagactatgcttccgtgaaaaaatctcttgaggaagctgagatttactttaaaatcaacattaactgcattgaccctttgggtcgcacagcactgctgattgctatagaaaacgagaatctggaattgatcgagctgctcttgtcctttaatgtatatgttggtgacgcactgctccatgccattcgaaaggaggtcgtgggcgccgtagaactactcctgaaccacaaaaagcctagcggtgagaaacaggttccgccaattctgttggataaacagttttcagaattcaccccagatattacccccatcatcctggctgctcataccaataattatgagatcattaagctgttagtgcagaaaggagtttctgtgcccagaccacatgaagtccgatgcaattgtgtggaatgcgtctcttcatcagatgtggattctcttaggcactcaagatctagactaaatatttataaagccctggctagtccatccttaattgcgttaagcagcgaagaccctttcctgactgccttccagctttcttgggagctccaggagctgtcaaaagtggaaaatgagttcaagagtgagtacgaagagctgagtagacagtgcaaacaatttgcgaaggacctcttagatcaaacgcgtagttcacgtgaactagagattatcctgaactaccgtgatgacaactcgctgattgaagaacagagcggaaacgacctggctcgcctgaagctggccatcaagtatcgccaaaaagaatttgtggcccaacctaattgccagcaactgctggccagccgttggtatgatgaattcccaggctggcgtcgccgccactgggccgtgaagatggtgacctgctttattataggactcctattccccgtgttttccgtatgctacctgattgcacctaagagccctctgggactgttcatccggaagccattcatcaaattcatctgccacactgccagctatctgacctttttgtttctattactgctggcgtcccagcatattgaccgatcggatttaaatcggcagggccctccacccaccatcgtcgagtggatgattctgccatgggttctgggtttcatatggggagagatcaagcaaatgtgggacgggggtctccaggactatatccatgattggtggaacctgatggatttcgtaatgaacagcctgtacttggcgactattagtcttaagatcgttgcgttcgtgaaatacagtgcactcaatccccgtgagagttgggatatgtggcaccccactctggttgctgaagctctgtttgcaattgctaatattttctcctcactccgcctcatcagcttgtttacagctaacagccatctaggccctctccagatttcactcgggcgtatgctgctcgatattctgaaatttttattcatctattgtctcgttttgttagcattcgcaaacggcctgaaccaactgtacttctactatgaagaaactaaaggtctaacttgcaagggaatcagatgtgagaagcaaaataatgctttttctaccctctttgagactcttcagtctttattttggagcattttcggtctcataaacctgtatgtgaccaacgtgaaagcgcagcacgagttcaccgagtttgtgggagccaccatgtttggcacatacaacgtaatttctcttgtcgtccttctgaacatgctgattgcaatgatgaataatagctaccagctaatcgcagatcatgccgatatcgagtggaaattcgcgagaactaagctctggatgtcatactttgaggagggtgggactctccccaccccttttaacgtcattccttctccgaaatccctctggtacctgatcaagtggatttggactcacctttgtaagaagaaaatgcgcaggaaacccgaaagctttgggacaatcggaagacgagccgccgataacctgcggcgtcatcatcaatatcaggaggttatgcgaaacctggtgaagaggtatgtcgccgccatgatccgcgacgcaaaaacagaagaggtcgctagacagcaagccgctggaccacttgagcggaacatccagctcgagagtagaggcctggcctccaggggcgatctgagcattcctggcttgagcgaacaatgcgtcctggtggaccatagagaacgaaataccgacactctgggtctacaggtgggcaaacgcgtgtgccctttcaaaagcgaaaaggtggtggtagaggacactgtacctataatcccgaaggagaagcacgccaaagaggaagacagctctatagactatgatctcaacttgccagatactgtgacccatgaggactacgtcacaacgcggttatag

SEQ ID NO: 209192 - DNA, 2394 bp, Artificial Sequence
  Description of Artificial Sequence: Synthetic coding sequence
atggccgccgcccccgtggccgccggcagcggcgccggccggggccgcaggtccgcagccacagtggctgcttggggaggctggggcggccgccctcgccctggcaacatcctcctacaattgagacagggacaactcactggacgaggactggtgcgagctgtccaattcacagagactttcttgacagagagggacaagcagtctaagtggagcggaataccacagttgctgctgaagctgcatacaaccagccatctgcattctgactttgtcgagtgccagaatatacttaaggaaatttcccctctgctgagcatggaggccatggcctttgtgacagaagaaagaaaactcactcaagagacaacctaccccaacacctacattttcgatctttttgggggcgtggacttgttggtggaaatcctgatgaggccgaccatctcaattcgaggccagaagctcaagatttcggacgagatgtccaaagattgtctttctatcctgtacaacacctgtgtctgcacagaaggtgtaaccaaacggctcgccgaaaaaaatgacttcgttattttcctcttcacactgatgacttcgaaaaagacgttcctgcaaacagctaccctcattgaagatattttaggtgtgaagaaagaaatgattcgtctggacgaagtgcctaacctcagctccttggtcagtaactttgaccaacagcagttagcaaatttttgtagaatactggcagttaccatttcagagatggatacagggaatgacgacaaacacacactgctggcaaaaaacgctcagcaaaaaaaaagtctcagcctcggccctagtgccgcggaaattaatcaggccgccctcctgagtatcccaggctttgttgagcggctgtgcaaactggctactaggaaagtatccgaaagcaccgggaccgccagtttcttgcaggagcttgaggaatggtatacttggctcgataacgcactcgttttggatgccctgatgagggtcgccaatgaagagtctgagcataatcaggcttcaatcgtcttcccccccccaggggcctccgaggagaatgggctcccccacacatccgctcgcacacagctaccacagtcaatgaagatcatgcacgagatcatgtataagctggaggtattgtacgtactgtgtgtgctgttaatgggaaggcaaaggaaccaggtacatcggatgatcgcagagttcaagctcattcccggcctcaataatctcttcgacaaacttatctggcgaaagcacagcgctagtgctttagtgttgcatggccataatcagaactgtgactgcagtcccgacattacattgaagatccaatttttgcggctgcttcagagcttcagcgatcatcacgagaacaaatacctgctgctgaacaaccaggaactgaatgaattatctgccatcagtcttaaagccaatattccagaggttgaagctgtgctgaacaccgatagaagcctggtgtgtgacggaaaacggggcctcctcactcgtctgctgcaggtgatgaagaaggaaccggctgagtccagcttcagattctggcaggcgagagcagtagaaagcttcctccgaggcaccacatcctatgctgatcagatgtttctcctgaagcgcgggttgctggaacacatcctttactgcatcgtggactctgaatgcaaaagtagggatgtgctccagtcctacttcgatttattaggcgagctcatgaagtttaatgtggacgcatttaaacggttcaataagtatataaatactgatgcaaaattccaggtgttcctgaaacagattaatagctcactcgttgacagcaacatgcttgtccggtgcgttacactaagcctggatcggtttgaaaaccaggtagacatgaaggtcgccgaagttttaagtgaatgccgactccttgcctatattagccaggttccgactcagatgtcgttcctgtttcgactgatcaatattatccacgtgcagaccctgacgcaggagaatgtctcatgcttgaatacgtccctagtcatcctcatgttagctcgccgaaaagaaaggctgcctctctatctccgtcttttacagcggatggaacacagtaaaaagtaccccggatttctgctgaataacttccataaccttctgcggttctggcagcagcactatctgcacaaagacaaggatagcacatgcttagaaaattcatcgtgcatcagtttctcatattggaaggagaccgtgtccatcctcctgaaccccgataggcagtcaccatctgctctggtgagctacatcgaggaaccatacatggatatcgaccgggattttactgaggagtag

SEQ ID NO: 209193 - DNA, 2277 bp, Artificial Sequence
  Description of Artificial Sequence: Synthetic coding sequence
atggccgccgcccccgtggccgccggcagcggcgccggccggggccgaagatccgcagccacagtggctgcctggggcggatgggggggcagacctcgccctggaaacatactcctccagctgcgtcagggccagttgaccgggcgcggcttggtacgggcagttcagtttactgagactttcctgacagagcgcgataaacagagcaaatggtcagggattccccaactgctgctaaaactgcacacaacatcacacctccactctgatttcgtagagtgtcaaaacatcctgaaattactggtagagatactcatgcgtcctactatctccatacgtgggcagaaattgaagatttccgacgagatgagcaaggactgcctcagcattctgtataatacatgtgtctgcacggaaggtgtgacaaagagactggctgagaagaatgactttgtgatcttcctgtttaccctgatgacatccaaaaaaacatttcttcagacagctacattgatcgaggatatcttaggtgtgaaaaaggagatgatcaggctagatgaggtaccaaacctgtcctctttggttagtaactttgatcaacagcagctcgcaaatttctgtcgcatccttgcggtgacaatctcggaaatggatacagggaatgacgacaagcacacattgctggccaagaacgcccaacaaaagaagtctctatcgctagggccttctgccgctgagatcaatcaagctgcattgctgtccatccccgggtttgtggaaagactgtgcaaactcgctacacgcaaagttagcgagtcaacgggaaccgccagcttccttcaggaactggaagaatggtacacatggctcgacaatgctttagtactggatgcacttatgcgggttgccaacgaggaatccgagcataatcaagcatccatcgtgtttccgccaccaggagccagtgaagaaaatggactgccccatactagtgccagaacccagttaccccagtcaatgaaaatcatgcacgagatcatgtacaagctggaggtactttacgtgttatgtgtgttactcatggggagacaaaggaatcaggtgcacaggatgatcgccgagttcaaactcattcctggtttgaacaatctatttgataaacttatctggaggaagcactccgcctcagctttggtgttgcacggccacaaccaaaactgtgactgctcgccagacataaccctcaagattcagtttctgcgcctgttacagtcattcagcgaccaccatgaaaacaaatacttgctgttgaacaaccaggaactgaacgagctgtcagccatctcccttaaagcgaatattccagaagtagaagcggtcctgaacaccgatcgttccttagtctgcgatggaaaacgcgggctgttaactaggctactgcaggtgatgaaaaaagaaccggccgagagtagttttcggttttggcaagcgagagctgttgagtcattcttgagaggtacaaccagctacgccgaccaaatgttcctcctgaaacgtggactgctcgagcacatcctgtactgcatcgtagattccgaatgcaagagtagagacgtcttacagtcctacttcgacctgctcggagaactgatgaagtttaatgttgacgccttcaagaggttcaacaagtatatcaataccgatgctaagttccaagtcttcttgaaacaaattaacagctcactggtggattctaacatgctggtccgctgcgttactcttagcctggatagattcgagaatcaggtggatatgaaagtcgcggaggtgctgtcagagtgtcggctcctggcctacatttctcaggtcccgacccagatgagcttcctgttcaggttgatcaatattatccacgttcagactctaacccaggaaaacgtgtcttgcttaaatacctcccttgtgattttgatgctggcacgaagaaaggaacggctcccactgtacctgcggttgttacagcggatggaacacagtaagaaatatcccggatttctgttaaacaacttccacaaccttcttcgattttggcagcagcactaccttcacaaagacaaggactctacctgcctggaaaatagctcatgcatatccttttcatactggaaggaaacagtaagcatccttctgaatccagacagacagtcaccctccgccctggtgtcttacatcgaggaaccctacatggatattgatcgggacttcactgaggaatag

SEQ ID NO: 209194 - DNA, 2370 bp, Artificial Sequence
  Description of Artificial Sequence: Synthetic coding sequence
atggccgccgcccccgtggccgccggcagcggcgccggccggggccgcaggagcgccgcaaccgtcgcagcctggggtggatggggaggtcgtcccaggcctggtaatatcctgctgcagttgcgccagggccagttgacggggagagggcttgtgcgtgcagtacagtttaccgagacttttctgaccgaaagagataaacaatcaaagtggtccggtatacctcagctcttgctaaagctccataccacttcgcatctccactcagatttcgtggagtgccagaatatcctcaaggaaatatccccgttactgagcatggaggccatggcattcgtgaccgaagaaagaaaactcacccaagagactacctaccctaacacatacatctttgatctgtttggaggcgtcgacctcctggtcgagattcttatgagacccaccatttctatcagaggccaaaagttaaagatcagtgatgagatgagtaaggactgcctttccattctgtacaacacgtgcgtttgcactgaaggggtaactaaacgactggcagagaagaacgattttgtgattttcttgttcacactgatgacttctaaaaagacgttcctgcagaccgccacactcattgaggacatcctaggcgtgaaaaaggagatgatacgcctcgacgaagttccaaacttatctagccttgtgtccaacttcgaccaacagcagctcgccaatttctgccggatcctggcggtgacaatcagcgagatggataccggtaacgatgacaaacacacactgctggccaaaaatgcgcagcagaagaaaagcctaagcctggggcccagcgccgctgaaataaatcaggctgcactgcttagcatacccggattcgttgaaagactgtgtaagctggctacccggaaggtgtcagaatctactggtacagcctccttcttacaagaattggaagagtggtacacatggctggacaacgctttggttctcgacgccctgatgagggtggccaacgaggaaagcgagcataatcagggcgcttcagaggaaaacgggctcccacatacatctgcccggacccagctaccccaatcaatgaagataatgcatgaaataatgtacaaactagaggtactctacgtcttatgcgtgctactcatgggtcggcagaggaatcaggttcaccggatgattgccgaattcaaacttatccctggtctcaataatctgttcgacaaactcatatggaggaagcactctgcctctgcacttgtactccacgggcacaaccagaactgtgactgttcacctgacatcacactgaaaatccaatttttgcgcctcctccagagcttttccgaccatcacgaaaataaatatctgctgctgaataatcaggagcttaatgagctaagtgctatctcgctcaaggcgaatattccagaagtcgaggctgtgctgaacaccgatcgctcactcgtctgtgacggaaagcggggactgctaacgagactgttacaagtgatgaagaaggagccggctgagtcatccttcagattttggcaggctcgcgcggtggagtctttcttacgtgggaccacttcatatgccgatcagatgttcctgctaaaacgggggttgcttgaacatattttatactgtatcgttgatagtgagtgtaaaagtcgcgacgttttgcaatcttacttcgacctcttgggggagctaatgaagtttaatgtcgatgcctttaagcgcttcaataagtacatcaataccgacgccaaattccaggtgttcctgaagcagatcaattcctcactcgtagatagtaacatgctggtgcggtgcgtgacactgtccctcgacaggttcgaaaaccaggtcgatatgaaggtggcagaagtgctaagcgagtgtcgcctgctggcatatatctcccaagtccctacacagatgagtttcctctttaggctaatcaatatcattcacgtgcagactctaacccaagaaaatgtcagctgcttgaatacctcgcttgtaatcctgatgcttgcccgacgaaaggaacgactgcctctctacctccgtttgctccagagaatggagcactctaagaagtaccccggattcttgctcaacaattttcacaaccttctccggttctggcagcagcactatctccataaggacaaagacagtacatgcctggagaatagttcatgtatctctttttcctattggaaggaaaccgtgtcaatactgctgaacccggatcgacagtctcctagtgctctggtgtcatacattgaggaaccatatatggacattgatcgggatttcacagaagagtag

SEQ ID NO: 209195 - DNA, 1200 bp, Artificial Sequence
  Description of Artificial Sequence: Synthetic coding sequence
atgcggagccagagcaccatcaaggtgcaccggatgatcgccgagttcaaactgattcccggactaaacaatctgtttgacaagctcatttggcgaaaacactcagctagcgcactggtgctgcacggacacaatcagaactgtgactgtagccctgacataaccctcaagatccagtttttaaggttgctacaaagtttctcagaccaccacgagaataaatacctgttgctgaacaaccaggaattaaatgaactctctgctatctccctaaaggctaacattcctgaggtcgaagccgtcctgaacactgatagaagcctggtgtgcgatggaaaaaggggactgttaaccagactgctgcaggtgatgaagaaagagcctgccgagtcctcattccggttttggcaggcccgagcagttgaaagctttctgagggggaccaccagctacgccgaccagatgttcttattgaagcggggactgctagaacacattttgtattgtatagtggatagcgagtgcaaatcccgggacgttcttcagagctactttgacctgttgggcgaactgatgaagttcaatgtggacgccttcaaacgcttcaacaagtatatcaacacggacgcgaagtttcaagtgttccttaaacagatcaactcctctcttgtagacagtaacatgctggtgcgatgtgtcacactctccctggaccgatttgaaaatcaagttgacatgaaggtcgcagaagttctgagcgagtgtcgcctgctggcctatatcagccaggtgccaacacagatgtccttcctgtttaggctgatcaacatcatacatgttcaaactctgacccaggagaacgtttcttgtttgaacacttcgctggttatcttgatgctggcccgcaggaaggaacggctcccattgtaccttagactgttacagcgtatggaacactccaagaaatacccaggattcctgctgaataattttcataatctactgaggttttggcagcaacactacttgcataaagacaaggactccacatgtctggagaatagtagctgcatctctttcagttactggaaggagactgtaagtatccttcttaatcccgatcgacagtcaccgagcgccctggtctcatacatagaggagccgtatatggacatcgaccgcgatttcacagaggaatag

SEQ ID NO: 209196 - DNA, 2349 bp, Artificial Sequence
  Description of Artificial Sequence: Synthetic coding sequence
atggccgccgcccccgtggccgccggcagcggcgccggccggggcagacggtctgccgctaccgttgctgcctggggcgggtgggggcaactcactggccgcgggctggtgcgtgccgttcagttcactgagacatttctcacagagcgagataagcagagtaaatggtccggtatcccccaacttcttctcaaactgcataccaccagccatctacattctgacttcgttgagtgccagaacatactcaaagagatttcacctctcctgtccatggaagccatggcttttgtgaccgaagagaggaagcttacccaggagactacgtaccctaatacgtatatttttgacctgttcggtggtgtggacctcctcgtcgagattctaatgcgacccacgattagcattcgtggacagaagttaaaaatatcagatgaaatgtccaaagattgcttgagtatcttgtacaatacttgcgtctgcactgaaggggtgacgaaacggttagcagaaaaaaatgatttcgttatctttctgttcaccttgatgacgtccaagaagacgtttctgcagaccgcaacgctgattgaagacattctgggagtgaagaaggaaatgatccggcttgatgaagtgcccaatcttagttcactggtgtcaaactttgaccagcagcagctcgcaaatttttgtcggatcctggccgtgaccatctctgaaatggacacaggcaacgatgacaagcacacattgctcgccaaaaatgcgcagcagaaaaagtcgctgagccttggtccttctgcggccgaaataaaccaggctgccctgctatccatccctgggtttgtcgaacggctgtgtaagctcgcgacgagaaaagtgagcgagagcacaggcaccgcatccttcctccaggaactggaggagtggtacacctggctggacaacgctctggttcttgatgctcttatgcgtgtggccaacgaggaatcagagcacaatcaggcatccattgttttccccccccctggcgcctccgaagaaaacggattgccacacaccagcgcaagaactcagttgccacagtccatgaaaatcatgcatgagataatgtataagttggaggtgctatacgtactctgcgtgttactgatgggccggcaaagaaaccaggtacaccgaatgatcgcagaattcaagttaattcctggcctcaataacctttttgacaagttaatctggaggaagcactcagcgagcgcccttgtcctgcatggccacaatcaaaattgtgactgttcgcctgacatcacactgaagattcagttcctgcgcttacttcagtctttttccgatcaccatgagaacaaatacctgttgttgaataatcaggagttgaatgaactatctgccataagtttgaaagccaatatccccgaagttgaagcagtcctgaatacagacagatccctggtgtgcgacgggaaacgtggattgctgacccggcttcttcaggttatgaagaaggagcccgccgagagttctttcaggttctggcaagcacgggctgtggaatccttccttagaggaacaaccagctatgcggaccaaatgtttctgctgaaaagaggactcttggagcatatcttatactgcatcgttgattcagaatgcaagtcccgcgacgtgttacagtcttactttgacctgctgggagagctgatgaagtttaacgtagacgcctttaaacgcttcaacaaatacattaacacggatgcgaagttccaggtgtttttgaaacagatcaattcgagcctcgttgattcaaatatgctcgtcagatgtgtgaccctgagcctggatcggtttgaaaaccaagtcgatatgaaggtcgccgaagtgttgtccgaatgcaggttactagcatacataagtcaagtgcccacacagatgagctttctcttcaggctcataaacattattcacgtgcaaaccctcacgcaggaaaacgtctcatgtctgaataccagtttggtcatcctgatgctggcccgaagaaaggagcggcttcccctctacctccgtctccttcagcgcatggaacacagcaagaagtatccagggtttctcctcaataatttccacaaccttcttcgtttctggcagcagcattatctccataaggacaaagatagtacctgtctagagaactctagctgcattagctttagctattggaaggagaccgtaagtattctcctgaatcccgatcggcaatctccttcggccttagtatcttatattgaagagccatacatggatattgaccgggattttaccgaagagtag

SEQ ID NO: 209197 - DNA, 2922 bp, Artificial Sequence
  Description of Artificial Sequence: Synthetic coding sequence
atggcccagctgtactacaagaaggtgaactacagcccctaccgggaccggattcccctgcagatcgtgcgggccgaaaccgagttgtcggcagaagaaaaagcatttcttaatgccgtggagaagggggattatgccaccgtgaaacaggctctgcaagaggcagagatttactataacgtgaacataaactgtatggaccctttgggcaggagtgcgcttttaatcgcaatcgagaatgaaaaccttgagatcatggaattattgctcaaccattctgtgtacgtgggcgatgcgctactgtatgcaatcaggaaggaggtggtgggagcagttgagctgctgctgagctatcgtcgtccttctggcgagaaacaggttcccaccctcatgatggatacccagtttagcgagttcactcctgacatcaccccgattatgcttgcggctcatacaaataactacgagattataaaactgctagtccagaagagggtgactattccacgcccccatcagattaggtgcaactgtgtcgaatgcgtttcgtcttcagaggttgattcactcagacactcaaggtcaaggctgaacatttacaaagccctggccagccccagtctcatagccctgtctagcgaggaccctattttgaccgcttttagactggggtgggaacttaaggaactgtctaaagtggagaacgagtttaaagccgagtatgaagaactgagtcaacagtgcaaactgtttgccaaagacctcctggatcaggcccgcagcagtagagagcttgagatcattctgaaccaccgggacgatcacagcgaggaactggacccgcagaaatatcacgatttagctaaactcaaggtggcgatcaagtatcatcagaaggaatttgtcgcccaacccaactgccaacagcttttggcaactttgtggtatgacgggtttcctggctggaggaggaaacattgggtggtcaagctgctcacttgcatgacaatcggcttccttttcccaatgctgtccatcgcgtatctgatctccccccgatctaatctggggctcttcatcaagaagccattcattaagttcatctgtcacaccgctagttacttgaccttcctatttatgctgctgctggcctcacagcatatcgttcgcaccgacttacatgtccaggggccaccccccacagtggtggaatggatgattctgccctgggtgctggggtttatctggggggagattaaagagatgtgggacggggggtttaccgagtatatccatgattggtggaacctaatggacttcgccatgaacagtctctacctcgccactatttccctcaagattgtggcatacgtcaaatacaacgggagccgccccagggaagaatgggagatgtggcaccccaccctgatagcagaagccctctttgcgattagcaatattctttcttcgctacgcctgatcagtctgtttactgctaattcgcacctaggccctcttcagatcagcctcgggcgaatgctcctcgacattcttaaattcttattcatctactgtctggtgttgctggcctttgccaacgggttgaatcaactgtatttttactacgagacaagagccatcgacgaaccaaacaactgcaaaggaattagatgcgagaaacagaataacgcgttcagtaccttatttgaaaccctgcaaagcctgttctggtctgtgtttggcttactaaatctgtacgtaaccaatgtgaaggcgcggcacgagttcaccgagtttgtgggcgcaacaatgtttgggacctacaatgttatttctcttgtcgttcttctgaacatgcttatcgccatgatgaacaattcctatcagctgatcgcagaccatgcagacatagaatggaaattcgcgcgtaccaagctctggatgagttactttgatgagggcgggactctgccacctccatttaacatcatcccctctcctaagtcattcttatacctaggaaattggtttaacaacacattttgccctaagcgggacccagacggtagaaggaggagaaggaacttgcgatccttcaccgaacggaatgcagattcactgatccaaaaccagcactatcaagaggttattagaaacttggtaaagcgttatgtcgctgctatgattagaaacagcaagacacatgagggcttgaccgaagagaatttcaaggagctgaagcaggatatttcttcctttcgatacgaagtccttgacctgctcggtaatcggaagcacccaagatcgttctctacttctagcacagagctcagccagagagatgacaacaatgacggttccgggggcgcgagagcgaaaagcaaatctgtgagctttaacctgggttgtaagaagaaaacttgtcacggacctcccttaataaggacaatgcctcggagttccggtgcccaaggaaaatccaaggctgagagctcatccaaacggtcattcatgggcccctccctaaaaaagctggggctgttattctcgaagttcaatggacacatgagcgaaccgtcatcagagccaatgtacactattagcgacggaattgttcaacagcactgcatgtggcaagatatccggtactctcagatggaaaaagggaaggccgaagcgtgcagtcagtccgagatcaatctctcagaggtagagcttggagaagttcagggtgccgcccaatcctcagagtgcccactggcttgttcttctagcctccactgcgcgagctcgatctgtagcagtaatagtaaactgctggatagcagcgaagatgtattcgagacttggggcgaagcctgtgacctgcttatgcacaaatggggcgacggtcaggaagaacaggtgaccacccgcttgtag

SEQ ID NO: 209198 - DNA, 2796 bp, Artificial Sequence
  Description of Artificial Sequence: Synthetic coding sequence
atgagccagagccccgccttcggcccccggcggggcagcagcccccgtggggccgctggcgctgccgccagaagaaacgagagccaggactatctgctcatggactccgagctgggggaggacggctgtcctcaagctcctctgccttgttacggttattacccatgctttcgcggttccgataatcgattagcccaccggcgccaaactgtgttacgcgagaaggggcgccgactggctaatcgcgggcctgcgtatatgttttcggaccggtccacctcactgtccattgaagaggaacgattcctagacgccgccgaatacggaaacattccagtagtgcggaagatgctagaggaatgccatagcctgaatgtaaattgcgtggactacatggggcaaaacgctctgcagctggcagttgccaacgagcatctggagatcaccgaactcctcctgaaaaaagagaatctctcacgcgtgggcgacgctctgctcctggcaatttccaaaggatacgtaagaattgtagaagctatcctctcacaccctgcgtttgctgaaggtaaacggcttgccacaagcccctctcagtccgagctacagcaggacgacttttacgcatatgatgaggatggcacacggtttagccacgatgtgaccccgatcattctggctgctcactgccaagaatacgagatcgttcataccctactgcgcaagggagcccggatcgagagacctcacgactatttctgtaagtgtaacgactgtaaccagaagcagaagcacgacagcttcagccacagccgctctcgtattaatgcctacaagggactggcgagcccagcttatttgagcctgtccagtgaagacccagtcatgaccgcacttgaattgtcaaatgagctggcagtgcttgccaatatcgagaaagagttcaagaatgattacaagaaactgagtatgcagtgtaaagattttgtcgtgggtctgttggatctgtgcagaaatacagaggaggtggaagccatcctaaacggcgacgtcgaaacactccaatccggagatcatgggcgtcctaatctctcgcgactgaaactggctatcaagtacgaggtgaagaagtttgtcgcccaccctaactgtcaacagcagttgctgtctatatggtacgaaaacctaagcgggcttaggcaacagaccatggccgtgaagttccttgtcgtactggctgtcgctatcggattgcccttccttgccctgatttactggtttgctccctgtagcaagatgggcaagatcatgagaggcccttttatgaagtttgtagcacacgcggcttctttcaccatcttcctcggtcttctcgtgatgaacgcagcggaccgcttcgaaggtacaaagctgcttccaaacgagacttcaacggataatgccaagcagctcttccggatgaagacgtcctgctttagctggatggagatgcttatcatcagctgggtaattggtatgatctgggccgaatgcaaggaaatctggactcaggggcctaaagagtacctattcgagctgtggaatatgctggactttggcatgctggcgattttcgccgcctcctttattgctcgttttatggccttctggcacgcatctaaggcacaaagcatcatcgacgcaaacgataccttgaaagaccttacaaaggtgacactgggggacaatgttaagtactataatctggcgcgcatcaagtgggatccaagcgacccccagatcatatctgagggactgtacgctatagccgtcgtgttgtcgttttcccgaattgcatacattctgcccgctaacgaatcgttcgggccgctccagatctctctcgggcggacagttaaagacatatttaaattcatggtgatcttcatcatggtgttcgtggcatttatgatcggcatgttcaatctctacagctattacattggggctaagcagaacgaggctttcaccacggttgaggagtcctttaagacccttttctgggcaatattcggattatctgaagtgaaaagtgttgtcataaattataaccacaaattcattgagaacatcggatacgttctgtatggcgtgtataacgtgacgatggtgatagtgctgcttaatatgctgatagccatgattaatagctccttccaggagatagaagacgacgccgacgtggagtggaaatttgcgcgtgctaaactgtggttctcttacttcgaagagggtcgtaccttgccggtgccattcaatctggtgccaagtccgaagagtttattctatctgctgctaaaactgaagaaatggatctctgaactattccagggacataagaagggtttccaggaagacgcggaaatgaataaaataaatgaagagaagaaacttggaattctcgggagtcatgaggatttatccaagctatccctggacaaaaaacaggttggacacaacaaacagccgtctatcagatcctctgaggactttcatctaaatagtttcaacaaccctcctcggcagtatcagaagatcatgaaacgtctgatcaagcgctatgtgttgcaggcacagatcgacaaagagtcagatgaggtgaatgaaggagagctaaaagagataaagcaagatattagcagtctgaggtatgaactgttggaggagaagtcccagaatacagaggacctggccgagctgattagggagctcggagagaagttgtccatggaaccaaaccaggaggagaccaatcgctag

SEQ ID NO: 209199 - DNA, 2448 bp, Artificial Sequence
  Description of Artificial Sequence: Synthetic coding sequence
atgagccagagccccgccttcggcccccggcggggcagcagcccccgcggcgccgcaggtgctgccgctcggcgaaacgagtcacaagactaccttttgatggattctgagctaggtgaggacgggtgcccacaggcccctctgccgtgttatggctactatccttgtttcaggggatccgacaacagactcgcacataggcgccagaccgtgctgcgggaaaaaggcaggaggctggccaatcggggacctgcttacatgtttagtgatcgctctacatcattgtcaattgaggaagagaggttccttgatgctgcagagtatggcaatatccccgtggtccgaaaaatgctggaggaatgccacagcctcaacgttaattgtgtggactacatgggccagaatgctctccagttggccgtcgctaatgagcatctggagattaccgagctccttctgaaaaaagagaatctatctagggtaggcgatgccctgcttctcgccatttccaagggatatgtaagaattgtggaagccatactgagccatcccgccttcgctgagggaaagcggcttgctacaagtcccagccagagcgagcttcagcaggacgacttctacgcctacgatgaggacgggacaaggttctctcacgacgtaactccaattattctggcagcccactgtcaggagtacgagattgtccatacactgctgcggaagggtgctcgtatcgagagaccacacgactatttttgtaaatgcaatgactgcaatcagaagcagaagcacgattccttttcacattctcgatctaggattaatgcctacaagggcttggcaagtccggcttatctgagcctgagttctgaggatccagtcatgaccgccttggaactgagcaacgaactcgctgtgctagcaaacatcgagaaggaatttaagatggggaagattatgcggggccctttcatgaaattcgtggcccatgcggcctccttcactatcttcctgggcttactggtgatgaacgcggccgatagatttgaaggaaccaagctgctacccaatgagacatccaccgacaacgccaaacaactgtttaggatgaagacgtcttgcttcagttggatggaaatgctcattatctcatgggtcattgggatgatttgggctgagtgtaaagaaatctggacccaaggcccaaaggaatacctcttcgagctgtggaatatgctggacttcggaatgctggctatatttgccgccagctttatcgcaagatttatggcattttggcatgcttccaaggcacagagcatcattgatgccaatgacaccttaaaagacctcaccaaggtgacgttaggtgacaatgtcaagtactacaacctggcgaggattaaatgggatccatctgacccacagattattagcgagggtctctatgccattgctgtggtgctgtctttttcccggattgcctatatcttaccagccaacgagtcttttgggccacttcaaatctccctgggtcggacggtgaaagatatatttaagttcatggtcatattcatcatggtgttcgtggcatttatgattggcatgtttaacctgtacagttactacattggagcgaaacagaacgaggcattcacaactgtcgaagagagcttcaagaccctgttctgggctattttcggcctgtcggaggtgaagtccgtcgtgatcaattataaccacaaattcatagaaaatattgggtacgtcctgtacggggtctataatgtgaccatggtgatagtgctgctcaatatgcttattgccatgataaactcatcatttcaggagatagaggatgatgcagatgttgaatggaagttcgctcgggcgaaattatggttttcatacttcgaagaagggcgtaccttgccagtcccattcaatctggttccaagccctaaatccctcttctatcttttgttaaaactgaaaaagtggatttccgaactcttccagggtcataagaaaggctttcaggaagacgccgagatgaataaaatcaacgaggaaaagaagctgggaattctcggcagccacgaggacctcagcaaattgagtctggataagaaacaagtcgggcacaataaacaacctagcatacggtcttcagaagactttcatctgaactcctttaacaacccccctagacagtatcagaaaatcatgaaacgtttaattaagcggtatgtgctgcaggcccagatagataaggaatccgacgaggtcaacgagggcgagctaaaggaaatcaagcaggacatttccagcttacgctatgagctgttggaggaaaaatcgcagaataccgaagatttggcagagcttataagagagcttggagaaaagctgagtatggaacctaaccaggaagagacaaataggtag

SEQ ID NO: 209200 - DNA, 2631 bp, Artificial Sequence
  Description of Artificial Sequence: Synthetic coding sequence
atgagccagagccccgccttcggcccccggcggggcagcagccccagaggagcagctggggcagctgcccgccgtaacgaaagtcaggattacctgctgatggattctgaactgggcgaagatggctgcccgcaggctcctctgccatgctatgggtattatccctgtttccgaggatcagacaatagactggcccaccgtcgacagaccgtgttacgagagaaaggacgccgactggccaacagaggtcccgcttacatgttttcagatagaagcacatctctgagtatcgaggaagagagattcctggatgcagcagagtatggaaacatacctgtggtgcgaaaaatgctagaagagtgccatagccttaatgttaactgtgtggactacatggggcagaatgctcttcagctggcggtcgccaatgaacacctagagattacggaattgctgttgaagaaggaaaatctctctcgggtcggcgatgcactactattagctattagcaaggggtacgttcgaattgtggaagccatcttatcccaccctgcttttgccgagggcaagagactcgctacgagtccaagccagagcgagctgcagcaggacgacttctacgcatacgatgaagacggcacccgattttcgcatgacgtaacgcctattatactggccgctcactgtcaagagtacgagatcgtacacaccctgcttcgcaagggagctcggatcgagaggccgcacgattatttttgcaaatgtaacgattgcaatcagaaacagaagcatgattctttctcacactctagatccagaataaatgcatacaagggattggcatcaccggcctacctctccctgagcagtgaagatcccgttatgacagccctggagctgtctaacgagctggcagtactggcaaacattgagaaagagttcaagaacgactacaaaaagctgagtatgcagtgcaaggactttgtggtaggattgttggacctgtgtagaaacactgaggaagtcgaagcaatcctgaatggcgatgtggagacactgcagtcaggtgatcatggtaggcctaatttaagtcgacttaaactggccattaagtatgaggtgaaaaagatgggcaaaatcatgaggggaccctttatgaagtttgtggcacacgccgcttcgtttacaattttcttagggctgttggttatgaacgccgctgaccgttttgaggggaccaagctcttgccaaatgagacatccaccgataacgcaaagcagttatttagaatgaaaaccagctgcttcagctggatggaaatgcttatcatttcctgggtcatcggcatgatttgggccgaatgtaaggagatctggacacagggacccaaagagtatctatttgagctgtggaatatgctggattttggcatgctggccatcttcgctgcctccttcatagctaggttcatggcattctggcacgccagcaaagctcagtcaatcatcgatgcgaatgatacactgaaggacctcacaaaagtgactttgggtgataacgtgaaatattacaacttggccaggatcaagtgggatccttctgacccacagattattagcgagggactgtacgccatcgctgtcgtcctctcattttctcggattgcttatattcttcctgcaaatgagtcttttggcccgctccaaatatccctcggtaggaccgtgaaagacattttcaaattcatggtgattttcataatggtatttgtcgcattcatgatcgggatgttcaatttgtactcctactacataggggcgaagcagaacgaggctttcactaccgtcgaagaaagcttcaaaactctgttttgggctattttcggtttgtctgaagtaaagagtgtggtaatcaactacaaccacaagtttattgaaaacattgggtatgtcctgtatggagtttataacgtgacaatggtaatcgtgttgctaaatatgctgatcgcgatgattaacagttcttttcaggaaattgaggacgatgcagacgtggaatggaaattcgcccgagcaaagctgtggtttagctacttcgaagagggtcggaccttgcccgttccatttaacttggttccaagtcctaagtctctattttatttactactgaagttaaagaagtggatatctgaacttttccagggccacaagaaaggtttccaggaggacgcagaaatgaataagataaatgaagaaaaaaaactggggattctaggctcccatgaggatctatctaagttgtctctggacaagaagcaggtgggacacaacaagcagccctcgatccgtagcagtgaggactttcacctcaattcctttaataatccaccacgccaatatcagaaaattatgaaacggcttatcaaaaggtatgtgttgcaagcgcaaatcgataaggaaagcgacgaagtgaacgagggagagcttaaagagatcaagcaggatattagcagcctacgctacgagctgctggaagagaagagccaaaatacagaggacctagctgagctcatacgcgaactaggagagaagctaagtatggagccaaaccaagaggagactaaccgctag

SEQ ID NO: 209201 - DNA, 2406 bp, Artificial Sequence
  Description of Artificial Sequence: Synthetic coding sequence
atgctgcggaacagcaccttcaagaacatgcagcggcggcacaccacccttagggaaaaagggagacggcaagcaatacggggaccggcctacatgttcaatgagaaaggcactagcttgaccccagaggaagagagatttttagactctgcggagtatggtaacattccagtggtgcgtaaaatgctggaagaatctaagacgttgaacttcaattgtgtcgactacatgggacaaaacgccctgcagctggctgtgggcaacgaacacctcgaagttactgaactcctcctgaagaaagagaaccttgccagggtgggcgacgcactactgctggccattagcaagggctatgttcgcatcgtcgaggccatccttaaccaccctgccttcgcccaaggacaacgtctgactctttcaccccttgaacaggaattgagagatgacgatttctatgcctatgatgaggacggaacacgattttcacacgacattacccccatcatactggccgcccactgccaggagtatgaaatcgtgcatatcctgctgctgaagggggcaaggatcgagagaccccacgactacttctgtaagtgtaatgaatgtacagagaagcaaagaaaagattctttctctcactcacgctccaggatgaacgcctacaagggtcttgcctccgcagcatacctttccttgagctccgaagatccagtcttaaccgccctggaactaagcaacgagctggcacgcctggctaacatagagaccgagtttaagttcgtggcccacccgaattgccaacagcaattacttaccatgtggtacgaaaacctttctggactgcgacaacagagtatagcggtgaaattcctggctgtgttcggtgtgagtataggcttaccattcctggcaattgcatactggattgccccttgcagcaaactggggcgcacgctaaggtcaccatttatgaagttcgtggcacacgccgtgagcttcacgattttcctgggcctactagtcgtcaatgcgtcagataggttcgagggggtgaaaacgctgccaaatgaaactttcactgactatccaaagcaaatctttcgggtgaagaccactcagttctcttggaccgaaatgctgataatgaagtgggtgttaggaatgatctggagcgaatgcaaggaaatctgggaggaaggacccagggagtacgtgctgcatttgtggaatctgctggactttgggatgctgtctatttttgttgccagctttacagccagatttatggcctttctgaaagcaactgaggcccagctttacgtggatcagcacgtgcaggacgacactctgcacaatgtgagccttcccccagaggttgcatacttcacctatgcccgcgataagtggtggccatctgatccccagattatctccgaggggttatatgccatcgcggtagtgctgtctttcagtcggatcgcatacatcctgccggcgaacgagagctttgggcccctgcagatctccttgggcagaacagtcaaggatatcttcaagttcatggtaatcttcataatggtctttgtcgcctttatgatcgggatgttcaacctctattcgtactatcggggagctaaatataatcctgctttcacgacagtcgaggagagcttcaagacactcttctggtcgatctttggtctgagcgaggtgatatctgttgtcctgaagtatgatcacaaattcatagaaaacataggttacgtcctctatggagtgtacaacgtgacaatggtggtagtgctgctgaatatgctgatcgcaatgattaacaattcctaccaggagatagaggaagatgctgatgtcgagtggaagttcgctcgtgctaagttgtggctgagctacttcgatgaaggccggactctgccagccccattcaacctagttccctcccctaaaagtttttactaccttatcatgcggatcaagatgtgtttgattaagctgtgcaaatcaaaggccaaaagttgtgagaatgacctggagatggggatgctcaacagcaaattcaaaaaaacgagatatcaggccggcatgaggaattccgaaaacctaaccgcaaacaatacactgtccaaacccacacgatatcaaaagatcatgaagcgactgatcaagcgctatgtcctcaaggcacaggtcgatcgcgagaatgacgaagtcaatgaaggggaactaaaagagatcaaacaggatatctcttcactccgatatgaattgcttgaagaaaagagccaggcaacgggtgaacttgcagaccttattcagcagctgtccgaaaaattcgggaaaaacctcaataaagatcatctgagagttaacaaaggaaaggacatttag

SEQ ID NO: 209202 - DNA, 2241 bp, Artificial Sequence
  Description of Artificial Sequence: Synthetic coding sequence
atgctgcggaacagcaccttcaagaacatgcagcggcggcacaccactctgcgtgagaagggacggcggcaagctatccgcggtcccgcatatatgttcaacgagaaaggcacaagtcttacgccggaagaagagcggttcctcgacagtgccgagtatggcaatattcctgtagtgagaaaaatgcttgaggagtcaaagacactgaatttcaactgcgtggactacatgggccaaaacgccctgcagctggcggtcgggaatgagcacctcgaggtcacagagctactgcttaagaaggagaatttggcccgcgtcggggatgccctgcttcttgcaatctcaaaaggctacgtgcgcattgtggaggccatcttaaaccaccccgccttcgcacaggggcagcggctgacacttagcccattagagcaggaacttcgcgacgatgatttttatgcctatgacgaggatggaacaagattcagtcacgatattacccccattatcctcgccgctcattgccaagagtacgagattgtgcatatcctgcttctaaaaggtgcgcgcattgagagacctcatgactacttttgtaaatgcaatgagtgcaccgagaaacagcgcaaggacagctttagccactcaaggtcaaggatgaacgcgtacaagggtctggcgtcagctgcctatttgtccttgtcgtcagaggatcctgttctcactgcactcgaattgagtaacgagctcgctcgactcgctaacatcgagacagagttcaaacttggccgcactcttagaagtccgtttatgaagtttgtggcccacgcagtcagctttacaatcttcctgggcctcctagtggtgaatgcgagcgatcgcttcgagggagtcaagaccctgcccaacgaaactttcaccgattaccccaagcaaatattccgagtgaaaactacacagttcagctggaccgagatgctaatcatgaagtgggtgctaggaatgatatggtctgagtgtaaggaaatttgggaggaggggccccgggaatacgtccttcacctgtggaatttgctcgacttcggcatgctgtcgatctttgttgctagctttacggcgagattcatggcattcctaaaagccacagaagcccagctgtatgtggatcaacacgtgcaggatgacactctgcacaatgtttccctcccccctgaagtcgcgtattttacttatgcacgcgacaagtggtggcccagtgacccacagatcatcagtgaggggttatacgctatagcagttgtgctttctttcagtagaattgcctatatccttcctgccaacgaaagttttggccctctgcagatttccctgggacggactgtaaaagacatcttcaagtttatggttatctttattatggtgtttgtcgccttcatgattggaatgttcaatctgtatagctattaccgcggtgccaagtataaccctgcattcaccacagtggaggagagtttcaagaccttattctggtctattttcggtctgtccgaggtaatttcagtcgtgctgaagtacgaccacaagttcattgaaaatatcgggtatgtgctgtacggcgtgtacaacgtcactatggtagtcgtgctactgaatatgctgattgcaatgataaataattcttatcaggaaattgaggaggacgccgatgttgaatggaaattcgcccgcgcaaaactctggcttagctatttcgatgaaggccggactctccccgctccctttaatttggtacctagccctaaaagtttttattacttgattatgcgaattaaaatgtgtctgattaagctctgcaaaagcaaagctaaaagctgcgaaaatgatctagagatggggatgctaaattccaagttcaagaaaacgcggtatcaagcaggcatgcgcaactcagagaatctgactgcaaataacaccttgtccaaacctaccagatatcagaagattatgaagaggcttattaagaggtacgtcctgaaggcccaggtcgatcgcgagaatgacgaggtgaacgagggagagttaaaggaaatcaagcaggatattagtagcctgaggtacgaacttctggaagaaaagtctcaagctaccggagagcttgcggacctgatacagcagctgtccgaaaagtttggcaaaaacttaaacaaggatcaccttagagtgaacaaaggaaaagacatttag

SEQ ID NO: 209203 - DNA, 2589 bp, Artificial Sequence
  Description of Artificial Sequence: Synthetic coding sequence
atgctgcggaacagcaccttcaagaacatgcagcggcggcacaccacgctaagagagaaagggcggaggcaggctattagagggccagcctacatgttcaatgagaagggaacaagcctaacgccagaggaagagcgatttctagacagtgctgagtatgggaacattcccgtagtgcgaaagatgcttgaggagtccaaaacgttgaactttaactgcgtggattacatgggccagaacgctttgcaactagcagttggaaacgaacacctagaagtcactgagctcctgctgaagaaagagaacctggctagggtgggagatgccctgctgcttgccatttccaaagggtacgtaagaattgtcgaggccattctgaatcatcccgcgttcgcccaggggcagagacttacactctcccctctcgaacaagagctgcgcgacgatgatttctatgcctacgacgaagatggcacacgtttttctcatgacattacccccattattctcgccgcccactgtcaagaatatgagatcgtccacatccttctgctgaagggcgcccgtatcgagagaccccacgactacttttgcaagtgcaatgaatgtacagagaagcagcgaaaagactcattcagtcatagccgatcccggatgaacgcgtacaagggactcgcttctgccgcgtatctgagtctctcctcggaggatccagtgctaacggcattagagttgtcaaatgagctcgcacggctggctaacattgaaaccgaattcaagaacgactatagaaaactgagcatgcagtgtaaggatttcgtagtgggcgttctggatctatgccgtgacacagaggaagttgaggcgatcctgaatggggacgtgaattttcaagtgtggtccgatcaccaccggccctctctcagcagaatcaaattagccattaagtatgaggtcaaaaaattcgtagcccatccaaattgccaacaacagctactaaccatgtggtacgagaacctgagcggactgagacagcagtccattgcagtgaagttcctggctgtcttcggggtgagtattggcttgccatttctcgcaatcgcatattggatcgctccatgttccaagctgggtcggaccctgcggtcgcctttcatgaagtttgtggctcatgctgtctcttttactatttttctgggcctcctggtggttaacgcttctgaccgcttcgagggagtgaaaacgctccctaacgagactttcaccgactatccgaagcaaatattccgggtgaagaccactcagttttcctggaccgagatgctaatcatgaaatgggtgttggggatgatttggagcgaatgcaaggaaatctgggaagagggaccccgcgagtatgtccttcatctgtggaatctgctagacttcgggatgttgtctatttttgtggcatctttcacagcacggtttatggcttttctgaaggcaaccgaagcccagttatatgtggaccaacatgttcaggatgatacactgcacaatgtctcgttgccacccgaggtggcatatttcacatacgccagagataagtggtggccctcagatccacagattatctcagagggcctgtacgcaattgccgtcgtgctgtcattttctagaattgcatacatattaccggcaaatgaaagcttcggccccctgcagatatctttgggccggacggtgaaggacatttttaaattcatggtcattttcattatggtcttcgtggccttcatgatagggatgttcaatttgtacagctactataggggggcaaagtataatccggcctttaccactgtggaagagagcttcaagaccctcttttggtccattttcggcctttccgaagtcatctcagtagtgcttaagtacgatcataagtttatcgaaaatattggctatgtgttatatggtgtttataacgtcacgatggtcgtggtgttactgaatatgctgattgccatgatcaataatagctatcaggaaatcgaggaggacgctgacgttgagtggaagttcgcgagggctaaactctggctttcttactttgacgaagggagaacactgcccgccccatttaatcttgtcccctctccgaaatccttttattacttaatcatgcgtattaagatgtgcttaatcaagctctgcaagagcaaagccaaatcgtgcgagaacgatttggaaatgggcatgctgaattctaagtttaaaaagacccggtatcaggctgggatgaggaattctgagaacctcaccgccaacaataccctcagcaagcctaccagataccagaagatcatgaaacgcctcatcaaacgctacgttcttaaggcccaggtggacagagagaacgatgaagtgaacgagggagaactgaaggaaattaaacaggatatctccagtttacggtatgagctgttggaagaaaagtctcaggcaacaggtgagctagcagatttaattcagcagctgagtgaaaagtttgggaagaacctcaataaggatcatctccgggtgaataagggaaaagacatctag

SEQ ID NO: 209204 - DNA, 4350 bp, Artificial Sequence
  Description of Artificial Sequence: Synthetic coding sequence
atggagcccagcgccctgcggaaggccggcagcgagcaggaggagggcttcgaaggactacctagaagggttaccgacctcggtatggtatccaatctgcgtcgaagcaattcctctttgttcaaaagttggcgtctccaatgccctttcgggaacaatgacaagcaagaatccctctcgtcttggatcccagaaaatatcaagaagaaagagtgtgtttattttgttgagtctagtaagctgtccgatgctggaaaagtggtgtgccagtgtggttatactcacgaacagcatctggaggaggccaccaagccccataccttccagggaacccagtgggaccctaagaagcatgtgcaggaaatgcctaccgacgcatttggcgacatcgtctttactggactcagccagaaggtcaaaaagtacgtgagggtttcccaggacacaccttcaagcgtgatataccacttaatgacacaacattggggacttgacgtaccaaatctactcatctcagtgacaggtggtgcaaagaactttaacatgaagcccaggttgaaatctatttttcgacgaggtttggtgaaagtggcccagactaccggcgcctggatcattaccggggggagccacaccggcgtcatgaaacaagtcggcgaggcagtgagagatttttcactgtccagctcgtacaaagaaggagagttgatcacaattggggtcgccacctgggggacagtgcatagaagagaaggcctcatccaccccacaggatctttcccagctgagtatatcctcgatgaagatggccagggaaaccttacatgcttggatagtaatcacagtcacttcattctggtagacgacggtactcatgggcagtacggagtagagatcccactgaggacacgactggagaaattcatatccgaacagaccaaggagcgaggaggcgttgcgatcaagattcccatcgtctgtgtggtgctggaagggggtcccggcaccctgcacaccattgataatgctacaaccaatggtactccctgcgtcgtcgtggagggtagcgggcgcgtggccgatgtgattgcacaggtggcgaacctgcccgttagcgatatcactatctcactgatccagcagaagttgtctgtatttttccaagaaatgttcgagacttttactgagtcccgcattgttgagtggacaaaaaagatacaggacattgtgcgaagaagacagctgctgacagtatttagggagggaaaagatggccagcaggacgttgacgtagccattcttcaggccctgctcaaagcttccaggagtcaagaccacttcggccacgagaattgggaccaccagttaaagcttgccgtcgcctggaacagagtagacatagcccgcagcgaaatattcatggatgagtggcagtggaagccctcggacctgcatccaacaatgactgcggccctcatttccaacaagcctgaatttgtaaagttattcctggaaaatggtgtccagttgaaagagtttgtgacttgggatactttactctacctctacgagaacctggatcccagctgtctcttccatagcaaactccaaatgcatcacgtggcgcaggtcctaagggagctgctgggggatttcacacagccactttacccacgccccagacacaatgatcggctgcggttgctgctgcccgtcccccacgtgaaactcaatgtacagggcgtcagccttcgtagtctttacaaacggtcctcggggcacgtaaccttcaccatggacccgatacgcgatctcctgatttgggctatcgtgcagaaccgcagggagctggcaggtattatctgggcgcaaagccaggactgcattgccgcggctcttgcctgtagtaagatcctgaaagagctgagcaaagaggaggaagatacagacagctctgaggaaatgctggcactggctgaagaatatgagcaccgtgctatcggcgtgtttacagagtgctacaggaaggatgaggaacgtgcgcagaagctgctgacgagagtgtccgaagcctggggcaagaccacatgcctgcaacttgcgctcgaggcaaaagacatgaagttcgtgagtcatggaggaattcaggcctttttgacgaaggtgtggtggggacaactctcagtggataatggactatggcgggtcacgctttgcatgctggcgttccccctccttctgactggtctgatctctttccgcgagaaaagattacaagatgttggaactcccgcagcacgcgcacgggccttcttcactgcccctgtggtagtgttccatttgaatatcctgagttactttgcttttctttgcctgtttgcttatgtactgatggtggatttccagcccgttccaagctggtgcgagtgtgccatctacctgtggttgttttcactggtgtgtgaagaaatgcgccaattgttttacgaccctgacgaatgtggactcatgaagaaagcggccttgtatttctccgatttctggaataaattggacgttggcgccatcctcctgtttgtcgctggcctgacgtgtaggctaatccctgccacattatatcctggtcgcgtgatccttagcttggattttattttgttttgcctgcgcttgatgcatatctttacaataagtaagactctcggccccaaaatcatcattgtgaagagaatgatgaaggacgtctttttttttcttttccttctagcagtctgggtggtctcatttggtgtcgcaaaacaggctatcctgatccataatgagagacgcgttgattggctgttccgcggcgccgtgtatcacagttatctaacaatcttcggccagattcccgggtatatcgatggcgtgaacttcaatcctgaacattgtagccccaatggaacagatccgtataaacctaagtgtcctgaatctgatgcgacccaacagaggccggctttccctgagtggctcacagtgctgctcctttgtctgtatctgctgtttaccaacattcttctccttaatttactcattgcgatgtttaactacacttttcaacaggtgcaagagcacaccgaccagatatggaaatttcagcggcatgaccttatcgaggaataccatgggcgacccgctgcccccccccctttcattttactgtcacacctgcagttgttcataaaaagagtggtcctgaagacgcctgccaagaggcataagcagcttaagaacaagctggagaaaaacgaggaagccgcacttctgagttgggaaatttatctgaaggaaaattatctgcaaaacaggcaatttcagcagaagcagcgcccagaacaaaagatagaagatatttcaaataaggtcgacgctatggtagacctcctggatttggacccactgaagcggtcgggcagcatggaacagaggttggcatcactcgaggagcaggtcgcccagacagcccaggcacttcactggatagtcagaacacttcgggcatctggattcagctctgaagctgacgtgcccactctggccagccagaaggccgccgaggaacccgacgccgaaccaggaggtcgtaaaaagactgaggagccaggggacagttatcacgtcaacgccagacacctgttgtatcccaattgcccggtaactcgctttccagtccctaacgagaaagtgccctgggaaaccgagtttctgatttacgatccccccttttatacagctgagcgcaaggacgcagcagccatggacccaatgggcgagaaccctatgggtcggaccgggctcagaggccgaggatcgctgtcttgcttcgggccaaatcacactctttatccgatggtaactagatggagacgaaacgaggatggggccatatgcaggaagagcatcaaaaaaatgctggaagtgctggtggttaaattaccactgtcagaacattgggctctgcctggtgggagccgggagcccggggagatgttacccagaaaactcaaaagaatactccgccaggagcattggccatctttcgagaatctgctgaagtgcggcatggaggtgtataaaggctacatggacgacccacgtaacactgacaacgcatggatcgaaaccgtcgcggtgtctgtgcactttcaagaccaaaacgatgttgagcttaacagactgaactccaacttgcatgcctgcgattctggcgccagtatacggtggcaggtcgtggataggcgcatacctctgtacgccaaccataagacacttctccagaaagctgctgccgagtttggagcccattactag

SEQ ID NO: 209205 - DNA, 4512 bp, Artificial Sequence
  Description of Artificial Sequence: Synthetic coding sequence
atggagcccagcgccctgcggaaggccggcagcgagcaggaggagggctttgagggactaccaaggagggtaacagatctaggcatggtatccaatctccggagaagcaatagcagcctctttaaaagttggcgcctacaatgtccatttggaaataacgataagcaagagagtttgagcagctggataccagagaacatcaagaaaaaagaatgcgtgtatttcgtggagtcctctaagctgtcagacgctggcaaggtggtgtgtcagtgcggttacacacacgagcaacatctggaagaggccaccaaacctcacacttttcaggggactcaatgggaccccaagaagcatgttcaggagatgccgactgatgctttcggcgatatagtcttcacaggactgtctcagaaggttaaaaagtacgtgagagtaagccaggatacacctagttcagtgatctaccacttaatgacgcaacattgggggcttgatgtgccaaacctgctcatcagtgtaactgggggtgcgaaaaacttcaatatgaagcctcggctgaagtctatcttccgccgggggctcgtgaaagttgcccaaacaaccggggcttggataatcactggggggtctcataccggagtgatgaagcaggtgggggaagcagtccgggatttttcactcagttccagctacaaagagggggaactaattactatcggagttgccacctgggggacagtgcataggagggaaggcctgatccatcctacaggctcctttcctgcagagtatatcctggacgaagatgggcaggggaatctgacgtgtctggacagcaaccatagtcatttcatcttagtcgacgatggaacgcacgggcaatatggggtggagatcccactcaggacccgcttggaaaaatttatctccgaacaaacaaaggagcgtggcggggtggccattaagataccgatagtgtgcgtcgtgctcgaaggtgggcctggaaccttgcataccattgacaatgctactacgaacgggaccccatgcgtggtggtcgagggctccgggcgggtcgcggatgttatagcccaggtggcaaatctcccagttagcgacattacgatttccttgattcagcaaaaactgtcagtgttttttcaagaaatgtttgaaacgttcaccgagtcaagaatcgtggagtggactaagaagatacaagacatcgtccgacgccggcaactcttgaccgtgtttcgggaagggaaggatggacagcaggacgttgacgtcgccatactccaggccctcctaaaagcgtctagatcacaggaccacttcggtcacgaaaactgggaccaccaattaaagcttgccgtagcttggaaccgggtggatattgcccgtagcgaaatcttcatggacgaatggcagtggaagcccagcgatctgcatccaacaatgacggctgccttgatctcaaataaaccagaattcgtaaagctatttctggagaacggcgtccaactcaaggagtttgtgacatgggataccttgctttatctgtacgagaatctggatccgtcttgtctcttccattccaaactccagaaggtactggtagaggaccccgagaggccggcttgtgctccggctgctcctcgactacagatgcatcatgtcgcccaggttcttcgagaactgctcggagatttcacccagcccctatatccacggccaagacacaatgaccgacttcgactgctgttgccggtaccacacgtgaagctgaacgtccagggcgtcagccttcgcagtctttacaagcgtagctccggccacgttacctttactatggaccccatacgagatctattgatttgggccattgtgcagaaccgccgggaactagccggcatcatctgggctcaatcacaggattgcatcgctgctgccctagcatgctccaaaatcctaaaggaactctcaaaagaagaagaggataccgacagttccgaggagatgctggccctggcagaagaatacgaacatagggccatcggcgtctttaccgagtgttataggaaagatgaagaacgagctcagaagctgcttacacgcgtttctgaagcctggggtaaaacgacctgcttgcagctagccctggaagccaaggatatgaagttcgtttcccatggcggaatccaggctttcctgactaaagtgtggtggggccagctgtccgtggataacgggctgtggcgggtaaccttatgcatgctggctttcccgctgttgttgactgggttgatatcattccgggagaaacggctacaagatgttggaacccccgccgcgagagctcgagcattcttcaccgctcctgtagtcgtcttccatttaaatattctttcgtatttcgcttttctgtgcctgtttgcctacgttctgatggtggacttccagcctgtgccctcttggtgcgagtgcgctatttatctgtggctctttagccttgtatgcgaggaaatgcgccagctcttttatgaccccgacgagtgtggccttatgaagaaggctgctctttatttcagcgacttttggaacaaactcgatgtaggagctattcttcttttcgtggccggcttgacctgccggctgattccagccactctttatcccggccgcgttattctatccttggatttcatccttttttgcctacggctgatgcatatcttcacgatctctaagactcttgggcctaaaattatcatcgttaaaagaatgatgaaggatgtctttttcttcctgttcctgctcgctgtctgggtagttagttttggagtggccaagcaggcaattctgattcataatgagcgacgggtggactggttatttcgtggggctgtgtaccatagttatcttacaattttcgggcagatccctggatatatcgatggcgtgaactttaatcccgagcattgcagtcccaacggaacagacccctacaaacctaaatgtccagagtcagatgcaactcagcagcggcctgcgtttccggaatggctgacagtgttgttgttgtgcctgtacctcctctttactaatatcttactgctcaacctgctgattgctatgttcaactataccttccagcaggtccaggagcacacagaccaaatctggaagttccaaaggcatgacctcatcgaggagtaccatgggcgaccagcggcaccccccccattcatccttctgtcccatcttcaactgtttattaaacgagtggtcttgaagacgcccgctaaacggcacaaacaactgaagaataagcttgaaaaaaacgaggaagcagccctgttgagttgggaaatttacctgaaggagaactacctccagaaccggcaattccagcaaaagcagagaccagagcagaagatcgaggatatctctaataaagtcgacgcaatggtggatctgctggatctggaccccctgaaacggtcgggtagcatggagcaaaggctcgctagcctcgaagagcaggtggcccagactgcccaggccctgcactggattgtgcgcacacttagagctagcggattcagctcggaggccgatgtgccgaccttagcaagtcagaaagccgctgaagagcccgacgccgaaccggggggacgcaagaagacggaggaaccaggggacagttaccacgtgaacgctcgtcacctgctgtaccccaattgccccgtaactaggtttcccgttcccaacgagaaagtgccctgggaaaccgagtttcttatttacgatccccctttttatactgccgagcgtaaggacgccgctgccatggaccctatgggcgacacccttgagcctctttctaccatccagtacaacgtagtcgatggtctccgagacagaagatctttccacggcccctatacagttcaggccggcctgcctctgaaccctatggggcggactgggctgcgcggtagagggagcttatcctgttttggccccaaccatactctctaccctatggtcaccaggtggcgcaggaacgaggacggagctatatgtcgaaagtccattaaaaaaatgctagaggttctggtagtgaagctgcccttgtctgagcactgggcattacccggaggctctagggaaccgggcgagatgctgccccgcaagctgaaaaggatattacggcaggagcactggccctcctttgagaacttgctcaaatgcggcatggaggtgtataaaggatatatggatgatccgaggaacaccgacaacgcctggatcgaaacagtcgccgtgtctgttcacttccaggaccagaacgacgtggaactgaatcgcctgaacagtaacttacatgcatgcgactccggagcgagcatcaggtggcaggtggtcgatcgccggatccccctatatgcgaaccataaaactctccttcagaaggccgctgcggaatttggagctcactactag

SEQ ID NO: 209206 - DNA, 4512 bp, Artificial Sequence
  Description of Artificial Sequence: Synthetic coding sequence
atggagcccagcgccctgcggaaggccggcagcgagcaggaggagggcttcgaaggactcccaaggagggttaccgacttgggaatggtgtcaaacctccggcgcagtaatagctctctgtttaagagttggcggcttcagtgtccgtttggcaacaacgataagcaggagagccttagctcttggatccctgaaaatattaagaagaaggagtgcgtatattttgtggaatcttccaagctttcggacgcaggcaaagttgtgtgccagtgtggttatactcatgagcagcacctcgaagaagccacaaagccccatacattccagggaactcagtgggatcccaagaagcatgtccaagaaatgcctaccgatgccttcggtgatattgtgttcaccggcctcagccagaaagtaaaaaagtatgtaagagtctctcaggacaccccatcctctgtgatttaccacctcatgactcagcattggggccttgacgtgccaaatctgctgatttccgtcactgggggggctaaaaattttaatatgaaaccccgcttgaagtcaatcttccggcgtgggttggtaaaagtggctcagacaacaggggcctggattattacgggcgggagtcacaccggggtcatgaagcaggtgggcgaggctgtgcgggacttttctctgtcgtctagctataaagagggggagctgataacgattggtgtggcaacctggggaactgtgcaccggagagaaggactcatccaccctaccgggagtttccctgctgaatacatcctggacgaagatgggcagggaaatttgacatgtctcgactctaatcactctcactttatcttagttgatgacggtacccacggacagtatggcgtagagattccacttcggaccagactggagaagtttatttctgagcaaactaaggagcgggggggggttgccatcaagattccaatcgtatgcgtagtactcgagggtggccctggaactctgcatactattgataacgcaactaccaacgggaccccatgcgtggttgtggaagggtctgggagggtggcagatgtaatagctcaggtcgcaaacctcccagtgagcgatattacgattagcctcatccagcagaaattgagtgtcttcttccaggagatgtttgaaacctttacagagagtaggattgtagagtggacaaaaaaaatccaggatatcgttagacggaggcagctactgaccgtgttcagagagggtaaggatgggcagcaggacgtggacgtggcaattctccaggcacttttgaaagcttcacgatcccaggaccacttcggtcatgagaattgggaccatcaactaaaactggcagtcgcctggaacagggtcgacattgctagaagcgaaatattcatggacgagtggcaatggaaacctagcgatcttcacccgactatgaccgcagctctaatctctaacaaacccgagtttgtgaaactcttcctggagaacggcgtgcagctgaaggagttcgtgacttgggatacactgctctatctgtacgaaaatctggatccctcttgcctgtttcacagtaagcttcagaaagtcctcgtcgaggaccctgagcggccagcttgcgccccggcggcccctaggctgcagatgcatcatgtcgcgcaagttctccgggaattgctcggggattttacccagcccctctatccacggccgaggcacaatgatcgtctacgccttctcctgcccgtccctcacgtgaaattgaatgtgcagggagtctctctcagatctctgtataagcggagctctgggcacgtgacgttcaccatggaccccatcagagatctattaatctgggctatagttcagaaccgccgggagttagccggaattatttgggcccagtcccaagactgcatcgccgccgcgctcgcctgctctaaaattcttaaagaattatccaaggaagaagaggacactgacagcagcgaggaaatgctagctttggcagaagagtatgaacatcgcgccatcggagtttttactgaatgttaccgtaaagatgaggagcgagcacaaaaattactcactagggtgtctgaagcatgggggaaaactacgtgtttacagctagctctggaggccaaagacatgaagtttgtcagccatggcggcatccaggcttttttaactaaggtctggtggggacagctttcagtcgataacggcctgtggagagtaacattatgtatgcttgcttttcctcttctgttgaccgggctgattagctttcgtgaaaagcgattgcaggacgtgggaaccccagctgcccgagccagagctttctttacggcacccgtggtagttttccaccttaatatcctgagctattttgccttcctttgtctgtttgcttatgtgctaatggtcgatttccagccggtccccagctggtgcgaatgcgcaatatatctctggctgttttcactggtttgtgaagagatgagacagttgttctatgatccggacgagtgcggtttaatgaaaaaagctgccctttacttttccgatttctggaataaactggacgtgggtgctattctgctgtttgtggctggattgacctgccggctgattcctgcaacactctacccgggtagagttatcttgtctctggacttcatcctgttctgtttaaggctgatgcacatcttcaccattagtaagacattgggcccaaaaatcattatcgtcaaaaggatgatgaaagacgtgttttttttcctgttcctcctggccgtgtgggttgtaagcttcggagttgccaaacaggccattttgattcataatgaacggagagtcgactggttattcagaggggccgtgtatcacagttacttgacaatatttggacagattcccggctatatcgacggcgtgaattttaacccagaacattgttccccgaacggcacagacccttataaacccaagtgtcccgaatcggacgctacacagcagagacccgcctttccagagtggctaacagtcctgctgctgtgcctgtacctcttatttaccaatatcttgctgctgaatctgctgatcgcaatgtttaactacacatttcagcaagtacaggagcacaccgaccaaatttggaagttccaaaggcatgacctcatcgaagaataccatggaagaccggcggccccgccaccattcatcctgctctcccacctgcagttgtttataaagagagttgtgctgaagactcctgcaaaacgccacaagcagctgaaaaacaagctagagaaaaacgaggaggctgctctactatcttgggaaatctacttgaaagaaaactaccttcagaatcgacaattccagcaaaagcagaggccggaacaaaagatagaggacatttcaaataaagtggatgctatggtcgatctgctcgacctcgaccctctgaagcgatccggctcaatggagcagaggttggccagcttagaagagcaggtcgcccaaaccgcccaggctctgcattggattgtgaggacgttgagggcatccggtttttccagcgaggcagacgtgccaacactggctagccagaaagccgcagaagaacctgatgcggagcctggaggaaggaagaaaactgaggagcctggcgatagttaccatgtaaacgcaagacatctgctgtaccctaattgccctgtgactcgattcccggttccaaatgaaaaggttccctgggaaacggaattcttgatctacgacccacctttttacacagccgaacggaaggacgcagcagctatggacccaatgggggatacactggaacccttatccacaatccagtacaatgtcgtggacggcctgcgggaccggcgatcctttcatggaccctacactgttcaggccggactacccctgaaccctatggggaggacaggactaagaggcagggggtcactgtcgtgtttcggccccaaccatacgctttatcctatggtgactagatggcgcaggaacgaggatggggctatttgtcgcaaatctatcaaaaaaatgctagaggtgttagttgtaaagctgcccctctcagagcactgggctcttcctggtgggagccgcgagcctggcgagatgctgcctcggaaactgaaacggatcctgaggcaagagcactggccaagcttcgagaatttactaaagtgcgggatggaggtttacaaagggtacatggacgacccccgcaataccgacaacgcatggatcgagaccgtggccgtgtccgtgcactttcaggaccagaacgatgttgagttgaaccgcctgaacagcaatttgcatgcctgtgattcgggtgcttctattagatggcaggtggtagatcgcagaattcccctgtatgctaaccacaaaactttgctccagaaggccgcggccgaattcggtgcccattattag

SEQ ID NO: 209207 - DNA, 435 bp, Artificial Sequence
  Description of Artificial Sequence: Synthetic coding sequence
atggagcccagcgccctgcggaaggccggcagcgagcaggaggaggggtttgagggactcccaagacgggttacagatctcgggatggtgagcaacctgaggcgatccaacagttcactgtttaagtcctggagactccaatgcccctttgggaataatgataaacaggagtcactgagctcctggattcctgaaaatatcaagaagaaggagtgcgtgtacttcgtggaaagctctaagttaagcgacgccggcaaggtggtgtgtcaatgcggctacactcacgagcagcatctggaagaagccactaagccgcatacattccagggaacccagtgggatcccaaaaaacatgtccaggaaatgccgacagacgctttcggtgacattgttttcacagggctgtcccagaaagtgaaaaagtatgttagatag

SEQ ID NO: 209208 - DNA, 744 bp, Artificial Sequence
  Description of Artificial Sequence: Synthetic coding sequence
atgctgagccgggagcaggaggaggacggcggcgccggccggcagtaccacgtcaacgccaggcacttgctttatccaaattgcccagtaaccagattccccgttccaaacgagaaggtgccttgggaaacagagttcttgatctatgaccctccattctacaccgccgagcgcaaggatgctgccgcaatggacccgatgggcgaaaatccaatgggaagaaccggtttgagaggcagaggttccctcagttgcttcggacccaatcataccttatatcccatggtaacaaggtggcggcggaatgaggacggagctatttgtcgcaaaagcatcaaaaaaatgcttgaggtccttgtcgtgaaattgcctttgtccgaacactgggctctgcccggggggtctcgagagcccggagagatgttgccgcggaagctcaagaggatcctgcggcaggagcactggccatctttcgaaaacctgctcaagtgcgggatggaagtgtacaaaggatatatggatgatccccggaacacagacaacgcttggatcgaaactgtggcagtgagcgtgcatttccaagaccagaatgacgtggaactcaaccgacttaactctaatcttcatgcctgtgattctggcgcttcgataaggtggcaggtggtggacagacgaattcccctttacgccaatcacaaaacgttattacagaaggccgccgccgagtttggcgcccattactag

SEQ ID NO: 209209 - DNA, 5136 bp, Artificial Sequence
  Description of Artificial Sequence: Synthetic coding sequence
atgggcaagaagtggcgggacgccgccgagatggagcggggctgctccgatcgggaggataatgccgaatcccgccggcgcagtcgctcggcatcccgggggagatttgccgagagctggaagaggttgtcgagtaagcaagggagtactaagagatccggactccctagtcagcagacccccgctcagaagagttggatcgagagggccttttataagcgagaatgcgtgcacatcattccatccaccaaggacccacatcgctgttgttgcggacggctgatcggacagcacgttggattgacgccaagtataagtgtactgcagaacgagaagaatgagagccggctgtcaaggaacgatattcagtccgaaaagtggtctatctcaaagcatacccagctaagcccaaccgatgcttttggaacaatagagttccagggcggcggccacagcaacaaggctatgtacgtacgcgtaagctttgacacaaaacccgacctgctactgcacctcatgacaaaagaatggcagctggagctgcccaaactactgattagcgtgcatggcggtctgcagaacttcgaactccagcctaagttaaaacaagtctttggcaaaggtctgattaaggcggcaatgaccactggcgcctggatcttcacgggaggagttaacactggagtcatcaggcacgtgggggacgccctgaaagatcatgcatcaaagtcccgtggcaagatctgcacaattggcatagctccttggggcatcgtggagaatcaagaggatctcatcggcagggatgttgtacgaccctatcaaacaatgagcaatccaatgtccaaactaactgtgctgaattctatgcatagtcattttatcctagctgacaatggcaccacaggaaagtacggggcagaagttaaactaagacgacagcttgagaaacatatctccctgcaaaagatcaatactcggatcggccaaggagttccggttgtggcactgatcgtagagggcggaccaaacgtcatcagcattgtattagagtatctccgggatactccacctgtgccagtcgtggtttgcgacggcagcggccgtgctagcgacatactggctttcggccacaagtactccgaggaaggaggactcatcaacgagtctcttcgggaccagctgttggtcaccatacaaaagacctttacatacaccagaacccaagctcagcacctgtttataatcctaatggagtgtatgaaaaaaaaggagctgattacggtgttcagaatggggtcagagggacatcaggatatcgacctagccatcttgaccgccctccttaagggagcaaacgcttccgctcccgaccagctctcattggccctggcttggaaccgtgtggacatagctcggagccagatttttatatacggtcaacaatggcccgtgggtagcctcgagcaggcgatgctcgatgcgctggtccttgaccgggttgactttgttaagttgctgatagagaatggagtcagcatgcacagatttctgaccatctcacgtctcgaggaattatataacacaaggcacgggccctcaaacactctttaccaccttgtgagggacgtgaaaaagcgagagtatcccggatttgggtggatctattttaaagggaatctccccccagactatcgaatctccctgattgatattggactagtcatcgagtacctcatgggcggagcataccggtgtaactatacccgcaaacgcttcaggaccctttaccacaacctattcggccccaagagggacgacatacctctgcgtcgcggacgcaagactactaagaaacgtgaggaagaggttgatattgacctcgatgatcctgaaatcaatcatttcccttttcctttccatgaactcatggtctgggcagtactcatgaagaggcaaaagatggcactgttcttctggcaacatggcgaggaggcaatggccaaggcccttgtggcgtgtaagctatgtaaggcaatggctcacgaggcgagcgagaatgacatggtagacgacattagtcaggagttgaaccacaactcccgggatttcggccagctcgctgtggagctgctggaccagtcatataaacaggacgaacagctggctatgaaactgctcacttatgagctcaagaattggtccaatgcaacttgtctgcagctcgccgtggctgctaaacacagagatttcatagcacatacctgcagccaaatgttgctaaccgacatgtggatggggcggctccgtatgagaaaaaatagcggcctgaaagttatcctgggcatcctgctgccaccttcaattttgtccttagagtttaaaaacaaagatgacatgccttatatgagccaggctcaagagattcaccttcaggagaaggaggcagaggagccagagaagccgactaaagaaaaggaagaggaggacatggagctgacagctatgctgggacggaataacggggagtcctcacgaaagaaggatgaagaggaagttcaatccaagcaccgcctgatccctctcggacgcaaaatctatgaattctataacgcacctatcgttaagttttggttctacacactggcatatattgggtatctcatgctgtttaactacattgtcctggtcaagatggagcggtggccctcaactcaggaatggatcgtcatctcatacatcttcaccttgggaattgagaaaatgagggagatactgatgtctgaaccgggtaaattgttacagaaggtaaaagtgtggctccaggaatactggaacgtgacagatctcattgccatactactctttagcgtcggaatgatcctgcggctgcaggaccaacccttccggtctgatgggcgcgtgatttattgtgtcaacatcatctactggtacatccgactgcttgacatcttcggcgtaaacaaatatttaggaccatatgtgatgatgattggaaagatgatgatcgatatgatgtacttcgttataataatgcttgttgtgctgatgtccttcggggtcgctagacaggcaatcctttttccgaatgaagagccttcctggaagcttgcaaagaacatcttttacatgccttactggatgatttacggcgaggtgtttgcggaccagatcgacccgccttgtggacagaacgagaccagagaggacggcaagatcattcagcttcctccatgcaaaaccggcgcctggatcgtacctgcgattatggcatgctatctgctcgttgcaaacatccttctggttaacctgttaatcgctgtgtttaataacacatttttcgaggtcaagagcatttctaatcaagtctggaagtttcagcgctaccaactgattatgacctttcatgagcggcccgtattacccccaccgctgatcatattctcccacatgacaatgatcttccagcacctgtgttgccgctggcgcaaacatgagtccgatcccgacgagcgggattacggtttgaaactcttcatcacagatgacgagctgaagaaggtccatgactttgaagagcaatgcatcgaggagtactttcgcgaaaaggacgaccgatttaactcctccaacgatgagaggattcgggtgacctcagagcgcgtagaaaacatgtcaatgagactggaggaggtcaacgagagagagcactccatgaaagcaagcctgcagaccgtagacatccgtctcgcccagctggaagacctgatcgggagaatggccaccgccctggaaagactcactggactcgaaagagctgaaagtaataagattcggtcaagaacgtccagcgactgtacagacgctgcgtacatcgtgcgacagtcctcctttaattcccaggagggcaacacatttaaactgcaggagagtatagatcccgccggggaagagaccatgagcccgacgagcccaactctcatgccacgcatgagatcgcactctttttattccgtcaacatgaaagataaagggggaatcgaaaaactggagagtatcttcaaggaaagatcactaagtctgcatagggctacctcttctcattctgtggcaaaagaacccaaagcgcctgctgctcccgcaaataccctagctattgtgccggactctcgcaggccgtcttcgtgtattgacatttacgtgtctgcaatggatgagctgcattgcgacattgatcccctagacaatagtgtgaatatcctagggctgggagagccatccttcagtacccctgtaccgtccacggctcctagttcctccgcctacgctacgctcgctccaactgatcgaccaccctcccgaagtatagactttgaggatattacgtccatggatacgcgctcttttagcagcgattatacacacctacccgaatgtcagaatccgtgggacagcgaacctcctatgtaccacactattgagagatccaagtcctcacgctatctagctacaacgcccttcctgctggaagaggcccctatagttaagtcccattccttcatgttcagcccgtctcggtcgtactacgcgaactttggggtgcccgtgaagactgctgagtataccagcatcacagactgtattgacacaaggtgcgtgaatgccccgcaggcgatcgcagatcgcgctgccttcccgggcggtctcggtgacaaagtcgaggacctaacgtgctgccatccggaaagagaggctgagctgtctcacccgtcgagcgacagtgaagagaacgaggcgaaaggtcggcgggctacaattgccatcagttctcaggagggggacaattctgagcgaacattgtctaataatattacagtgccaaaaatagagagagcaaactcttattccgctgaagaacctagcgccccctatgcacacactagaaaatcattcagtatcagtgacaagttggatcggcagcgaaataccgcgtcactgcgcaatccattccagagaagcaagtcttccaagcccgaagggcgaggcgactctctgtccatgaggcgtctgtcccggaccagtgcctttcaatctttcgaaagcaaacataattag

SEQ ID NO: 209210 - DNA, 4710 bp, Artificial Sequence
  Description of Artificial Sequence: Synthetic coding sequence
atgtacgtgcgggtgagcttcgacaccaagcccgacctgctgctgcacctcatgacaaaggagtggcagctggagcttccgaagctcctgatctccgtccatggcgggctccagaattttgagctacagcctaagctgaaacaggtatttggaaaggggctaataaaggccgctatgacaactggcgcctggattttcacaggaggcgtcaacacaggagtcatcagacatgtcggagacgccttaaaagatcacgctagtaagagtcgagggaagatttgcactataggcattgctccgtggggcatcgttgagaatcaggaggacctgataggccgcgatgtggttcggccgtaccagactatgtcaaatcccatgtctaaactgacggtgcttaacagcatgcactcacattttatccttgcagacaatggcacaaccggtaaatacggtgccgaggtgaagctccgccgtcaactggaaaagcatatctcactgcagaagataaataccagatgccttccattcttcagcctggactccaggctgttttacagcttctgggggtcttgtcagctggactctgtcggcatcgggcaaggcgtgcctgtggtggccctgatagtagagggcggacccaatgtaatatcaatcgtattggaatatctccgggatacaccaccggttcccgtcgtagtttgtgacgggagcggtagagctagtgatatcttggcattcggccataagtactcagaagagggaggtctgattaatgagtccctgcgagaccagctcttggtgactatccaaaagacttttacctatactcgcacacaggcccaacatctgttcattattctgatggagtgtatgaaaaaaaaggaactgattacagtctttaggatgggcagtgaagggcaccaagatattgacctagccatcctgactgctttattgaaaggagcaaacgcaagtgccccagaccaactgtctcttgccttggcctggaatcgggttgatatcgccagatctcagatctttatttacggccaacagtggccagtaggatccctggaacaggctatgttagatgcattggtgctggatagagtagatttcgtaaagttgcttatagagaatggcgtatctatgcaccgcttcttgactatcagccgtttggaggaactgtacaacacccggcatggtcccagtaacacactctaccatttggtgcgcgacgttaagaaaggaaacctgcccccagactaccgcatctccttgatcgatatcggcttagtgattgaatacttgatgggaggcgcatatagatgtaactatactcggaagagattcaggactttgtaccacaacctgttcggcccaaaacgggatgacattcctctccggcgaggccggaagactactaagaagcgggaggaggaagtggatattgatttggatgaccctgagattaatcattttcctttcccattccacgaactcatggtttgggcagtactgatgaagcgccagaaaatggctttgttcttttggcaacacggagaggaggccatggcaaaggcattagtggcctgcaagctgtgtaaagctatggctcacgaggcatcggagaatgatatggtggacgacatctcgcaggaactgaatcataattcccgggactttggtcagctggcagtggaactgctggatcagtcctataaacaggatgagcagctggctatgaaactactcacctatgagctaaaaaattggtcaaacgccacctgcctgcagctggcggtggccgcgaaacaccgggacttcattgctcacacctgctcccagatgctgctcacagacatgtggatgggcaggctcaggatgagaaaaaattccggactgaaggtgattctaggcatactgctgcctcctagcatcctttcactggagttcaagaacaaggatgacatgccttacatgtctcaggcccaggaaatccacctgcaggagaaggaggccgaggagcccgaaaagcccacaaaggagaaagaggaggaggacatggagctaaccgcaatgttggggaggaacaacggggagagcagtagaaagaaggatgaggaggaagttcagtccaagcacaggttaattccgctgggccgaaaaatatacgagttttacaatgctccgattgttaagttctggttctatactctggcttatattggctacctcatgctctttaactatatcgtgcttgtcaagatggagcgctggccaagcacacaggagtggattgtcatcagctatattttcaccttgggcatcgaaaagatgcgcgaaatcttgatgagtgagcctggcaaactgctccagaaagtaaaagtgtggctccaggaatattggaacgttaccgatctcatcgccatcttgctcttttccgtcggtatgatcctgcggctacaggaccaaccctttcgtagtgacggccgagttatctattgcgttaatattatttactggtatataaggcttcttgacatattcggagtcaacaaatacctgggcccatatgtgatgatgatcggcaaaatgatgattgacatgatgtattttgttattatcatgctagtagtccttatgagcttcggagtagccagacaggctattctgttcccgaacgaggagccatcctggaagctggcgaagaacattttttatatgccctactggatgatctacggagaagtgttcgcggatcagattgaccctccatgtggccagaatgagactcgtgaggacgggaaaatcatccaacttccaccgtgcaagactggcgcgtggattgttccagcaatcatggcatgctacctgctggtcgccaatattcttctggtcaatcttctcattgccgtgtttaataacactttctttgaggtcaagagtatttccaatcaagtgtggaagttccagcgctaccagctgataatgaccttccacgaaaggcctgtcctcccacctcctttaattatttttagccatatgacaatgattttccagcacttatgttgtcgctggagaaagcatgaatctgacccagatgaacgggattacggtctgaaactgttcataacggacgatgagcttaagaaggttcatgacttcgaggagcagtgtattgaggagtatttccgcgagaaagacgataggtttaactccagtaatgacgaacgaatccgcgtgacctctgagagggtcgaaaacatgtccatgaggctggaggaggtgaacgagcgtgaacattcaatgaaggcctctctccagactgtggacattcgtctggctcagctcgaggatttgattggtcgtatggccacagcgctggagcggctgactggtttagagagagctgaaagcaataaaatccgtagtagaactagctcagattgtactgacgccgcctatatagttcgacagtcctctttcaactcgcaagaaggaaacacattcaagctgcaggagtccatcgaccctgctggggaggaaacaatgagtcctaccagccccactttaatgcctcgcatgcgctcccactccttttacagtgttaacatgaaggacaaaggcgggattgagaaactggagtccatctttaaggaacgttcattgtctctgcacagagctacctcttcccattcagttgcgaaggagcctaaggctcccgcagctcctgccaacacattggccatcgtgcccgactctagacgaccgtcttcatgcatagacatctacgtgtctgctatggatgagctgcactgcgatatcgatccgctagacaacagcgtaaacattctggggctgggggagccaagcttcagcacccctgtgccaagtaccgctccctcatcttctgcctacgccacgcttgctcccactgacagaccacctagccgttcgatcgattttgaggacatcacatctatggacactaggtcattcagtagcgattacacacacctgcccgaatgtcaaaacccatgggactcagaacccccaatgtaccatactatcgagaggtccaaaagttcacggtacctggctaccaccccattcctgctagaggaggcaccaattgtgaaatcccactcttttatgttctctccatcacgtagctattacgctaacttcggggtgcctgtgaaaacagctgaatatactagtataaccgactgtattgacacccggtgcgtgaacgcgccacaggcaattgctgatagggcagcctttccaggtggcctcggagataaggttgaggaccttacctgctgccaccccgaaagggaggcagagctgtcccatcctagttcggatagcgaagaaaatgaggcaaaaggccggcgtgccaccatcgccatcagttctcaagagggcgataattcagaaagaacgctctctaacaatatcaccgtgccgaagatcgaaagagctaacagttattcggcagaagagcccagtgctccatatgcacatactagaaaatcattctcaatctccgacaagctcgacaggcaacggaataccgcgagcttgagaaacccgttccaacgatctaaaagctcaaaacctgaggggcggggggacagtctctcaatgcgcagactcagcaggaccagcgcattccagtcctttgagtcaaaacacaactag

SEQ ID NO: 209211 - DNA, 4710 bp, Artificial Sequence
  Description of Artificial Sequence: Synthetic coding sequence
atgtacgtgcgggtgagcttcgacaccaagcccgacctgctgctgcatttgatgactaaagaatggcaacttgaacttcctaagcttctgatcagcgtgcatgggggtctgcagaacttcgagctccagcctaagctcaaacaagtcttcggcaaaggcttgattaaggccgccatgaccaccggggcctggatctttactggaggggtcaacacgggtgtcattcgtcacgttggcgacgccttgaaggaccatgcatccaagagccgcggaaagatctgcactatcggtattgctccttggggtattgtcgagaatcaggaggacctgatcggccgggacgtcgtgcgcccgtaccagacaatgagcaacccaatgtctaaactgaccgtgctgaatagtatgcactctcactttattctggcagataacggtactactgggaagtatggtgcagaggtgaaactccgacggcaacttgaaaaacatatatctcttcagaagatcaacaccagatgcttgcccttcttttctttggattccaggttattctacagtttctggggaagctgtcagctcgatagtgtcggaatcggtcagggagtgcccgtggttgccctgatcgttgaggggggacccaatgtgatttccatcgtactagaatacctgcgcgacacgccaccagtaccagtcgttgtgtgcgacgggtccgggagagcttcagatattctggcgttcggtcataagtactcagaggagggcggtctaattaacgagagcctcagagaccaactgcttgtgaccatacagaaaacattcacctatacaaggacccaggcacagcaccttttcatcatactgatggagtgtatgaagaagaaggaattgataactgtgtttcgtatggggtctgagggtcaccaggacatagacctggctatcctcaccgccctgttaaagggggcaaatgcctcagcacctgaccagctgtctctcgctctcgcttggaatcgcgtagacattgcgcgtagtcagattttcatatacggacagcagtggcctgtggggtcccttgagcaggcaatgctagatgcgctggtgctggaccgagtggatttcgtgaagctcttgatcgagaacggagtctccatgcataggtttttgaccatcagccgcctggaggagctctataacacacgccacggccctagtaatacactgtatcaccttgtgagggacgttaaaaaaggaaacctaccgcctgactacagaatcagcctgatagatattggtctggtcattgagtacctgatgggtggagcctatcggtgtaactatacaaggaaacgatttcgcactctatatcacaatctcttcggaccgaagcgggatgatatccctcttcggagaggcaggaagaccacgaagaagcgcgaggaagaggttgatattgacctagacgacccagagattaaccactttccatttccctttcatgagttaatggtatgggcagttttgatgaaacggcaaaagatggctttattcttctggcagcatggggaggaggccatggcaaaggctctggtcgcatgcaagctctgcaaggccatggcacatgaggcatctgagaacgacatggtggatgatatcagtcaggagctcaaccataattcacgcgactttggccagctggccgtggagttgctggatcagtcgtacaagcaagacgagcagttggccatgaagctattgacctacgaactgaaaaattggtctaatgctacttgtctgcagttggcagtggcagccaagcatagagacttcattgctcatacttgttcccagatgctgttgaccgacatgtggatgggccgtctacggatgagaaaaaacagcggactaaaggtgattctaggtatactgttgcccccctctattttatcactggaattcaagaacaaggatgatatgccgtacatgtctcaggctcaggaaatccacctgcaggaaaaggaagccgaagagccagagaaacctaccaaggagaaggaagaagaagatatggaactgactgccatgctgggccgcaacaacggcgaatcctccagaaagaaggatgaagaggaggtgcaatcgaaacaccgcttgatccccctgggacgcaagatttacgagttctataacgctccaattgttaagttctggttctatacgctggcctacatcggatatctcatgctttttaactacatcgtgttagtaaaaatggagcggtggcctagcactcaagaatggatcgttatttcatatattttcacccttggcatagagaagatgcgggaaattctaatgtccgagccaggcaagctgctccagaaggttaaggtgtggcttcaggagtattggaacgtaacagatttaatagctatcctcttgttctcagtcgggatgattctgagactgcaggaccaacccttcaggtcagatggtagagtcatctattgcgtgaacattatttactggtatattagacttctcgatatttttggagtaaacaagtacctcggtccttatgttatgatgattggcaaaatgatgatcgatatgatgtatttcgtgattatcatgctggtagtgttaatgagtttcggggtggcaaggcaagccattctgtttccaaacgaggaaccaagctggaagttggcgaaaaatatattttatatgccctactggatgatttatggtgaagtgtttgccgaccagatagatcctccctgcggccaaaatgagacacgagaggacggtaagattatccagctcccaccttgcaaaacaggcgcttggatcgtccctgccattatggcctgctaccttcttgttgcaaacatcctattggtgaacttactgatcgctgtcttcaataataccttttttgaagtcaaatctatctccaaccaggtgtggaagtttcagagataccagctcatcatgaccttccatgagaggccggttctcccacctcctctgattatcttcagtcatatgactatgatatttcaacatctctgttgtaggtggcgtaagcacgaaagcgaccccgacgaaagagattatggcctgaaactgtttattacggatgacgagctgaagaaagtgcatgatttcgaggagcagtgcatcgaggagtactttcgcgagaaggatgaccgcttcaattcatcaaatgatgaacgtattagggtgacatcagagcgggtggagaatatgagtatgcgcctcgaagaagttaatgagagggaacatagcatgaaggcatcactgcaaacagtggacatacggctggctcagctggaggacctcatcggcagaatggctactgcactggaacggttgacaggactggagcgcgcagagtcaaataagatacgaagtagaacttccagtgactgcactgatgctgcgtacattgtgcgccagtcctcctttaattcccaggaaggcaatacctttaagctgcaggagagtatcgaccctgcaggtgaagagacaatgtccccgacctctcctacattaatgcctcggatgaggtcccactctttctattcagtcaatatgaaggataagggcgggatcgagaagctagagtccatcttcaaggagcgcagcctctcactgcatagagctacctccagccattccgtggccaaagagcccaaagcaccggccgccccggccaacaccctcgccatagtcccggactcgcggcgccccagcagctgcattgatatctatgtgtcagcaatggacgaactgcactgtgatatcgatcccctcgataacagtgtcaacatcctcggcctgggcgaacccagcttttccacacctgtcccgagcacagccccctccagcagtgcctacgctaccctcgctccaactgatcgcccaccctccagatctatcgacttcgaggatatcacgtccatggatactcggtctttttcctctgactacacccacttacccgaatgtcagaacccctgggatagcgagcctccgatgtaccatactattgagcgcagcaaatccagccgctacctggctactacaccctttctgctggaagaggctcctatcgtaaaatcacactcattcatgttttccccaagccgctcatactatgcgaactttggggttccagtcaagacagcagagtacaccagcatcacagactgtatcgacacacggtgtgtgaatgccccacaggctattgccgacagggcggcttttcccggcggtctcggcgacaaggttgaggacctgacatgctgtcacccagagcgggaggcagagctgtctcatcctagctctgatagcgaggaaaatgaagccaaggggagaagggcaactattgccatttcatctcaggagggagacaactctgagagaaccctttctaataacataactgtgcctaagatcgagcgtgccaattcctatagtgccgaggagccaagcgccccatacgcacatacaagaaagagcttttctattagcgataagctggacaggcagcgtaatacagcaagtctgcggaaccctttccagagatctaagtcctcaaagcccgagggcaggggggattcgttgtccatgagacgcctaagtagaacatctgcctttcagtctttcgaaagcaagcacaattag

SEQ ID NO: 209212 - DNA, 4701 bp, Artificial Sequence
  Description of Artificial Sequence: Synthetic coding sequence
atgtacgtgcgggtgagcttcgacaccaagcccgacctgctgctgcatctgatgaccaaggaatggcaactggagttaccgaaactattaatctcggttcacggaggtctacagaattttgagctgcagcctaaattaaagcaagtgtttggcaaaggccttattaaagccgcaatgaccactggggcttggatcttcacaggaggggtaaacaccggcgtgattaggcacgtcggggatgcactgaaggatcacgcatcaaagagccgtggcaaaatctgtacgatcggaatcgcgccttggggtattgtagagaatcaggaggatctcattggccgggacgtcgtgaggccctatcagactatgtctaaccccatgtctaaactgacggtccttaactcaatgcacagtcattttatactggcggataatgggaccacaggaaagtatggagctgaggtgaaactcagaaggcagctggagaaacacattagcctgcagaagatcaacacccgtattggccagggggtgcccgtggtggcgttgatcgttgagggggggcccaatgtaatcagcatcgtgcttgagtacttgcgcgacacacccccagtcccggtggtggtgtgcgatggctccgggagggcatccgacatcttagcctttggtcacaagtatagcgaggagggtggccttatcaacgagagtctgcgcgatcagctactggtgaccattcagaagacttttacatatactcgtacccaggcccagcacctgtttattattttgatggaatgtatgaaaaagaaggagctgatcactgtcttccgcatgggaagcgaaggccaccaggatattgatctggcaatactgacagctctgctgaaaggagcaaacgcctcagcccccgatcagttgtccctagctctggcttggaaccgtgttgatatcgcccgcagccagatctttatctatggacaacaatggccagtcgggtccctagagcaggccatgctagatgctctcgtgcttgaccgggttgactttgtgaagctgctcattgagaacggcgtatcgatgcacagatttctgactatttctcggcttgaggaattgtataacacaaggcacgggccttctaatactctgtatcacctagtgcgggacgtgaaaaagcgcgagtaccccggattcggctggatttactttaaagggaacctgccaccagattatcggatcagcctgatcgatatcggactggtgatcgaatacttaatgggaggggcatatcggtgtaactatacccggaagagattccgcaccttgtatcacaacttgtttggacccaaaagaccaaaggccttaaagttgctggggatggaggacgacatccctctgagacgcggtagaaaaaccacaaagaaacgagaggaagaggttgacattgacttagacgaccctgaaattaaccattttccattccctttccatgagttgatggtctgggcagttttgatgaagcggcagaagatggccctgttcttctggcaacacggcgaggaagcgatggctaaagcgctagtagcctgtaagctgtgcaaggcaatggcacacgaggcatccgagaatgacatggttgacgacattagccaggagctgaaccacaattcccgggattttggtcagctcgccgtcgaactcttggaccagtcatataagcaggatgaacaactcgctatgaagctactaacatatgaattaaaaaattggagcaatgctacatgcctgcaattggctgtggctgccaaacaccgggactttatcgctcacacctgctctcagatgctgctgacggacatgtggatgggtcgcttgaggatgcgcaaaaattcgggcttgaaggtcatcctgggaattttgctcccaccttctatactgagcctagaatttaagaataaggatgatatgccgtacatgagtcaggcacaggagattcacctccaggagaaggaagcggaagagcccgagaaaccaactaaggagaaggaagaggaggacatggaactgacggccatgctgggaagaaataacggtgagtcatccagaaaaaaagacgaagaggaggtgcagtccaaacacagactgatacctcttggccgtaagatctacgaattctataacgcacccattgttaaattttggttctacaccctggcttacattgggtacttgatgctttttaattatatcgtgttggtcaagatggagagatggccctctacacaggaatggattgtaattagctatatcttcacactcggcatcgagaagatgagagaaattctcatgtcagaacccggcaagctactccagaaggttaaggtgtggctccaggagtattggaatgtcaccgatctcattgccatcctgcttttttctgtgggcatgatcctgcgcctacaggaccaaccctttcgctccgatggcagggttatttattgtgttaatataatttactggtatatccgtcttctggacatttttggcgtgaataagtatctgggaccatacgtgatgatgattggcaagatgatgatagatatgatgtacttcgtgatcatcatgttggttgtcctgatgagctttggcgtcgctcgacaggccatcctgttccccaatgaagaacctagctggaaacttgcaaaaaatatcttctatatgccctattggatgatctatggcgaggtgtttgctgatcagatcgatccgccttgcggccagaatgaaactagggaggatggtaagattatacaactgcctccttgtaaaacgggcgcatggatcgttccagccatcatggcctgctatttactagtggctaacatcctcctcgtgaatctactaatcgccgtcttcaataataccttcttcgaggtcaagtccattagcaaccaggtgtggaaatttcagaggtaccagctcatcatgacattccatgagcgacctgtgcttccccctccgctgatcatattctcccacatgaccatgatcttccagcacctctgctgtcgatggcgcaagcacgagtccgacccagacgagagggattacggtttaaagctcttcatcactgatgatgagctaaaaaaagtacatgattttgaggaacagtgtattgaggaatactttagagaaaaggacgacaggtttaatagcagcaacgacgaaagaatacgggtcacgtcggagagggtggagaacatgagtatgaggcttgaggaggttaacgaaagggagcatagcatgaaagcatccctccagactgtggacattagattggcacagcttgaagatttgattggacgaatggcaaccgccctcgaaaggctcacaggcctagagagagccgaatctaataaaatcaggtctcgcacgtcttccgattgcactgatgccgcttacatcgtcagacagtcctctttcaactcacaggagggcaatacctttaaactgcaggagtccatcgaccctgccggagaggagaccatgtcacccactagccccacactgatgcctcggatgcggtctcactccttctactcagtaaatatgaaagacaaaggaggcatagaaaagctggagtcaatatttaaagagagatcactgtccttgcaccgcgccacaagcagtcattcagtggcaaaggaacccaaggcgcctgctgcccctgccaataccctggccatagtccccgactctcgtaggcccagcagctgcattgacatttacgtcagcgcaatggacgaactccattgtgacatcgacccactagacaattctgtgaacattctgggactgggcgaaccctccttcagcacacccgtgcctagtacagccccttccagcagtgcctacgcaaccttggcgcccactgaccgacctccctctagatcaatcgactttgaagatatcacctctatggatactcgatctttctcctcagattatacccatttacctgagtgtcagaatccatgggacagcgagccccctatgtatcatacaatcgagcgtagcaagtcctctcgctatctggccacgacgccttttctcctcgaggaggcccctatcgtgaaatctcacagctttatgttttctccaagtcgctcatactacgctaattttggggtaccagtcaagacggcggagtatacgtcaattaccgattgtatagacacccgctgcgtcaacgcacctcaggctatcgcagacagggccgcttttcccggaggtttgggtgacaaagtggaggacctgacttgttgtcaccctgagcgcgaggccgagctgtctcaccccagttctgattccgaagagaacgaggctaaaggtaggcgggccaccattgcaataagctcacaggagggcgacaacagcgagaggactctatctaacaacattaccgttccaaagatcgaaagggccaattcttattctgctgaggagccctctgccccctacgctcacacccgaaaatccttttccatttcggacaagctcgaccgccagcgcaacaccgctagcctgcgcaacccctttcaaaggtcaaaatcctctaagccagagggcagaggggattcactttctatgcgaagactgtcccgtactagcgcgttccagagcttcgaaagcaagcacaattag

SEQ ID NO: 209213 - DNA, 4740 bp, Artificial Sequence
  Description of Artificial Sequence: Synthetic coding sequence
atgtacgtgcgggtgagcttcgacaccaagcccgacctgctgctgcatctgatgacaaaggagtggcagctggagctgccaaaactcctgatttcagtgcatggaggactgcaaaattttgagttgcagcctaagctaaaacaggtctttgggaaggggcttattaaagctgcaatgacaacgggggcatggattttcacaggcggtgtcaacactggagttatcaggcacgttggggacgctctaaaagaccatgctagcaaaagccgcggaaagatttgtaccatcggaattgcaccgtgggggatagtcgaaaaccaggaagaccttattgggcgagacgtagtgagaccttaccagaccatgtcaaaccccatgagcaaacttaccgtcctgaattccatgcatagtcattttattctcgccgacaatggaactacaggtaaatacggcgccgaagtgaagcttcggcgtcaacttgagaaacacatcagcctgcagaagatcaatacacggtgtcttcccttcttttccctggactcacggttattctactctttttgggggagttgccagctcgactcagtggggattggtcagggagttccggttgtggcgctcatcgtggaagggggaccaaatgtgatttcgatcgtgttagagtatctgcgcgacacaccccccgtaccagttgtggtgtgcgatggctccggacgagcgtccgacatccttgccttcgggcataaatacagtgaagagggagggcttattaatgagtctcttcgagaccagctgctagtaaccatccaaaaaaccttcacatacacaagaacgcaggctcagcatctgtttatcatcctcatggaatgcatgaagaaaaaagaacttatcacggtttttagaatgggatccgaggggcaccaagatattgacctggcgattcttactgcgcttctcaaaggcgcaaacgccagcgccccggatcagctaagtcttgcactcgcctggaatagggttgatatcgctcggtcacagattttcatttatggtcagcagtggcccgtgggaagtcttgaacaagccatgctggacgccctggtgttggaccgtgttgactttgtcaaactcctgatcgaaaatggggtgtccatgcataggttcctgacgatttcccgcctcgaggaactatacaacacccgacacgggccgtccaacacgttgtatcatctggtgcgtgacgttaaaaaagggaatcttccaccggattataggatcagtttaatagacataggactggtcatcgagtatctgatgggtggggcttaccgatgcaattacaccaggaaacgcttccggactctgtaccataacctctttggacctaagagacctaaggctctgaaattacttggaatggaggacgacatacctctgaggagaggacggaagacaactaagaaacgggaggaggaggtcgatatcgacttggatgatccggaaatcaatcacttccccttccctttccacgagcttatggtgtgggccgttctcatgaagagacagaagatggcactttttttctggcagcatggggaagaggccatggctaaggccctggtcgcctgtaagctctgtaaggccatggcccacgaagcatccgaaaatgatatggtggatgacatcagccaggagctgaatcataacagtcgtgactttggccagcttgctgttgagcttctcgatcagagctataaacaggacgagcagctggcaatgaaactgctgacatacgaactgaaaaattggtctaatgcaacatgcttgcagcttgccgtcgctgccaagcatagggactttattgcgcacacttgcagtcaaatgctcctgactgatatgtggatgggtagactgaggatgaggaagaactctggattgaaagttatcctgggaatactgttgccgccctctatcctgtctttagaatttaagaataaggatgatatgccttatatgtcccaagcacaagaaatccacttacaggaaaaggaagcggaggagccagagaagccaaccaaggaaaaggaggaggaagacatggagctgactgcgatgctaggcagaaacaatggagaatcatcacggaagaaagatgaggaggaagtacagtcaaagcaccgcctgatccccctagggaggaagatatatgagttttacaatgcccctatagtcaaattttggttttacacccttgcttacatcgggtatctgatgcttttcaactatatagtgctggtgaaaatggagcggtggcccagcacccaggagtggattgttattagctacattttcacattggggattgagaaaatgagagaaatcctgatgtccgagccagggaagctgctccagaaggtcaaggtctggctgcaggaatactggaatgtgaccgacctcattgctatcctgctgttctctgtggggatgattttaagactgcaggaccaacccttccgatctgacgggcgggttatttactgcgtcaatattatctactggtatatcagattacttgatatatttggtgtcaataagtatctgggcccttatgtcatgatgatcggcaagatgatgatcgacatgatgtatttcgtgattatcatgctagttgtgctcatgtccttcggtgttgccaggcaggccatactctttcccaatgaggagccatcatggaagctggcaaagaacattttttatatgccctattggatgatctacggagaggtctttgccgaccaaatcgacccaccatgtggccagaacgagacccgtgaagacgggaagattatccagctcccgccttgcaaaactggtgcatggatagtgccagctatcatggcctgctatctcctagttgccaatatcctcttggtgaatctcctcatagccgttttcaataacacattctttgaggtcaaatctatctccaatcaggtgtggaaattccagcgctaccagcttataatgactttccatgagcggcctgtcctgcccccacccctgataatcttctctcatatgaccatgatctttcagcatctgtgctgtagatggcggaaacacgaatctgaccccgacgaacgcgactacggattgaaattattcattaccgacgacgagctgaagaaagttcatgattttgaggagcagtgcatcgaagagtatttccgggaaaaggacgataggttcaactctagtaacgatgaacggatccgggtgacatcagagcgtgtggagaacatgagcatgcgcttagaagaggttaacgagagggagcactccatgaaggcctctctacagacagtggatatcagactggcacaactggaggaccttattggccgaatggctactgcattggagcgattaactggacttgagagagcagaatccaacaagattagatcccggactagctcagattgcactgacgctgcttacatcgttcggcagtccagtttcaacagccaggagggcaacacattcaagctgcaggaatccattgatcctgcaggcgaggagactatgagtccgaccagccccactcttatgccgagaatgcgctcccacagtttttactctgtaaatatgaaggacaaaggtggaattgagaaactagaatcaatcttcaaggagaggagcttgtcgctgcaccgagcaacctcctctcacagtgtggctaaggagccgaaggctcctgcagctccagccaacaccctcgcaattgtacccgattcccgccgacccagcagctgcatagacatatacgtgtcagctatggatgaactgcactgtgatattgaccccctggacaactcagttaatatcctcggcttgggagagccatccttttctacccctgtaccaagtacagctccttcctcaagtgcctatgcaaccttagctcccaccgatcgacccccgagtaggtccattgactttgaggacataacaagcatggacactcggtcattctcttctgactacacccatctgccagagtgccaaaacccctgggactcagaaccaccaatgtatcataccattgaaagatcaaagagcagtcgctatttggctacaactccctttcttcttgaagaggcgcctatcgtcaagtcccatagctttatgttctccccgtcccgatcatattacgccaatttcggagtgcccgttaagactgccgagtacactagcatcactgattgtatcgacaccagatgcgtgaacgcaccacaggctattgccgaccgggctgcatttcctggcggtttgggggataaggtcgaagatctgacctgttgtcaccccgagcgcgaagccgagctctcccacccgtcaagtgattccgaagaaaatgaagccaaaggtaggagagccactattgccatttcatctcaggagggagacaatagcgaacggaccttatccaataacattaccgtcccaaaaatcgagagagccaattcttattccgccgaagaaccgagcgctccatacgcgcacactaggaagtcgttttctatatccgataagttggatagacagcggaatactgcatccctccgaaaccccttccagcggtctaagagcagcaaacccgaaggcaggggtgactctttatctatgagacgtctcagtagaacgtccgccttccagtccttcgaatccaagcacaattag

SEQ ID NO: 209214 - DNA, 5124 bp, Artificial Sequence
  Description of Artificial Sequence: Synthetic coding sequence
atgcccgagccctggggcaccgtgtacttcctgggcatcgcccaggtcttcagcttcctgttctcttggtggaatctagagggggtcatgaaccaagccgacgcccctcgccccctgaactggaccatcagaaagctatgtcatgctgccttcctccctagcgtgagactgctcaaagcacaaaagagttggatcgagcgtgccttttataaacgggagtgcgtgcacatcattccaagcactaaagacccccatcgctgctgttgtggcaggctgatagggcaacatgtaggccttaccccctctatttcagttttgcagaacgagaaaaatgagagtaggctgagccgtaatgatatccagtcggagaagtggtcaattagcaagcatacacagctgagtcctacggatgcttttggtacaatcgaatttcaaggtggaggtcacagtaataaagcgatgtacgtgagggtgtcatttgacacaaaaccagatctcttactgcatctgatgactaaagaatggcagctggagctgcccaagctcctaattagcgtccacggcggactgcagaattttgaactacagcctaaactgaaacaggtattcggcaagggactgattaaggctgctatgactaccggcgcttggattttcaccggcggggtgaatacaggagtgatccgccatgttggagacgcgctgaaggatcatgcttccaaatccagagggaagatctgtaccattgggattgctccctggggcattgttgagaaccaggaagatttaataggccgagatgtcgttcggccatatcaaaccatgagcaacccgatgtccaaactgaccgtgcttaatagtatgcacagccacttcatcctggccgataatggaacaacagggaagtatggcgcggaggtcaagctgcgtcgccagctcgagaagcacatttcactacagaaaataaacacccgcattgggcagggcgtgcccgtcgtggcactgatcgttgagggaggacccaacgtgatatcaatcgttcttgagtaccttcgagacaccccgccagtgcctgtcgtggtctgcgatggaagcggcagagccagcgatattctggccttcggacacaagtatagcgaagagggggggctaataaatgaatccctgagggaccagctgttggtgactatccaaaagaccttcacttatacaaggacccaggcacagcatctgttcatcatccttatggaatgcatgaaaaagaaggaactgatcactgtgttcagaatggggtcagaaggacatcaggatatcgatctcgctattttaacagcacttctcaagggggcaaacgcttctgcacctgatcagttaagcctggccttggcttggaacagggttgacatagccaggtctcaaatcttcatttacggccaacagtggccagtggggtccttagaacaagctatgcttgacgcactcgtactagaccgcgtggatttcgtgaaattgttgattgaaaatggcgtttcaatgcaccggttcttgaccatctcccggctcgaggagctctataacacccgccatggaccgagtaacacactgtatcacctggtccgagacgtaaagaaagggaacctgccacctgattacagaatctctctcattgatatcggccttgttattgagtatcttatggggggcgcctatcgctgcaattatacccgaaagcggtttcgaaccctctaccataacctttttggacccaaaaggccaaaggctcttaagctgctgggcatggaggacgatattcccctgcgccgcggaagaaaaaccactaagaaaagagaggaggaagtagatatcgatctggacgacccagagatcaaccattttcctttcccattccatgagctgatggtttgggctgttctcatgaaacgtcagaagatggcactcttcttttggcagcacggggaggaggcgatggcaaaggccctggtggcctgtaagttatgtaaagcaatggcgcacgaagcttcggagaacgatatggtggacgatattagtcaggagctgaatcacaattcacgtgattttggccaacttgcagtcgagctcttggatcagtcttataagcaggacgagcagctcgcgatgaaactgctgacgtatgaactaaagaattggagcaacgccacctgcctacagctcgcagtagccgctaaacacagagatttcatcgcccacacatgctcccagatgttgctgactgacatgtggatggggcggctgcgaatgaggaagaattcaggcctgaaggtcatcttaggcattctgttgcccccctcaattctcagtctggagttcaagaacaaggatgacatgccctacatgtcccaggcacaggagatccacttacaggaaaaagaagccgaggagccagagaagccaactaaggaaaaagaggaggaggacatggagttaacggctatgctggggagaaacaatggggagtctagccgaaaaaaggacgaagaggaagtccaaagcaagcaccgcttaatcccactgggccgaaaaatctatgagttctacaacgccccaatcgtgaagttttggttctacactctcgcatatatcgggtacttgatgctatttaactatattgttctcgtgaaaatggaacgatggccgagtacgcaggagtggatcgttatttcatacatttttactttgggaatagagaagatgcgggagatcctaatgtccgagccgggcaagctgctgcaaaaagttaaggtatggctccaggaatattggaatgtgaccgatctgattgccattctgttattctccgtcggaatgatcttgcgacttcaggaccaaccctttcgatctgacgggcgggtcatttattgcgtgaatataatttattggtacattcggcttctggatatttttggagtcaacaaatacttggggccttacgttatgatgataggaaagatgatgattgacatgatgtactttgtcattatcatgctggtggtactgatgtcgttcggggtggcgcgccaggctatcctcttccccaatgaggaaccatcctggaaacttgctaagaacattttttacatgccctattggatgatctatggagaggtgtttgctgatcagatagacccgccctgcggacagaatgagacaagagaggacggaaaaatcatacagctgcccccatgcaagactggggcatggattgtccccgccatcatggcatgctacctcctggtggcaaatatcctgctggtgaatttgcttattgcagtctttaataatactttcttcgaagtgaaatctataagcaaccaggtgtggaagtttcagcgttaccaattaatcatgacgttccatgaacgacccgtgcttccgccacctctgattatttttagccacatgacaatgatttttcaacacctttgttgtcggtggcgcaaacatgagagtgatccggatgaacgggactatggtctgaagctgtttattacagatgacgagttaaaaaaggttcacgattttgaggagcagtgcatcgaagagtattttcgcgagaaagatgataggtttaactctagcaacgatgagcggatccgagttacctctgagcgcgtggaaaatatgagcatgaggttggaagaggtaaacgagagggaacatagtatgaaggcatcactgcagactgtcgatatcaggctggcacagctcgaagatttgattgggcgcatggctaccgctctcgaacgtctgaccggactggagcgtgctgagtcaaacaagattagatctcgtacttcgagtgactgcactgacgcagcctatatcgtgcgccagtccagctttaatagtcaggagggcaacacatttaagctgcaggaatctattgacccagctggcgaggaaacaatgtccccaacatcaccgacattgatgcccaggatgcgttcccatagcttctattctgtgaatatgaaagacaaaggcgggattgaaaaactggaatccatcttcaaagagcgctcactctctctccaccgcgctacgagtagtcactccgtagctaaggagccaaaggcacctgcggctcctgccaataccctggccatcgtacccgattctcggaggccaagtagctgcatagacatttacgtatcggctatggatgagctacactgcgacattgaccctctagacaactccgtgaacattctgggtctgggcgagccatcattctcgactccggtgcccagtactgccccctctagcagtgcctacgccacattggctccaaccgataggccaccctccagatcaatcgacttcgaagacattacgagtatggacaccaggtctttttcaagcgactatactcatctgcctgaatgtcagaacccctgggactcagagccccctatgtatcacactattgaacgtagcaagtcctcacgttatcttgcaaccacaccgtttttgctggaggaagcccctattgtcaagagtcatagtttcatgtttagcccttctaggtcctactacgcaaatttcggtgtccccgtgaagacggcagaatatacctcaatcaccgattgtatcgatacacgatgtgtgaatgcgccccaagcaatcgcagaccgggctgcctttccgggcggattgggagacaaggtagaggatctgacatgttgtcatccagaacgcgaggctgaactcagccatccgtcaagcgacagtgaggagaacgaggctaaggggagacgcgccacgattgccatctcctctcaggagggagacaattcggagaggacactgtcgaataacatcacagtgccaaaaatcgaaagagcaaactcctatagtgccgaagaacctagcgccccctacgcccacactcgtaagtctttttctatctctgataagctcgaccgtcagagaaacacggcatcacttcgaaacccttttcagaggagcaaaagctcgaaacctgagggacgaggtgactctctgagcatgcggagactgtctcgcactagtgcattccaaagttttgaaagcaagcacaactag

SEQ ID NO: 209215 - DNA, 3978 bp, Artificial Sequence
  Description of Artificial Sequence: Synthetic coding sequence
atgcccgagccctggggcaccgtgtacttcctgggcatcgcccaggtatttagcttcctcttctcatggtggaatttggagggagtcatgaatcaggccgacgcacctaggcccctcaactggacaattcgcaagctctgccatgctgcatttctcccttccgtacgtctgctgaaggcccaaaaatcctggattgagcgggccttctacaaacgcgagtgcgtgcatatcatccctagtacaaaggaccctcaccgttgctgctgtggcaggttaattgggcagcacgtgggtttgacaccgtctatcagcgtcctgcagaatgaaaagaatgagtctcggctctccagaaatgacattcagtctgaaaaatggtccatatctaagcacactcagctgtcaccaacagacgcttttgggacaattgagtttcaagggggcggccatagtaacaaagctatgtacgtgcgggtctcattcgacactaagcccgacttgctgctgcatctgatgacgaaggaatggcagctggagctcccaaagttgctaatttctgtgcacggagggttacaaaatttcgaactgcaaccgaagctgaaacaggtgttcggcaagggtttaattaaagccgcaatgactactggtgcatggatctttaccgggggtgtcaacactggcgttatacgacatgtgggcgacgctctgaaggatcacgcttccaagtctcgtgggaagatctgcaccattggcatcgctccttggggcattgtggagaaccaggaagatctaatcggacgcgatgtcgtccgtccctatcagacaatgtccaatcccatgagtaagttaacagtgctcaattcgatgcactcacactttattttagctgacaacggcaccacaggtaaatacggtgccgaagtcaaactgaggaggcagctcgaaaaacacatatccctccaaaagattaacacacgaattgggcaaggcgttcccgtcgtggccctgatcgtagaaggaggccccaacgttattagtatagtgctcgagtatctgcgtgacaccccgcctgttccagtggtagtgtgtgacggatcaggcagggctagcgatatcctggcatttgggcacaagtattctgaggaaggaggcctcatcaatgaaagcctccgcgaccagctgctcgttaccatccagaaaacattcacttacaccagaacacaggctcagcaccttttcatcattctcatggagtgcatgaagaagaaggaactgattaccgtcttcaggatggggtccgaagggcatcaggatattgacctcgcgatacttacagctctgctgaagggtgctaacgcgtctgcacctgaccagctctccttagcccttgcgtggaatcgcgtagacatcgcccgatcccaaatttttatttacggacagcagtggccagttggctcgcttgagcaggcaatgctggacgctctggtattggatagagtggatttcgtgaaactgctaatagaaaacggtgtctctatgcatcggtttctcacgatcagccgtctggaggaactctacaatacccgacacggcccttccaacacattatatcacttggtcagagacgtgaagaaaggcaacctgcctcctgactacaggatctcccttattgacattggcctggtcatagagtacctgatggggggagcatatagatgtaactacacaagaaagcgcttccgaacgctgtaccataacctttttggccccaagaggcctaaggccctgaaactgctcggtatggaggatgacatcccccttcggcgcgggagaaaaacaacaaagaaacgtgaagaggaggtcgacatagaccttgatgaccctgagatcaaccactttccattcccttttcatgagctaatggtatgggctgtgctgatgaaacgacaaaaaatggccctgtttttttggcagcacggcgaggaggccatggctaaagctctcgtcgcatgcaagctgtgcaaggccatggcccacgaggccagcgaaaacgacatggtcgacgacattagccaggagctgaatcacaattcccgcgatttcggtcaattagctgtcgagctcctagatcagtcttataagcaggatgaacagctggcaatgaagctccttacctacgaactgaaaaactggagcaatgctacttgccttcagttggctgtggccgctaaacatagagactttatagcccatacttgttctcagatgctgctgaccgacatgtggatgggacgactgagaatgcgcaagaattcggggctgaaagtcatactgggcatcttattaccaccttctattctcagtctggaattcaagaacaaggatgatatgccctacatgagccaggctcaggagatccatctgcaggaaaaagaggccgaagagccggagaaacctaccaaagagaaggaggaggaggacatggagctgactgctatgttaggtcgaaacaacggcgagagctctcggaaaaaagatgaggaggaagtccaatctaaacaccggcttattcccctgggacggaagatctacgagttctataacgctcctatcgttaaattctggttttatacactggcctatatcggctatctgatgctttttaactacattgtgttagttaaaatggagaggtggccgagcacacaggaatggattgtaatcagttatatctttaccctcgggattgaaaagatgcgagagatactcatgtctgagccgggaaagttgctgcaaaaagtgaaagtctggctacaggaatattggaatgttactgaccttattgccatcctgcttttttctgtgggcatgatcttgagactccaggatcagccttttagatcagatggaagagtgatatattgcgtcaatattatttattggtatattcgattactcgacatctttggcgtgaacaagtacctgggcccatacgtgatgatgattggcaaaatgatgatagatatgatgtattttgtcatcatcatgctggtggtgttgatgagcttcggcgtggcgcggcaagcaatactctttcccaacgaagagcctagttggaaactcgcgaagaatattttctacatgccgtactggatgatctacggcgaagtcttcgccgaccaaatagatcctccttgcggacagaacgagacacgggaagacggtaagatcatacagctcccgccctgtaagactggcgcttggatcgtcccggcaatcatggcctgctacctcctggttgcgaatattttactcgtgaacctgctcatcgctgtcttcaataacaccttcttcgaagtaaagagcatctccaatcaagtctggaagtttcagcgctaccagctgattatgactttccacgagcggccagtactgccaccacctttgataatattctcacacatgacaatgatcttccaacatctatgctgccggtggagaaaacatgagtctgacccagacgaacgtgactacggcctgaaactcttcatcacggatgacgaattaaaaaaagttcacgactttgaggagcagtgtattgaagagtacttccgggagaaggatgatcgttttaattcctctaatgatgagcggatcagggtgacgtctgagcgcgtggagaatatgagcatgcggctagaggaggtgaacgagcgcgaacactccatgaaggccagccttcaaactgtggacatccgattagcccagctcgaggatcttattggacgcatggctactgctctggaacgacttaccggtcttgaacgggctgagtctaacaaaatccggagccggacctcatctgactgtacggatgcagcctatattgtacgccagtctagctttaatagccaggagggcaatacctttaagctgcaggagtccattgaccctgcagagcaccctctctattccgtgtag

SEQ ID NO: 209216 - DNA, 4671 bp, Artificial Sequence
  Description of Artificial Sequence: Synthetic coding sequence
tgatacgtgcgggtgagcttcgacaccaagcccgacctgctgctgcacctgatgaccaaggaatggcagttagaacttcctaaactgctcatttctgtgcacggcggtttacaaaactttgagctgcagcccaaactcaagcaggtcttcgggaaaggtttgatcaaggccgccatgaccactggcgcctggattttcacaggcggagtgaatactggggtgattagacatgtgggagacgcgctaaaagatcacgcgagcaaatctagaggcaaaatctgtactatcggcatcgccccttggggaatcgtggaaaaccaggaggatctgataggacgcgatgttgttagaccatatcagaccatgagtaaccctatgagtaagcttacagtgctgaactcaatgcattctcatttcatcttagctgataatggcacaacgggcaagtatggagccgaagttaagttacgccggcagctggaaaagcacatctccttgcagaaaattaatacgcgcataggccagggggtgccagttgtggcactgattgtggaaggcggccctaatgttataagtattgttcttgagtatctacgggacactcctcccgtccccgttgtagtgtgcgacggctctgggcgtgccagcgacatcttggccttcgggcataagtatagcgaagaaggaggtctgataaacgaatctctgcgggatcagttgctcgtaactatccagaagacatttacctatacccggacacaggcccagcatctgttcatcattttgatggagtgcatgaaaaaaaaggaacttattactgttttccggatggggtcagagggacaccaagatattgatctggcaatccttaccgctctcctcaaaggagccaacgcgtcagctccagatcagctgagccttgccctcgcatggaaccgggtggacattgctcggagccagatcttcatctatggacagcagtggcctgttggtagcttggagcaggccatgctggacgctttggtactggatcgtgtggattttgtaaagttactgatcgaaaacggcgtgagtatgcatcggtttctgacaatatcgcggttagaggaattgtataacactaggcacgggccctccaacacgctgtatcacctcgtcagggacgtgaaaaaacgcgagtaccccggcttcggctggatatactttaaggggaacctccccccagactatcgcatttcattaatcgacatcggactggtcattgaatacctgatggggggggcctatcggtgtaattacactcgaaaacgtttccgaaccttataccataatctctttggcccaaagagggatgacattccactgagacgaggccgaaagacgacaaagaagagagaggaagaggtggacatagacttagacgacccagagatcaatcacttccctttcccgttccacgaacttatggtgtgggccgtgctgatgaaaagacaaaagatggccctcttcttctggcagcacggggaggaggcaatggcaaaagctctagttgcctgcaaattgtgtaaagccatggcacacgaggcttcagaaaatgacatggtagacgacattagccaggagctaaaccataacagcagggatttcggccaacttgctgtggaattgctggaccaatcctataagcaggacgaacaactggccatgaagctgcttacttacgaactaaaaaactggtcaaatgctacctgccttcagctcgctgtggctgccaagcaccgggattttattgctcacacatgtagccagatgttactgacagacatgtggatggggcggcttaggatgcgtaagaatagcggactgaaggtcatcctggggatcctgcttcctccaagtattcttagcctggagttcaagaataaggatgatatgccttacatgtcccaagcgcaagaaatccacctgcaggaaaaagaagctgaggagccagaaaagcccactaaggagaaggaagaggaagatatggagcttacagccatgctgggtcgaaacaatggggagtccagccggaaaaaggacgaggaggaggtgcagtctaagcatcgactcattccattagggcggaaaatctatgaattctacaacgccccgatcgtcaaattctggttctacaccttagcctatattggatatcttatgctgttcaattacattgttttggtcaaaatggagaggtggccaagtacacaggagtggatcgtgatcagctacatcttcactcttggcatcgagaagatgcgtgaaattttgatgagcgaacctgggaagctgctccagaaagtgaaggtgtggctccaagagtactggaacgtgacagatctcatcgccatccttctcttctcggtaggtatgattttgcgcctgcaggaccaaccattccggtccgatggaagggtgatctactgcgtcaatatcatctactggtacattcggctgctcgacatcttcggcgtcaacaaatatctgggcccctacgttatgatgattggcaaaatgatgatcgacatgatgtacttcgttattataatgcttgttgtgcttatgtcatttggtgtggccaggcaggctatccttttccccaatgaagaacctagttggaagctcgctaaaaacattttctatatgccctactggatgatctatggagaagtatttgccgatcagattgacccgccttgtggccagaacgaaactagagaggacgggaagattattcaactgcccccttgtaagaccggtgcctggattgtgcccgcaattatggcttgttatctgctggtggccaacatcctgcttgtgaatctgttgatcgctgtgttcaataacaccttcttcgaagtcaagtcgatctctaatcaagtgtggaaatttcagcgctatcaactgattatgactttccacgagcgaccggtgctgcccccgccactgatcattttttcacacatgacgatgattttccagcacctctgttgtcgctggagaaaacatgaatctgaccctgacgagagagattacggacttaaactgtttatcaccgatgacgagctgaagaaggtccacgacttcgaggaacaatgcatcgaagaatattttagggagaaggacgaccgctttaacagttccaatgatgaaaggattagggtcacatcagagcgggtggagaatatgtctatgaggctcgaggaggtcaacgagcgggagcacagcatgaaggcttctcttcagacagtggatattcgcctggcccagctggaggacctgatcggtcggatggccactgccctcgagcgattaaccgggttggagcgggccgagagtaacaaaattagatctcgcacatcctcagactgtaccgacgccgcctatatcgttagacaatcatctttcaactcccaggaagggaatacctttaaattgcaggagtctattgatcccgcaggagaagagactatgtctcctaccagcccaacactgatgcccaggatgaggtcccactccttctactccgtgaacatgaaggacaagggcgggattgaaaaactcgagagtatcttcaaggagcggtccctatctctgcaccgcgcgacaagtagccattccgtcgcaaaagaacctaaggctcctgcagctccagccaatactctggcaattgtccccgattctcgtcggcccagctcttgcatcgacatatacgtgtcagccatggatgaattgcattgcgatattgatccgctcgacaatagcgtaaacattctgggattgggtgagccttctttttcaacaccggttccgagcactgcccccagctcaagcgcctacgcaaccctcgctccaacagaccgcccgccttctcggtccatcgatttcgaagacatcacaagcatggatacccggtccttcagctccgattacacgcaccttccagagtgtcaaaacccctgggacagcgaaccaccaatgtaccacactatagaaaggagtaaatctagtaggtacctcgctactacccctttcctgctggaggaggctccgattgtcaaaagccacagttttatgttttctccgagcagatcgtattacgccaattttggcgtgccagtgaagacagccgagtatacaagcatcactgattgcatagacactaggtgcgtgaacgcaccccaagccatagccgatagggccgcatttcccggaggcctgggcgataaggtggaggatctgacctgctgtcatcccgaaagagaagcggagctgtcccaccccagctctgattccgaggaaaacgaggcaaaggggcgacgcgccacaatcgcaatcagtagccaggagggcgataattcagagagaactctcagtaacaatatcacagtccccaagatcgagagggcaaattcgtactcagccgaggaacccagtgccccgtacgcccacacccgaaaatcatttagcatatctgacaagctagacaggcaaaggaacactgcatcgctgcgcaacccgttccagagatcaaagtcctccaagcctgaaggtcggggcgatagcttatctatgaggcgtctaagcaggacatctgcttttcagagtttcgaatccaagcacaactag

SEQ ID NO: 209217 - DNA, 4701 bp, Artificial Sequence
  Description of Artificial Sequence: Synthetic coding sequence
atgtacgtgcgggtgagcttcgacaccaagcccgacctgctgctgcacttgatgacgaaggagtggcagttagaactccccaagctccttatttccgtgcatggaggcctccaaaatttcgaactgcaacccaagctcaaacaggttttcggaaagggactcatcaaggccgctatgaccactggcgcatggatttttacgggaggcgtgaacaccggggttatcaggcacgtcggtgatgctcttaaggatcacgcgtccaaatcacgaggtaagatttgtacaattggcatcgccccttggggaattgtggagaaccaggaagatttgatcggtagggacgtggttcgcccctatcagaccatgagtaacccgatgagtaaactgacagtcctcaactctatgcatagccacttcatcctcgctgataacggtactactggtaagtacggagcagaggttaaactgagaagacagcttgagaaacacatttctctgcagaagatcaacacacgcattggacaaggcgtgcctgtcgtcgcccttatcgttgagggaggaccaaacgtcatatctatagtcttggagtatttgagagacacaccccccgtccccgtggtggtgtgcgacggtagcgggcgggcatccgacattcttgcattcggccacaagtattctgaagaaggcggccttatcaacgaatcattgcgggaccagctgttggtcaccatacagaaaaccttcacatacacccggacccaggctcaacatctgttcattattctaatggaatgtatgaagaagaaagagctgataacagtttttcggatgggtagtgaaggccatcaggacatagatctcgcgattctgactgcactgttgaagggcgctaacgcttctgcgccagaccagttaagccttgctctcgcatggaatagagtggacatagcaaggtcccagatcttcatctatggtcagcagtggcccgtcggctctctggaacaggcaatgctggacgcgctagtgcttgacagggtagacttcgtgaagcttttgatagaaaacggcgtctctatgcacagatttcttacgattagtagactggaagaactgtataatactcggcatggcccttccaacacactttatcacttggttagagacgtgaagaaggggaatttgccaccggattacagaatttcgcttattgatatcggcttagtgatcgagtatctgatgggtggggcctataggtgtaactatactcggaaaagattccggactctgtatcataaccttttcggccctaagaggccaaaggcattgaagctcctggggatggaggacgacattcctcttagaaggggaagaaagaccacgaagaaaagagaggaagaggtcgatatcgatctggatgacccagaaatcaaccactttccgttccccttccacgaacttatggtgtgggccgtcctgatgaaacgacagaaaatggccttgttcttctggcaacatggcgaggaggcaatggccaaagcacttgtagcgtgtaagttgtgtaaagcgatggcccatgaagcgtccgaaaatgatatggtcgacgatatctcccaggagttgaaccataattcgagggacttcggccagctcgctgttgagctcctggaccaatcatataaacaggatgagcaacttgctatgaagctgctaacatacgagttgaagaactggtcaaacgctacctgcctgcaactcgcagtcgccgccaagcacagagatttcatcgctcacacctgttcccaaatgcttctgaccgacatgtggatgggccgactccgcatgcgcaaaaatagcggactcaaggttatccttggaatactgttgccccccagtatactaagtctggaattcaaaaataaggatgacatgccctatatgagccaggcccaagagatacacttacaggaaaaggaggcagaagagccggaaaagcccactaaagagaaggaagaagaggacatggagctgaccgccatgctggggcggaacaacggtgagagcagcaggaagaaggatgaagaggaggtgcagtccaagcatcgtctcattcctttggggcgcaagatttacgagttttacaatgctcccattgtcaaattttggttctatacactcgcatacattggctacctaatgctgttcaattatattgtcctggtaaagatggaaaggtggccgagcacacaggagtggatcgttatttcctatatttttactctgggcattgagaaaatgagagagatcctcatgtccgaaccgggcaaactactccagaaagtgaaggtgtggctgcaggaatattggaacgttaccgacctgatcgccatccttctcttttcagttggcatgatacttagactgcaggaccagccctttcgctcagatgggagagtaatatattgcgttaatatcatttattggtacatccggctcttagatatttttggtgtgaataagtacctgggcccttatgtaatgatgataggaaagatgatgatcgacatgatgtactttgtgatcataatgttggtcgttttaatgagcttcggagttgctcgacaagctatcctttttcccaacgaagagcccagctggaagctagctaagaacatcttttatatgccatactggatgatttatggtgaggtattcgccgaccagatagatagaaagcaggtctatgactcacacaccccgaaaagcgccccctgtgggcaaaacgaaacccgcgaagacggaaagattattcagctacccccctgcaaaacaggagcctggattgtacctgctatcatggcgtgttatctgcttgtggccaacatccttctcgtgaacctcctaatagcagtcttcaacaacacgttcttcgaagtgaagagtatatctaaccaggtctggaaatttcagcgctaccagctcatcatgacattccatgaaaggcctgttttgcctcctccgttgatcatcttctcccatatgacaatgattttccagcacttatgttgcaggtggcgtaagcatgaaagtgaccctgacgagcgcgattatgggctaaaactgtttataaccgacgacgagcttaagaaagtccacgactttgaggaacaatgcattgaggagtattttcgtgaaaaggacgatcgcttcaacagctcgaacgatgagcgaattcgggtaacatctgagcgggtggagaacatgtcaatgcgcctcgaggaggtgaatgaacgagagcattccatgaaagccagtttacagacagttgatatacgattggcacaacttgaggatttgattgggaggatggccaccgctctcgaaagactcacgggactcgaaagagccgagtctaacaagataaggtctaggacaagcagcgattgcaccgatgcggcctacatcgtgcgccagtcgagctttaactctcaggaaggtaacactttcaagttgcaggaaagtatagaccccgccggcgaagagacaatgagtcccacctcaccaactttgatgccccgtatgaggtcacatagcttctattctgtcaacatgaaagacaaaggcggcatagagaaattggaatcaattttcaaggaaaggtctctttccctgcaccgagccacgagcagtcacagtgtggccaaagaaccaaaggcgccagccgctcctgcgaatactttagctatcgtccctgatagcagacgcccatcgtcttgcattgatatctatgtgtctgccatggatgagctgcactgcgatattgaccctctggataactccgtaaacatcttgggactaggcgagccgtcttttagcacgcccgtgccaagcaccgctccttcctccagcgcttacgctacactggccccgaccgaccgtccaccgtcaagatccattgattttgaggacattacctctatggatactcgctctttctcttcagactatacccatcttcccgagtgtcagaatccctgggacagcgagccccctatgtatcatactattgagcgaagcaagtctagcagatacctagccacgaccccgtttcttctagaagaggcccctatcgtgaaaagtcactccttcatgttctcaccatcgagatcgtattacgccaattttggagtcccggtcaagacagccgagtatactagtataaccgattgcatcgatactcgatgcgtcaatgccccacaggcgatcgctgatcgtgccgcatttcctggggggcttggcgacaaagttgaggatctgacctgttgtcaccccgaaagagaagcagaactcagccatccttcgagcgactctgaggaaaatgaggccaaaggaagaagagcgaccattgccatttctagccaggaaggagacaacagtgaacgcacactgagcaataatattaccgtccccaagatcgagagggctaatagttacagcgccgaagagccctcagcgccttatgcccatactagaaaaagtttttccatctccgataagctcgatagacaaagaaatactgcaagtcttagaaaccccttccagagaagtaaatcctctaagcccgaggggaggggcgatagcctgtctatgcgcaggctttcgcgtacatccgcctttcagagtttcgagtccaaacacaactag

SEQ ID NO: 209218 - DNA, 4740 bp, Artificial Sequence
  Description of Artificial Sequence: Synthetic coding sequence
atgtacgtgcgggtgagcttcgacaccaagcccgacctgctgctgcacctcatgactaaagagtggcaacttgagttgcccaaactgttgatcagcgtgcacggtgggctacagaacttcgaacttcagccgaagttgaaacaggtctttggcaaaggacttatcaaggctgctatgaccaccggcgcgtggatcttcactggaggagtgaatacaggcgtgattcgacatgtcggtgacgccctgaaggaccacgctagcaagtctcggggtaaaatctgcactatcggcatagccccctggggaatagtggaaaaccaggaagatctcattggacgagacgtggttcggccctaccaaaccatgagcaaccccatgtccaaattaaccgttttgaacagcatgcattctcatttcattctggccgacaatggtacgaccggtaaatatggtgctgaagtgaaactacggcgtcagctggaaaagcacatttctctgcaaaaaattaacacgagatgtctgccttttttttctctagacagccgcctgttctacagcttctggggaagctgccagctcgatagtgtgggaattggtcagggcgtgccggtagtggcacttatagtggagggcggccccaatgtcatctcgatagtattggagtatttacgtgacacaccccccgtgcccgtggtggtctgtgacggatctggccgcgccagcgatatcttagccttcggacacaaatactccgaagagggcggcctgatcaatgagtccctgcgggatcagctcttggtgacgattcaaaaaacttttacctacactcggactcaggcacagcacctgttcatcatcctgatggagtgcatgaagaaaaaggagctgatcaccgtatttagaatgggctccgaaggtcaccaagatatcgacctggctatcctgacggctctgctcaaaggggcaaatgcaagtgcccccgaccaactgagcctggcactcgcgtggaacagagtggacattgcacgctctcagattttcatttatggacagcagtggccagtgggctctctggagcaggctatgctggacgctctagtgctggacagagttgatttcgtcaagctcctgattgaaaacggagtgagtatgcatcggtttctcacaatttctagactggaagaactgtataacacacggcacggtccatcgaacaccttataccatctcgtccgagacgttaagaagggaaacctcccccctgactacaggatctctcttatagatattgggctcgtcatcgaatacttaatgggcggcgcttatcgctgcaactatacacgcaagagatttcgcaccctgtaccacaatctgttcggccctaaacggccgaaggctttaaaactgctcggcatggaagatgatatacccctccggagaggaaggaagacaactaaaaaacgcgaagaagaggtggatattgacctcgacgaccccgaaatcaatcatttcccgttcccattccacgagctcatggtttgggcagtgctaatgaaacggcagaagatggctttgttcttctggcagcacggtgaagaggccatggcgaaggctctcgtggcatgtaaactgtgtaaagctatggcacacgaagcttctgagaacgacatggtagacgacatttcccaagagctgaaccacaatagccgcgactttggacaactcgctgttgaactgctcgatcaatcctataagcaagatgagcagcttgcaatgaagctattaacctatgaattgaagaactggtctaatgctacatgtctgcagctcgccgtcgccgccaaacaccgtgattttatcgcgcacacttgttcccagatgttgttgacagacatgtggatgggccgcctcaggatgcggaagaatagtggcctgaaagtgatactgggtatcctcttgcctcctagtattctgtccttagagttcaaaaacaaagatgatatgccctacatgtcacaggcacaggaaatccatctgcaggagaaggaagcagaggagcccgagaaacctaccaaagaaaaggaggaagaagatatggagttaacagccatgttgggaaggaataacggagagagttctcgcaaaaaggatgaagaagaagtgcagtcgaaacatagactgatccctttggggaggaagatctacgagttttacaatgcacccatcgtgaagttctggttttacacactagcctacattggctacctaatgttgtttaattatattgtcttagtgaaaatggagcgatggcctagtacccaggagtggatcgtaatctcgtacatctttaccctcggcatcgaaaaaatgcgggagatcctgatgtcggaaccagggaagctgctgcagaaagttaaggtgtggcttcaggagtattggaatgtgacggacctgatcgccattctcctcttcagtgtaggcatgatactgcgtttgcaggaccagccctttcgctccgacgggagggtgatctactgcgtaaacattatatactggtacatccgcctgcttgatatctttggagtaaacaagtatctggggccttatgtgatgatgatcgggaagatgatgatcgacatgatgtacttcgttatcatcatgctggtcgtcctgatgagttttggcgtggcacggcaggcaattctctttcccaatgaggaaccgtcctggaagctggccaaaaacatcttctacatgccctattggatgatctacggggaggtgttcgcagatcaaatagatccgccatgtgggcagaacgagacccgcgaggatggtaagatcattcagttacctccttgtaagacgggcgcttggattgtgccagccatcatggcttgctacttgctggttgctaatattctccttgtaaacctgttaatcgccgtgtttaataacactttttttgaggttaagagtatttcaaaccaagtgtggaagtttcagagatatcagctcattatgacttttcatgaacggcctgtgctccctccaccgcttattatcttctctcacatgactatgatttttcagcatttgtgttgccggtggagaaaacatgaatcagaccccgacgagagggactacggtctgaaactctttattacagatgacgagcttaagaaggtccacgatttcgaggaacagtgtatcgaagagtactttcgtgagaaagacgatagattcaattcctctaacgacgaaaggatccgggtgaccagcgagcgcgtagaaaatatgtcgatgagactggaagaggttaacgaacgggaacatagtatgaaagcctccctgcagactgtagacatacgactggcccagctcgaggatttaatcggacggatggcaaccgccctcgagaggcttactgggctggagagggctgagtcaaataaaattcggagtagaacttcttccgattgcacagacgctgcttacattgtgagacaaagctcttttaactctcaggagggtaatacctttaagcttcaggagtcgatagaccctgctggcgaggagacaatgtcacccacatcgcctaccctgatgcccaggatgcggtctcatagcttttactcggtgaatatgaaggataagggcggcatcgagaagctggagagcatcttcaaagagcgaagcttgtcacttcacagagcgactagtagtcacagcgtcgcgaaggagcccaaagctccagcagcccccgctaacacgctggcgatcgtccccgattcccgacgaccaagttcgtgcatcgacatctacgtgtccgctatggacgagctgcattgcgacatagacccattagacaattcagttaacatcctgggccttggtgagccttccttctctacgcctgtgccttccaccgcacccagctcctccgcctatgcaacattggccccaactgatagaccaccatctcggtcaatcgacttcgaagatattaccagtatggatactcgatctttcagcagtgactacacccatctgccagaatgccagaacccatgggactctgagccacccatgtaccataccattgagcgctccaagtcctcccgttacctggccacaacgccgttcctgctcgaagaggcaccgatcgtgaagagtcacagcttcatgttttccccatctaggtcatattatgcaaacttcggggttcctgtgaagacggctgaatacacctctataacagactgtatcgacaccagatgcgtgaacgccccgcaagccatcgccgatcgagctgcgttccctggggggctgggagataaggtggaggacctcacatgctgccatccggaaagagaggccgaacttagccacccatcctcagattcagaggagaacgaggctaagggcaggcgtgccaccatagccatatcaagtcaagaaggcgacaattcagagcgcaccctgtccaacaacatcactgtccccaagattgagagagccaacagttattccgctgaggaacctagcgctccctacgcccacactcgaaagtctttcagcatctctgataaactcgaccgtcagcggaacacagctagcctgagaaaccccttccagaggagcaagtcatccaaaccagaagggcgtggagactccctatctatgcggagactatctaggacctctgcctttcagtcatttgagtccaagcacaattag

SEQ ID NO: 209219 - DNA, 4701 bp, Artificial Sequence
  Description of Artificial Sequence: Synthetic coding sequence
atgtacgtgcgggtgagcttcgacaccaagcccgacctgctgctgcacctgatgactaaggaatggcagctggagctgccaaaactgcttatttccgtccatgggggactacagaattttgaacttcagcccaagctgaaacaagtcttcgggaagggcctgatcaaggccgcaatgaccacgggggcctggatcttcacagggggcgtaaacacaggggtcatccggcacgtcggagatgcactcaaagatcacgctagtaagtcaaggggcaaaatctgcacaatcggaatcgccccttggggtatcgtagagaaccaggaagatctgatcgggagggacgttgtcagaccttatcagacaatgtccaatcccatgtccaaactcactgtgctgaattcgatgcacagccacttcatcctggcagataacggcacaaccggcaagtacggcgccgaggtgaagctccgacggcagttagaaaagcatatttctttacaaaagattaacactcggatcggtcagggcgtgcccgtggtggctctgattgtcgagggcgggcccaatgtcattagtattgtgctggagtatctgagggacacgccccccgtcccggttgtggtgtgcgatgggtccggtcgggccagcgacatattggcttttggacacaagtatagtgaggaagggggattgatcaatgaaagtttgcgggatcaactgttggtcacaatccagaagacattcacctatacccggacccaggcacaacacctgttcattatcctgatggagtgcatgaagaagaaggagcttataacagtattccgaatgggcagcgaaggacaccaggatatcgaccttgcaattctgacagccctcttaaagggagctaacgcttccgctccagaccagctgtcgctagctctagcctggaatcgggtggatatcgcccggtcccaaatattcatttacggtcagcaatggccagtgggatcgcttgagcaggcgatgctggacgccctcgtcctcgatagggtcgatttcgtgaaactgctaatcgagaacggagtctccatgcacaggtttctgacaatttctcgcctcgaggagctctacaatactagacatggtccgagcaataccctctatcacctggtgagggacgtaaagaaaagagaataccccggattcggctggatttactttaaggggaatttgcctccagattaccgcatctcacttattgatattgggttagtgattgaatacctcatggggggtgcctatcggtgtaattatacgagaaagagattccggacactgtaccacaacctctttggccctaagagacccaaagccttgaagttgctgggaatggaagatgacattccactcaggcggggacgcaagacgacaaagaagcgggaggaggaagtggacattgacctggacgatcctgaaattaatcactttccttttccatttcatgaattgatggtgtgggccgtgctgatgaagagacagaagatggcactctttttctggcagcacggggaggaggctatggcgaaggccttggtggcttgtaagctgtgcaaagctatggctcacgaagcttctgagaacgacatggtagacgatatatctcaggaacttaatcacaattcacgggactttggccagttggccgtggaactgctggatcagtcgtataagcaggacgaacagcttgctatgaagctgttgacctacgaactgaaaaattggtctaacgccacctgccttcagctggctgtcgcggccaagcatcgcgatttcatcgcgcacacatgctcccagatgcttcttacagacatgtggatgggccggctccgtatgagaaagaacagcggtctgaaggtgattctgggaattctcctgcccccctctattctcagccttgaatttaaaaacaaagacgatatgccctatatgtcacaagcacaggagatccatttgcaagagaaggaagctgaagagcccgagaagcccaccaaggagaaggaagaagaggatatggagctcaccgcaatgctcggacggaacaacggagaatccagtcggaaaaaagacgaggaggaggtacaatcgaaacatagactaattccactaggacgaaagatctacgagttttataacgctcccatcgtcaagttttggttctacaccttggcctatatcggctaccttatgctgtttaattatatcgttcttgtgaagatggaaagatggccctctactcaagagtggattgtgatatcctacatatttactctcggtatcgagaagatgcgagagatcttgatgtccgagccgggcaaactgctgcagaaggtcaaggtgtggctccaggagtactggaacgtgacagacctgatcgctatcctcctgtttagcgtgggtatgattctccgtctgcaggaccagccttttagaagcgatgggagggtaatctactgcgtcaacatcatctattggtatattcgtcttctagacattttcggagtgaacaaatatctggggccctacgttatgatgatcggcaaaatgatgattgacatgatgtatttcgtgatcattatgctggtagtcttaatgtccttcggcgtggctcgacaggccatattgtttccaaatgaggaaccatcctggaaacttgcaaaaaacatcttctatatgccttactggatgatctatggtgaggtctttgcagaccagatcgacccgccctgcggacaaaatgagactcgagaagatggcaagatcatccagttgcctccatgtaagactggcgcctggattgtccccgccataatggcttgctatctgttggttgcaaatattttactggtgaatctgctaatcgctgtgttcaacaacacctttttcgaggtcaagagtatttcaaatcaagtttggaagttccaaagataccagcttatcatgacgttccacgaacgccccgtgctcccaccgccgttaatcatcttctcacatatgaccatgatatttcagcacctttgttgcagatggcgaaagcacgagagtgatcctgacgaacgggattacggtttgaaactgttcataacagacgacgagttgaaaaaagtgcacgatttcgaggaacagtgcattgaagagtattttagagagaaggacgacaggtttaactcgtctaacgatgagaggattcgggtcacaagcgagcgagttgaaaatatgagcatgcgccttgaagaagtaaacgagagggaacactctatgaaggcctcgctgcagaccgtcgacattaggctggcccagctcgaagaccttatcggccgtatggccacggctctggaaagactcactggactggagcgcgctgaaagcaataagattcggtcccgcacctcaagcgactgcacggatgccgcgtacatagtcagacagtcaagcttcaatagtcaggaagggaacactttcaaattgcaggagtcaatcgacccagcaggtgaagaaaccatgtcccctacctcgccaacccttatgcctcggatgcggtcacattccttctatagcgtaaacatgaaggacaagggagggatcgaaaagttggagtccatctttaaggaacgaagcctttccctccaccgcgcgacatcttctcactctgtggcaaaggaaccaaaagcccccgccgccccagccaacactttggctatcgttccagacagccggaggccatcatcctgcatagacatttacgtgagcgccatggatgaacttcactgtgatattgatcctctcgacaactcagtgaacatccttgggctgggtgagccctcctttagtacccctgtcccttccacagccccttcttccagcgcatatgcaacgctagctcccaccgacagacctccaagccgatccatcgactttgaggatatcacatcaatggacacacgtagctttagttctgactacacacacctcccagagtgccagaacccttgggatagcgaaccacccatgtaccacactattgagcgctcaaagtcttcccgttatttggctacaacacccttcctgcttgaggaggcaccaattgtcaagtcccattcattcatgttttccccttctcgatcctattatgctaattttggggtgccagttaagactgccgaatatacttcaattacagactgtatcgatacacgctgtgtgaatgccccacaggcgatcgcagatagagcggcatttcctggcggactaggagacaaagtcgaggatctcacttgttgccacccggaaagagaagcagagctgagtcacccttcgagtgactcagaggagaatgaggctaaggggcgtcgggccacaattgctatttctagccaggagggggataatagcgagaggacattgtcgaacaatattactgttccaaaaatagaacgggcgaactcctactctgctgaggagccaagcgctccctacgcacatacacggaagagcttttcaatcagcgacaaactagaccgccagcgcaataccgcatccctccgcaaccccttccagcgcagtaagagctccaaacctgaaggacggggagacagcctcagcatgcgcaggctctccaggactagtgccttccagtcattcgagagcaagcataattag

SEQ ID NO: 209220 - DNA, 5205 bp, Artificial Sequence
  Description of Artificial Sequence: Synthetic coding sequence
atgggcaagaagtggcgggacgccgccgagatggagcggggctgctccgacagggaagataacgctgagtctaggaggcggagtcgatctgcctctcgtggccggtttgcagaaagttggaagagactaagttcaaaacaggggtccactaagagaagtggccttccctcacagcagacaccagctcagaagtcatggatcgagcgggctttttacaagagagaatgcgtgcatatcattccatcaacgaaagacccacaccgatgttgttgtggccgactgatcgggcagcacgtgggcctcactcccagcatttccgttttgcagaacgagaagaatgaatccagactcagtcggaatgacatccaaagtgaaaagtggtctattagtaaacacactcaactaagccccactgatgccttcgggactatcgagttccaaggcgggggacacagcaataaagcgatgtacgtgcgagtatccttcgatacaaagccagacttgttacttcacttaatgaccaaggagtggcaacttgagcttccaaaactcctgatttccgtgcacggggggctccaaaattttgaactgcaaccaaaactgaaacaagtattcggtaaggggctcataaaggccgccatgaccaccggcgcctggattttcacggggggagtgaacaccggcgtgatccggcacgttggcgacgccttgaaagatcacgccagcaaatcccggggcaagatctgtacaatcggcattgccccgtgggggatcgtggaaaaccaggaggacctgattggtagagatgttgtccggccctaccagacaatgagcaaccccatgagcaagttgacagtcttaaattcaatgcactcccattttattctggccgacaatggcactacaggcaagtatggcgccgaagtgaagttgcgtagacagctcgaaaagcatatcagcttacagaagatcaacactaggtgtctgcccttctttagcctggacagtcgcctgttttactctttttggggctcctgccaattggacagcgttgggattggtcagggcgtgcctgtggtggcactgatagtggagggggggccgaacgtgatcagcatcgtgttagaatacctaagggatacaccacccgtccctgtggttgtctgcgatggctctggacgggcatcagacatactggctttcggccacaaatactccgaggagggaggccttatcaatgagtcactcagagaccagctgctggtcaccatccagaagactttcacatatacacgaacgcaggcccagcacctatttattattttgatggagtgcatgaagaaaaaggagctcataactgtgttcagaatgggcagtgaaggccatcaggatattgatcttgctatcctgacggcactacttaagggagccaacgcatccgcgccagaccagctgtccctcgccttagcgtggaacagagtcgacattgcccggtcacagattttcatctacgggcaacaatggcccgtcggctcacttgaacaggccatgctggacgccctggtcctcgacagagtcgactttgttaagctgctgatcgaaaacggagtttccatgcatcggtttctaaccatcagcaggttggaagaactttataatacccggcatggtcctagcaatacattgtatcacctggtcagggacgtgaaaaaaggaaatctgccaccagactatcggatatcccttattgatatcggactggtgattgagtatctgatgggcggggcttatcgctgcaattacactcgtaaaagattccggactctgtatcacaaccttttcgggcctaaaaggcccaaagctctgaagttgcttgggatggaggatgatattcccctgaggcgggggaggaagactaccaagaaaagggaggaagaggttgatatcgatcttgacgacccagaaattaatcattttccgttcccgtttcacgagctcatggtgtgggccgttcttatgaagcgccagaaaatggcattgttcttttggcagcacggcgaggaggccatggccaaagcactggtggcctgtaagttatgcaaagcaatggcgcacgaggcatccgagaatgatatggtggatgatattagccaggaactgaatcacaacagtagggatttcggccagttggccgtcgaactgctggaccagtcttacaaacaagatgagcaattggccatgaagcttctgacctacgagttaaaaaattggtccaatgcaacctgtcttcaattagctgtcgctgcaaagcaccgcgattttattgcgcatacatgtagccagatgctgctgacagatatgtggatgggtaggctacgcatgaggaaaaacagtggtctcaaggttattctcggcattttgttgccaccatcaatattaagcctggaatttaaaaacaaagacgatatgccatacatgagccaagcacaggagatccacttacaggagaaagaggccgaggagccagagaaacccacaaaggaaaaggaagaggaggatatggagctcacggccatgttgggcagaaacaacggggagtcctcccgtaagaaggacgaggaggaggtgcagtctaagcatcgtctcatacctctgggccggaagatttatgaattctacaacgcgcccattgtcaaattttggttttacaccctggcgtacatcggctacctcatgctgttcaactacattgttctcgtcaaaatggaaaggtggccgtccactcaggagtggatagtcattagttatatctttactttaggcatcgaaaaaatgcgggaaatcctgatgagcgagccaggaaaactgctgcagaaggtcaaggtctggttgcaggaatattggaacgtgaccgacttgattgctattcttttattctccgtggggatgattttgcggctccaagatcaaccttttaggagcgacgggcgagtgatttactgtgttaatataatttactggtatatccggctcttggatattttcggtgtgaataagtacctcggcccgtatgtgatgatgatcggaaagatgatgatagacatgatgtactttgtgatcatcatgctggtggtgctgatgagtttcggagtggccagacaggccatattgtttcccaacgaagagccatcatggaaactggcaaaaaatatcttctatatgccttattggatgatctacggtgaggtgtttgctgaccaaattgatccaccctgtggtcagaatgaaacccgagaggacgggaaaattattcagctaccaccctgcaaaaccggcgcatggattgtgcctgctatcatggcatgttatctcctcgtggcaaatatcttactcgtgaatctcttgatcgcagtgttcaacaatacattttttgaagttaagtccatcagtaaccaggtgtggaaattccagaggtaccagttgatcatgaccttccacgagcgacctgttctgccacccccccttataatttttagtcacatgaccatgatttttcagcacctttgctgtcggtggcggaagcacgagtctgacccggacgagcgggactatgggctaaagttgtttatcactgacgacgaactgaaaaaggtgcacgacttcgaggaacagtgcatcgaggagtactttagagaaaaagatgaccgcttcaactcaagtaacgacgaaaggatccgcgtgaccagtgaaagggtcgagaatatgtctatgagactggaggaggtgaatgaacgggagcattcgatgaaggcctctcttcagactgtggatataaggctggcccagctagaagatctgataggtaggatggcaacagctctggagcgtctcacgggcctagaacgggctgagtccaataaaatccgttcgcggacctcttctgactgcacagacgcagcgtatatcgtgcgccaatctagttttaatagccaagaaggcaatactttcaagctgcaggagtccatcgatccagccggagaggaaaccatgtctcccacaagtcctacgctgatgcctcgaatgagaagtcactctttttactccgtcaatatgaaggataagggtggtatcgagaagctggaaagtatctttaaggagagatccctgagcttacaccgggccacatcttcgcattccgtggccaaagaaccaaaggctcctgcagcccccgcaaatacactagctattgttccagattcccggcggccctcgagctgtattgatatctacgtttcagccatggacgagctgcactgcgacattgaccctctggacaacagtgttaacatactcgggctaggcgaaccgtccttttccaccccagtgccctctaccgctccctcatcaagcgcgtatgcgacgttggcgcctacagatcggccaccttcccgctcgatcgactttgaggatatcacaagtatggacacccggtccttttcaagtgactatacccacctgccagaatgccagaatccatgggactcggagcccccaatgtatcacaccatagagagaagtaagagcagtcggtacttggcaactacgccttttctgctcgaggaagcaccaatcgtgaagtcccattctttcatgttttcaccttctcggtcttactatgccaacttcggcgtgccagtaaaaactgccgaatatacttccataaccgactgtatcgacacccggtgcgtcaatgcgccacaggcaattgcggaccgagctgcattcccaggagggctaggagacaaggttgaagatctgacatgttgtcatcctgagcgcgaagcggagctaagtcatccatcttctgatagtgaggaaaacgaggccaagggtagacgcgccacgatcgcaatctctagtcaggaaggcgacaacagcgaaaggacgctgagtaataatattactgtgcctaagattgagcgagctaattcttactccgcggaggagccctctgccccttacgcgcacacacgcaaatctttctctatttctgataaattagatcggcagcgtaataccgccagtctgagaaatcccttccagcggagcaagagcagcaagcctgaaggacgaggcgatagcttatctatgagacggctgtccaggacttcagcatttcagtcttttgaatctaagcacaattag

SEQ ID NO: 209221 - DNA, 645 bp, Artificial Sequence
  Description of Artificial Sequence: Synthetic coding sequence
atgtacgtgcgggtgagcttcgacaccaagcccgacctgctgctgcatctgatgaccaaagaatggcaactagagttgccaaaactgctgatttcggtccatggaggcttgcagaatttcgagctccaaccaaagctcaaacaggttttcggcaaagggttgataaaggctgcaatgaccacaggtgcttggatctttacaggaggtgtcaacactggagtaatccggcacgtgggggacgcgctgaaggatcacgcctcaaagagccgaggcaagatttgcactatcggaattgctccctgggggattgttgagaaccaagaagatctcatcgggcgagatgtggttcggccataccagaccatgtcaaatcctatgtccaaactgacagtgctgaattctatgcacagccatttcatcttagctgataacggcaccaccggtaaatatggggctgaggtcaaactcaggcgccagctagagaagcacatcagcctccaaaagatcaatactagctttcactcatataaaactgcccatgtagacttacaggacaaacgtcaagtaaaaacagcacttgaacaggctgaatggcagcccggtagaggaatgttcgaccatgacaatctaatgcaaagcacatag

SEQ ID NO: 209222 - DNA, 3645 bp, Artificial Sequence
  Description of Artificial Sequence: Synthetic coding sequence
atggtggtgcccgagaaggagcagagctggatccccaagatcttcaaaaagaagacatgtactacatttatcgtagactctaccgacccagggggtactctgtgccaatgcgggcgtccccgcactgctcaccctgcagtggccatggaagacgctttcggcgcagccgtcgtgactgtctgggattcagacgcacatacgacggagaaacctaccgacgcttacggagagttggacttcactggagctgggagaaagcactctaatttcctacggctttccgacagaactgaccccgcagcagtgtactccctcgtgacaagaacttggggattcagagcgccaaacctggtcgtttccgtactgggcggcagcggtggtcccgttctgcagacttggctccaggatctcctacggcgaggcctggtgcgcgccgcacagtcaacaggcgcctggattgtgaccggcggattgcatacagggatcgggaggcacgtcggcgtggcagtgcgcgaccaccagatggcaagcaccgggggcacaaaagttgtggctatgggcgtggcaccctggggagtggttagaaatcgggacaccttgattaaccctaagggatcatttcccgcacgatacaggtggcgcggggatccagaggacggtgttcaattccctctagactataattatagcgccttcttcctggtcgacgatggaacacatggctgtctagggggagaaaatcggtttcggttgcgcctggagagctatatcagccagcagaaaactggagtcgggggtaccgggattgatatccctgtgttactcttattgatcgatggtgacgaaaagatgctcacaagaattgaaaatgccacacaagcgcagctaccgtgcctcctggtcgctggcagcggcggcgctgccgattgtctggccgaaacgctggaagataccttagcaccaggaagcggcggcgcgagacagggcgaagccagagatagaattagacgctttttccccaaaggggacctggaggtcttgcaggcccaggtcgagagaattatgacgaggaaagaattgcttacagtgtactcttctgaggacggttcagaagaatttgaaacaatcgtattgaaagccctggtcaaagcttgtgggagtagcgaggccagcgcctacctggatgagctgagactggcggtcgcttggaatagggtagacatcgcccagtctgagttgttccggggggatattcagtggcgtagcttccatttggaggcatccctgatggacgcactactcaatgatcggcccgaatttgtccgcctgttaatctcccatggactgtcactggggcattttctgactccaatgagactggctcagctttatagtgctgcaccctcaaactccctcatccggaatctgctggatcaggcctcccactcggccggcaccaaagcaccagctctgaagggaggcgctgccgaactaaggcctccagacgtgggccacgttctgcgcatgctcctcggcaagatgtgcgcccccagatatccttcagggggcgcatgggacccccaccctggccaagggttcggggaatccatgtatctcctcagcgacaaagccacctctcccctatccttggatgcaggactgggtcaggctccttggtcagacttacttttgtgggccttgttgctgaatagagcacagatggctatgtacttctgggagatgggaagcaacgcagtgtctagtgccctcggtgcatgcctcctgttgagagttatggctcgtttggaacctgacgccgaagaagcagcgcgtaggaaggacctggccttcaagttcgaaggtatgggcgttgatttgttcggagaatgctacaggtctagcgaggtgcgagctgcgaggcttctcctgagacgctgcccactttggggtgacgccacctgcctgcagcttgccatgcaggctgatgctagggctttctttgctcaagacggcgttcagtctttgttgacacaaaaatggtggggagacatggcgtctacaacgcccatctgggcactggtgctggcatttttctgtccccccctcatttacaccaggttgatcacgtttcgaaagtccgaggaggagcctacccgggaggagctggagttcgacatggactccgtgattaatggtgaaggcccggtcggaactgcggatcccgcggagaaaacccctctcggggtccccaggcaatcaggtcggccgggatgctgcggcggacggtgcggggggcggagatgtctgcgccggtggtttcatttctggggcgcacccgtcactatttttatgggtaacgtcgtgtcctacctgctttttctactgttgtttagtagggtgctgttggtggatttccagcccgcccctcctggctccttagagctgttactatacttctgggcatttacacttctttgtgaagaacttcgccaggggctctcgggaggtggcggttcactagcatcaggcggacccggcccgggccacgcatcattgagccagcggttgaggctttacctagcagattcttggaatcagtgtgacctcgtcgccctgacatgttttctgctgggggtcggttgccggttgactcctgggctgtaccatctaggacgcacagtgctgtgtatcgactttatggttttcaccgtaagattgctacacatttttaccgtcaacaaacagttgggtccaaagattgtcattgtgtccaagatgatgaaagatgtcttctttttcctgtttttccttggggtctggttggtcgcatacggcgtggctacagagggactgctgcgcccacgggatagcgattttccctccatcctgcgccgcgtgttttatcgaccctacctgcaaatctttggacagattccgcaggaggacatggatgtggccctgatggaacacagcaattgttcctccgagccagggttctgggcccatcctcccggggcacaggctggaacttgcgtatcgcaatacgccaattggctcgtggtgctgctgctggtaatctttcttctcgtagccaacatccttctcgtcaatctgctaatcgctatgtttagctacacttttgggaaggtgcagggaaactcggatctgtactggaaagctcagcgttatcgtctcattagagagtttcacagccgcccagcgttggccccccccttcattgtgatttcacacctgagactgctcctaagacagctgtgtagacggcctcggtcaccacagccaagcagtcctgcactcgaacactttcgtgtctatctttctaaggaggcagagcggaagctgctcacatgggagtctgttcataaagagaacttcctgttggccagagcgcgcgataaacgtgaaagcgatagtgagcgtctgaaaagaacatcccaaaaggtggatctggctctgaaacaattgggccacattagggaatacgagcagcgcctgaaggttctggagcgcgaagtgcagcaatgctctcgcgtgcttggttgggttgctgaagccctcagccgctcagcacttctgccacctgggggccctcctccccccgatctgcctgggagcaaggactag

SEQ ID NO: 209223 - DNA, 2583 bp, Artificial Sequence
  Description of Artificial Sequence: Synthetic coding sequence
atgctgacccggatcgagaacgccacccaggcccagctgccctgccttctggtcgcagggtccggaggcgcagcggattgtctggcagagactttagaagatacacttgccccaggatccggaggagctagacagggcgaagccagggacagaatccggagatttttccctaagggtgatttggaggtgcttcaggctcagagtttccatcttgaggccagtttgatggatgctctgcttaacgatcgccccgagtttgtgaggctgctgatctcccatggtttgtcactcggtcacttcctgacgcctatgcgactggctcagctgtatagcgccgcaccgtctaatagtcttatcagaaatctgctggaccaagcgtcgcatagcgccggcaccaaagccccagcgttgaaagggggcgccgcagagctcagacccccagatgtcgggcacgtcttgaggatgttactgggcaagatgtgtgctcctcgctatccaagcggtggagcttgggacccacatcctggccaggggttcggtgagtccatgtatttactcagcgataaagctacctcacccctttcgcttgacgccggcctcggccaagccccgtggagcgacctcctgctttgggcactgctcttgaaccgggcgcaaatggcaatgtatttctgggagatggggagcaatgcagtctccagcgccttaggagcctgtctgctgcttcgcgtgatggcgcgcctggagccagacgccgaagaggctgctcggcggaaggatctggcgttcaagtttgaggggatgggcgtagacctgttcggggaatgctatcgctctagtgaagtgagagcggcgagacttcttctcaggagatgcccactttggggagatgccacctgcctgcagcttgccatgcaagcagatgctagagctttttttgctcaggatggggtccagtctctactgactcagaagtggtggggggacatggcctctaccacccccatatgggcccttgtgttagctttcttctgcccccctctcatatacacacgactgataaccttcaggaagtcagaagaagaaccaacgcgtgaagagctggaattcgatatggacagcgtgatcaacggcgagggacccgtcggcaccgccgatccggccgaaaagactcccttaggcgtgccacggcagtcgggaaggccagggtgttgcgggggaagatgcgggggcagacgttgcctgagaagatggttccatttctggggagctccagtcactattttcatggggaacgtggtgtcctatctactcttcctcctactattcagccgcgtcctattggtagacttccaaccggcccccccaggttctttggagctgctgttatacttctgggcattcactctgttgtgcgaggagctgaggcaaggcctgagcgggggggggggctcactagcttccgggggccccggtcccgggcatgcaagtctgtcccagcgactgaggctctatctggcggacagctggaatcaatgtgacctggtagcgctaacttgctttctcctgggtgttgggtgtcgccttacccctgggttgtaccacctcggtcgcacagtcctgtgtatcgactttatggtcttcaccgtgagactgttacacatcttcaccgtcaacaaacaactgggcccaaaaatcgttattgtttcgaaaatgatgaaagacgtgtttttttttcttttttttctaggagtgtggttggttgcttatggtgtggcgactgaaggtctgctgagaccaagagactccgacttcccatcgattttaaggagggttttttaccgcccatatctgcaaatattcgggcaaatcccacaggaagacatggacgttgccctgatggagcactctaactgcagctcagagccgggattctgggcccaccctcccggcgcacaggcgggcacctgtgtgtcgcagtatgccaactggctcgttgtcctgctcctggtcatttttctgctggtggcaaatattctcctggtgaatctgctcatcgcgatgtttagctatacgtttggtaaagtacaagggaacagtgacctgtactggaaggcccaacgatacagactaatcagagagttccactcaagaccagcccttgcacccccttttatcgttatctcacatctccgcctgctcctgcgacagctgtgtcgacgcccccggtcccctcaaccctctagcccagcactggagcacttccgtgtatacctatcaaaagaggcggagcgcaaactgctgacttgggaatcagtgcataaggagaacttcctgctggcacgggcaagggacaaaagggagtccgatagcgagcggttgaagaggacctcacaaaaggtggacctcgctctcaagcagctggggcatattagggagtacgaacagcggctcaaagttctggaaagagaggtgcaacaatgttccagagttttgggatgggtggctgaggcactgtcccgcagcgcactcttaccccctggggggccccctccacctgaccttccgggttctaaagattag

SEQ ID NO: 209224 - DNA, 3210 bp, Artificial Sequence
  Description of Artificial Sequence: Synthetic coding sequence
atggtggtgcccgagaaggagcagagctggatccccaagatcttcaaaaagaagacctgtacaactttcatagttgatagtactgacccaggaggaaccctgtgtcaatgcggcagaccccgaactgcacaccctgcggtggcaatggaggatgcatttggagccgctgtcgtgaccgtgtgggattccgacgcccacaccaccgaaaaacctactgacgcctacggagaactagacttcaccggcgctggacgcaagcattccaattttttgaggctgtcagaccgcacagatcctgcagccgtgtacagtctggtgacaaggacgtgggggtttcgcgcccctaacctggtggtatcggtgctgggcggctctgggggtccagttctccaaacctggttacaggaccttttaaggagaggccttgtccgggccgcccagagcactggagcatggatcgtcacaggaggcctccataccggcattggcagacacgtgggggtcgccgtaagggatcaccagatggcttctacaggcggaacaaaggtggtcgccatgggagtggcgccctggggagtggtccgaaatcgtgacacgctgataaaccctaaaggtagtttccccgcgcgctaccgctggcggggtgatccagaggacggcgtccagttccccctggattataactacagtgcatttttcttagtggacgatggcacccacggatgcctgggcggcgaaaatagattccgactgcggcttgaatcttacattagtcagcaaaaaacaggggttggaggtactgggattgacatccccgtgctgcttctcctgatcgacggcgatgaaaaaatgctgacacgtatcgaaaatgctacccaggctcagctgccttgcctgttggtggctggatccggcggggcagctgactgtcttgcagaaaccttggaggacactttagctcccgggtccggcggagcccggcagggcgaagctcgggaccgcattcgcaggttcttcccaaaaggagaccttgaagtgctgcaggctcaggtggaaagaatcatgaccaggaaggaactcctgaccgtttatagttcagaggatggttccgaagagttcgagacaattgtgctgaaggccctggttaaggcatgtgggagctcagaggcttcagcctacttggatgagctgaggttagccgtcgcatggaaccgggtggacatagcccaatcagaactgttccgcggcgacatacaatggcgaagtttccacttggaagcatcgctcatggatgccctgctgaacgatagacccgagttcgtgaggctccttatttcccatggtctgagccttggacactttcttacccctatgcgtctggcgcagctatacagcgctgcgccctctaacagtctcattcgtaatctgctggatcaggcttctcattcagcagggacgaaggcgccagcgctcaaaggaggtgccgccgagctcagacccccagacgtgggacatgttctcaggatgctgctgggcaagatgtgcgcccccagatatccatccgggggagcatgggacccccaccctggacagggctttggcgagagcatgtacctcttaagcgacaaggctacaagtccgctatccttggacgctggactgggccaggccccatggtcagacctgttgctttgggcactgttgttgaaccgcgctcagatggcgatgtacttttgggaaatgggctctaatgccgtttcaagcgcgctgggggcatgcctgttgcttcgggttatggcaaggctcgagcctgatgcagaggaggcagcacggagaaaagacctggcctttaagttcgaaggcatgggggtagacttgttcggcgagtgttatagatcctctgaggttagggcggcacggcttttactgcggagatgccctctgtggggggacgccacctgtcttcaattggctatgcaagcagatgctagggcctttttcgcccaggatggcgtccagagccttctgacccagaagtggtggggtgacatggcctctactaccccaatttgggcactcgtactggccttcttttgcccccccctgatctacacccggctgattactttccggaaatcagaggaggagccaacccgggaagagctggagttcgatatggacagtgtcatcaacggagaaggtcccgtgggcctgacgcccggactttaccacctggggcggactgtcctctgcattgattttatggtgttcaccgttaggctgctccacatcttcactgtgaacaaacagctcggacctaagatcgtgattgtctcaaaaatgatgaaagatgtctttttttttctgtttttcctcggagtatggttggtcgcatacggcgtagccactgagggtctgctcaggccaagagatagtgatttcccctctatcttgcgcagagttttctaccggccctatctgcagatttttggccaaatcccacaggaggacatggatgtggcactgatggaacattccaactgtagcagcgagccagggttttgggcgcaccctccaggcgcccaagccggtacttgcgtcagtcagtatgccaattggctagttgtgctgttgcttgttatatttctgttggttgcaaatatcctgctagttaatttgttaattgcaatgttttcatataccttcggcaaggttcagggtaactccgacctgtactggaaagctcagaggtacagattgatccgagaattccacagccggcctgcactggcacccccctttattgtcataagtcacttgaggctcctcctgcggcagctctgtaggcggcccaggtctccgcagccaagcagcccggcgcttgagcattttcgcgtatacctctctaaagaggcagagcgtaagctgctcacctgggaatccgtgcataaagagaacttccttctggccagagcgagagacaagcgggagtccgattcagaaaggttgaagcggaccagtcagaaggtggacctggccctcaagcaactgggccatatccgtgaatatgagcagaggcttaaggtgctggagagagaagtgcagcagtgtagccgcgtgctagggtgggtagctgaggctctgtcccggtccgccctcctccccccaggcggaccacccccacccgatctcccaggctcaaaggattag

SEQ ID NO: 209225 - DNA, 3498 bp, Artificial Sequence
  Description of Artificial Sequence: Synthetic coding sequence
atgcaggacgtgcagggcccccggcccggcagccccggcgacgccgaggaccggagagagctgggacttcataggggggaggtaaacttcgggggctccggtaagaagcggggcaagtttgtgcgtgtgccatcaggggtcgccccgtccgtccttttcgatcttttactggcagagtggcatctgccggcacctaacctagtggtatccttggttggagaggaacaacccttcgctatgaagagttggctccgcgatgtgcttcgtaaaggattggtaaaagccgcgcagagcactggtgcatggatactgactagcgccctacgcgtgggcctggcccgccatgttggccaggcagtgcgggaccattctctcgcctccactagcactaaggttcgggtggtggcggttggaatggcctctttgggaagggtgttacataggcgaatcctggaagaggcccaggaggactttccagtgcactaccccgaagacgatgggggaagccaggggcctctttgttctctggactctaacttgtctcattttattctggtcgagccaggaccacctggcaaaggggacggcctgaccgaactacgcctgaggctggagaaacatatttccgagcagagagctgggtacggaggtaccggatcaattgagatcccagttctttgccttctagtcaatggtgacccaaacacacttgaacggatctcacgggcagtcgaacaagcagccccatggctgatacttgtgggaagcggtggtatcgcagatgtcctggccgcactggtaaaccagcctcatttgctggtccccaaggtcgcagagaagcagtttaaggagaagttcccctccaaacatttctcttgggaggacattgtgcgctggaccaagcttctgcagaatattacatcccatcagcatttacttacagtctacgacttcgagcaggagggcagtgaagaactggatactgtgatcctaaaagccttggtcaaagcctgtaagtcgcattcgcaggagcctcaggactacctcgacgagctcaaactcgccgtggcttgggaccgagtggacatcgccaagtctgagatctttaatggagacgtcgagtggaagtcttgcgacctcgaggaggtgatggtcgatgcattggtgtccaacaagccagaattcgtgcgtctcttcgtcgacaatggtgcagacgtggccgactttctcacatatggaaggctgcaggagctgtatcgcagcgtgtctaggaaatccttattattcgacctcctgcaacgaaaacaggaggaagctagactgactctcgcaggcctcgggacccaacaggcccgggaaccacccgccggccctccggccttctcgctccatgaagtttcccgggtgttgaaggacttcttgcaggacgcgtgcagaggcttttatcaggatgggagacccggcgaccgccggcgggccgaaaaaggcccggccaagagacctactggacaaaaatggctgctggacctcaaccagaaatccgaaaatccctggagggatctgtttctctgggccgtgttgcaaaacagacatgaaatggctacttatttttgggccatgggtcaggagggggtggcagctgcccttgctgcctgcaaaatactgaaggaaatgagtcacctggagaccgaggccgaggctgctagggctaccagggaggcaaaatacgagcgtctggctcttgatctgtttagtgagtgctacagcaacagcgaagcccgagcctttgcactactcgtccggaggaaccggtgttggagtaagaccacctgccttcacttggcaactgaggccgacgctaaggccttttttgctcatgatggagtccaggcattcttgacgcgcatttggtggggcgacatggccgctggaactcccattctgagactgcttggagccttcctgtgcccggccttagtgtacacaaacttgatcaccttcagtgaggaagccccactgcgtacaggtctcgaggacctccaggatctggactctctggacacggagaaatcacccctgtacggcctgcaatcccgggttgaagaactggtggaggctccgcgcgcccaaggggatagaggccctcgagcagtcttcctgctgacaagatggagaaagttttggggggcaccggtcacggtgttcctgggcaatgtcgttatgtacttcgcattcctctttctctttacatatgtgctcctcgtggactttcgaccacccccgcagggcccatccggtcctgaggttaccttgtatttctgggtgtttactctggttctggaagagatccgccaggggttcttcacggacgaggatacccatttggtcaagaaattcacattgtatgtcggcgacaactggaacaaatgcgacatggtagctatattcctgttcattgtgggtgtgacttgcaggatgttgccatccgcttttgaggcaggtcggaccgtgctggcaatggactttatggtctttactctgaggctgatccatattttcgccatccataagcagctgggaccaaaaataatcgttgtggagcgaatgatgaaggatgtcttttttttcttgttctttctctcagtctggcttgtcgcttacggcgttacaacgcaagccctcttacacccccacgacggtagacttgagtggatctttaggcgggttctataccgcccctacctccaaatctttggccagattcccctggacgaaattgatgaagctagggttaactgttccacgcaccctttgctactggaagattcacctagttgtccatctctgtacgcaaattggcttgtgatcctgctgctagtaaccttcctgttggtgacgaatgttttattgatgaatttgttaatcgccatgttctcctacaccttccaggtcgtgcagggcaacgccgacatgttctggaagtttcagaggtacaacctaattgtggaatatcacgaacgtcccgcactcgcccccccctttatcctcttgtcacacctttccctcacgcttagacgcgtatttaaaaaagaagctgagcacaaaagagagcacctggagcgggacctgcccgatccattggaccagaaggttgtgacatgggagactgtccagaaagaaaattttctgagtaagatggagaaacggaggagagattccgaaggggaagtgctcaggaaaacggcacatagagttgacttcatcgctaagtatcttgggggactcagggagcaggagaaacgaatcaagtgtttagaatcccaaattaactactgctctgtgcttgtctcaagtgttgcagatgtgctggcgcaagggggcggaccacgaagcagtcagcactgcggagagggcagccagctggtggcagccgatcaccgcggcggattggatggctgggagcagcccggcgccggccaaccaccaagcgacacatag

SEQ ID NO: 209226 - DNA, 2619 bp, Artificial Sequence
  Description of Artificial Sequence: Synthetic coding sequence
atgcaggacgtgcagggcccccggcccggcagccccggcgacgccgaggatagacgggaattgggtttgcatagaggggaagtcaacttcgggggatccggaaagaagaggggaaagttcgtgcgagtgccgagcggggttgcaccttctgtgctgtttgaccttcttttggctgagtggcacctaccggccccaaacctagtggtgtctctggtgggagaggaacagcccttcgccatgaaatcttggttacgggatgtactgcgtaaggggctggtgaaagctgcccagtccactggcgcgtggattttgacctccgccttacgggttggactggctagacacgtgggacaggcagtgagagaccacagcttagccagcacttccactaaggtgagggtcgtggcggtcggtatggcttctctgggccgcgtacttcacaggagaattctcgaggaggctcaggaggacttcccagtgcattatcccgaggatgatggggggtctcaaggccctctctgtagcttggactccaatctctcacacttcattctcgtggaacctggcccacctggtaagggagatgggcttaccgaactgcggctcaggctcgaaaagcacatcagtgagcagcgcgccggctacggcgggaccggatccattgagatcccagtactatgtctcctagtgaatggcgatcctaatactcttgagagaattagccgggctgtggaacaggccgctccatggctgatcttggtcggaagcggcggtatcgctgatgtgctggctgccttggtcaatcagccccacctgcttgtgccgaaggtagctgagaaacagttcaaggaaaaattcccctctaagcactttagttgggaggacatcgtgaggtggacaaagttgctgcagaatatcacttcccaccagcacctgcttacagtctacgatttcgagcaggagggtagtgaggaactagatacagtgattctgaaagccctggtgaaggcctgtaaatcccatagtcaagagccacaagattacctggatgagctgaagttagcagtggcttgggatagagtggatattgccaagtctgagatcttcaacggtgacgtggagtggaagtcctgcgacctggaagaggtcatggtggacgccctcgtgtcaaataagccggagtttgttcgactgttcgtagataatggagcagatgtcgcggactttttaacatacggtagacttcaggaactttacaggagcgtgagcaggaaaagtctgctgttcgacctgctgcagagaaaacaagaagaggccagactaactctggccggactgggaacacagcaggcaagggagcctcccgcgggaccccctgccttcagtctgcatgaggtaagtcgagttttgaaagattttctgcaggacgcttgtagaggattttaccaggacggccgacctggcgaccgcagacgggccgaaaaaggccccgcaaaacgcccgacggggcagaaatggctgctagacttgaaccagaagagcgaaaacccctggagagatcttttcctgtgggcagtgctgcaaaaccgccatgagatggccacgtatttctgggcgatgggacaggagggggtggccgcagccttggctgcctgtaaaattttaaaagagatgtcacacctcgagacggaagccgaggcagcgagagccactagagaagccaaatatgagaggttggctttagacctgttctctgagtgctattcaaactcagaggctagagccttcgccttgctggtacggcgcaacaggtgctggtcgaagaccacctgtttacacctcgcaacagaggcagacgccaaggcttttttcgcccatgatggagtccaagcgttcctgaccagaatctggtggggtgacatggcggccgggaccccaatcctgaggcttttgggcgctttcctgtgtccagctttagtgtacaccaatctgatcacatttagtgaagaggcgccgctgcgcactggtctcgaggaccttcaggacctcgactcgctggacaccgagaagtcacccctgtatggtctgcagagcagggtggaggaactagtggaggctccgcgcgctcagggtgatcgcggtccccgagctgtgttcctccttacaagatggcgtaagttttggggagcgcccgtcacggtgttcctgggcaatgtagtcatgtattttgcctttttgttcctgtttacttacgtgttgttggtggacttccggccgcctccacaggggccgtcaggcccggaagtgacgctatatttctgggtattcacacttgtactggaggagattagacaggggttcttcactgatgaagacacgcacctggtcaagaaatttacactctatgttggcgataattggaataagtgtgacatggtggccatctttctgtttatcgtaggagttacatgcagaatgttacctagcgcgttcgaggccggacggacagttctggctatggacttcatggtattcaccctgaggctgattcacatctttgctatccataaacagctgggtcccaaaataatcgttgtagagagaatgaagccagtatag

SEQ ID NO: 209227 - DNA, 3504 bp, Artificial Sequence
  Description of Artificial Sequence: Synthetic coding sequence
atgcaggacgtgcagggcccccggcccggcagccccggcgacgccgaggacaggagagagttgggcttgcaccggggcgaggtcaatttcggcggatccggtaagaagcgcggtaaattcgtgcgggtgccctctggcgtcgcaccatcagtattgttcgacctactgttggccgagtggcacctgccagcccccaaccttgtcgtctctctggtgggggaggagcagccttttgcgatgaagagctggctaagggacgtgctacggaaaggtttggtgaaagcagcccaaagcacaggcgcttggatattgacgtccgccctgcgcgttggtttagcgagacatgttgggcaggctgtgcgggaccactctctggcaagtacatctacgaaagtccgagtcgtggccgttggtatggcctcgctgggtagagttctgcatagacggatcttggaggaggcacaagttcacgaggacttccccgtacactacccagaggatgatggcggctcccaggggccactctgctccctcgactcaaacttatctcactttatcttagtcgagcccggcccaccaggaaagggagatggcctgaccgaactccggttgagactggaaaaacatatttctgagcagagagccggctacgggggtacgggatccatcgaaatccctgttctatgcctactggtgaacggcgaccccaatacactggaacggatctcaagggctgtggagcaagcagctccttggctgattctcgtcggaagtggcggcatagccgatgtgctggctgcactggtgaatcaaccgcatctcctagtacccaaggtggccgagaaacaattcaaggagaaatttccatccaagcatttctcctgggaggacattgttcggtggactaaacttttacagaatatcacaagtcaccagcacctcctgaccgtttacgatttcgaacaggaggggtcagaagagctggacacggtaattttgaaggctctggtgaaagcttgcaagtcacattctcaggaaccccaggactatctcgatgaactcaagctcgcagtcgcttgggatagagttgacatagcaaagtcggaaatcttcaatggcgacgttgaatggaagtcctgtgatctcgaggaagtcatggtcgatgccctcgtgtcaaacaagcccgaatttgtcagactgtttgtggacaatggggccgatgtagcagacttcctcacctatggtaggctgcaggagctgtatcggtctgtcagccgtaagtccctcttgttcgacctcctgcagaggaagcaggaggaagctcgactgaccctggccggactcggcacgcagcaggctcgggagccgccagctggacctccagccttctcactacacgaggtgagcagagtgctcaaggatttcctgcaggatgcctgcaggggtttctatcaggatggccgtcccggcgataggcggagagcagagaagggtccagccaaaagacccacaggtcagaagtggctgctcgaccttaatcagaagtcagagaacccatggagagatctcttcctgtgggcggtccttcagaacagacacgagatggctacttacttttgggcaatgggtcaagaaggggtggcagctgctctggcggcttgcaaaattctcaaggagatgtcccacttggaaaccgaggctgaagccgcccgggccacacgggaagcgaaatacgagcgtcttgccctggatctattttcggagtgttatagtaacagcgaggcccgggcattcgcgctgctagttcggcggaaccgctgctggagcaaaacgacctgcttgcatcttgctactgaggcagacgctaaggcctttttcgcccatgacggcgtacaggcattcctcactcgaatctggtggggtgacatggctgctggaacccccatcctgcggttactgggcgcctttctgtgtcccgcattagtgtacaccaatctgataacgttttctgaggaggctccactgcgaaccggtctcgaggacctgcaggacctcgatagcctcgacacagagaaaagtccactgtacgggctccagtctcgagtggaagaactagtggaggcgccccgcgcccagggcgaccgcggaccacgagctgtgttcctcttgacgagatggcgcaagttttggggggcaccagtgacggtcttccttggaaacgtggtgatgtattttgcattcctgtttttatttacctacgtcctactggtcgactttcgcccgccaccccagggtccctcaggccctgaggtgactctatacttctgggtcttcactctggtcctggaggagataagacaggggtttttcacagacgaagacacacacctcgtgaaaaagtttacgctctatgttggggacaattggaataagtgcgacatggtcgcaatctttctttttatcgtaggggttacatgccggatgctgccatctgctttcgaagctggcaggaccgtgctggccatggacttcatggtctttactctgcgcttgatacatatcttcgcaatccacaagcaactcggtcccaaaattattgtcgtggaacgaatgatgaaggacgtgttttttttcctcttcttccttagcgtgtggctggttgcatacggggtcaccacccaggcccttctacaccctcacgacgggcgcctggagtggatcttcagaagagtgctgtatagaccgtacctgcagatcttcggacagattccactggacgagattgacgaggctcgggtgaactgctcgacacaccccctgctgcttgaagatagccccagttgcccctccctttacgctaactggttggtgatcctgcttctggttacattcctcttggttacaaatgttctgctgatgaacctccttatcgccatgttcagctacacattccaggtggtccagggcaatgccgatatgttttggaagttccaaagatataacctcattgtggagtaccatgagcgaccagctcttgccccgccatttattctcctcagccacctcagcttgactttacgccgggtcttcaaaaaggaggcagagcacaaaagagagcatttagagagagatctacctgaccccttggaccaaaaagttgtcacatgggagacagttcagaaagaaaacttcctgagcaaaatggaaaagcgccgccgggactccgagggcgaggttctccggaaaactgcccatcgagtagacttcattgccaaatacctgggaggccttcgggaacaggagaaaagaatcaaatgtctcgaatcccagatcaattactgtagcgtcctggtcagctctgtggccgatgtgctggcacaagggggagggcccagatcgtcccaacattgcggggagggaagccaactcgtcgccgccgatcacagaggagggctggatggctgggagcagccaggtgcaggccagcctccttccgacacctag

SEQ ID NO: 209228 - DNA, 3480 bp, Artificial Sequence
  Description of Artificial Sequence: Synthetic coding sequence
cccggcagccccggcgacgccgaggaccggcgggagctgggcctgcaccgcggagaggttaatttcggaggaagtgggaaaaagcgagggaagttcgtgagggtaccatcgggggttgctccgagcgtcctctttgatctgctgcttgcagaatggcatctgccagcaccaaacttggttgtttccttggtcggagaagaacagcctttcgctatgaagagctggctgcgggacgtgttaaggaagggtctggttaaggctgcccagagcacaggcgcctggatcctcactagcgcgctgagggtgggtttagctcgccatgtggggcaggccgttcgtgaccattccctcgcatctacaagtacaaaggttcgtgtcgtggctgtgggcatggctagcctgggtcgggtgcttcaccgtcggatactggaagaggcccaggttcacgaggacttccctgtacattaccccgaagatgacggaggttcccagggacctctttgttcactagatagtaacctgtctcattttatactggttgaacccggtcccccagggaagggcgatggcttgacagagctgaggttgcggctggagaagcacatcagcgagcagcgagctggttatggtgggacagggagcatcgagataccagtgctgtgcctgctggtgaacggcgatcccaacacactcgaaagaatcagcagagctgtggagcaggccgcgccgtggctcatactcgtaggctccggcgggatcgcagatgtactggccgccctggtgaaccaaccacacctcttggttccaaaagtggctgagaagcagttcaaggagaaatttccatcaaaacacttcagttgggaggatattgtgcggtggacgaaacttttgcaaaacatcacatcccaccaacatcttctcactgtgtacgatttcgagcaggaagggtctgaagagctagataccgtgattctgaaagctctggtcaaggcttgcaagagccattcccaggagcctcaggattatttggatgagctgaagctggccgtcgcttgggaccgcgtcgatatcgcgaaaagcgagatattcaacggcgatgtggaatggaaaagctgtgacttggaagaggtaatggtggatgctttggtgtctaacaaacccgagtttgtgcgtctttttgtggacaacggtgcagacgtggccgactttctgacttacgggcgcctgcaggaactgtacagatcggtgtcaagaaaaagcctgcttttcgacctgttgcagagaaagcaagaagaggcacgcctgactttggctgggctcggcactcaacaggctagggaaccaccagccggaccgcctgccttcagccttcacgaagtgtctagggtgctgaaggacttcttgcaggatgcatgtagggggttttaccaggatggccgcccgggcgaccggcgacgtgctgagaagggccccgctaagagacctaccggccaaaagtggttgcttgatctcaatcagaaaagcgaaaatccttggcgtgatctctttttatgggcggtgctgcaaaacagacatgaaatggccacttacttttgggctatgggccaggaaggggttgctgcagcactagctgcttgcaagatccttaaggagatgtcacacctcgaaaccgaagctgaggccgctcgtgctacccgggaagccaagtacgagcggctggccctggacctgttttcagagtgttacagcaactctgaggcccgggcattcgccttgttggtgcggcgaaaccgatgctggagcaaaaccacttgcctccacctggcaactgaagcagatgctaaagccttctttgctcacgatggggtgcaagcctttcttaccagaatttggtggggggatatggccgccggaacgccaatcctaaggctgctcggggcattcctgtgccctgcactcgtgtatacgaatcttataacgtttagcgaagaagcgccgctcagaactgggctggaggatctccaggacctcgactccctcgacaccgaaaaatccccactgtacggcctccagtctagggtggaagaattagtcgaagcccctcgcgcccagggggacagaggccccagggcggttttcctcctaacccggtggcggaagttttggggcgctccagttacagtgttcctaggaaatgtcgtcatgtactttgctttcctctttttgtttacctacgttctgctggtggatttccggcctcccccacaggggccttctggccctgaagtgacactatacttctgggtgttcaccctggtcctcgaggagattcggcagggctttttcacggacgaggatacacacctcgtcaagaagtttacactgtacgtaggcgacaattggaacaagtgcgatatggtcgccatctttttgtttatcgttggcgtgacttgcaggatgttacctagcgccttcgaggcagggcggacagtgctcgccatggactttatggtgttcacacttcggctgatccatatatttgcgattcacaaacagttgggccctaaaataatagtggtagagagaatgatgaaagatgtattcttcttcctgtttttcctaagtgtgtggctggtggcgtatggcgtgaccacgcaggctctgctgcatcctcacgacggaagactagagtggatttttcggcgcgtactgtacaggccttaccttcaaattttcggacagatacctctggatgagattgatgaggcaagagtcaattgcagtacccatcccctgttgcttgaggactccccctcgtgcccctcactgtacgccaattggctcgtcatcctgctgctggtcacgtttctcctagtgaccaacgtattgcttatgaacctgctgatagccatgttcagctacaccttccaggtagttcagggcaacgctgacatgttctggaaattccagcgctacaatctgattgtggaataccacgaaaggccagcactcgctccaccttttattctactcagccacctttccctcactttgaggagagtgttcaagaaggaggctgaacataaacgggaacatctggaacgcgatctccctgaccccctcgatcaaaaggtggtgacatgggaaaccgtgcagaaggagaactttctctccaagatggagaaaaggagacgggatagtgagggtgaagtacttaggaagactgcccatcgtgtggactttattgcaaaatatctcggaggactgagagagcaggagaaaagaattaagtgcctcgaaagtcagatcaactattgcagcgtgctggtgtctagcgtagcagacgtgcttgcccagggcggggggccccgttcttcccagcattgtggagaaggaagccagctggtggcggctgatcaccgcgggggacttgatggatgggagcaaccaggtgcagggcaacctccatccgatacttag

SEQ ID NO: 209229 - DNA, 3402 bp, Artificial Sequence
  Description of Artificial Sequence: Synthetic coding sequence
atgctgcggccccaggtgaaggaggagatcatctgcatgatccagaacacgtttaatttttctctgaagcagagcaaacacctgtttcagatactgatggaatgtatggtccacagggattgtatcactatcttcgacgctgattccgaggagcagcaggatttggatctcgccatccttactgccctgttgaaaggcacaaatctttcagcatcagagcagctgaacctagctatggcctgggatagagtcgacatagctaagaaacatatccttatctatgagcagcactggaagcccgacgccctcgaacaggcaatgtctgatgcgctcgtaatggaccgcgtggatttcgttaagctgctcatagagtatggcgtaaatcttcacagattcctcacaatcccgagacttgaggagctgtataatactaagcagggtccaaccaatacactattgcaccatctcgtgcaagacgtgaaacagcataccctcctatcaggatatcgaataactcttatcgacatcggcctggtggtcgagtacttaatcgggagggcttataggtccaactacacccggaagcatttccgcgcattatacaacaacctttaccgcaagtacaagcatcagagacactcttccggcaaccggaacgaaagcgccgagtcgaccctccacagccagtttatcaggaccgcccagccttataaatttaaagaaaaaagcatcgtccttcacaaatcacggaaaaagtccaaggagcagaacgttagtgacgaccctgaaagcacgggcttcctgtacccatacaacgacctgctggtatgggctgtccttatgaagagacagaaaatggctatgtttttctggcagcacggtgaggaggccaccgttaaggcagtcatcgcttgtatactataccgcgcaatggctcatgaagccaaggagagtcatatggtagatgatgcaagtgaggagcttaaaaactactctaagcaatttggacagcttgcattagacttgcttgagaaagcattcaaacagaatgagcggatggcaatgaccctgctgacctacgagttgcgtaactggagcaacagcacgtgtctcaaactggcagtgagtggcggattgcggccgtttgtgtctcatacctgtacccaaatgctactgacagatatgtggatgggcaggctgaaaatgagaaagaacagctggctgaaaattattatatccattatcctcccaccaaccatcttgaccttggaattcaagtccaaggccgagatgtcccacgttcctcagagtcaggattttcagttcatgtggtattactccgatcaaaacgcttcatccagcaaggaatccgcatcggtaaaggaatacgacctggagcgcgggcatgatgagaagctggacgaaaaccaacattttggactggagtccggacatcagcaccttccttggacgcggaaggtctatgaattctactctgcacccatagttaaattctggttctatacaatggcctatctcgctttcctgatgctattcacttatacagtcctcgtggaaatgcagccccagccttcagtgcaggagtggctcgtctcaatttacatcttcactaacgctatagaggtcgttcgggaaatttgtatctcggagccagggaagtttacccagaaggttaaggtctggatctcagaatactggaatctgaccgaaaccgtggccatcgggctcttcagcgcaggtttcgttcttcggtggggcgatcctccctttcacacagcagggcgcctgatttactgcatcgacattattttctggttctcccgattgcttgatttttttgccgtgaatcaacacgctggtccttatgtgactatgattgctaaaatgacagctaatatgttttatatcgtgatcataatggcgattgtccttctcagcttcggggtagctcgcaaagccattctgagccccaaagagcctcccagttggagcttagctcgtgacatagtcttcgaaccatactggatgatttatggcgaagtgtatgctggggagatcgatgtatgcagttcccagcccagttgcccaccaggatctttcctgactccgttcttgcaggctgtgtatctctttgtgcagtacataataatggtaaatctgctgatcgcttttttcaacaacgtctacctggacatggagtctatcagtaataacctgtggaaatataatcgctatcggtacatcatgacttaccacgagaagccctggcttcccccaccactgattcttctgtctcacgtgggactgttgctgagacgcctgtgctgccacagagcgccacacgatcaggaggagggtgatgtgggtctgaaactttatctctcaaaggaagatctcaagaaactgcacgatttcgaggagcagtgtgttgagaagtatttccacgaaaagatggaagacgtaaattgttcatgcgaggagcggataagggtgacctccgaacgcgtaaccgaaatgtatttccagctgaaggagatgaacgaaaaggtgtcttttattaaggatagccttctgtctttggacagtcaagtgggacatctccaggatctctccgctctgaccgtcgatactcttaaggtgctgtcagcagtggacactctgcaggaggacgaggctctactggctaagcgaaagcactccacttgcaagaagttaccgcattcctggtccaatgtaatttgcgcagaagtcttagggtctatggaaatagcgggcgagaagaaatatcagtactattcaatgccctcgtcgcttctccgcagcctggccggcgggcgtcatccccctagagtccagcgcggcgccctcctggagatcaccaacagcaagagagaagccactaatgtccggaacgaccaggagcgccaggaaacgcagtccagcatcgtcgttagcggcgtcagtcccaacaggcaggcccattccaagtacggacaatttctgctggtcccctcaaatcttaagcgcgtcccattttctgcagaaactgtcctgccgctgtcccgaccgagcgtgcctgacgtgctggccacagaacaggacatacagacagaggtattggtccacttaactgggcaaaccccagtagtgtcagattgggcctctgttgatgagccaaaagaaaagcatgaaccaattgcacatttgctggacggccaggacaaggccgaacaggtgttgccaacattatcatgcacccctgagccaatgactatgagttctccactgaggaggtatcgcccatttgcaagatcccattcatttagatttcataaagaggaaaaacttatgaagatctgtaagattaagtcaaaagagtag

SEQ ID NO: 209230 - DNA, 912 bp, Artificial Sequence
  Description of Artificial Sequence: Synthetic coding sequence
atgaaggagcagcccgtgctggagcggctgcagagccagaagagctggatcaaaggcgttttcgacaagcgggagtgctcaaccataatcccctcttcgaaaaatccccacagatgcactccagtttgtcaagtgtgccaaaatctgataagatgttactgcggaagactcataggagatcacgctggaatcgactattcctggacaatctctgcagctaaaggcaaggagagcgagcaatggtcggtggaaaaacatacgaccaaatcaccgacagacacctttggcacgattaacttccaggatggcgaacatacccaccacgcaaaatacattaggacatcctatgatacaaagctcgaccatctgttacatcttatgttaaaggagtggaagatggaactgcctaaattagtaattagcgtccatggaggcattcagaatttcaccatgccgtccaaatttaaagaaatttttagccaaggcttggtcaaggctgccgagacgactggagcctggataattacagaaggaattaacactggagtgtcaaaacacgtcggagatgcactcaaatctcacagttcgcattctcttaggaagatctggactgtgggtatccctccttggggcgttatcgagaaccaacgggacctgatcggaaaggacgttgtgtgtctctaccagaccttagataatccactaagcaagttgacaaccctcaacagcatgcattcccacttcattctctccgatgacggaaccgtggggaaatacggcaacgaaatgaaattaagaaggaacctggagaagtacctaagtctgcagaagattcactgtcgagagtatcatcgggggtccgtaactcagagtggctgccggcctgccgaggtatttcacgggctgccatag

SEQ ID NO: 209231 - DNA, 6069 bp, Artificial Sequence
  Description of Artificial Sequence: Synthetic coding sequence
atgaaggagcagcccgtgctggagcggctgcagagccagaagagctggatcaagggggtctttgacaaacgtgagtgctccacaattatcccgtcatccaaaaatcctcatcgatgcacacctgtgtgccaagtgtgtcaaaatcttattcgctgttattgtgggcgcttaatcggtgaccacgcaggaatagactacagctggaccatctctgccgcaaaaggcaaggagtccgagcagtggtcagtggaaaaacatactaccaagagcccaacagacaccttcggtaccatcaactttcaggatggagagcacacacaccacgccaaatatatccggacctcctatgacacaaagctggatcacttgcttcacctcatgttaaaagaatggaaaatggagctacccaagctggttatttctgtgcacggaggtattcagaactttacaatgccctcaaagttcaaagagattttcagccagggactggttaaggccgccgaaactacaggagcgtggattatcactgagggaatcaatactggcgtctctaaacatgttggcgacgccttaaagagccacagttcccacagtttgcggaagatttggaccgttggtatccccccatggggggtaattgagaaccagagagatctgatcggcaaagacgtggtatgtctctatcagaccctcgacaaccccctgtccaagttgacaacattgaatagcatgcattcgcacttcatcctgtccgacgacggcaccgtgggtaagtacggtaacgagatgaaactgaggcgcaacctagagaagtatctgtcccttcagaaaattcactgcagatccagacagggggtgccagtcgtcggacttgtggtcgaaggaggtccaaatgtcatcctatcagtttgggagactgtgaaggataaagaccctgtagtcgtgtgcgaagggaccggacgggccgcagacctgttggcatttacacataagcatcttgcggacgaaggcatgctcaggcctcaagtgaaagaggagattatctgcatgatacaaaacacatttaatttctccctgaaacagagcaaacatctgtttcaaattctgatggagtgtatggtgcatcgggattgcatcaccatttttgacgctgactctgaggaacaacaggacctcgaccttgcgatcttgaccgccctactgaagggcacaaacctttcagcctcagagcagctgaatctcgccatggcctgggaccgggtagacatcgcgaagaaacatatccttatttacgagcaacactggaagccggatgccctcgaacaggctatgtcagacgcgctggtgatggatcgggttgacttcgtaaaactgctgattgagtatggcgttaatctgcaccggttcctgaccatcccacggctggaagagctctacaacaccaaacagggtccgactaacacccttcttcatcaccttgtccaggacgtcaaacaacacacactgttgagtggttatcggattacgctcatcgatatcgggcttgttgtggaatacttaatagggagggcctatagatccaattatactcgtaaacactttagagcattgtataataatctgtatagaaagtataagcatcagcggcattcgtcgggcaacagaaatgagagcgcagagagtaccctgcactctcagttcatcaggacggcacaaccttataagtttaaagaaaaaagtatcgtgctccacaagtctcggaagaagtcaaaggagcagaacgtctctgatgatcctgagagcaccgggttcttgtatccctacaacgacctcttggtgtgggcggtactgatgaagcgccagaagatggctatgttcttctggcagcacggggaagaggccaccgtgaaggccgtcattgcctgcatcctgtaccgagctatggctcacgaagccaaggagagtcacatggtggacgacgccagcgaagaactcaagaattactcgaaacagttcggccagcttgcactagatctgctggagaaggcctttaagcagaacgagcgcatggccatgaccctgcttacttatgaacttagaaattggtctaactcaacctgtctcaaactggccgtgtctgggggccttagaccgtttgtgagccacacatgcacccagatgctattaaccgacatgtggatgggcagacttaagatgagaaagaattcatggctgaagattatcatctccataatcctccctcctacaatactgacactcgagttcaagtccaaagccgagatgagccacgtgccgcaatcacaggactttcagttcatgtggtattacagtgatcagaacgcttcatctagcaaagagagtgcctccgtgaaggagtatgatctggaacgcggccacgacgaaaagctagacgagaatcagcacttcgggttagagagcggacaccagcatttaccatggacccgaaaggtgtatgaattttacagcgccccgattgtgaagttttggttctacacaatggcttaccttgcctttctcatgttgtttacatataccgtactggtggagatgcagcctcagccatccgtgcaggagtggttggtatccatttacatatttacaaacgccatcgaagttgtgagggaaatttgtatctctgaacctggaaagtttacacaaaaggtgaaagtgtggatcagtgaatattggaacctaactgaaaccgtggctatcgggctgtttagtgctggatttgtactgagatggggggacccaccgtttcacacagcggggcgcttgatctactgtattgacataatcttttggtttagcagattgctggattttttcgctgtgaaccaacacgccggcccctatgtgacaatgatcgcaaagatgaccgccaatatgttttatattgtcattattatggccatcgtactgctgtccttcggtgtggcacgaaaggccattcttagcccaaaagaaccaccttcgtggtcactggcacgcgacatagtgtttgagccctactggatgatctacggcgaggtgtatgccggtgaaatcgatgtgtgctccagccagcccagctgccctcctggatccttcctgacaccttttctgcaggctgtgtatctcttcgtgcaatacatcatcatggttaaccttctgatcgctttctttaataacgtttatctagacatggagtcaatatccaataacctttggaaatacaatcgatatcgttacatcatgacataccatgaaaaaccctggctgccacccccactgatcctgctcagtcatgtggggctgctgctccgtaggttgtgctgtcatcgtgccccacacgaccaggaagaaggggacgtcggtctgaagctgtatctctctaaagaggaccttaagaaactacatgatttcgaggagcagtgtgtcgagaaatacttccacgaaaaaatggaggatgtcaactgctcctgcgaggagcgaattcgggtaacatcagagcgcgtgaccgagatgtactttcagcttaaagaaatgaacgagaaagtttccttcatcaaggattccctgttgtcactggattcacaagttggacacctccaagatctgtctgccctgaccgtggacaccctaaaggtgctgagcgccgtggacacccttcaagaagatgaagctctgctggccaagaggaagcatagtacgtgtaagaagctccctcattcttggtcaaatgtcatatgtgctgaagtcctgggcagcatggagatcgccggagaaaagaagtaccagtactatagtatgccttctagtcttttgcgtagcttagccggtggacgacaccctccgcgcgtccagagaggtgcgttgcttgaaattaccaactcgaagcgcgaggcaactaatgtgcggaacgatcaagaaaggcaagaaacccagagtagcatcgtagtgtctggcgtctccccaaatagacaggcccatagcaagtacgggcagttcctgctcgtgccgtccaaccttaagcgagtgcccttcagcgcagaaacagtgttgcctctcagcaggcccagcgtgccagacgttctggccaccgagcaggatatccagacagaggtgctcgtgcaccttacaggccaaaccccggtcgtatccgattgggcctcagtagatgagcctaaagagaagcatgagccgatagcccaccttcttgatggtcaagacaaagccgaacaagtcctgcccaccttatcctgtaccccagagccgatgacaatgtcgtcacctctttctcaagctaagatcatgcagaccggtgggggttacgtgaattgggcgttctcggagggggatgagaccggagtcttctcaataaagaagaaatggcagacgtgcctgcctagtacctgtgattcagatagcagtcgtagtgagcagcaccagaagcaggcacaggacagctccttgagcgacaactccacgcggtctgcccaaagctctgaatgctcagaagtcggcccctggctgcagccaaatactagcttctggattaatccactcaggagataccgacctttcgcacgctctcactccttccgctttcataaagaagaaaaactgatgaagatttgcaaaattaaaaacttatccggctcttccgagatcggtcaaggagcgtgggtcaaggccaagatgttgaccaaagatcgacgactttccaaaaagaagaaaaatactcagggactgcaggtacccatcataactgtgaacgcttgttctcagagcgatcagctcaatccagagcctggcgaaaattctatctctgaagaggagtactcaaagaactggttcacagtctccaagtttagccataccggagtggagccgtacatccaccagaagatgaaaactaaagagatagggcagtgcgccattcaaattagtgactacttaaaacaaagccaggaggatctttccaagaactccctgtggaatagcaggtcaacaaatctgaaccggaactccctgctgaagtcatctattggagtggacaagattagtgccagcctgaagtccccacaggaaccccaccaccactactcggcaattgaaaggaacaacctcatgaggctctcacagactatcccttttactccagtgcagctctttgcgggcgaggagatcacagtttaccgactggaagagtcgagcccactgaacctcgataaatctatgtcatcatggtctcagagaggaagagccgccatgatccaggtgctctctcgggaagaaatggacggcggtcttcgcaaggcaatgcgggtggtgagtacatggtccgaagacgacattttgaaaccaggtcaggtcttcatcgtcaaaagcttcttaccagaggttgtcagaacgtggcataaaatctttcaagaaagcaccgtacttcacctgtgtctgcgcgagattcagcagcagcgcgcggcacagaaattgatctacacatttaaccaagtaaaaccccagaccatcccttacactccgcggttcctcgaagtgttcctcatatactgccattccgccaatcaatggttaacaattgagaagtacatgacaggagagttccgaaaatacaataataacaatggggatgaaatcacacccacaaataccctggaagaactgatgctcgcttttagtcattggacatacgaatatactaggggcgaactgctggtgctcgatctgcagggcgtgggcgagaaccttaccgatccctccgtgattaagccagaggtaaagcagagtaggggcatggtgtttgggccagcaaacctaggagaggatgctattcgaaattttattgcaaagcaccactgcaactcatgctgccggaaattgaagcttcctgacctgaagcggaacgattactcccctgaaagaattaacagtacttttgggctggagatcaagatcgagtctgctgaagagccaccagctagggaaaccgggagaaattcaccagaagatgatatgcagctgtag

SEQ ID NO: 209232 - DNA, 6054 bp, Artificial Sequence
  Description of Artificial Sequence: Synthetic coding sequence
atgaccgcccccgtgaccagccagaagagctggatcaagggcgtgttcgacaagcgcgaatgttcaaccattatcccctccagcaagaacccccatcggtgcaccccagtgtgtcaggtgtgtcagaacctcatacgttgctactgtgggcgcctgatcggggatcatgccggcattgactactcctggactatctcagctgctaaaggcaaagaatcagaacaatggtctgttgaaaagcacacgactaaatccccaacagacacatttggcaccatcaacttccaggacggggaacatacccatcacgcaaagtatataagaacttcttatgatacaaaactggatcacctactgcacctcatgcttaaggagtggaaaatggagctgcccaagctcgttatctccgttcatggcgggatacaaaatttcacaatgccatcaaaatttaaagagatatttagtcaaggcctggtgaaggctgctgagactactggagcctggataataacagaaggcatcaataccggcgtaagtaagcacgtcggagatgctctgaaatcacattcttcccactcactgagaaagatttggactgtggggatccccccgtggggtgttatcgaaaatcagcgtgacctcattggaaaggatgtagtctgtctgtatcagacattagataacccgctcagcaagctcacaaccctgaattccatgcattctcatttcattctgagcgacgacggcaccgtaggaaaatatggtaatgagatgaagctgagacggaacttggagaagtacttgtccctgcagaagatacactgtcgcagcaggcagggagtcccggttgtcggcctggtggttgaaggtggccccaacgttatccttagcgtgtgggaaacggtcaaagacaaagaccccgttgtggtctgcgaaggtactggcagggccgcagacctgctggctttcacacacaagcatttggccgatgaggggatgcttcgaccccaggtgaaagaagagatcatatgtatgattcagaacacattcaactttagcctgaagcagtctaaacatttattccagatcctcatggaatgtatggtgcatagagactgcatcaccatcttcgatgcagacagcgaagagcagcaggacctggacctggctattctgacggcattactcaagggcactaacctctctgcgagcgagcaactgaaccttgcgatggcctgggaccgagtcgatatcgcaaagaaacacattttaatttacgagcaacattggaagccagacgccctggagcaggctatgtctgacgctttggtgatggaccgtgtggattttgtgaagctgctcatcgagtacggggtaaacctccataggttcctgacaatcccacggctggaggagctttacaacactaaacaaggtccgacaaataccttgttgcatcaccttgtgcaagatgttaagcagcacaccttactttcgggctaccggattaccctgatagacattgggttggtggtagagtatttaataggcagggcctacagatccaattatacaagaaaacattttagagctctctacaataatctctatcgtaagtacaaacaccagaggcattcctccgggaaccgtaacgaatctgctgagagtacactgcatagccagttcatcaggaccgctcagccatataagtttaaagagaagtctatagtactccataaatccagaaaaaagtcaaaggagcagaacgtgagcgacgatcccgaatccacaggtttcctgtatccatataacgacctcctcgtttgggcagtgcttatgaaaaggcagaagatggcaatgttcttttggcaacacggtgaggaagcgaccgttaaggccgtgattgcctgtatcctgtatcgggcaatggcccacgaagcaaaggagagccacatggtggatgacgcctcggaagagctcaagaactactccaagcagttcggacaactcgcgttggatctgctcgagaaagccttcaagcagaacgagagaatggccatgacactcttgacctatgagctgcgaaattggtctaattcaacatgcctgaagctcgctgtttccggggggcttagacccttcgtgtctcacacgtgtacacagatgctgctgaccgacatgtggatggggcgcttaaagatgcggaagaacagctggttgaagatcattatcagcatcatcttaccgcctaccatcctgacacttgagttcaagtctaaagccgagatgtcccatgtcccacagtcccaggattttcagttcatgtggtattattcagatcagaacgcctcctcaagtaaagagtctgcctctgtgaaggaatacgaccttgagcgcgggcacgatgagaaactggatgagaatcagcacttcggactggagagcgggcaccagcacttgccctggactaggaaagtatatgaattttactccgcgccgattgtcaagttttggttttataccatggcttacctggctttcttgatgctgtttacctacacagtcctggtcgaaatgcagccacaaccaagcgtgcaggagtggcttgtgagcatatatattttcacaaacgcaatcgaagtcgtgagggagatatgcatcagcgagccaggaaaatttactcaaaaggtgaaagtgtggatcagtgaatattggaacttaacggaaactgtggcaataggactctttagcgctggcttcgttttacgatggggcgatccaccgttccatactgcaggccgcctgatctactgcattgacattatcttctggttctcccggctcctggatttctttgctgtgaaccagcacgcaggcccgtatgtgacaatgatcgcaaagatgacagccaacatgttttacatcgtcatcatcatggcaatagtacttttatcttttggcgttgcgcgcaaggcgattctgagtccgaaagagcccccttcttggtcccttgcccgcgacatcgtgttcgaaccatattggatgatctatggagaggtttatgccggggagatcgatgtgtgctcatctcagccttcttgtcctcccggaagtttcctgacacctttcctgcaggctgtctatttgtttgtccagtacattatcatggttaacctacttatagccttttttaataatgtgtatcttgatatggaatctatctcaaacaatctgtggaagtacaaccgatataggtatattatgacctaccacgaaaagccatggcttccaccgcctttgattcttcttagccatgtcggcctgctcctgcgccgattgtgttgccacagggcaccccacgaccaagaggagggtgacgtggggcttaaattgtacttaagcaaagaggatctcaaaaaactccatgactttgaggaacagtgtgttgagaaatacttccacgagaaaatggaggatgttaattgttcttgcgaagaacgcatcagagtgacttccgagcgagtcaccgaaatgtactttcagcttaaagagatgaatgagaaggtgtccttcatcaaagacagtctgctgtctcttgacagccaggttgggcatctccaagatctgtcagcccttactgtggacacgttgaaggtcctgtctgcagtagacaccctccaggaggacgaggccttgctcgcaaaaagaaaacatagcacatgtaaaaagctgccccattcctggtctaatgtgatctgtgccgaagttctgggctccatggaaatcgccggtgagaagaagtaccagtattactcaatgccatcctcattactgaggtccctggccgggggaagacacccccctcgagtgcaaaggggggccttgctcgaaatcacaaacagtaaaagagaggctacaaatgttagaaacgatcaagaacgacaagagactcagagctctattgtggtgtcgggcgtgtcccccaacagacaagcgcatagtaagtacggacagttcctgctggtgccgtccaaccttaagagggtccccttctcagcagaaaccgtgctgccactgtctagaccaagcgtacccgatgttctggcaaccgagcaggacatccagaccgaggtgctggtacacttaacaggtcaaactcccgtggtgagtgattgggcctccgtggatgagcctaaggaaaaacacgagcccattgcacatcttttggatgggcaagataaggccgaacaagtgctgccaactttgtcatgtacaccagagcctatgaccatgtctagcccgctcagtcaggccaaaatcatgcaaaccggaggaggatatgtgaactgggccttctctgaaggcgacgagaccggcgtcttttctatcaagaagaagtggcaaacttgtctcccaagcacatgcgactcagacagctctcgatctgagcaacatcagaagcaggcgcaggactccagcctgtcagacaactccactcggtccgcgcagtcttctgagtgctcagaggtcggcccgtggcttcagcctaataccagcttttggattaacccgctgagacgatacagaccattcgccaggtctcattcattcagattccataaagaggagaaactcatgaaaatatgtaaaatcaaaaatctttcaggcagcagcgaaattggtcagggggcatgggtaaaggccaaaatgctgaccaaggaccgcaggctatcaaagaagaagaaaaacactcaagggcttcaggtacctatcatcaccgtcaatgcatgttcccagagcgatcagctgaacccagaacctggagagaactctatcagcgaagaggagtactccaagaattggttcaccgtgtcgaagtttagccacacaggcgtggagccctacatccatcagaaaatgaaaaccaaggaaattggacagtgtgccatccagatctcggactacttgaaacaatcccaggaagacttaagtaaaaacagcctctggaattcccgatcaaccaaccttaaccggaatagtttgctcaagtcgagcatcggtgtggataagattagtgccagtctaaagagcccccaggagccccaccaccactattcagcaattgagcgtaataatcttatgcgtttgtctcagacgatccccttcactccagtacagttatttgccggagaagaaatcactgtctatcgactggaggagagcagccctctaaatctcgacaaatccatgtcaagctggagtcaacgagggcgcgccgccatgattcaggtcctgtcacgcgaggagatggacggtggccttcggaaggctatgagagtggtctcaacatggtccgaggacgatattctgaagcccggccaggtttttatcgtgaagtcttttttacccgaagtcgtccgcacctggcataagatttttcaagaaagtacagtgctgcatctgtgtttacgggagattcagcagcagagggcagcccaaaaactgatctataccttcaaccaggttaagccccaaactattccatatactccacggttcctggaagttttcctgatctactgccacagtgctaaccagtggctgactatagagaaatatatgacgggcgagttccggaagtacaacaataataacggcgatgaaatcacgcccactaatacactggaagagctaatgcttgcgtttagccattggacttacgaatatactagaggtgaacttctagtgctcgacctccagggcgttggcgagaatctcaccgatccgagtgtaatcaaaccggaggtgaagcagagtagaggaatggtcttcgggccggcaaatcttggggaggatgccatcaggaatttcatagcgaagcaccattgtaattcctgttgtcgaaagctgaaacttcccgatctgaagagaaatgactacagcccagaacgcattaactctaccttcggactggagatcaaaattgagtccgccgaagagccccccgcgcgggagacgggtcgaaactcacccgaggacgatatgcagctctag

SEQ ID NO: 209233 - DNA, 5844 bp, Artificial Sequence
  Description of Artificial Sequence: Synthetic coding sequence
atgaaggagcagcccgtgctggagcggctgcagagccagaagagctggatcaagggggtcttcgataaaagggaatgctcgacgattataccctcttcaaagaatccacaccgatgtactccagtttgtcaggtgtgtcagaacctgatcaggtgttactgtggtcgcctgatcggcgaccacgcggggattgactattcctggacgatatcagcagccaagggaaaggaatccgaacaatggtccgtcgagaagcatactacaaagagccccaccgacaccttcggtacaattaactttcaggacggtgagcacactcaccacgctaaatacatccgaacgtcctacgacaccaaacttgaccacctcttacacttaatgcttaaagaatggaagatggaacttccaaaattggttatttccgtgcatggtgggatacagaatttcaccatgccatccaaatttaaggagattttctcacaggggctggttaaggctgccgaaactacaggcgcatggataattactgagggcatcaacactggagtcagtaagcacgtgggcgacgccttaaaatcccatagcagccactccctcagaaaaatttggactgtcggaatccccccctggggagtcattgaaaatcaaagagatctgattggcaaagacgttgtctgtttgtaccagaccctggacaaccccctaagtaagttgactaccctcaatagcatgcactcgcatttcattttgagcgatgacggcacggtcgggaagtatggaaacgaaatgaaactccgccgcaatctggagaagtatctgtctctgcaaaagatccactgccgctcacggcagggcgtgcccgtggttggccttgtcgtggagggtggcccaaatgtaattctttccgtttgggagaccgtgaaagacaaggaccccgtcgtggtgtgtgaaggtaccggtagagcagccgacctgctagcgttcactcataagcaccttgccgatgaagggatgttacggccacaggtaaaggaggagatcatatgcatgattcagaataccttcaattttagcctgaagcaatcaaaacatctgtttcaaattttaatggagtgtatggtgcatcgtgattgtataactatctttgacgctgattctgaggagcagcaagatctcgatctagccattttaaccgccctgttaaagggcacaaacctgtccgcctcagaacagctaaacctggctatggcatgggacagggtggatatagcaaaaaagcatattctgatatacgagcagcactggaagcccgacgccctggaacaggctatgtccgatgccctcgtaatggacagggtcgattttgttaagctcctgattgagtacggtgtcaacctgcataggttcctgacgattccccgactcgaggagctgtataatactaagcaaggtccaacaaacaccctcctgcaccacctggtgcaggacgttaaacagcatactctactcagcggctacaggatcaccctgattgacataggtctggtggtggaatatctgattggccgagcatatcgcagcaactacaccagaaaacattttagagccctgtataacaatctgtaccggaaatacaagcaccaacgccattctagcgggaacagaaacgagtctgccgagtcaactctgcacagccagttcatccgaaccgcccagccctacaagttcaaggagaaatctattgtgctgcataagtcgagaaaaaaatccaaagagcaaaacgtcagcgacgatccggaatctacaggttttctctatccttacaatgatctgttggtctgggcggtgttgatgaaaagacagaaaatggcaatgttcttctggcaacatggcgaggaagccactgtgaaggccgtcattgcatgtatcctgtatcgcgcaatggctcacgaggctaaagaatcccacatggtggacgacgccagcgaggaactgaagaactattccaagcagttcggtcagttggcactggatctgttagagaaggcgtttaagcagaatgaacggatggcaatgactcttttaacctatgaattgcggaattggtcaaactcaacttgcctgaagcttgctgtgagtggtggactgcgtccctttgtgtcacatacgtgcacccagatgcttctgacagacatgtggatgggacgtctaaagatgagaaaaaactcctggctgaaaataattataagcatcatcctgccgcccaccatcctgacccttgaatttaaatccaaagccgaaatgtctcatgtccctcagtcccaggactttcagttcatgtggtactactctgaccagaacgcctcgtcctctaaagaaagtgcctctgtcaaagagtatgatctggagcgcggacacgacgaaaagctggacgaaaatcagcattttgggttggaatctggccaccaacacctgccatggacccgcaaggtgtacgagttctactctgcccccatagtaaagttttggttttataccatggcttatctagctttcctgatgttgttcacatatacggtccttgtcgagatgcagccacagccctcagtgcaggagtggttggtatctatctacatatttacaaatgccattgaagtcgtgcgtgagatctgcattagtgaaccaggtaagtttacacagaaagtaaaagtctggattagcgagtactggaatctaactgaaaccgtggccatcggtctcttttcagccggtttcgtcttacgctggggcgatccccccttccacacagccggaagactgatttactgtatcgatataatcttctggttttcacggctgctggacttcttcgccgtgaaccagcatgctgggccatacgtaaccatgattgccaagatgaccgcgaatatgttttacatcgtaatcattatggcgattgtactattgagctttggggtggcgcggaaagctattctctcccccaaagagccaccttcctggtcactcgcacgcgatattgtgtttgaaccctattggatgatctacggagaggtctacgccggagaaatcgacgtgtgctcctcccagccctcttgcccaccgggttccttcttaacaccctttctccaggcagtttacctctttgtccagtatattattatggttaacctgttgatagccttcttcaataacgtgtatctcgacatggaaagcatcagcaacaacctgtggaaatacaatcgttatcgctatattatgacttaccacgagaagccttggctgcccccccccctcattctgctaagccacgtagggttgctcctcaggcgcctgtgttgccacagggccccgcacgaccaggaagagggtgacgtgggcctgaaactttacttaagcaaggaagacctgaagaaactgcatgacttcgaagaacagtgcgttgaaaagtacttccatgagaagatggaagacgtcaactgttcttgtgaagagcgcattcgggtgaccagcgagcgagttacagaaatgtactttcagctgaaggagatgaacgagaaagtgagctttatcaaggatagtctgctgtcgctggatagtcaagtgggccacttgcaggacctcagtgctcttaccgtggataccctgaaggtgttgagcgccgtcgacacactacaggaagacgaagccctgctcgctaaacgcaagcattcaacttgtaaaaagcttccgcattcctggagcaacgtgatttgcgcagaagtgttggggtctatggagatcgccggggagaaaaagtatcagtattatagtatgcccagcagtctgcttcgctctttagcgggcgggcgccacccaccacgagtgcagaggggtgccctgctggagattaccaattctaagcgggaagcgaccaacgtcaggaacgaccaggagcgacaggaaacccagagctccatagtggtttctggggtaagcccaaaccggcaggctcactccaagtacgggcagtttctgctggtgcccagcaatctgaagagagtgcctttttcggcagagactgtgcttccattaagtaggccgagcgtgccagatgtgctcgccacagagcaggatatccaaacagaggtgctcgttcatctaactgggcagaccccagtggtttccgattgggcaagcgttgatgagcctaaggagaagcacgagcccattgcccacctgctggacggccaggacaaagctgagcaggtgctacctactctgtcttgcactccagagccaatgactatgtcttcccccctaagtcaggcaaagatcatgcagactggagggggctatgtgaactgggctttttccgagggcgacgagaccggagtgttcagcataaagaagaaatggcaaacctgtctgccctctacttgcgactcagactcctctcggagtgagcagcaccagaagcaggcccaggattccagcctgtccgacaattccactaggagtgcccagagttccgaatgctccgaggttggaccatggcttcagccgaacacaagtttctggattaatcctctccggaggtatcgcccctttgcccgatctcactccttccgattccataaggaggagaaactcatgaagatatgcaaaataaaaaatctgagcgggtcctctgagattggacaaggcgcctgggtgaaagctaagatgctgacaaaagatcggaggctgagcaagaagaaaaagaatactcagggactgcaggtaccaattattaccgtgaacgcatgctcgcagtcagaccagcttaatccggaaccaggggagaactcaatctctgaggaggaatactctaaaaattggtttacagtctccaaattttcacatactggggttgagccctacatccatcagaaaatgaagaccaaagaaatcggccagtgtgcgattcagatcagcgactacttaaaacagagccaggaggatttaagcaagaattctctgtggaactcccgatccacaaacctgaaccgcaatagcttacatgtcattaagatgcccatctcctctctgatttccgaaatctccgcttcactaaagagccctcaagaaccacaccaccactattccgctatcgagagaaacaatctcatgagactgtcgcagaccataccgttcaccccagtgcagctgttcgccggagaggagattaccgtttatcgactcgaggagtcatcccccctcaatcttgacaaatcaatgagcagttggtcacaacgcggacgtgctgccatgatccaggtcttatctcgcgaggaaatggacggaggcctgaggaaggcaatgagagtcgttagcacttggtccgaagacgatatactgaaaccaggtcaagtcttcatcgtgaagtcttttcttcccgaagtagttcgaacgtggcacaagatttttcaagagtcaacagttctacatctgtgtctcagagagatccagcagcagcgagcggcccaaaaacttatttacaccttcaaccaggtgaaaccacagactattccgtatacaccaaggttcctggaagtttttcttatatattgccacagcgccaatcagtggcttacaatcgagaagtacatgacaggtgagttcaggaagtataacaacaacaacggggacgaaattaccccaacaaacacactggaagagctgatgctggcgttctctcattggacttacgagtatacacgcggtgaattgttagtgctggacttgcaggccctgtggttttgggactccatgctgaaagcgcgtctgggtggttggcgaatgtag

SEQ ID NO: 209234 - DNA, 1707 bp, Artificial Sequence
  Description of Artificial Sequence: Synthetic coding sequence
cgggagagcccccaccccgccctgctgcagagccagaagagctggatcaaaggggtatttgacaagcgggaatgcagcacgatcatcccatcgtcgaaaaacccccaccgatgcactcccgtctgtcaggtctgccagaatttgattaggtgttactgcggcaggctgattggagatcacgctggtatcgattattcctggactatttccgcagccaaggggaaggaaagcgagcagtggtctgtggagaaacacaccacaaagtcgccaacagatacctttgggaccatcaactttcaggatggcgagcacacccatcacgcaaaatatatccgaaccagctacgacaccaaactggaccatctgctgcatctgatgttaaaagagtggaaaatggagctgccaaagctcgtgatatctgtccatggtgggattcagaactttactatgccctctaagtttaaggaaatctttagtcagggcctggtcaaggcagccgaaactactggagcctggataataaccgagggaataaacaccggagtaagcaaacatgtcggggacgcattgaaatcacactccagtcactctctgcggaagatatggacagtgggcattcccccctggggggtgatcgaaaaccaacgcgacttaattggaaaagatgtggtgtgcctctaccagacgctcgataacccactgtcgaagctgacaaccctaaactccatgcactctcactttatactcagcgacgatggaactgtcggaaagtacggcaatgagatgaagctgagaagaaacctggagaagtatctgagccttcagaagatccactgccccggtgaagagattactgtctaccgtctggaggagtccagcccactcaacttagataaaagcatgtcctcatggtctcagcgcggcagagccgccatgattcaagtgctgagtcgggaggaaatggacgggggattaaggaaagcgatgcgtgtggtctccacttggtctgaggacgacatattaaaacccggacaggtgtttatcgtgaaaagctttctaccagaggtggtgcgtacctggcataagatatttcaggagagtacagtgcttcacctgtgcctgcgtgagattcagcagcagcgtgcagcccaaaaactgatttacacattcaaccaagttaagccacagacgatcccttacacccctcgcttcctggaggtctttttgatttattgccactccgcgaaccagtggttaacgatcgaaaaatacatgacaggggagtttaggaagtataataacaataacggcgacgagatcacccccacaaataccttagaggagttgatgctagcgtttagccactggacgtatgaatatactcggggggagctcctggtgcttgacctacagggagttggggagaatttgacagacccatccgttatcaaaccagaggtgaagcagtctcgaggaatggtcttcgggccagcaaacctgggggaggacgctatcagaaatttcatcgctaaacaccactgtaactcgtgctgtaggaagcttaaattgcccgacctgaaacgcaatgattacagccctgagaggattaactccacgtttggtctggaaattaagatcgaatccgcagaagagccgccagcgcgcgaaactggacggaatagtcctgaagatgacatgcagctatag

SEQ ID NO: 209235 - DNA, 2580 bp, Artificial Sequence
  Description of Artificial Sequence: Synthetic coding sequence
atgaaggagcagcccgtgctggagcggctgcagagccagaagagctggattaaaggcgtttttgacaaacgggagtgcagtacaattattccatcatctaaaaaccctcatcgctgtactccagtgtgccaggtatgccagaacctgatacggtgctactgcggccgtctaattggagaccacgcaggcattgattacagctggacgatctcagccgcaaagggcaaggagtccgagcagtggtcggtggaaaaacatactactaaaagtccaaccgacacgttcggcacaatcaactttcaggatggggagcacacccaccacgctaaatatattcggacgagctatgacaccaaactggatcaccttctacatctaatgctcaaagagtggaaaatggaactgcccaagctggtaatatccgtgcacggtggcatccagaacttcaccatgccatctaaatttaaggaaatcttctcgcagggtcttgtgaaagctgcagaaaccaccggcgcgtggataattacagaaggaatcaatacaggggtgtccaagcacgtgggggacgcactcaagtctcactcctcccatagtctgcgaaaaatttggactgtcggtatcccgccatggggagtgatcgagaaccaaagggacttgattggaaaagacgtcgtgtgtctctaccagaccctggataatcccctgagcaaactcaccaccctcaatagtatgcatagccactttatcctgtccgacgatgggactgttggtaaatacgggaatgagatgaagctccggcgcaacctagagaaatacctgagtttgcaaaagattcactgtagaagccggcagggggtgcccgtcgtcgggctcgttgtggagggaggccctaatgtcatcctcagtgtgtgggaaaccgtgaaggataaagaccccgttgttgtgtgtgagggcacggggagggccgcagacctgctggccttcacccacaagcatcttgcggacgaggggatgcttaggcctcaggtaaaggaagaaattatctgcatgattcagaatacattcaatttttcactgaagcagtcaaaacacttgttccaaatattgatggagtgcatggtccaccgtgattgtatcactatctttgatgcagattcagaggaacaacaagacctcgatctggcaattctcaccgctcttcttaaaggaacaaatttgagtgcgtccgagcagcttaatctggcgatggcctgggacagggtggatatagctaaaaaacacatccttatctacgagcaacattggaaacctgacgctctagaacaggctatgagtgatgctctggtaatggaccgcgtggattttgttaaactcctgattgaatatggcgtcaatcttcatcggtttctcacaataccacggttagaggaactttataacaccaaacaaggccccaccaatacgcttctgcaccatctggtacaggacgtgaaacaggatctgtctaagaatagcttgtggaacagcagaagcacgaacctgaatcggaacagcctgcacgtaatcaagatgcctatcagtagcctgatcagtgagattagtgctagtctaaagagcccacaggagccccatcatcattactcagccatcgaaaggaataacctgatgagactttcccagaccattccattcactcctgtgcagctgttcgcaggggaggagatcacagtctacagattagaggagtcctctccgcttaatcttgataaaagcatgtccagctggtcgcagcggggacgcgccgccatgatccaggtgctgagtcgcgaggagatggatgggggactccgaaaggccatgcgggttgtgagcacttggtcagaggacgacatcctgaaacccggacaggtttttattgtaaaaagttttctgcccgaggtagtacgcacatggcacaaaattttccaagagtccacagtccttcatctctgtctacgtgagatccaacagcagagagccgcgcagaagctaatttacactttcaaccaagtgaaacctcagacgatcccttacacaccccggttcctggaggtctttcttatctactgccatagtgccaaccagtggctgacaattgagaagtacatgactggcgagttccgtaagtataataacaacaatggagacgagatcacgccaaccaatacactggaggaactcatgttggccttctcccattggacctatgagtacacgcgcggggagctgctggtgcttgatcttcaaggcgttggtgaaaacttgactgacccgtccgtgattaaacctgaggtgaagcagtcccggggcatggtttttggtcccgctaatctgggggaagacgccatcagaaacttcattgcgaaacaccactgtaattcatgctgccggaaactgaaacttcccgacttaaagcggaacgactactcgcccgaaaggattaacagcaccttcgggctggaaattaaaatcgaatccgcggaggaaccccccgctagggagacaggacggaacagccccgaggatgacatgcagctgtag

SEQ ID NO: 209236 - DNA, 2934 bp, Artificial Sequence
  Description of Artificial Sequence: Synthetic coding sequence
atgaaggagcagcccgtgctggagcggctgcagagccagaagagctggattaagggtgtttttgacaaacgcgagtgctcaactataatcccatcaagcaaaaatccccatcggtgtacacctgtttgccaggtgtgccagaacctgatccggtgttactgtgggcggctaatcggcgatcacgcaggaattgattacagttggaccattagcgcagcaaaaggtaaggagtcagagcagtggagtgttgagaaacataccacaaaaagtccgaccgatacctttggcacgataaacttccaggacggcgagcacacccatcacgccaagtatattaggaccagttatgatactaagctcgatcatcttttgcatcttatgctgaaggaatggaagatggagttgcctaaactggtaatttccgtgcacggaggtattcagaattttacgatgccctcgaaatttaaggagatcttctctcagggactggtaaaggccgctgaaacaacaggcgcttggattattacagaggggattaataccggcgtttccaaacacgtgggagatgctctcaaaagccacagctctcactccctgcgtaaaatctggacggttggaatccccccatggggggttatcgagaatcaacgagaccttatcggtaaagatgtggtgtgtctgtatcagaccctggacaatccattgagcaaacttacgacactgaacagtatgcactcacacttcatcctgagcgatgatgggacagtggggaagtacgggaacgagatgaaattacgcaggaacctggaaaaatacctttcactacaaaagatacactgtaggagtcgccagggcgttcctgtggttggcctagtggtagaaggcggcccgaacgtgattttatccgtgtgggaaacagtgaaggacaaggacccagtggtcgtttgcgagggtaccgggcgagcagccgacctcctggcgttcacccataagcatttggccgacgaaggcatgctgcgccctcaggtcaaggaagagattatctgtatgattcagaacacattcaatttcagccttaaacagtctaagcacctattccagatactgatggagtgtatggtacatcgggattgtattactattttcgacgcagactccgaagagcagcaggacctggatctcgccattctgacagctctactgaagggcactaatctgagcgcgtcagagcagctgaatctcgccatggcatgggacagagtggatattgcaaagaagcatatattgatttatgaacagcattggaaacccgatgccttggagcaggccatgtcagacgccctcgtaatggaccgcgtggattttgtgaagttacttatcgagtatggcgttaacctgcaccgttttctcactatcccgagactggaggaactgtataatacaaagcagggacccacaaataccctgctacaccacttagtgcaggacgtcaaacaacacactcttctttctggctatagaattaccctgatagacattggcctggtggtagagtatctgattggccgggcttacaggtcgaactacacgcgtaaacacttcagggctctgtacaacaatctctaccgaaaatacaagataataaccgtcaatgcctgttcccagtccgatcagcttaatcctgaacctggagaaaattccatatctgaggaggaatactctaaaaattggttcacagtgagtaaattctcgcatacaggggtagagccttatatacaccagaaaatgaagaccaaggagatcgggcaatgtgctatccagatctccgattatctgaaacagagccaagaggatctgagcaaaaactccctgtggaactcacgctccaccaacctgaaccgcaacagtctacacgtcattaagatgcccatttcaagtctgatttccgaaatctccgcctccctgaaatctccccaagaaccacaccaccactatagtgccattgagcgtaacaatttaatgagactatctcaaaccataccctttaccccagtgcagctcttcgccggtgaagagatcaccgtgtacagattggaagagagcagccccctcaacctggacaaaagcatgtcatcatggtcccagcggggtagagcagccatgattcaggttctcagtcgcgaagagatggatggaggcctccggaaggccatgagagtcgttagcacctggtccgaagacgatatcctgaaacccggccaagtttttattgtgaaaagtttcctgccagaggtggtgcgcacgtggcataaaatttttcaggaatctactgtattacacttgtgcttaagggaaattcagcagcagcgcgctgctcaaaagttaatttatacgttcaatcaagtcaagccgcagacaattccttacacacctcgtttcctggaggtgtttctgatctattgtcacagtgctaaccagtggctgacgatcgagaaatatatgaccggcgagtttagaaaatataacaataacaacggcgacgagataacacccactaatactcttgaagagctgatgctggccttctcgcactggacatatgagtatacccggggcgagctgctggtgctggatctgcaaggcgttggagagaacttaaccgacccgagcgtcatcaagcctgaggttaagcagagccggggtatggtgttcggtcccgcaaaccttggcgaggatgctatccgaaatttcatcgcaaagcatcactgcaactcatgttgtcgtaaactcaagctgccagacctcaagcggaacgattatagccctgaacgtattaatagcacttttggtctggaaattaagattgagtctgcagaggagccacctgccagggagaccggccggaactcccccgaagatgatatgcagctatag

SEQ ID NO: 209237 - DNA, 3402 bp, Artificial Sequence
  Description of Artificial Sequence: Synthetic coding sequence
atgctgcggccccaggtgaaggaggagatcatctgcatgatccagaatacatttaatttttcgctaaagcagtcgaagcacctgttccagatcctgatggaatgtatggtgcatagggattgcatcaccatatttgatgctgattctgaagagcagcaggacctggatctcgccatactgaccgctcttctgaagggaaccaatctttccgcaagcgaacagctgaacttagcaatggcctgggaccgcgtcgacatcgcgaagaaacacattttaatttacgagcagcactggaagccagacgctctcgaacaggcaatgtcagacgccctggttatggatcgggtcgacttcgtgaagctcttaatcgagtatggcgtcaatctccaccgttttctgactatacctcgtcttgaggagttatataacacaaaacagggaccaacgaatactctactccaccaccttgtgcaggacgttaaacagcacaccctcctgagcggctatagaattaccctgatagatataggcctggtggtggaatatctgataggccgggcataccgcagcaattacacaaggaaacacttccgggctctctacaataacctgtatcggaaatacaaacaccagcgccattcttccggtaacaggaatgagtctgctgagagtacactgcattcgcagtttatcaggacagcgcagccatataagttcaaggagaaaagtattgttctgcacaagtctcggaaaaaatccaaagagcagaatgtttccgacgacccagaatcgacggggtttctatatccttataacgacttgctagtgtgggccgttctgatgaaacggcaaaagatggctatgttcttctggcaacatggggaggaggcaaccgtgaaggccgtgattgcttgtatcctctatagggccatggcgcacgaggccaaggagagtcacatggttgatgacgctagtgaagaattgaagaactactccaaacagtttggtcagctagcactcgacctgcttgaaaaggcttttaagcagaatgaaagaatggcaatgaccctgctaacctacgagctccgcaattggtcgaacagtacgtgtctgaagctcgccgtgtcgggaggcttgcgaccattcgtatcacatacatgcactcagatgctgctcacagacatgtggatgggccgactgaagatgcgtaaaaattcatggctcaagataattatttcaattatcctgccaccgacaattctgacacttgagtttaagtccaaagccgagatgtcacacgttcctcagtctcaggatttccagtttatgtggtactacagcgaccagaatgctagctctagcaaggagagtgcttcggtgaaggagtatgacttggagagagggcacgacgagaagctggacgagaaccagcattttgggctggaaagcggccaccagcatctcccctggacaaggaaagtctatgagttctacagtgctcctatcgtgaagttctggttctacaccatggcgtatctggctttcctgatgctttttacctacacagtattggtagaaatgcagcctcagccatccgtacaggaatggttggtgtcgatctacattttcacgaatgccatcgaagttgtgagggaaatctgcatcagtgagccgggaaagttcactcaaaaggtcaaggtctggatctctgagtattggaaccttactgaaacagtcgccatcggattgttcagcgcaggatttgtcctgagatggggcgaccctccttttcatacagccggccgtcttatctattgcattgacatcatcttttggttttctcgcctgctggactttttcgcagtaaaccagcatgcaggtccgtatgtcaccatgatcgcaaagatgaccgccaacatgttttatatcgtgattatcatggccattgtcctgttatcatttggagtggcaagaaaggcgatcttgagtcctaaggaaccccctagctggagtctggcccgggatattgtcttcgaaccgtactggatgatttacggcgaggtgtatgctggagaaattgatgtctgtagtagccaaccgtcttgtccccctggtagctttctgacgccatttctgcaagctgtctatcttttcgtgcagtatattataatggtcaatttgctgattgcgttctttaacaatgtgtatttagacatggaatccatctctaacaatctgtggaagtataacaggtatcggtatatcatgacctaccatgagaaaccctggttacccccaccactgatactgctctcccacgtgggtctcctgttgcgacggctttgttgccaccgggctccacacgatcaggaggaaggcgacgtaggattgaaactgtacctgagtaaggaggatttgaagaagctgcatgattttgaggagcagtgcgttgagaagtattttcacgaaaaaatggaggatgtcaattgctcttgcgaggagaggatccgcgtcacttctgagagggtgacggaaatgtacttccagctgaaagaaatgaatgagaaagtttcttttattaaagattcgctgttgtcattggattctcaggtagggcatctgcaggatctttcagccctgactgtggacacactgaaagttctgtccgctgttgataccctccaagaagacgaggccctccttgccaagcgtaaacattccacatgtaagaaacttccccactcctggtccaacgtcatctgcgccgaagtgttgggttccatggaaatcgcaggcgagaagaagtatcaatactactcaatgcctagcagcctgttacggagcttagccggaggcagacacccacctcgggtgcagcggggggccctgctggaaataactaactctaagagggaagcaacaaacgtcagaaatgatcaggagagacaggagactcagtccagtattgtggtatcgggagttagtcccaaccggcaggcccacagcaagtacgggcagttcttgttggtgcctagtaatctgaagcgagtgcccttttccgctgagaccgtattgccactgagtaggccttccgtacccgacgtgctcgccactgagcaagacatccaaacagaggtgctcgttcatctgaccggtcagacacctgttgtgagcgactgggcttcggttgacgaacccaaggaaaagcatgagcccattgctcacctcctggacgggcaagataaagctgagcaggttcttcccactctcagctgtacacctgagccgatgaccatgtcctcacccctgtcacggtataggccttttgcaaggagccactcctttcggttccataaggaagagaaactgatgaaaatctgtaaaatcaaaagcaaggaatag

SEQ ID NO: 209238 - DNA, 6054 bp, Artificial Sequence
  Description of Artificial Sequence: Synthetic coding sequence
atgatcatcctgagcaagagccagaagagctggatcaagggcgtgttcgacaaacgagaatgctccaccatcatccccagctccaaaaacccccacaggtgcacccctgtgtgccaggtgtgtcaaaatctcataagatgctactgcggcaggctcataggcgatcatgccggaatcgactacagttggacgattagcgccgcaaaagggaaagaatcggagcagtggtccgtggagaagcacacgaccaagagccccacagatacctttggtacaattaacttccaggatggggaacacactcaccacgccaagtacatcaggaccagttacgatactaaactcgaccatctcctccacctgatgctgaaggagtggaaaatggaattacctaaattggttatcagtgtgcacggcgggattcagaattttacaatgccaagcaagttcaaggaaatcttttcccagggcctcgtgaaggcggccgaaactacgggcgcctggatcattacggagggcatcaatacaggggtgtctaagcacgtgggggacgccctcaaatcccattctagccatagcctgaggaagatttggacagtgggaatacctccctggggggttatcgaaaaccagcgagacctgattggaaaggacgtggtatgcctgtatcaaacactcgataatccactctccaaactgaccaccttgaactctatgcattcccatttcatcctgagtgatgacggcactgtcggcaaatatggcaacgaaatgaagctgaggcgcaacttggagaagtatctctccctgcagaaaattcactgccgcagtagacagggcgtgcccgttgtgggtctggttgtcgaaggcggacctaatgtgattctgagcgtatgggaaaccgtcaaggataaggaccccgtggtagtctgtgagggcactggaagagcagcagaccttttagcttttactcacaagcatctggccgacgagggaatgctacggcctcaggttaaggaagaaatcatctgtatgattcaaaatacatttaacttctccctcaagcagtctaagcacctttttcagatattgatggaatgcatggttcatagagactgcatcaccatctttgatgccgatagcgaggaacagcaggaccttgatctcgctatcttaacagcacttctgaagggcacaaatctctctgcaagtgagcaactgaacttagcaatggcctgggatagggtggacatcgccaaaaaacacatcctcatttatgaacagcattggaagcccgacgctctggaacaggccatgtcagacgccttggtcatggacagagttgactttgtcaagcttttaatagaatacggggtcaatctccaccggttccttaccatccctagactcgaggagttgtataacacaaagcagggacctaccaatacactcttgcaccacctggtacaggacgtcaaacagcacactctcttgagcggataccggatcactctcattgatattggtctggtcgtagagtacttgatcggaagagcctaccggtccaactatacccggaagcactttcgggctttgtacaacaacttatacagaaagtacaagcaccagagacactcctccgggaacagaaatgagtccgccgagtctacactccactcgcagtttattcgcaccgcccagccttacaagttcaaagaaaagtctatcgtcctgcataagtctagaaaaaagagtaaagaacaaaacgtgtccgacgatccggagtcaaccggatttctgtacccctataacgacttgctggtgtgggcagtgctaatgaaacggcagaaaatggcgatgtttttctggcagcatggtgaagaggctacggtaaaagcagtcatcgcctgcattttataccgggccatggcccacgaggctaaggaaagtcacatggtggatgatgcctctgaagagctgaagaattatagcaaacagttcggccagttggccctggatttacttgagaaggccttcaaacagaatgaaagaatggccatgactctactgacgtatgagttgaggaattggtccaatagcacgtgcctgaaactggcggtgtctggcggattgcggcccttcgtctcccacacttgtacgcagatgctgctgaccgatatgtggatgggccgtctaaaaatgcgtaagaactcatggctcaagattatcatctctattatccttcctcccacaatcctgacgttagagttcaaatctaaagccgagatgtcccatgtcccacagtctcaggattttcagttcatgtggtactatagcgatcagaacgctagtagtagtaaggaatcagcgtcagttaaagagtacgacctcgagcgcgggcacgatgaaaagttggatgaaaatcagcatttcggccttgaatcaggacatcagcacctaccatggacacggaaagtgtatgaattttatagcgcaccaatagtcaagttttggttctatacaatggcctacttggcctttttaatgctctttacctatacagtactagtggaaatgcagcctcagcccagcgtccaggaatggctggtgtcgatctacattttcacgaacgccattgaggtcgtccgggaaatctgcattagtgagccgggcaagttcactcagaaggtcaaggtgtggatctccgagtattggaatctcaccgagacagtggctattggcctgttcagcgccggctttgtgctgagatggggggaccctcccttccatacagctggccggctgatctattgcatcgatatcatattctggttttccagactgctggacttctttgctgtgaatcagcacgcgggaccctatgtcactatgattgctaagatgacagccaacatgttttatattgtaatcattatggctattgtgctgctctccttcggcgtcgctcggaaagccatcctttctccgaaggagccaccctcttggtccctggccagggatattgtttttgaaccctattggatgatctacggtgaggtctacgctggcgaaatcgatgtatgtagcagtcagccgtcctgtccccctgggagttttctcacgccctttttgcaagctgtctacctctttgtgcagtacataataatggttaatctcctcattgcctttttcaacaacgtttatctggatatggagtcaatctccaacaacctgtggaagtacaacagataccgctacataatgacttaccatgaaaagccttggcttcctcctcctctcatcctgctttcacacgttggtctgctccttaggcggctttgttgtcaccgggctccccatgatcaggaagaaggggatgttggacttaagttgtatctgagcaaagaggacctgaaaaaactgcatgatttcgaagagcagtgtgtggagaaatacttccacgagaaaatggaagatgtgaactgttcctgcgaagaacgcatccgtgtcacctctgaaagggtgaccgagatgtattttcagttaaaggagatgaatgagaaggtgtccttcattaaggacagcctgcttagtttagatagtcaggttgggcacttgcaggatctcagcgctctgaccgtggatactctgaaggttctaagtgccgtggacaccctacaggaggatgaggccctattggccaaaagaaagcacagtacctgtaagaagctgccacactcctggtctaacgtgatatgtgctgaggtgttaggttccatggaaattgcaggggagaaaaagtaccaatattattcgatgccctcttctctattgagaagtctcgccggcggacgccacccaccccgcgtgcagagaggagccctcttggaaataacaaattccaaaagggaggctacaaatgttagaaacgatcaggagagacaggagacacagtctagtatcgtagtatctggcgtatcacctaatagacaggcccattctaagtacggccagttcttactcgtgccctcaaatttgaaacgcgtcccattttccgcagaaaccgtgcttcctttgtctaggccctccgttccagacgtgctggcgaccgagcaggatatacagaccgaagtcctggtacatctcacaggacagactcctgttgtgagcgactgggctagcgtggacgagccgaaggaaaagcatgagccgattgctcatctgctggatggacaggacaaagccgagcaagtattaccgactttgtcatgcactcccgagccaatgactatgagctcgccactcagccaggccaaaattatgcagactggcggaggttatgtaaactgggcattctccgagggagatgaaactggagtttttagcatcaagaaaaagtggcagacatgcctccccagtacgtgtgattctgattcgagtcgatccgaacagcatcagaagcaggctcaggatagcagcctgtctgacaacagcaccagatccgctcaaagcagcgagtgtagtgaggttggcccgtggctgcagccgaatacttctttttggattaacccactgcgtagatatcggccttttgcgaggtctcatagttttcggtttcataaagaagaaaagctgatgaagatatgcaaaatcaaaaatctttctgggtcctccgaaatcggccagggagcttgggtcaaagcaaagatgcttacaaaggatcgtaggctgagcaagaaaaagaaaaacacgcagggcctgcaggtgcctattatcacagtaaatgcttgttcacagtccgaccagctgaatcctgaacctggtgaaaattccatcagcgaagaggagtacagcaaaaactggttcactgtgtccaagttttcccacacgggggtcgaaccctacatccaccagaaaatgaagaccaaggagattgggcaatgtgccatccagatctccgactatcttaaacagagtcaggaagatctttctaaaaacagcctttggaattctcgctctacaaacttaaaccggaactcactgctaaagtcctccataggagtagataaaattagtgcaagtttgaagtccccacaggaaccccatcaccactattcagctatagaaaggaacaacttaatgcgtttgtcacagacgatcccctttaccccagtccagctgttcgctggagaggagatcacagtatatcggctggaggagtcatctcccttgaacctggacaagtccatgagttcgtggtcccagcggggcagggcagctatgattcaagtcttgtcccgagaagagatggatggagggctccgcaaagccatgcgagtagtgtccacttggtctgaagatgatatattaaaacctggccaagtgtttatcgtcaagtcctttctgccggaagtggttcgtacgtggcacaagatcttccaagagagtacagtgctccacctctgtttgcgggagattcagcagcagagggctgctcagaaactgatttacacttttaaccaagtcaaacctcagacaatcccctataccccacgattcctggaagtgtttctcatttattgccacagcgccaaccaatggctgacaatcgaaaagtacatgacaggggagttccgtaagtacaataacaataacggggatgagatcacgcctactaacaccctggaggagctcatgcttgctttctcccactggacatatgaatacacaagaggcgaactactcgtgctagatttacaaggggtgggagagaatctgaccgatccgagcgtgattaagcccgaagtcaaacagtctcgaggcatggtgtttggtcctgccaacttaggggaggacgctattcggaattttatagcgaaacatcattgtaacagttgctgccgcaaattgaagctgcccgacctgaaacggaacgattactcccctgagcggataaacagcactttcgggctggagattaaaatcgagtctgctgaagagcccccagcccgcgagacaggacgcaactcacccgaagatgacatgcagctgtag

SEQ ID NO: 209239 - DNA, 6081 bp, Artificial Sequence
  Description of Artificial Sequence: Synthetic coding sequence
atgaaggagcagcccgtgctggagcggctgcagagccagaagagctggatcaagggtgtgttcgacaagagggaatgttcgaccattatcccttcatctaaaaaccctcacaggtgcactccagtgtgtcaggtatgccaaaatttgattcggtgctactgcggaagactcatcggggaccacgcaggcatcgactacagctggaccatcagtgccgcaaaaggcaaagagagtgagcagtggagcgtggagaagcacactactaagtctccaaccgacaccttcgggaccatcaattttcaggacggggaacatacccaccacgccaaatatatccgcacttcgtacgacacaaaactcgatcacctactccacctaatgctgaaggaatggaagatggagttgcccaaactggtgatctccgtgcacggagggatccagaatttcacgatgccgagcaagtttaaggaaatcttcagtcaaggcctagtgaaagcggccgaaacaacgggagcatggattatcacagaaggaatcaacaccggggtctctaaacacgtaggcgatgccctgaaatcccacagctcacacagtctccgcaaaatttggacggtgggtatcccaccctggggcgtgattgaaaaccagcgggacctgattggcaaggacgttgtgtgtctgtaccagacactggataaccccctctctaagcttacaaccttaaactctatgcactcccactttatcctgtcagatgacggcaccgttggtaagtatggcaacgaaatgaagttacgacggaacctggagaagtatttgagtctccagaaaatccattgccgctcccgccagggggtgcccgtggtcggattggtggtcgaaggtggtcccaacgtgattttatctgtctgggagaccgtcaaggacaaagatcctgttgtcgtgtgtgagggaacagggagagctgccgacctgcttgcttttacgcataaacacctagcagacgaaggtatgctgaggcctcaagtgaaagaggagattatctgtatgatccaaaatacctttaacttctccctcaagcagtccaagcacctgttccagatcttgatggaatgcatggtccaccgcgattgtatcactatattcgacgccgactctgaagaacagcaagatttagatcttgcaatcttgacggctctgctgaagggaacgaatctcagcgcctctgaacaactgaatcttgccatggcttgggatcgcgtggacattgccaagaaacacatccttatctatgaacagcattggaaacctgacgctctagagcaggctatgtccgacgctctcgtaatggatagagtggactttgtgaaactgctaatagagtacggagtcaacctgcaccgattcttaaccatccccaggctggaggaactgtataacactaaacagggacccacgaacacgctgctccatcacctcgttcaagatgtgaaacaacatacgctcctctctgggtaccgaatcactctgatagacatcgggctcgtggtggagtatttgattggcagagcctatcgcagtaattacaccagaaagcattttagggcgctgtataacaacctctatcggaaatacaagcatcagcgtcattccagtggcaacaggaatgaatcagccgagtccacacttcactctcagttcattaggacggcccagccttataagttcaaggagaaaagtatagtgttgcacaagagtagaaagaaatcaaaagagcaaaatgtgagcgatgaccctgagtcaaccggatttctgtacccttacaacgatctcctggtgtgggccgtcctcatgaagcgtcagaaaatggcaatgttcttttggcagcacggagaggaagcaaccgtcaaggcggttatagcctgcatcctgtatagggcaatggctcatgaggccaaggagagtcacatggtcgatgatgcctccgaggagcttaagaactactccaagcagttcggacaattagcgctggacttactcgagaaggccttcaagcagaacgagcgcatggcaatgactctcctaacatacgaacttcggaattggagcaactcaacttgcctgaaactggccgtgtctggaggcttgcggccatttgtaagccatacttgcacccagatgttgctgacagatatgtggatggggagactcaagatgcggaagaacagctggctgaaaattatcatatccatcattctccccccaaccatcctgaccctcgagttcaaatctaaggccgagatgagccacgtgcctcagtcccaggactttcagttcatgtggtactactccgatcagaatgcatccagctcgaaagagtctgcctctgtgaaagaatacgacctggagagaggtcacgacgaaaagcttgacgaaaatcagcacttcggcctcgagagcgggcaccagcatttgccctggacacggaaagtttatgaattctactccgctcctatcgtcaagttctggttctatacgatggcctatctggcattcctaatgctcttcacttatacagttctggtagaaatgcaacctcagccttccgtccaggaatggcttgtgagcatttatatcttcaccaatgcgattgaggtggtgagggaaatatgtatctcagaacccgggaagttcactcagaaggtgaaagtttggattagtgaatattggaatctaacagaaaccgttgccattggcctattctccgcaggatttgtgcttcgctggggtgatccacccttccacacagcaggacgtctgatctactgcatcgacataattttctggttctcaaggttactggacttcttcgcggtgaatcagcacgctggcccctacgttacaatgatcgccaagatgaccgccaatatgttctatatcgtgatcataatggctatagttttgttatctttcggggtagcaagaaaagctattttgtcacctaaagaacctccatcttggagcttggctagggacatcgtgtttgagccttactggatgatctatggagaggtgtatgccggagagatagatgtctgcagctcgcagccctcgtgtcctcctggatcttttctgacaccattccttcaggcagtatatctctttgtccaatacattattatggtcaacctcctcatagcctttttcaacaatgtttacctggacatggagagcatcagcaataacctttggaaatataatcgttatcgatatataatgacctatcatgaaaagccttggctgcccccacctttgattttgttgagtcacgttggcctcctcctacgcagactgtgttgtcatcgggccccacatgaccaggaagaaggtgacgtgggtcttaagctctacctttccaaggaagaccttaagaagctgcacgactttgaggaacagtgtgtagagaaatactttcatgaaaagatggaagatgtcaactgctcatgtgaggaacggatcagggtgacctcagagagagtaactgagatgtactttcagctgaaggagatgaacgaaaaggtcagcttcatcaaggacagtcttctctcactggactcccaggtgggtcatctgcaagacctgagtgcattgactgtggacaccctaaaagtgctctcggccgtcgacacactccaggaggatgaggcactgcttgcgaaacgcaagcacagcacctgcaaaaaactaccacatagctggtctaacgttatttgtgctgaagtgttaggcagcatggagatcgccggagagaagaaataccagtattatagtatgccatcctcgcttttgaggagtctggcaggtggacggcatccccctcgggtgcagaggggcgctctgctcgaaattacaaattctaaacgtgaggctacgaacgtgagaaacgatcaagaacgccaggagacgcagagttccatagtagtatccggggtgtcccccaatcggcaagcacactcgaaatacggccagttcctgctcgtgcctagtaacctcaagagggtcccttttagtgctgagacagtgctgcccctgtcgcgtccaagcgtgcccgacgtgctcgctaccgagcaggacatccagaccgaggttttggtgcacttaaccggccagactccagttgtctcagactgggccagcgtggacgagcctaaggagaagcacgagccaattgcacatctgctcgatggtcaggacaaagcagaacaagtactgccaacattgagttgcactccagagcctatgactatgtcgagtccactgagtcaagcaaaaatcatgcagacaggcggcggctacgtgaattgggccttctcagaaggggatgagacgggggtcttttctattaagaagaagtggcagacatgtcttccctcgacatgtgactccgactcgtctagatctgagcaacaccagaaacaagctcaagactcttcccttagcgacaactccacccggtcagctcagtcttccgaatgtagtgaagtgggcccttggctgcagcccaataccagcttttggatcaaccccttacgtaggtaccgccccttcgccaggtcccacagctttcggttccataaggaggaaaagctgatgaaaatctgtaaaattaaaaacctcagtggttcttcggagatcggccagggcgcatgggtcaaagctaaaatgctcaccaaggaccggaggctgagcaagaagaagaaaaacactcagggcctccaggttcccatcatcaccgtaaatgcttgctctcagtcagatcagctcaatccagaaccaggagagaactctatttctgaggaagagtacagcaagaactggttcactgtgagcaagttcagtcacacaggtgtggagccctatatccaccagaaaatgaaaacaaaggagattgggcagtgtgctatacagatttcagactacctcaagcagtctcaggaagacctgtctaaaaactctctctggaactcccggtcaactaacttgaataggaacagcttgcacgtgattaagatgccaatcagctccttaatctctgagatatccgcctctttgaaaagcccccaggagccccaccaccactatagcgccattgagaggaacaatctgatgagactcagtcagacgattccattcactcccgtgcagctgttcgctggcgaggaaattacggtctaccgactagaggaatctagtccgctgaacctggacaaatccatgtctagctggagtcagcgcggccgggctgccatgatccaggtgctgtcacgtgaggagatggatggcggactgcgcaaggccatgagagtggtgtccacttggagcgaagacgatatcctgaaacccggtcaggtattcattgttaagtcttttcttccagaagtcgtgaggacctggcataagatctttcaggagagcacggtacttcacctgtgtctcagggagatccagcagcagagagccgcccaaaaattaatctatacattcaaccaagtaaagcctcagacgatcccttacaccccccgcttcctggaagtgttcctcatctactgccactcagcaaaccagtggcttaccatagagaaatatatgaccggggagtttcggaaatataataacaacaacggagacgaaatcacccctaccaacaccctggaggaacttatgctggccttctctcattggacttatgaatacaccagaggtgaattactcgtccttgatctgcagggggtgggagaaaatcttactgaccctagcgtcataaagcccgaagtcaagcagtcccggggcatggtgttcggccctgccaatctgggcgaagacgccattcgcaattttatcgcaaagcaccactgtaatagttgctgccggaagttaaaactgcccgatctaaagaggaatgattatagcccggagcgcatcaactcaacatttggtctagagattaagatcgagtctgctgaggagccacctgctagggagactgggcgtaatagccctgaggacgacatgcagctctag

SEQ ID NO: 209240 - DNA, 5598 bp, Artificial Sequence
  Description of Artificial Sequence: Synthetic coding sequence
atgagccagaagagctggatcgagagcaccctgaccaagcgggagtgtgtgtatattatccctagctcaaaagaccctcatcgctgccttcctggctgtcagatctgccaacaactggtgaggtgcttctgcggccgactggtcaagcagcatgcctgctttacagcaagcctcgccatgaagtattctgatgtaaaactcggcgaccactttaaccaggccatcgaagagtggagtgtggagaaacacacagagcagagccccactgacgcgtacggggtgataaacttccaaggcggatcgcactcttacagagctaaatatgtccgcttatcgtacgacactaagcctgaagtcatcttacagctgttactaaaggaatggcaaatggagctaccaaaactggtcatctcggtacatggaggaatgcagaagttcgaactgcatccaagaatcaaacagctcctcggaaagggattaatcaaggctgcagttaccaccggtgcctggatattgacaggtggtgtaaacaccggggtggcaaagcacgtgggcgatgcgctgaaagaacacgcctctcggagcagtagaaaaatttgcacaattggcatcgcaccatggggtgttatcgagaacaggaatgacttggtgggcagggatgtggttgccccataccagacactgctgaaccccctgtcaaagctcaacgtgctgaataatctgcactcacattttatactcgtggacgacggcacagtcgggaagtatggtgcggaggtgaggctccgtagagaactcgaaaaaacaatcaaccagcagaggatccacgccaggattggccagggcgtcccagttgtggcattaatttttgaagggggaccaaacgtcatcctaaccgtgttggagtacctgcaggaatctccgcctgtccctgttgttgtgtgcgaaggcacaggacgggctgcagatctacttgcttatatccacaagcagacggaggagggtggcaacttaccggatgctgccgagccagacattatcagcactattaagaagacatttaatttcggccaaaatgaggctcttcatttgtttcaaactttgatggagtgtatgaaacgcaaagagcttataaccgtattccacattggctccgatgaacaccaggacatcgatgtggccattctgacagccctccttaaggggacaaatgcgtcagctttcgaccagctgatactcacgttagcttgggaccgggtggatattgctaaaaatcatgtgtttgtatacggtcagcagtggcttgttggttcactagagcaagctatgttggacgcactcgtcatggatagggtggctttcgtgaaactgctgattgagaacggggtgtcgatgcacaaattcctaacaattccaagacttgaagaactttacaacacaaagcaagggccgaccaatcctatgttgttccatctcgtgagagacgttaagcagggcaacctacctccaggctacaaaatcacattaattgatatcgggttagtgatcgagtacctgatgggcgggacttacaggtgtacatacaccagaaagcgtttcaggcttatctacaacagcttgggaggcaacaataggaggagcggtcgtaatacctcttccagtaccccacagctgcgcaagagccatgagagcttcggaaatcgggctgacaagaaggagaagatgagacataatcatttcataaaaacagcacaaccttataggcctaaaattgacaccgtgatggaggaggggaagaaaaagcgcacgaaggatgaaatcgtagatattgacgatcctgaaacgaaaaggttcccttatcccctaaacgaattactgatctgggcgtgcctgatgaagagacaggtaatggccaggttcctatggcaacacggagaagagtctatggctaaggcacttgtggcatgtaagatttatcgttccatggcatatgaggcgaagcaatccgatctagtcgacgatacatcggaagagttaaagcagtattccaacgatttcgggcagctagccgtcgagctgctggagcagagtttcagacaggatgagactatggcgatgaaacttctgacatatgaactcaaaaactggtccaattctacatgtctgaagctcgccgtcagcagtaggctgaggccctttgttgcccacacctgtacccaaatgctactttcagacatgtggatgggccgattgaatatgcgaaaaaatagttggtacaaggtgatccttagcatcctggtaccccccgccattctgctcctggagtataagacaaaggcagagatgagccacatcccacagagccaagacgcccatcagatgacaatggacgattcagaaaacaatttccaaaatattaccgaggaaattcctatggaggtcttcaaggaggtgcgcattctcgacagtaacgaaggaaaaaatgagatggagatccagatgaaatctaagaagctgcctatcacccgcaagttttacgcattttatcacgcgcctatcgtgaaattttggtttaatacactggcttacctgggcttcctgatgctgtatactttcgtcgtgctcgtgcagatggagcaactgccttcagtccaagagtggattgtcatcgcatacattttcacatacgctattgaaaaagtcagggagatctttatgtctgaggccggcaaagtgaaccagaaaattaaagtctggttttcagactactttaatatttctgacactattgcgatcatcagctttttcatcggctttggactgagattcggcgcgaaatggaacttcgccaacgcgtacgacaatcatgtcttcgttgccggaagactaatttattgtctgaacatcattttttggtacgtacgactgctggattttctggctgttaatcagcaagcgggcccttatgtgatgatgattggcaagatggtcgctaacatgttttacattgtcgtgatcatggcactggtactgctttcattcggcgtgccaaggaaggccattctttacccacacgaagcccccagctggacactggctaaagatattgtgtttcatccttactggatgatctttggagaagtatacgcctatgagatagacgtatgtgcgaacgactctgtgatccctcagatctgtggtccagggacatggctgactccattcttgcaggcggtatacctattcgtccagtacataattatggtgaacctgctcatcgctttctttaacaacgtttacctacaggtcaaagccatttctaatatcgtgtggaaataccagcggtaccatttcatcatggcttaccacgagaaacctgtcctcccaccaccgttgatcatcctctctcacattgtaagtctgttctgctgcatctgcaagcgcagaaaaaaggataagacttccgacggccccaaactgtttctaacagaggaagaccagaaaaaactgcatgatttcgaggaacagtgcgtggagatgtacttcaacgagaaggatgacaaattccattccgggagcgaggagcgcatcagagtgaccttcgagcgcgtcgagcagatgtgcatccagattaaagaggtgggagaccgggttaactacattaagcgtagcctccagtccctagatagccaaatagggcacttacaagacctgtccgcactgactgttgatacgctgaaaaccctgactgcacaaaaagcttcggaggccagcaaggtgcacaatgaaatcacccgcgagctgtcaattagtaaacatttggcgcagaatttgattgatgatggaccagtgcgaccctctgtgtggaaaaagcatggagtcgtaaacacactgtctagctcccttccacagggagatctggaaagcaataacccctttcattgcaatatcctgatgaaagatgacaaggacccacaatgcaatatctttgggcaagatttgcccgccgtgccccagcgcaaagagtttaactttccggaggcgggaagttcatcaggcgcactgttcccatccgccgtctcacctcccgagcttcgccagcgtctgcatggcgtggaacttctgaagatttttaacaaaaatcagaaacttggttcgagctcaacaagcatccctcatctttcatcccctccgacgaagttttttgtgtcgaccccctcacagccaagctgtaagagtcacttagaaacggggaccaaagatcaggaaaccgtgtgctcaaaggccacagagggcgacaacacagagttcggagcatttgtgggccaccgggactcaatggatctccagaggttcaaagagacttcgaacaaaatcaaaatcctgtccaataataacacttcagaaaataccttaaagcgggtgagtagcctcgcagggtttaccgactgccacaggaccagcatccccgtgcactcgaagcaggctgaaaaaatatctcgaaggccctctactgaggacacgcatgaagtggactccaaagccgccttgattcccgactggctccaggatagaccttctaatcgggagatgccttctgaggaaggcacattgaatgggctaacttcgcccttcaaacccgctatggatacaaactattactattctgcggtagagcgcaacaatctgatgaggcttagtcagagtataccttttaccccagtgcctccccggggtgagcccgtcactgtgtatcgcttggaagaatctagcccaaatattctgaacaacagcatgagctcttggtcccaactcggactgtgcgcgaagattgaatttttgagcaaagaagagatggggggaggcctgcggagagcagtgaaagtgcagtgcacttggagtgaacatgatatcttgaagtcgggccacctgtatatcattaagtctttcctcccagaagttgtcaacacctggtccagcatttacaaggaagacacagtgctgcatctgtgcctccgcgagatacaacagcagcgggcggcccagaaacttactttcgcttttaaccaaatgaagccgaagtctatcccctattcaccaaggtttctggaggtatttcttctgtattgccatagtgctggacagtggttcgccgttgaagaatgtatgacaggcgagttcaggaaatataacaataacaatggtgatgagatcattcccaccaatacactcgaggaaatcatgctggccttctcccattggacttacgagtacaccaggggcgagttgctggtgctggacttacagggggtgggagagaatctcactgaccctagcgtgattaaagcggaggagaagagaagctgtgacatggtgttcggcccagctaacctgggagaagacgctatcaaaaacttcagagccaagcatcattgcaacagctgttgtcggaagttgaagctccctgatttaaaacgcaacgactacactcccgacaagataatctttccacaggacgaaccctccgacctcaatctgcagccgggcaatagcaccaaagagtccgagtccacaaacagcgtgagattaatgttgtag

SEQ ID NO: 209241 - DNA, 3315 bp, Artificial Sequence
  Description of Artificial Sequence: Synthetic coding sequence
atgagcttccgggccgcccggctgagcatgcggaaccggcggaacgataccctggattcaacgagaacgctgtactcttctgcctctcgcagcacggacctgagctactccgaaagcgatctggttaactttatccaggcgaattttaaaaaacgtgaatgcgtcttcttcacaaaggattcaaaagctacagagaacgtgtgcaaatgtgggtatgcgcagtcccagcacatggaaggaacccagatcaaccagagcgagaagtggaactacaagaaacacaccaaagagttccccacagacgcgtttggcgacattcaatttgaaactttaggcaagaaagggaaatacattagattgtcttgcgatacagacgccgagatcctctacgagttgcttacgcagcactggcacctgaaaacccccaacctggtaatcagtgtcactggtggggctaagaattttgctcttaaaccacgtatgagaaagatctttagcagactgatttatattgcccaaagcaagggggcatggatcctcactgggggcacacattatgggcttatgaaatatatcggagaggtcgtgagggacaacaccatctcgcgcagcagcgaggagaatattgtggcgataggcatagccgcctggggtatggtgtcgaaccgcgacaccctgatccgcaactgtgatgctgaaggttacttcttagcccagtacctaatggacgattttaccagagaccctctgtatattctagacaacaatcatacacatcttttgctcgttgataatgggtgtcacggacaccctactgtcgaggctaagcttcggaatcaactagagaagtacatatccgaacgtactatacaggattctaattacggcgggaagatccctattgtatgtttcgcacaggggggtgggaaggagacgctgaaggccattaatacttctataaagaataagataccctgcgtcgtggttgagggctctggacagatagcagacgtgatagcttccctcgttgaagtggaggacgccctgaccagtagcgcagtgaaggagaagctggtgcgcttcttgccacgaactgtctctcgactccctgaagaggagaccgagagttggattaagtggctcaaggaaatccttgagtgcagccacctgcttacagtgatcaagatggaagaggctggggatgagattgttagcaatgccatttcctatgctctgtacaaagcattttcaactagcgagcaagataaggataactggaatgggcagctgaagcttctccttgaatggaaccagctggacctggcgaacgacgaaattttcactaacgataggaggtgggaatctgcggacctgcaagaagtgatgtttaccgccctgataaaagaccgaccgaagttcgtgcgactctttcttgagaacgggctcaatctgcggaaattccttacccacgatgtactgaccgagctattttcaaatcacttctctactctggtttatcggaatctgcagatcgcaaaaaacagctacaacgacgcattacttactttcgtgtggaaactggtggccaattttcgccgagggttcagaaaggaggatcggaacggcagggacgaaatggacattgagctccacgatgtgtcccccatcaccagacacccgctccaggcattgttcatatgggcaatcctgcagaacaaaaaagaactctccaaagtgatctgggaacagactagggggtgtacattggccgctcttggcgcaagcaagctgctgaaaaccttagcgaaagtcaaaaacgatatcaacgctgctggcgaatccgaggaactagccaacgaatatgagactagggccgtcgaattgttcaccgagtgttactccagcgacgaggatcttgcagagcagttgttggtgtacagctgtgaagcctggggtgggagcaattgtcttgagcttgccgtcgaggctacggatcaacattttatagcccagcccggagtgcagaattttctgagtaagcagtggtacggtgaaatcagcagggacaccaaaaattggaagattatcctgtgtctcttcattattccacttgttgggtgtggcttcgtctcctttaggaaaaagcctgtcgacaagcacaagaagcttttgtggtattacgtggcgttcttcacgtcaccctttgtggttttttcctggaacgtagtgttctatatcgcattcctattgctctttgcttacgtcctgctgatggactttcactccgtgccacacccccccgagctggttctgtactccttagtgttcgtgctgttttgtgacgaggtcagacaatggtatgttaacggggtgaactacttcaccgatctgtggaatgtgatggacacgcttgggttgttttactttatagcggggatagtgtttcgtttgcactctagtaataagtcatcgctgtattccggccgcgttattttttgcttggattatataatcttcactctgcgactgatacacatttttacagtctcccggaatttgggtcccaagattataatgttacaacgcatgctgattgacgtattcttctttctcttcctgttcgccgtctggatggttgcttttggagtggcgagacaaggaattctacgacagaatgaacaacgctggagatggatatttcgttccgttatatacgagccatacttagccatgttcggccaggtcccttctgatgtagatggcaccacttacgactttgcacattgtaccttcacgggcaatgagagcaaacccttgtgcgtcgagctggacgaacacaacctgccccgtttccccgaatggattacgatccccttggtgtgcatttacatgctatctacgaacattcttttagtaaacttacttgtggcaatgttcggctataccgtcgggactgtgcaggaaaacaacgaccaggtttggaaatttcagagatacttccttgtccaggaatactgcagccggcttaacatcccctttccatttatcgttttcgcctatttctatatggtggtgaaaaagtgtttcaaatgctgctgcaaggagaagaatatggagtcttctgtctgctgctttaaaaacgaggataatgagacactggcatgggaaggcgtaatgaaggaaaactatttagtcaagatcaacacaaaggcaaacgacacttccgaggagatgcggcataggtttcgccaactggacaccaagctgaacgatcttaaaggcctgcttaaggaaatagctaataagatcaagtag

SEQ ID NO: 209242 - DNA, 579 bp, Artificial Sequence
  Description of Artificial Sequence: Synthetic coding sequence
atgaagagcttcctgcccgtgcacaccatcgtgctgatccgggagaatgtttgtaaatgcggatacgcacagagccagcatatggaaggaacccagataaaccagtctgaaaaatggaactacaagaagcatacgaaagaatttcctaccgatgcctttggagatattcagtttgagactcttggaaaaaagggaaagtacatccgcctgtcctgtgatacagatgcggaaatcctgtacgagcttctgacccagcactggcatctcaaaactcccaatctggtgatatcggtgacaggaggtgccaagaacttcgcacttaagccaaggatgcgcaaaatcttctcacgtctgatctacatcgcccagtcaaaaggagcctggattctgaccggcggtacccactacggcctgatgaaatacataggcgaggtggttcgggataatactattagcagaagcagtgaagagaacatcgtggccatcggaattgcagcctggggcatggtttctaacagggatacactcataagaaactgtgatgccgaggtccctgtgggccaagaagaggtgtgctag

SEQ ID NO: 209243 - DNA, 498 bp, Artificial Sequence
  Description of Artificial Sequence: Synthetic coding sequence
atggagggcacccagatcaaccagagcgagaagtggaactacaagaagcataccaaagagtttcccaccgacgcatttggggacattcagtttgagaccctcggaaagaaagggaaatacattcgccttagctgcgacactgatgcggagattctctatgagctgctgacccagcattggcacttaaagacccccaatctagttatttccgttaccggcggcgccaaaaactttgctcttaagccacgaatgcgcaaaatcttttcccgcctgatctatatcgcccaatctaaaggtgcttggattctgacagggggaactcactatggacttatgaaatacattggggaggttgtgagagataacaccatcagcaggtcttcagaagagaatatcgtggcaataggcatcgcagcttggggcatggtcagcaatagagacactctaatccgtaactgcgatgccgaggtgcctgtcgggcaggaggaggtttgttag

SEQ ID NO: 209244 - DNA, 2049 bp, Artificial Sequence
  Description of Artificial Sequence: Synthetic coding sequence
atgcaggccatcaacaccagcatcaagaacaagatcccctgcgtggtggtcgaaggcagcggccagattgctgatgttatcgcttctctcgttgaggtagaggacgcactgacaagcagcgccgttaaggaaaagctggtgagatttcttcctcgaaccgtgtcccgactacccgaggaggaaaccgaaagttggataaagtggctgaaagagatcctcgaatgcagccacctactgaccgtcatcaagatggaggaagcaggggatgagatcgtaagtaatgccatctcttacgcattgtacaaagccttctcaacatcagagcaagataaggacaattggaacggccagttgaagctgctgctggagtggaatcagttggatctggctaacgacgaaatttttacaaatgatagacgatgggaatcagctgacctgcaggaggtgatgtttacagcactgatcaaggataggcccaagtttgtgcgcctattccttgagaacggacttaatctacgcaagttcctgacccatgacgtgctcacagaactgttttcgaaccacttcagtacactagtgtatcggaatttacaaattgctaagaactcatacaacgacgcactgctgacgttcgtgtggaagcttgtggcaaattttaggcggggattcaggaaggaagaccgtaacggtcgggacgaaatggacattgagttacatgacgtctctccaattacacgtcacccactccaggctctcttcatctgggctatccttcaaaacaaaaaggagctgtctaaggtgatctgggagcaaacgagagggtgcaccctcgcagcacttggggcatctaagctgctcaaaactctggccaaggtcaaaaatgatatcaatgccgcgggcgaatctgaggaacttgctaacgaatacgagaccagggctgttgagctgttcacagagtgctactcttctgacgaagaccttgccgagcagcttctcgtctattcttgcgaggcatgggggggtagcaattgtttggagctggctgtcgaggctaccgaccagcatttcatagcccagcctggcgttcagtggtatgttaatggcgtcaactatttcaccgatctgtggaacgtgatggatactctgggtctcttttattttatagccggaattgtattcaggctgcatagttccaacaaatcctcattatactcagggagagtaattttctgccttgactacattatctttacattgagattgattcacatttttaccgttagcaggaacctgggacctaaaattattatgctgcagcgaatgctgatcgatgtcttcttcttcctgttcctgttcgcggtgtggatggtggcctttggcgtcgctcgccaaggaatccttaggcagaatgagcagcggtggcgctggatatttcgatccgtgatttatgaaccctacctagccatgttcgggcaggtgccctccgacgtagacgggaccacatacgatttcgctcactgtaccttcaccgggaatgaaagcaagccactttgtgtcgaactggatgagcacaacctgccacggtttcccgaatggatcactatcccactcgtctgcatctatatgctgagtacaaacatcctactagttaacctgctagtcgccatgtttggctacacggtcggaaccgtccaggaaaacaacgaccaggtttggaaatttcaacgctactttctagtgcaagagtattgctctagactcaacattccattcccctttatagtgttcgcctacttctatatggtggtgaagaagtgtttcaagtgttgttgtaaggagaaaaatatggaaagctccgtttgctgttttaagaatgaggataacgagaccctagcatgggaaggtgttatgaaagaaaactatctcgtcaagataaacacaaaggctaacgatacgtctgaggaaatgaggcatcggttccggcagctggatacgaaactcaatgacttgaagggactgttgaaggaaatagctaataagatcaaatag

SEQ ID NO: 209245 - DNA, 2514 bp, Artificial Sequence
  Description of Artificial Sequence: Synthetic coding sequence
atggagaccctgacccccggccacctgcagcccagccccagcagcccgagaccacgcgctgcccccggctccttgggtagggtgacaaggcgccgactctccagatggatcgccctcacccgtaaagtgtcttggacacctgccaggccctctcagtcagccctattgtcacctagccgaggacaggaaacagctccccctgtcccaggctgttgtcctcgcacactctctcccccagcacctaggcggccctccgggtctatgattgccggtgtttcactgaagccactgctcaggatcacggcccgaatttggcgcgcatgctgctcaagttgcagaagagctcggagcacttcacaaactacctcatctaaggtggcacctgcgctgggttctggccgggcgccagctcttgcctgcccagaccctcccctctgcctctccgatccagagacggggaaaacttgtctcctcaaagccatgttgaatctccatgatggccagaacacaacgatcccacttctgctggagattgctaggcaaactgacagtctgaaggaactggtcaatgcctcctatactgactcttactataaaggccagactgctttgcacatcgctattgaaagaagaaacatggccctcgttaccctccttgtggagaatggcgccgatgtccaagcagctgctcacggcgatttctttaagaaaactaaggggagaccaggtttttactttggagagctccccttgtccctagcagcctgtaccaaccagcttggcatcgtgaaattcttattgcagaattcctggcaaacagctgacatcagtgcgcgcgattccgttggaaacactgtactgcatgccctcgtggaagtggctgataacaccgcggacaataccaaatttgtgacgtctatgtataatgaaattctaatgcttggtgccaaactgcatccaaccttaaagttggaggaactaacaaacaaaaaaggaatgacgcctctggctctcgctgctggtacaggcaaaatcggtgtacttgcgtacatcctgcagcgggaaattcaggaacccgaatgccgccatctgagccgaaaattcaccgagtgggcatatgggccagtgcattcaagcctatacgacctgagctgcatcgacacctgcgaaaagaattctgtgctggaagtcatcgcttactccagctctgagaccccgaatcgtcatgatatgctgctggtggaacccctgaaccgattactacaagataaatgggatcgattcgtgaagaggatcttttactttaattttcttgtttattgcctatacatgattatcttcacaatggcagcctattatcggccagtggacggactccccccatttaaaatggaaaaaacgggggattactttagggttaccggggaaatactgtctgtcctcggcggtgtgtacttcttctttaggggcatccagtactttcttcagcgccgcccatctatgaagaccctgtttgtggatagctatagcgagatgttgtttttcttacagtccctgtttatgctggccacagtggtgctttacttcagccatctcaaagaatatgtggcctccatggtgttcagcctggcactcggctggactaatatgctgtattatacacgcggtttccagcagatgggtatttatgccgtaatgatagagaagatgatcctgcgtgacctgtgtaggttcatgttcgtgtatatagtattcttgttcggcttctctacagctgttgtgacgctgatcgaggacgggaaaaacgactcactacctagcgagtcaaccagtcatcgttggcggggcccagcatgccgccccccagattccagttacaactcactatattctacatgcctggaactcttcaagttcactattgggatgggtgatcttgagttcactgagaattatgactttaaggccgttttcatcatactcctgctggcctacgtgatcctgacctatattctcctgcttaacatgcttattgcccttatgggggaaaccgtaaacaagattgcacaggagtccaagaatatttggaaactgcagcgggcaataaccattctcgataccgagaagtctttcctcaagtgcatgcggaaggctttccgatcgggaaaactgcttcaggtgggatatacacccgacggcaaggatgattatcgatggtgctttcgagtcgatgaagtgaactggacgacgtggaatacaaatgtgggcatcatcaacgaggacccaggaaactgtgagggcgtcaaacgtaccttgtccttttccttgcgctcctcacgggtaagcggacgtcattggaagaacttcgcactggtccccctgctgagggaggcgagtgcccgggacaggcagtccgctcagccagaggaggtgtacctgcggcagtttagcggcagcctcaagcccgaggacgccgaggtgtttaaatcaccggccgcttctggtgaaaagtag

SEQ ID NO: 209246 - DNA, 2340 bp, Artificial Sequence
  Description of Artificial Sequence: Synthetic coding sequence
atgaagaagtggagcagcaccgacctgggcgccgccgccgaccccctgcagaaggatacctgtcctgatccattggacggagatcctaatagtcgcccaccaccagcaaaacctcaactgtccactgcgaaaagccgtacccggctatttgggaagggcgactcggaagaggcctttccagtggactgtccccatgaggagggtgaactggactcttgtccaactattaccgtttcccctgttattacaatacagcggccaggcgatgggccaactggcgcccgtctgctaagtcaggacagcgtggcggcatccaccgagaagacactgagactatacgatagacggtctatttttgaggcagtcgcccaaaacaattgtcaagacctggagtcattgttgctgttcttgcagaagtcaaaaaagcatctaacagacaatgagttcaaggaccctgagaccgggaagacttgtctactgaaggcaatgttgaacctccacgatgggcaaaacacaactatccccctgctgctggaaatcgctaggcaaaccgattctcttaaagaactggtcaacgcaagctacaccgattcttactataaaggacagacagccttgcatatagccattgagaggcggaatatggcattagtgactctactggtggaaaacggagccgacgttcaagcagccgcccacggcgactttttcaaaaaaactaaaggacgccccggattttatttcggggagcttcctctctcgttggctgcttgtaccaaccaattaggaatcgtgaaatttctgctgcaaaattcttggcagacggcagatattagcgctcgggactcggtcggaaacacagtgctgcacgctttagtggaggttgctgataacaccgctgataacaccaagtttgtgacgtcaatgtataacgagatcctgatgctgggagccaagctgcaccccaccttgaagctcgaagaactgaccaataagaaagggatgacccctcttgccctcgccgccggaacaggcaagattggaaatcgtcacgacatgctcctcgtggagcctctgaatagactcctgcaggacaagtgggataggtttgtgaagcgcatcttttactttaatttcctcgtgtattgcctgtacatgatcatttttaccatggccgcctattatcgccccgtcgatggcttgccgccttttaagatggaaaaaacaggggactatttccgagtaacaggcgagatactgtctgtgctgggaggggtctacttctttttccgggggatccaatacttcctacagcgcagacctagcatgaagacactttttgtggattcctacagcgagatgctgtttttcctacagagtctgttcatgctggctaccgtggtcctctatttttcccatctcaaagaatatgtggcaagcatggtcttttcgctggcactgggctggaccaacatgctgtactacacacgtggattccagcagatgggcatttatgcagtcatgatcgagaagatgattcttcgggatctctgccggtttatgtttgtctacattgtgttcctgttcggctttagtactgcagtggtgaccttgatagaggatggcaagaatgactcactgccttcagaatccaccagtcacagatggcgcggacctgcctgcaggcccccagacagttcctataacagtttgtactcaacatgtctcgaactgtttaagtttacgattggaatgggagatctggaattcactgagaactatgatttcaaggccgtctttattatcctgttgctcgcatacgtgattttgacttacatactgctgctcaacatgctaattgctttaatgggtgaaacagtcaacaaaatcgctcaagaatcgaaaaatatatggaagttgcagcgagccattactatcctggatacggaaaagagcttcctgaaatgtatgcggaaggctttccggtccgggaagcttctgcaggttggctatacccccgacgggaaagacgactaccggtggtgcttccgcgtggacgaggtgaactggacgacatggaatacgaacgtcggcatcattaatgaagaccctggcaactgcgagggtgtgaagcgcactctgtctttctcgctgcgctcaagccgcgtttctggccgacactggaaaaatttcgctctcgtgccattactgcgggaggctagcgccagggaccggcagtcagcacagccagaagaagtgtatctgcgacagttctctgggtccctaaaacccgaggacgcagaggtgtttaagtccccagcggcaagcggggagaaatag

SEQ ID NO: 209247 - DNA, 2520 bp, Artificial Sequence
  Description of Artificial Sequence: Synthetic coding sequence
atgaagaagtggagcagcaccgacctgggcgccgccgccgaccccctgcaaaaggatacatgcccggaccccctggatggtgatcctaacagcagacccccccctgccaagccacagttatccaccgcaaagagccggactcggctgttcggaaaaggggactcagaggaggcctttcccgtggactgtccacatgaagaaggagagctggattcttgcccaacgataacagtgtcccctgttatcactattcaaagaccaggggacgggcccacgggcgcccgtctcctgagtcaagattccgtggccgccagtactgaaaaaactcttcgcctgtacgaccggcgtagcatctttgaggccgtggctcagaataactgtcaggacctcgagtcactcctgctctttcttcagaaaagtaaaaaacatctgactgataacgaatttaaagaccccgagacagggaaaacatgcctgctgaaggccatgttaaacttacacgatggccagaatactacaatccctctgctgctggagatcgcacgacagacagacagtctgaaggagctcgttaacgcttcctataccgactcctactacaagggacaaaccgctctgcacatcgccattgagaggcgaaacatggccctcgttactctcttggtggagaatggcgcagacgtgcaagcggccgcccacggagacttcttcaagaagaccaaaggaagacccggcttttattttggtgaactccccctgagtctcgcagcttgtacaaatcagcttggaatcgtcaaatttctcttacagaatagctggcagactgccgacataagcgcccgagattccgtcggaaatactgtcttgcacgcactggtggaggttgctgataacactgctgataatacgaagtttgtgacgtccatgtacaatgaaatcctgatgttgggcgcgaagttgcacccaaccttaaagttagaagaactgacaaacaaaaagggcatgactcctctggcccttgcggcagggacagggaaaataggtgtactcgcatatattctgcagagggaaattcaggaacctgaatgtcggcatctcagtaggaaattcactgaatgggcctacggccctgtgcacagctccctatacgacctgagctgtatcgacacatgtgagaagaattcagttctagaggtcattgcatactctagtagtgaaactccaaatcgccacgatatgctgcttgttgagcccttgaataggctgctccaagataagtgggaccgctttgtgaaacgcatcttttacttcaattttttggtctattgtctgtacatgatcatcttcacgatggccgcatattataggccggtggatgggctcccacccttcaagatggagaaaactggggactattttagagtcactggcgaaattttgagtgtattaggtggcgtatacttttttttccgaggaatccaatattttctgcagagaagaccctctatgaaaaccttgtttgttgattcctatagcgagatgttattcttccttcagtctttgtttatgctagcaactgtggtactgtacttttcccaccttaaggaatacgtcgcatctatggtgttcagccttgctctgggatggactaatatgctttactatacacgaggttttcagcagatgggaatctatgccgtaatgatcgaaaaaatgatcctcagagacctgtgcagattcatgttcgtttatattgtatttctttttggtttcagtaccgctgtcgtgacgttgattgaagatggcaagaatgactccttaccgagtgaatctacaagccatcgttggaggggacctgcctgccgcccgccagactcctcttataatagtctgtactccacgtgtctggaactctttaagtttaccatcggcatgggggacctggagtttacagaaaactacgacttcaaggccgtcttcattatcctgctgctcgcctacgtgatattaacctacatcctcctcctgaatatgctaatcgccctgatgggagagaccgtgaacaaaatagctcaggagtcgaagaatatctggaaattgcaacgtgcaatcacaattctggacactgagaaatcttttctgaagtgcatgaggaaggcctttcgcagtgggaagctcctccaggtcggctacactcctgacggcaaagacgattaccgatggtgctttcgagtggacgaggtgaactggacaacttggaacaccaatgtggggatcatcaatgaggatcctggcaactgcgaaggagtcaagcggacgctctcctttagtctccgcagtagcagggtaagtggcagacactggaaaaattttgctcttgtacccttactgcgtgaggcttcggcacgagataggcagtctgcgcagcccgaagaagtgtaccttcgtcagttctcaggatctttgaagcctgaggatgctgaagtatttaaatccccagcagcatccggcgagaaatag

SEQ ID NO: 209248 - DNA, 2520 bp, Artificial Sequence
  Description of Artificial Sequence: Synthetic coding sequence
atgaagaagtggagcagcaccgacctgggcgccgccgccgaccccctgcaaaaggacacatgccctgaccccctggatggagaccccaacagtaggccccctcccgccaagccacagctttcaacggccaagagcagaactcgcctcttcgggaaaggcgatagcgaagaagcattccctgtggattgtccccacgaggagggggagttagatagttgccctactattaccgttagcccagtgattaccattcaaaggccaggagatggccccactggggccagactactaagccaggacagcgtggctgccagcacagagaagaccttgcgcctgtacgatcgccgatctattttcgaggctgtggctcaaaataactgccaggacctggagtcgctgctgctgttcctgcagaagtccaaaaagcacctcacggataatgaatttaaggatcccgagaccggtaagacctgtctactgaaagccatgctgaacttgcacgatggtcagaatacgaccattccattgttgctcgagattgcccgtcagacagacagcttgaaggaactggtgaatgccagctacacagattcatattataaagggcagaccgcacttcatatcgctatcgagagacgaaacatggctttagtcaccctcctggtggagaacggggcagacgtgcaggccgccgcccacggagacttttttaagaagaccaagggaaggcccggattctactttggggaactgccccttagtctcgccgcctgcacaaatcagctcggaatcgtgaaatttctcctacaaaatagttggcagacggccgatattagtgcccgtgattctgttggaaataccgtgctgcacgctcttgtggaggttgcagataatacagccgataatacaaagttcgttacaagcatgtacaatgagatcctcatgctcggtgcaaaattgcaccccacattaaagctcgaggagcttaccaataaaaaggggatgacaccacttgccctggccgctgggactggtaagattggggtcctcgcttacatactgcagcgcgagatacaggagccagagtgtagacacctcagccgtaagttcacagaatgggcctacggcccggtgcattctagcctgtatgacctgtcatgcatcgacacatgtgagaaaaattccgtactcgaagtgattgcttatagttcttcggaaacgccaaatcggcacgacatgctcctggtggaaccactcaaccgccttctgcaggataagtgggatcgcttcgtgaagcggattttctattttaatttcttagtgtactgtctgtacatgattatttttacaatggctgcctactacagacctgtagacggcctgccaccgttcaaaatggaaaaaaccggcgactacttccgcgtaactggcgagattctgtctgtcctcgggggagtttactttttcttcagggggatacaatatttcctgcagcgaagaccgagtatgaagactctcttcgttgatagttatagtgagatgctgtttttccttcagtccctgtttatgctagccactgtagtcctttacttcagccaccttaaggagtacgtggcatctatggtgttctccttggcactgggctggactaacatgctttattacacccggggattccagcagatgggcatctacgctgtgatgattgaaaaaatgatcttgcgggacctctgtaggttcatgttcgtgtacattgtgttcctgttcggattcagtacagcagtggtgacattaatagaggacggcaaaaacgacagtctgccttctgagagcacaagccatcggtggcgaggacctgcttgtagacctcctgactcaagctataatagcctttatagcacgtgtcttgagttgtttaaattcaccatcggcatgggcgatttggagtttacagagaattatgactttaaggctgtgttcattattctgcttctggcttacgtgatcttaacctacatcttactgcttaatatgcttatcgccctaatgggcgaaaccgttaataaaatcgcacaggaaagcaagaatatctggaagctgcagagagcgatcactattctggacaccgagaaatccttcctcaaatgcatgcgcaaggcttttcgcagtggcaaactattgcaggtcgggtatacgcccgacggcaaggatgattatcgctggtgctttcgggtagacgaggtcaattggactacgtggaacactaacgttggaatcatcaacgaggaccccgggaactgtgaaggcgtgaaacgaacactctccttcagcttgaggtcgtctcgggtgagtggaagacactggaagaattttgctctggttcctttactccgggaggccagtgcccgcgacaggcagtcagcacagccggaagaagtgtatctgcgacaattcagcgggagtctgaagcccgaggatgcagaagtgtttaaatccccggccgcaagcggagagaaatag

SEQ ID NO: 209249 - DNA, 2553 bp, Artificial Sequence
  Description of Artificial Sequence: Synthetic coding sequence
atgaagaagtggagcagcaccgacctgggcgccgccgccgaccccctgcagaaagatacctgccctgacccactggatggcgatcccaattccagacctccccctgcaaagccccaactgagcaccgctaaatcaaggaccaggctcttcggaaaaggagacagcgaagaggcctttcccgtggactgcccacacgaggaaggggagctggactcctgcccaactattacagtgtcgcccgtgataactattcaacgcccaggagacggccctactggggcccgcttactctcccaggattcagtagccgcaagcaccgagaaaactctacggttgtacgaccgacggagtattttcgaagccgtcgcccagaataattgccaagacctcgaaagcttgctactgttcctgcaaaagtcgaaaaaacatctcactgacaatgagtttaaagaccctgaaacaggaaaaacatgcctcttgaaagccatgctgaacctgcatgacggacagaacacaaccatcccattgctgcttgagatagctagacagacagactccctcaaggagcttgtcaacgcatcttatacagattcttactacaagggtcagacagcactgcatatcgccatcgaacgtagaaatatggcactggtaaccctcctcgtggagaatggcgccgatgtgcaggccgccgctcatggcgacttttttaagaagactaagggccggccaggattttatttcggagagctgccactgagtttagccgcgtgcaccaatcagttagggatagtcaagtttttactgcagaatagctggcaaaccgctgacatttctgctcgagacagcgtgggaaataccgtattacatgcgctggtggaagtggctgataatacggccgacaatacgaagttcgtgacttccatgtataatgaaatcctgatgctcggagcgaagctccacccgacgttaaagcttgaggagctgaccaataaaaagggtatgactccactagcattagctgcaggcactgggaagataggggtgatcgaaaacggaccccctctgagtttcatggtcctagcttacatactccaaagagaaattcaggagccagagtgtagacacctctctcggaaatttactgaatgggcttacggtcccgttcacagcagcctatacgacctgtcttgtatcgacacgtgcgagaagaacagcgttctagaggttatagcatattcttcctcggagacaccaaaccgtcacgacatgcttctcgtggaacccctgaaccggctactccaggataagtgggatagattcgttaagaggatcttttacttcaacttcctcgtctattgtctctatatgataatctttacaatggccgcttactataggccggtggatgggctacccccctttaagatggaaaaaacgggagactacttccgcgttacgggcgagatactgtcagtgctgggcggcgtgtattttttcttccgcgggatccagtatttcttgcaacgaaggcccagcatgaagaccttgttcgtcgattcctattcagaaatgctcttcttcctgcagtctttattcatgcttgcaactgtggttctctacttctcccatttgaaggagtatgtagcatccatggtgttttctcttgcactgggctggactaatatgctctactacactaggggattccagcaaatggggatctacgccgtcatgattgagaagatgattctccgagacctgtgtagattcatgttcgtctatatcgtgttcctgttcgggttcagcaccgccgttgtgactcttatcgaggacgggaagaacgattctctgcctagcgagagtactagccatcgatggcggggccccgcttgccgcccgccagactccagctataacagcctctacagtacctgtctggagctgtttaagtttacaattggaatgggagacttagagttcactgagaattacgatttcaaggcagtgttcattatactcctacttgcttacgtgatcctgacttacatccttctactgaacatgctgatcgcccttatgggcgagactgtgaacaagatcgcgcaggagagcaagaatatttggaagctgcagcgcgctataactatcctcgacactgaaaaaagctttctcaagtgcatgcgcaaagcttttcgctctggtaagcttctccaggtcgggtatacgcccgatggcaaggacgattaccggtggtgctttagggtggacgaggtcaactggacgacctggaacaccaatgtcggaatcattaatgaggacccgggaaattgtgagggcgttaaacgaacactctctttctcactccgatcgtcccgggtgtcaggcaggcattggaagaacttcgccctagtgcctctgctcagagaagcctccgcacgcgatagacaatccgcccagcccgaggaagtctacctacggcagttctctggttcactgaagccagaagatgcagaggtcttcaagtctcccgctgcctctggagagaagtag

SEQ ID NO: 209250 - DNA, 2295 bp, Artificial Sequence
  Description of Artificial Sequence: Synthetic coding sequence
atgaccagccccagcagcagccccgtgttccggctggagaccctggacggtgggcaagaagatgggtcagaggcagaccgtgggaaacttgatttcggttccgggctacctcctatggaaagccagttccagggtgaggacagaaagttcgcccctcagatccgcgtcaatttgaattaccgaaaaggcacaggcgctagccaacctgatcccaaccgattcgacagggaccgactgttcaacgctgtgtcacgtggcgtaccagaagacttggccggcctcccagaatacttgtctaagacttccaaatatctaaccgactcggaatataccgagggttctacaggaaaaacctgtcttatgaaagctgttcttaatttgaaggatggcgtaaatgcttgtattctgcctctactgcaaattgaccgcgattcggggaacccgcaaccattagtaaatgcccagtgcacagatgactattatagggggcactcagccctccacattgctatcgagaaaaggtccttacagtgtgtaaaattacttgtggaaaacggtgcgaatgtccacgctagggcatgtggaagattttttcagaaaggccaggggacatgtttctatttcggagaactccccttatccttggccgcatgtactaagcaatgggacgtcgtgtcctacctcctcgaaaaccctcatcagcctgcctcattgcaggcaacagactcacagggaaatacggtgctgcatgccttagtgatgatctcagacaatagtgcggagaatatcgccttggttaccagcatgtacgatggcctgcttcaggccggagcccgactttgtcctacagtgcagctcgaagatatccgaaacttgcaagatttaaccccactaaagctcgctgccaaggaaggcaagatagagattttccggcacatactccagcgggaatttagcgggttgagtcatctctctagaaagttcacggaatggtgctatggccctgtgcgtgtcagtctttatgatctcgcttcagtggacagctgtgaagaaaactctgtgctggagatcatcgcgttccactgcaagtccccgcatcggcaccgcatggtggttctcgagccactcaacaaactgctccaggccaaatgggacctcctgatccctaaattcttccttaactttctgtgcaaccttatttacatgtttatttttacagccgtagcgtatcaccagcccaccttgaagaaacaggccgctcctcatttgaaagccgaggtagggaactcaatgctgttgacgggccatatcctgattctgctgggggggatctatctgctggttggtcaactgtggtacttttggagaaggcacgtcttcatttggatcagtttcatagactcatatttcgagatactcttcttattccaagccctgctcaccgtggtctcccaggtgttgtgtttcttagctatcgaatggtacctccctctgctcgtcagtgcactggttcttgggtggttgaacctcctttactacacgaggggatttcagcacaccggaatttattccgtaatgatacagaaggtaattctaagagatctgttacgcttcttactgatttatctagtattcttgtttggcttcgctgtcgctttggtcagtttgtcacaggaggcatggcggcctgaagcccccaccggccccaatgcaacggaatcggttcaacctatggaaggccaggaggacgaagggaatggggcccagtaccggggtattctggaggcctccctcgaactcttcaagtttaccattggtatgggcgagttggccttccaggagcagcttcatttccggggcatggttctcttgctgcttctggcctatgttttgttgacatacatcctcctactaaacatgctgatcgcccttatgagcgaaacagtaaacagtgtggcaactgactcttggtccatatggaagctgcaaaaagccatcagcgttctcgaaatggagaacgggtactggtggtgtcgcaaaaagcagcgcgcgggagtcatgctgactgtggggaccaagccagatggcagtccagacgaacggtggtgcttccgagttgaggaggtcaactgggctagctgggaacagacgttacctacactatgcgaagatccaagtggagccggtgtgcccagaacactggaaaatcctgtacttgccagcccccccaaagaggacgaagacggcgcctccgaagaaaactacgtccccgtgcagctcctccagtcgaactag

SEQ ID NO: 209251 - DNA, 801 bp, Artificial Sequence
  Description of Artificial Sequence: Synthetic coding sequence
tgagacttcagcctgggcgtgcccagctggtggtgcctgatctgcttcaatatcggtccctccgtaggcccatctcagcccgatccaaaccgttttgaccgggatcggctgtttaacgcagtgagtcgaggcgtgcctgaagatttggcgggtttgccagagtacctgtccaagacctccaagtacttaactgattcagagtacaccgaaggcagcacaggaaaaacttgcctgatgaaagcggtattgaacttgaaggacggcgtcaacgcttgcatccttccactgctgcagatcgatcgcgacagcggaaacccacagccattagtcaacgcccagtgcactgacgactattatcggggtcatagcgccctgcacattgctatcgagaagaggtcactccagtgtgtaaagttgctcgtggaaaacggcgctaacgttcacgcgagagcctgtggtaggtttttccagaaaggccagggcacttgtttttacttcggagagctgccactttccttggctgcttgcactaagcagtgggatgttgtttcgtacctgctcgaaaacccccatcagccagcttcacttcaggcaacagactcccagggcaacaccgttctccacgccttagtgatgatttcggacaattctgccgagaacattgctctagtaactagcatgtacgatggtctactccaagccggtgcgcgcctgtgccctaccgtccaactggaggatattcggaacctccaggatctcacgcctctgaaactggccgccaaggagggcaaaatcgaatag

SEQ ID NO: 209252 - DNA, 2373 bp, Artificial Sequence
  Description of Artificial Sequence: Synthetic coding sequence
atgaaggcccaccccaaggagatggtgcccctgatgggcaagcgggtggcagctcctagtggaaatcccgccatactccccgaaaagcgtcccgctgagattacccccacaaagaagagcgcccacttcttcctggagatcgaaggcttcgaacctaacccgacagtggctaaaacatcacctcccgtcttctcaaagcccatggactccaatattcgccagtgcatcagcgggaattgcgacgacatggattcaccacagtccccacaggacgacgtgaccgaaacccctagcaatccgaacagtccatccgcacagttggccaaagaggagcagaggcggaagaagcgacgcctgaagaaacggatcttcgcggcagtctcagagggttgcgtggaagaactggtagaactgttagtggagttgcaggagctatgtcgaagaagacatgatgaggacgttccagattttctgatgcacaagctaaccgcctcagacactgggaagacatgtcttatgaaagcccttctgaatattaatcccaacaccaaggaaattgtgagaatcctgctggccttcgccgaggaaaacgatattttgggacgattcattaatgcggagtacaccgaagaggcatacgaaggccaaacagcgttgaacattgccatcgaaagacgccagggtgacattgcagcacttctgattgccgcaggcgctgatgtgaacgcccacgctaagggcgcttttttcaatcctaaatatcaacatgaaggattttactttggcgagactcctctggcactcgctgcctgcacaaatcagccggaaattgtgcagctcctgatggagcacgagcagacagatattacgagtcgggatagtaggggcaacaacatcctgcatgccttagtgaccgtggctgaagacttcaagacccagaacgacttcgtcaaaaggatgtacgatatgattcttctcagaagtggcaattgggaacttgagacaacccgcaacaacgacgggctcacccctctgcagctagcagccaagatgggcaaggcagaaattctcaaatacattttgtcccgcgagatcaaggaaaagcggctgaggtcattatcacgtaaatttaccgactgggcttacggcccagtgagcagcagcctctatgatctaaccaatgttgacacaacaacggataactctgtgttggagatcactgtttataacacaaatatagacaaccgccatgaaatgcttactctggaacctctgcacacactgcttcatatgaaatggaaaaagttcgccaagcacatgttcttcctgagtttctgcttttactttttctacaacatcacactgaccctggtctcctattatagacccagagaggaggaggcaattccccatccccttgccctgactcacaaaatgggctggctgcagctactggggaggatgttcgtgctgatttgggcaatgtgtatttctgtaaaagaaggcatcgcgatttttctgctgagacctagtgatctgcaaagcatactgtctgatgcctggttccactttgtgtttttcatccaggccgtgttagtgatcctgagcgtcttcctgtatctctttgcctacaaagagtatctggcatgcctggtgctggccatggctcttggctgggctaacatgttatactacacccggggcttccagagcatgggaatgtacagtgtgatgatccaaaaggtgattctgcatgacgtgctgaaattcttgttcgtgtacatagttttcctcctggggttcggcgtggctctcgctagcctgatcgagaagtgtcctaaagacaacaaagattgctcaagctacggctctttttcagatgctgtcctcgagctattcaagctgacaatcggactcggagaccttaacatccagcagaacagcaaataccccattctgtttctattcctgctgattacctatgtgatcctgacattcgttctcctcttaaacatgctcattgcactcatgggggagaccgtcgaaaatgtgtctaaggaatccgagagaatctggcggctacagagagcgcgcactattctggaattcgagaaaatgctgccagaatggcttcggagccgttttcgaatgggtgagctgtgtaaggtggccgaggacgactttcgcttatgtcttaggataaacgaagtgaaatggactgagtggaagactcatgtctcttttctgaacgaggatccaggccccgtgcgaaggacagactttaataagatacaggactcctctcgcaataattctaagaccacccttaatgcttttgaagaggtcgaagagttccctgaaacctctgtgtag

SEQ ID NO: 209253 - DNA, 2376 bp, Artificial Sequence
  Description of Artificial Sequence: Synthetic coding sequence
atgaaggcccaccccaaggagatggtgcccctgatgggcaagcgggtcgctgcaccctctggcaatcctgctattctacctgagaagcgccctgccgaaattacgcctaccaagaaatccgcccacttttttctggagatcgaggggtttgaaccaaaccctaccgtcgctaagacttcacctcctgtgttctccaaacctatggacagcaatattcgccagtgtatctctgggaactgcgatgacatggacagcccccaatcgccccaggacgatgtgactgagactccaagcaacccaaacagtccgtccgctcagcttgctaaggaagagcagagacgaaagaagcgccgcttgaagaaacgaatcttcgccgcagtgtccgaggggtgcgtagaagagttggtggagcttttagtagagcttcaggaactgtgtaggcgccggcatgacgaggatgtccctgacttcttgatgcacaaattgactgccagtgatacgggcaaaacgtgccttatgaaggccttactgaatataaaccctaatacaaaagaaatagtccggatacttcttgcctttgccgaagaaaatgatatcctcggacgattcattaacgcggagtacaccgaggaggcttatgaagggcagacagcattaaatattgcaatcgagagacgccagggcgacatcgccgcactgctgattgcagcaggcgccgatgtgaacgcccatgccaagggggctttcttcaacccgaaatatcaacacgaaggattctattttggcgagacacctcttgcgctggctgcctgtactaaccagccagaaattgtgcagttgctgatggaacatgaacagactgacatcacgagcagagatagccgaggcaataatattctgcatgccttggtaacagttgcggaggattttaagacacagaacgactttgtcaagaggatgtacgacatgatcttgttacgatccggaaattgggagcttgaaacgacccggaacaacgacgggctgacaccactccagcttgccgccaagatgggtaaggctgaaattctgaagtatatcctttcccgcgaaataaaagaaaagaggcttcggtctcttagccgcaagtttaccgactgggcctacggacctgtctcttcgtcactgtatgacctgaccaacgtcgataccacgaccgataacagcgttctggagattacagtatataacaccaatatcgacaataggcatgaaatgcttaccctggagcccctgcataccctactgcacatgaagtggaaaaagttcgcaaaacatatgttttttttatcattctgcttctactttttctataacatcaccctcacactggtatcctactatagaccgagggaggaagaggccatcccccaccctctcgctctcacacacaaaatggggtggctgcagctcttgggcaggatgttcgttctcatctgggctatgtgcatctccgtaaaagagggtattgccatattcttgctacggccaagcgatctccaatccattctgtccgacgcttggtttcacttcgtcttcttcattcaggctgtgctggtaattctgagtgtgtttctgtacctctttgcttacaaggaatatttagcatgcctggtattggcaatggctctaggctgggccaatatgctgtactatactagaggttttcaaagtatgggcatgtactccgtgatgattcagaaagttattctgcacgacgttctaaaattcctattcgtctacatcgtgtttttacttggcttcggggtggcactcgcgagcttgatcgagaagtgccctaaagataacaaggactgctctagttacggttcgttcagcgacgccgtgttagagctatttaagctaactattggcctgggcgaccttaatatccagcagaactcaaagtatcccattctgttcctgtttcttctcatcacctatgtcattcttacgttcgttctactgctgaatatgttaattgcactgatgggggaaacggtcgagaatgtaagcaaagagtccgagcggatctggaggctgcagcgagcccgcaccattttagagttcgaaaagatgctgcccgaatggctcagaagtaggttcaggatgggcgaactatgcaaggtagccgaggatgacttccgcctatgtctccgtatcaatgaggtgaaatggacggagtggaagacacacgtctccttcctgaacgaggacccaggacctgtccgcaggactgctgattttaataaaatacaggactcctcaagaaacaatagcaagacaacactcaatgcatttgaggaagttgaagagttccccgagactagtgtatag

SEQ ID NO: 209254 - DNA, 2328 bp, Artificial Sequence
  Description of Artificial Sequence: Synthetic coding sequence
atgagccaccacacctggcccagccccgccctgaacctggacttcgccacgtacctcttacgcgatttgggtgctcattttttcctggagatagagggcttcgagcccaatcctaccgttgcaaaaacgagccccccagtttttagtaagcctatggacagcaacatccgtcaatgcatttctggaaattgcgacgatatggattccccgcagtccccccaggacgacgtaactgagacaccatctaatccgaactctccgtccgcacaattggccaaggaggaacagcgcaggaaaaaacgacggctgaagaagcggatcttcgctgcagtgtccgaaggatgcgtagaggagctagtcgaattacttgttgaattacaagagctgtgccggcgccgacatgacgaagatgtcccagactttctgatgcacaagctcacagcttctgacacaggaaaaacctgccttatgaaagccctcctgaacattaacccaaacaccaaagagattgtgcggatccttctggcttttgctgaggagaacgatatattagggagattcattaatgcggagtacactgaggaagcctacgagggtcagactgcactcaatatcgctattgagcggcgacagggtgacatcgctgctctgctgatcgcagcaggcgctgacgtcaacgcccacgctaaaggcgctttcttcaaccctaagtaccagcatgagggcttttactttggagagactcctctagccctggccgcttgcacaaatcagccagaaattgtccagttgctgatggagcacgagcagacagatatcacatcaagggacagtcgagggaataatatactccacgcccttgtcactgttgcagaagactttaaaactcaaaacgatttcgtgaagagaatgtatgatatgatcctcctgcgctctggaaattgggagctggaaacgacacggaataatgatggcttgaccccactccaattggctgctaagatggggaaggccgagattctaaagtatattttgtcccgggagatcaaggagaagcgccttcgctccctgagtcgtaaatttaccgactgggcatacggacctgtctctagctctctttacgacttaaccaacgtagacaccaccacagataacagcgtcctggaaattacagtttacaacaccaacatcgacaatcggcacgagatgctgacgttggaacctctccatacccttctgcacatgaagtggaaaaaatttgctaagcacatgtttttcctgagcttttgcttctattttttttataacatcacattaacactcgtaagttactacaggccaagggaggaagaagccatacctcacccactggcactgacacataagatgggatggctgcaattgctgggaagaatgtttgttctgatatgggccatgtgtatctctgtgaaggaaggcatcgccatattcctgttgcggccctcagacctccagagcatcctgtctgatgcgtggttccattttgtcttcttcatccaggctgtcctcgtcatcctaagcgtctttctatacctttttgcctacaaggagtatttggcctgtttggtgctggcgatggcattgggctgggcaaacatgctttactataccagaggcttccagagtatggggatgtattccgtgatgattcagaaggtgattctgcacgacgtgctcaagttcctcttcgtgtacattgtctttttactcggatttggtgtggcattggccagcctcattgaaaaatgcccgaaagacaataaggactgctcctcctacggaagcttttctgacgcggtcctggaactattcaaactcacaattgggctcggggacctcaacatacagcagaactcgaaataccccatcctttttttattcttgctgattacttacgttattcttactttcgtgttgctgcttaacatgcttatcgccctgatgggcgagacagttgagaacgtgtccaaggaaagcgagagaatatggaggctacaacgtgcacggacaatactagagttcgaaaagatgctgccagagtggctgcgcagccgttttcgtatgggagagctgtgtaaggtggcagaggatgatttccgactgtgtcttaggatcaatgaagtaaagtggaccgagtggaagacacatgtcagttttctcaatgaggatcctgggcccgtcaggagaaccgcagacttcaacaaaattcaggacagcagtcgcaacaattcaaagactacattaaatgctttcgaagaggttgaagaattcccagagacatcagtgtag

SEQ ID NO: 209255 - DNA, 2616 bp, Artificial Sequence
  Description of Artificial Sequence: Synthetic coding sequence
atggccgacagcagcgagggcccccgggccggccccggcgaggtggccgagttaccaggggacgagagcggcacgccgggaggcgaagcgttcccgctgtcctcattagccaatctcttcgaaggcgaagacggtagcctgtcaccgtcaccagcagatgcgtcccgaccagctggcccaggcgacggcagaccaaatctacgcatgaagttccagggagcctttcgaaagggcgttccaaaccctattgatctactggagtctaccctttatgaatcttctgtggtgccgggtcctaaaaaggcacctatggacagtctcttcgactacgggacctaccgacaccactctagcgacaataagcggtggagaaaaaaaatcatagaaaaacagcctcagagtccaaaggccccagctcctcaaccacctcctatcctgaaggtgtttaatagacccattctgtttgacatcgtctcccgtgggtctaccgccgatcttgacggtctgttgcccttcttgcttacccacaagaaacgtctcacagacgaggagtttcgagagccatctacaggaaaaacctgtctacctaaggccctgcttaacttgtcaaatggtcggaatgataccatcccagtgctgctcgacattgctgagcggacaggtaacatgagggagttcattaacagtcccttccgtgatatctattacagggggcagactgccctgcatattgccatagagagaaggtgcaagcactacgttgaactattagtggctcagggtgcagatgtgcacgcccaggctagagggcgattttttcaacctaaggatgagggtggctacttctactttggggagctccctcttagcctagccgcctgtaccaatcagccccatattgtgaattatttgacagagaatcctcacaaaaaagccgacatgcggaggcaagattcgcgtggaaatacggttctccatgctctggtggctattgctgataatacaagggagaacaccaagtttgtgactaagatgtacgacctgctgctgttgaagtgcgccaggttgttccccgactctaatctggaggctgttctgaacaacgacggcctgtcacctcttatgatggctgccaagaccggcaagattgggatattccaacatatcattcgacgcgaagttacagatgaggatactaggcacctctctcgtaaattcaaggactgggcttatggccccgtttatagtagcctgtacgacctgtcctcactcgatacatgcggggaggaggcgagcgtcctggaaattctggtctacaacagtaagatcgaaaacagacacgagatgctggctgtcgaacccattaacgaattactgagggataaatggcgaaaatttggcgccgtgagcttttacatcaacgtggtgtcgtatttgtgcgccatggtcatctttaccctgactgcgtactaccagccactcgagggcacccccccatacccttaccgaactactgtggactaccttagattggctggggaggtgattaccctgttcaccggtgtgctgtttttcttcaccaacattaaggatctgtttatgaaaaagtgccctggcgtgaatagcctctttatagatggaagctttcagctgttgtattttatttatagcgtgttggtgatagtgagcgccgcactgtatcttgctgggattgaggcataccttgcagtgatggtgtttgccctagtccttggctggatgaacgctctctacttcacaaggggacttaagctgactgggacgtactccatcatgattcagaaaatcctgtttaaggatttattccgcttcctgctggtgtacctgttgtttatgattggctacgcatccgcactggtgtcgctgctcaacccatgcgccaatatgaaggtgtgcaatgaagatcagacgaattgcaccgtgccaacgtacccctcctgcagggattctgagacattctctacattcctgctggacctgttcaagttgaccattggaatgggcgatctggagatgctgtcctcaacgaagtatcctgttgtcttcattattcttcttgttacttacatcatacttaccttcgtactcctgctcaacatgctgattgctcttatgggagaaactgtcggtcaggtaagtaaggagtctaagcacatctggaaactgcagtgggccacaaccatcctcgacatagaacgctccttcccggtgtttctgagaaaagcttttcgatccggggaaatggttaccgtcgggaagagcagcgacggtactccggacagaagatggtgctttagggttgacgaggttaattggagccactggaaccagaacttggggattattaacgaagaccccggaaagaatgagacctaccaatattacggattctcccacacggttggccggctgaggagagaccggtggtcatccgttgtgccacgggtggtcgagctgaacaagaattctaaccccgatgaagttgtcgtgcctttagacagcatgggaaaccccagatgtgatggacatcaacagggatatcccaggaaatggcgaactgacgatgcgcccttatag

SEQ ID NO: 209256 - DNA, 2436 bp, Artificial Sequence
  Description of Artificial Sequence: Synthetic coding sequence
atggccgacagcagcgagggcccccgggccggccccggcgaggtggccgagctcccgggagacgaatctgggacccccgggggcgaagccttcccgctgtcctctctggcaaatcttttcgaaggtgaggacggctctctctcccccagtccagccgacgccagccgccccgctggtccaggggatggcagacctaacctgagaatgaagtttcagggcgcgtttcgaaagggggtaccaaacccgatagaccttctggaatcaactctttacgaatcctcagttgttcccgggcccaaaaaagcacctatggattcattgtttgattacggcacgtataggcaccattcttccgataacaagcgctggaggaagaagatcatcgagaaacaaccacaaagtcccaaagcacctgcccctcagcctcctcctatcctgaaagtctttaaccgacccatactgttcgatattgtgtcacgtgggagtaccgccgatctggacgggttgttaccttttctccttacccacaagaaacggcttaccgatgaagagtttcgtgagccttctaccgggaaaacttgtctccctaaggcacttcttaatctctctaatggccgtaacgatactatacctgtcttgctggatatcgccgagaggacaggaaatatgagggaattcataaactcgccattcagagacatctactatcgtggtcaaacggctttgcatattgccatcgagagacgttgtaagcattacgtcgagttgctggtggcgcaaggcgccgacgtgcacgctcaggctaggggacgcttttttcagcctaaagacgaaggcggatacttctactttggcgagctcccactctcactggcggcctgtaccaatcagccacatattgtcaattatttgacagagaaccctcataagaaggcggatatgcgcaggcaggactcacgtggaaatactgtccttcatgcactcgtcgcaatcgcagataatactagagagaatacaaaattcgtgaccaaaatgtacgacttactgctgctaaagtgtgcaagactgtttcccgattccaatctagaagcagtgctgaacaacgacggcctttcacccctcatgatggccgcaaaaacgggtaagattggcaacaggcacgagatgctcgcagtcgaaccgatcaacgagcttctgagggataagtggcggaagtttggcgccgtatctttctacattaatgttgtctcctatctgtgtgccatggttatatttaccctgactgcctattatcagcctctagagggcaccccgccgtacccatacaggactaccgtcgactatttgcgtctcgctggcgaggtaattaccttgtttaccggcgtgctgtttttctttactaacatcaaagatctcttcatgaaaaagtgccccggtgtcaatagtctgtttatcgacggttcctttcaattgctttacttcatctatagtgtgttggtgatcgtgtcagctgctttgtatctagcagggatcgaagcctacctcgcggtgatggtcttcgcattagtcttaggatggatgaacgctctctacttcactaggggcctgaagctcaccggaacctacagcattatgatccaaaaaattctgtttaaggatctcttccgcttcctgctggtctacttactgtttatgattggctatgcctcagccctggtatctttgctgaacccttgtgcgaatatgaaggtgtgtaacgaagaccagaccaattgcaccgtgcccacatatccttcttgccgagatagcgagaccttctcaacatttctgctagatctcttcaagctcactataggaatgggtgacctggagatgctgagctccacgaaatatcctgttgtgtttatcatactgctggtaacttacattatcttgacgtttgtgcttctccttaacatgttgatcgctctcatgggtgagaccgtgggtcaggtgagcaaagagagtaaacacatctggaaacttcaatgggccacaaccattctggatatcgagcgatctttccccgtgttcttgcgaaaagcctttcgatctggcgaaatggtgacagtcggcaaaagttcggatggcacaccagataggcgctggtgcttccgggtggacgaagttaactggtctcactggaatcagaatctaggtattattaacgaggatcctgggaagaatgagacctatcaatactatgggttcagtcacacagtcggccgcctgcggagagatcgttggtcgagtgttgtgcccagggtggtggagctgaataagaactctaatccagacgaagtggtggttccgttagattcaatgggaaaccctagatgcgacgggcatcagcagggctaccccagaaagtggcgcaccgacgatgctccattatag

SEQ ID NO: 209257 - DNA, 2475 bp, Artificial Sequence
  Description of Artificial Sequence: Synthetic coding sequence
atggccgacagcagcgagggcccccgggccggccccggcgaggtggccgagctcccgggagacgagtctggtacaccaggtggcgaagcttttcctttgagctccttggcaaacctgtttgagggggaggacggatccctttctccctctccagccgatgcgagccggccagctggacctggtgacgggagaccaaatctcaggatgaagttccagggcgccttcagaaaaggggtgccaaatccaatagacctgctggagtctacactgtacgagtcgtcagtggtgccaggccccaaaaaggcacccatggacagcctgttcgactacggaacatacaggcatcacagcagcgacaacaagaggtggcgcaagaagataatcgaaaagcagcctcagtcccctaaagcccctgccccacagcccccgccaatcctgaaagtctttaatcgacctatcttatttgatattgtgtctcgcggatcaacagccgacctggacggtctgttgcctttcctgctgacacataaaaagcgcctgaccgatgaagaatttagagaaccttcgactgggaagacatgcctcccaaaagcgttactgaacctgtctaacggccgcaatgacaccattcccgtgctgctggacattgcggagaggaccggtaatatgcgcgaattcattaatagccccttcagggacatatactacagaggcgaactcccattgagcttagcagcctgcactaaccagccacacattgtcaactaccttacagagaatccacataagaaagcagatatgcggcgccaggattctcgaggcaatacggtcctgcatgctctggtggccatagctgacaatactagagaaaatactaaatttgtgaccaagatgtatgatctgttattgcttaaatgcgctcgactttttccggactcaaatctggaggctgtgctcaacaacgacgggctaagccctttgatgatggcagcaaaaacgggaaagatcggaatctttcagcacattattagaagggaggtgacagatgaggatacacgtcacctatcccggaagtttaaagactgggcttatggcccagtgtatagcagcttatacgatctgtcatcactggatacctgtggggaggaggcctcagttctggagatcctggtttacaacagcaaaatagaaaatcggcatgagatgctcgctgtagagcctatcaatgagcttctgcgcgacaagtggcggaagttcggcgctgtgagcttctacattaatgtcgtgtcttatctttgtgctatggttatttttaccctcacagcttactaccagcctctggagggcacgcccccatatccgtaccgaactacggtcgactacttacggctggcgggtgaagtaattactctgtttacaggcgtgctgttcttcttcactaacatcaaggacctcttcatgaagaaatgcccaggagtgaatagcttattcatcgatggatctttccaactgctatactttatttactccgtcttggttatcgttagcgccgctctctaccttgcaggaatcgaagcatatctggctgtaatggtctttgctctggtgctcggatggatgaacgcactctatttcaccagagggcttaagttaaccggtacatattcaattatgattcagaagattctgttcaaggacctgtttcggtttctgttggtctacctgctgtttatgataggatacgcgagtgcacttgtatctctgttgaacccatgcgcaaatatgaaggtgtgcaacgaggaccagacaaattgtacagtgccaacttaccccagctgtcgcgatagcgaaacattctcaacctttctcctcgatttattcaaactgaccataggaatgggtgatctggagatgttatcctcaaccaaatatcccgtggttttcatcatcctgcttgtcacctacattattctgacgttcgtgcttcttctgaatatgctgatcgcactaatgggtgaaacggtagggcaggtgtccaaagagagcaagcacatctggaagctccaatgggcaaccaccatcctggatatagaacggtccttccccgtatttctgcggaaggcattccgttccggcgaaatggtgactgtgggcaagtcctctgacgggacacctgaccggcggtggtgctttcgggtagatgaggttaactggtcccactggaaccaaaaccttgggattataaatgaagaccccggcaagaacgagacgtaccagtactacggattcagtcacaccgtgggtaggctgaggcgtgataggtggtcttccgttgttcctagggtggtggagcttaataagaacagtaatccagatgaggtggttgtgcccctggacagcatgggcaatccccggtgcgacgggcaccaacagggttacccgcgaaagtggagaacggacgatgcccctctatag

SEQ ID NO: 209258 - DNA, 2616 bp, Artificial Sequence
  Description of Artificial Sequence: Synthetic coding sequence
atggccgacagcagcgagggcccccgggccggccccggcgaggtggctgaactaccaggagacgagtccgggacgcccggcggagaagccttccctctatcctctctagccaatctatttgagggagaagatgggagcctgagtcctagcccggccgacgcttcccgtccagccggaccgggggacggtcggccgaaccttcggatgaagtttcagggagccttccgcaaaggggtgccaaacccaattgatttgctggaatccactctgtacgagtccagcgtggtgccagggcctaagaaggctcccatggattctctgtttgactatggaacatatagacaccacagtagtgataacaagcgatggcggaagaagattatcgagaaacagccacaaagccctaaagcaccggcaccacagcccccacccatattgaaagtgttcaaccggcccatcctgttcgacattgttagccgaggcagcacggcagatttggacgggctactgccctttctactgacacacaagaagcggctcactgacgaggagtttcgcgagccctccaccggcaagacctgtctgcctaaagctctcttgaacctctcgaatggtcgtaacgacacgatacccgtgctgctagatatcgctgaacgcaccgggaatatgagggagttcattaacagcccattccgcgacatatactacagaggacagacagcacttcacatcgcgatcgaacgcagatgcaagcactacgtggagctgctcgtagcccagggcgccgacgtgcatgcccaggcgaggggcagatttttccaaccgaaggatgagggtggttacttctatttcggagagcttccccttagtctagctgcctgcacaaatcagccacatatcgtcaactatctcacagaaaatcctcataagaaagccgacatgcggaggcaggattcaagaggaaacacagtgttgcacgccttggtggcgattgccgacaatacaagggaaaataccaagttcgttactaaaatgtatgacttgctcctcctgaagtgcgcacggcttttccctgactcgaacctggaagcagtcttgaacaacgatggtctgtctccactgatgatggccgcgaaaaccgggaaaattggcatattccagcacattatccgaagagaagtgaccgatgaagacacccgacatctgtcaaggaaattcaaagactgggcctacggacccgtgtatagcagcctttatgacctatcttcgttggacacatgtggtgaggaagcatcagtgcttgagatcctggtgtacaactctaagattgaaaatagacatgaaatgcttgccgtggagcccatcaatgagctgcttagggacaaatggcggaaattcggcgcggtaagcttctacattaacgtcgtgagctatctgtgcgcgatggtgatctttacactgacggcctattaccagcctctagaaggcacccctccctatccatataggaccacggttgattacctgcggctggcaggagaggtgattacactttttacaggcgtactctttttcttcaccaacatcaaggatctgtttatgaaaaagtgccccggcgttaactccctgttcatagacggctctttccagctgctttactttatttacagcgtattagtgatcgttagcgcagccttatatttagcaggaattgaggcctacttggccgttatggtgttcgcgctggtattgggctggatgaatgctctgtatttcactcgtggtctgaaacttaccggcacgtactctattatgatccagaagattctttttaaggatttgttcagattcctcctcgtctacctacttttcatgattggctatgcaagcgccctggtttctctattgaatccctgtgccaatatgaaagtatgtaatgaagatcagacaaactgcacagtaccaacctacccaagttgcagagatagcgaaacgtttagcacctttctgctggacctctttaaactgacaatcgggatgggcgatctagaaatgttgtcctccactaagtacccagtggtgttcataattctgctcgtgacctatatcatattaaccttcgtgctgttactgaacatgcttatcgctttaatgggcgagacggtcggtcaggtctctaaggaatccaagcacatctggaagttgcagtgggcgaccactattctggacatcgagaggtcttttcccgtgttcctgcgcaaggcctttcgcagcggggagatggttactgtcggcaagagtagtgacgggaccccagatagaaggtggtgcttccgggtagatgaggtgaactggagccactggaatcaaaaccttggaataatcaacgaggatcccggtaagaatgagacctatcagtattacggattcagccacaccgtgggccggctaagaagggaccgctggagctcggtcgtgcctagggtggtggaactcaataagaatagcaatcccgacgaagtcgtggtgccactggattctatgggtaacccacgatgcgacggtcatcagcagggatacccaaggaagtggcggacggacgacgcacctctctag

SEQ ID NO: 209259 - DNA, 2514 bp, Artificial Sequence
  Description of Artificial Sequence: Synthetic coding sequence
atggccgacagcagcgagggcccccgggccggccccggcgaggtggccgagctgccgggggatgagtcagggacacctggagacggccgacctaatctccgcatgaaatttcagggcgcctttaggaaaggcgtgcctaacccaatcgacctgctggagtccactctgtacgaaagttctgtggtgccggggcccaaaaaagccccaatggacagcctcttcgattatggtacatacagacatcattcgagtgataataaaagatggcgtaagaaaatcatcgagaaacaaccccagagccccaaagcccctgcgcctcagcccccccccatccttaaggtcttcaaccgcccaatcctcttcgacatcgtgtctcgaggctccactgcagacctggatgggctcctgccctttctgctcacccataaaaaaagactcactgacgaggaattcagagaacccagtactgggaaaacatgcctccccaaggctttactcaacttgagcaatggcaggaatgacacaataccagtgctcctggacattgccgagagaactggcaacatgagagagttcatcaacagcccatttcgcgatatatactatcgaggccagacggctttgcatatcgcaattgaacggcggtgtaaacattatgtagaactgctggttgcacaaggtgcggatgtgcatgctcaggctaggggcaggttttttcagcctaaagatgagggaggttatttttattttggtgagctgcccctgtctttggctgcatgcaccaaccaaccacacatcgtgaactatttgactgagaacccccataagaaagcggacatgcgccgccaggacagcaggggcaacacagtactgcacgcgcttgtggcgatagccgataataccagggaaaacaccaaattcgtgactaagatgtacgacttgctactcctcaaatgtgcacgcctgtttcctgactccaacttggaggccgttctcaacaacgacggactgtctccactgatgatggctgccaagacaggtaaaattggtattttccagcatattattaggcgggaggtgacagacgaggatacgaggcacctaagcagaaagttcaaggactgggcatacggcccagtctattcttcgctgtatgatctcagctcgctcgatacatgtggcgaagaagcgagcgttctcgagatccttgtgtataactccaaaatcgaaaaccggcacgagatgctcgccgttgagccaatcaatgaactgctgcgcgataaatggaggaagttcggagccgtctccttctatattaatgttgttagctatctgtgcgccatggtcattttcacgctgactgcatactatcagccattggagggaacccctccttatccataccggaccacagtggactatttacgattggctggtgaagtgatcaccctgttcaccggcgtgttattcttttttactaatatcaaggatctgttcatgaagaagtgtcccggcgtcaatagtctcttcatcgatggctcgttccaactactctattttatctacagcgtccttgttatcgtgtctgccgcactctaccttgccgggatcgaagcctatttagccgtgatggtcttcgcactcgtgctgggttggatgaacgctctgtacttcacccgtggcctgaagctgactggaacttattctattatgatacaaaagatactctttaaggatctcttcaggttcttgctggtgtatctccttttcatgataggttacgcatccgccctggtcagcctcctcaacccgtgtgccaacatgaaggtctgcaatgaagaccaaaccaattgcactgtgcctacgtacccatcctgtagggatagtgaaaccttcagcacttttcttcttgatttattcaagcttaccatcggcatgggcgacctcgaaatgctatcttccaccaagtatcctgtcgtgtttataatccttctcgtcacatacatcatactgaccttcgtcctcctgttgaacatgctgatcgcccttatgggggagaccgtgggccaggtgtcgaaggagtcgaaacatatctggaaactgcagtgggccaccactatcctcgatattgagagaagctttcctgtgtttctgaggaaggctttcaggagtggagagatggtgactgtagggaagtcctctgacggcacaccggataggaggtggtgcttccgagtcgatgaagtgaactggagccactggaatcagaatctgggcatcatcaacgaagaccctggtaaaaacgaaacataccagtattatggattctctcacaccgtaggccggctgcgcagagatcgctggagctcagtggttcccagagtggtcgaactgaataaaaattcaaatcccgacgaagtcgtggttcccctggattcaatgggaaatccgcggtgtgatggccatcaacagggatatcccagaaagtggaggaccgacgatgcacctctttag

SEQ ID NO: 209260 - DNA, 2436 bp, Artificial Sequence
  Description of Artificial Sequence: Synthetic coding sequence
atggccgacagcagcgagggcccccgggccggccccggcgaggtggctgagttacctggcgacgaaagcggaaccccgggcggagaagccttcccccttagttctctggctaacctgtttgagggagaagatggaagtctctcaccatccccagcagacgcatctcggccagccgggcctggcgatggcaggcccaacctccggatgaaatttcagggcgctttcagaaagggagtgcctaacccgattgacctcctggaaagtactctatacgagtcatcagtggtgccaggcccgaaaaaggccccaatggatagtctgttcgattatggcacttatcggcaccattctagtgacaataagcgatggaggaagaagatcatagagaagcagccccagtccccaaaagcgcctgctccccagcccccaccaattttgaaggtgtttaatcgacctattttgttcgacattgtgtctcggggcagtacagccgacctcgacggcctactgccctttctgctcacgcacaagaaaagactgacagatgaagagttcagggaacctagtactgggaagacttgcttgccgaaggccctgctgaatctcagcaatggaaggaacgataccatacccgtcctgctggatatagccgaacgtacagggaacatgagggaatttataaattccccattccgggacatctattaccggggacagaccgcgctgcatatcgctatcgaacgaaggtgtaagcattacgtcgagttgctggtggcgcagggagcagacgtgcacgcccaggctagaggccgcttcttccaacccaaggatgagggaggatacttctacttcggcgagctgcccctgagtctggctgcctgtacaaaccagccccacatcgtcaactacctgacggaaaacccccacaagaaagctgacatgagacggcaggacagcaggggcaatactgtgctacacgccctcgtagctatagctgataatactagagagaacacaaaattcgtcactaagatgtacgacttgctcctgctcaagtgcgctcgactgtttcctgattctaatcttgaagccgtattgaataatgatggattgtctcccctcatgatggctgcaaaaacaggaaagattggtaatcggcacgaaatgttagctgtggagcccatcaatgagctgctgagggacaagtggcgaaaattcggtgccgtctccttctacattaatgttgtatcttacctctgtgcaatggtaattttcaccctcactgcttactaccaacccctggaaggtaccccaccctatccatatcgtacaacagtggactaccttagacttgcaggcgaggtcatcaccctctttacaggggttctgtttttcttcactaatataaaggatctgttcatgaaaaaatgtcccggggttaacagcctttttatagacggctcttttcagttactgtatttcatatacagtgtcttggtgatcgtgagcgccgcactgtatctggccgggatagaggcctatctggccgtgatggttttcgcattagtacttggctggatgaatgcactttacttcactcggggattgaaattgacaggaacatacagcattatgatccagaagatactctttaaggacctcttccgctttctcctcgtgtacctgttatttatgattgggtacgcatctgccctggtttcactactgaatccctgcgccaacatgaaggtgtgtaatgaggaccagactaactgtactgtgccaacgtacccatcatgtcgggattccgaaaccttcagcacttttctactggacttgtttaaactaaccattggaatgggcgatctcgagatgctctcaagtacaaaatatcctgtggtgttcatcattttactggtcacttacataattctgacattcgtcctgctcttaaatatgctaatcgccttaatgggggaaacagtggggcaggtatccaaggagtccaaacacatctggaagctgcagtgggcaacaacaatcttggatatcgagagatcatttccagtcttcctgagaaaggcctttcgaagcggggaaatggtgacagtcggcaagtcgagcgatgggactcctgatcggagatggtgctttcgggtagatgaggtcaactggtcgcattggaatcagaacctgggcattattaacgaagacccgggcaagaacgaaacctaccaatactacggctttagtcatactgtggggcggcttcgccgtgaccggtggtcttcggtcgtccctagggttgtagagctgaacaaaaatagcaaccctgacgaagttgtcgtgcccttggactcgatggggaacccaagatgtgatggccaccaacagggctatccgcgaaagtggaggaccgacgacgcccccctgtag

SEQ ID NO: 209261 - DNA, 2475 bp, Artificial Sequence
  Description of Artificial Sequence: Synthetic coding sequence
atggccgacagcagcgagggcccccgggccggccccggcgaggtggctgaactgcctggggatgagagtggaaccccaggtggcgaggccttcccgctgtcgtcattggcgaacctgtttgagggggaagatggttccctgagtccttcaccagcagatgcctcccgccctgccgggccaggcgatgggcggccaaatttaagaatgaaatttcagggcgcctttcgtaagggggtgccaaatccaattgacttgcttgagagcaccttatacgagtcatcggttgtgccgggtcctaaaaaagcccccatggattccctgtttgattatgggacatacagacaccactcttcagataacaagaggtggagaaaaaagatcatagaaaagcagccgcagtcccccaaggcccccgcccctcagccaccccccatcttgaaggtctttaatcgccccatcctgttcgacatcgtgagtcgtggaagcacagccgacctcgatgggctattaccctttctgcttacgcataagaaacgtttgactgatgaagaattccgcgaaccttctacaggaaagacctgtctccccaaagccctgctgaacctgagcaatggccgtaacgacaccattcccgtactgctggatattgccgaacgaacaggcaacatgcgggagttcattaattcacctttccgcgacatctactaccggggagaactcccactgagtctggccgcctgcaccaaccagccacacattgtgaactacttaactgagaatccgcacaagaaggctgacatgcgtaggcaagactcccgtggaaataccgttctccacgcactggtcgctatcgctgataatacgcgggaaaacactaagttcgtaacaaaaatgtatgacctgctgctcttaaagtgcgcccgacttttcccagactcgaacttggaagctgtcctgaacaatgatggcctatctcctttgatgatggcagctaaaacaggaaaaatcgggatcttccagcacataataagacgcgaagttacagacgaggacacgagacaccttagtagaaagtttaaggactgggcatacggccctgtgtactcatctttgtatgacctgagttctctcgatacctgtggcgaggaagcatccgtgctcgaaatactcgtttataactccaagattgaaaatagacacgaaatgctagcagtggagcccattaatgaactactgagggataagtggagaaagtttggagcggtgagcttttatatcaatgtcgtctcttatctgtgtgctatggttatctttaccctaacagcttattaccagcctctagagggtacaccgccctatccgtataggaccactgtggattatctgaggctcgcaggggaagtcattactctttttaccggcgtactctttttcttcaccaatatcaaggacctgtttatgaaaaagtgtcctggtgtcaacagcttgtttatcgacgggtcatttcagctgctgtacttcatttactcagtactcgtgattgtctccgccgccctgtatctagccgggatcgaagcttatttagcggttatggtttttgctttggttctgggatggatgaatgcactctattttactcgaggcttaaagctcacaggcacctactctattatgatccagaagattttgtttaaggatctgtttagatttctactggtatatttattgttcatgataggctatgctagtgcactcgtgtccttactcaacccatgcgccaacatgaaagtttgcaatgaagatcagacaaactgtaccgtgccaacctaccccagctgtagggactctgagaccttctccacttttttgctagacttgttcaaattgacaatcggaatgggggatctggaaatgctgtcatcaacaaaataccccgtggtgttcattatcttgctcgtcacatacattatcttaacatttgtgcttctgctaaacatgctgatcgcgctgatgggcgagacagtcggtcaagttagtaaggagtccaaacatatttggaagctccagtgggccactacgattctggatattgagaggagtttcccggtgttcctcagaaaagctttcagaagcggtgaaatggttaccgtagggaagtcatccgacggtacccctgaccgccgctggtgtttcagagtagacgaggtaaattggtcccactggaaccagaacctgggtataatcaacgaagacccgggaaagaacgagacttaccaatactacggcttttctcacacggttggccgcttgagaagggaccgctggtctagtgttgtgccacgggttgtcgagctgaataaaaactcaaatcctgacgaggtcgtcgtgcctctggacagcatgggcaacccacggtgtgacgggcatcaacaagggtaccctcggaaatggagaactgatgacgcccccctgtag

SEQ ID NO: 209262 - DNA, 2295 bp, Artificial Sequence
  Description of Artificial Sequence: Synthetic coding sequence
atggccgacagcagcgagggcccccgggccggccccggcgaggtggccgaactgcccggagacgagtctggtactccaggtggggaggcgttcccgctcagctctctggctaatctgtttgaaggagaggacggctccctgagccctagtccagcagatgctagccgcccggccggtccgggagatgggcgacctaacctgcgaatgaagtttcagggcgcctttcgaaaaggagtcccaaatcctatcgacctgctggaaagtaccctctatgaatcttcagtcgttcctggcccaaagaaagctcccatggatagcctattcgactatggcacctacaggcatcatagcagtgacaacaaacgctggaggaagaagatcatagagaaacagccgcagagtcctaaagcccccgctcctcaaccaccgcctatccttaaggtgtttaacagacctatactgttcgatatagtcagcagaggcagcacagccgacctggacggccttctcccctttctgctcacacacaagaagcggttaacagacgaggagtttcgcgagccctctacagggaagacctgtctgcccaaagcactcctgaatctgtctaatggtaggaacgatacaatcccagtgctgctggacatcgccgagaggaccggcaacatgagagaatttattaattccccatttcgtgacatttactaccgaggggaactgccactttccctggcagcttgtaccaatcagcctcacatcgtaaattaccttaccgaaaatccgcacaagaaggccgatatgagaagacaggactcaagaggcaacaccgtgctacacgctctggtggctattgccgacaatacacgagagaatactaaattcgtgaccaaaatgtacgacctccttctgcttaagtgtgccagattgttccccgactcaaacctggaggccgtccttaataatgatgggctcagcccccttatgatggctgcgaagacaggtaagattgggaaccgccatgagatgcttgcagtggagccaatcaatgagttacttcgcgataagtggagaaaatttggcgcggtctcattttacattaacgtggtgagttatctgtgcgctatggttatctttactctgacagcatactatcagcctctggaagggacaccaccctatccctacaggacaactgtggactacctccggctagccggtgaggtgatcaccctctttaccggcgtactctttttcttcacaaacataaaagatctgtttatgaagaaatgcccaggagtgaactctctctttattgacggaagctttcagcttctgtactttatctactctgtactcgtgattgtttctgccgccttatatctggctggcatcgaggcatatctcgccgtgatggttttcgctctagttctaggatggatgaacgctctttactttacgagagggctgaaattaacggggacatactccatcatgattcagaaaatactctttaaagacctgttccgcttcttgctggtgtatctgctgttcatgatcggctacgctagtgccttggtgtcactgcttaacccttgcgccaacatgaaagtctgtaatgaggatcagaccaactgtaccgtccctacttaccctagctgtcgggacagcgaaaccttcagcacattcctgctcgacctgttcaaacttacaattgggatgggagatcttgaaatgctttcttccaccaagtatccagtcgtattcataattctgttagtaacttacattatcctgactttcgttctgctcctgaatatgctgattgcactcatgggtgagacggtcggccaagtaagcaaggagagtaaacatatttggaaattgcagtgggccacgaccatactggacatcgagcggagctttcctgtctttctgaggaaagccttccgctccggagagatggtgacagtgggaaagagttcagacgggactccagacagacgctggtgcttccgggtcgatgaagtaaactggagccattggaatcagaacctcggcattatcaacgaggatcccggtaaaaacgagacctatcagtactatggtttctcacacactgtgggaagactgcggcgggatcgctggtcatctgtggtgcctagggtagtcgagctaaataaaaactcaaatcctgacgaggtcgtggtccccctcgactccatgggcaatcctagatgtgacggacaccagcaggggtaccccaggaaatggaggactgacgatgcccctctctag

SEQ ID NO: 209263 - DNA, 2190 bp, Artificial Sequence
  Description of Artificial Sequence: Synthetic coding sequence
atgggcggcttcctgcccaaggccgagggccccggcagccagctgcagaagctgctgccctcgtttctggtgcgtgaacaggattgggatcaacatctggacaagctgcatatgcttcagcagaagagaattcttgaaagtcccctgctgcgggctagtaaggagaacgacctgagcgttctgcgtcaactgctgctcgattgcacctgtgacgttagacaacgcggcgccctcggcgagacagccctgcatattgccgccctgtatgacaacctggaagccgcccttgtgctgatggaagccgcccctgagcttgtgttcgaacccacaacttgtgaagctttcgcgggacagactgccctgcacattgccgtggtaaaccagaatgttaatctggtgagggccctcctgacccggagggcaagtgtgtcggcccgtgctaccggcacagcatttcggaggagcccaaggaatctaatctatttcggagagcatccattaagtttcgcagcatgcgtcaacagcgaggaaatcgtgaggctattgatcgagcacggggctgacatccgggctcaggactcactcgggaacacggttctgcatatacttattctgcagcctaataagacattcgcatgccagatgtacaatcttctcctgtcttatgacgggcatggggaccacctgcagcctctagatctggtgcctaatcaccaagggctcacgcccttcaaactggccggcgtcgaagggaatacagttatgttccagcatcttatgcaaaaacggcgccacattcagtggacatatggccccctgaccagtattctttatgatctcactgagatcgacagttggggagaagagctgtcctttctggaactggttgtgtcttctgacaagcgggaggctcgtcagatcctcgagcaaacaccagtcaaggaacttgtaagcttcaagtggaataagtatggtaggccatatttttgtatccttgcagccttatacctattgtacatgatatgttttaccacatgctgtgtctataggcccctaaagttccgcgggggcaacaggactcacagcagggacatcacgattctccagcagaaattgttgcaagaagcatacgaaacccgggaagacataatccggctagtgggagaactggtcagcattgtcggtgccgttattattttgctcttggaaatcccagatatttttcgcgtcggtgcatctcggtattttggaaaaaccatccttggcggacctttccacgttattatcataacctatgctagccttgtccttgtcactatggtgatgcgattgaccaacaccaacggcgaggtagttcctatgagctttgcattggtgctggggtggtgcagcgtgatgtatttcacgcgaggtttccagatgctggggcccttcaccatcatgattcagaagatgatttttggggacctgatgcgtttctgctggctgatggccgtggtaatactcggattcgctagcgccttttacattatctttcaaactgaggatccaacatcactaggacagttttatgattacccaatggctctctttacgacttttgaacttttcttgacggtaatcgacgcaccagccaattatgacgtggacctgccttttatgttctcaatcgtaaatttcgcatttgccataatcgctactttactgatgcttaacctgtttatagctatgatgggagacacccactggcgggtggcccaagagcgggatgagttgtggcgggcacaagtcgtggccaccaccgtgatgctagaacggaagctgccaagatgcttgtggccaagatctggtatatgcgggtgcgagtttgggctcggcgatagatggtttttgcgtgtggaaaatcataatgaccagaaccccctccgagtgcttcggtatgttgaagtttttaagaactctgataaagaggacgaccaggaacacccctctgaaaaacagcccagcggggccgagtcggggactcttgcccgtgctagcctcgccctgcctacgtcttccttgtcccgaacggcatcacagagctcctcccacagagggtgggaaatcctacgccagaacacactggggcatctgaatttagggctcaacctgtcagaaggagatggcgaagaagtgtaccatttttag

SEQ ID NO: 209264 - DNA, 1146 bp, Artificial Sequence
  Description of Artificial Sequence: Synthetic coding sequence
atgggcggcttcctgcccaaggccgagggccccggcagccagctgcagaaactcctgcctagttttctcgtaagagaacaggactgggaccagcacctcgacaagctgcatatgcttcagcaaaaaaggatcctcgaaagtccgttgttaagggcttcaaaggagaacgacctgtctgtgctgagacagctattactcgactgcacttgcgatgtgagacaacgcggggctctgggggagacagccctgcacatagctgcactttatgacaatctggaggcagccctggtgcttatggaggccgcccccgaacttgtctttgaaccaaccacctgtgaagcatttgctggtcagacagctctgcacatcgcagttgtcaaccaaaacgtcaatttggtgcgggctcttctaacgagacgagcatccgttagcgcccgggcaacagggacagctttcaggcgctcccctaggaatctcatatattttggggaacaccccctgtcgtttgcagcatgtgtgaattcagaagagattgtgagattgttgatcgaacacggagcagatatccgcgctcaagactcactggggaatactgtactgcacattctgatactgcagcccaataagacatttgcatgccagatgtacaacctcctgctgagctacgatggacatggggaccatcttcaacccctggatctggtgccaaatcaccaaggcctgacacctttcaagttggctggcgtcgagggcaacacagttatgttccaacacctcatgcagaaaagacggcatatacagtggacttatggcccactcactagcattctctacgatctgacggagattgattcttggggggaggaactaagctttttggagctcgtcgtctcgtctgataagagggaagcacggcagatcctcgaacagactcctgtgaaggagcttgtgtccttcaagtggaacaaatatggcaggccgtatttctgcatactggccgccctgtatctgctttacatgatttgtttcactacatgttgcgtgtacaggccactgaaattcaggggcgggaacagaacacacagccgggacatcaccattctgcagcaaaagctgctccaggttatcctcctccgccgggggtag

SEQ ID NO: 209265 - DNA, 1674 bp, Artificial Sequence
  Description of Artificial Sequence: Synthetic coding sequence
atgggcctgagcctgcccaaggagaagggcctgatcctgtgcctgtggtcaaaattttgtagatggttccaggactctttaggcaacacagtactgcatatcctcatcctccaaccgaataagacatttgcatgccagatgtacaacctgctcctgtcctatgataggcacggggatcacctgcagcctttggacctggtgccaaatcaccagggtctcacccccttcaagctggctggcgttgaaggaaacaccgtgatgttccaacatttaatgcagaaacgcaagcacacgcagtggacctacggccctctgacatcaaccctgtacgatcttaccgagattgacagtagcggagatgagcagagcttactggagctcattatcaccacaaaaaagagagaagccaggcagatcttagaccagactcccgtcaaagaactggtcagcctgaagtggaaacgctatggtaggccgtatttctgtatgcttggggccatttacttactttatattatctgcttcactatgtgctgtatatataggccgctcaaaccaaggaccaataatcgaacctcgcctcgcgataatacactcctgcagcagaagctgctccaggaggcctatatgacccctaaggacgatatccggctggtgggagaattggtaaccgtgataggggccatcattatacttcttgttgaggtacccgacatcttcaggatgggcgtcaccagattctttgggcagacgatactggggggccctttccacgtgctgatcatcacttatgcattcatggtgctggtgactatggtgatgagactcattagcgcaagcggcgaggtggtgcccatgtcattcgccctggtcctgggatggtgcaacgtgatgtattttgctcggggctttcagatgctcgggcccttcacaataatgattcagaagatgatattcggcgatctgatgcggttctgctggcttatggctgtcgtgatcctcggatttgcaagcgccttctatattatattccaaaccgaagaccccgaggaactgggccatttttacgattatcccatggcacttttctccacctttgagcttttcctgaccatcatcgatggccctgccaattacaacgttgatcttccttttatgtattcgatcacttacgccgccttcgcgatcatcgcaacactgctgatgctgaacctgctcatcgccatgatgggcgacactcattggcgagtggctcacgagagggatgagctgtggagggcccagatcgtggccaccacggtaatgctggaaaggaagctgccccggtgcctgtggcctagatccggcatctgcgggcgcgaatacggactaggtgaccggtggttcctcagagtggaagaccggcaggacctgaaccgccaaaggattcaaagatatgctcaggcttttcacacccggggaagtgaggacctggataaagattcggtggagaagctagagctggggtgtccgttctccccacatttgagcctcccaatgcctagcgttagtcggtcaacctctaggtcctctgctaattgggaacgactgcggcagggaaccctgcggagggacctgcggggcatcatcaatcgcggtctcgaggatggagagtcctgggagtatcagatctag

SEQ ID NO: 209266 - DNA, 2178 bp, Artificial Sequence
  Description of Artificial Sequence: Synthetic coding sequence
atgggcctgagcctgcccaaggagaagggcctgatcctgtgcctgtggtccaagttctgtaggtggttccagcgccgcgaatcttgggcacaatcaagagacgaacaaaacctgctacagcagaaaaggatttgggaaagccccctcctcctggcagcaaaagacaacgatgtccaggccctcaataaactgctgaagtatgaagattgtaaagttcatcagcggggggcgatgggagagaccgccttgcatatcgcagccctgtatgataatctcgaagccgctatggtccttatggaagccgcacctgaacttgtcttcgaacccatgacaagtgaactctacgaaggccagaccgccctgcacatcgctgtggtcaaccagaatatgaacctggtacgggccttgcttgctcgcagggcctctgtgagtgcgagagccacaggcactgcgtttcgcaggtctccctgcaacttgatctacttcggagaacatcccctgtcattcgcagcgtgtgtgaactcagaggaaattgttcgtctcctgatagaacacggcgccgatatcagagcccaggatagtcttggaaatactgtgctgcacatcttgatccttcaaccgaataagacattcgcgtgtcagatgtataacctcttgctctcttatgatcgacatggcgatcacctgcagcctcttgacctcgttcccaatcatcagggtctgactccattcaaactcgccggcgtcgaggggaatactgtcatgtttcagcacctcatgcagaaacgaaaacacactcagtggacctacgggcccctgaccagtacactctacgatctgaccgagatagactccagcggagacgagcagtcgctccttgagctgatcatcactaccaaaaagagagaagcaagacaaatacttgaccagacaccagtcaaggaacttgtttcactgaaatggaagcggtatggcagaccatacttctgcatgctgggggccatttacctcctgtatatcatctgctttacgatgtgttgtatctaccggccactcaaaccccgcacaaacaaccggacaagccctagggataacactctcctgcagcagaagctcttgcaagaggcctacatgacccctaaagatgatatccggctcgttggggagctcgtgacagtcatcggggcaatcatcattctgctcgtcgaagttcccgatatcttccgtatgggcgtgacaaggtttttcggccaaactatcctcggaggtccattccatgtactcataatcacctatgcctttatggtgttggtgactatggttatgaggctgatcagtgcctctggagaggtcgttcctatgtcatttgccttggtgctgggctggtgcaacgttatgtacttcgctcggggattccagatgctggggccatttacgatcatgatccagaaaatgatctttggcgacctcatgcggttctgctggctcatggccgtggtcattcttggattcgcgagcgccttttacataatcttccagaccgaggatccggaagagctcgggcatttctatgactaccctatggcattattctcaacattcgaattgttccttaccatcattgatggcccggcaaattacaatgtggatctccctttcatgtattcaataacctacgcggctttcgcgattattgcgactcttctcatgctgaacctcttgattgcaatgatgggcgacacacactggagggtggctcacgaacgggacgaactgtggcgtgcccagatcgttgccacgaccgttatgttggagaggaagctccctcggtgcctgtggccgcggtcgggaatttgcggcagagaatacggacttggagataggtggttcttgagggtcgaggaccggcaggatctgaaccgccagcggatacagagatacgcccaagccttccacaccagagggtctgaagacctcgataaggatagcgttgaaaagcttgaactcggttgccctttctctcctcatttgtcactgcccatgccaagcgtgagccggtcaacatctcgctcgagcgccaattgggagagacttcgacaagggaccctgaggcgggaccttagaggcatcataaacagaggactggaggacggcgaatcatgggaataccagatttag

SEQ ID NO: 209267 - DNA, 168 bp, Artificial Sequence
  Description of Artificial Sequence: Synthetic coding sequence
atgagcaccagccggaagctgaagagccacggcatgcggcggagcaaatccagatcaccacacaagggcgtgaagcggggcggctctaaacggaaatatcggaagggtaatctcaagagccggaaaagaggggacgatgcaaacagaaattaccgttcccatctatag

SEQ ID NO: 209268 - DNA, 417 bp, Artificial Sequence
  Description of Artificial Sequence: Synthetic coding sequence
atggacacccagacccacagcctgcccatcacccacacccagctgcattctaacagtcaacctcagagccgtacttgtacccgacattgccaaaccttttcccaaagctgccggcagtcgcatcggggatcaaggtcccagtcaagctcccagagtcccgcttctcaccgcaacccaacaggtgcccacagttcgtctgggcaccaaagtcaatcccctaataccagccctccgcccaaaagacacaaaaaaacaatgaattcgcaccattccccaatgcggcctacaatcctgcattgtaggtgccctaagaatcgcaagaacctggaaggcaagctgaaaaagaaaaagatggcgaaaagaatacagcaggtgtataagaccaagaccagaagtagtggctggaagtccaattag

SEQ ID NO: 209269 - DNA, 1731 bp, Artificial Sequence
  Description of Artificial Sequence: Synthetic coding sequence
atggccgtgctgttcttccacaccatgcggtacaagagccaggaccctcggaacccccataacgatcggtttgtcttgtccaaaggccatgcagctccgatattatacgccgtgtgggcagaggcaggatttctagccgaggcagaacttcttaacctgaggaagatctccagcgacctggacggccatcccgtcccaaaacaggcttttaccgacgttgccacaggaagcttagggcagggactgggtgcagcctgcggaatggcctacaccggaaaatactttgataaagcgtcctatagagtgtactgtctactgggagacggcgagttgtctgaaggatcagtgtgggaggcaatggcttttgcttcgatctataagctggataacctcgtggccattctggacatcaatagacttggacagtcggaccccgccccactgcaacaccaaatggacatttatcagaaaagatgtgaggcgtttggatggcatgcaatcatcgtagatgggcattccgtcgaggagttgtgcaaggcctttgggcaggcaaaacaccagcccacagcaatcatagcaaagaccttcaagggcagagggatcacgggtgtagaggataaggagtcttggcacggcaaacctctgcctaagaatatggccgaacagattattcaggaaatatatagccagatccagtcaaaaaagaagatcctggccacccctccccaggaagacgcaccctctgtagatattgccaacatccgaatgccctctttaccctcatacaaggtgggcgataaaattgcaacacgaaaagcatatggccaagcactggcaaagctcggccacgcttctgaccgaataattgcactcgatggtgatacaaaaaactccacgttcagcgaaatattcaaaaaggagcaccctgaccgcttcatcgagtgttacatagcggagcagaacatggtttccattgccgtgggctgtgctacacgcaaccggacagtacccttctgcagcacttttgccgcattctttacccgggcgtttgatcagatcaggatggcagcaatctccgaaagtaatattaacttgtgtggaagtcattgtggagtcagtattggagaggatggtccgtctcagatggctctggaggacctggcaatgtttaggagcgtgcctacctccacagtcttctacccctctgatggcgtcgccactgaaaaagcagtcgaattagccgccaataccaagggtatatgtttcattcgtacctctagaccagagaacgccatcatctataataacaatgaggactttcaggtgggtcaggcaaaggttgtcttgaagtctaaggatgaccaggtgactgtgatcggcgctggcgtgacgttgcatgaagccctggctgctgccgagctactgaaaaaggagaagatcaacatccgcgttcttgaccctttcacaattaagcctttggaccggaaactgatactggattcggcacgggcaaccaagggaaggattttgacggttgaggaccattattacgagggaggcattggggaggccgtgtcctcagccgtggtaggagagcccggaattacagtcacccatttggcagtgaatcgggttccgagatctggaaagcccgccgagctgctgaagatgttcggcatagacagagatgcaatcgctcaagctgtgagaggcttaattacaaaagcatag

SEQ ID NO: 209270 - DNA, 1374 bp, Artificial Sequence
  Description of Artificial Sequence: Synthetic coding sequence
atggccttcgccagcatctacaagctggacaacctggtggccatcctcgatatcaacagactcggccagagcgatcccgcccccctgcagcaccagatggatatctatcagaagagatgcgaagccttcggatggcatgctatcatcgtggacggtcactccgtggaggagttgtgtaaggcattcggccaagctaagcaccagccaacggccattatagctaagacgtttaagggtagaggtattacaggcgtcgaggacaaagaatcgtggcatgggaaacctctgccaaaaaacatggccgagcagatcatccaagaaatttactctcagattcaatctaagaagaagatactggctacacctccccaagaagatgcccctagcgtagacattgccaatatcagaatgcccagcctgcctagctataaggtgggcgacaaaatcgctactcggaaagcttacggccaggccttagctaagctgggtcatgcttcggatcgaattatcgcactagatggcgataccaaaaattcaacctttagcgagatctttaaaaaggaacaccctgataggtttatcgagtgttatattgcggagcagaatatggtgagcattgctgttggctgcgcaaccaggaatagaaccgtacctttctgcagcaccttcgccgcctttttcactcgagcctttgaccagattagaatggcggccatcagcgaaagcaacattaatctgtgtgggtctcattgcggtgtatctataggcgaggacggaccaagtcagatggccctggaagacctggccatgtttcggtcagtgcccacaagcaccgttttttacccttccgacggggtggccaccgagaaggccgtcgagctcgccgccaacaccaaggggatatgctttatcaggacttctcgaccggagaacgcgataatctacaacaataacgaggattttcaggtgggacaggccaaagtggtgttgaagagtaaggatgaccaagtcacagtgattggcgcaggggttacactacacgaggcactggctgccgcggagcttttgaaaaaggagaagattaatatacgcgtgctggacccattcactatcaagcccctggatcgtaagctgattttggactctgctcgcgccacgaagggacggatattaaccgtcgaggaccactactacgagggaggaatcggcgaggccgtaagttctgcagtggttggggaacccggtattacggtcacccatttagccgttaacagagtgccccgtagtggaaaacctgcagaactactgaaaatgttcggtattgatcgcgacgctatagcccaggctgtgcgcggtttaattacgaaagcatag

SEQ ID NO: 209271 - DNA, 1872 bp, Artificial Sequence
  Description of Artificial Sequence: Synthetic coding sequence
atggagagctaccacaagcccgaccagcagaagctgcaggccctgaaagacaccgctaatcggctgcgaattagctcgatacaggcaaccaccgccgccggatctggccaccctacaagctgctgcagcgctgcagagattatggcagtgctgttcttccacactatgagatataaatcacaggatcctaggaacccgcacaatgatcgatttgtgctgagcaagggtcacgccgcacccatcctgtatgccgtgtgggccgaggctggattcctggcagaagcggagctcctgaatctgcgcaagatctcaagtgacctggatggccaccctgtgccgaagcaggctttcaccgacgttgcaaccggctcactgggccaggggttgggagcagcatgtggaatggcctatacaggtaagtattttgacaaagcatcctaccgcgtgtattgcttgctcggggacggcgagctttctgaggggagtgtttgggaggccatggcattcgcctcaatctataaattggacaacctggtggctatactggatatcaaccggctgggccagagcgaccccgctcctctccagcatcagatggacatttaccagaaacgctgcgaggcttttgggtggcacgctataatcgttgacggacactctgtggaggagttatgcaaagcattcggacaggccaagcaccagcctacagccatcatcgcaaaaacattcaaaggtaggggaatcacaggcgtagaggacaaagagtcgtggcacggaaagcccctcccaaagaacatggccgaacagattatccaggaaatctactcccagatccagtctaaaaagaagatcctggcaacccccccacaggaggacgctccatcagtggacattgctaacattcggatgccgtcactgccatcatataaggtgggagacaagatcgcaaccagaaaggcctatgggcaggcactggcaaaattaggccatgcttcagaccggattatcgcccttgatggagatacaaagaatagcacattctcagaaatatttaaaaaagaacacccagataggttcatcgagtgttacatagccgagcagaacatggttagtatcgctgtcgggtgcgcaactcggaacagaacagtgcctttctgcagcacctttgcggcattctttacccgcgccttcgaccaaattcggatggctgcgatctccgaatccaatatcaatctgtgcggttctcattgcggagtgtccatcggcgaagacggcccaagccagatggccctcgaggatctggcgatgttcagaagtgttcctacctccaccgtgttttacccctcagatggggtggctaccgagaaagcagtggagctggccgctaatacaaaggggatctgttttatacggactagccggcctgaaaacgctattatttataataataatgaagattttcaggtcggacaggccaaggtcgtactcaagtctaaggatgaccaggtgacggtaatcggagccggtgtgaccttacacgaagcattagccgcagcagagctgctcaaaaaggaaaaaataaacattcgagtgttagaccccttcaccattaaaccactggatcgaaaactcattctggacagcgcacgggccacgaagggcaggatattaacggtggaagaccattattatgagggcggcatcggggaggctgtctcatctgccgtggtcggggaacctgggataacagtgacacacttggcagtcaaccgcgttccccggtccggtaagcctgcggaactcctgaaaatgttcggcatcgatcgggatgcgatcgcacaggcagtcagggggctgattacaaaagcgtag

SEQ ID NO: 209272 - DNA, 1872 bp, Artificial Sequence
  Description of Artificial Sequence: Synthetic coding sequence
atggagagctaccacaagcccgaccagcagaagctgcaggccctgaaggacaccgccaatcggctaaggatcagttctatacaggcgacaaccgccgctgggagtggccaccccacgagttgttgttccgccgccgagattatggccgtactgttcttccacaccatgcgttataagtctcaggatcctcggaatcctcacaatgataggttcgtcctgtctaaaggtcacgccgctcctatcctatacgctgtgtgggctgaagccgggttcctggccgaggcggaactgctgaatctacgcaagatctccagtgaccttgacggtcacccggtgcctaaacaggcctttacagatgtggccaccggtagtctcggtcaaggtctaggggcagcttgcggtatggcgtacacgggcaaatacttcgacaaggcttcttacagagtgtattgcctgctgggcgacggtgagctgagcgaggggagcgtgtgggaggccatggctttcgcatctatatataagctggacaatctggtagctatcttagatattaatcggctggggcaatcagatccagctcccctgcagcaccaaatggatatctatcagaaaagatgcgaagccttcgggtggcatgccatcatcgtcgacggccattcggtggaggagctttgcaaagcatttgggcaggcaaagcaccagccgactgctataattgcaaagacctttaagggacgcgggataacgggtgtggaggacaaggaaagttggcatggaaaacccctcccaaaaaacatggcagagcaaatcatacaagaaatctacagccagatccaatctaaaaaaaagatcttagccactcctccgcaggaggacgccccctctgttgatatagccaatattagaatgccctctctccccagttataaggtgggggacaagattgccaccagaaaggcatacggccaggcccttgccaagcttggccacgcctctgaccgaattattgccctcgatggcgacaccaagaatagtactttcagtgagatcttcaaaaaagaacaccccgaccgttttatagagtgttatatcgctgagcagaatatggtgtctattgccgtgggctgtgcaacgcgcaaccgcactgtacccttctgctcaaccttcgcggccttcttcaccagggccttcgatcagatacggatggctgctattagcgagtctaatatcaacctgtgcggtagccactgcggcgtttcaatcggcgaggacgggccatcacaaatggccctggaggatcttgctatgtttcgatctgtccctacgtcaactgtcttttatccttcagatggggtggccaccgagaaagcagtggagctcgctgctaatactaaaggcatatgtttcattagaacatctagaccggaaaacgcaatcatctataataacaatgaagatttccaggtagggcaagcaaaggtggttctgaaaagtaaagacgaccaggtcaccgttataggcgccggcgtcacgctccacgaggcactcgccgccgctgagctccttaagaaagaaaaaatcaatattcgggtcctggatccatttactattaagccgctggaccgaaagctgatacttgactcagcccgtgctacaaaaggccgcatcctgacagtggaggaccactactatgaaggggggatcggcgaggctgtgagtagcgctgtggtgggcgaacctgggatcacagtgacacatctggccgtcaacagggttccccgctcaggcaaaccggcagagctcttgaagatgtttggcatcgatagggacgcaatcgcccaagctgtgcggggtttgatcacgaaggcctag

SEQ ID NO: 209273 - DNA, 1896 bp, Artificial Sequence
  Description of Artificial Sequence: Synthetic coding sequence
atggagagctaccacaagcccgaccagcagaagctgcaggccctgaaagatactgctaataggctgcgcatcagttcaatccaagctacgactgccgctggcagcgggcatcccacctcctgttgcagcgccgcggaaatcatggccgtactctttttccacaccatgcgatataagagccaggacccaagaaacccacataacgatagatttgtgctgtcaaagggacacgcggcccctattttatatgccgtgtgggccgaagcaggctttttagctgaagcggagctgctgaacctgcgtaaaatatcctcagacctggacggtcatccggtgcccaaacaggccttcactgatgtcgcaaccgggagtctaggacaggggctgggtgccgcttgcggcatggcctataccggcaaatattttgataaggcatctttgcccagcagctgggattacagctatcgggtgtattgtttgcttggcgacggcgaactgagcgagggatcggtctgggaagccatggcctttgcatccatctacaaattagataatcttgtggccatcctggatattaacaggctcgggcagtcagatccggctcccctccagcaccagatggatatctaccaaaagcgctgcgaggcctttggttggcatgccatcatcgtcgatggtcactcagtcgaggagctgtgtaaggcattcggccaggctaaacatcaaccaaccgccatcatcgcaaagactttcaaggggcgcggtattacgggagtcgaggacaaggaatcttggcacggcaagcccctaccgaaaaacatggcagagcagatcattcaggaaatctatagccagattcagagcaagaagaagatactggccacaccccctcaggaggacgccccatccgttgatattgctaatatcagaatgccaagtttgccctcctataaagtgggagataagatcgccacccgtaaggcctatggtcaagcgctggctaagctgggacacgcctctgatagaatcattgctctcgacggagacactaaaaactccactttctctgagatcttcaaaaaggaacaccctgacagattcattgagtgctatatcgcagaacagaatatggtctccatagcggttggatgcgctacccggaacaggacagtacctttctgcagtactttcgcagcctttttcacccgcgctttcgatcagattaggatggctgctatttctgagtcaaacatcaatctgtgtggcagtcattgcggtgtgagtataggagaagatggcccgagccaaatggccctggaagatctggccatgttccggtccgtgcctacatcaactgttttttaccctagcgacggtgtggctacagagaaggctgttgagttggccgccaataccaagggcatttgcttcattcgtacaagccggcccgagaacgccattatctacaataacaatgaagatttccaggtcggccaagcaaaagtggttctgaagtccaaggacgatcaggtaacagttatcggcgccggcgttacactgcacgaggcactcgctgccgcagaacttctaaaaaaggagaaaatcaacatccgggttctggaccccttcactatcaaaccgttagaccgaaaactcatcttagattccgctcgggccaccaagggacggattctgacggttgaagaccactactacgaagggggcatcggtgaagctgtgtcttctgcggtggtgggtgaaccagggattacagtgacgcacctcgccgtgaatagagtcccgcggtctggaaaacccgctgagttgctgaagatgttcgggatcgatagagatgcgatagcccaagcagtgagaggcctgatcactaaagcctag

SEQ ID NO: 209274 - DNA, 1182 bp, Artificial Sequence
  Description of Artificial Sequence: Synthetic coding sequence
atggccctgaaggtggccaccgtggccggcagcgccgccaaggccgttctggggcccgcactcctgtgtcggccctgggaagtgctgggcgcacacgaggtcccgtcgagaaacatattttcggaacagaccatccctcctagcgctaagtacggcggtaggcacaccgttacaatgatccctggggatggtatcggccctgaactaatgctacatgttaagtctgtctttagacacgcctgcgttcccgtggactttgaagaggttcatgtatccagcaacgcagacgaagaggacattaggaacgctatcatggcgattcgcagaaatagggtggcattaaagggtaatattgaaacaaaccataatcttccgccctcccacaagagccgaaacaacatcctgcgtaccagcttggatctgtacgcgaacgtgattcactgcaagtcactgccaggcgtcgtgacccgacacaaggatatcgatatccttattgtgagggaaaatactgaaggtgagtatagttcactggaacacgagtccgtagccggcgttgtagaatctctcaagattattaccaaggcgaagtcccttcgcatcgcagagtatgcgttcaaactggctcaggaatcgggcaggaagaaggttactgcagtacacaaagctaacatcatgaagctcggagacggcttgttcctccaatgttgtcgggaggtcgctgcacggtatccccaaatcacttttgagaacatgatagttgataacacaaccatgcaactggtttcacgcccccagcagttcgacgtgatggttatgcctaatttgtacggaaatattgtcaataacgtctgtgctggcctcgtgggtgggcccggcttggttgccggggcaaactatggacacgtgtatgccgtgtttgagactgccacacgtaacaccggaaagtccattgcgaataagaatatcgccaacccaactgctactctacttgcaagctgcatgatgttagatcacctgaaactacatagctacgccacttccatcaggaaggccgtactggcatcaatggacaacgaaaatatgcacaccccagacatcggcggtcagggcacaacaagcgaagcgatccaagacgtgatcaggcatattcgggtgataaacgggcgggcagttgaggcctag

SEQ ID NO: 209275 - DNA, 1791 bp, Artificial Sequence
  Description of Artificial Sequence: Synthetic coding sequence
atggccgacgccgaggcccgggccgagttccccgaggaggcccggccggataggggaaccctgcaggtattacaggacatggcatcacgattgaggattcattccattagagcgacatgctccaccagcagcgggcaccctacttcctgttctagctcttcagagatcatgagtgtgttgttcttttatataatgcgatacaaacagagtgacccagagaaccccgataatgacagattcgtgctggccaaacggctgagttttgttgatgtggcaaccggctggctgggacaggggctgggggttgcgtgcgggatggcatacaccggaaagtattttgacagagcaagctatagagtattctgtcttatgtcagatggggaaagctctgaggggtcagtgtgggaggccatggctttcgcaagttattattcactcgataatctcgtggcgattttcgacgtaaatagactgggacatagcggagccctccctgcagaacactgtataaacatctatcagagaagatgcgaggcttttggatggaatacttacgtggttgatggtcgcgatgttgaggccctttgtcaagttttttggcaagcttcccaagtcaagcataagccaactgcagtggtggccaagacatttaaggggcgcggaacgccaagcatagaagacgctgagtcctggcacgccaaaccgatgccacgtgagagggccgatgccatcatcaaactgatagaaagccagattcagactagcaggaacctggacccacagccccccatcgaagactcccccgaagtgaatatcacagacgtgcgtatgacgagcccccccgactacagagtgggcgacaagattgccacccgcaaagcgtgcgggctcgcattggcaaagttgggttacgccaataatcgcgtcgtagtgctcgatggcgatacccgctattcaacgttcagcgagatcttcaacaaagagtacccagagagatttatcgagtgttttatggcggagcaaaatatggtgtccgtggccctgggctgcgcatcccggggacgcacaattgcctttgctagcacgttcgcagcctttctaacacgggcttttgaccacattagaattgggggactggcggaaagcaacatcaacatcatcggatctcactgcggcgtgagcgtgggcgacgatggagcttcacagatggcactggaggacatcgctatgttccgcacaataccaaagtgcactatcttctatcctaccgacgccgtctctactgaacacgctgtcgctctagccgccaatgctaagggaatgtgttttattcggaccactcggcctgagacaatggtgatttacaccccccaggagaggttcgaaattggacaagcaaaggtcctaaggcactgcgtgtccgataaggtcacggtgattggggctggcatcacagtgtatgaggctctcgccgccgcagacgaactctccaagcaagacatcttcattagagtcatcgacttgttcacaatcaaaccactggacgttgcaactatcgtttccagcgctaaagccaccgaggggcggattatcacagtggaggaccactaccctcaaggaggcatcggagaggctgtatgtgctgcagtgtctatggacccagatattcaagtccactcactggcagtctctggcgttccacaatccggcaagagcgaagaactgctggacatgtacggaatttctgcaagacatattatagtggcagtaaaatgcatgctgttgaattag

SEQ ID NO: 209276 - DNA, 1674 bp, Artificial Sequence
  Description of Artificial Sequence: Synthetic coding sequence
atgagcgtgctgttcttctacatcatgcggtacaagcagagcgaccctgagaaccctgacaatgacaggttcgtcctcgccaaacgcctctcgtttgtcgacgttgccacagggtggctggggcagggcctcggggttgcgtgcggaatggcttacaccgggaaatatttcgaccgcgccagttaccgggtattttgcctaatgtctgatggcgaatcttcggaaggctccgtatgggaagccatggcgtttgcttcctattacagccttgataacctggtggctattttcgatgtgaatcggctcggacactcaggcgcacttcccgctgagcactgtatcaatatctatcagagacgttgcgaggcctttggttggaacacatatgtggtagatggtcgagatgtggaagccctttgtcaagtcttttggcaggccagccaagtcaaacacaagcccaccgctgtggtggcaaaaacattcaagggacgcggcacaccatccatcgaagacgcggagtcctggcacgccaagcctatgcctcgagagagggccgatgccatcataaagctgatcgagtctcagatccaaacttctcgcaacttggacccccaacctccaattgaggatagccctgaggtgaacattactgacgtacggatgacaagcccacccgattaccgagtaggggacaagatcgccacgcgtaaggcttgtggtctggccctggcaaaactcggttacgccaataaccgtgtggtagttctggatggggataccagatacagcaccttcagcgagatctttaataaggagtaccctgagaggtttattgagtgttttatggcagagcaaaatatggtctcagttgccctgggctgtgcttcccgaggacggaccattgcatttgcatcgacttttgctgccttccttacacgagcatttgaccacattcggattggcgggctggccgaaagcaatattaatatcatcggctctcactgtggggtctctgtgggcgatgacggagcgagccagatggccctggaggacattgccatgttccgcaccatccctaaatgtaccatcttttacccaacagacgccgttagtacagaacatgcagtcgccctggcagccaatgccaaggggatgtgctttatacggaccaccaggcctgaaacgatggtgatatacacacctcaggagcggttcgagatcgggcaggccaaaggagtgtcaatgctgcaggattcctggagttctgtgatctcttatcagaaggttctgcggcattgcgtctccgacaaggtgacagttatcggcgccggtattacagtttacgaagctctcgccgccgccgacgagctcagtaagcaggacatcttcatcagggtgattgatttgtttacgattaaaccattggacgtcgcgaccattgtcagctccgctaaagctacagagggaaggataataactgtggaagaccactatcctcagggcgggattggcgaagccgtgtgtgccgccgttagtatggatcccgacattcaggtgcatagcctcgcagtctcgggagtgccccagtctggtaaaagcgaggaactgttagatatgtacggaatttccgctcggcatatcatagttgctgtcaagtgcatgttactcaattag

SEQ ID NO: 209277 - DNA, 1623 bp, Artificial Sequence
  Description of Artificial Sequence: Synthetic coding sequence
atgagcgtgctgttcttctacatcatgcggtacaagcagagcgaccccgaaaatcccgataacgacagattcgttctagctaagagactgtccttcgttgacgtggcaacgggctggctcggacagggattaggcgtggcatgcggtatggcctacaccgggaagtattttgacagggcctcatatcgggttttctgcctgatgagtgatggagagagcagtgagggaagcgtttgggaggctatggcttttgcctcctattactctctagataatctagtggccatttttgacgtgaatcggttgggacacagtggcgcacttccggccgaacactgcattaacatttaccagagacggtgtgaagcgttcggatggaacacctatgtggtagatggaagggacgtagaggctctgtgccaagttttctggcaggcatcgcaagtgaagcacaagccaaccgcggtggttgcaaagacttttaagggaaggggcactccatcaattgaggacgcagagtcctggcacgccaagccaatgccacgggagcgagctgatgctatcataaagttaattgagtcacagatacagacttctcgtaacctggacccacaaccccccatcgaggactcaccagaagttaatataaccgatgttaggatgacatctccaccggattacagagtgggagacaagattgccacgcggaaggcttgcgggctggccctggcgaaattaggatatgcaaataaccgggtggttgtcttggatggggacacacgttatagcacttttagtgagatatttaacaaagaatatccggagagattcattgagtgcttcatggcggagcagaacatggttagcgtcgcgctcggttgcgcctcaaggggacgcaccatagcctttgcttccacctttgctgctttccttaccagagcgttcgatcatatccggattgggggtctggcggagagtaacataaacattatcgggtctcattgcggggtgtccgtcggggacgatggcgcttctcagatggcacttgaggacatcgccatgttcagaactatccctaaatgtaccatattctaccctactgacgcagtgtccactgaacacgcagtcgctttggcagccaatgctaaagggatgtgctttatacggaccacaagaccggaaaccatggttatctacacaccccaggagcgcttcgaaatcggtcaggctaaggtgctgaggcactgcgttagtgacaaagtgactgtcataggtgccggcatcacagtttatgaggctttggctgcggcagatgagctgagcaagcaggatatttttatacgggtgatcgatctgtttacaataaagccgctcgatgttgcaactattgtcagttcagccaaggcaaccgagggccgcataattacagtggaggatcactatccacaaggcggcattggagaggctgtgtgtgcagcagtttccatggaccccgacatccaggtgcattctttggccgttagcggagtccctcaatcaggcaagagcgaggagttgctagatatgtacgggatttccgcccggcacattatagttgcggttaagtgcatgctcttaaattag

SEQ ID NO: 209278 - DNA, 894 bp, Artificial Sequence
  Description of Artificial Sequence: Synthetic coding sequence
atgagcgcctgggccgccgccagcctgagccgggccgccgcccggtgcttactcgcaagagggcctggcgtgcgggctgctccacctcgcgatcctagaccgagtcaccctgagccaagaggatgtggagcggcccctggcagaacgctgcatttcactgctgcagtcccagctgggcataacaagtggagcaaagtgcgccacataaaggggcccaaagacgtggagcgctctcgcatctttagcaagctctgtttaaacattagattggccgttaaggaaggcgggcccaacccagagcataatagtaatcttgccaatattttagaggtatgtcgttctaagcacatgcccaaatccacaatagagaccgctctcaagatggagaaatccaaggatacgtacttactctatgagggccggggaccaggcggaagcagcctgcttattgaagcactgtccaactcctcacacaaatgccaggcagatattcgccacatcctgaacaaaaacggcggggtcatggccgtcggagccagacatagtttcgacaaaaagggagtgatcgttgtagaagtcgaggaccgggagaaaaaggccgttaatctggaacgagctctggaaatggcaattgaggctggggcagaggatgttaaggaaactgaggacgaagaggagaggaacgtgtttaaattcatttgcgatgcgagctctttacatcaggtccgcaaaaagcttgattcccttggactctgtagcgtttcttgtgcactggagtttatccccaacagcaaggtgcagttagctgagccagaccttgagcaagcagctcatctgattcaggccctgtctaaccacgaggacgtgatccacgtttatgataatattgagtag

SEQ ID NO: 209279 - DNA, 687 bp, Artificial Sequence
  Description of Artificial Sequence: Synthetic coding sequence
atgagcgtgagcgagatcttcgtggagctgcagggcttcctggccgccgagcaggacattcgcgaagagattaggaaggtcgtacagagtttggaacagacggctagagaaatcctcactctgctgcaaggagtccaccagggggccggtttccaagatattccaaaacggtgcctcaaggcccgcgagcattttggaactgttaaaacccaccttacatcacttaagactaagtttcccgcagagcagtactaccgcttccatgaacattggcgattcgttctgcaaaggctggtcttcttagcagctttcgtggtttacctagagacggagacactggtaacccgtgaagctgtcacagagatactaggtatcgagcccgacagggagaaagggttccacttggatgttgaagattacctatctggggtccttatcttggcctcagagctgtctaggttgtcagtgaattcggtgacagcaggcgactattcaagacccctgcacatttctacatttattaatgagctggactcaggcttccggctgctgaatctgaaaaacgacagtctgcggaaaaggtacgatggccttaagtatgatgtgaagaaagttgaagaagttgtttatgacctctctatcagaggctttaataaggagaccgctgctgcttgtgtggaaaaatag

SEQ ID NO: 209280 - DNA, 585 bp, Artificial Sequence
  Description of Artificial Sequence: Synthetic coding sequence
atgagcgtgagcgagatcttcgtggagctgcagggcttcctggccgctgaacaagacattcctaaaaggtgcctgaaagcgcgtgagcacttcggcaccgtgaagacccacctgacaagtctgaagactaaattccccgcggaacagtattatagattccatgaacactggcggtttgtcctgcagaggctggtctttctagccgctttcgtggtatatctggagacagagaccctcgtgacgcgagaggcagtgacagagattctaggaatcgaacccgaccgtgagaagggcttccatttggatgtggaggactacctatcaggagttttaatcctggcatcagaactgtctcggttgtctgttaactcggtgacggccggggattattcacggccactgcacatttccacatttatcaatgaactggattctggtttccgcctgctcaacctgaaaaacgactctcttcggaagcgatatgacgggctgaagtacgacgtgaagaaggtcgaggaggttgtctacgatctctctatccggggatttaacaaagagactgctgcggcctgcgtggagaagtag

SEQ ID NO: 209281 - DNA, 447 bp, Artificial Sequence
  Description of Artificial Sequence: Synthetic coding sequence
atgagcgtgagcgagatcttcgtggagctgcagggcttcctggccgccgagcaagatatccgggaggagattcgcaaagtggtgcagtcactggagcaaactgctcgtgagattttgacactgctgcagggggtccatcaaggtgccggtttccaggacattcctaagaggtgcttgaaagcgcgggaacattttgggaccgtgaagacacacctgacatcactgaagactaaattccccgccgagcagtactacaggttccacgaacactggcgattcgtcctccagaggctggtctttttggccgccttcgtagtttacctggagaccgagaccttggtgacccgggaagctgtgaccgagattctaggtatagaagccgtgtgtcagcaacgtgattgttggcgtctgctgcccaccccacctcatctccatcttcatcagtag

SEQ ID NO: 209282 - DNA, 873 bp, Artificial Sequence
  Description of Artificial Sequence: Synthetic coding sequence
atgagcaacaaggagggcagcggcggcttccggaagcggaagcacgacaatttccctcataaccaacgccgggagggcaaggacgtcaacagctcctctcccgtgatgttggcgtttaagtccttccagcaagagctggacgctcggcacgataaatatgaaagactggtcaagctgtcccgggacatcaccgtagagtctaaacgtacaatcttcctcttacaccggattacttctgctcctgatatggaggatattctcaccgagagtgagatcaaactggatggcgtgagacagaagatctttcaggtagcccaagagctgtcgggtgaggatatgcatcagttccaccgagccatcactaccggtctgcaagaatacgttgaagcagtgagcttccagcatttcattaagacaagatccctcatctcaatggacgagatcaataagcagcttattttcaccactgaagataacggtaaggagaataaaactccctccagcgatgctcaggataagcaatttggcacatggagattgcgagtgactccagtggattaccttttgggggttgccgatctgactggagaacttatgaggatgtgcatcaattccgtgggcaacggcgatatcgacacaccttttgaagtttcacagtttctacggcaggtttacgatggattttcttttatcggtaacactggcccttatgaggtttctaagaaactgtataccctgaagcaaagtctggccaaagtagaaaacgcctgctacgccctgaaggtcagaggctcagagatccccaagcacatgctcgctgacgtgttctcagtgaagaccgagatgatagaccaagaagaggggatctcttag

SEQ ID NO: 209283 - DNA, 492 bp, Artificial Sequence
  Description of Artificial Sequence: Synthetic coding sequence
atgagcaacaaggagggcagcggcggcttccggaagcggaagcacgacaattttccccacaaccaacgcagagaaggtaaagatgtgaactcatcttcacccgtgatgctcgcgttcaaatccttccagcaggaacttgacgctcgccacgataagtatgagcgcctagttaaactgtcccgcgacataactgtggagtctaagcgcacaatttttttgttgcaccgaatcacgtcatcccagtatctcgatcacagtgctccagatatggaagatatcttgactgagtctgagattaagcttgatggagttcgccagaaaatcttccaagtggcccaagaactttcgggcgaggacatgcaccagtttcacagagccataacaacaggcctccaagagtatgtggaggccgtgtccttccaacatttcattaaaaccagatcactaatcagtatggacgaaattaataagcagctgatctttaccacttag

SEQ ID NO: 209284 - DNA, 273 bp, Artificial Sequence
  Description of Artificial Sequence: Synthetic coding sequence
atggaccccctgcgggcccagcagctggccgccgagctggaggtggaaatgatggctgatatgtacaaccggatgacttcagcgtgtcaccgaaaatgcgtccccccacactataaggaggccgagctctcaaaaggggaaagtgtgtgccttgaccggtgtgtatcaaagtatctcgatattcatgagaggatgggaaaaaagctgaccgagttgagcatgcaggacgaagagctgatgaaaagggtacagcagtccagtggccctgcttag

SEQ ID NO: 209285 - DNA, 273 bp, Artificial Sequence
  Description of Artificial Sequence: Synthetic coding sequence
atggaccccctgcgggcccagcagctggccgccgagctggaggtggagatgatggccgatatgtataataggatgacatctgcttgtcaccgtaaatgcgtccccccgcattataaggaggcagaactatctaagggagagtcagtctgtttggatcggtgcgtgagcaaatatttagatatacacgagcgtatgggaaaaaaacttactgaactaagcatgcaggatgaggagttgatgaagcgagtgcaacagtcatcagggcctgcttag

SEQ ID NO: 209286 - DNA, 273 bp, Artificial Sequence
  Description of Artificial Sequence: Synthetic coding sequence
atggaccccctgcgggcccagcagctggccgccgagctggaggtggaaatgatggctgacatgtacaatcgaatgacatctgcctgccatcggaagtgtgtcccccctcactataaggaggctgagctgagcaaaggcgaatcggtgtgcttagaccgctgtgtgtcgaagtatctggatattcatgaacggatgggaaaaaagctcactgagctttccatgcaggacgaagagctgatgaaacgcgttcagcagtctagtgggcctgcatag

SEQ ID NO: 209287 - DNA, 927 bp, Artificial Sequence
  Description of Artificial Sequence: Synthetic coding sequence
atgaagcactacgaggtggagatcctggacgccaagacccgggagaaactgtgttttttagataaagtagaaccacacgccaccatcgcagaaatcaagaatctgttcactaaaactcacccacagtggtatcctgcgagacaatctctaagactagatccaaaaggcaagagcttgaaggacgaagacgtcctccaaaaactgccagtcgggactaccgccaccctgtactttcgggatctgggcgcccagattagctgggtcacagttttcctcacagaatacgccggacctctgtttatttacctcctgttctattttcgtgtcccatttatttacggccacaagtacgactttacatccagccggcatacggttgtgcatctcgcctgtatatgtcacagtttccattatatcaaaaggctccttgaaacgctgtttgtacaccgctttagtcatggcacaatgcccctgagaaacatcttcaagaactgcacatactactggggcttcgctgcatggatggcatactacatcaaccatcccctctacacaccgcctacgtatggcgcccaacaggtcaaacttgcactggccatctttgtcatctgccagttaggtaatttttccatccacatggcacttagggatttgcgtccagctggatctaaaaccagaaagataccttacccaactaagaatcctttcacttggttgttcctactagtatcgtgtccgaattacacctacgaggtgggttcatggattgggtttgctattatgactcagtgcctgccggttgcactgtttagtctggtggggttcacccagatgactatctgggccaaagggaaacacagaagctacctgaaggagttccgagactaccctcctctcaggatgcccattatcccattccttctgtag

SEQ ID NO: 209288 - DNA, 516 bp, Artificial Sequence
  Description of Artificial Sequence: Synthetic coding sequence
atggaggagtacgcccgggagccctgcccctggcggatcgtggacgattgtgggggtgccttcacaatgggtaccattggcggtgggattttccaggccataaagggcttcaggaacagccctgtgggagttaatcatcgactgaggggatctcttacagctatcaaaaccagggcgcctcagctcggcggcagcttcgcggtctggggagggctttttagcatgatcgattgttccatggtccaggtgagaggcaaggaagacccttggaacagcatcactagcggggcccttacaggcgcgatactggctgccagaaacggcccagtggcaatggtgggctctgctgccatggggggtattttactcgccttaattgagggagccggcattctccttacgcggtttgccagcgctcaattccccaacggacctcagttcgccgaagatccatcacagctgccttcaactcaactgccgtcctctcccttcggggactacagacagtaccaatag

SEQ ID NO: 209289 - DNA, 519 bp, Artificial Sequence
  Description of Artificial Sequence: Synthetic coding sequence
atggaggagtacgcccgggagccctgcccctggcggatcgtggacgattgcgggggggcattcaccatgggggtgataggcggcggagtctttcaggcaatcaaagggttccggaacgcacccgtcggtattcgacacagattgcgcggtagtgcgaatgccgtgcggattcgtgctccacagataggtggttctttcgctgtgtggggcgggctattcagcacgatcgattgcggcttagtgaggttaagggggaaagaagacccatggaacagtatcacttctggagcactaacgggcgccgtgctcgcagcacggagcggaccattggccatggtgggtagcgctatgatggggggcattctgttagcactgatcgaaggggtagggattctgctgacccggtatacagcccagcagttcaggaatgcacctcccttcctggaagacccttcacagctcccccctaaggacggcacgcccgcccccgggtacccttcttatcagcagtatcactag

SEQ ID NO: 209290 - DNA, 669 bp, Artificial Sequence
  Description of Artificial Sequence: Synthetic coding sequence
atggaggagtacgcccgggagccctgcccctggcggatcgtggacgactgtgggggcgcctttaccatgggggtgattggcggaggtgtgtttcaggctatcaagggatttcgaaatgccccggtttgccgactcttgagcgaagcccctctgtttatctatagctgttccagatctgtcagtcctactgtgaacgtgtcttctgagcgggctgaatccaggccgacattgtttatggcagtgtccctgcatatggcatggtgcttggcccatataggtatccgacatcgtctgcgcggctccgctaatgccgttagaattcgtgcccctcaaatcggcggaagcttcgccgtgtgggggggcctgttttctaccattgattgcggactcgtgcgactgcgagggaaggaggacccatggaattccataaccagcggggcattgacaggcgcagtactggctgctcgctccgggcctctggcaatggtcgggtcggccatgatgggaggtattcttctggctcttatcgagggggttgggattctcctcacacggtatacagctcagcagttccgtaacgccccaccgtttcttgaggacccaagtcagctaccccccaaagatggaacccctgcccccgggtatccatcgtatcaacagtatcactag

SEQ ID NO: 209291 - DNA, 585 bp, Artificial Sequence
  Description of Artificial Sequence: Synthetic coding sequence
atggccgccgccgcccccaacgccggcggcagcgcccccgagaccgcaggctcagccgaggctccactccagtatagtctgctgttgcaatacctcgtgggtgacaaacggcagccacgtctcttggaacctggatcactgggtggcatcccttccccagctaaaagcgaagagcagaaaatgatcgaaaaagctatggaaagctgcgcctttaaggcagcgctggcctgcgtgggaggtttcgtcctcggcggcgcttttggtgtgtttacggccggaatcgatacaaacgtgggcttcgatcctaaggacccgtaccgcacgccaaccgctaaagaggtactcaaggatatgggacagcggggtatgtcatacgcgaagaatttcgcaattgtgggggcaatgttttcctgcacagagtgcttaatcgaaagctacaggggcactagcgactggaaaaactctgttatatctggttgtattacagggggcgcgatcggattccgggcgggcttaaaagctggggctattgggtgcgggggctttgcagcgttctctgcagccatcgactactatcttaggtag

SEQ ID NO: 209292 - DNA, 630 bp, Artificial Sequence
  Description of Artificial Sequence: Synthetic coding sequence
atggagggcggcggcggcagcggcaacaagaccaccggcggcctggccggtttcttcggtgctggcggtgccggctactcccacgctgacctggccggcgtgccgctgacagggatgaaccccctgtcgccatatctgaatgtagacccccggtatctggtacaggatacggacgaattcatcttacctaccggcgccaacaagaccagaggcaggttcgagctcgccttctttactattggaggttgctgcatgacaggagcagcctttggagcgatgaacggacttcgcttgggcttgaaggagactcaaaacatggcttggtccaaaccaaggaatgtgcagattctaaatatggtgaccaggcagggcgccctgtgggctaatacgctgggtagcttagccctcctgtacagcgcctttggcgttattatagaaaaaaccagaggggccgaagacgaccttaacacagtggccgctgggactatgacaggcatgctgtataagtgtacgggcggattaagaggcatagcccggggtggattgacaggccttacactcacttccctatacgcactgtataataattgggagcacatgaagggtagcctgctgcagcagagtctgtag

SEQ ID NO: 209293 - DNA, 486 bp, Artificial Sequence
  Description of Artificial Sequence: Synthetic coding sequence
atggagggcggcggcggcagcggcaacaagaccaccggcggcctggcgggctttttcggtgctggcggtgccggttattctcatgccgacctcgcgggggtgccattaacagggatgaaccctctctcaccctatttaaacgttgatccccgatacctcgtacaagacacagacgagttcatcctgcccactggcgctaataaaacacgggggagattcgaactcgcctttttcactattggcggatgctgcatgactgcgttactgtacagtgcattcggcgtcataatcgagaagacccgaggagcggaggatgacctgaacacggtagctgctgggactatgacgggcatgctatacaagtgtacaggtggtcttcgtgggatagcgcgaggtggtcttacggggttgactctaacaagcttatacgccttatataacaactgggaacatatgaaaggatctctgctgcaacagtctctctag

SEQ ID NO: 209294 - DNA, 519 bp, Artificial Sequence
  Description of Artificial Sequence: Synthetic coding sequence
atggagggcggcggcggcagcggcaacaagaccaccggcggcctggccgggttctttggagcaggtggtgcaggatacagtcatgctgacctggctggcgtgcctctaacagggatgaaccctctctcaccctacctgaatgtagatccccgatacctggtccaggacactgacgaattcatcctgcctaccggcgccaataaaacaagaggtagatttgagctggccttcttcacaatcgggggatgctgcatgacaggagccctgtgggccaacaccctgggaagcctggcccttctgtattccgcattcggcgtcataatcgagaagactcgaggcgctgaggatgacctcaatactgtagccgctggcactatgacgggaatgttatataaatgtaccggcgggcttaggggcattgcacgagggggtttgaccgggctgaccctaacttctttatatgcgctctacaataactgggaacacatgaagggctcgctcctgcagcaaagcctgtag

SEQ ID NO: 209295 - DNA, 381 bp, Artificial Sequence
  Description of Artificial Sequence: Synthetic coding sequence
atgaccggcgccgccttcggcgccatgaacggcctgcggctgggcctaaaagaaacccagaacatggcttggtcgaagccccgcaatgtacagattctgaacatggttaccaggcagggcgctctttgggcaaacacactagggtcactcgcgctgctctactcagcttttggtgtcattatcgagaagacacgtggcgcagaggatgatctaaacaccgtggcagctggcactatgacaggaatgttatacaagtgcaccgcatctgcatcgcaaagcgcccgcattgctgacggactgatttttaccgaattctgctcagtggctcggctgcaaggttcgggaactatcctggcccactataacttacacctgccttag

SEQ ID NO: 209296 - DNA, 324 bp, Artificial Sequence
  Description of Artificial Sequence: Synthetic coding sequence
tgaggcggcagcggcaacaagaccaccggcggcctggccggcttctttggggctggaggcgcaggctattcccacgctgatcttgcgggggtgcccccactgctgtattcagcttttggcgtcattattgagaaaactcggggagcagaagacgaccttaacacagtggcggcaggaaccatgacagggatgttatacaagtgcacgggaggactacgggggatcgccaggggggggctcactggcttaactctgactagcctgtatgctctgtacaacaattgggaacatatgaagggcagtctgctacagcaaagcctctag

SEQ ID NO: 209297 - DNA, 1359 bp, Artificial Sequence
  Description of Artificial Sequence: Synthetic coding sequence
atggccgccgccgccctgcggagcggctggtgccggtgcccccggaggtgtctcggaagtggtatccagttcttatccagccacaatctgccccatgggtccacctaccaaatgaggagacccggcggcgaactgccactgagtaagtcttatagctctggcaaccgaaaaggctttttatcgggtctcctggataacgtcaaacaggaacttgcgaagaataaggagatgaaagagtccatcaaaaaattcagagatgaggcacgcaggcttgaagagagtgacgttcttcaggaagcacgcagaaaatacaagacaattgagtccgaaaccgttcggaccagcgaagtcctgagaaagaaactgggcgagcttacaggcacagtcaaggagagcttgcatgaggtcagcaagagtgacctgggaagaaaaattaaggaaggtgtggaagaagcagctaagactgccaaacagtcagcagagtctgtatcaaaggggggcgagaagctcggcagaaccgccgccttccgcgcgctgagccaaggtgtggagagcgtgaagaaagaaatcgacgactctgtcctcggtcagactggtccttatcggcggccccagcgcttaaggaagcgcaccgagtttgccggagataaattcaaagaagaaaaggtattcgagcccaacgaagaagcactgggcgtggttctgcacaaggactccaagtggtatcagcagtggaaggacttcaaggagaataatgttgtcttcaatcggttcttcgaaatgaaaatgaagtacgacgaaagcgacaatgcattcatcagggctagccgcgccctcactgacaaagtgacagacctgctgggaggtttattctccaaaactgagatgtccgaggtgttaaccgagatactcagagtcgatcccgccttcgacaaggaccgatttctgaagcaatgtgagaacgacattattcctaacgtgttggaggccatgatctctggagagttagatattctcaaagactggtgttatgaagctacatatagtcagctggcgcacccgatccaacaagcgaaggcgctgggcttacagttccatagcaggatcctggatatcgacaatgttgacctggccatgggtaaaatgatggaacaagggcccgtgcttatcatcaccttccaggcgcaactcgtcatggtggtgcgaaacccaaagggcgaggtagtggaaggtgaccctgataaagtgctgcgaatgctgtacgtctgggcactgtgccgggatcaggacgagctgaacccatacgccgcttggaggttactcgatatctctgcctcttcaacagaacaaatcctttag

SEQ ID NO: 209298 - DNA, 294 bp, Artificial Sequence
  Description of Artificial Sequence: Synthetic coding sequence
atggacagcagcagcagcagcagcgccgccggcctgggcgccgtggatcctcagctccagcatttcatcgaggtggagacacagaagcaaagattccagcagctcgtgcaccagatgactgagctgtgctgggaaaagtgcatggacaagccaggcccaaaactggactctcgggctgaagcctgctttgtcaactgcgtcgagagattcatcgacacaagccagttcatcctgaatcgcctggagcaaacccaaaaatcaaagcctgttttctcggagagcctgtcggactag

SEQ ID NO: 209299 - DNA, 270 bp, Artificial Sequence
  Description of Artificial Sequence: Synthetic coding sequence
atggccgcccagatccccgagagcgaccagatcaagcagttcaaggagttcctaggcacttataacaagctaactgagacatgctttctcgactgcgtcaaagattttaccactcgggaagtgaaacctgaagagacaacatgttctgagcactgtttacagaaatatttaaagatgacccaacgcatctccatgcgatttcaagagtaccacattcagcagaatgaagccctggctgcaaaggcagggttgctgggccagcctcgttag

SEQ ID NO: 209300 - DNA, 270 bp, Artificial Sequence
  Description of Artificial Sequence: Synthetic coding sequence
atggccgcccagatccccgagagcgaccagatcaagcagttcaaggagtttcttgggacctacaataagttgaccgagacttgtttcctggattgtgttaaggactttaccacccgggaagtgaagcccgaagaaactacctgctcagaacactgtctccagaaatacctcaagatgacccagcggatctccatgaggttccaggagtaccatatccaacaaaacgaagcccttgcggcaaaggccggcctgcttggccagcctcgctag

SEQ ID NO: 209301 - DNA, 135 bp, Artificial Sequence
  Description of Artificial Sequence: Synthetic coding sequence
atggccgcccagatccccgagagcgaccagatcaagcagttcaaggagtttctgggaacctacaataaactaacagagacttgcttcttggactgcgtgaaagatttcaccacaagggaagtaaaacccgaatag

SEQ ID NO: 209302 - DNA, 270 bp, Artificial Sequence
  Description of Artificial Sequence: Synthetic coding sequence
atggccgcccagatccccgagagcgaccagatcaagcagttcaaggaattcttagggacttataataagctgacagaaacgtgcttcctggattgcgtcaaagatttcaccacgagagaagtcaaacccgaggagacaacttgcagcgaacactgcctccagaagtacctgaagatgacacagagaatctccatgagattccaggaataccatatccaacagaacgaagctttagctgccaaggccggtctcctaggccaaccacgctag

SEQ ID NO: 209303 - DNA, 270 bp, Artificial Sequence
  Description of Artificial Sequence: Synthetic coding sequence
atggccgcccagatccccgagagcgaccagatcaagcagttcaaggaattcctgggaacatacaataaattgaccgaaacatgcttcctggactgtgtgaaagactttacaacacgcgaagtgaagccagaagagacaacgtgctccgaacactgcctgcaaaaatacctgaagatgacacaacggatttccatgagattccaggagtaccatatccaacagaacgaagctttagcagcaaaagccggcctattggggcaaccccgctag

SEQ ID NO: 209304 - DNA, 381 bp, Artificial Sequence
  Description of Artificial Sequence: Synthetic coding sequence
atgcccttcttcggcaacaccttcagccccaagaagaccccccccaggaaatccgctagcctgtctaacctgcattcactggataggagtacccgcgaggtagaattagggctggaatacggatcacctaccatgaatctcgcagggcaatccttgaaattcgaaaacggacagtggattgccgagactggcgtgagcgggggcgtcgaccgccgggaagtccagaggttgcgaagaagaaaccagcaactcgaggaagagaataatctgctgcggcttaaggtggacatcttgctggatatgctttccgagagcacggccgagagccacttaatggagaaggagctggacgaacttaggattagcaggaagaggaagtag

SEQ ID NO: 209305 - DNA, 1086 bp, Artificial Sequence
  Description of Artificial Sequence: Synthetic coding sequence
atgggcaacgtgctggccgccagcagcccccccgccggcccccccccgccacccgctcctgccctggtgggcttgccaccgcctcctcccagtcccccaggattcaccttgccccctctgggcggcagtttgggcgcagggacctctacctcgcggagttccgagagaacgcctggtgctgctacggctagtgcttcaggagccgctgaggatggggcatgtggctgcttgcccaaccccggtaccttcgaggagtgccaccgcaagtgcaaggagctcttccctattcagatggagggcgtgaagctcacggtgaacaaaggcctctcaaaccactttcaggtcaaccatacagttgccctcagtacgattggagagtccaactaccattttggggtcacatacgtcggtaccaagcaacttagccctacagaggctttcccagtcctggtcggcgacatggacaacagcggttccctcaacgctcaggttatccaccagctgggccctggcttgcgatcaaagatggccatccaaactcagcagagcaaattcgtcaactggcaagtggatggggaatatagagggtcggacttcactgctgccgtaacactaggcaacccagatgtgctggtcggctccggcattttagtcgcacattatcttcaaagcatcactccatgccttgctctgggtggagagctggtatatcaccgccggccaggagaggaggggaccgtaatgtctctcgcgggtaagtacaccctgaacaactggcttgcgaccgtgactctggggcaggcaggtatgcatgccacatactaccacaaagcgtctgatcagcttcaggtcggcgtcgagttcgaagcctccacgaggatgcaagacactagcgttagcttcggctaccagctggacctgcccaaagcaaacctgctgtttaagggctcggtggatagtaattggattgtgggcgccaccctagaaaagaagttgcctccattacccctgacattggctctaggcgcatttctgaatcatcggaagaataagttccagtgtggttttggcctgacaatcgggtag

SEQ ID NO: 209306 - DNA, 1086 bp, Artificial Sequence
  Description of Artificial Sequence: Synthetic coding sequence
atgggcaacgtgctggccgccagcagcccccccgccggccccccccctccccccgcccccgccctggttggcctgccccctccccccccatcaccaccaggttttaccctgccacccctggggggtagcctaggcgcaggcacatcaactagtcggagctccgagcgcaccccaggggccgctactgccagtgcctccggcgcagcagaggatggggcttgcgggtgccttcccaatcctggcacattcgaggaatgccaccgcaagtgcaaggagctgtttcctattcagatggagggagtgaaactgacggtcaataagggactgagtaaccacttccaggtgaatcacactgtggccctgtccactataggtgagtctaactaccatttcggagtcacctacgtagggacaaagcagttatccccgaccgaggcgtttcctgttctcgtcggcgatatggataatagcgggagtctgaacgcgcaggtgatccatcagctggggcctggactccggtcgaaaatggcgatacagactcagcaatccaaattcgtcaattggcaggtggatggagagtataggggctcggatttcactgctgcagttaccctgggcaaccccgacgtgctggtaggatccggcattctggtggcacactatctccagtccattacgccgtgcctggccttggggggtgaactggtctaccataggagacctggagaggagggaacggtcatgtctttagccggcaagtacacccttaacaactggctcgcaaccgtgactctgggtcaagctggaatgcatgcaacttactatcataaagctagcgaccagctgcaagtcggtgtagaatttgaggcctcgacaagaatgcaggacactagtgtgagctttggctatcagctcgacttacccaaagctaatctgctgtttaaagggtccgtggattcaaactggatcgtgggtgctactcttgaaaaaaagcttcccccactacctctcaccctggccctgggggcctttctgaatcatcgcaaaaataagttccagtgcggctttggcctaactatcggatag

SEQ ID NO: 209307 - DNA, 1086 bp, Artificial Sequence
  Description of Artificial Sequence: Synthetic coding sequence
atgggcaacgtgctggccgccagcagcccccccgccggccccccccctccacccgcccctgccctggttggactgcctcctcctccaccatcgccacctggctttactctgcccccactggggggaagtttgggagcaggaacatcaacctccagatcgagtgagcgcacacccggcgctgctaccgcttcagcctcaggtgcagccgaggacggggcctgtgggtgcttaccaaatcccggcacatttgaggagtgtcacaggaagtgtaaagagcttttccccattcaaatggagggcgtgaagctgacagttaacaagggcttgagtaatcattttcaggttaatcacacagtggcgctcagtacaatcggcgaatcaaattaccacttcggtgtgacttacgtggggacaaaacagttatccccgacggaggctttcccggtgctcgtgggggacatggacaacagtggtagtctgaacgcccaggtgattcaccagcttggtcccggtcttcggtccaaaatggccattcagacccagcagtccaaatttgtgaactggcaggtggacggcgaatatcgcggttccgactttaccgctgccgttaccctgggcaaccctgacgtcctggttggatccggcattttggtagcacattatctgcagtcgataaccccctgcctcgccctgggcggcgagctcgtctaccatcggcgtccaggcgaggagggcactgtcatgtctctggccgggaagtatactctgaataattggcttgccaccgtaaccctgggccaagctggaatgcacgcaacctactatcataaagcttctgatcagctgcaggtcggagtggaattcgaggccagcaccagaatgcaggacacctccgtgagttttggttaccagctggatctgcctaaagccaatttactgttcaagggtagcgtggacagtaattggattgtgggagccacattggaaaaaaaactcccccctcttcccttaaccctagccctcggggctttcctgaaccaccgcaaaaataagtttcagtgtgggttcggactcaccatagggtag

SEQ ID NO: 209308 - DNA, 453 bp, Artificial Sequence
  Description of Artificial Sequence: Synthetic coding sequence
atgcccagcagcggcagcgtgagccggagccggcagcggggccggtcgatggcctcaaggggcttcgacggctccagacgcggcagcctgcgccgtgccggcgctagggagcctcccagcgaagtaatcgaggcagcggcacaggctagcggaagctgctggtccagcccttttttttctgctagcacaccctccgccgctgccacaggggtgccagggcccacagatatggcagcggtgttgcagcaggtgctagaaaggacagaactgaataagttacctaagtctgtgcagaataagctggaaaagttccttgctgatcagcagtctgaaattgatggtttgaaggggcgacacgaaaagtttaaggtggaatcggagcagcagtacttcgagattgagaagaggttgtcccactctcaagaacgtctggtcaatgaaacccgtgaatag

SEQ ID NO: 209309 - DNA, 7092 bp, Artificial Sequence
  Description of Artificial Sequence: Synthetic coding sequence
atggccgccgtgctgcagcaggtgctggagcggaccgagctgaacaaattgccgaagtcagtgcagaataagttggaaaagtttttggcggaccagcagtccgaaatcgacggcctgaaaggtcggcatgagaagttcaaggtagaaagcgagcagcagtacttcgagatcgagaagagactgagccattctcaggagcgtctcgttaatgagaccagggaatgccagagccttcgcctcgaactagaaaaactgaataatcagctgaaggcattgacagagaagaacaaggaacttgaaattgcgcaggatcgcaatatagccatccaatcacagttcactcgcacaaaggaagaacttgaagcagagaagcgggatttaatccggacgaacgaacggctgagccaggagctagaatatcttaccgaggacgttaaaaggctcaacgaaaagttaaaggaatccaatacgactaagggggagctgcagctaaaattggatgaactgcaggcttctgacgtgtctgtcaaatacagggaaaaacggctcgaacaggaaaaggagctgctgcacagtcagaacacttggcttaacacagaactcaaaacaaaaaccgacgaactcctggccctgggccgagagaaggggaatgagattctcgagttgaagtgtaaccttgagaacaagaaggaggaagtgtcaaggctggaagagcagatgaatggcttgaagaccagcaacgagcatctacagaaacatgtggaagacctcctgaccaaactcaaggaagcaaaagagcagcaggcctcaatggaggaaaaattccacaatgaattgaatgcacatattaaactgagcaatctctacaagtctgctgcagacgattcggaggctaagagcaacgagttaactcgggctgtcgaggaacttcataaactactaaaggaagccggtgaggccaacaaagcaatccaggatcatttactggaagtcgaacagtcaaaggatcaaatggagaaagagatgttggagaaaattggcaggctggaaaaagaattagagaacgccaatgatctgctgtctgccaccaagcggaagggagctatcctgagcgaagaagaactagcggcgatgtcccccacggcggctgccgtcgcgaagattgtgaagccaggcatgaagctgacagaactgtacaatgcctatgtcgaaacacaagaccagcttctgctggagaagctggagaataaaaggatcaacaagtaccttgacgaaattgttaaggaggttgaggccaaggcccctatactcaaacgtcagcgggaagagtacgaaagggcccaaaaagcagtggcctcgttgtccgtcaaattggagcaagccatgaaggaaatccagcgtctgcaggaggacacagataaggctaacaagcagtcatcagttctcgagcgggacaatagaaggatggagatccaggtgaaggacctctctcagcagattcgagtactgttaatggaactcgaagaggctcgcggaaatcatgtgattcgggacgaggaagtttccagcgcggacatctcttctagctccgaggttatttcacagcacctggtttcttaccgtaacatcgaggagctgcagcagcaaaatcagaggctacttgttgcgttgcgagagttaggggaaacacgcgagagggaggagcaagaaaccacttcctctaaaatcaccgagctgcagctgaagctggaaagcgccctgaccgaactggagcagctgagaaagtccagacagcaccagatgcagctagtcgacagcatcgtccgacagcgggacatgtaccgaatcctcttgtcccagacaactggagtcgctatccctctgcatgccagctccctggacgacgtaagtctggctagcacacccaagagacctagcacgtctcagacagtgagtacccctgcccccgtcccagtgattgagtccaccgaggccatcgaagctaaagccgccctcaaacagttacaagagatattcgagaattataaaaaagagaaggctgaaaatgagaagatccagaatgaacaattagaaaaactccaagagcaagtgacagacttacggagccagaatactaaaattagcacacagctggatttcgcaagcaagcggtatgagatgcttcaggacaatgttgaaggttatcgcagagaaataactagcctacacgaacgaaaccaaaagttaaccgccaccactcaaaagcaggagcaaatcattaacaccatgacccaggatctgcgtggcgcgaatgagaaattggccgttgctgaagtgcgggctgaaaatcttaaaaaagagaaagagatgctcaagctcagtgaagtacgactttctcaacagagggaatcattactcgctgagcagcgcggccagaatttgcttcttacaaaccttcaaacaattcaagggattttggagcggtcggaaacagagaccaagcagaggctctcgtcgcagattgagaagctggagcacgaaatctctcacctgaaaaagaaacttgagaacgaagttgaacagaggcataccctcactcggaatcttgacgtccagcttttggacacaaagcgacagctcgacactgagacaaaccttcatcttaatacaaaggagctgctgaagaatgctcaaaaagagatagccactctgaaacagcatctttcaaacatggaagttcaggttgccagccagtcttcacaaagaaccggtaaaggccagccctccaacaaagaggatgtcgatgacctcgtctctcagcttagacagaccgaggagcaggtgaacgacctgaaggagagactgaagactagcaccagcaacgtggaacagtatcaggctatggtgacttcgctggaagaaagtctgaacaaagagaagcaagtcacagaggaggtgaggaaaaatatcgaagttcgcctgaaggagagcgcggaatttcagactcagctggagaaaaagctaatggaagtggagaaggaaaaacaggaactgcaagatgacaagcgaagggcaatcgaaagcatggagcaacagttatccgaacttaagaaaactctctcttcggtgcagaatgaggtccaggaggcactccaaagggcatctacagcgctaagtaatgagcagcaggcacgccgtgactgccaagaacaggctaagatagcagtggaggcccagaacaaatatgaacgggaattaatgcttcatgctgctgatgttgaggcattgcaggcagcaaaggagcaggtgtccaaaatggcttctgtaagacaacacctggaagaaactactcagaaggcggagtctcaactgttggagtgtaaagcttcttgggaagagagggagcgtatgctaaaagatgaagttagcaagtgtgtttgtaggtgcgaggacttggaaaagcagaataggcttttacacgatcagatagagaagctctctgacaaggtggtggcatcagtgaaagaaggagtacaaggacccctcaacgtgtcattgtccgaggaaggcaaatcccaagaacagatcctggagattcttcggttcattaggagggaaaaggaaatagcagaaactaggttcgaagtcgcacaggtggaatccctgcgataccgacaacgggtggagcttctggagagggagctccaggagctgcaggattctcttaatgctgagcgcgaaaaggtacaggtgactgcgaagaccatggctcagcacgaggaactgatgaagaaaactgaaaccatgaacgtggtaatggaaactaacaagatgctgagagaagaaaaggagcgtctggaacaagatttgcagcagatgcaggcgaaagtgcgaaaactcgagttggacatattaccactgcaggaggccaatgccgagttgtctgagaaatcaggaatgctgcaggctgagaaaaaactgttggaagaggacgttaaaagatggaaggcgcgcaaccagcacctggtgtcacaacagaaagacccggataccgaagagtatcgaaaactcctcagcgaaaaagaggttcatacaaaacgaatccaacagctgactgaagagatcggcaggctgaaggcagagatcgcacggagcaacgcctctctcacaaacaaccaaaacctgatccaatcgctgaaagaagatctcaataaggtacggacagaaaaagaaactatccaaaaagatctggatgctaagattatcgacatccaggaaaaagtgaagacaatcacccaggttaagaaaatcgggcgacgttacaaaacccagtacgaagagcttaaggcccagcaggataaagtaatggagacgagtgcacagtcaagcggcgaccatcaagagcagcacgtctcagtgcaagagatgcaagagttgaaggagaccctgaatcaggctgaaactaaaagcaaatctctggagtcccaggtggagaaccttcagaaaactctctcagagaaggagactgaagccaggaacctacaagagcaaacggttcaattacaatccgagttatcaaggctccgccaggacctgcaggatcgcacgactcaggaggagcagctgaggcagcaaattacagagaaggaggagaagacacggaaagctatcgtggcagccaaatccaagattgcccacctggccggcgtcaaagatcaattaacgaaggagaatgaggagttaaagcagagaaacggtgccctggatcagcagaaggacgaattggacgtgcgtatcacggcattgaagtctcagtacgagggcaggattagccgactcgagcgggaactgcgggagcaccaggaacgtcatctggagcagcgggatgagccccaggagccgtccaacaaggtgcccgagcagcagagacagattactctgaaaaccacccccgccagcggggagagagggattgcatcaacgtctgatcctcccaccgccaatattaagcccaccccagtggtgtcaaccccttcaaaagtcacggctgcggccatggctggcaataagtcgacaccaagggccagcatacgtcctatggtgacgccagccaccgtgacaaaccccactaccaccccgaccgccaccgtgatgcccactactcaggttgaaagccaggaggcaatgcagtcggagggtcctgtggagcacgtgccagtgttcgggtcgacatcaggatcggtgaggtctacctcccccaacgtgcagcctagtatatctcaaccaatcctgactgttcagcagcaaacccaggccacagcctttgtgcagcccacacaacaatcacatccacagattgagccagccaatcaagagctgtcttccaacattgtggaagtagtccagtcatccccagtggagcgtcctagcacctccaccgctgtgttcggtacggtgagcgctacaccaagttccagcctgcccaagaggacgagggaggaggaggaggacagcaccattgaagccagcgaccaggtgtctgatgacacagtggagatgcccctgcctaagaaattgaaatccgtgacccccgtgggcacagaagaggaggtcatggctgaggaatcaactgacggcgaggttgaaacccaagtgtacaaccaggattctcaggattccatcggggaaggcgtcacccagggagattacacaccaatggaggactccgaagaaacaagccagtctctccagatagatcttggcccactgcaatctgatcagcagaccaccacgtcaagtcaggacgggcaggggaaaggggatgacgtaatcgtcattgattcggacgatgaagaggaggatgatgacgagaatgacggcgagcatgaggactacgaagaggatgaggaagacgacgatgatgatgaagatgatactggcatgggggacgagggcgaagactccaacgagggcactggttctgccgacgggaatgacggatacgaagccgatgatgctgagggaggcgatggtacagaccccggaacagagactgaagagtctatgggagggggggaaggtaatcatcgcgccgctgatagtcagaactcaggcgaaggaaataccggggctgccgaatcaagtttctctcaggaggtcagtcgcgaacaacagccatcatcagcaagcgaacggcaagccccacgggccccccaatccccaaggcgcccaccgcaccccctgccacctaggcttacaatacacgccccccctcaggagctcgggccacctgtccagcgtatccagatgacaagacgccagagcgtggggagaggactgcaattgacaccaggcatcgggggcatgcagcaacacttctttgacgacgaagatcgtacagtgcccagtacccctacgttggttgtcccacaccgaacagatggattcgccgaagccattcattcccctcaagtggcaggtgtgcctaggttcagattcggacctccagaagacatgccacagacctcgagttctcactcagaccttggtcaacttgcctcccaaggcggtttgggcatgtacgagacaccattatttcttgctcatgaagaggaatcaggtgggaggagcgtgcctaccacgccacttcaggttgcggcacccgttaccgtgttcacggagagtacaaccagcgacgcaagcgaacacgcttcccagagcgtgcccatggtaaccaccagcactggaaccctctccactacaaatgaaacagccaccggggacgatggagatgaggtctttgtagaagcggaatctgaaggcataagctcggaagccggtctggaaatcgattctcagcaagaggaggagccagtgcaggcgtctgacgaaagcgatcttccctcaacatctcaggatccaccgtcgtccagcagcgtggacacctctagctcccagccgaaaccgttcaggagggtgcgattgcagaccacacttaggcaaggggtgcggggccgccagttcaaccgccagcggggcgttagccacgcaatgggaggacgaggcggaatcaaccgcggaaatatcaactag

SEQ ID NO: 209310 - DNA, 453 bp, Artificial Sequence
  Description of Artificial Sequence: Synthetic coding sequence
atgcccagcagcggcagcgtgagccggagccggcagcggggccggtccatggcatctcgcggcttcgatggatccaggagggggagcctcaggcgagctggtgcccgagaacccccctcagaggttattgaagccgcagcacaagcgagcggttcatgctggtcttcacccttttttagcgcgtccaccccaagcgctgcggcaaccggcgtccctgggcctacggatatggcagcagtactgcagcaggtattggaaagaaccgaactaaacaaactcccaaaatctgtgcaaaataagctggaaaagttcctggccgatcagcaaagcgagattgacggtctcaaagggagacatgaaaagttcaaggtagagtctgagcagcaatactttgaaattgagaagcgactctctcactcccaagaacggctggtcaatgagactcgagagtag

SEQ ID NO: 209311 - DNA, 510 bp, Artificial Sequence
  Description of Artificial Sequence: Synthetic coding sequence
atggcccccccctgggtgcccgccatgggcttcaccctggccccctccctaggatgtttcgtaggttcgcggttcgtgcatggggaaggactgcgttggtacgcaggattacagaaaccttcttggcaccccccacactgggttctggggccagtctggggcacactctatagcgctatgggctatgggtcttatctcgtgtggaaggaactgggcggatttaccgaaaaggctgtagtgcctttggggctttacactggccagctggctttgaactgggcctggcctccaatcttcttcggggcaagacagatggggtgggcactggtggatctgctgctggtgagcggggcggccgccgctactaccgttgcttggtatcaggtgagccctctggctgcaagactcctgtatccatacctggcttggctggcgtttaccacaactctcaattattgtgtgtggcgggacaatcacgggtggagaggcggccgtcgcctgccagaatag

SEQ ID NO: 209312 - DNA, 510 bp, Artificial Sequence
  Description of Artificial Sequence: Synthetic coding sequence
atggcccccccctgggtgcccgccatgggcttcaccctggccccctccctgggctgcttcgtggggtccagattcgtccatggggaagggctccgatggtacgccggcttacagaaaccttcgtggcacccaccccactgggtcctggggcctgtgtggggaacactgtacagtgctatgggctatggcagctatctggtctggaaagagctgggaggctttaccgagaaggccgttgtacccctaggcctgtacacgggacaacttgctttgaactgggcttggccacccatattctttggcgctcgccagatggggtgggccctagtggatttactcctcgtgagtggcgccgcagctgcaaccactgtggcctggtatcaggtgagccccctggccgcccgactgctatacccttatctggcttggctggcgttcactaccactttgaattactgtgtctggcgagacaaccacggctggaggggaggccggcggctgcccgaatag

SEQ ID NO: 209313 - DNA, 309 bp, Artificial Sequence
  Description of Artificial Sequence: Synthetic coding sequence
atggccccccacctgctgtggtgccccaccaacggcctgggcctgggcggaagcccagccggtcagtggggcggcggctcccactacagaggacttgtgccaggagaaccagccggtcgaccgcccgccctacccctgcctgggctggccgggctgcacgaccacacccagctgctgaggatggcgggccagccctggctggcatggggaaccgctgctgcacgagtctccgcgcggccgacgcgggactgtagctgcactagccgctgccaccatgcatgtgatgtggtggcagtcacgctcagctag

SEQ ID NO: 209314 - DNA, 324 bp, Artificial Sequence
  Description of Artificial Sequence: Synthetic coding sequence
atggcccccccctgggtgcccgccatgggcttcaccctggcccccagtctagggtgctttgtgggctccagatttgttcatggggaggggctcagatggtatgcgggactgcagaaacctagctggcaccccccgcactgggtcctgggacccgtttggggcactctttatagtgctatgggctacggttcttacctcgtctggaaggaactcggagggttcacagaaaaggctgtggtgcctcttgggctctatactgggcagctggcacttaactgggcgtggccccccatcttcttcggcgctcgccagatgggttggtag

SEQ ID NO: 209315 - DNA, 609 bp, Artificial Sequence
  Description of Artificial Sequence: Synthetic coding sequence
atgtgctacggcaagtgcgcccggtgcatcggccacagcctggtgggtctcgccctcctgtgtattgcggcaaatatcctgttgtattttcccaacggcgaaactaagtatgcctccgaaaatcatctgagtaggtttgtgtggttctttagcgggattgttgggggagggcttttgatgttattacccgcattcgtgttcatcggcttggaacaggacgactgttgcgggtgttgtgggcatgagaattgcgggaagcggtgtgcaatgctttcatcagtgctggctgcactgataggcatcgcaggatcagggtattgtgtgatcgtcgccgcactcggactcgctgaagggcccctgtgcttggactccctggggcagtggaactacacatttgcttcaacggagggacagtaccttctcgatacctccacatggtctgaatgtactgagccaaaacacattgtcgaatggaatgtcagtctctttagcatcctcctggcactgggtggcattgaatttattctttgtttgatacaggtgattaatggagtgctggggggcatttgtgggttctgctgctcacatcagcaacagtatgactgttag

SEQ ID NO: 209316 - DNA, 699 bp, Artificial Sequence
  Description of Artificial Sequence: Synthetic coding sequence
atgtgctacggcaagtgcgcccggtgcatcggccacagcctggtgggtctcgcactgctgtgcattgccgccaacatactactatacttcccaaacggagagacaaagtacgcgagcgagaaccacttgtcccgattcgtgtggtttttctctggcatagttggaggggggctcctcatgctgctgccagccttcgtttttatcgggctggagcaggatgattgttgtgggtgttgtggtcacgagaactgcggtaagagatgtgcaatgcttagcagcgtattggcagccctcatcggtatcgctggatccgggtactgcgtgattgtggccgcgctgggactcgcggaaggccctctgtgcctggactctttagggcagtggaactatacttttgcaagcaccgagggccaatatctgctggacacaagcacctggtctgagtgtactgagcccaagcacattgtggaatggaatgtgtccctttttagtatcttgctcgcactgggcggaattgaattcattttgtgcctgatccaggtcatcaacggtgtgctgggaggcatatgcggattttgctgcagccaccagcagcagatgactgccaagaggacaaacccgggacaatcccacaatctgcctctcttccactgcaatttgtatatcagcctggtgttcatctgcaaaaccttgtattag

SEQ ID NO: 209317 - DNA, 609 bp, Artificial Sequence
  Description of Artificial Sequence: Synthetic coding sequence
atgtgcaccggcggctgcgcccggtgcctgggcggcaccctgatcccgctggctttcttcggttttctggccaatatacttctgttttttcccggcggcaaggtaatagatgacaatgatcatctgagccaggaaatctggtttttcggggggattctcggctccggcgtgctaatgattttccccgcccttgtgtttctcggtttgaagaacaatgattgttgtgggtgctgcggcaacgagggctgcggcaaacgtttcgcaatgttcacctcgactatcttcgccgtagtcgggtttcttggcgctggctattctttcatcatttcagccatttccattaacaaaggcccaaagtgtctaatggccaacagcacgtggggctaccccttccacgacggagattatctgaacgacgaggccctttggaacaaatgccgggagccacttaatgttgtgccatggaacttgacacttttcagtatcctactggtagtgggaggaatccagatggttctttgtgctatccaagttgtcaatggcctgcttggtacgttgtgtggggattgccaatgttgcgggtgctgcggcggcgatggcccagtgtag

SEQ ID NO: 209318 - DNA, 594 bp, Artificial Sequence
  Description of Artificial Sequence: Synthetic coding sequence
atgtgcaccggcaagtgcgcccggtgcgtgggcctgagcctgatcaccctgtgtctggtttgtattgtcgctaatgcactgcttctggttcccaatggggagacctcctggacaaatacaaaccacctgtcactgcaggtgtggctgatgggggggttcattggcggcgggctgatggtgctctgtccaggaatagcagcggtgagagccggaggtaagggatgctgtggtgccggctgctgcggcaatagatgcaggatgttgaggtccgtgttctcctccgccttcggcgtgctgggcgccatttattgtctctctgtgagtggggccggtttaaggaatggcccgaggtgtctgatgaacggggaatgggggtaccattttgaggataccgccggcgcttatctccttaatcgaaccctgtgggacaggtgcgaggcaccaccccgcgtcgtcccttggaacgtcacattattctcactcttggtcgctgcctcatgcttagagatcgtcctgtgtgggatccagcttgtgaacgctacgatcggcgtgttctgtggggactgcaggaagaagcaggatacccctcactag

SEQ ID NO: 209319 - DNA, 438 bp, Artificial Sequence
  Description of Artificial Sequence: Synthetic coding sequence
atgagcgccagcgccgccaccggcgtgttcgtgctgagcctgagcgcaattccagttacttatgtatttaatcacctcgccgcacagcacgactcctggaccattgtgggtgtcgctgccctgatactattcctggtggcccttctggcgcgtgtcctcgtcaagcggaagcccccacgggatcctctgttctacgtatatgctgtttttgggtttacatcagttgtgaaccttataattggtttagagcaggatgggatcatagatggattcatgacacactatctgagggaaggagagccgtacctgaacacagcctatggtcatatgatctgctattgggatggctcagctcattacctgatgtatcttgtgatggtggccgccattgcatgggagtgttggcacatctgctcaatcctgttcctgacattatag

SEQ ID NO: 209320 - DNA, 1113 bp, Artificial Sequence
  Description of Artificial Sequence: Synthetic coding sequence
atgagcgccagcgccgccaccggcgtgttcgtgctgagcctgagcgccatccccgttacctacgtgtttaatcacctggcagctcagcatgattcatggacaattgtcggcgttgctgctctgatcctgttcctggtcgcactcttagctagggtgttggtaaagcgaaagccccctagggaccctctcttttacgtatatgctgtgtttggattcacctcggtggtcaatttgatcattggcctggagcaagacgggatcattgatggctttatgacgcactatctgagggagggtgagccctatctcaataccgcctatggtcatatgatttgctattgggacggtagcgctcattacttgatgtacttggtcatggtggcagccatcgcatgggaagaaacttaccggactatcgggttatactgggttggcagcatcatcatgtcggtggtggtgttcgtgccaggcaatattgtgggtaagtatggaactcggatttgcccagcattctttctttccattccgtacacctgtctgcctgtctgggctggtttcaggatatataaccaacctagcgagaattacaattatccgagcaaggtcatccaggaggcccaggcaaaagatctgctgaggcgtccgttcgacctcatgctggtcgtgtgcctgcttcttgcgaccggcttctgtctgttcagaggtttgattgcactagactgtcctagtgaactctgccggctgtatacccagttccaggagccttatttgaaggatccagctgcctatcctaagattcagatgctagcctatatgttctactccgtaccttattttgtaacagcactgtacggcctagtagttcctggctgttcttggatgcccgatatcaccctgatacacgctggaggtctggctcaggcacagttttcccacatcggggcgagtttgcatgctcgcaccgcttacgtctacagggtcccagaagaggctaagatcttattccttgcactcaatatcgcttacggcgtactcccacagctgctagcctacaggtgcatctacaaaccggagttcttcatcaagactaaggcagaagagaaggtcgagtag

SEQ ID NO: 209321 - DNA, 1020 bp, Artificial Sequence
  Description of Artificial Sequence: Synthetic coding sequence
atgagcgccagcgccgccaccggcgtgttcgtgctgagcctgagcgctattcccgtaacatacgttttcaaccatttagccgcccagcatgactcttggaccatcgtgggtgttgcagctttgatcttattcctcgtggcgctccttgcccgagtgttggttaaaaggaaacctccccgggacccactcttctatgtttacgcagttttcggattcacctctgttgtgaatcttatcataggcttagaacaggatgggatcatagacggatttatgacccattacctgcgggaaggagaaccctatctgaacactgcgtatggacacatgatctgctactgggacgggtccgcacattacctgatgtatctcgtcatggtcgctgcaatcgcctgggaagagacgtaccgcacgattggcctatactgggtcgggagtattatcatgtccgtggtggtctttgttccgggcaatattgttggaaagtatggcacacgcatctgccctgcgttctttctcagtataccttacacctgtctgcctgtttgggcaggcttccgcatctacaaccagccttccgagaattataactacccatcaaaggtcatccaagaggcacaggcaaaggaccttctaaggcgcccctttgacctgatgctcgttgtgtgtctgcttctggctaccggcttctgtctcttccggggactgatgctcgcgtatatgttttattctgttccttattttgtgacagcactctatggcctggtagtgcctgggtgcagctggatgcctgacattacactcatccatgcaggcggactggcccaggcacagttttcgcacatcggggccagtttacacgctcgcacagcttacgtgtatcgggttccagaggaagctaaaatcctcttcctggccctcaatattgcgtatggcgtgcttccacaacttctggcttatagatgcatttacaaacctgaattctttattaagactaaggcagaggagaaggtggagtag

SEQ ID NO: 209322 - DNA, 1122 bp, Artificial Sequence
  Description of Artificial Sequence: Synthetic coding sequence
atgagcgccagcgccgccaccggcgtgttcgtgctgagcctgagcgcaatccctgttacatacgtgtttaatcatctagctgcccaacacgattcttggacaatcgtcggtgtagcggcgctgattctgtttttggtcgcgttgttggctcgcgtgctcgtcaagagaaagcctccacgagacccactgttttacgtctacgcagtcttcggattcacaagtgtggtgaatctcatcattggcctagagcaggacgggataatcgatggatttatgacgcattacttacgcgaaggtgaaccatatctcaatacggcatatggacacatgatctgttattgggatggatcagcgcactacctcatgtatttggtaatggttgcagctatcgcctgggattgttaccgcgagacgtatcggactattggcttatattgggtgggttccattatcatgagcgttgtggtgttcgtacccggcaacatcattggtaaatacgggactcggatctgcccagctttcttcctgtcaattccttatacatgtctgcctgtgtgggccggtttccgcatttataatcagccatcagagaactataattacccgtcaaaagtgatccaggaggcccaggccaaggacctgctgcggcgtcccttcgatttgatgcttgttgtgtgtttactgctggctaccggcttttgtctgtttcgcggcctgattgccttagattgcccctctgaattatgccgtctgtacacacagttccaggagccatacttgaaagacccggccgcctatccaaagattcaaatgctagcatatatgttttacagcgtgccctacttcgtaacggccctgtacggattggtcgtgccaggatgctcttggatgcccgacattactctgattcatgccggcggcctcgcccaagcccagttttctcacatcggggcctccttgcatgcccgcaccgcctacgtgtatcgggtgcctgaggaggcaaagatccttttcctcgcgctgaatattgcatacggggtccttcctcaactgttggcatacagatgtatctacaagcctgaatttttcatcaagaccaaggccgaagaaaaggtagaatag

SEQ ID NO: 209323 - DNA, 567 bp, Artificial Sequence
  Description of Artificial Sequence: Synthetic coding sequence
atgagcgccagcgccgccaccggcgtgttcgtgctgagcctgagcgccatcccagtcacttacgtgtttaaccacctggcagctcagcatgactcctggacaattgtgggagtcgcagctcttatactcttccttgtggccctcctggcgcgggtcctcgttaaaaggaagccacctcgagatccgcttttttatgtgtacgccgttttcgggtttacatctgtcgtaaatctcattataggactcgaacaggacggtattatagatggattcatgacccattacctgcgcgagggagaaccatatctcaacacagcctacggacacatgatttgctattgggacggttccgcgcactatctgatgtaccttgtgatggtcgccgccattgcgtgggaagagacctatcggaccattggcctatactgggttggatcaatcattatgagcgtagtggtctttgtgccggggaacattgtggacgcagggatctatgtattattctgcagcttactctgtgattgcaccgtctggctgtctggttcctggatgtttttggatgcttag

SEQ ID NO: 209324 - DNA, 1020 bp, Artificial Sequence
  Description of Artificial Sequence: Synthetic coding sequence
atgagcgccagcgccgccaccggcgtgttcgtgctgagcctgagcgccatcccagtcacttacgtatttaaccaccttgcagctcaacacgacagttggacaatcgtcggcgtggctgccctgatcctgttcctcgtggctttactagccagagtgcttgtgaaacggaagcccccaagagatccactgttttacgtctatgcagtgtttggatttacctccgtggtgaacctaattatcggtctggagcaggacgggataatcgacgggttcatgacccattacctgcgggagggggagccatacttgaacacagcttatggacacatgatctgctactgggatggctcggctcattatctcatgtatctcgtcatggtagctgccatagcctgggaagaaacttaccgaaccataggactctattgggtcggtagcataattatgagtgtcgtggtgtttgtccccggaaacatagtcggaaagtatggcaccaggatctgtccagcttttttcctttccatcccgtacacctgccttccggtttgggcaggcttccgaatctataatcagccaagcgaaaactacaactatccgagcaaagttatccaagaagcccaagccaaagatttgttgaggcgacctttcgatctcatgctcgtggtctgtctacttctcgccaccggcttctgtctgttccgcgggttgatgctggcctacatgttttactccgtgccatactttgtgacagcactgtacggactggttgtcccgggttgctcttggatgccagatatcactctgattcatgctggagggcttgcgcaggcccagttcagccacattggggcctccttacatgccagaactgcctacgtgtatagggtgccagaggaggccaaaattctcttcctcgccctgaatatcgcctacggtgtgctcccccagctcctagcctaccggtgcatctataaacctgaattttttataaagactaaggccgaggaaaaagtagaatag

SEQ ID NO: 209325 - DNA, 1056 bp, Artificial Sequence
  Description of Artificial Sequence: Synthetic coding sequence
atggacatcccccccctggccggcaagatcgccgccctgagcctgagcgctctgcctgtgagctacgccttaaaccacgtttctgccctgtcccacccgctgtgggtggccctgatgtccgccctgatcctcggcctcctctttgtcgctgtgtattcactaagtcatggcgaggtaagctacgaccccctctatgcagtgttcgccgtttttgcattcaccagcgtggtcgaccttataatcgccctccaggaggactcttacgttgtgggctttatggagttttataccaaggagggcgaaccatacttacgaacagcacacggcgtgttcatctgttactgggacggtacagtccattacttgctgtatctggctatggccggcgccatctgtcggaggaagcgctacagaaatttcggcctctactggttgggtagcttcgccatgagcatccttgtatttctgacgggcaatatactggggaagtattcctcggagatccgtcctgcattctttcttactatcccgtatctcctagtgccgtgttgggccggaatgaaagtgttctctcagcctagggcattgacaaggtgcaccgccaatatggtgcaggaggaacagcgtaaaggcctcctccagcgacctgcagatttggctcttgtaatctacttgattcttgctggcttctttaccttgtttcgtggtctcgtggtactggactgtcccaccgacgcttgcttcgtgtacatataccaatacgaaccctatcttcgagacccggttgcgtaccccaaggtccagatgcttatgtatatgttctacgtcttgcccttttgcggccttgcagcgtacgcattgaccttcccgggctgcagctggcttcccgactgggcgctagtgttcgcgggcggcatcgggcaagctcaattttcgcatatgggcgccagcatgcatctccgcacgccttttacctaccggtgtctgcagtggcccgcctttttccatcagccaccgcccagcgatccactcgccctgcacaagaagcagcattag

SEQ ID NO: 209326 - DNA, 1134 bp, Artificial Sequence
  Description of Artificial Sequence: Synthetic coding sequence
atggacatcccccccctggccggcaagatcgccgccctgagcctgtccgcccttccggtgtcgtacgcgctgaaccatgtgagtgcgttatcacatcctctgtgggtggccctgatgtctgccctgatactgggacttctttttgtcgcagtttatagcctgtctcacggggaggtgagctacgatccgctctatgcagtattcgccgtgttcgccttcaccagcgtcgtggatctgattatcgctctgcaggaggactcttacgtcgtgggctttatggagttttacactaaagagggagagccctacctcagaactgcccatggcgtttttatatgctactgggacggtacagttcactatctgttatatctggcaatggcgggggcgatatgcaggcgcaagaggtaccggaactttggcctgtactggctcggatcattcgccatgtcaatcctggtcttccttacaggaaatattttgggcaagtacagtagcgagatcagacctgcattctttctgacaatcccttacctgctggtgccatgctgggcagggatgaaggtgttcagtcaacctcgcgcactgaccaggtgcaccgccaacatggtacaggaagagcagagaaaagggcttctccaacggcccgctgacctcgcactcgttatttatttaatcctcgccgggttttttactctgtttagaggcctcgttgtcctggattgcccaacagatgcctgcttcgtgtatatctaccagtacgagccatatcttagggatccggtggcctacccgaaagttcaaatgctgatgtacatgttttacgttctacctttctgcggactggcagcttacgcactgacctttcctggctgcagctggctacccgactgggccctggtatttgccgggggaataggccaagcccagttctctcacatgggagcctcaatgcaccttcgaacgccctttacataccgggtacccgaggacacatgggggtgcttcttcgtctgtaacctgctatacgcccttggcccacacctactggcctatcggtgtcttcagtggcccgccttttttcatcagcctccgccgagcgatcccctggcactgcataagaaacagcactag

SEQ ID NO: 209327 - DNA, 642 bp, Artificial Sequence
  Description of Artificial Sequence: Synthetic coding sequence
atggacatcccccccctggccggcaagatcgccgccctgagcctgtctgctcttcccgtgtcgtacgctctgaatcacgtgagcgccctgtcacaccccctctgggtggcactgatgtccgccttgattctcgggctgctgttcgtggcagtgtattctttgtcccacggagaagtcagctatgacccactgtacgcagtctttgccgtgtttgctttcacctccgtggtcgatctcattatagctctgcaggaggatagttacgtagtcggcttcatggagttctataccaaggaggtgctggggggccgcccgggctctccactgccacactgtccttccgaatcccctacatgcccccacagagagtctcatacatgcgcccagcgtactgagtctagctcggccactggtatggctctgtttaccaccagtagcacttggccctggcccgccccatcagctgagggcgccggcggcagagagcgcgtggctcccgatccaggtagggaagtcgctagttccgatggcgtccccggccagggcggagcaaggtctgtatgccgcagaaatcaggacgcatcactcggactgcagccgggcgttgcccgccggagatttcagggtactagccaggtctag

SEQ ID NO: 209328 - DNA, 1257 bp, Artificial Sequence
  Description of Artificial Sequence: Synthetic coding sequence
atggcccccacccagggcccccgggcccccctggagttcggcggcccactgggcgctgccgcacttctcctgcttttgcccgccacgatgttccatctgctgctggccgctagatccggcccagctaggctgcttgggcctcctgcttcactcccaggtctcgaagttctgtggtcccctcgcgctctgctgttgtggcttgcttggttgggtctgcaagcagcactgtacttgttacccgcccgcaaggtggctgagggacaggagctgaaagacaagagcaggctacgttaccctattaacgggtttcaagccctggtgctgaccgctctcctggtgggattagggatgagcgccggactgcctctcggcgccctcccggaaatgttgttgcccttagcgttcgttgccacacttacggccttcatcttttccctatttctttatatgaaagcccaagtcgcacctgtgagcgcactggccccagggggtaactctggcaacccaatctacgacttttttctgggccgcgagctgaatcccagaatctgttttttcgacttcaagtatttttgcgagctgcgccctgggctgatcggctgggtattaattaacctggccctattgatgaaagaagccgagctacgcggcagtccttcgctcgccatgtggcttgttaatgggttccaattactatacgtgggagacgctttgtggcatgaggaggccgtgttgaccaccatggacataacccacgacgggtttggcttcatgctggcgtttggtgacatggcttgggttcctttcacgtactcattgcaggcccaatttctgcttcaccaccctcagccactcggactacccatggctagcgtcatctgcctcataaacgcaaccggatactatatcttcaggggggccaattctcaaaagaacactttcagaaagaacccgtccgatcctagagtggcaggactggaaacaatttcaaccgcaacaggcaggaaactcttagtctccgggtggtggggaatggtcagacacccaaattaccttggggacttgataatggctcttgcttggagcctgccttgcggggtttcacacctgctcccttatttctatctgctctattttacggccttactggtccacagagaagcccgtgacgagcggcagtgcctccagaagtatggccttgcatggcaggagtactgtcgtagggttccatatagaatcatgccctacatatactag

SEQ ID NO: 209329 - DNA, 1176 bp, Artificial Sequence
  Description of Artificial Sequence: Synthetic coding sequence
atggcccccacccagggcccccgggcccccctggagttcggcggcccactgggtgctgccgcgctactactgttgttgcctgccactatgtttcacctgctactcgccgccagaagtggccctgccagactcctagggccacctgcatcactgcccggtctggaagttctttggagcccccgcgctttgctgctttggctcgcttggctaggccttcaggccgcgctgtatctgctgcctgcacgcaaagtggctgaaggccaagaactgaaggacaaaagtcgccttagataccccatcaatggctttcaggccctcgtcctaacagctctgttggtcggtctgggcatgtcagccggcctgcccctcggagcactccccgagatgctcctcccactagcatttgtagccaccttgactgctttcattttctccctgtttctgtacatgaaggcccaggtggcccccgtctccgcgctggctcccgggggcaacagtggcaaccctatatatgacttctttctgggaagggaactcaaccctcggatttgcttttttgatttcaaatatttctgtgagctccggcctgggttaatcggttgggtgcttattaacctcgcattgttgatgaaggaagccgagttacgtgggtcaccctccttagccatgtggttagtcaatggatttcagctgctttacgtaggagatgccctatggcatgaagaggccgtattaaccaccatggacattacccatgatggattcgggttcatgctggcattcggtgatatggcttgggttccattcacctatagtctgcaggctcaattcttactgcaccatcctcaaccattgggcttgcctatggcctcagttatctgcctcatcaatgggctggagacgataagtacagcgacgggaagaaaacttctggtctcaggatggtggggcatggttcgccatccgaattatctcggcgacttgattatggccctcgcgtggagccttccatgcggagtgtctcacctcttgccctacttttaccttctgtatttcacagccctgctcgtgcaccgggaagctcgcgatgagcgtcagtgcctgcagaaatatggcttagcttggcaggaatactgccgacgcgtgccataccggatcatgccctacatctattag

SEQ ID NO: 209330 - DNA, 909 bp, Artificial Sequence
  Description of Artificial Sequence: Synthetic coding sequence
atgagcgccggcctgcccctgggcgccctgcccgagatgctgctgccacttgcttttgtcgccaccctcactgctttcatatttagcctgtttctttacatgaaggcccaggttgctcctgtttctgcgctggccccaggaggcaattctggaaatcctatttatgattttttcctgggtcgcgagcttaatcctaggatttgtttttttgattttaaatacttttgtgaactgcgtcctgggctaattggatgggtactgattaacctagctttgctcatgaaggaagctgagctgcggggctctccatcactcgccatgtggttggtgaatggctttcaactgctgtacgttggagatgcactgtggcacgaagaggcagtactgactactatggatataacccacgatggatttggatttatgctggcgtttggggatatggcctgggtgcctttcacatatagtctccaggcacagttcctcctccatcatccgcagcccctgggactgcccatggcgtccgtcatttgccttatcaatgccacaggctactatatcttccggggagccaactcacagaagaacacctttcgaaagaatccgtctgatccccgggtagccggtcttgagaccatcagcaccgcaaccggacgaaaactcctcgtctcaggttggtggggcatggtgagacaccccaattaccttggtgacctgatcatggcacttgcctggagcctgccatgtggcgtttcccatctgctgccgtacttctacctgttgtattttacggcactgctcgttcaccgcgaagccagagacgagcgccagtgtctccagaaatacggcctggcttggcaggagtactgtaggagggttccttataggataatgccatatatttactag

SEQ ID NO: 209331 - DNA, 1713 bp, Artificial Sequence
  Description of Artificial Sequence: Synthetic coding sequence
atgggcttcctgcagctgctggtggtggccgtgctggccagcgagcaccgcgtggcgggagccgctgaggtgttcggtaatagctccgaaggcttgattgagttttcagtcggcaagttcaggtacttcgaactcaaccggccatttccggaggaggccatactgcatgacattagtagtaatgtgacttttctgatctttcagattcacagccagtaccagaataccacagtgtccttctctcctaccttgttgtcaaactctagcgagactggaactgcaagtgggctggtcttcattctcaggccagagcagtcaacatgtacctggtacctcggcaccagcggcatccagccagtgcagaatatggcaattttactcagttactctgagagagatcctgtgccaggtggatgtaacctcgagttcgatttagacatcgacccaaacatttatcttgagtataacttcttcgagaccactatcaagttcgcccctgctaacctcggttacgcacgtggagtggaccctccaccttgtgatgctggaactgaccaggacagcagatggcgcttgcaatacgacgtataccaatactttctgcccgaaaatgatcttacagaagaaatgctcctcaaacacctgcagaggatggtgtccgtccctcaggtcaaggcctctgctctcaaggtggtcactcttacagctaatgataaaacgtccgtgtctttttcctcactgcccgggcagggtgtgatatacaacgttatagtctgggatccgtttctgaacacaagcgctgcttatattcctgcccatacttatgcctgttctttcgaggcaggggaaggtagttgcgcctctctgggtagagtctcttccaaagtcttttttacactgtttgcactactgggcttttttatttgcttctttggccaccgcttttggaagacagagttgttttttataggcttcattattatgggcttctttttttacatccttatcacacggctcaccccgatcaagtatgatgtcaatctcatactaaccgccgttactggatctgtaggcgggatgtttttggtagcggtatggtggcgctttggaattttatctatctgtatgctctgtgtcggtctggtcctgggtttcctcatatcatccgtgacctttttcactccactgggaaacttgaaaattttccatgatgacggtgtgttctgggtcaccttttcctgcatcgctatcctgatccctgttgtattcatgggttgtctgagaattcttaatatactgacatgcggggtgattggtagctattccgtggttctcgcaatagactcctactggtcgacctcactatcgtacataactttgaatgtccttaaacgcgcgctgaacaaggacttccaccgagcattcactaacgtgccttttcagaccaacgactttatcatcctggcagtgtggggcatgttagcggtttcaggaatcacactgcaaatacggagagagagaggacgccccttcttccccccccatccatacaaactgtggaagcaggaaagagaacggagagttaccaacattctggacccgtcatatcacatcccaccactgcgtgagcggctttacgggcgactgactcaaataaagggcctgttccaaaaggagcagcctgccggagagcggacccccctgcttttgtag

SEQ ID NO: 209332 - DNA, 351 bp, Artificial Sequence
  Description of Artificial Sequence: Synthetic coding sequence
atgggcttcctgcagctgctggtggtggccgtgctggccagcgagcaccgggttgccggtgctgcagaggtgttcggcaattcctccgaggtgtacttggtcgtgggtctcatcgagttctctgtgggtaaattccgctattttgagctgaaccggcccttccctgaagaagctatcctgcatgatatatcctccaacgtgaccttcctaatcttccagattcattctcagtatcagaacacgacagtgtccttctctccaacacttctttctaactcttcggaaaccggcacagcgagcggcctggtctttatccttaggcctgaacaaagtacctgtacctggtattag

SEQ ID NO: 209333 - DNA, 1413 bp, Artificial Sequence
  Description of Artificial Sequence: Synthetic coding sequence
atgggcatctggaccagcggcaccgacatcttcctgagcctgtgggaaatatatgtcagcccgcggtcccccgggtggatggactttatacagcacttgggcgtgtgctgcctagttgcgcttattagcgtcggcctcctgtccgtggccgcctgttggtttcttcctagcatcattgctgccgcagcatcctggatcattacgtgtgtgctcttgtgctgctcaaaacatgcccggtgctttattttgctggtgttcctgtcatgtggactgcgcgagggccggaacgctctgatcgcagccgggactggcatagtgatactgggccacgtggagaacatatttcacaactttaaaggcctgcttgacgggatgacttgtaatctacgagccaagtcttttagcatccacttcccgttactaaagaagtatatcgaggccattcagtggatttatggcctcgccacccccctaagcgtgtttgacgacctcgtttcgtggaaccagaccctggccgtatcactgtttagtccttcccacgttttggaagcgcagcttaacgattccaagggggaggtgctttctgtgttgtatcagatggcaacaactaccgaagttctctctagcttgggacaaaagctgctcgctttcgctggtttgtccctcgtcctcctgggcaccgggcttttcatgaagaggtttctaggaccctgcgggtggaaatacgagaatatctatataacacgccagttcgtccagttcgatgaacgcgagcgccaccagcagcgcccttgtgttcttcctctgaacaaagaagagagacgaaagtatgtgattatcccgactttctggcctacccccaaagagagaaaaaatcttggcctttttttcctgccgattttgattcatttgtgcatatgggtactattcgcagcggttgattatctcctgtaccgcctgatttttagcgtttccaaacaattccaatccctgcctgggttcgaggtgcacctgaaactacacggggagaaacaggggacccaagatatcatccacgacagttctttcaacatctcagtttttgaaccaaactgtatcccgaaaccaaagtttttgctgagcgagacgtgggtgccattaagtgtcatattactcatcctggtgatgctaggccttctgtcctccattttgatgcagctgaaaatactcgtcagcgcctcattctacccctccgtcgaaaggaaaagaatccagtatcttcatgccaagttgcttaaaaaacgaagcaagcaaccactgggagaagttaagcgtagactctcactttatttaaccaagatccatttttggttgcctgtgcttaaaatgatcagaaaaaagcagatggatatggcatctgcagacaaatcatag

SEQ ID NO: 209334 - DNA, 567 bp, Artificial Sequence
  Description of Artificial Sequence: Synthetic coding sequence
atgagcaccatgttcgccgacaccctgctgatcgtgttcatcagcgtgtgcaccgctctgctggcagagggaatcacttgggtgttagtgtatagaacggacaaatataagcgactgaaggcggaagtggagaaacaatctaagaagctggagaagaaaaaggaaaccattacagagtctgccggccggcagcagaagaaaaagatcgaacgacaggaggaaaagctgaaaaataataaccgggatctgagcatggttcgaatgaaatccatgttcgctatcgggttttgcttcaccgctctgatggggatgtttaactcaatctttgatggcagggtggttgctaaacttccatttacgcctctgagctacattcagggactgtctcaccggaatctgctgggagacgatactaccgactgttctttcatcttcctgtacattttgtgcactatgtccatcaggcagaatatccagaagatcctgggcctggcgccttccagggcggccaccaagcaagctggtggattcttaggacctccacctcctagcggaaagtttagctag

SEQ ID NO: 209335 - DNA, 510 bp, Artificial Sequence
  Description of Artificial Sequence: Synthetic coding sequence
atgagcaccatgttcgccgacaccctgctgatcgtgttcatcagcgtctgcacggcattactggccgaggggataacttgggttttggtttatcggaccgacaagtacaaaagactgaaagccgaagtggaaaagcaatcaaagaagttggagaaaaagaaagaaaccattaccgagtcagcaggacgccaacagaaagtccgcatgaaatccatgttcgcaattggattctgttttaccgccctcatgggaatgtttaactcaatttttgacgggcgtgtcgtggcaaaactcccgtttacgcctctgtcttacatccagggcctttcacatcggaacctactgggagatgatacaacagactgcagcttcatattcctgtatattttatgcacgatgagtattcgccaaaatatccagaagattttgggcctcgcaccaagccgcgctgcgacgaagcaggccggaggctttctgggcccaccccctccctccggtaagttttcctag

SEQ ID NO: 209336 - DNA, 603 bp, Artificial Sequence
  Description of Artificial Sequence: Synthetic coding sequence
atgatgcactacgtggactacagcatgatgtaccacctgatccggggtcagagcgtgatcaagctgtacattatttacaatatgctcgaggtggctgaccggctgttctcgagcttcggacaggacattctggacgccttatattggactgccaccgaaccaaaggagaggaagcgtgcccatatcggttttgtagagattaagggatcggtgtttaaaaagttcgagaagaacaatcttttccagatgagcaactccgacattaaggagcggtttacaaactacgtgctcctgctgatagtgtgccttcggaatatggagcagttcagctggaatcccgaccacctatgggtgctgtttcctgacgtatgcatggtgattgcttccgagatcgcggtggatatcgtcaagcacgcatttataacaaagttcaacgatatcaccgccgatgtatactctgagtatagagcttcactggccttcgatctggtgagctctagacagaagaatgcttatacggattactccgacagtgtggcgagaaggatggggtttattccattgccccttgccgtcttagtagacatccccgaaagcacatag

SEQ ID NO: 209337 - DNA, 1371 bp, Artificial Sequence
  Description of Artificial Sequence: Synthetic coding sequence
atggtgttcggcatcttcctgtgcctggacgccttcctgtacgtgtttaccttgctaccgcttcgcgtgtttctggctctctttcgcctcctaaccctgccttgttatggcctgagggataggagactactgcagcctgctcaggtgtgtgacattttgaagggagtcatactcgtaatctgctacttcatgatgcattacgtggattacagcatgatgtatcacctaatcagggggcagtcagtgatcaagctctatataatctataacatgcttgaggtagccgatcggctattttcatcttttggacaggacatcctggatgccctgtattggaccgcgaccgaaccaaaggagcgcaaacgggcgcacattggagtaatcccgcatttcttcatggccgtgctgtatgtgtttttgcacgctatcttgatcatggtgcaggccacaacactgaacgtcgcctttaatagccacaacaaatctttactgaccattatgatgagtaacaatttcgttgagataaaggggtcggtcttcaagaagttcgagaaaaacaatctcttccagatgagcaattcggacataaaagagagattcacgaattatgtactactcctgatcgtgtgcctgcggaacatggagcagttctcttggaaccccgatcacctgtgggtgctgttccctgatgtttgcatggtgatagcaagtgaaattgccgttgacattgtcaaacacgcttttataactaagttcaacgatattacagctgacgtgtacagtgaatatcgcgccagtctcgcttttgatctggtatcttcccggcaaaaaaacgcctataccgattactctgacagcgtcgccagacgcatggggttcatccccctgcctctggccgtcttactaatccgggtcgtgacctcatcgataaaagtgcaggggatattgagttatgcctgcgtcatcttgttctattttggattgatatccctaaaagttctaaactcaattgtactgttgggtaagagttgtcagtacgtgaaagaagccaaaatggaggaaaaactgagcaaccctccagccacatgcactcccggtaagccctcatccaagtcccagaataagtgtaaaccatctcaggggttgtcaaccgaagaaaatctgagtgcgagcattaccaagcagccaatacaccagaaagagaatattatccccttactcgttacctcaaattcagatcagtttctcactaccccagatggagacgagaaggatataacacaagataactcagaactcaaacaccgatcatccaagaaggaccttctggaaatagaccgctttaccatatgtggtaaccggatcgactag

SEQ ID NO: 209338 - DNA, 1704 bp, Artificial Sequence
  Description of Artificial Sequence: Synthetic coding sequence
atggccggcgtgggcgacgccgccgcccccggcgagggcggcggcggtggggtggatggaccgcagagggacggacgaggggaggccgagcaaccgggcggatcaggcggtcaagggccaccacccgctcctcagctgactgagactttaggcttttacgagtcagacagacgccgtgagagacggcgcggacgcacagaactcagcttactcaggttcctaagcgccgagttgaccaggggctatttcctagaacataatgaagcaaagtacactgagcgtcgcgagagggtctatacttgtctccgtattccccgggagttagagaagttgatggtttttgggatttttctttgcttagatgccttcttgtacgttttcactttactgcccttacgtgtgttcctggcgcttttcagactgctgaccttgccttgctacggcctgcgggatagacgtctccttcagcctgcccaagtttgtgatatcctgaagggggtgattctggtgatctgttacttcatgatgcactacgtagactactcaatgatgtaccacctcattcgggggcagtctgtgatcaagctgtatatcatatacaatatgctggaagtggctgatcgcctgttcagctctttcggtcaggacatccttgatgcactttactggaccgccacagagccaaaggagcggaagcgagcccacattggagtgattcctcacttttttatggctgttctgtacgtgttcctgcacgccattctgatcatggtgcaagcaacaaccctaaacgtagcattcaactcacataacaaatcactactgaccataatgatgagcaacaacttcgtggaaattaaaggctcagtgttcaaaaaatttgaaaaaaataatctgtttcaaatgtctaattcagacataaaagagaggttcacgaactacgtcctgcttcttatagtatgtttgaggaatatggaacagttttcatggaacccggatcacctgtgggttctgttccctgatgtgtgtatggtgatcgcttccgaaatcgcagtggacatcgtaaaacacgcatttataactaaattcaacgatatcaccgctgatgtctactctgaatacagagcttctctggccttcgatctcgtgtcctctagacaaaaaaatgcttacacggactactcagactcggtcgccagaaggatgggcttcatcccactcccattagccgtgttactcatccgagtggtgaccagctccatcaaggtgcagggaattctctcctacgcttgcgtcattttattttatttcggactcatcagcctgaaagttttgaatagcatcgtgctccttggaaagtcatgtcaatacgtaaaagaggccaagatggaggagaaattgagcaaccctcccgccacatgcactccgggcaaaccttcttcaaagtcccagaataaatgcaagcctagtcaaggcctgagcactgaagagaacctgagtgcctccattaccaagcagccaatccatcaaaaagagaatatcattccgctgctcgttacatctaattctgaccagttcctgaccaccccagatggcgatgaaaaggatattactcaggataacagcgagttgaaacacaggagttccaaaaaggatctgctcgagattgatagattcactatttgcggtaacaggatagattag

SEQ ID NO: 209339 - DNA, 1689 bp, Artificial Sequence
  Description of Artificial Sequence: Synthetic coding sequence
atggccggcgtgggcgacgccgccgcccccggcgagggcggcggcggcggcgtggacgggccccagcgggacggccggggtgaggcagagcaaccagggggctccggcggccaggggccccccccagcgcctcagctgaccgagactctgggattctatgagagcgatcggcgccgagagcgtcggcgggggcgcacagaactgtctttacttcgctttctatccgctgaacttacccgtggttattttcttgagcataatgaggctaaatataccgaacggcgggagcgggtttacacttgtctgcgcatcccccgtgaactggaaaaactgatggtgttcggtatcttcttatgtttggacgcgttcctgtacgtctttactttgctgcctctgcgagtctttctagccctcttcagactattaaccttaccttgttacgggttaagagaccggagattacttcagccagcacaggtgtgtgacattttaaaaggagtgatcctagtgatttgctactttatgatgcactatgtcgactactctatgatgtaccacctcatccgcggtcagagcgtgatcaagctgtatattatctacaatatgttggaggtggctgatagattgttcagttcttttggccaggacatcctggatgctctctactggactgcaaccgagcctaaggaacggaaaagggcgcacatcggcgtcataccccatttttttatggcagtgttgtacgtgttcctgcacgctattttaattatggtgcaggcaaccaccttgaacgttgcctttaacagccacaataagagcctacttactatcatgatgtctaacaactttgtggagatcaagggaagcgtgtttaaaaagttcgaaaaaaataatctattccagatgtccaattctgacattaaagagcggtttacaaactatgtgctccttttgatagtgtgtcttcgcaatatggaacagttctcctggaatccagaccatctttgggttttgttccctgatgtctgtatggtgattgcctcagagatcgctgtcgatatcgtcaagcacgcttttatcactaagttcaatgacattacagcagatgtgtattcagagtacagagcttcattggcgtttgacctggtgtcaagcaggcagaaaaatgcgtatactgattatagcgactccgtcgcccggaggatgggatttatcccgttgccgctcgcagtcctgcttattagagttgtgaccagctcgatcaaggtgcaagggatcttgagttacgcctgtgtgatcttattttatttcggtctgatcagtcttaaagtgctcaattctatcgtcctgttagggaagtcatgccagtatgtaaaggaagccaagatggaagagaaattgagcaatcctcctgcgacatgcactcctggcaagccttcttcaaagtctcagaataagtgcaagccatctcagggcctgagtactgaagaaaacctctcagcgtctatcactaagcagcctatccatcagaaggagaatataatacctctcctggtgacatctaacagcgatcagttccttacaaccccagacggtgatgagaaggacatcactcaggacaactctgagctcaaacaccgaagttcaaaaagcgttctgctgtgtcagtctggtctgcccgagtgttag

SEQ ID NO: 209340 - DNA, 2283 bp, Artificial Sequence
  Description of Artificial Sequence: Synthetic coding sequence
atgagccccaagaaggtgcagatcaaggtggaggagaaggaggacgaaactgaggagtctagctctgaggaggaggaggaagttgaagacaaactacccaggcgcgaatcattgaggcctaaacgcaaacgcactagagatgtgatcaacgaggacgatcccgagccagagcccgaagacgaagaaaccagaaaggctcgagagaaggagcggcggcggcggttgaagcgaggtgccgaagaggaggaaatcgatgaggaagagctggagaggctgaaggcggagctggacgagaaacgccagatcatcgccacagttaaatgtaagccatggaagatggagaaaaagattgaggtactaaaggaagccaaaaagttcgtgagcgaaaacgaaggagcactgggcaagggaaaaggtaaaaggtggttcgcctttaaaatgatgatggcaaagaaatgggccaaattcctgagagatttcgagaattttaaggcagcctgtgttccttgggaaaataagataaaggctatcgaatcccagttcggaagttccgtcgcctcatacttcctttttctacgctggatgtatggggtcaacatggtgttgttcattttgaccttctctttaatcatgttgccagagtatctgtgggggctcccttacggttccctgcctcgcaaaaccgttcctcgggctgaggaggcgagtgctgccaatttcggcgtgctttacgactttaatggactggctcaatactccgtcctcttttacggatactacgataacaagagaactatcgggtggatgaacttcagactgcctctgagctattttctggtgggaatcatgtgcatagggtattcctttctggtcgtcctgaaggccatgacaaagaacataggggatgatggcgggggggatgacaacacgtttaatttctcttggaaagtatttaccagctgggactacctgatcgggaacccggaaacggccgacaacaagttcaattctatcactatgaacttcaaggaagccatcaccgaggagaaggcggctcaggtggaagaaaacgtccacttgatacgttttctgaggttcctggctaatttctttgtcttcctcactctcggcggaagtggctatctgatcttctgggcagtcaaaagatctcaggagtttgcccagcaggaccctgataccttagggtggtgggaaaagaatgagatgaatatggtcatgagcctgttgggaatgttctgccccaccctttttgatttatttgccgagttggaggactaccaccctttgattgcgctcaaatggctgctgggaagaatttttgcacttctcttgggcaacctgtatgtctttattctcgcactgatggacgagataaacaacaagattgaagaggaaaagctggttaaggctaacataacgctgtgggaggctaacatgatcaaagcatacaatgcttccttctcagagaactcaacaggtccaccatttttcgtccacccagccgatgttccccgcggcccctgctgggagacaatggttggacaggaattcgttaggctgacagtcagcgatgtgctgactacctacgtcacaatcctgattggcgatttcctgcgggcctgcttcgttagattctgcaactactgctggtgctgggatctggagtatggctacccctcatatactgaattcgacatttccgggaatgtgctggcactcattttcaaccaggggatgatctggatgggttcattctttgcaccgagtcttcctggaattaacatcctgcgcctccatacttccatgtattttcagtgctgggctgtaatgtgttgcaacgtgccggaggcccgcgtgttcaaagcttcacgcagcaacaatttttaccttggtatgctgctcttaatattatttctatcaacgatgcccgtattgtacatgatcgtctccctgccacccagcttcgattgtgggcctttttccggcaagaatagaatgttcgaagtcattggcgagaccctggaacatgactttccaagctggatggccaagattttacggcagctgtcgaaccccgggctcgtcattgctgtcatcctggtgatggtgctggcaatatactatctcaacgccaccgctaagggacagaaggcggccaacctagatctcaaaaagaaaatgaaaatgcaggcccttgagaacaagatgcgaaataaaaagatggccgcggcacgagctgccgctgccgctggcagacagtag

SEQ ID NO: 209341 - DNA, 2283 bp, Artificial Sequence
  Description of Artificial Sequence: Synthetic coding sequence
atgagccccaagaaggtgcagatcaaggtggaggagaaggaggacgaaacggaagaaagctcaagcgaggaggaggaggaggtggaggacaagcttccccgcagagagtcacttcgcccgaagaggaagaggactcgcgatgtaatcaacgaagatgaccctgaacccgaacctgaggacgaggaaacgcgcaaggcgcgagagaaggagcggaggcggagactaaagagaggcgcagaggaagaagaaatcgatgaagaggagcttgaacgacttaaagccgagctcgatgagaaaagacagataattgcaacagtgaaatgcaagccctggaaaatggagaagaagatcgaagttttgaaggaggccaaaaagtttgtatctgagaatgagggagcactgggcaagggaaagggtaagagatggtttgcgttcaagatgatgatggccaagaagtgggctaagttcctgagggatttcgagaatttcaaagccgcctgcgttccttgggagaacaagattaaagcaattgagagccagttcggttccagcgtcgcctcttatttcctgtttttgcggtggatgtacggagtgaacatggttctttttatactcaccttttccctgatcatgctgccagagtacttgtggggactcccctatgggtcactgcctcgaaaaacagtacctcgcgccgaagaggcgagtgccgccaatttcggagttttgtacgactttaatggactcgcccagtacagcgtccttttctacgggtattatgacaataaacggaccatcggatggatgaatttccggttgccgctgtcgtatttcttagtgggcatcatgtgcataggttatagttttctcgtggtgttgaaggcaatgaccaaaaacattggagacgatgggggcggcgatgataataccttcaatttttcctggaaggtctttaccagttgggattatctcattggcaatccggaaacagccgacaacaagtttaattccatcaccatgaatttcaaggaggccattactgaagaaaaagccgcacaagtggaagagaatgtgcaccttatacgctttttgcgctttctagctaatttcttcgtcttcctgactctaggaggttctggatacctcatcttttgggctgtcaagcgctcccaggaattcgcacagcaagaccccgataccctgggatggtgggagaagaatgagatgaatatggtgatgtcactcttgggtatgttttgccctactctgttcgacctcttcgccgaattagaggattaccatccactcattgcccttaagtggctgctcggaaggatcttcgcactgctgctgggcaatttgtacgtctttatcctcgccctcatggatgagatcaataacaagatcgaggaagagaagctcgtgaaggcaaatatcaccctctgggaggccaatatgattaaggcttataatgcctccttttccgagaattcaaccggtccccccttttttgtccatcccgccgatgtaccccgagggccttgttgggaaacaatggtgggtcaggaatttgtgaggctgaccgtaagcgatgtactgactacgtatgtcaccatattaattggcgacttcttgcgcgcatgttttgtgcgtttttgcaactactgttggtgttgggatcttgagtacggctacccttcatatactgagtttgacatcagcggcaacgtactggccctaatcttcaaccaggggatgatatggatgggaagtttctttgcgccttccctgccgggaatcaacatccttaggctgcatacatccatgtacttccaatgttgggccgtcatgtgttgtaatgtccccgaggctagagtcttcaaagccagcagatctaacaacttttacttaggtatgcttcttctgatcctgttcctgtccactatgccagtgctttatatgatcgtgagtttaccaccaagcttcgattgcggccctttttctgggaagaatcggatgttcgaagtgattggcgagaccctcgagcacgactttccctcttggatggcgaagatcctaagacagctatcaaatcccggattagtcatagcagtcatactggtcatggtgctggccatctactatctgaatgccactgccaaaggccagaaagcagcaaacctcgatctcaagaagaagatgaaaatgcaggccctagaaaataagatgcgtaacaaaaaaatggccgccgcccgtgcggctgctgcggccggaaggcagtag

SEQ ID NO: 209342 - DNA, 2223 bp, Artificial Sequence
  Description of Artificial Sequence: Synthetic coding sequence
gtggagtggagcggcgagtgcctgcggagctgccggcgggaggtgcagattaaggtagaggagaaagaggacgaaaccgaagaatcttctagcgaagaggaggaggaggttgaggataaattacctcggcgggaaagtctccgccctaagcggaagaggacgagggacgtcattaacgaagatgatccagagcccgagccagaagatgaggagacgaggaaggctcgggagaaggagaggaggcgccgcttgaagcgcggagcagaagcgaaaaagttcgtgagcgagaatgagggagcgctgggcaaaggcaaaggaaaacgatggttcgcgtttaagatgatgatggcaaaaaaatgggccaaattcctaagagacttcgaaaactttaaggcagcttgtgtaccgtgggaaaacaagattaaggccatcgagagtcaatttggaagttccgtcgcttcatatttcctgtttctcaggtggatgtacggcgtaaacatggtcctatttatactgacttttagtctgataatgctgcccgagtacttatgggggttaccatacggcagcctcccccgaaaaacggtgccgagagctgaggaagccagcgccgcaaacttcggcgtcctatatgattttaatggactggcccaatactcggttctgttctacgggtactatgataataagcgaacgattggttggatgaacttccggctgcctctgagctacttcttggttgggatcatgtgtattggttactcatttcttgtcgtgttgaaggctatgaccaagaacatcggggatgacggaggcggcgatgacaacacctttaacttctcttggaaggtgttcacaagttgggactatctgatcggtaatcccgagactgccgataataagtttaattcgataactatgaactttaaagaggcgatcaccgaggagaaggccgcacaggtagaagaaaacgtgcacttaattcgttttctcaggttcctggcgaatttctttgtctttcttactttaggaggcagcggctatcttatcttctgggcagtgaagaggagccaggaattcgctcagcaggatcctgatactctgggatggtgggagaagaacgagatgaatatggttatgtcactcctagggatgttctgtcccactcttttcgatctcttcgcggaactcgaggactaccatcccctgattgccctgaagtggctgctaggacggattttcgctctcctgctcggaaacctctatgttttcattctggccctcatggatgagattaacaataagattgaggaagagaaactggtgaaggctaacatcaccctctgggaggcaaacatgattaaggcgtacaatgcttccttctcggagaactcaacagggcccccgttttttgttcatccagccgatgtccctagaggaccttgctgggagacaatggtcgggcaagaatttgtccgccttactgtgtcagacgtgcttacaacctacgtgacaatcttgataggtgacttcctgcgcgcctgttttgtacgcttctgcaactactgctggtgctgggatctggaatacggctacccgtcttacacagagttcgacattagcggcaatgtgttggccctgatcttcaaccaaggcatgatctggatgggctcgttcttcgctccaagcttgcccggcataaatattttgcggttgcacacttctatgtattttcagtgctgggctgtgatgtgctgcaacgttcccgaggccagagtattcaaagcttccagaagcaacaacttttacctcggcatgctgctcttgatcttgtttctgtctacaatgcccgtgctgtacatgatcgtgtctctgcctcctagttttgactgtgggcctttttccgggaagaaccgcatgttcgaggtcatcggggaaacactcgaacatgactttccttcttggatggccaagattttgagacagctcagcaaccctgggttggtgattgctgttatcctggtgatggtgctcgcaatttattatctcaacgctaccgccaaaggccagaaagcggcgaatctggacctcaaaaaaaaaatgaaaatgttgcagctgctggtggcgagtaataagtatcccgagtcgcccgaaaaggtccacttcgccctactgtttaaatcaaatgccatatgcgagaggcctgagaataagcactgttag

SEQ ID NO: 209343 - DNA, 2283 bp, Artificial Sequence
  Description of Artificial Sequence: Synthetic coding sequence
atgagccccaagaaggtgcagatcaaggtggaggagaaggaggacgagaccgaggagtcttctagtgaagaggaggaggaagtggaggataaactgcccagacgagagtctctgagacccaagcgcaagcgaactagagacgtcattaacgaggacgatccagagcctgaacccgaagatgaggagactcgcaaagctagagaaaaggaacgcaggcgtagattgaagagaggagcagaagaagaggagatcgatgaggaggaactcgagaggctgaaggctgaattggatgagaagcgtcagatcatcgctactgtcaaatgtaaaccctggaaaatggagaaaaagattgaagttctgaaagaagctaaaaagttcgttagtgaaaatgagggggccttgggcaaaggcaagggaaagcgctggttcgcctttaagatgatgatggctaagaagtgggccaaatttctgcgggacttcgagaatttcaaggccgcctgtgttccctgggaaaacaagattaaagcaattgagagccaatttggttcatccgtggcgtcatattttctcttcctacgatggatgtacggcgttaatatggtgctgttcattctgacattcagcttgattatgctccccgaatacctatggggattaccatacggtagtctccccaggaagactgttcctcgggcagaagaagccagcgccgcaaattttggcgtgctctatgactttaacggcttagcacaatactccgtcttgttttatgggtactacgataataagcggaccataggttggatgaacttcagactgcccttaagttatttcctggtaggtattatgtgtataggttactcctttctggttgttctcaaagctatgacaaagaatattggtgatgacggcggcggagacgacaataccttcaatttttcttggaaggtgttcacatcatgggactatctcatcggaaaccctgagacagccgacaacaaattcaacagcattaccatgaattttaaagaagctatcacagaagagaaagcagcacaggtcgaggagaatgtccacctgatccggtttctgaggttcttagccaattttttcgttttcctgaccctgggaggctctggctatttaattttctgggccgtaaagagaagtcaggaattcgcacagcaggaccctgacactttaggctggtgggagaagaacgagatgaatatggtcatgagcttgctgggtatgttctgccctacgctcttcgaccttttcgcggaactggaggactatcacccattgatcgcactgaagtggctgctggggagaatcttcgcactcttactcggcaacctctatgtgttcattctggccctaatggatgagatcaacaacaagattgaggaggagaagttggtaaaggccaatatcaccctctgggaagctaatatgatcaaagcttacaacgcctctttcagcgagaactcaaccggccctcctttctttgtgcatccagccgacgtccccagaggcccttgttgggagacaatggtaggccaggaatttgttcgtctgacagtgagcgatgtgcttaccacctatgtcactattctgataggggacttcttgcgggcctgcttcgtgcgcttctgcaattactgctggtgctgggaccttgagtacggatacccatcctatacagagtttgatatctccggaaacgtgctggccctgatcttcaaccaaggcatgatctggatgggctccttcttcgccccaagtctacctggaattaatatcctgcggctccatacaagcatgtatttccagtgttgggctgtcatgtgctgcaatgtgccagaagcccgcgtcttcaaagcaagtagatcaaataacttttacttgggcatgcttctgttgattctctttttgtccactatgcccgtcctttacatgatcgtcagcctcccccccagctttgactgtggcccattctctggaaagaatcgcatgtttgaagtgattggcgagacactcgagcacgattttccatcctggatggcaaagattctgagacagctgtccaaccccggcctcgtgattgcagttatcttggtaatggtgctggccatttactatctgaacgccaccgcgaagggtcagaaggctgccaatttagatctcaagaaaaaaatgaagatgcaggccctcgagaacaaaatgaggaacaaaaagatggctgccgcccgcgcggctgctgcggccggccggcagtag

SEQ ID NO: 209344 - DNA, 2184 bp, Artificial Sequence
  Description of Artificial Sequence: Synthetic coding sequence
gtggagtggagcggcgagtgcctgcggagctgccggcgggaggtgcagatcaaagtggaggagaaggaggatgagacagaagaatctagctctgaagaggaagaagaggtcgaggataagctgcctcgacgggagtcactccgtccaaagcgaaagaggacccgcgacgtgattaatgaggatgatcccgaacctgagcctgaagatgaggagacgaggaaggcccgagagaaagaacggagacggaggcttaaaagaggcgcagaggcaaaaaaatttgtgtccgaaaacgagggcgcactcggtaagggcaaaggcaaaaggtggttcgccttcaaaatgatgatggccaaaaagtgggccaaatttctcagagactttgagaattttaaggccgcatgtgtgccatgggagaacaagatcaaggccatcgaaagccaatttggctcaagtgtcgcctcctactttctttttctacgttggatgtatggcgttaatatggttttgtttatcctcactttctccctgatcatgcttcctgagtacctgtggggattgccctacgggagtctgcccaggaagactgtgccccgcgcagaagaggctagcgccgctaactttggggtgctgtatgactttaatggccttgcccaatatagtgtactcttctatggctattacgataacaagcggaccattggctggatgaattttcgcttacccctcagttacttcctggtgggaattatgtgcattgggtatagtttcctggtggtgctgaaagccatgacaaagaatattggagacgatggaggcggcgacgacaatacatttaacttcagctggaaagtgttcacatcctgggactatctgataggaaatccggaaacagcagataataaattcaattctattacaatgaatttcaaggaggctatcactgaggagaaagctgctcaggtcgaagaaaacgtacatctcatacgattcttacggtttctggccaatttttttgtgttcctgaccctcggtggcagtggatacctgatattttgggcagtcaagcgctcccaggagttcgcacagcaggaccctgatactttggggtggtgggaaaagaacgagatgaacatggtcatgtccctcttgggcatgttttgtccgacactttttgatttattcgccgagctcgaggattaccatccattaatcgcgctcaagtggctactgggaaggatttttgctcttctccttggcaacctgtatgtatttattctcgccctgatggacgagatcaacaataagattgaagaggagaagttggttaaggctaatataacactctgggaggccaacatgataaaggcttacaatgcctcttttagtgagaactcgactggccccccattctttgtgcatccagccgatgttccaagaggcccttgctgggaaacgatggtcggacaggagttcgtccgtttaaccgttagcgacgttctcaccacctacgtgaccatcttgattggagactttctgcgagcctgcttcgtccggttttgcaattactgctggtgttgggacctggagtatggctatccttcttacaccgaatttgatatctccgggaatgtgcttgctctgatctttaaccaaggcatgatctggatgggttcattcttcgctccatcactgccaggcatcaatatattaagactgcacactagcatgtacttccagtgttgggccgtgatgtgttgcaacgtccccgaagctagagttttcaaggcttcaagatccaataacttctatcttggtatgctcctcctcatccttttcctgtccaccatgcctgtactgtatatgatagtctctctccccccttcatttgactgtgggccctttagcggcaagaatagaatgttcgaggtgatcggagagaccttagagcacgacttcccgtcgtggatggccaaaattctaaggcagctgtccaaccctggactggtgattgccgtaattctcgtgatggtgttggcgatatattacctcaatgctacggcaaagggccaaaaggctgccaatcttgatctgaagaagaaaatgaagatgcaggcattagagaataaaatgcgtaataaaaaaatggccgctgctcgggccgcagccgcagccggccgacagtag

SEQ ID NO: 209345 - DNA, 1665 bp, Artificial Sequence
  Description of Artificial Sequence: Synthetic coding sequence
gtggagtggagcggcgagtgcctgcggagctgccggcgggaggtgcagatcaaagtggaagaaaaggaggacgagacagaagagagctcatccgaggaggaagaggaagttgaagacaaactcccgagaagggaatctctaagaccaaagcggaaaagaacaagggatgttattaacgaggatgaccccgaacccgagccggaagatgaggagactaggaaagccagagagaaagagaggcgcaggagactgaaaaggggggccgaggcaaagaaattcgtgtctgagaacgaaggggccttgggaaaggggaagggtaagcgctggttcgccttcaaaatgatgatggctaagaagtgggcaaagtttctccgggacttcgaaaatttcaaggccgcctgtgtcccctgggaaaataaaatcaaagcaatcgaatcacagttcggtagttcagttgcatcttacttcctctttctcagatggatgtacggtgtgaacatggttctgttcatcttgaccttctcgttgattatgctgccagagtatctgtggggactcccgtacgggtccctgcccagaaagaccgtcccccgtgcagaagaagcttcagccgccaactttggagtcctgtacgactttaatggcctggctcaatacagcgtgctcttctacgggtactacgacaataagcgcacaattggctggatgaacttcaggcttccgctatcttactttctcgtgggtatcatgtgtattgggtatagcttcctggtcgtgctcaaggccatgaccaaaaacataggcgacgatgggggcggcgacgacaataccttcaacttctcatggaaggtttttactagctgggattatctgatcggcaatccggagactgcggacaataagttcaactctattacaatgaacttcaaagaagccattaccgaggaaaaggctgcccaggtggaagagaacgttcatctaattcgcttccttcggtttttggcgaacttttttgttttcctaacattgggaggcagtggctacctgattttttgggccgtaaagcgaagccaggaattcgcacagcaggacccagacactctgggatggtgggaaaaaaatgaaatgaatatggtgatgagcctcctcggcatgttttgccccactttgttcgacctgtttgctgaattggaagattatcatcccctgattgccctgaaatggctcctaggcaggattttcgcattgctgctcggcaacctctacgtgtttattctcgccctgatggacgaaattaataacaaaattgaggaggaaaaactggtgaaggcaaacataactttgtgggaagctaatatgatcaaagcctataacgccagctttagtgagaacagcacggggcccccgttctttgtgcacccagccgacgtccctcgaggtccgtgttgggagacaatggtagggcaggagttcgttcggctaactgtatctgacgtgctgaccacctacgtgactatcctaatcggggactttttaagggcttgcttcgtgcgtttttgtaattactgttggtgttgggaccttgagtacggctacccctcctatacggagttcgacatcagtggcaatgtgctcgctctgattttcaaccagggaatgatttag

SEQ ID NO: 209346 - DNA, 2265 bp, Artificial Sequence
  Description of Artificial Sequence: Synthetic coding sequence
cagatcaaggtggaggagaaggaggacgagaccgaggagagcagctctgaggaggaggaggaggtcgaggacaagttgccacgcagggagtcgctcaggcccaagagaaagaggactcgggacgtaatcaacgaagatgaccccgagcccgagcccgaggacgaggaaaccaggaaagcacgcgaaaaggagcggaggcgacggctgaagcgaggtgcggaggaggaggagattgatgaggaagagctggaaaggctcaaagcggaactggacgaaaagagacagatcattgcaaccgtgaaatgcaaaccttggaagatggaaaaaaaaatcgaggtcttaaaggaggccaagaagtttgtgtcagaaaacgagggtgctctgggtaagggcaaggggaagagatggtttgccttcaagatgatgatggctaagaagtgggccaagttcctgagggatttcgagaactttaaggccgcttgtgtgccatgggagaataagataaaggccatcgaaagccagtttggcagctccgtcgcaagctacttcttgttcctaaggtggatgtacggtgttaatatggttctctttatcttaacctttagcctgatcatgctccctgaatacctctgggggctgccatatgggtccttgccacggaagacagtgccgcgggccgaggaggcttctgctgcgaatttcggcgtactttatgacttcaacggactcgcccagtactctgtgctcttttatggatattatgacaacaagcgcaccatcgggtggatgaactttagactccctctgtcatatttcctggtcggaatcatgtgcataggatactccttcttggtagtactcaaggccatgacaaaaaatattggcgatgatgggggcggagatgacaacacattcaacttttcctggaaggtattcaccagttgggattatctgataggcaatccagagaccgcagacaataagtttaattccatcacaatgaactttaaggaggctatcaccgaagagaaagccgcacaagtcgaagaaaacgtacatctgatcagattcctgcgatttctggcaaacttttttgtgttcctaacactggggggtagcgggtacctgatcttctgggcagtcaagagatcccaagagttcgcgcagcaagaccccgacacccttggttggtgggagaagaatgaaatgaacatggtgatgtccctgctgggtatgttctgtcctacacttttcgacctgtttgcagaactcgaggactatcaccctctcattgcattgaagtggctgctgggacggatcttcgcactgctgttgggtaatctgtacgtgtttatcctggccctgatggacgagataaacaacaaaatagaggaagagaagctcgtaaaagccaatattacgctctgggaggcaaacatgattaaagcttacaatgctagcttctctgagaactctacaggacccccattcttcgtccacccagctgatgttccacgggggccatgttgggaaaccatggtggggcaggaattcgtgcggctgaccgtgagcgatgtcctgacgacctacgtgacaattcttattggcgacttcctcagggcatgctttgtgcgcttttgcaactattgctggtgctgggaccttgagtatgggtacccttcttacactgaattcgacattagtggaaatgttctggccctcatcttcaaccagggtatgatctggatgggctcgtttttcgccccctcgcttcctgggatcaatattctgagacttcatacttccatgtatttccaatgttgggccgtcatgtgctgcaatgtccctgaagctcgagtttttaaggcctcgcgcagcaacaatttctatctcggtatgcttctgctgatcctgttcctgtcgactatgccagtcctgtatatgatcgtctccctgccacctagcttcgactgcggaccttttagcggcaaaaatagaatgttcgaagtcataggcgaaactctggagcatgatttcccctcatggatggcaaagatcctgcgacagttgagtaatcctggcctcgttatcgccgtgatcctggtaatggtgctcgcgatttactatctgaatgcgactgccaagggacagaaagcagccaacttagatctgaagaagaaaatgaaaatgcaagccttagaaaacaagatgaggaacaaaaagatggctgctgcccgggcagacggcgcagccggccgcgcttag

SEQ ID NO: 209347 - DNA, 2721 bp, Artificial Sequence
  Description of Artificial Sequence: Synthetic coding sequence
atgagccaccaggtgaagggcctgaaggaggaggcccggggcggcgttaaaggtcgggtgaaatctggttcaccccacacaggcgatagattaggcagacgctccagctccaaacgggcactgaaagctgaggggacgccaggcaggaggggcgcacaacgaagccaaaaagagcgcgctggcggctcgccctcacctggcagccctaggcgcaagcagactggtcgccggcggcatcgggaggagttaggtgagcaggagcggggagaggccgagcgcacttgtgaaggcagacgcaagcgggatgagagggctagcttccaagagcggactgccgcaccgaaacgggaaaaggagattccgcggcgggaagagaaaagcaaaagacagaagaaaccacggagctcaagccttgcgagcagcgcgagtggtggggaatcgctatccgaagaagagcttgcccagatactggagcaggtagaggagaaaaagaagctcatcgccaccatgagatctaaaccctggcccatggccaagaagttgacagagctccgcgaggctcaggagtttgtggaaaagtacgagggggccctgggaaagggcaaaggaaagcagttatacgcatataaaatgctgatggccaaaaaatgggtgaagttcaaaagggacttcgacaactttaagacgcagtgcatcccctgggaaatgaaaatcaaagacattgagtcacacttcggctcgagcgtggccagttattttatttttctgcggtggatgtatggtgtgaacctggtcctgttcggcctcatcttcgggcttgttattattcctgaggttctgatgggaatgccatatggctctatcccgaggaagactgtcccaagggcagaagaggagaaggcaatggactttagcgttctgtgggactttgagggctatatcaagtattccgccttattctacggatattacaataaccaaagaacaattgggtggttgagatacaggttgccaatggcatacttcatggtaggggtgtctgtgttcgggtactctctgataatagtgatccggtcaatggcctctaacacgcaaggcagtactggcgaaggcgagtccgataattttaccttcagttttaagatgttcactagttgggattacttaataggcaatagcgagaccgcggacaacaaatatgcgtcaatcacgaccagttttaaggaaagcattgtggacgagcaggagtctaacaaggaagagaatatccacttgacccgcttccttagggtcctggccaacttcctgatcatatgctgtctctgcggcagcggctatctcatttacttcgtcgtcaaacgttcccagcagtttagtaaaatgcagaatgttagttggtatgagaggaacgaggtggaaatcgtgatgagccttctcggtatgttttgtccccccctgttcgagacaatagctgccctagagaactaccaccctcggaccggcctcaagtggcagctaggtagaatattcgccttgtttctgggaaacttgtatactttcttgctggcgttaatggacgacgtgcacttaaagctggcaaacgaagaaaccataaagaatatcactcattggacactttttaactactacaacagtagcggttggaatgagtcagtcccccggccaccacttcaccctgctgatgtgccccgagggtcgtgttgggagacggctgttgggatcgaattcatgcgtttgactgtcagtgatatgctggtgacttatattactattctgcttggggatttcctgagggcatgcttcgtgcgcttcatgaactattgttggtgttgggatctagaggccggtttcccttcctacgccgagtttgatatttctggaaatgttctcgggctcattttcaaccaaggcatgatatggatgggatccttctacgcccccggcctggtcggaataaatgtccttagactcttaacttcgatgtatttccaatgctgggctgtgatgagctctaatgtgccccacgagcgggtgtttaaagcgtctagatccaataatttctacatgggactcctgttgctggttctttttttatccctgctgccagtggcctacacgatcatgtccctgccaccgtcctttgattgtggcccattctcaggcaaaaaccgaatgtatgatgttctccaggagaccattgaaaacgacttccctacctttctcgggaaaatattcgccttcctggcaaaccccggccttatcattcccgccatcttgttaatgtttcttgccatctattacctcaattccgtatcaaaaagcctctccagggccaatgcccaacttagaaagaaaatccaggtgctgcgggaagtggaaaaaagtcacaagtccgttaaaggaaaggccacagctcgagatagtgaagatactccgaagagctcctccaagaatgctacacagctccagctaaccaaggaagagaccaccccaccttcagcttcccagtcacaggccatggataaaaaagcacagggccctggaacaagcaactctgcctcccgaacgaccctcccagcatcaggccacctgcccatttcacggcccccaggcatcgggcccgactccggtcacgcgccaagccaaacacacccgtggaggagtgcaagcgggaagagtgctcagaggccgccacattag

SEQ ID NO: 209348 - DNA, 1365 bp, Artificial Sequence
  Description of Artificial Sequence: Synthetic coding sequence
atggcccagcccctggccttcatcctggacgtgcccgagacccccggcgaccaggggcagggccctagcccctacgacgaaagtgaggttcacgattctttccagcaattaatacaggagcagtcccagtgcaccgcacaggaagggctggagctgcagcaaagagaaagggaggttaccggatctagccagcaaacactgtggaggccagagggaacgcagagcacagccaccctgagaattctcgctagcatgccgtcccggacaattgggaggtctcgcggcgccattatttcccaatactataacagaacagtccagcttaggtgtcggtctagccggcctttgttggggaatttcgttaggagtgcatggcctagcctgcgactatacgatctggagctagatccgactgcgctcgaggaagaagagaagcagagcctgctggtgaaggaactgcaatcccttgcagttgcccagcgcgatcacatgttgcggggaatgccactgtccctggccgagaaacggtccctccgagagaagtcaagaaccccccgcggcaagtggcggggccagcccggttccggcggcgtgtgctcttgctgcggaagactgcggtatgcgtgcgtgctggcgttgcactcactgggactggctctgttaagtgctcttcaagcattgatgccctggcggtatgcgttaaagaggatcgggggtcaatttggatcttcagtgctctcctacttcctgttcttaaagacgcttctcgcctttaatgctctcctccttttgctactcgttgccttcataatgggaccacaggtggcattcccacctgcactccccgggcccgctcccgtttgcactggactagaattactgaccggcgctggctgctttacccacacagtaatgtattacggccattacagcaacgctaccctcaatcaaccctgcggctctccacttgatggcagccagtgtacaccccgggtgggagggctgccttacaacatgcccctggcttacctgagcaccgtgggcgtgagcttcttcatcacatgcataacactcgtttattcaatggctcatagcttcggtgagtcgtaccgcgtgggttctacgtctggcattcatgcaattacagtgttctgttcatgggattacaaagttacccagaaaagggcatcacggcttcagcaggataacataaggacacggttgaagggcgaagacaaaatcttcctgatcaataagctgcatagtatatatgaacggaaggagcgggaggagcgtagtagggttgggaccaccgaagaagctgcagcacccccggcacttcttactgatgagcaggatgcctag

SEQ ID NO: 209349 - DNA, 2418 bp, Artificial Sequence
  Description of Artificial Sequence: Synthetic coding sequence
atggcccagcccctggccttcatcctggacgtgcccgagacccccggcgatcagggacagggtcctagtccatacgatgagtccgaagtccatgacagctttcagcagcttattcaagagcagagtcagtgtaccgctcaggagggacttgaactgcagcaacgggaacgagaagtgactggttccagccagcagactttatggcgccctgaggggacccagtccacagccacgcttcgcatcctggcaagtatgccctcccgcacgatcggtagaagccggggagctataatctcccagtattataacagaacggttcagttaagatgtcgctcctcaagacctctgcttggaaatttcgttcggagtgcgtggccctctctgagactctatgacttggaattggaccccaccgccctagaagaggaagagaagcagtcactcctggtgaaagaactgcagagcctcgcagtggcacagcgcgatcacatgctcagaggaatgcccttaagtctggccgaaaagcggagcttacgcgagaaaagcagaaccccccgagggaagtggcgcggtcagcctggtagcggaggagtgtgctcttgctgcggacgcctgaggtatgcatgtgtgctggcactgcattccctgggcctggcccttttaagtgctcttcaggcgctgatgccttggcgttacgccttgaagagaattggcggacagttcggatcatcggtgctctcgtacttcctgttccttaagactctgctggcctttaatgcgctgctcctcctgctgcttgtcgcattcataatgggcccccaggtagcattcccccccgccctgccaggacctgctcctgtgtgcactggactggagctgctaaccggggccggttgcttcacacacacagttatgtactacggtcattattctaatgcaacactgaatcagccctgtggctcgcctctggacggaagccagtgcacacccagggtaggtggcttgccctataatatgcccctcgcttacctctccactgtcggagtgagcttcttcatcacttgtataactctggtctattccatggcccactcatttggggagagttatagagttggatccacttctgggatacacgctattaccgtgttctgctcctgggattacaaggttacccagaaacgggccagccggctgcagcaggataacatccgcacgagactcaaagagctgctcgccgagtggcagctgcgtcacagccctaggtcagtttgcgggcgacttagacaggcagcagttctcggcctcgtctggctgctgtgcctagggacagccctcggctgtgccgtggccgttcacgtgttttcagagtttatgatccaatctcctgaggccgccggccaagaggctgttctacttgtgctaccacttgtcgtaggtctcctgaacctgggggccccctatctgtgtcgggtcctggctgcccttgaaccccacgattcccccgtgctcgaggtttatgtggccatctgtcgcaatttaatcctcaaactggcaattctgggtaccctgtgttatcactggctgggtagaagagtgggcgtgctgcagggacaatgttgggaagacttcgtgggccaggagttatataggtttttggtgatggatttcgtgctgatgctgctcgatactttgtttggtgaactcgtttggcgcatcataagtgagaagaagctcaagagacgtcggaaacctgagttcgacatagctcgtaacgtccttgaactgatttatggccagacattaacatggctgggggtactgttctccccattgctgccggcagtccagattataaagctgcttttggtcttttacgtcaagaagacctctctactcgccaattgtcaggctccacgccgcccttggcttgccagtcacatgagcacagttttccttacgctcctgtgttttccagcattcttgggtgcagccgtcttcctgtgctacgccgtgtggcaggttaaaccatcttcaacatgtggaccattccgaactctcgatactatgtatgaagccggtcgggtgtgggtgagacatctggaagcagccggaccacgggtgtcatggctgccctgggtacatcgataccttatggaaaatacattttttgtgttcctcgtctctgccttgctactggcagtcatttatttgaatatccaggtggtccgcggacagcgcaaggtgatttgcttgttaaaagaacagatcagtaacgagggagaggacaagatattcttaatcaataagcttcacagtatttacgagagaaaggagcgcgaagaacggagccgagtgggtaccactgaggaagctgccgcaccacccgccctgctcactgacgagcaggatgcatag

SEQ ID NO: 209350 - DNA, 1155 bp, Artificial Sequence
  Description of Artificial Sequence: Synthetic coding sequence
atggcccacagcttcggcgagagctaccgggtgggcagcaccagcggcatccacgcaattacagttttctgctcttgggactacaaagtcactcagaaaagagcctcaagactacagcaggacaatatccgcactcggctcaaggaacttctggccgagtggcaactgaggcacagtccgcgcagcgtatgtggcaggttgcgccaggctgccgtgctggggctggtgtggctcctctgcctcggaactgccctgggatgcgccgtcgcagtccatgtgttcagcgaatttatgattcaaagtcctgaggctgcgggacaggaggcagttttactggtccttcctttagttgtaggactgctaaacctgggggccccttacctgtgccgcgtcctggctgcacttgagccacatgacagcccagtgctggaagtgtacgtggccatctgtcggatcatcagcgagaaaaaactgaagcgccgacgcaagcccgagttcgacattgcaagaaatgtgctcgaactgatttacggccagacattgacatggttaggtgtgctcttctctcccctgttacccgccgtgcagattattaaactgcttcttgtgttctacgtgaagaaaacgtctttgctggccaattgccaggcccccaggaggccatggttggcttcccatatgagtacagtgttcctgactttgctctgtttccctgcattccttggcgccgccgtattcctgtgttacgccgtatggcaggtgaaaccttcatctacgtgcggcccctttcggacactagacacaatgtatgaagctgggagagtttgggtgcggcacctggaagcagctggaccgcgtgtcagttggcttccgtgggtgcaccgctacctaatggagaacacattctttgtttttctcgttagcgcattgttgctggctgtaatctacctgaacattcaagtggtgcgcggccagcggaaggttatttgtttattaaaagagcagatctcaaatgaaggggaggataagatcttcttgatcaataagcttcatagtatctacgagagaaaggagcgcgaggaacggagtcgtgtgggtacgaccgaagaggccgctgccccaccggctctgctgactgatgagcaggatgcatag

SEQ ID NO: 209351 - DNA, 417 bp, Artificial Sequence
  Description of Artificial Sequence: Synthetic coding sequence
cagtgctgggaggacttcgtgggccaggagctgtaccggttcctggtgatggattttgtgcttatgttgcttgacaccctgttcggggagctcgaaaataggttccaatctgatgtcttttccagccgaatatgggcatggtggcggaagccagagttcgatatcgctagaaatgtacttgagttaatttatgggcagactctgacatggctcggcgtactgttcagcccactcctgccagctgtgcagattatcaagctgctgctcgtgttctacgttaaaaagaccagtttacttgctaactgtcaggccccacgccgtccctggctggccagtcacatgagcaccgttttcctgacacttttgtgctttcctgccttccttggggcagctgtgtttctgtgctacgccgtttag

SEQ ID NO: 209352 - DNA, 2418 bp, Artificial Sequence
  Description of Artificial Sequence: Synthetic coding sequence
atggcccagcccctggccttcatcctggacgtgcccgagacccccggagaccagggtcagggaccctccccatacgacgaaagcgaagtacacgacagtttccagcagctaatacaggaacagtcccagtgtactgctcaggaaggtttagaactgcagcaacgcgagagagaggtgacaggtagtagtcagcagaccctgtggcgcccagagggcacgcaaagcacagctactttacggattctagcctccatgccctcacgcacaatcgggaggtctagaggggccattatcagccagtactataataggactgtccagctgcgctgtaggtctagtcggccactgctgggcaactttgtgaggagtgcatggcccagcttgagattatacgatctagagttagacccaacagcacttgaagaggaagagaagcagagtctgctcgtcaaggagctccagagtttggcggtagctcagcgagaccacatgttgcgcgggatgccgttgagtctggccgagaagcgttcactgagagagaaatcccggacgcctcgcggcaagtggcgcgggcagccgggatccgggggcgtgtgttcgtgctgtgggagactcagatatgcctgtgtcttggcattgcacagcctcggcctcgctctgctgtctgcacttcaagctctcatgccctggagatatgccctgaaaaggataggaggtcagttcggtagtagcgtgttgtcatatttcctgtttctcaagacgctgctagcttttaacgccctgcttctgctactactcgtcgcctttatcatggggcctcaggtggctttcccaccggcccttcccgggccggctcccgtgtgtacagggctcgagctacttacaggtgccggctgcttcacccacaccgtcatgtactatgggcactactcgaacgctaccctcaaccagccttgcgggtccccactggacgggtctcagtgtaccccacgcgttgggggactgccctacaacatgccactcgcctatttgtcaacagttggcgtgtctttcttcatcacctgcatcaccctggtatactccatggcccatagctttggtgaatcttaccgtgtgggcagtacttctgggatccatgccatcactgtattttgctcatgggattacaaggtgacacagaagcgggcctctagactgcagcaggacaatattagaactcgcctaaaagaattgctcgctgaatggcaactgagacactcaccccgatccgtgtgcggtagattgagacaggctgccgttctcggcctcgtctggctgctttgtttaggcacagcgctcggatgcgctgttgcggttcacgttttctctgaatttatgatacagagtcctgaggcggcgggccaagaggcagtcctgctcgttctgcctctggtcgtgggcctgctgaacctgggggccccatacttgtgtcgtgtccttgctgccctggaaccacatgactccccagttctagaggtgtacgtggctatatgccgcaacttgattctcaagctggctatcctgggcaccttgtgttatcattggctgggccggagagttggcgtactacaggggcagtgctgggaggatttcgtcggtcaggagctatatcgcttcctggttatggactttgtgctgatgcttctggataccctcttcggtgagcttgtctggcggattattagcgaaaagaaactgaagcgaagaagaaaacctgagtttgatatcgccagaaacgttctggagctcatttatgggcagacactgacttggttgggggtgttgtttagccctctgctgcctgccgtgcaaatcatcaagctccttctcgtgttctatgtcaaaaaaacctcccttctagcaaattgccaggcgccacgacgcccttggttggctagccatatgagcacagtgtttctgaccttgctgtgttttcccgcatttctcggcgccgcggtgttcctctgctatgccgtgtggcaggtgaaaccttcatccacgtgtggccccttcaggactctcgatacaatgtatgaagcaggccgggtttgggtgaggcacctggaggcagcgggaccacgggtgtcttggctgccttgggtgcaccgctacttgatggagaatacattttttgtcttcctcgtctcagcgcttttactagccgtgatctacctgaatatccaggtggtgcgggggcagcggaaggtcatttgtctccttaaggagcagatttcaaatgagggggaggacaaaatctttctgattaataagctccactctatatatgaacgcaaggagcgggaggagcgcagccgagtgggcacaacagaggaggcagccgccccacctgccttgctcactgatgaacaggacgcctag

SEQ ID NO: 209353 - DNA, 1098 bp, Artificial Sequence
  Description of Artificial Sequence: Synthetic coding sequence
atgaacatcatggacttcaacgtgaagaagctggccgccgacgccggaacttttcttagtcgggcagttcagttcaccgaagaaaagcttggtcaggccgaaaaaaccgagctggacgcgcacctggagaacctgttgagcaaggcagaatgcactaaaatttggacggaaaagattatgaagcaaactgaggtgctgctacagcccaatccaaacgctcgcatcgaggaatttgtatatgagaagttggacaggaaagcaccaagtaggatcaacaatcctgagctgctaggccagtacatgattgacgccggcacagaatttgggcccggcactgcctatgggaacgctttgatcaagtgtggagagacacagaagcggatcggaaccgccgatcgagagctgattcaaacctccgcattaaatttcctcactcctcttcgcaattttatcgagggtgattataagacaattgctaaggagcgcaaacttttacagaacaagcgcctggatctggacgcagctaagacccggctaaaaaaggcgaaggcagcagaaactaggaatagttctgagcaggagctgcggatcacccaatccgaattcgaccgccaggccgagatcactcgcctcctgctcgagggcataagttccacacacgcgcaccacctgcgctgcttgaacgactttgtcgaagcccaaatgacttactatgcccaatgctatcaatacatgctggatttacagaagcagcttggatctttcccctctaactacctgagtaacaataatcaaacaagcgtaactccagtgccctccgtcctgcccaacgccatcggatcctctgcaatggcgagcaccagcggcctggtcattacatctcctagtaacctctccgacctgaaggaatgtagtggctccaggaaagcccgtgtgctctacgactacgacgccgccaactcgaccgaactgagcttgctggccgacgaagtaatcacggttttttctgtcgtggggatggactcagattggctgatgggcgagcggggtaaccaaaaaggtaaagtccctattacttacctggaattattgaattag

SEQ ID NO: 209354 - DNA, 636 bp, Artificial Sequence
  Description of Artificial Sequence: Synthetic coding sequence
atggccggcgtgggcgccggccccctgcgggccatgggccggcaggctttgcttctgctcgcactctgcgccaccggagcccagggactctatttccacattggggagaccgaaaagagatgttttattgaggagattccagacgagacaatggtcattggaaactaccggacccaggggatgcatgtggaggtgaaggatcccgatggcaaagtcgtgctgagcaggcagtatggcagcgaagggaggtttacgttcacgtcgcacactccaggagaccatcagatttgcctgcattccaactctaccagaatggctctgttcgcgggaggtaaactgagagtccatttggacattcaggtaggagagcatgcaaacaactaccctgaaatcgcagccaaggataagcttacggaattacaacttagagcacgacagcttctggaccaggttgagcaaatccagaaggagcaggattatcaaaggtatagagaagaaagattcaggctcacatctgagagcactaaccagcgcgtgttgtggtggagtattgcacaaaccgttattctaatcctgaccggcatctggcaaatgaggcaccttaaaagttttttcgaggctaagaaactggtctag

SEQ ID NO: 209355 - DNA, 684 bp, Artificial Sequence
  Description of Artificial Sequence: Synthetic coding sequence
atggccggcgtgggcgccggccccctgcgggccatgggccggcaggctctcctgcttttggctctctgcgccacaggggctcagggcttgtattttcacatcggggagacagaaaagcggtgttttatagaagaaattcccgacgaaacaatggtgattggaaactatagaacccagatgtgggataaacagaaagaagtgtttctgccttcgacgcctggattgggcatgcatgtggaagtgaaagacccagacggtaaggtggtgctgagccgccaatatggatccgagggccggtttacttttacttcacacacaccaggggaccaccagatttgcctacacagcaactctacccgcatggcgctcttcgctggaggcaagttgcgcgttcacctcgatattcaggttggcgagcatgcgaacaactaccccgaaattgcggcgaaagacaagttaaccgaactccagctccgcgccagacaactgcttgaccaggtagagcagattcagaaggagcaggactatcagcggtaccgggaggaacgctttcgcctgacttccgagtcaaccaatcaacgggtgctgtggtggtcaatcgcccaaaccgtaatactgatattgacgggaatctggcagatgaggcacctgaagtcattcttcgaagccaagaagcttgtttag

SEQ ID NO: 209356 - DNA, 660 bp, Artificial Sequence
  Description of Artificial Sequence: Synthetic coding sequence
atgagcggcctgagcggcccccccgcccggcggggccccttccccctggctttgctgctgctatttctgttgggaccaaggctggtactggcaatatcctttcacctgccaatcaactctcgcaaatgtttgcgtgaggaaatccacaaagacctattagtcacaggagcatatgagatctctgatcagtcagggggggctggaggactgagatcacatctgaaaatcactgattccgctggccacatcctttatagtaaggaggatgctactaaaggcaaatttgcgttcacaactgaagattacgatatgttcgaagtatgcttcgaatccaagggcacaggccgcatacctgatcagctggtgattctggatatgaagcatggagtggaggccaagaactacgaggaaatcgccaaggtggagaaactcaaaccccttgaagtggagctgcggcgattagaggatttgtctgaaagcattgtgaacgatttcgcttacatgaagaaaagggaggaggagatgagggatacaaatgagagtacaaatacacgtgtactatatttttcaatattttcaatgttctgccttatcggtttagctacctggcaggtgttctaccttaggcgtttttttaaggccaagaagttgatcgagtag

SEQ ID NO: 209357 - DNA, 471 bp, Artificial Sequence
  Description of Artificial Sequence: Synthetic coding sequence
atggccggctggcccggcgccggccccctgtgcgtgctgggcggcgccgccctcggagtatgtttggcaggcgtagcaggacagcttgttgagccatcaacagcgccacccaagcccaaacctccccctctcaccaaggagacagttgtcttttgggacatgcgcctttggcacgtagtgggaatcttcagcctgttcgtcctctcaatcattattacgctgtgctgtgtctttaactgtcgcgtgccaagaacccggaaggagatcgaagccaggtatctgcagcggaaggcagctaagatgtataccgacaaactcgaaacagtgccacccctgaatgaactgacagaagtgcctggtgaggataaaaaaaagaaaaaaaaaaagaaaaaagactccgttgatactgtggctattaaggtggaagaggatgaaaaaaacgaggccaagaagaagaagggggagaagtag

SEQ ID NO: 209358 - DNA, 1602 bp, Artificial Sequence
  Description of Artificial Sequence: Synthetic coding sequence
atgaacgagagccccgaccccaccgacctggccggcgtgatcatcgagttgggccctaacgacagcccacaaacttctgaattcaagggagctacagaggaagcccctgcaaaggagtcagtccttgcccgcttatccaaatttgaggttgaggatgccgagaatgtggcgagttatgattcaaagattaagaagatcgtgcattctatcgtctcatctttcgcctttgggctattcggcgtttttctagttttactggatgtaacactgatactcgctgatcttattttcacagacagtaaactctacattccactggaataccgctccatctcactggctattgccctgttctttctgatggacgtgttgcttagggtgtttgtagaacgtcgccagcaatacttttctgacctgtttaacatactcgacacggccatcatcgtgattcttctgcttgttgacgtcgtgtatattttcttcgatattaaactactccggaacatcccccgctggacccacctcttgcggctccttcgccttattatcttgcttcggatattccatctcttccaccagaagagacagttagaaaaactgatccgcagacgtgtaagtgagaataagcgaaggtacacaagggacggctttgatttggatctgacctacgtgacggagaggatcatcgctatgtctttcccctcatccggacggcagtctttctatcggaaccctatcaaagaggtcgtccgtttcctagataaaaagcatcgtaatcactaccgggtgtacaatttgtgctctgaacgcgcctatgatcccaagcattttcacaaccgagtcgtgagaatcatgatcgacgatcacaacgtgccaaccctgcatcagatggttgtctttaccaaagaagttaacgagtggatggcccaggacttggagaatatcgtcgcaatacactgtaagggggggacagatcgaactggcactatggtctgtgctttcctcatcgcatcagagatttgctcaacagcaaaggaaagcctgtattatttcggggaacgtaggacagacaagacacattccgaaaagtttcaaggggtgaagacaccatcccagaaacgctatgtagcctattttgcccaggtgaaacatctgtacaactggaacctgccccctaggaggattttgttcattaaacactttatcatctattctatcccacggtatgtccgcgatttaaaaattcaaatagaaatggaaaaaaaggttgtattttccacaatttccctgggcaagtgtagcgtacttgataatatcaccaccgataaaatccttatcgatgttttcgacggcctccctctttacgacgatgttaaggtgcagtttttctactccaatcttcccacgtactatgataactgtagcttttacttttggctacatacttcctttatagagaacaacagactgtacctgccaaaaaacgagctggataacctgcataaacaaaaggctcgccgcatttaccctagtgatttcgctgtggaaatcctgtttggagagaagatgacttcaagcgatgtcgtagcaggatctgattag

SEQ ID NO: 209359 - DNA, 1542 bp, Artificial Sequence
  Description of Artificial Sequence: Synthetic coding sequence
atgaacgagagccccgaccccaccgacctggccggcgtgatcatcgaactgggaccgaatgacagtccccaaacaagcgagtttaagggtgcaaccgaagaggctcctgccaaggagtcctcaaaaatcaaaaagatagtccacagtatagtctctagttttgccttcggcttgtttggtgtttttctggtgctgctcgacgtgaccctcatccttgccgatttaatttttacggattcaaagctttacattccactggaatatcgttccattagtctggccatcgcccttttctttctgatggacgtgttactccgggtgtttgtcgaacggcgtcagcagtattttagcgacctttttaatatcttagataccgcgataatagtgattctgctgctcgtggacgtagtttatatctttttcgatatcaaactgctcagaaatatccctagatggactcatcttctgcgccttctccgcctgattattctgctgcgtatcttccatctgtttcatcagaaaagacagctggaaaaattgattagaaggcgtgtctccgaaaacaaacgtaggtataccagggacgggttcgatttggatttgacttacgtgactgagcgaatcatcgccatgagtttccctagttcaggacggcaaagtttctaccggaatccgattaaggaagttgtccgctttttagacaagaagcaccgcaaccactatcgggtctacaatctgtgttccgagcgcgcctatgacccaaaacacttccacaatagggtagttaggatcatgatcgacgaccacaatgtgccaactcttcatcagatggtcgtattcactaaagaggtgaatgaatggatggcccaggatcttgagaatatcgtggcgatccattgcaaagggggcactgatagaaccggaactatggtatgtgccttcttgatagccagtgagatttgtagcaccgccaaggaaagcctgtactacttcggcgaaaggagaactgacaaaacccacagtgagaaatttcagggcgtgaaaacgccctctcagaaacggtacgtcgcatactttgctcaagtgaagcacctgtacaactggaatctgccgccccgccggatcctcttcattaagcacttcatcatttactcaattcctcggtacgtaagggaccttaagattcaaattgaaatggagaagaaagtggttttttcaaccatttctctgggtaagtgcagcgtgcttgacaacattactacagataaaatcctgatcgatgtctttgatgggctgccattatatgatgacgttaaagtccaatttttttactccaacttacctacctactatgacaactgcagcttctacttctggctacacacatcctttatagaaaacaaccgcctctacttgcccaaaaacgagctagacaaccttcacaaacaaaaagcgcgtcgcatctaccctagtgatttcgctgtggagatcctgtttggtgagaagatgaccagctcggacgttgtggcgggcagcgactag

SEQ ID NO: 209360 - DNA, 1656 bp, Artificial Sequence
  Description of Artificial Sequence: Synthetic coding sequence
atgaacgagagccccgaccccaccgacctggccggcgtgatcatcgagcttgggccgaacgactccccccaaaccagtgaatttaaaggcgctactgaagaagcgcctgccaaggaatcaccgcacacttccgaatttaagggggcagcacgcgtatcccctataagtgaaagtgttttggcaagattaagcaaatttgaagttgaggatgcggaaaacgtggcgagctacgactccaagatcaagaaaatcgtgcactcaatcgtgtctagctttgccttcggcctatttggggtctttctagtgcttctcgatgtgactctgatcttggcggacctgatatttactgactcaaagctctacattccactggaatatcggagcatttcactggccatcgcccttttcttcctgatggacgtgctccttcgcgtctttgtggagaggaggcagcagtactttagcgacctgtttaacatacttgataccgctatcatcgtgattttactcttagtagacgtggtttatattttctttgacatcaaactgttaaggaatattcccagatggactcatcttctccgcttgctgcggctcatcatcctgctgcgcatttttcacctctttcatcaaaagagacagttggagaaactgatacgcaggagggtcagcgagaataagcggcggtacacacgggacggcttcgacttagacctgacttatgtcacagaaaggatcatcgccatgtcattccccagttcgggaaggcagagcttctatcgcaatcctatcaaagaagtcgttaggtttcttgacaaaaagcatcgaaatcattatcgcgtctataacctttgtagtgagcgcgcgtatgatcccaagcacttccataatcgcgtggttcggatcatgatagacgatcacaacgtgccaacattacaccagatggtggtctttaccaaagaagtgaacgaatggatggctcaggatctcgagaatatcgtagcgatccactgcaagggaggtactgatcggaccggtacaatggtctgtgcctttctaatagcttctgagatttgcagtacggcaaaggaatccctctactacttcggcgagcggcgtacagacaaaactcactccgagaaattccagggagtcaagacccccagccagaagaggtacgtggcatattttgctcaggttaaacatttatacaactggaaccttccacctaggcggattcttttcataaagcattttatcatttactcaatacctaggtacgtccgggatctgaaaatccagatcgagatggaaaagaaggtcgttttcagcaccattagtctcggcaaatgttctgtgttggacaatatcacgactgataagattttgatcgatgtgttcgacggcttaccactttacgatgacgtgaaagtgcagttcttttacagtaatcttcctacatactatgataattgtagcttttacttttggttacatacgagcttcatcgagaataatagactataccttccaaagaatgagctggacaatctgcacaagcagaaggcaaggcgcatctacccatcagattttgccgttgagatcctgtttggagagaaaatgacatccagcgatgtcgtggcaggctccgactag

SEQ ID NO: 209361 - DNA, 1692 bp, Artificial Sequence
  Description of Artificial Sequence: Synthetic coding sequence
atggagcgggacagccacggcaacgccagccccgcccggaccccctcggccggagcttcacccgcccaggcatcccccgcaggcaccccccctgggagggcaagtcccgcacaggccagccctgcacaagccagccctgctggtaccccgcccgggcgcgcctctccagcccaggctagccccgccgggacccctccaggacgcgcttctccaggcagagcgagccctgctcaggcctccccagcccaggcatctcctgccagggcaagcccagctctggcctctttgagccgaagcagctctggtcgatcctcgtccgccagatccgcctctgtcacaacatcccccacacgtgtgtaccttgtcagggccactccagtgggcgccgttccaattaggtcttcacctgctagaagcgcccctgcaaccagagccacacgcgagtcgcctgggacttcgctgcccaagttcacgtggcgcgaaggccagaaacaactgccattgattggatgtgtcctcctgctgatcgcgttagtagtgtccctcatcattctgtttcaattctggcaggggcacactggaatccggtacaaggaacagcgggagtcatgtccaaaacatgcagttaggtgcgatggggtcgtggattgcaaattaaagagcgacgagttgggttgtgtgcgttttgattgggataagagcttgctgaaaatatacagcgggagttcgcaccagtggctgcccatttgttcttcaaactggaacgacagttattccgaaaaaacttgtcaacagcttggcttcgagtctgctcacagaacaactgaggtagcacaccgcgattttgctaactccttctccattctgagatataattcaactatccaggagtctctgcatagaagcgagtgtccaagccagaggtatatctctctccagtgtagtcattgcggtcttcgcgccatgaccggaaggatcgtcgggggggcgctggcatctgattccaagtggccttggcaggtgtcactgcacttcggcacaacccatatctgtggcgggaccctgatagacgctcaatgggtgctaacagccgcacactgcttttttgtgacccgagagaaagtgctggagggatggaaggtgtacgctggcactagtaacctccatcagctgcctgaggccgcttctatagccgagatcatcatcaactccaactataccgacgaggaagacgactacgatatcgcactcatgaggttgtcaaagcccctcacgttgtccgcacacattcaccccgcctgccttcctatgcatggccagacgttctctctgaatgagacttgctggatcacaggatttggaaaaacccgtgaaacagacgacaaaacatcaccttttctcagagaggttcaggtgaaccttatcgatttcaagaagtgtaacgactacctcgtctacgactcctacctgacaccaaggatgatgtgtgccggcgatctgcgcggaggccgggactcctgtcagggcgatagtggcggtccactcgtgtgtgagcaaaataatcgctggtatctggctggggtgacttcttggggcacgggttgcggtcagcgcaacaaacctggggtttatacaaaggttaccgaggtgctgccttggatctacagtaaaatggagtcttcagcaggctag

SEQ ID NO: 209362 - DNA, 1194 bp, Artificial Sequence
  Description of Artificial Sequence: Synthetic coding sequence
atggaccccgacagcgaccagcccctgaacagcctggtgaaggtgattcttgataagtactattttctgtgcgggcagccactccattttatcccaagaaagcagctgtgcgatggtgaattggactgcccgctgggggaagacgaagaacactgcgtcaaatcttttcctgagggacctgctgttgctgtgagactgtcaaaagacaggtccaccctgcaggtactggactctgccaccggtaattggttttctgcctgcttcgataatttcacagaagccttggccgaaaccgcttgccggcagatgggctattcatccaagcctacattcagggccgtcgaaatcggtccagaccaggacctggatgtggtcgagatcacggagaatagccaagaactaagaatgagaaatagctcaggtccttgcctgtccgggtcgcttgtgtctcttcactgccttgcttgtgggaagtcccttaaaactcctagggtagtcggcgtagaggaggcgtcggtggatagttggccttggcaggtttccatccagtacgacaagcagcacgtctgtggcggatccatactcgatcctcattgggtgctaaccgccgcccattgcttcagaaagcacacagatgtgttcaattggaaggtcagagcaggaagcgataaactcggttcatttcccagtctggctgtggctaaaataattatcatagagttcaaccccatgtatccgaaggataacgatatcgccctgatgaagctgcaattccctctgacgtttagcggcacggtgcgccctatttgtctgccctttttcgatgaagagctaaccccagctaccccactctggattatcgggtgggggttcactaaacagaacggcggcaaaatgtcggacatcctcctccaggcaagcgtccaggtcattgactccacacggtgtaacgcggatgacgcataccagggcgaggtgacagaaaaaatgatgtgtgccgggattcccgagggcggagttgatacatgccagggagattctgggggtccactgatgtatcagagtgaccagtggcatgtagtcggaattgtgtcttgggggtacggatgcgggggtccatccactccgggcgtgtataccaaggtgtctgcctacctcaactggatatacaacgtctggaaggctgaactgtag

SEQ ID NO: 209363 - DNA, 1266 bp, Artificial Sequence
  Description of Artificial Sequence: Synthetic coding sequence
atgatgtaccggaccgtgggcttcggcacccggagccggaacctgaagccatggatgatagccgtcctcattgtcctctccctgaccgtggtggccgttactatcggcctcctggtgcattttttggttttcgaccagaagaaggagtactatcacggatcatttaaaatcctagatccacagatcaataacaatttcgggcagtctaacacataccagctcaaggacctccgcgagactacagaaaatctggtgtcccaggtcgatgaaatcttcatcgactcagcctggaaaaaaaactacatcaaaaatcaggtggttcgtctaactccagaggaggacggtgttaaggtggacgttataatggtgttccagttcccctccaccgaacaaagggcagttcgagagaagaaaatccagagtatcctgaaccagaagatcaggaacctgagagcgttaccaattaacgctagctccgtccaggtgaacgccatgtcctcgtccaccggtgagctgacagtgcaggcttcttgcgggaaacgcgtggttccactcaatgtcaacagaattgcttccggtgttatcgcgccgaaagcggcttggccttggcaagcgtcactccaatacgataacattcatcagtgtggagcgaccctgatatctaacacctggctcgtcactgcagcccactgcttccaaaagtacaagaacccccaccagtggactgtaagcttcggcacgaagatcaatccacctctaatgaaacggaacgtgcgcagatttatcatccacgagaaataccgatcagcagcccgggagtacgatattgccgtggtgcaagtgtcgagccgcgtgactttttccgacgacattcgccagatctgtctgccagaagcgtctgcgtcttttcagcccaacctgactgttcatattacaggcttcggtgccctgtactacgggggcgaatcccagaatgatctacgtgaagcgagggtaaaaatcatctccgatgatgtgtgtaaacaaccccaggtttacggaaacgatattaagccgggaatgttctgtgcgggctacatggaaggaatctatgatgcatgcagaggagactctggcgggcccctggtaacccgcgacctgaaggacacctggtatcttattggaattgttagctggggagacaactgcggccagaaggataagcccggcgtctatacgcaggttacctattatcgaaactggattgcctcgaagacgggaatttag

SEQ ID NO: 209364 - DNA, 1257 bp, Artificial Sequence
  Description of Artificial Sequence: Synthetic coding sequence
atgatgtaccggaccgtgggcttcggcacccggagccggaacctgaagccttggatgatagcagtcttgatcgtgcttagcttaactgtcgtcgccgtgacaattggactgttagtccacttccttgtgtttgaccagaaaaaagaatactaccatggctcattcaagattctggacccacagattaacaacaatttcggccaatctaatacgtatcagctgaaagacctgagagagacaacagagaacctagttgatgaaatattcatagattcagcctggaagaagaattacatcaagaaccaggtcgtgcggttgactccagaagaggacggcgtgaaggtagacgtcataatggtcttccaatttccatctacagagcaacgtgctgttcgcgagaagaagattcaatctatcttgaaccagaaaatcaggaatctgcgcgcactcccaatcaatgctagcagcgtgcaagtgaatgctatgagcagctcaacaggagaactgaccgttcaagcctcctgcggcaagcgcgttgttcctctgaacgtgaacaggatcgcaagtggagttatcgctcctaaagctgcgtggccttggcaggctagtctgcaatatgacaatattcaccagtgtggcgctactctaatttctaatacctggctggttaccgccgctcactgcttccaaaaatataaaaatcctcaccagtggaccgtatccttcggcactaaaatcaacccaccccttatgaagagaaatgtgaggcggttcataatccacgagaaataccggtccgccgccagggaatacgatatcgccgtcgtgcaggtgtcgtccagagtgacgttttcggatgacatcagacaaatctgtcttcccgaagccagtgcttcttttcagcccaatctgactgttcacattacaggctttggcgctctgtattatggcggggaatcccaaaatgatcttcgggaagccagagtgaaaatcatctctgatgacgtctgtaaacagcctcaggtttatggtaacgatattaagcccgggatgttttgcgccgggtatatggagggcatctacgacgcatgcaggggggattctggcggcccactcgtaacaagagatttgaaggatacttggtacctgatcggaatagtgagctggggagataactgcggccagaaggataagcctggggtatacacacaagtcacctattataggaactggattgcttccaagaccggtatttag

SEQ ID NO: 209365 - DNA, 1254 bp, Artificial Sequence
  Description of Artificial Sequence: Synthetic coding sequence
atgtaccggaccgtgggcttcggcacccggagccggaacctgaagccatggatgatcgcagtgctcatcgtactgtctctgaccgtggtggctgtaaccatcggattactcgttcatttccttgtcttcgatcagaagaaggaatactatcatgggtcatttaaaattctggacccccagatcaacaacaatttcgggcaatctaatacataccagttgaaggacctacgcgagaccaccgagaacctggtggatgagatttttatagactctgcctggaagaagaattatattaaaaaccaggttgtgcggctcacacccgaggaggatggagttaaggtcgatgtaatcatggtgtttcaatttccaagtaccgagcaacgcgctgtccgggaaaagaagatccagtcaatcctgaaccaaaagattaggaatttaagggcacttccaataaatgcttccagcgtacaagtcaacgccatgagttccagtacgggtgagctgactgtccaagcttcctgcggcaaaagagtcgtccccttgaatgtgaatcgcatcgcatcaggcgtgatcgcccccaaagcagcttggccttggcaggccagcctccagtacgataacatccatcagtgtggcgctacactcatctccaacacgtggctcgtaacagccgcgcactgtttccagaaatacaaaaacccccatcagtggactgtttcctttggaactaagatcaacccacccctgatgaagaggaacgtgcgccgctttattatccatgagaaatatcgctctgctgcacgggaatacgacatcgccgtggtacaggttagcagtcgcgtgaccttctccgatgacattagacagatctgtctgcccgaggcatctgctagtttccaaccaaatcttactgtgcatatcacaggtttcggggccctgtattacggcggtgagtcccaaaacgacctgcgtgaagctagggtgaagattatctcagacgacgtctgcaagcagccacaagtttacggtaatgacatcaagcctgggatgttttgcgccgggtatatggaaggtatctacgacgcttgtcggggtgattccggtggccccctcgtgactcgggacctaaaagacacatggtacctgatcggaattgtgagctggggcgacaactgcgggcaaaaagacaagccaggagtgtacacgcaggtgacttactatcgtaactggattgcttccaaaacagggatttag

SEQ ID NO: 209366 - DNA, 1689 bp, Artificial Sequence
  Description of Artificial Sequence: Synthetic coding sequence
atggagcgggacagccacggcaacgccagccccgcccggacccccagtgctggagcgagtcctgcgcaggcctcccccgctggaacacctccaggtcgggcctcccctgctcaggcgtccccagcccaagccagtcccgctggtacgccccctgggcgggcttcccctgctcaggccagccccgcagggacaccaccagggagagcctcccccgggcgggcatcacccctgcaagcttctccagctcgcgcatcccccgcactcgcatctctatccagaagttcctctggtcgttctagcagcgctcggtccgctagcgtgaccacttctccaaccagagtctatttagtgagggccacaccagtcggggccgtccctattcggtcctcccctgctcgctcagccccagctactcgcgctacacgtgagtcccctggcactagcctgcctaaattcacatggcgcgaaggacagaagcagctacccttgatcggctgcgtccttctgttaattgccttggtggtaagtctgatcattctgtttcagttttggcaagggcatactggaatacggtataaagagcaacgtgaatcatgcccaaaacatgctgtgagatgcgatggggtggtcgactgcaagctgaagtcagacgagctgggttgtgtccgttttgattgggacaagtcactgctgaagatatatagtggctcctcgcaccagtggcttcccatttgcagcagcaattggaacgactcgtatagcgaaaagacctgtcaacagctcggttttgagagtgcacatcgaaccactgaagtggcccacagagatttcgccaattcatttagcatactgagatacaatagtactatacaagaatctcttcataggtctgaatgtccttcccagcgttacatctctctgcagtgttcccactgcgggttaagggccatgactggccgaatcgtgggaggggctctcgcttctgactcgaagtggccctggcaggtcagtctccatttcggcaccacccacatctgcggtgggacactgatagacgcacagtgggtcctcacagccgcccactgtttttttgtcacaagggaaaaggtgctggagggatggaaagtgtatgctgggacttcaaacctgcaccagctcccggaggccgctagtattgcagagattatcatcaactctaattatacagacgaggaggacgactacgatatagcactcatgcgcctgagtaaaccgctgaccctgtctgcccacatccatccagcctgcctccccatgcacgggcaaacattctccctcaatgaaacatgttggattacaggattcggtaagactagagagactgacgacaagacctccccatttctccgggaggtccaggtcaatctcatcgattttaaaaagtgcaacgattacctggtttatgattcctatctgacccctagaatgatgtgtgccggtgatctgcgtggcggaagggacagctgccagggtgacagcggagggccacttgtgtgcgaacagaataaccgctggtacctggccggggtaacatcctgggggactggctgcggccagaggaacaagccgggcgtttatacgaaggtgacggaggtgctgccctggatatacagcaagatggaaagtgaagtgcgctttagaaaatcctag

SEQ ID NO: 209367 - DNA, 1761 bp, Artificial Sequence
  Description of Artificial Sequence: Synthetic coding sequence
atggagcgggacagccacggcaacgccagccccgcccggacccccagtgctggtgcctctccagcgcaggcctcaccagccggaacccccccaggccgtgcaagccctgctcaggcctccccagcccaagccagcccagccggaacacctccgggtcgagcctcaccagcgcaagcctccccagccggtacgccacctggtcgggctagcccgggacgggccagccccgcccaggccagtcccgctcaggcttcgcccgccagagcctcacctgcattggcgtccttgtctcgctcctccagcggaaggtcatccagcgcacgaagcgcgtccgtgacaaccagtccaacacgagtctacctagtgcgggcaaccccagtgggggcggtacccataagatcctctccagcgcggtctgctcccgctacaagggcgactagagagtccccagggacaagcctcccaaagttcacttggcgcgaaggacagaagcagctgcccctaatcggatgcgtgctgctgctgatcgctctcgtcgtgtctcttatcatactgtttcagttctggcagggacatactggcattaggtacaaagagcaacgcgaaagttgccctaaacatgccgtgcggtgtgacggcgtagttgattgcaaactcaaatctgatgaactgggatgcgtaaggttcgactgggataagtcactcttgaagatttactccggcagttcacatcagtggttacctatctgcagtagtaattggaacgattcatatagtgagaagacatgccaacaactcggcttcgaatcagcgcaccgaaccacagaggtggctcaccgggattttgctaattcattttccatattaagatacaacagcacgatacaggaatccctgcaccggtccgaatgccccagccagaggtatatttcactgcagtgttctcattgtgggctgcgggcaatgactggcaggatcgtgggtggcgccctggccagcgactcgaaatggccatggcaggtgtccctgcatttcggtaccacgcatatctgcggaggcaccctcatagacgctcagtgggtgttgacagccgctcactgcttcttcgtgaccagggagaaggtgctggagggctggaaggtgtacgctggcacctctaatctgcaccagctgccggaagccgcaagtatcgcagaaataatcattaatagcaactacactgatgaagaagacgattatgatattgctctcatgcgtctttcaaagccactcacattatcagcccacattcacccagcctgtctgccgatgcacggccagacttttagtcttaacgagacttgttggatcaccggctttgggaagaccagggaaactgacgataagacctctccattccttcgtgaggttcaggtcaatcttattgactttaagaaatgcaatgactacctcgtgtacgactcctatctaactccaaggatgatgtgtgccggcgaccttcggggaggaagggacagctgtcagggcgacagtggggggccgctggtgtgtgagcagaacaaccgctggtacctggccggtgtgacctcctggggaaccggttgtggccagaggaataaacccggagtctacactaaggtaaccgaagttttaccctggatctacagcaagatggaagtccgaagcttgcagcaagacaccgcccctagccggttgggtacgagctctgggggcgacccaggcggcgccccacggttgtag

SEQ ID NO: 209368 - DNA, 1704 bp, Artificial Sequence
  Description of Artificial Sequence: Synthetic coding sequence
atggagcgggacagccacggcaacgccagccccgcccggaccccctctgcgggcgcctccccagcacaagcttctcctgctggaacacctcccggaagggcgtccccagcacaggcgtcacctgcacaggcatcccccgcgggaaccccacccgggcgggcgagcccagctcaggcgtcacctgctggaacacctcccgggagagcatctccaggtagagcaagtcccgcgcaggccagtcctgctcaggcttccccagcccgagcatcccccgcgttggccagcttatcacggtctagttcaggcagatcatcctctgcccggtccgctagcgtcacaaccagccccacgcgcgtctatctggtgagggcaacacctgtgggagctgtgcccattagaagctcgcccgctcggtcggctcctgcaacccgagcgacaagggaaagtcctgggacctccctgcccaagttcacctggcgcgaagggcaaaagcaactgcccctaatcgggtgcgtgcttcttctgatagctctggtggttagcctgattatcctcttccagttttggcagggacacaccggtatcagatacaaagagcagcgggaatcgtgcccaaagcacgcagttcgatgtgacggagtcgtagactgcaagctaaagtctgacgagctgggttgcgtgaggtttgactgggataagtcgctgctgaagatttactcggggagtagccaccagtggttacctatttgctcctcaaactggaacgacagctacagcgaaaagacatgccagcagctcggctttgaatccgcacaccgcaccaccgaggttgcgcaccgggactttgccaacagttttagcatactgagatataacagcacgatccaggaaagcctgcacagaagcgagtgtccaagccaacggtacatcagcctacagtgttcacactgtgggctcagggcaatgactggccggatagtcggaggcgctctcgcttcagattccaagtggccatggcaggtctcgctgcacttcggaacaactcatatctgcggggggactcttattgatgcccagtgggttctgactgcggcccattgctttttcgtcacacgagaaaaggtgttggaaggctggaaggtatatgctggcacgagtaatctccatcagcttcctgaagcagcatccatcgctgagatcataataaacagcaactacacagacgaagaggacgactacgatatcgccttgatgcggctgagcaagccattgactctgtcagctcatatccatcctgcatgcttacccatgcatggacaaacatttagcttaaatgaaacctgttggatcaccggattcgggaagacccgcgagaccgacgataaaacaagccccttcctgcgcgaggtgcaggtgaatctgattgactttaagaaatgcaacgattacctggtctacgatagctacctaacaccgcggatgatgtgcgcaggcgatttaagagggggtcgagactcttgccaaggagacagcggggggccactcgtgtgtgaacagaataatcggtggtatctggcaggcgttacctcttggggaacaggatgtggccagcgaaataagcccggcgtatacaccaaagttacagaggtcctaccctggatctactctaaaatggaaagcgaagtgcgcttcaggaaaagttag

SEQ ID NO: 209369 - DNA, 1476 bp, Artificial Sequence
  Description of Artificial Sequence: Synthetic coding sequence
atggagcgggacagccacggcaacgccagccccgcccggaccccctctgcaggggctagccccgcccaggctagccccgcaggaactccccctggccgtgcaagtcctgcacaagccagcccagcccaggcctcacctgccggtacaccgcctggcagggcgtcacccgcacaggcaagccccgcaggaacaccgcccggccgagcatctcccggtagggcctcccctgcgcaggcttcccctgctcaggcctcccctgcccgcgcctctccagcactggctagcttgtcgcgtagttcatcaggccgatcatcctccgcaagaagtgctagcgtgaccaccagcccaacccgcgtctatctggtccgggcaacaccggtcggagctgtgcctataaggtccagcccagcccggtccgctcctgcgacccgggcaacccgcgaatcccccggcacgagccttcctaaatttacatggagggagggccagaagcaactcccactcattggatgcgttttactgctgatagccttagtggtgagtttaatcatcctgttccagttttggcaaggacacaccggtattcgctataaggagcagagggagagctgtcccaagcatgctgtgcgctgtgacggcgtggtggactgtaaactgaagagcgacgagctgggttgcgtgcggttcgattgggacaaatccctgctcaagatctattctggcagctcacaccagtggctccccatctgttccagtaactggaatgacagttattccgagaagacctgccagcagcttgggtttgagtcggctcataggaccacggaagtggcccacagggattttgctaactctttcagtattttacggtataattctaccatacaggagagcctgcaccgcagtgagtgcccatctcaacggtatatttctctgcagtgttcccactgcgggctcagggccatgactgggcgcatcgtcggtggcgctctggcaagcgattccaagtggccgtggcaggtctcccttcactttggcacaactcatatttgcggaggtacgctgattgatgcacaatgggtgcttactgctgcccactgcttttttgtgacccgcgaaaaggtgctggaagggtggaaagtgtatgcagggacatcaaaccttcatcagctgcctgaagcggcctccatcgccgaaatcatcatcaacagtaactatacggacgaagaagatgattatgacatagccctgatgagattatcaaagcctctcactttgagcggcgagggtatttgcacccctagaagtcccgcaccacaaccccagcaccccctgcagccctctcacttgtctgcctctgtgaacagctaccctggaccaaaggcctccgcaggacagaaatccaaaaccctgaaagacccatatatggagcacttttgtttcattatccgagagactgaagcccagggtctttag

SEQ ID NO: 209370 - DNA, 1599 bp, Artificial Sequence
  Description of Artificial Sequence: Synthetic coding sequence
atggagcgggacagccacggcaacgccagccccgcccggacccccagcgccggagcctctccggcccaggcctcacctgccgggaccccacccggcagagctagtccagcgcaggcaagccccgcccaagcctcaccagcgggcaccccacccggacgagcgtccccagcacaggccagtcctgccgggactcctcccggccgggctagtccagggagggcctcccctgctcaggcatctccagcacaggcatcccccgcgcgggcatccccagctttagcctctctgtcgaggagcagctcgggtagatcttctagcgcacgatccgcgagcgtgactacctctccaacccgagtgtatctggtcagggccactcccgtcggcgccgtgccgattaggagttcccccgcccgcagcgcccctgctactcgtgcaactagggaaagccctgttcagttctggcagggacacactggaatcagatacaaggagcagagagaaagctgtccaaaacacgcagttagatgtgatggtgttgtcgactgtaagctcaaaagtgacgaactgggctgcgtgagatttgactgggacaagtccctcctcaaaatttactccgggtccagtcaccaatggctgccgatctgttcgtccaattggaatgacagctactcagagaaaacctgtcagcagctgggcttcgagagtgctcaccgaacaaccgaagtagcccaccgagactttgctaacagtttttctatccttaggtacaacagcacaatacaggagagcctgcatcggtcagaatgtccttctcagcgctacatttccctgcagtgctcacactgtggactgcgcgcaatgactggccggattgtgggaggggcattagcctcagacagtaaatggccttggcaggtttcactgcattttggtaccactcacatctgtggcggaaccctcatcgacgctcaatgggtgctgacggcagcacattgctttttcgtgaccagagagaaggtgcttgaaggctggaaggtgtatgctggcacgtccaatctccatcagctgcctgaagccgcatccattgccgaaatcatcataaatagcaactataccgatgaggaggatgattatgacatcgccctcatgaggctgtctaagccacttacactgtcagcccacatccaccccgcctgtctcccaatgcacgggcagaccttctccttaaacgaaacctgctggatcaccgggtttggcaagaccagagaaacagacgataagacatctccattccttagggaagtgcaggtcaacctgattgactttaagaaatgcaatgattacctcgtttatgactcctatctaactccgaggatgatgtgtgccggggacctgagaggcggcagagattcatgccagggggacagtggaggcccactggtatgtgaacagaacaaccggtggtacctggcaggtgttacaagctggggaaccgggtgtggacagcgcaacaaacccggagtttataccaaggtgaccgaagtccttccctggatttattcgaagatggagtctgaggtcaggttccggaaatcttag

SEQ ID NO: 209371 - DNA, 1365 bp, Artificial Sequence
  Description of Artificial Sequence: Synthetic coding sequence
atgggcgagaacgacccccccgccgtggaggcccccttcagcttcagatccctatttgggctcgatgatctgaaaatcagtcctgtggcccctgatgcggacgccgttgccgcccaaattttgtccctccttcccctgaaattttttccaatcattgtgatcggcataatcgccctgatcttggccctggcaattgggttgggaattcatttcgactgctccggcaaataccgctgtcggagctctttcaagtgcatcgaattgatcgctagatgcgatggagtgtcggattgcaaggacggagaggatgaataccggtgcgtaagggtgggagggcagaatgctgttcttcaggtgttcacagctgcctcttggaagactatgtgcagtgatgattggaaaggacactacgccaacgtcgcatgcgcacagttgggcttcccaagttacgtcagttcagataatcttcgggtgtcatctcttgaagggcaatttagagaggagttcgtcagcattgaccacctgttgcccgacgacaaggtgaccgcattacatcactccgtgtacgtcagagagggctgtgccagtggccacgttgtgaccctgcaatgcactgcgtgtggacatcgtcggggttactccagcagaatcgtcggcgggaacatgtcactcctaagccagtggccctggcaagcaagcctgcagtttcaggggtaccacttgtgcggcggcagtgtgattactccactgtggattatcactgctgcccattgtgtgtacgacctctatttgcccaaaagctggaccattcaggttggcctagtctccttactggacaaccccgccccgagccatttggtggagaagatcgtatatcacagcaagtacaagcctaaaaggctcggcaacgacatagccttaatgaagctagccgggccactcacattcaatgaaatgatacagcctgtgtgtctccccaattctgaagagaactttccagatgggaaggtgtgttggacatcaggctggggcgcaacagaggacggagccggtgacgcttcacccgtgctgaatcatgccgcggtcccactcattagcaacaagatctgtaatcatagggacgtctacggtggcatcatatcaccttcaatgctctgtgcagggtatctcactggaggcgtcgacagctgccaaggtgactccggaggaccactggtttgccaggagaggagattgtggaagctggttggggccacgtctttcggcatagggtgcgctgaagtaaacaaaccaggtgtgtatacaagagtcacttcctttctcgactggatccatgagcagatggaaagggatttgaagacctag

SEQ ID NO: 209372 - DNA, 1617 bp, Artificial Sequence
  Description of Artificial Sequence: Synthetic coding sequence
atgcaggccgtgggccccaagcccctgcccaccctgctgtgcggcgggcggacaggacataggaccgcacgagtgctctcatttctcatcagaagttgcccctgtgagccaggtaagggatgcgtgtacggcaaacctgtgacgctctggccaacaatttcttcagtcgtacccagcacctttctgggcttgggcaattatgaagtggaggtggaagccgaacccgacgtccggggtccagagatcgtgactatgggcgaaaatgacccgcctgcagtcgaggcccctttttccttccggtcattgtttggtctggatgatctaaaaatctcccccgtagctcctgacgccgacgccgttgccgcccaaattctgtcattactgccgctgaaattttttcccatcattgtgatagggattattgctctgatattagccttggccatagggctcggcatccactttgactgctcagggaagtatcgctgccggtcatcctttaagtgtatcgaactgattgctcgctgtgacggcgtgagcgactgcaaggatggcgaggatgagtataggtgcgtcagagtcggcggtcagaacgcggtgctccaggtgtttacagcggcctcttggaagactatgtgcagcgacgactggaaggggcattatgccaacgttgcttgtgcacaacttggcttcccctcctatgtttcttctgacaatctgcgcgtttcctcccttgaaggccaattccgcgaagaatttgtctctattgatcaccttctacccgatgataaagtaactgccctgcaccatagtgtgtacgtgcgagaaggatgcgcttctggacacgtcgtcacgctccagtgtaccgcctgtggtcatagacgcggttattccagcagaatagtgggaggaaatatgtctctgttgtcgcaatggccatggcaggccagcctacaatttcaaggctaccacctgtgtgggggatcagttattactccactgtggatcatcaccgcagctcattgcgtatacgacctctatctgcccaagtcgtggaccatccaggtgggcctggtcagtcttctcgataacccagccccatcacacctagtagagaaaattgtctatcatagtaagtacaagccaaaaaggcttgggaatgatattgcactcatgaaacttgccgggcctctaacctttaacgagatgattcagcccgtttgcctccccaattctgaagaaaattttcccgatggtaaggtttgctggacatcgggctggggcgcaactgaggatggggctggcgacgcctctcccgtcttaaatcatgccgctgtgcctctcatctccaataaaatatgtaatcatcgcgacgtgtacggggggattattagtccatccatgctttgtgccggctacctgacaggcggcgtcgattcatgtcagggagacagtggcggccccctggtgtgtcaagaaagaaggctgtggaagctagttggggccacatcctttgggattggatgcgctgaggtgaacaagccgggtgtttatacccgggtgacttcttttcttgattggatccatgaacaaatggaacgggacctgaaaacgtag

SEQ ID NO: 209373 - DNA, 1035 bp, Artificial Sequence
  Description of Artificial Sequence: Synthetic coding sequence
atgggcgagaacgacccccccgccgtggaggcccccttcagcttcagatccctttttggattggatgatttgaaaatcagccctgttgccccggacgcagacgccgtcgccgctcagatactcagcctcctgcccttgaaattttttcccatcatcgtgataggcatcattgctctgatcctggctctcgccattggacttggtatccattttgattgcagcgggaaataccggtgcagatcttctttcaagtgcattgaactgatcgcccggtgtgacggggtctccgattgtaaggacggcgaagacgagtacagatgtgtacgagttgggggacagaacgctgttttacaggtgttcaccgcggcttcttggaaaaccatgtgtagtgacgattggaagggtcactacgcgaatgtggcatgcgcccagctgggattcccctcatacgtcagttccgacaacctaagggtctctagcttagagggacagtttagggaagaattcgtctcaatcgatcatcttctgcccgatgacaaagtgactgctttgcaccatagcgtatacgtgcgtgagggttgtgctagtgggcacgtggtaactttgcagtgtactgcgtgcgggcatcggcggggatactcctctcgtatcgtagggggaaatatgtcgttactctcacagtggccatggcaggcgtctctccagttccagggataccacctgtgtggggggagcgtgattacacctctgtggattattactgccgctcactgcgtctatgacctctatctaccgaaaagctggacaattcaggtgggattggtctctctactcgacaaccccgctccatcccacctggtcgaaaaaatcgtttatcattctaagtacaagcctaagcgcctggggaacgatatcgccctaatgaaactcgctgggccccttacctttaacggcaccagtggatcactgtgtggctccgccgcactgccattgtttcaagaggaccttcaactactgattgaagcgttcctgtag

SEQ ID NO: 209374 - DNA, 1362 bp, Artificial Sequence
  Description of Artificial Sequence: Synthetic coding sequence
atgggcgagaacgacccccccgccgtggaggcccccttcagcttccggtcgctattcggtctagatgatctgaagatcagtcccgtggcaccagatgctgatgcagtggctgcccaaattctgagcttgctccctctgaaattctttcccatcatagtcattggcatcatcgctctaatcctcgccttggccattgggctaggcatccacttcgattgctcagggaagtatcgatgcaggtcaagttttaaatgtatcgagctgattgcccgctgcgacggggtctctgattgtaaggatggcgaagatgaatataggtgtgtcagggtcggcggccagaacgccgttcttcaggtgtttaccgccgcttcttggaaaacaatgtgttctgatgactggaaaggccactatgccaacgttgcctgtgcacagcttggcttcccctcctacgtctcatcggacaacttgagagtttcttccttggagggacagttccgagaggagtttgtgtctattgaccaccttcttccggatgataaagtgacagccctgcaccatagcgtctacgtccgagaaggatgtgctagcgggcatgttgtgaccctccagtgcactgcctgcgggcatcggaggggatattcctctaggatcgttggtggaaacatgagtctgctttcccagtggccatggcaggcttccttgcagttccagggttatcacctgtgtggtggcagcgtgatcacgcccctgtggatcattaccgccgcgcattgtgtttatgacctgtatctccccaaatcctggactatacaggtcggtctggtctccctgctggataacccagcaccatctcacctggttgaaaaaattgtctaccattccaagtacaaacccaaacgccttggaaacgacattgccctgatgaaactcgcgggacccctaactttcaatgaaatgatccagccggtctgtctcccaaattcggaggagaatttccccgatggaaaggtctgctggaccagtggatggggggctaccgaagatgggggcgatgcctccccagtcttgaatcatgctgcagtgcctctgatcagcaataagatctgcaaccaccgggatgtttatgggggcataatctcaccttcaatgctgtgcgcgggctacctgaccggcggggtggattcttgccagggcgactccgggggcccattggtgtgccaggaacggcgcctctggaaactggttggcgccacttcttttggcatcggttgcgctgaggtaaataagcccggggtgtacactcgagtcacctcctttctggactggattcatgaacagatggaacgagatctcaaaacctag

SEQ ID NO: 209375 - DNA, 1314 bp, Artificial Sequence
  Description of Artificial Sequence: Synthetic coding sequence
atgctgcaggaccccgacagcgaccagcccctgaacagcctggacgttaagccccttcggaagcctaggatccctatggagacattccgcaaagtggggatccctattattatcgccttgttgagccttgcttcgataatcatcgtcgtcgtgttaattaaagtgattctggataagtactacttcctgtgcggccagcctttacattttattcctcgcaagcaactgtgtgacggcgagctagactgccctctgggcgaggatgaagaacactgcgtaaaatcatttcccgaaggacccgccgtcgccgtgcgtctgtcaaaggaccgctccacactccaagtcttagatagcgcaacagggaactggttttctgcctgtttcgataactttaccgaagccttggcagagacagcgtgtcgtcaaatgggctacagcagtaaacctacctttcgcgccgtggagatcggccccgaccaggacttggacgtggtggagattacagaaaatagccaggaactgagaatgcggaactcaagcggtccctgcctttccggctccctagtgtcactccattgcttggcatgtgggaagtcattgaagacccctcgcgtagtaggcgtggaggaggcttccgtcgactcttggccctggcaggtgagcatccagtacgacaaacagcatgtgtgcggcggatctatccttgatccgcactgggtgctaacagctgcccattgcttccggaaacacaccgatgtctttaattggaaggtgcgcgccggatctgataagctgggaagtttcccgagtctcgccgtcgctaagatcataatcattgagttcaatcccatgtatccgaaagataatgacattgcattgatgaagctgcaatttcctcttacattctctggaacagtacgacccatatgtttgcctttcttcgacgaagaactgacaccagctaccccgctgtggattattggttgggggttcacaaaacaaaatggcggcaagatgtcagacatcctgcttcaggccagcgtccaggtgatagactctacccgctgtaatgccgatgatgcatatcagggggaagtcaccgagaaaatgatgtgtgcaggcatcccagaagggggcgtggacacttgtcagggagactcaggaggccctcttatgtatcagtcagatcaatggcatgtcgtcggcatcgtgagttgggggtatggatgtgggggcccctccacaccaggcgtgtatactaaggtgagcgcatacctgaactggatttataatgtttggaaagcagaactatag

SEQ ID NO: 209376 - DNA, 1299 bp, Artificial Sequence
  Description of Artificial Sequence: Synthetic coding sequence
atgctgcaggaccccgacagcgaccagcccctgaacagcctggacgtgaagcctttgcgcaagccaaggatcccgatggaaaccttcagaaaggttgggatcccgattattatcgccctgctctctctggcttctatcattattgttgtagtgttgattaaggtgattctcgataagtactatttcctgtgtggtcagcccctacacttcatccccagaaagcagttatgcgacggcgagttagattgccccctaggcgaggacgaggagcattgtgtgaaatcgttcccggagggccctgctgtggcggtccgtctgtctaaggaccgtagtacattgcaggtcctcgacagtgccaccggcaattggttttcagcttgctttgacaacttcaccgaggccctggccgaaacagcctgccggcagatgggttactccagggcagttgaaataggccctgaccaagacctcgacgttgtggagatcacagagaattcacaggagctcagaatgcgtaattcatctggaccttgcttgtccggcagcctggtgtcgctacactgtctggcctgcggcaagagcttaaagacaccacgggttgtgggcgtcgaggaggccagcgttgactcctggccttggcaggtctcgatacagtacgacaaacagcatgtgtgtggcggctctattctggaccctcactgggtactgaccgcagcccactgtttcaggaagcacacggacgtgtttaactggaaggttagagcgggatccgataaacttgggtcatttccatcccttgctgtggccaagatcattattattgagtttaatccgatgtatcccaaagataatgacatcgccttgatgaagttgcagttccctctgacatttagcggaacggtgcgacccatttgcttgccctttttcgacgaagagctcaccccggcaaccccactatggattattggatggggctttacgaagcagaacggtggcaaaatgagtgatatcctgctgcaggccagcgttcaggtgatagacagtactcgctgtaacgctgacgacgcttatcagggggaggtcacagaaaaaatgatgtgcgctggaattccagagggcggagtagacacatgccagggtgactctggcgggcctctcatgtatcagtctgaccagtggcatgtggtgggaattgtgtcctgggggtatggctgcgggggcccctctacacctggcgtctacactaaggtgtccgcatatctgaattggatctacaacgtgtggaaagcggagttgtag

SEQ ID NO: 209377 - DNA, 1308 bp, Artificial Sequence
  Description of Artificial Sequence: Synthetic coding sequence
atggaccccgacagcgaccagcccctgaacagcctggacgtgaagcctctcagaaaaccgaggatccctatggagacatttcgcaaggtgggaattcctattattatagcactactgagtcttgcatcaatcattatcgtcgtggtgctcattaaggtaattcttgacaagtactattttctctgcggtcaaccactgcattttatcccacgcaagcaactatgcgatggagaactggattgtccattgggagaggatgaagaacactgtgttaaaagcttccctgaaggccccgccgtggcagtacggctgtctaaagacagatctacactgcaggttctggattccgccaccggcaactggtttagcgcatgtttcgacaattttaccgaagccttggctgagaccgcatgtcggcagatgggttatagttctaagcctaccttccgcgccgtcgaaatcggaccagaccaggatctcgacgttgtggagattacagaaaattctcaggagttgcgaatgaggaactcctccggcccttgcctgtcgggaagcctcgtgagcctccactgtctggcctgcggcaagagcttgaaaactcccagggttgtgggagtcgaagaagctagcgtcgatagctggccttggcaggtgtccattcagtatgacaagcaacacgtttgcgggggatccattttggatccccattgggtgctgactgctgcacactgtttcaggaagcacaccgacgtatttaactggaaggtccgcgcaggctccgataagttaggatctttcccctcccttgctgtggcgaaaattatcattatcgagttcaatcctatgtaccctaaagataacgatattgccctcatgaaactgcaattcccgctgacattcagcggcacagtgcggccaatctgtttgccattcttcgacgaggaactgacccctgccacacctctctggatcattggatggggattcaccaagcagaatggggggaaaatgagtgacattcttctccaggcgtctgtccaagtgattgacagcacgcgttgcaatgccgatgacgcttatcagggcgaggtgaccgagaaaatgatgtgtgctggaattcctgagggcggtgtggatacatgtcagggagactcaggaggacctcttatgtaccaatcggatcagtggcacgttgttgggattgtgtcctggggctacggttgtggtggaccctccactccaggcgtgtacaccaaagtgagtgcctatctgaattggatctacaacgtttggaaggctgaattgtag

SEQ ID NO: 209378 - DNA, 1374 bp, Artificial Sequence
  Description of Artificial Sequence: Synthetic coding sequence
atgagcctgatgctggacgaccagccccccatggaggcccagtacgctgaagaaggtcctggccccggaatctttcgagctgaaccaggcgaccagcagcatccgatcagccaagcagtgtgctggcgttctatgcgccgcggctgcgctgttcttggggccctaggccttctggccggggcaggcgtgggctcttggctgctggtgctctacctgtgtcccgcggccagccagcccatctctggaacacttcaggacgaggagattacactatcttgctctgaggcgagtgctgaagaggcgctacttccagcactgcctaaaacagtctcctttagaatcaactccgaggactttctgttggaggcccaggttagggatcagccccgctggctgctagtctgccacgaggggtggagcccggccctggggctgcaaatctgttggtcactgggccatctgagacttacgcatcataaaggggtcaacttaactgatattaagctgaatagctctcaggaattcgcacagctcagccccagattgggaggtttcctggaggaggcgtggcagcccaggaataactgcacttccggacaggttgtcagtctgaggtgctctgagtgtggtgctaggccgctggccagccggatcgttggcggccagagcgtagcaccagggcgctggccctggcaagcttcagtggctctgggctttcggcatacttgtggtggatccgtccttgccccaaggtgggtggtgaccgctgcgcactgtatgcacagcttcaggctggcaaggctgagttcttggcgagttcatgctggcctcgtgtcccattccgccgtgcggccacatcagggtgccttagtcgagcggattatacctcaccctctgtactccgcccagaaccatgattacgatgtggccctgctccgtctgcaaaccgctcttaatttttccgacaccgtcggggcagtttgtctgccagccaaagagcaacactttccgaaggggagcaggtgttgggtgagcggctgggggcacacccatcccagccacacctatagttctgacatgcttcaggataccgtagtccccttgttctcaacacaactgtgcaatagcagctgtgtctacagcggtgccttaactccacggatgctttgcgccggatacttagatggaagagccgacgcctgccagggagatagtggaggacccctggtctgccctgacggggacacatggcgcttggttggggttgtcagctggggaagaggatgtgctgaaccaaatcatccgggtgtgtatgctaaagtggctgagtttctggactggatccatgacacagcccaggactccctcttgtag

SEQ ID NO: 209379 - DNA, 2436 bp, Artificial Sequence
  Description of Artificial Sequence: Synthetic coding sequence
atgctgctgctgttccacagcaagcggatgcccgtggccgaggccccccaggtggccggggggcagggcgatggcggagacggcgaggaggcagagcccgaggggatgttcaaggcttgtgaggacagcaagcgaaaggctcgcggttatctgagattagtgcccttatttgtgttgttagcattactagtcttggcgagcgccggtgtgctcttgtggtattttctcggctacaaggccgaggttatggtatcccaggtgtactccggttcattacgcgtgctgaacagacacttctcacaggatctgactagacgggaaagttccgccttccgctcggagaccgccaaggcccagaagatgctaaaagaactcatcaccagtacaaggctggggacatactataacagctcctccgtatattctttcggggaaggcccgctcacatgcttcttttggttcatcctacagattccggagcaccgacgcctgatgctttcacccgaggtggtgcaagcactgctagttgaggaacttctctccaccgttaattcttccgcagcggtcccctacagggccgaatacgaagtcgacccggaagggctagtcatcctggaagcctcggtaaaagacattgcagcgctcaactccaccctgggttgctatcgatatagctacgttggccagggccaagtgctgcggcttaagggccccgaccatctggctagttcttgtctttggcacttgcagggccccaaggacttaatgctcaagctgcggctcgaatggacccttgcggaatgtagggataggcttgccatgtacgacgtagccgggcctctcgaaaaaaggcttatcacatccgtgtacggctgtagccgacaagagcccgtagtcgaagtgctggcaagcggcgccatcatggctgtggtgtggaaaaagggcttgcacagctattatgatcctttcgtgctcagcgtgcaacccgttgtgtttcaggcctgtgaggtgaatttgacgctggataatagattggatagtcaaggagtcctgagtacaccttatttccccagctattattctcctcaaacccactgctcttggcatcttactgtcccaagtctggattacggactagccctctggtttgacgcttatgctctgcggcgccaaaaatacgacctcccgtgcacacagggccagtggaccattcagaaccgcaggctctgtgggctccgaatcctccagccttacgccgaacggatccctgttgtggccaccgctggcatcacgataaacttcacctctcagatcagcttaaccggtcccggagtgcgcgtgcactatgggctgtacaaccagagcgacccttgccccggcgagttcctgtgctcagtgaatggattatgtgttccggcatgcgacggagtcaaagactgtcctaatgggctcgacgagcggaactgcgtgtgccgtgcgacctttcaatgcaaagaagattctacgtgcatttctcttcctaaggtgtgcgatgggcagccagactgcctgaacggctcggatgaagagcagtgtcaggaaggggtgccctgtgggacgtttacttttcagtgcgaagataggagttgtgtgaagaagcccaatccccagtgcgatggccgaccggattgtcgcgatggaagcgacgaggagcactgcgactgcggcctgcagggaccttcaagccggatcgttggaggagccgttagctccgagggcgagtggccatggcaggcaagtctgcaggtgcgaggccgccatatttgcggaggcgccctgatcgctgatcgatgggtcattacggccgcgcattgctttcaggaagacagcatggccagcacggttctgtggactgtgttcctcggcaaggtctggcagaattcccgctggccaggcgaagtctcatttaaggtttctagattactactgcatccgtaccatgaagaggatagccatgattacgacgttgccctccttcagctggatcatccggtcgtcagatcagcggccgtgcgacccgtgtgcctgccagctagatcacacttctttgagcccggattgcattgctggataactggctggggcgcactgagagaaggaggtccaataagcaacgcccttcagaaagttgacgttcagctgattccacaggatctgtgcagtgaggtttataggtaccaggttacacccaggatgttgtgcgccggctacagaaagggcaagaaagacgcgtgccagggggatagtggtggtccacttgtgtgcaaggccctctccgggaggtggttccttgccggcctcgtttcctgggggctgggttgcggcaggcccaactattttggtgtctatacacgcatcaccggcgtgataagttggattcagcaggttgtcacctag

SEQ ID NO: 209380 - DNA, 2475 bp, Artificial Sequence
  Description of Artificial Sequence: Synthetic coding sequence
atgcccgtggccgaggccccccaggtggccggcggccagggcgacggtggcgacggagaagaagctgagccggaggggatgtttaaggcatgcgaggattctaagagaaaggcaaggggttacctgcgtttggttccattgttcgtgttacttgcgttgcttgtattggcctccgcgggcgtgctactgtggtatttcctagggtacaaggccgaagtaatggtttctcaggtgtatagcggcagcctccgggtattaaatcgccactttagccaggacttgaccaggcgcgagagctcggcattccgcagcgagaccgcaaaggcccagaaaatgctgaaggagctgattacatccacacgtcttggcacatattataattcttcctctgtgtactcgtttggcgaaggccctctgacctgttttttctggtttatcttgcagattccagaacaccggaggctaatgctgagccccgaagtggtgcaggccttgttggtggaggaactgctgtctaccgttaattcaagtgcggccgtgccttatagggctgaatacgaagtggatcccgagggtttggtcattctcgaagccagcgtcaaagacatcgccgcgctgaatagtacgctgggttgttatcggtacagctacgtgggacagggacaagtgttacggctgaagggacctgaccacctggcatcatcctgtctttggcatctgcagggccccaaagacttgatgctgaaactccggctggaatggactcttgctgagtgtagagaccgcctggcgatgtatgacgtggctggccctctggagaagcgcctgataactagtgtctatggctgctccagacaggagcccgttgtcgaggtgttggccagcggggcaattatggcagtggtgtggaagaaggggttgcactcctactatgacccattcgtgctctctgtgcaacctgtggtttttcaggcctgtgaggtgaacctcacactagacaatagacttgactcccagggggtgttgtcaaccccttactttccctcctactattcaccacaaactcattgttcgtggcatttgaccgtgccatcattggactacggccttgcactgtggttcgacgcatatgccctcagacgccagaagtacgatctcccctgtacacagggacagtggaccattcagaatcgtagactttgcgggttaaggatactacagccctacgcagagcgtattccagtggtggccacagcaggaatcacgattaacttcactagtcagataagcttgaccgggcccggggtgagagtacactacggattatacaaccaatctgatccatgtccgggcgaatttctatgctccgttaacgggctctgtgtgcccgcctgcgacggggtcaaagattgtccgaatgggctggacgagcgtaactgtgtgtgtagggccacctttcagtgtaaagaggactccacgtgtatatctttacctaaggtatgcgatgggcaaccggactgtctgaacgggtccgatgaggaacagtgtcaagaaggcgtgccctgcgggaccttcacattccagtgcgaggatcgtagttgtgtgaagaaacctaatcctcagtgcgacggccgtccggactgccgcgacgggtctgatgaagaacactgtgactgcggcttacagggcccatcctctaggattgtaggcggagcggtaagctccgaaggcgagtggccttggcaagcaagtttgcaggtgagagggagacatatctgcgggggagccctcattgcggataggtgggtcatcactgcagcgcattgttttcaggaagatagcatggcttctacagtactgtggactgtcttcctcggcaaagtgtggcaaaattcaaggtggcccggggaggtgtcattcaaggtgtccaggctcctactgcacccataccatgaggaagactcacacgattatgacgtggctctactgcagctcgaccatcctgtggtgaggtcagctgctgtcagacccgtgtgcctgcctgcgcgctcacacttttttgaacccggtctgcactgctggataacaggttggggtgcactacgggagggcgccctcagggccgacgctgtagcgctgttctatggatggcgtaaccaagggtccgaaacatgctgttgccccatttcgaatgcactgcagaaagtcgatgtgcagctcatcccgcaggacctttgctcagaagtataccggtaccaggttaccccacgaatgctatgcgcagggtacagaaagggcaagaaggatgcttgccagggcgattcaggaggacccctggtttgcaaagctctaagcggaaggtggtttttggctggccttgtgagctggggactcggttgcgggcgccctaattacttcggagtgtatactcggattaccggcgtcatctcctggattcagcaagtcgtcacttag

SEQ ID NO: 209381 - DNA, 2409 bp, Artificial Sequence
  Description of Artificial Sequence: Synthetic coding sequence
atgcccgtggccgaggccccccaggtggccggcggccagggcgacggaggagacggtgaagaggccgaacctgaagggatgttcaaggcatgcgaggactctaagcgaaaagcccgtggttacctgaggctagttcctctgtttgtgctcctggctctgctggtgctagcctcagcaggcgtgttgctgtggtactttcttggctataaagccgaggttatggtaagccaggtgtacagcgggagtctccgcgtcttgaatagacatttcagtcaagatcttaccaggcgggaaagctctgctttccgctctgaaaccgccaaggcccagaaaatgctgaaagagctcatcacaagtacaaggttaggcacgtattacaattcaagtagtgtgtactcctttggtgagggccccttgacatgctttttctggttcatcttgcaaatcccagaacatcggcgcctgatgctctctccagaagtagtgcaggctctcctggtggaagagctgctgtccaccgttaattcctctgcagccgtgccctacagggccgaatacgaagtggatcccgaaggcctcgtcatcctagaagcttcagttaaggacattgccgccttgaattccacactgggatgctaccgatattcatacgttggccaggggcaagtactcagactgaaggggcctgaccaccttgcctcatcctgtctgtggcacctgcaaggtccaaaagacctcatgttgaagttacgcctcgaatggactctggcagagtgtagagatcgtttagccatgtacgacgtagcgggaccccttgagaaaaggctgattacctccgtgtacggctgctctagacaagagcccgtggtcgaggtgttagcttccggggctatcatggcagtggtctggaaaaagggcctacattcttactatgacccatttgtactctctgtccaacccgtagtctttcaggcatgtgaggtcaacctcaccctggataataggctcgattcccagggcgtactcagtaccccatattttccttcttactactctccgcaaactcactgttcttggcatctaacagtgccatcccttgattacggcctggccctgtggtttgacgcgtatgcactccgcagacaaaaatacgacttgccctgcacacagggacaatggaccatacagaaccggagactttgcggactgaggatactgcagccatacgctgaaagaattcctgtagtggccactgctggtattaccatcaacttcaccagccagatcagtttgacaggtcccggagttcgggtgcattacgggctgtacaaccagagtgatccctgccccggtgaatttctgtgctctgtgaatggcctgtgcgtgcccgcgtgcgacggcgtgaaagattgccctaacgggctcgacgagcgtaattgcgtctgccgggccacctttcagtgcaaagaggattccacgtgtatctctctgccaaaggtttgcgatgggcagccagactgtttaaatggctctgatgaggagcagtgtcaagaaggagttccttgtggaacattcacattccagtgtgaagaccgcagctgcgttaagaagcctaacccacagtgtgatggaaggccagactgtagagacggttcggacgaagaacactgcgattgcggcctgcagggaccctcttcacgcatcgtgggcggtgccgtgtcttctgagggagagtggccttggcaagcctcgctgcaggttagagggcgccatatttgtgggggcgcactgatagcagacagatgggtaatcacagccgcgcactgcttccaggaggatagtatggcatccaccgtcttatggactgtttttctgggaaaggtttggcaaaactcaagatggcctggggaggttagtttcaaggtttcgcgccttcttctccacccctaccatgaagaggattcccacgattacgacgttgcactgctgcaactagatcacccagttgttcggtccgctgccgttcgccctgtttgtcttccagctcgatcacactttttcgaaccaggccttcactgctggatcaccggatggggtgctctgcgcgagggcggccccatttcaaacgcattgcaaaaagtagatgtacaactaatcccgcaggacttatgttctgaggtgtatcggtatcaggtgacacctaggatgctctgtgctggatatagaaaggggaaaaaggatgcgtgtcagggagactccggcggccccttggtttgtaaggctctgtccgggcgatggttccttgcaggactcgtgagttggggattagggtgcggtaggcccaattattttggcgtatacacacgcataacgggcgtaatcagctggatccagcaggtcgtgacctag

SEQ ID NO: 209382 - DNA, 2475 bp, Artificial Sequence
  Description of Artificial Sequence: Synthetic coding sequence
atgcccgtggccgaggccccccaggtggccggcggccagggcgacggtggcgacggtgaggaggccgagcctgaaggcatgttcaaggcttgtgaggacagcaaaagaaaggctcgcggctatctgcgcctggttcctttgttcgtcctactagcactacttgtgctggccagcgctggtgtgctgctttggtactttttgggctacaaggctgaagtgatggtttcccaagtttattcaggcagcctcagggtgttaaatcggcacttttcacaggaccttaccaggcgagagtcctcggccttccggagtgagaccgctaaggcgcagaaaatgttaaaggaacttattacctccacgcgcctcgggacctactacaattcaagtagtgtatactcattcggcgagggccccttgacatgttttttctggtttatcctgcaaattcccgagcaccggcgactgatgctgtcccccgaagtggtgcaggctctgcttgtggaggaactcttgtccacagtgaattctagcgccgctgtgccttatcgagcggagtacgaggtcgaccccgagggcctcgtcattctggaagcttcagtgaaggacatcgccgcattaaattcaacactcggctgctatcggtactcatacgtgggacagggacaggtgttacggctaaagggcccagaccatctcgcaagcagctgtctttggcacctgcaaggacctaaggaccttatgcttaaactccgattggagtggactctcgctgagtgtcgcgatagattggctatgtacgacgtggcaggtccactggagaagaggcttatcacatccgtttacggatgctctcggcaagagcccgtagtagaggtgctcgccagtggtgccatcatggcggtggtgtggaaaaagggccttcactcttactacgaccccttcgtgctgtctgttcagcctgtcgtattccaagcttgtgaggttaacctcacactggataaccggctggactcccaaggggtcctttctacaccatattttccctcttattacagcccccagacgcactgcagctggcacctgacagttccttcattagactatgggctggccttgtggttcgatgcgtacgcgctccgtagacagaagtacgacctcccttgcacccaggggcaatggaccatccagaaccgccggctctgtgggttacgaattctgcagccgtacgcggagcgaatacccgtggtggcaactgccgggatcaccatcaacttcacttctcagatttccctcacaggccccggggtgagggtgcattatgggctttacaatcaatcagatccgtgtcccggtgagtttctgtgtagcgtcaatggactttgcgtacccgcgtgtgatggcgtcaaggattgtcccaatggcctggacgagaggaactgcgtttgccgagccacgtttcagtgtaaggaagattccacgtgcatttcactccctaaagtgtgtgatggacagcctgactgtctcaacggaagcgatgaggaacagtgccaggagggagtgccctgcggaaccttcactttccaatgcgaggatcgatcatgtgttaaaaagccgaatcctcaatgtgacggacggcctgattgtcgcgatggcagcgacgaggaacattgtgattgcgggctgcagggaccctccagcagaatcgtcggcggtgctgtgtctagcgagggggaatggccttggcaagcctctctgcaggtacgcggacgccacatctgcgggggcgctctgatagctgatcggtgggtgattactgctgcacactgcttccaggaagactctatggcttccacagttctgtggactgtgttcctaggtaaagtgtggcagaatagccgatggccaggggaggtgtcttttaaagtaagcagactactcctccacccataccacgaggaggatagtcacgactacgatgtggcactcctgcagcttgatcatccagtcgtccgctctgcagctgtgagaccagtctgcctccctgccaggtcccacttcttcgagcccggtttgcattgctggataaccggatggggcgcactacgcgagggtgccctacgggctgacgccgtcgccctgttctacggatggcgtaaccagggtagcgaaacctgctgctgcccaatctcaaatgcactgcaaaaggtggatgtgcagttgatacctcaggacctgtgttcagaagtataccgataccaggttaccccgaggatgctgtgtgctggctatcgcaaaggcaagaaggacgcttgccagggcgactccggcggtccactcgtctgcaaagcactatcaggaagatggttcctggcaggcctggtaagctggggcttaggctgtggtagacctaattatttcggagtgtacacccgcatcacaggcgttatctcctggattcaacaagtggttacttag

SEQ ID NO: 209383 - DNA, 426 bp, Artificial Sequence
  Description of Artificial Sequence: Synthetic coding sequence
atgcccgtggccgaggccccccaggtggccggcggccagggcgacgggggcgacggtgaggaagcagagccagagggaatgtttaaagcctgcgaagactccaaacggaaggctcgcgggtatctgagactggtgcccctgtttgttctgctggccctacttgtccttgcatcagcaggggtcctcctgtggtacttcctgggctacaaggctgaggtcatggtgtcccaggtgtactccggttccttgagagtgttaaatcggcactttagccaggatctcaccaggagggagagctctgcgttcaggtcagagacagcaaaggcgcagaagatgcttaaagagttgatcacttccaccagactcggaacttactacaattcatcttcagtctactccttcggagaaggtccgctaacttgctag

SEQ ID NO: 209384 - DNA, 1386 bp, Artificial Sequence
  Description of Artificial Sequence: Synthetic coding sequence
atgctgctgctgttccacagcaagcggatgcccgtggccgaggccccacaggttgccggcggacagggagacgggggcgatggcgaggaggctgagcccgaaggaatgtttaaggcgtgtgaagattctaagcgaaaagctcgtggatacctgcgtctagtgcccctctttgtgctgcttgcactgctagttctcgcaagcgccggagtgctactttggtacttcctggggtacaaagctgaagttatggtctctcaggtatactctggatctttgcgcgtgctcaaccggcatttttcccaagacctcactagacgtgagtcgtcagcctttcgatctgagactgccaaggctcaaaaaatgttaaaggaactcataactagcactcggctaggaacctattataatagttcttccgtttacagcttcggggaggggcctctgacttgctttttctggttcatactccaaataccagaacaccgcaggctaatgttatcgccagaggtagtgcaggccctgctggtagaggaactcctctccaccgttaactcctccgcagcagtgccgtatagggctgaatatgaagtcgacccagagggcttagttattctcgaagcgtctgtcaaagatatcgccgcactgaactccacactgggctgctacagatacagttacgtgggccagggacaagtgctgaggctgaagggtccagaccacttggcaagctcttgtctctggcacctgcagggccctaaagacctcatgctgaaactgcgcttggagtggactctggccgagtgtcgcgaccggctagcaatgtacgatgtggcaggacctctggagaagcgactgatcacttctgtgtatggatgtagtaggcaggagcccgtggtcgaggtattagcctctggcgctatcatggcggtggtttggaaaaaaggactgcattcttattatgatcctttcgtgcttagcgtgcagccagtcgtgttccaggcttgcgaagtgaatttgaccctcgacaaccgtctggactcacagggcgttctttccactccctacttcccgtcctattattcaccccagactcactgctcatggcacctcaccgttccgtccctagactacggtctagcattatggtttgacgcctatgcacttagaaggcagaaatatgacttgccttgtacccaagggcagtggaccattcagaatcgccggtaccactttctgtctagcctctggcttcccttcttgccccctccaccctcgctaccttccagcatcgtgactccatcactggaagctcaggtcccgaatcttcggggtgcagccaggggtgcaagtaggggatggggatggtgtcaagcgtgctgcccttag

SEQ ID NO: 209385 - DNA, 1527 bp, Artificial Sequence
  Description of Artificial Sequence: Synthetic coding sequence
atggccagcgccgtgtggggcagcgccccctggtggggcccccccccaccagcgccagctcgtcctctcacagacatcgacttttgttccggagcccagctgcaggaattgactcagctgatacaagagctgggcgtccaggagtcttggtcagacggacctaagcctggagccgatctccttagggccaaagacttcgtgttctctctgcttggcctggtgcatcggcgagatccgcgatttcccccacaggctgagcttctactcctgcgcgggggcataagagagggctcactggacctgggacatgcccccctgggcccctatgcccgtggcccccactacgacgcaggttttacactgctcgtgcctatgttctccctggacggcaccgagctgcagctcgatctagaatcgtgctacgctcaggtttgcctcccggaaatggtatgtgggactccaatcagagagatgtggcaggactgcttagggccgccagtgccaggcgctcgagattctatccaccgcaccgagagcgaggagtcgtcgaaagattggcaaagcagcgttgatcagccacactcttatgtcaccgagcatgaggctccggttagtttggaaaagtccccatccgacgtatccgcatccgaaagcccccagcatgacgttgtggaccttggcagtaccgctcccctgaaaaccatgtcgtctgatgtcactaaggcagcggtggagagtccagttcctaagccaagcgaggcgagagaggcttggcctacactgtgttcggcccaggtggccgcctggttcttcgccacgctggccgccgtggcggaatcgctaattcccgtgccaggggcaccccgcctggtacacgccgcaaggcacgctgggtttaccacggtccttctagccactcctgagccaccacgtcgacttctgttgttcgacttaatccccgtggttagcgtggccggctggcctgagggcgcaagatcccatagctgggcgggcccgcttgccagcgagagcgccagcttttacttggtgccaggcggggggaccgaaaggccatgtgcatccgcttggcaactctgtttcgcccgccaggagttagcacttaaggcccgaatccctgcccccctgctccaggcacatgccgctgcgcaggccctactgaggcctctggttgcaggaaccagagcagcagcaccttacctcctgagaaccttgttgtattgggcctgtgagaggctgccagccttgtatctcgcccgcccagagaacgcaggtgcctgttgcctgggacttctcgatgagttgggaagggtcctggaggccggtactctccctcactactttctaaacggtagacagctgaggactggggatgacagcgccgcgctgttgggcgaactggcgaggctgcgcggagaccctgcacgtgctctgcgagcagcagtcgaggaagccaaagtggccaggaagggaggcggcttggctggtgtcggagggggggcacactag

SEQ ID NO: 209386 - DNA, 1527 bp, Artificial Sequence
  Description of Artificial Sequence: Synthetic coding sequence
atggccagcgccgtgtggggcagcgccccctggtggggcccccccccgcccgccccggcccgccctctgaccgacattgatttctgttcgggcgcgcagcttcaagagcttactcagctcattcaagaactgggggtgcaggagtcgtggtcagatggcccaaaacctggcgctgacctgctcagggctaaggactttgtgtttagcctgcttggtcttgttcaccgacgggatcccagatttccacctcaggccgagctcctgctgctcaggggaggaatccgagaaggcagcctcgatctgggtcatgcccctctgggaccctatgccagaggcccccattacgacgctggatttactttgcttgtgcccatgttcagtctcgacgggactgagctgcagctggatctcgagagctgctacgctcaggtatgcctccctgagatggtttgtggaaccccaataagagaaatgtggcaagactgtctggggccccccgtgccgggagccagggattccatccatcggactgaaagcgaggaatcatctaaagattggcagagtagcgtggatcaaccccatagctacgtcactgaacatgaagcccctgtttctcttgagaaaagtccatctgacgtttctgccagtgaatctccacagcacgacgtggtggatcttgggagcaccgcaccgttaaaaacaatgagcagcgacgtgactaaagcggcggtggaaagccccgtcccaaagccatctgaagcccgggaggcctggccgacactttgctctgcccaagtggccgcctggttcttcgctacccttgccgccgtggctgaaagcctgatccctgtaccaggcgcccccaggcttgttcatgctgcacgccacgcgggattcaccacagtacttctcgcgacccccgaacctccccgacggctcctcctgttcgatctcatcccagtggtcagtgtggccggctggccagagggtgccaggagccactcttgggccggcccgttggccagcgagtcagctagcttctacttagtacctggggggggtaccgagaggccttgtgcctctgcatggcagctttgttttgcacgccaggagctcgctcttaaggcaagaatacctgcgccactgctccaggcccacgctgccgcccaggcgctgctccgccctctcgtggccggtaccagagcagcagccccttacttgctgcgcaccctcttgtactgggcctgtgaaaggctgccagccttgtacttggccagacctgagaatgcaggcgcatgctgcctgggcctgcttgacgagttgggacgcgtgcttgaggcaggaacgttgcctcattacttccttaacggacgtcaactgcgaacaggagacgactccgccgccctcctgggcgaactggctcgactgcgaggcgaccccgcccgggccttaagggctgctgtggaggaggccaaggtagctcgcaagggaggtggtcttgcaggcgttggtggaggcgctcattag

SEQ ID NO: 209387 - DNA, 825 bp, Artificial Sequence
  Description of Artificial Sequence: Synthetic coding sequence
atgggcaagagcctgagccacctgcccctgcacagcagcaaggaggacgcctatgacggtgtaacttctgagaacatgcgcaatggtttagtgaactctgaggtccataacgaggatggccggaacggtgatgtatctcagtttccatacgtggaatttacaggccgagactctgttacatgtcccacctgccagggcaccggtcgcatcccccgtgggcaggaaaaccagctcgtggctcttataccctactcagatcagagactccggcctcgaagaacaaaattgtacgtgatggcctccgtctttgtttgtctgctgttatccggattggcggtgttctttctctttcctcggtccattgatgtgaagtacatcggtgtgaagagcgcctatgtgagctacgacgtgcaaaagagaacgatttatcttaacattacgaataccctgaatatcaccaacaacaactactacagcgtcgaggtggagaacattacagcgcaggtccagttttcaaagacagtgattggcaaagccaggcttaacaacattacaattattgggccccttgacatgaaacagatagactataccgttcctacagtcatcgctgaggaaatgtcttatatgtatgatttctgtaccctgatctcaattaaggtgcataatatagtcctgatgatgcaagtgacagtcacgactacctactttggccactctgaacaaattagccaggaaagatatcaatacgtggattgcggtcgtaatactacatatcaactcggccaaagcgagtacctgaacgtcctgcagccacagcaatag

SEQ ID NO: 209388 - DNA, 825 bp, Artificial Sequence
  Description of Artificial Sequence: Synthetic coding sequence
atgggcaagagcctgagccacctgcccctgcacagcagcaaggaggatgcatacgatggcgttacctccgagaatatgaggaatgggctcgtgaattcggaagtccataacgaagacgggcggaacggggacgtttcccaattcccatacgtcgaattcaccggcagggactcagtgacttgtccaacttgtcaggggacgggccgaataccacgtggacaggaaaatcagcttgtggcactcatcccctatagtgaccagaggctgcgccctcgcaggaccaagctgtacgtaatggcgagcgtattcgtgtgtcttctgctaagtggtttggcggtattctttctcttcccacggtctatcgatgtaaagtacattggagtgaagtctgcatacgtaagttatgacgtccagaaaagaacgatttacctgaacattactaatacactgaacataacaaacaataattactactctgtggaggtcgagaacattaccgcccaagttcagttctctaagacggtgattgggaaggccaggctgaacaacatcactattatcgggcctttggacatgaagcagatcgattacacagtgcccaccgtcatcgcagaggagatgtcttacatgtatgatttctgcacactcatctccatcaaggtacacaacatcgtgcttatgatgcaagtgaccgtgactaccacatacttcggacatagtgagcagatctcacaggagagataccagtacgtcgattgcgggaggaacaccacttatcagctggggcagagtgagtacctgaacgtcttacaaccccaacagtag

SEQ ID NO: 209389 - DNA, 78 bp, Artificial Sequence
  Description of Artificial Sequence: Synthetic coding sequence
atgggcaagagcctgagccacctgcccctgcacagcagcaaggaggacgcgtacgatggtgttacttctgaaaactag

SEQ ID NO: 209390 - DNA, 333 bp, Artificial Sequence
  Description of Artificial Sequence: Synthetic coding sequence
atgggcaagagcctgagccacctgcccctgcacagcagcaaggaggatgcctacgatggcgtgacatccgagaatatgcgcaatggcctcgtcaactctgaggtgcacaacgaggacggccggaatggcgatgtaagccaatttccctatgtggaattcaccgggcgagacagtgtgacctgccccacgtgccaggggacagggcgcatccccaggggccaggagaatcagctggtggctttgattccatactccgaccaaagactcaggcctcgccggaccaagctttatgtgatggccagcgtgttcgtctgcttgctgttgtctgggtag

SEQ ID NO: 209391 - DNA, 369 bp, Artificial Sequence
  Description of Artificial Sequence: Synthetic coding sequence
atgcacggcaccttcgtgatcctgctgcccctgagcctgatcctgatggtgtttggcgggatgactggcttcctgagctttctcctgcaggcttatctgctgctgctcctgaccgggatactctttttgttcggcgccatggttacattagctgggatctctgtgtacatcgcctactcagccgcagccttcagggaggccctgtgtttgctggaggagaaggccctgctggatcaggtggacatctcgtttggctggagcctggccctgggctggatttccttcatcgccgagctgctgaccggggcagccttcttagcagccgcccgtgagctgtccctccgacgcagacaggaccaggccatctag

SEQ ID NO: 209392 - DNA, 570 bp, Artificial Sequence
  Description of Artificial Sequence: Synthetic coding sequence
atgggcctgggcgcccggggcgcctgggccgccctgctgctgggcacgctgcaagtgctcgctcttttgggggccgcccatgaatctgccgcgatggccgagaccttacaacatgtaccctcagatcatactaacgaaacttcaaattcaactgtgaagccccctacaagcgttgccagcgactcttctaacacgaccgtcactacgatgaagccgacagccgcttctaacacaactactccaggtatggtgtcaacaaatatgacttcgacgacgctgaagagtaccccaaagacgacaagcgtgagccagaacacttcccaaatatcaacgtcaactatgacagtgacacacaattccagtgttactagtgctgcttcttccgttacaattaccacgactatgcacagtgaagccaaaaaggggagcaaattcgataccgggtcattcgttgggggaatcgtcctgacacttggggtgctgtcaattctatacatcggctgtaagatgtactacagtagacggggtattagatataggacaatcgatgagcatgacgcaatcatctag

SEQ ID NO: 209393 - DNA, 627 bp, Artificial Sequence
  Description of Artificial Sequence: Synthetic coding sequence
atgggcctgggcgcccggggcgcctgggccgccctgctgctgggcacactgcaagttctggcgctgctcggagccgctcatgagtccgctgccatggcagcctctgccaacattgagaatagcgggttgccgcataattcctctgcaaactctacggagactctgcagcatgttcctagcgatcataccaatgaaaccagtaactctaccgtcaagcctccaaccagtgtggcatcagattcttccaatactacggtgactaccatgaaaccaactgccgcaagcaataccacaaccccagggatggtatcaaccaacatgacatcgaccaccctgaagtcaacccccaagaccacttcagtttcgcagaacacctcccagattagcacatctaccatgaccgtgacacataatagtagcgtgactagcgcagcttctagtgttaccataacaacaactatgcatagtgaggcgaaaaaaggatccaaattcgacaccggttcttttgtggggggtatcgttttgacattgggtgttctgagtattctgtacataggctgtaaaatgtactacagtagacgggggatacggtataggacaatcgacgagcacgatgccattatatag

SEQ ID NO: 209394 - DNA, 588 bp, Artificial Sequence
  Description of Artificial Sequence: Synthetic coding sequence
atggagaaccacaagagcaacaacaaggagaacatcaccatcgtggacatctctagaaagattaaccagttgccggaagccgagagaaacctgctcgaaaatggctccgtttacgtgggtctgaacgcggctctgtgtggactcatcgctaacagtctgtttagaagaattctcaacgttactaaggcaagaattgccgccggcctgccgatggcagggatcccttttttgaccaccgacctcacttacagatgcttcgtcagcttccccctcaacaccggcgacctggactgtgagacgtgtaccatcacaaggagcggtctgaccggacttgtgatcggcggtctgtatcctgtgttcctggcaattccggtcaacggaggcctggcagcccggtatcagtcagccctactgcctcacaaaggaaatatcctgtcttactggatccgcacgtccaaacccgtgttccggaagatgctctttccaatcctgctgcaaacaatgttttccgcctacctcggatctgaacagtataaactgctgatcaaagcccttcagctcagtgagcccgggaaggagatccattag

SEQ ID NO: 209395 - DNA, 378 bp, Artificial Sequence
  Description of Artificial Sequence: Synthetic coding sequence
atggccggcatccccttcctgaccaccgacctgacctaccggtgcttcgtgtcctttccactgaacaccggcgacctcgactgcgaaacctgtactatcaccagaagtggactgaccggcctggtgattggggggttataccctgttttcctggctattccagtaaatggggggctcgcagccaggtaccaatctgcactgttaccacataaggggaatatcctgagttattggatccgcacctctaagccagtctttaggaagatgctatttcccattctgctgcagaccatgttctctgcctacctggggtccgagcaatataagctcctcattaaagctttacagctctccgagcctgggaaggagatccattag

SEQ ID NO: 209396 - DNA, 489 bp, Artificial Sequence
  Description of Artificial Sequence: Synthetic coding sequence
atgctgcagaccagcaactacagcctggtgctgagcctgcagttcctgctgctctcttatgacttgtttgtcaactctttctctgaactgttgcagaagactcctgttattcagctggtgctctttataatccaggacattgctgttctgtttaacatcattatcatcttcctcatgttcttcaacacgttcgtatttcaggctggtctggtgaatttactgttccacaaattcaaaggcacaattatcttaaccgccgtctacttcgccctctcaatatctctgcacgtctgggttatgaacttgcggtggaaaaactccaactcctttatctggactgatgggctgcagatgctttttgtgttccaaaggctggccgctgttctctactgctatttttacaagcggacagctgtccgcctgggagatccacacttctaccaggacagtttgtggctgcgcaaggagttcatgcaggtgcggcgctag

SEQ ID NO: 209397 - DNA, 318 bp, Artificial Sequence
  Description of Artificial Sequence: Synthetic coding sequence
atgctgcagaccagcaactacagcctggtgctgagcctgcagttcctgttgctgtcttatgatctgttcgtcaattcattctctgagcttttgcagaaaacaccagtaatacaactggtcttattcatcatccaagatattgccgtgttgtttaatatcattatcatattcctaatgttcttcaatactttcgtgtttcaagccggactggtgaacctcctatttcacaaatttaagggaacgataattctgactgctgtttatttcgcactgagcatcagtctgcacgtatgggtcatggtgagggtggccgtgtag

SEQ ID NO: 209398 - DNA, 1140 bp, Artificial Sequence
  Description of Artificial Sequence: Synthetic coding sequence
atgccccacagcagcctgcaccccagcatcccctgcccccggggccacggggctcagaaggctgcccttgtgctgctctcagcttgccttgtcactttgtggggattgggggaaccccctgaacataccctccgctatttggtgctccacctcgccagtctgcagctggggttgctcttaaacggtgtttgcagcctggcagaagagctgcgacacatccactcacggtacagagggagctactggaggaccgtcagggcctgcctgggttgccctctgaggcggggtgcattattgctgctcagcatctatttttactactccctccccaacgcagtcgggccacccttcacctggatgcttgcacttttgggcctctctcaggccctgaatattctcctaggcctcaaagggttagcccctgccgagatctcagccgtgtgcgaaaaaggcaattttaatgtggcacatggcttggcatggtcctactacatcggctacctgagacttatactgccggaactccaagcgcggattcggacttataatcaacactataacaatctgttaagaggggccgtgtcccagcggctctacatcttactgcctctggattgcggcgtgccagacaatctgtccatggcagaccctaatatccggtttctcgacaagctgccgcaacaaaccggagaccatgctgggatcaaagaccgcgtgtactcaaacagcatctatgaattactggagaacgggcagagagctgggacatgcgtcttggagtacgctacacccctacagactctttttgcaatgtctcagtatagccaggcaggattctctcgggaagacagactggagcaagccaagctattctgccgaactctggaggacatcctggctgacgcccctgagtcacaaaacaattgcaggctgatagcttaccaggagccggccgatgattcatccttcagtctctcccaagaagtcctccggcacctcaggcaggaagagaaagaggaggtcaccgtcggtagcctaaagacctctgcagttccaagcacatcgacgatgtctcaggagcctgagctacttatcagtggaatggagaagccattgccactcaggaccgatttctcctag

SEQ ID NO: 209399 - DNA, 762 bp, Artificial Sequence
  Description of Artificial Sequence: Synthetic coding sequence
atgccccacagcagcctgcaccccagcatcccctgcccccggggccatggggcccagaaagccgccttagtgctactgtctgcttgtctggtgactttgtggggcttgggtgaaccccctgaacatactctgcggtacttagtcctccaccttgcctctctccagttgggcctccttctcaacggagtctgctctttggcggaagaactgcgacatatccatagccgctatagaggtagttactggaggacagtgagggcttgcctcggctgtccgcttagacgaggagccctcctgctcctgagcatttatttctattactcactccccaatgctgttggacctcccttcacttggatgctcgcgttactcggcctgagccaggcactgaatatactgttgggtctgaaagggttggcacccgccgagatcagtgccgtgtgcgaaaaggggaactttaacgtagctcatggcctcgcatggagctactacattggatatttgagactgatcctgcccgagttgcaagctcgcatcagaacttataatcagcactataataaccttctcagaggtgctgtgagccaacgactctatattttactgccgctggattgtggagtgcctgataatctctcaatggcagacccaaatattcgattcctggacaagctgcctcagcaaactggggatcacgctgggatcaaagatcgtgtgtattcaaattctatatatgaactgctcgagaatggacaacgctag

SEQ ID NO: 209400 - DNA, 423 bp, Artificial Sequence
  Description of Artificial Sequence: Synthetic coding sequence
atgcccagcgccttcagcgtgagcagcttccccgtgagcatccccgctgtgctgacacagactgactggacagaaccctggttaatgggattagctacattccatgcactctgtgttctcttaacatgcctgtcaagtcgttcttacaggctgcagatcggccactttttgtgcctagtgatccttgtatactgcgctgagtatatcaacgaagcagccgctatgaattggagactgttcagcaagtatcagtacttcgacagtaggggcatgttcattagtattgttttctcagccccgctgctggtcaacgccatgatcatagtggttatgtgggtctggaaaactttgaacgtgatgactgatctgaaaaatgcccaggagagacgaaaggagaaaaagagacgccgcaaagaagactag

SEQ ID NO: 209401 - DNA, 384 bp, Artificial Sequence
  Description of Artificial Sequence: Synthetic coding sequence
atgctgagcggctacctgcagaccgactggaccgagccctggctgatggggctggccacatttcatgcactgtgcgtgctgttgacctgtttatcatctcgatcatatcggctgcagattgggcatttcctttgtcttgtcattctggtttactgtgcagaatacatcaatgaggcggcggcaatgaactggcggctgttcagtaaatatcagtattttgatagtaggggtatgttcatttcgatcgtgttctcggccccgctccttgttaacgctatgatcattgtcgttatgtgggtgtggaagaccttgaacgtcatgacggacctcaagaatgcgcaggaacgtcggaaggagaagaagcgccgccgcaaagaggactag

SEQ ID NO: 209402 - DNA, 1560 bp, Artificial Sequence
  Description of Artificial Sequence: Synthetic coding sequence
ggccccgcccagcgggccagcagccccatccccagcgccggccggcgcgaaggggcccaagcggccacacagcgagtagagcgtcgtgaccgagaccctgggggctgtgcagcatggactccctccacgctcccacttagccccagaagtgctgcgtcgagttccacttgcgccggggggtgcggtaaaaggacagcaagcagtaggcgcactagtcggccatctaggatgacagcaactaccggccccaaggtgatccagacgtcagccgccaacttcagtctcaataattcaaaaaaactcaaacccatacagatactttctaacccactttctacgtacaatcagcagctctggcttacttgcgttgtagaattggaccagtccaaggaaacctccattaaaaccagctttcccatgaccgtgaaagtggacggagtggctcaggacggcaccaccatgtacatccataataaagtgcataatagaacacgaaccctgacgtgcgccgggaaatgcgccgagatcatcgtggcccacctcggctatttgaactatacacaatatactgttatagtggggtttgagcacttaaaacttcctattaagggaatgaactttacatggaagacatacaacccagcttttagtagattagagatatggtttcgcttcttttttgtagttctcactttcatagtcacttgtctctttgcacatagcctccggaagttctctatgagggactggggcattgaacagaaatggatgtcagtgcttttgcccctgttgctgttgtacaacgacccattttttccacttagttttttggttaattcttggttgccaggaatgttggacgatctttttcagagcatgtttctgtgcgctcttttgttgttctggctatgcgtgtatcacggaatcagagtgcagggcgagaggaagtgtctgactttctacctgcctaagttctttattgttggactcctgtggttggcaagcgtgacactcggaatttggcagacagtcaacgaactccacgatcctatgtaccagtatagggtcgataccggcaacttccaggggatgaaagtgttttttatggtcgtggccgccgtatacattctttatctgctcttccttatcgtacgagcctgttctgagctgagacacatgccctatgtcgatctgcgtctgaaatttctgactgcacttaccttcgtagtgcttgtcatcagtatcgctattctgtacctaagatttggagcacaggttttgcaagacaatttcgtggctgaattgagtactcactaccaaaagcccgctgagttcctgtcattctacggattgctcaatttttacctgtacaccttagctttcgtttactctccctccaagaacgccctttacgaatcccagctgaaagataacccagcattttcaatgctgaacgactccgacgatgatgtcatctacggtagcgactatgaggagatgcctctgcaaaacggccaggctattcgtgcaaaatacaaggaggagagcgacagcgattag

SEQ ID NO: 209403 - DNA, 1839 bp, Artificial Sequence
  Description of Artificial Sequence: Synthetic coding sequence
atgggcgccgcccccagccccacccaggccagcagccggggcggcggccctggcccccccgccccgacccgggcagtttccagttcatcgcgggctcgaggtggggctctgagcgcactaggaccgagcccggctcgtccactgacaactagtcctgctcccgctccaccacctcggtcaaggcccgccagacagcagccggacccccagtgttgggaaaagcgcggcggagccggaggtgacactaagggcggagccgccggaccaggcccggggcgccttcgggggatggacgcagaatatccggcattcgaaccccccctgtgctctgaacttaagcacctttgtcgcagactcagagaagcctacagggagctaaaggaagacctcacccccttcaaggatgatcgctactaccgactcgccccgatgagactgtataccctgagcaaacgccactttgtgctagtgtttgtggtgtttttcatctgttttggcctgacaattttcgtagggattaggggccccaaagtgatccagaccagcgcggctaacttctcactcaataacagtaaaaagctaaaacctattcaaatcctatccaacccactgagtacttacaaccagcaactttggctgacgtgcgttgtggaactggatcagagtaaggagacaagcatcaaaacatcctttccaatgactgtcaaggtggatggcgtagcccaggacggaacaactatgtatatccataacaaggtccacaacagaacaaggactctcacctgtgccggtaaatgcgcggagataatcgtggcacacctcggatacctgaactatacccagtacactgttatcgtaggatttgagcaccttaaattgcctatcaaggggatgaacttcacttggaagacctataacccagccttttctcgtctggagatctggttccgcttcttctttgtggtccttacatttatcgttacctgtctcttcgctcatagtctgcgtaagttctctatgcgcgattggggcattgagcagaaatggatgtccgtgttgctccccctcctcttgctgtacaacgatccatttttccctctttcattcttggtgaacagttggctgcctggcatgctggacgacctgtttcaaagcatgttcctttgtgctctgttgcttttttggctgtgcgtctaccatgggataagagttcagggcgaacggaagtgcctgacattttacttacccaaattcttcatcgttggactgttgtggctcgcatcagtaaccttaggcatctggcaaaccgtcaacgaattgcacgatcctatgtaccagtacagagttgataccggaaattttcagggtatgaaagtgtttttcatggtcgtagccgccgtttacatcttatacctcctctttcttatcgtacgggcatgctccgagttacggcacatgccgtacgttgatttgagacttaagtttctgactgccttgacttttgtggttctagtgatttctattgccatactgtatctgagattcggtgcccaagtgttgcaagacaattttgtggcagagctgtccacgcattaccagaacagcgctgaattcttaagcttttacggccttctgaatttttacctctacacactggcattcgtgtattcaccgagcaagaacgcactgtacgaatcgcagctaaaggataaccctgctttctcaatgctgaatgactctgatgacgatgtcatctacgggagtgattacgaagagatgcccctccagaacggtcaagccattagggctaagtacaaggaagagtcagactcagattag

SEQ ID NO: 209404 - DNA, 1317 bp, Artificial Sequence
  Description of Artificial Sequence: Synthetic coding sequence
atgccctgcacctgcacctggcggaactggcggcagtggatccggccactggtggctgtgatttaccttgtgagcatcgtggtggccgtaccactctgtgtctgggaacttcagaaactggaagttgggatccacactaaggcttggttcatagctggcatctttttgctcctgacaatcccaattagcctttgggtcatcctgcagcacttggtccactacactcagccggaactccaaaaacccatcattcgcatcctctggatggttccgatttactcgctggatagctggattgcccttaaatacccagggatcgctatttatgtggacacttgccgggagtgctacgaggcctatgtaatatataattttatggggttcctgaccaactaccttacaaatcgctaccctaacctggtactcattcttgaggcaaaggaccagcagaagcactttccaccactgtgctgctgcccgccgtgggccatgggtgaagtcctgctgttcagatgcaagctgggagttttgcagtacactgtcgtgagacctttcaccaccattgtggcacttatctgcgaactcctgggaatttatgacgagggcaacttcagcttttccaacgcgtggacatatctagtaataataaacaatatgtctcagctgtttgccatgtattgtttgctgttattctataaggtgctgaaagaagaattatctcccattcaacctgtcggcaagttcctctgcgtgaagttggtcgtgtttgtttccttttggcaggccgtggtgatcgcccttctggtgaaagtgggggtgatcagcgagaaacatacctgggaatggcagacggtggaagccgtagctaccgggctgcaagacttcatcatatgcatcgagatgtttctggccgcgattgcacatcactacacctttagctacaagccctatgtgcaggaggcagaggagggcagctgcttcgatagcttcttggctatgtgggacgtgagtgatattagggacgacattagcgaacaagtgcgccatgtgggcaggactgtgcgaggccacccccgcaagaagcttttcccggaggaccaagatcagaatgaacacaccagcctgctgagttcctcatcccaagacgctatttcgatcgcctcatcgatgccccctagtcctatgggtcactaccagggtttcggacacacagtgacgccacagacaactccaacaacggccaagatttcagacgagatcctttccgataccatcggggagaagaaggaaccttcagacaaaagtgtagactcctag

SEQ ID NO: 209405 - DNA, 4152 bp, Artificial Sequence
  Description of Artificial Sequence: Synthetic coding sequence
atgtacgccaccgacagccggggccacagccccgccttcctgcagccacagaacggcaattcacgacatccgtctgggtatgtgcccggcaaggtggtgccacttaggccacctccaccccccaagagccaagctagtgctaaattcactagcattagacgcgaagacagggccacttttgctttttcacctgaagagcagcaagcgcagagggagtcacagaaacaaaaaaggcacaagaatacattcatctgcttcgccattacatcatttagtttctttattgccctggcaataattctggggatctcctccaaatacgcgcccgacgagaactgtccagatcagaacccacgtcttcgcaactgggatcccgggcaggattccgccaaacaggttgtgataaaggaaggggacatgctgagactcacatccgatgccacagtccatagcatagtgatccaggacgggggcctactagtgtttggcgataacaaggatggctcgcggaacataacgttgaggactcactacattctgatccaagatgggggcgcactgcacattggtgccgagaagtgccggtataagagtaaagccacaatcaccctttatgggaagagtgatgagggcgaatctatgccaacctttggcaaaaagttcatcggggttgaagctggcggaactctggagctgcatggagccagaaaggctagctggactttactggcccggacactcaactcgagcggcctcccttttgggtcctatacctttgagaaagatttctctcggggcttgaacgtgagagtcattgatcaggataccgcaaaaatactggaatccgagaggttcgacacccatgaataccgcaacgagtctcgccgacttcaggagttcctgcggtttcaggacccgggcagaattgtcgctatcgctgtcggagactctgccgccaagagccttttgcaggggaccatccagatgattcaggaaagactgggatcagagctgatccagggactgggatacaggcaagcttgggccctcgtaggagtgattgacggggggtctacttcatgtaatgagagtgtcaggaattacgaaaaccatagttcaggagggaaagctctcgctcagagagagttctacaccgttgacgggcagaagttctcggtcacggcttattctgagtggatcgagggcgtttccctatctggattcagggtggaggtcgttgacggagtcaagctgaatctgctcgacgatgtatccagttggaagccaggagaccaaatcgtggtcgcttctacagattattcaatgtatcaagctgaggagtttacccttctgccctgttcagagtgcagtcattttcaggtgaaagtaaaggagacaccgcagttcttacatatgggtgagattattgatggggtggacatgagggccgaggttgggatactgacccgcaacatcgtgatccagggggaggtcgaggactcttgttatgctgagaatcagtgtcagtttttcgactatgacacattcgggggtcacattatgatcatgaagaatttcaccagtgtgcatctgtcgtacgtcgaacttaaacatatggggcaacagcaaatgggtcgatatcccgtccactttcatctgtgtggggacgttgactacaaagggggttatcgacacgccacatttgtggacggcctgagcatacaccacagcttctctaggtgcatcactgtgcatggcaccaacggcctgctcattaaagacacaatcgggtttgatacactgggccattgcttttttctggaggacggcatcgagcagagaaacacactctttcacaatctggggctgctgacaaagccaggaacccttttgccaaccgatcggaacaattccatgtgtactaccatgcgcgataaagtcttcgggaattacattcctgttccagctacagattgtatggccgtttctacattttggatcgcacacccgaacaacaacttgatcaacaacgccgcggcgggttctcaggatgccggaatctggtacctgtttcacaaggagcccactggagagagcagtggactgcagctgctggctaaacccgaactgactcccctgggaatcttttataataatagggtgcattctaattttaaggcgggacttttcatcgacaagggggtcaaaaccactaactcttccgcagccgaccccagggagtatctgtgtctcgacaactcggcgaggtttcggccccatcaagacgccaacccagagaaacccagggtggccgccctaatagacagactcatcgcctttaagaataatgacaatggcgcctgggtccggggaggcgatatcatagtccaaaacagcgcatttgcggacaatggaataggcctgacttttgcatcagatggttcattcccatcggatgaaggtagctctcaggaggtcagtgaaagcctcttcgtcggagaaagccgcaactatggctttcagggcggccagaacaagtatgtagggactggaggcatcgatcaaaagccaaggacacttccccgaaatagaacatttcctattagaggatttcagatttacgatggcccaatacatcttacccggagcactttcaagaagtatgtgccaacacccgacaggtactctagtgccatcggctttttaatgaagaactcgtggcagatcactccacggaataatatctcattggtcaagttcgggccccacgtttctctcaatgtgttcttcgggaaaccagggccttggttcgaagactgcgagatggacggcgataagaattcgatattccacgacatagatgggagcgtcactggatacaaggacgcgtatgtgggaaggatggacaactacttaataaggcaccccagctgcgtgaacgtttctaagtggaacgcagtcatctgcagcggcacttatgcacaggtgtatgtccagacttggagcactcaaaacctgtcgatgacaataacaagagacgagtaccccagcaaccctatggttctcaggggtatcaatcagaaggccgccttcccacagtaccagcccgttgtgatgctggaaaaaggttatacaattcactggaacggcccagcacccagaaccaccttcctgtacctggtcaactttaataaaaatgactggatacgggtcggcctgtgttacccctcgaacaccagtttccaggtcacattcgggtaccttcagcgtcagaatggaagcctctctaagatcgaagagtacgagcccgttcacagcctcgaggaattgcagagaaagcaaagcgaacggaaattttacttcgactcgagcactgggctcctgttcctgtatttaaaggccaaaagtcaccggcacgggcattcttattgcagttcccagggatgtgaacgcgtgaagatccaggccgctactgatagtaaagacatttcaaattgcatggcaaaggcttaccctcaatattaccgcaaacccagtgttgttaagaggatgccagcaatgcttaccggactgtgtcagggatgcggtacacggcaggtagtatttacctcggacccacataagtcatacctgccggtgcagttccagtctcctgacaaggcagagacccagaggggggacccatctgtaatcagcgtgaacggtacagactttactttcagatccgccggtgtgctcctgcttgtagttgacccatgctcagtgcctttcaggctaaccgagaaaaccgtgttccctctggcagacgtgtcaaggatcgaagagtatctcaagaccggcattccccccagatccattgtgttgctgtctactaggggcgagattaagcagcttaatatctcccacctgctggtgcctctcggcctggccaaaccggctcatctgtacgacaagggatccacaattttcctggggttctcaggaaattttaaacccagctggacgaagctgttcacatcacctgcaggccaagggctcggtgtgcttgaacagtttattcccttgcaacttgatgaatacggatgtcctagggccaccacagtccgccgtcgagacctagagctcttgaaacaggctagtaaggctcactag

SEQ ID NO: 209406 - DNA, 3963 bp, Artificial Sequence
  Description of Artificial Sequence: Synthetic coding sequence
atgtacgccaccgacagccggggccacagccccgccttcctgcagccacagaacggcaacagccggcatccaagtggctatgtccccgggaaggtggtgcccttgaggcccccaccgccgccaaaatcccaggctagtgcgaagtttacctctatccgccgcgaggatagagctacttttgctttctctcccgaagaacagcaggcccagcgcgaatctcagaaacaaaagcggcataaaaacacctttatttgcttcgccatcacctccttttcattctttatcgcccttgctatcatcctgggcatcagttctaagtatgctccggacgagaattgtcctgaccagaatccgcggctgagaaattgggacccgggacaggatagcgccaaacaagttgtgatcaaggagggagatatgctgagactgacgagcgacgccacggttcattccatcgtgattcaagacggcggattacttgtgtttggagacaacaaggatggaagccgtaatattacgttaaggacccactacatcctgatccaggacggaggcgccttgcatattggggctgagaagtgcaggtacaaatccaaagctaccatcaccctgtacggtaagtctgatgaaggtgagtccatgcccacctttggcaagaagtttatcggcgtcgaggccggcggcactctggaacttcacggtgcacggaaagccagctggactcttcttgctagaaccttgaactcatcagggctgcctttcgggagctacacatttgaaaaggattttagtcgggggttgaatgttagagtaattgaccaggataccgccaaaatactcgaatcagagcggtttgacacacacgagtaccgaaacgaatcacgcaggctgcaagagtttctccggttccaggatccagggagaatcgtagcaatagccgttggcgatagtgcggccaaatcacttctccagggtaccatccagatgatccaagaaaggctgggatctgagttaattcaaggcctgggatacagacaggcctgggctctcgtcggggtaattgatggaggatctactagctgcaacgaaagcgtgcggaattatgagaaccattcctcaggaggaaaagctctcgcccagagggagttttacactgtggatgggcagaagttttccgttacagcctactctgagtggatcgaggaaactcctcaatttcttcacatgggcgaaatcatcgatggtgtagatatgagggccgaggtcggtatcctaactcgcaacatcgtgattcagggggaggtggaggacagttgttatgctgagaaccagtgccagttcttcgactatgatacctttgggggtcatattatgatcatgaaaaacttcacatctgtgcacttatcatacgttgagctgaagcacatgggtcagcaacagatgggtcgctatcccgtgcactttcatctgtgtggtgacgttgattataagggcgggtataggcacgctaccttcgtggatggactgagcatccatcactcctttagccggtgtattaccgtacatggcacgaacggtctgctaattaaggacaccattgggttcgatactctgggacattgcttcttcctcgaagacggcattgagcagaggaacacgctgttccacaacctggggctcctgacaaagcctggcacacttctgccgactgaccgcaataattcgatgtgtactactatgcgggataaggtctttggaaactatatccccgttccagcaacggactgcatggcagtgtcaactttctggattgctcaccctaacaacaacttgatcaacaatgctgccgctggcagtcaggacgccggcatctggtacctgtttcataaagaacccactggagagagctctggtcttcagttgctggcaaaacccgagctcactccacttggtatattttacaataaccgagtgcatagtaatttcaaggccggcttattcatcgacaaaggtgtgaagacaaccaatagttctgctgctgatcctcgagagtatctttgcctcgacaattccgcacgtttccggcctcaccaggacgctaaccctgagaaacctcgagtggctgctttaatcgatcgcttgattgcattcaagaacaatgacaacggcgcttgggtgagaggcggggatatcattgttcaaaactctgctttcgccgacaatggcatcggcctgacgtttgcttctgacgggtcattcccttctgatgagggatcttcccaggaagtatcagaatctcttttcgtgggggaaagtagaaactacggcttccagggaggacagaacaaatacgttggcaccggaggaattgaccagaagccacgcaccctgccccggaatcgcacttttcccattaggggtttccagatttacgatgggccaatccaccttactcgttcgactttcaagaagtacgtgcctactcccgatagatattcatctgcaatcgggttcctaatgaaaaactcatggcagatcactccccggaacaacattagtctggtcaagttcgggccccacgtatcccttaacgtgttttttggaaagcctggcccctggtttgaggactgcgagatggacggggacaagaactcgatctttcacgacatagacgggtctgtgaccggctataaggatgcatacgttgggcgcatggacaattacttaatccgacacccctcctgtgtcaacgttagcaaatggaatgccgtgatatgctcagggacctatgcccaggtgtacgtacaaacatggtccactcagaacctgtcgatgaccattacacgagatgagtatcccagtaaccctatggtgctcagaggtattaatcaaaaggccgctttcccccaataccagcctgtagttatgctggagaagggatacacaatccactggaacggcccggcacctcgtaccacctttctctacctggttaattttaacaaaaatgactggatccgcgttgggctgtgctacccatctaataccagtttccaggtgacctttggatacctacagaggcaaaacggctcactctccaagatcgaagagtacgagcccgttcactcactggaggaattacagcgcaagcagtctgaacggaaattttactttgacagcagcacaggtctgctttttctatacctgaaggctaagtctcaccgacatggacactcctactgttctagccagggctgtgaaagggtgaaaatccaagccgcgacggacagcaaagatatatctaactgtatggcgaaggcttatccacagtactatcgcaaacctagtgtcgtcaagaggatgccagcaatgctgactggcttgtgccagggatgcgggacccggcaggtggtcttcactagcgaccctcacaagagctacctaccggtacagtttcaatctccagataaggccgaaacccaacgaggggacccatcagtgatctccgtcaatggcacggacttcactttccggtcagccggtgtgcttttgctcgtggtggacccatgttcggtgccatttcgtttgacagaaaaaactgtatttccgctggctgatgtctccaggatcgaggaatacctgaagaccgggatccctccacggagcattgtcctcctgtctactaggggggaaattaagcagttgaacatctctcacctacttgtccccctgggcctcgctaaacccgcccacctgtatgataaaggcagcacaatctttttgggcttctcagggaatttcaaaccgagctggacgaagctgttcacctcccctgctggccaaggccttggagtgcttgagcagttcatcccactgcagctggacgaatatggttgtcctagagcaacaaccgtgagacgccgggatctcgagctactgaaacaggcaagcaaagcccactag

SEQ ID NO: 209407 - DNA, 1131 bp, Artificial Sequence
  Description of Artificial Sequence: Synthetic coding sequence
atgaccatcacccgggacgagtaccccagcaaccccatggtgctgaggggaattaaccaaaaagctgcctttccccaataccagcctgtagttatgctggaaaaaggctatacaatccactggaatgggccagctcctaggaccacatttctttacttggtcaatttcaacaagaacgattggattcgcgtgggcttgtgttatcctagtaacacatcattccaggtgacatttggctacctccagagacagaatggctctttaagtaagatcgaagaatatgagcccgtgcacagcctcgaggaacttcagcgcaagcagtcagaaagaaagttttactttgactcttctactgggctgctcttcctgtatcttaaggccaagtcccaccgacacggtcactcctactgctctagccaggggtgcgagagggtgaagatccaggctgcgacggactccaaagatatcagcaattgtatggcaaaggcatatccgcagtactacaggaagccgagtgtggtgaaaagaatgcctgccatgttgaccgggctgtgccaggggtgcggtacaaggcaggtcgtgttcacttcagaccctcacaaatcctatctgcctgtgcaattccagagcccagataaagccgagacccagcgaggcgatcctagcgttatctccgtaaacggcaccgattttacattccgttccgccggcgtcttgctgctagtcgttgatccttgcagcgttccctttaggctgaccgaaaagaccgtctttccattagccgatgttagcagaatcgaggagtaccttaaaactggaataccaccccgctctatcgtgctcctaagtacgaggggggagatcaagcagctcaacatctcccatttgctcgtgcccctcggcctggcaaaacccgctcatttgtacgacaaaggcagtacaatcttcttgggttttagcggcaattttaagcccagctggaccaaactcttcacttctcctgcaggacaaggacttggggtgctagaacagttcattccactccagctggatgagtatggatgcccccgagcaaccaccgttcgcagaagggatctcgagctgctgaagcaagcctcaaaagctcactag

SEQ ID NO: 209408 - DNA, 57 bp, Artificial Sequence
  Description of Artificial Sequence: Synthetic coding sequence
atgtacgccaccgacagccggggccacagccccgccttcctgcagccacagaattag

SEQ ID NO: 209409 - DNA, 570 bp, Artificial Sequence
  Description of Artificial Sequence: Synthetic coding sequence
atggaggagggcggcaacctgggcggcctgatcaagatggtgcacttactcgtcctgagcggggcttgggggatgcagatgtgggtgacattcgtgtccggttttctgctgtttaggagccttcctcgccacacctttggactggttcagtcaaaactatttcctttctacttccatatcagcatgggatgtgcctttataaatctctgcatactcgcaagccaacacgcctgggcacaactgacattctgggaggcctcacagctgtaccttctgtttttatcactgaccttggcaaccgtaaacgcacggtggctggagcccagaaccaccgcagccatgtgggctttgcaaacagtggaaaaagagaggggactgggcggtgaggtaccaggctcccatcagggcccggacccttataggcagttacgcgaaaaggatcccaagtacagcgccctaagacagaatttcttccggtatcacgggctgagctccctttgtaacctgggctgtgtcttatccaatggtctctgcttagccggcctcgcgcttgaaataagatcattgtag

SEQ ID NO: 209410 - DNA, 570 bp, Artificial Sequence
  Description of Artificial Sequence: Synthetic coding sequence
atggaggagggcggcaacctgggcggcctgatcaagatggtgcacctgctcgttctgtctggagcttggggcatgcagatgtgggtgacatttgttagcggcttccttctgttccggagtcttccgaggcacacttttgggcttgtgcagtcgaagctgtttcctttctacttccacatttctatgggctgtgcttttattaacctctgtatacttgctagccagcacgcttgggcccagctgaccttttgggaagcatcacagctctaccttctgtttttgagccttacattagccaccgtgaacgcccggtggttggagcctcgcacgaccgccgctatgtgggcattgcagactgttgaaaaggagcgcggcctggggggcgaagtgcccggcagccaccaaggccccgacccgtaccgccagctgagagagaaggatcccaaatattctgctctcagacaaaacttttttaggtaccacgggttgtcctcactatgcaatcttggctgtgtgctctccaacggcctttgcctggctggactggccctggagatcagatccttgtag

SEQ ID NO: 209411 - DNA, 570 bp, Artificial Sequence
  Description of Artificial Sequence: Synthetic coding sequence
atggaggagggcggcaacctgggcggcctgatcaagatggtgcacctgcttgtcttgtctggggcctgggggatgcagatgtgggtgacattcgttagcggctttctgctgtttcgctcactgcccagacacacctttgggctcgtgcagtcaaagctcttccccttctatttccatatcagcatgggatgcgcttttatcaatctgtgtattctcgcgtcccagcacgcctgggcccagctcacattttgggaagcatcgcaactgtacctgctgttcctgtccctgactctcgccaccgttaacgctagatggttggagccacggactacagcagccatgtgggcacttcagactgtcgagaaggaaaggggcctgggaggagaggtccccggaagccatcagggaccagacccctacaggcaacttcgcgaaaaggaccccaaatattctgcgttgcgccagaacttcttccgatatcacggactctcatccctctgtaatttggggtgcgttctctcaaatggtctgtgtctggctggcctagccttggaaattcgatccctatag

SEQ ID NO: 209412 - DNA, 447 bp, Artificial Sequence
  Description of Artificial Sequence: Synthetic coding sequence
atgctgccccggggcctgaagatggccccccggggcaagcggctgagctctactcccctcgagattcttttcttcctgaacggttggtacaatgccacctacttcctcttggaactgttcatattcctatacaagggtgtgctcctaccttatccgactgctaatctcgtgcttgacgtggtgatgctcctgttatacctcgggattgaggtcatacgactgttttttggtaccaaggggaatttatgccagagaaagatgccattaagcatcagcgttgccctgacattcccaagtgcaatgatggcaagctactacctgctgctgcagacatatgtgctgcgactggaagccattatgaacggtatcctcttgtttttttgcggctcggagctccttctcgaagtcctgacgctggctgccttttctagcatggatagaatttag

SEQ ID NO: 209413 - DNA, 438 bp, Artificial Sequence
  Description of Artificial Sequence: Synthetic coding sequence
atgctgccccggggcctgaagatggccccccggggcaagcggctgagcagtactccactggaaatcctgtttttcctgaacggctggtacaacgcaacctattttctgcttgagctcttcatctttctgtacaagggagttcttttgccctacccaactgccaatctggtgctggacgtagtgatgttgctcttatatctcggtatcgaggtgatcaggctgtttttcggtacgaaggggaacctgtgccagaggaaaatgccactgagtatcagtgtcgctttaacattcccctctgctatgatggccagttattatctgctcctgcaaacttacgtgctccgattggaggccatcatgaatgggattctgctgttcttttgcggctcggagctgctccttgaagtgctgactttggcagcctttagccggatctag

SEQ ID NO: 209414 - DNA, 942 bp, Artificial Sequence
  Description of Artificial Sequence: Synthetic coding sequence
atgcggaccgacagcggcgcccggctggaggagggccacctgcggcccccgcgcgcactgccccctgtcccttctatcgatgatatcccgctgagtagaccgaagaaaaaaaaaacccagcccgccgaactgcaatatgccaacgaactgggagtagaagacgaggatatcattaccgatgaacagactaccgtcgagcagcagtctgtgtttaccgctcccaccggcatctcacagcctgtaggaaaggtgttcgtcgaaaagagcaggcgatttcaggctgccgatcgcagtgagctgatcaaaaccacagaaaatatcgacgtgagcatggacgtaaaacctagttggactacacgggacgtcgcattaactgttcatcgggcattccggatgattgggctgttttcacatggcttccttgccggctgtgcagtctggaacatcgtggtgatttacgtgctagctggggatcagctgagcaatctctcaaaccttctgcaacagtataagacactggcgtatcctttccagtcactactctatctcctcctcgctctgtccacgattagtgctttcgaccgcattgacttcgccaagatcagtgtggcaatccggaattttttggccctggatccaaccgctctggcatcatttctgtatttcacagccctcattctctctttgagtcagcaaatgacaagtgatcgtatccatctttatactccttcctccgtgaatggctccctctgggaggcagggatcgaggagcagatattgcagccttggattgtggtgaatcttgtcgtggctcttctcgtcggcctgtcgtggctgtttctctcgtataggcccggcatggacctgtccgaggaacttatgttttcttctgaagttgaggagtaccctgacaaagagaaggaaatcaaagcctctagttag

SEQ ID NO: 209415 - DNA, 1203 bp, Artificial Sequence
  Description of Artificial Sequence: Synthetic coding sequence
atgggcaagaaccccgtgcggcccccccgggccctgccccccgtgcccagccaggacgatatccccttatccaggccaaagaagaagaaaccacggactaagaacacacccgcttctgcatccctggagggactcgcccagacggctggaaggcggccctcagaggggaacgaaccttccaccaaagaactcaaagaacatcctgaagcccccgtgcagcgacgtcagaaaaaaactagactcccactagaattggagacaagttctacacagaagaagtcctcgagctccagcctcctgcggaacgaaaatgggatcgatgcggaacctgccgaagaggccgtaattcaaaaaccccgcaggaagacaaagaaaacgcagccagccgagctgcagtatgcgaacgaattaggcgtggaggatgaggatattatcactgacgagcagaccactgtagagcagcagtcggtgttcactgcgcctactggtattagtcaacctgtgggcaaggtctttgttgagaagtcaagaaggtttcaggctgccgatcggtctgagctcatcaagactacggagaatattgatgtgtcgatggacgttaagcccagttggactactcgagatgtggccttgaccgtccatagagccttcagaatgatcggactgttcagccacggtttcttggcgggatgcgcagtatggaacatcgtggtaatctatgtgctggctggcgaccagctctctaacctgtctaatctgctgcaacagtataaaaccctggcctatccattccagtccctcttgtacctattgctggccctgtcaacaatatcagcttttgacaggatcgattttgcgaagatcagcgttgctatccggaattttctggctctggatccgactgcactcgcctcctttctgtactttaccgcactcattctctcactctcccagcagatgacttcggaccgaatccacctttacacacctagttccgtaaacggcagcttatgggaggccgggattgaggagcagatcctgcaaccatggattgtggtcaacctggtcgttgccctgcttgttggcctttcctggctgtttctgtcctataggcctggaatggatctctccgaagaactgatgttctcctccgaggtagaagaatatccagataaagaaaaagagattaaagcctcctcttag

SEQ ID NO: 209416 - DNA, 1227 bp, Artificial Sequence
  Description of Artificial Sequence: Synthetic coding sequence
atgcggaccgacagcggcgcccggctggaggagggccacctgcggcctccccgggctctgcctccagttcctagccaagatgatatacccctcagcagacccaagaagaaaaaacccaggaccaaaaatacccccgcctcagccagccttgaaggcctggcccagaccgccggtcgcagaccttctgagggtaacgagccttctactaaggaacttaaagaacacccagaggcaccagttcagcggcgacagaaaaagacacgactaccactggagcttgaaacaagcagtacacagaaaaagtctagctcctcatctcttctcaggaacgagaatggtattgatgccgagccggctgaagaggcagttattcagaagcctaggcgaaagaccaaaaagacccagccagctgaattacagtatgccaacgaattgggggtggaggatgaagatataataactgacgagcagacgacagtggagcagcagtcagtgttcaccgccccaactggtatctctcaaccagtcggcaaagtgttcgttgagaaatccagacgtttccaggccgccgatcgatctgaactcattaaaacaaccgagaatatcgacgtgtctatggatgtaaagcccagttggacaacaagagatgtcgcactgaccgtacaccgggcgtttcgtatgatcggcctgttcagccatggattccttgcaggatgcgcagtctggaacatcgttgtcatctacgtgctggcgggggatcagttgagcaatctaagcaatctactccagcagtataaaaccctggcgtacccctttcagtctctgctgtacctgttgctcgccttaagtacaattagcgcctttgataggatcgatttcgcgaagatttccgtggctattcgcaattttttggccttagatccgactgctctggcctccttcctttacttcacagcgctcatactgagcttatcacagcaaatgacctcagaccggatccatctgtacaccccttcttctgttaacggatcactgtgggaggccggcatcgaggaacagattcttcagccctggatcgtcgtaaacctcgtggtggctctgttggtaggattatcatggctgtttctgtcataccgtccgggtatggatctttcagaagaattaatgtttagctcagaggtggaggagtacccagacaaggagaaggagataaaggccagttcatag

SEQ ID NO: 209417 - DNA, 1293 bp, Artificial Sequence
  Description of Artificial Sequence: Synthetic coding sequence
atgacccactgcgcctgcgcccgggaccggcgggagggctggggcgcgagatgcttgggtcgacgtcctccaagacctgctaagcgcagaatgggcaaaaacccggtgcgcccaccccgagcccttcccccagttccatcaatagacgacataccactgtcccgcccgaaaaaaaaaaaacccagaacgaagaacactccagccagtgcatctctcgagggcctggcccaaaccgctgggagaagaccctcagaggggaatgagccttcaaccaaagagctcaaagaacatccagaggctccggtgcagcgacgccagaagaagactcggctacctcttgaactggagacctcctctacacagaagaaatcgagctcctcaagcctgctgagaaatgaaaacggcatcgatgccgagcccgccgaagaggccgtaatccaaaagccccggcgcaaaacaaaaaaaactcaacctgcagaactgcagtacgcaaatgagctgggagtggaggacgaggatatcattactgacgagcaaaccactgtggaacagcagagtgtgttcacagcccctacgggaatctctcagccagtcggaaaggttttcgtcgagaaaagcagacgattccaagcagccgaccgtagcgagctaataaagactaccgaaaacatcgatgtgtcaatggatgtgaaaccttcatggacgaccagagacgtggccttaaccgtgcaccgagcctttcgcatgattggcctgttctctcacggattcttagccggttgtgctgtctggaacatcgtcgtcatatacgttttagccggagaccagctttctaatctttctaacctgctccaacagtataaaacgctggcttatcctttccaatcccttctctatctgctccttgcactgtcaaccatcagtgcattcgacaggatcgactttgctaagatctcagtggccattaggaacttcctggctctagaccccactgccctggcctcatttctttactttactgccctgatactgagcctgtcccagcaaatgacttccgaccgtatccatttatacaccccatcaagcgtaaatggcagcctctgggaggctggcattgaagaacaaatcctccagccttggattgttgtgaacctcgtagtcgcactgcttgtcggtctttcttggttattcttatcgtaccgacctggcatggacttgtccgaggagctgatgttctcctccgaggtcgaagaatatcctgacaaggagaaggagattaaggcctcgagctag

SEQ ID NO: 209418 - DNA, 1227 bp, Artificial Sequence
  Description of Artificial Sequence: Synthetic coding sequence
atgcggaccgacagcggcgcccggctggaggagggccacctgcggccgccaagagccctgcctcccgtgccttccatcgacgacattccactgtctaggccaaaaaagaaaaaaccccggactaagaacacacccgcttccgcttccctcgaggggctggcccagacagcaggccgccgcccttcggaggggaacgaaccctctaccaaagaattgaaagaacatcctgaagcgcctgtgcagcgcagacagaagaaaacacggcttccgctggagctggagacgagttccacccaaaagaaatcctccagttctagcttgctccggaatgaaaatggaattgatgctgaacccgccgaggaggcagtgatacagaagcctcggcgaaagaccaaaaagacccaacccgccgagctccagtatgcgaatgagcttggggtggaggacgaggatatcataacagacgagcagaccacagtcgagcaacagagcgttttcactgcaccaaccggaatctcacagcccgtgggaaaggtgttcgtcgagaaatctaggcggttccaggccgctgaccgttctgaacttataaaaacgacagagaacatcgacgtctcaatggatgtgaagccttcatggacaacccgcgatgtagctctaactgtccatcgtgccttcaggatgataggcctgttcagccacgggttcctcgccggctgcgctgtctggaacattgtcgtgatatatgtgctagccggtgaccagttatctaacttatccaacttactccagcagtataaaacattggcatatcccttccagtctttgctgtatcttttgctggcactgtctacaatatctgcatttgaccggatcgactttgcgaagatctcagtggcaattcgaaattttctggctctggaccccactgccctggcaagttttctgtattttacggctctcatcctcagcttaagtcaacaaatgacgtctgataggatccacttgtatacccccagttctgtgaacggttcgctgtgggaggcaggcatcgaggaacagatcttgcagccttggatcgtcgtaaacctcgtcgtggccctgctggtgggactgtcttggttgtttctctcctataggcctgggatggatctgagcgaggagttaatgttcagctctgaagtagaagaatacccagacaaagaaaaggaaataaaggcttcatcctag

SEQ ID NO: 209419 - DNA, 1101 bp, Artificial Sequence
  Description of Artificial Sequence: Synthetic coding sequence
atggccctgccccccggccccgccgccctgcggcacaccctgctgctcctaccggctcttctaagcagcgggtggggggaactcgaacctcagatcgatggacagacctgggccgagagggcactcagagagaacgagaggcacgccttcacctgccgtgtggcaggcggccccggtacaccccgcctagcctggtatttggatggccagcttcaggaggcctcaacttctaggctgctctcagtcgggggggaagctttcagcggagggacctctactttcacagtaactgcacatcgcgctcagcacgaactgaactgctcactccaggatccaaggtcggggcgctctgcaaatgcttctgttatattgaacgtacagttcaaacctgagattgctcaggttggggctaagtaccaagaagcccagggcccaggactcctggtggtgctgtttgcgttggtcagagctaacccccccgccaacgtcacttggattgaccaagatggacccgtgaccgtgaatacaagcgatttcctcgtgctggacgcacagaattacccatggttgaccaaccatactgtgcagctccagctgagatcattggcccataacttatccgtagtcgcgactaacgatgtgggcgttaccagtgcgagtctgcccgctcctggcttgttggccacccgcgttgaagtgcccctgctcggcatagtcgtggctgctgggctggcactgggtacacttgtaggattctcaaccctcgtagcatgccttgtatgccggaaggagaagaaaaccaaaggccccagtcgccacccttcactgatctcctctgactccaataatctgaaactgaacaacgtccgactgccccgtgagaatatgtctctgcctagcaacttacagttgaatgatctgactcccgatagcagggcagtcaagcccgccgacagacaaatggctcagaacaactctcgaccagagctgctcgatcccgaaccaggcggcctgttaacaagtcaagggttcatcaggctcccggtgctgggctacatctatcgagtgtcaagcgtgtcatccgatgaaatctggctctag

SEQ ID NO: 209420 - DNA, 657 bp, Artificial Sequence
  Description of Artificial Sequence: Synthetic coding sequence
atggccctgccccccggccccgccgccctgcggcacaccctgctgttgctcccagccctgctgtccagcgtcaaacccgaaattgcgcaggtgggcgcgaagtatcaggaggcacagggccctggcctgctagttgtgctctttgcattggtgagagctaacccacctgctaacgtgacatggatcgatcaggacggccctgtgacagtgaataccagcgacttcctggtcctggacgctcaaaattatccctggctcaccaatcatacggtccagcttcaactcaggtcgctggcccataacctgagcgttgtcgctactaacgatgtcggcgtgacttctgcttctctccccgcccccggtccgtctagacaccccagtcttatatcatctgactccaacaacctaaaactcaacaacgtgcggttgccgcgggaaaatatgtcactcccttcgaatctgcagctaaatgacctgacaccagactctagggccgtgaagcctgcagaccgtcagatggcacagaacaattccagaccagagttactcgatcctgaacccggcgggcttcttactagccaggggtttataagactgcctgtgctaggctacatctatcgcgtgagtagcgtctcctcggacgagatttggttgtag

SEQ ID NO: 209421 - DNA, 1056 bp, Artificial Sequence
  Description of Artificial Sequence: Synthetic coding sequence
atggccctgccccccggccccgccgccctgcggcacaccctgctgctgctgccagccttgttgagcagcggttggggagaactcgagccacagattgacggacagacctgggcggagagggccttaagggagaatgagcgccacgctttcacatgtagggtagccggtgggcccgggacacctaggctggcctggtaccttgacgggcagctccaggaagcgagtacctcacggctgctctcagtgggaggcgaagcctttagcgggggaaccagtaccttcacggtgaccgcccaccgcgcccagcacgagctcaattgctcacttcaggatccccgctctggtcgctccgcaaatgcctccgtcatccttaatgtacagtttaagccagagatcgcccaagtgggggccaagtaccaggaagcccagggtcctgggctgctagtggtgctgtttgctcttgttcgtgcaaacccgccagcgaacgtcacttggattgatcaggacggcccagtcacagtgaatacttccgactttttagtgctggacgcccagaactacccctggcttacaaatcataccgtccaactccaattaagatccctggcccacaacctgtctgtcgttgcaactaacgacgttggagtgaccagcgcaagcctgcctgcaccaggcctgttggcgacccgagtcgaagttcccctgctaggtattgtcgtggcagctgggctcgcgcttgggactctggtggggttcagtactcttgttgcatgcctagtgtgtcggaaggagaagaaaacaaaaggaccatcccgccacccttctttgatctccagcgactcaaacaatctgaaactcaacaacgtgcggcttccacgggaaaatatgagcctgcccagcaacctgcagttaaatgatctcactccagatagtcgggcagttaagcccgccgacaggcaaatggcccagaacaactctcgacctgagctccttgaccccgaaccgggaggactccttacatcccagggaagacgtaatcaagacaaggatgcatag

SEQ ID NO: 209422 - DNA, 969 bp, Artificial Sequence
  Description of Artificial Sequence: Synthetic coding sequence
atggccctgccccccggccccgccgccctgcggcacaccctgctgttgcttcccgcactcctctccagcggatggggggagctggaacctcaaattgacggccaaacctgggccgagcgtgccctccgagagaacgagcgacacgcctttacatgtcgcgtcgctggaggccccgggacccctcgactcgcctggtacctagatggtcagttacaggaggcctccacttccaggctcctttcagtgggcggtgaggccttttccggcggaacaagcaccttcacagtgaccgctcaccgagcccagcacgagctcaactgctctctccaagacccccgctccggcagatccgcaaacgcaagtgtgattttaaacgtgcagtttaaaccagaaattgctcaggtgggggcaaagtaccaagaagcgcagggtccgggcttacttgtagtgctgttcgcccttgtaagggccaaccctccagccaatgtcacttggatcgatcaggatggtcccgtgactgtaaataccagcgacttcctggtgctggatgcccaaaattatccatggctgacaaaccacacagtgcaactgcagctgaggtctttggcccataatttgtccgtcgtcgcaaccaatgatgttggagtgacatccgcaagcctccccgccccgggaccctccagacacccaagcctgattagtagtgactccaacaatctcaaacttaataacgttcggctgcctcgtgagaatatgagtttgccgtccaatttgcagctgaacgacctgactccagatagccgcgccgtcaagcctgccgaccgccagatggcgcaaaataattctagacccgagctgctggaccctgagccaggaggcttacttacgagccaaggcttcattaggctccctgtcctgggctatatttatcgagtgagctctgtctcgagtgacgaaatttggctgtag

SEQ ID NO: 209423 - DNA, 969 bp, Artificial Sequence
  Description of Artificial Sequence: Synthetic coding sequence
atggccctgccccccggccccgccgccctgcggcacaccctgctgctattgcctgccctgttgtccagcgggtggggagagctggaaccccagatagatggacagacttgggccgaacgagccctgcgcgaaaacgagcggcatgcatttacttgccgagtagcaggagggccgggaactcctcggttggcatggtacctggatggccaattgcaggaggcgtctacaagccggttactgagtgtgggcggagaagcgttctctggcgggacgtccacatttaccgttaccgctcaccgggcccagcacgaactgaattgcagtctccaggatccacggtcaggcagaagtgccaatgctagcgtaattttaaatgtgcagttcaaaccagaaatcgcccaagtgggtgccaagtaccaggaagcccaggggcctggactcctagtagttctgtttgccttagtgcgcgcgaatccgccagctaacgtgacttggatcgaccaagacggtccagtgaccgtgaacacttccgattttcttgtgctggacgcgcaaaactatccttggttgactaaccatacggttcaactccagttaagaagtctcgcacataatttaagcgtagtcgccaccaatgatgtgggtgttacaagcgcatccctgccagctcccggaccctcccgccacccgagccttatcagctctgacagtaataatctcaagctcaataacgtgagattgcccagggagaatatgtctctgccttctaacctacagctgaatgacctgacccccgattctagagctgtgaagccagccgaccggcagatggcccaaaacaactctcgacccgagcttttggaccccgaacccgggggcttgctcacaagtcaggggttcatcaggttgcccgtgctgggatacatttatagggtgtcaagtgtgagctctgacgagatctggctgtag

SEQ ID NO: 209424 - DNA, 921 bp, Artificial Sequence
  Description of Artificial Sequence: Synthetic coding sequence
atggccctgccccccggccccgccgccctgcggcacaccctgctgctgctgcccgcactgctttcctctgggtggggagaattggaaccccagatagatggacagacgtgggccgagcgagctctgcgtgagaatgagagacatgctttcacctgtcgcgtggcagggggccctgggacgccacgcctcgcgtggtacctcgacgggcagctccaggaagcctctacctcaaggctgctgtcagtcgggggtgaagccttcagtgggggtaccagcaccttcactgttaccgcgcatcgtgcacagcatgagctgaactgtagccttcaggacccacgctcggggaggagcgcaaacgcatccgttatccttaacgtccagttcaaacccgagatagcacaagttggcgcaaagtatcaggaagcacaggggccaggactgctggtggtcctctttgctcttgtgagggcaaacccccccgccaacgtgacctggattgatcaggatggtcctgtgacagtaaacacttcagacttcctagttctggacgcgcagaattacccctggctgacaaaccataccgtgcaattacagctcaggtctctggctcataatctcagcgtcgtggccacgaacgacgtgggcgttacttcggccagcttgcctgctcctggaccgagcagacatccaagcctgatttcttcagactccaacaacctcaaactcaataacgtacgcctgccaagagaaaacatgtccttgccaagcaacctacagctcaacgacctcacaccagactcacgcgtgaagcccgctgaccgccaaatggcgcagaataattcacgcccagaattgctggatccagaaccaggcgggttgctcacttcccagggccgcaggaatcaggacaaggacgcttag

SEQ ID NO: 209425 - DNA, 1146 bp, Artificial Sequence
  Description of Artificial Sequence: Synthetic coding sequence
atggccctgccccccggccccgccgccctgcggcacaccctgctgctgctgccagccctgctctccagcggctggggggagttggagccacagatcgacggccaaacatgggccgaacgcgccctgagggagaacgaaagacacgcttttacatgcagagtcgcaggtgggccaggtaccccacgacttgcgtggtacctcgacggtcagctgcaagaggcttcaacctcacgcctgctgagcgtcggcggtgaggcattctccggaggcacctcgactttcactgtcacagctcacagagcccagcacgaactgaattgtagccttcaagatccgcggtcaggccggagcgctaacgccagcgtgattctgaacgtacagtttaaacctgagatagctcaggtcggcgctaagtaccaggaggcacaggggcccggcttgttggtcgtcctgtttgcactggtgcgggctaacccgcctgcaaacgttacctggattgatcaggacgggccggtaaccgttaacacctcggacttcctcgtactggacgcccagaactatccctggttgacgaaccacaccgtccagttacagctgcgatctcttgcacacaacctgtccgtagtcgctacgaacgatgttggagtgaccagcgcttccctgccggctccaggcctgttagccactagggtcgaggtgccccttcttggcatcgtcgtcgctgccggactcgccctaggcaccctggtgggcttcagcactctggtggcctgcctggtttgtcgcaaagaaaaaaagactaaggggccatctagacacccttctttaatttccagcgattctaacaatcttaagttaaacaatgtcaggctacctcgtgagaacatgtctctgccatcgaacctacaactgaatgacctaaccccagatagccgcgttaaacccgcagatcgccagatggcccaaaataactcccgtcccgaactgctcgaccccgagcccgggggccttttgacctctcaggcatgtctgctgcaccacggaactcccgctctgaccaacccttggctcccacatcagcaagaaggcgcactccctggtggctggtctccgcaggcccacaattccaccgtgtggaagctgtag

SEQ ID NO: 209426 - DNA, 810 bp, Artificial Sequence
  Description of Artificial Sequence: Synthetic coding sequence
atggccctgccccccggccccgccgccctgcggcacaccctgctgttactacctgcactgttgagtagtgggtggggggaattggaaccacagattgatggacagacttgggccgaacgcgcactgagagagaacgagagacacgcttttacgtgccgcgtcgcagggggaccaggaacaccgcggttagcctggtatctggatggccagctgcaagaagcgtcgacgtctcgactgctaagtgtgggaggcgaagcctttagcgggggaacaagcacatttactgttactgcacaccgcgctcagcatgagctgaattgctctttgcaggatccacgctcagggcggtcagccaacgcttctgttattctcaacgttcagtggctgctagcgacaagagtggaggtccccctgctgggtatcgtggttgctgcgggactggccctggggaccttagtgggcttctcaaccctagttgcctgcttggtgtgtcgcaaggagaagaagaccaaaggaccgagccggcacccctctctcatctcttccgattcaaataatctgaagctcaacaatgtgaggctgccaagggagaacatgtctctgccctctaacctgcaactcaacgacttaacaccggacagtcgagcagttaagccagccgatcgacagatggcacaaaataatagcagaccagagttgttagatccagagcctggggggttgctcaccagccagggtttcattaggctccccgtgctcggctacatctatcgggtgtcttctgtcagctctgacgagatctggctgtag

SEQ ID NO: 209427 - DNA, 669 bp, Artificial Sequence
  Description of Artificial Sequence: Synthetic coding sequence
atgctgtggctgctgttcttcctggtgaccgccatccacgccgagctgtgccagcctggcgctgaaaatgcttttaaagttagactatccatcagaaccgcgctaggagacaaagcctacgcttgggatactaatgaagaatatctgttcaaggcgatggtggcgtttagtatgagaaaggtgccaaacagagaggccaccgagatctctcacgtactgctttgtaatgtgacgcagcgagtgtctttttggtttgtagtgacggacccatccaaaaatcatacactccccgctgttgaagtacaatctgctatcagaatgaataagaatcgtatcaataatgcctttttcctgaatgatcagaccctcgagttcctcaagattccctccacacttgccccaccaatggatcccagtgtgcctatttggatcatcatatttggggtgatcttttgtatcattatagtggccatagctcttttgattctcagtgggatctggcagcggagacgcaaaaataaggaacccagcgaggtggatgatgctgaggacaaatgcgagaatatgataacaatcgagaacggtatcccatccgacccactggatatgaagggcggacatataaatgacgcctttatgactgaagacgagcggttaacaccattatag

SEQ ID NO: 209428 - DNA, 252 bp, Artificial Sequence
  Description of Artificial Sequence: Synthetic coding sequence
atgctgcggaacctgctggccctgcggcagatcggccagcggaccattagcactgccagccggcgacacttcaagaacaaagtccccgagaagcagaagttgtttcaagaggatgatgagatccctctctatctgaagggcggggtggccgatgccttactctacagagctacaatgattttaaccgttggaggcaccgcctacgctatttatgagcttgcagtggcaagcttccctaagaagcaggaatag

SEQ ID NO: 209429 - DNA, 729 bp, Artificial Sequence
  Description of Artificial Sequence: Synthetic coding sequence
atgtactacggcctgagcaacttctaccagaaccaccggcggtacgtgaagtcccgtgatgatagccagctcaacggagacagttctgcacttcttaacccctctaaggaatgtgagccctatcgacgaaacgaggacaaacctatcgcaccttgtggagctattgctaacagcatgtttaacgatacgctggaactgttcctaatcggcaacgatagttacccaatcccaattgccctgaagaaaaaagggatcgcgtggtggacggataagaacgtgaagtttcgtaaccctcctggcggcgataaccttgaagaacgtttcaaaggaactactaaacccgtcaattggctgaaacctgtttacatgctggatagtgacccagataacaacggctttattaatgaagattttatagtgtggatgagaaccgcggctctcccaacttttagaaagctgtatcgcctaatcgagagaaagagcgatttacacccgacactccccgccggccgatattccttgaatgtcacctataactaccctgtacattactttgatggaagaaaaaggatgatcctgagtactatttcctggatgggtgggaagaacccattcctgggaattgcatatatcgcagtgggctccatcagctttttattgggcgtcgtgttattggtcataaatcataaatatcgcaattcctcaaacactgcagacataacaatttag

SEQ ID NO: 209430 - DNA, 978 bp, Artificial Sequence
  Description of Artificial Sequence: Synthetic coding sequence
atggccatgaactacaacgccaaggacgaggtggacggcggccccccatgcgcgcccggcggtactgcaaaaacccgccggccagacaatacagcctttaagcaacaacgcctgcccgcctggcagcctattctgaccgccgggactgtactgccaatcttcttcatcattgggctgatatttatccctatcggtataggcatatttgttacttccaacaacattagggaaatcgaaggtaacgtgtttatgtactatggactttcaaatttctatcaaaatcaccgcaggtatgtgaagtcccgcgacgattctcaattgaacggcgacagttccgcgcttttgaatccttctaaggagtgtgagccttaccgacgaaacgaagataagcccattgctccatgtggagcaattgccaattcaatgttcaacgatacacttgagctgttcctgatcgggaatgattcctatccaattcccattgcactaaagaagaagggtatcgcctggtggacagataaaaatgtcaaattcaggaatccgccgggcggtgacaatctggaggaacggtttaagggaaccaccaaacctgtaaactggctcaagcccgtgtatatgttagattcagacccggataacaatggattcatcaacgaagactttattgtgtggatgaggactgctgcgttaccaacatttcgaaagctgtacagactgatcgagcgcaaatccgatcttcaccctaccctgcccgctgggaggtattcactaaatgtaacatacaactatcccgttcattatttcgatggccgaaagcggatgatcttaagtacaatcagctggatggggggcaagaacccatttctggggattgcctatattgcagtaggttccatctcattcctccttggagtggtactgctggtcatcaaccataagtaccgcaacagcagtaatactgccgatatcacaatatag

SEQ ID NO: 209431 - DNA, 234 bp, Artificial Sequence
  Description of Artificial Sequence: Synthetic coding sequence
atgtactacggcctgagcaacttctaccagaaccaccggcggtacgtcaaaagtagagatgactcccagctcaatggagattcgagcgctctgctcaacccgagcaaagagtgcgagccataccggcgcaatgaagataagccgatcgctccctgcggcgctattgccaacagtatgttcaatgacaccctcgagctgtttctaataggcaacgactcttatcctataccatag

SEQ ID NO: 209432 - DNA, 1038 bp, Artificial Sequence
  Description of Artificial Sequence: Synthetic coding sequence
atggccatgaactacaccgccaagacccggcggcccgacaacaccgcatttaagcagcagagattaccagcttggcagcctattttgacagcgggtaccgtgctgccaatattttttattattggactcatttttatccctatcgggatcggcattttcgtgacaagtaacaatatccgggagatcgagatagactataccggtacagaaccatcttccccgtgcaataaatgtctgagccctgatgtgacaccttgtttctgtactattaacttcaccctggagaaatcttttgaagggaatgtctttatgtattacggactttctaacttttaccagaaccaccgaaggtatgtgaaaagcagagatgattcccagctcaatggtgactcttccgccctcctcaatccatcaaaagagtgtgagccctaccgtaggaatgaggacaaacctatagccccatgtggggctatcgcaaatagtatgtttaacgatactctggagctgtttttgattggaaatgactcatatcctatccctattgccctcaaaaagaaaggtattgcctggtggacagacaagaatgtaaagttcaggaaccctccagggggggacaatttggaggaacggttcaagggtaccaccaagcctgtgaactggctgaagcctgtttacatgctggattctgatcctgataacaacggctttatcaacgaggacttcatcgtgtggatgagaactgccgcactgcccacatttagaaagctttatcggctcatcgaacggaaatctgaccttcaccctacactcccagccggccgttacagtttaaatgtgacttataactacccggttcactattttgacgggagaaaaagaatgatattatccaccatctcatggatgggaggcaagaatcccttcttgggcatagcttatattgccgtaggatctatctcattcttattgggcgtggtgctcttagttatcaatcacaagtatcgcaacagtagcaatacggcggacatcaccatttag

SEQ ID NO: 209433 - DNA, 1056 bp, Artificial Sequence
  Description of Artificial Sequence: Synthetic coding sequence
atgacctggagcgccaccgcccggggcgcccaccagcccgacaacaccgccttcacccagcagaggttaccggcttggcagcccctgctcagtgcatcaatagccctgccattattcttttgtgccgggcttgcattcattggtttgggactgggcttatattacagctctaacggtattaaagaacttgagtatgactacactggagatcccgggactggcaactgctcagtttgcgccgccgccgggcaaggaagagcgcttccgcctccatgcagttgtgcctggtacttttccctcccagagctttttcaggggcccgtttacctgtattacgaactgaccaatttttatcagaacaatcggagatacggggtgagtagggatgacgcccagttaagtggactgcccagcgcactacgtcacccagtcaatgaatgtgctccttatcagcggtcagccgcagggctccctatagccccttgcggagcaattgctaactcactgttcaatgactcattctcactgtggcaccagcggcagccaggagggccctatgtggaggtgccactggacagatcagggatcgcttggtggaccgactatcatgtaaaattccgaaacccccccttggtcaatgggtctctggctctcgccttccagggcaccgcacctcctcctaattggaggagaccggtctatgagctgtccccagatcctaataacaccggctttattaatcaggatttcgtggtgtggatgagaaccgctgcgctgccaaccttccgaaagctctacgcacgcatccggcagggaaattactccgccggcctaccccgcggtgcataccgtgtaaacatcacttacaactacccagtacgagccttcggcgggcacaagctgctgattttttcttcaatatcttggatgggtgggaagaatccattccttggaattgcatatttggtggtgggatccttatgtatactgactggattcgtcatgctggtagtgtacatacgctatcaggaccaggatgatgacgacgaggaatag

SEQ ID NO: 209434 - DNA, 1056 bp, Artificial Sequence
  Description of Artificial Sequence: Synthetic coding sequence
atgacctggagcgccaccgcccggggcgcccaccagcccgacaacacagcttttacgcagcagagactgccggcctggcagccactgttgtctgcatcaattgcgctcccccttttcttctgcgccggcctggcctttatcggcttgggccttggcctttattacagcagcaacggtattaaggaattggagtatgactacactggggacccgggcaccggtaattgttccgtctgcgccgccgccgggcagggacgggcactccctcccccgtgctcctgtgcatggtacttcagcctgcccgaactattccaggggccagtttatttatattatgaactgaccaacttctaccagaataataggagatatggtgtctcacgagacgacgcccagttgtcaggcttgcccagcgccttgcgccaccccgtcaacgagtgtgccccctatcaacgaagcgcagcagggcttcccatcgccccatgtggcgctatagcaaactctctctttaatgacagtttctcactgtggcaccagcggcagcctggcggaccatacgtggaggttcccctggatcgcagcggcattgcttggtggacagattaccacgtgaagttccgcaaccctccactggtgaacgggtcattggctttggcttttcagggtaccgccccaccaccaaattggcgaaggccagtctacgagctctctccagacccgaacaacacgggcttcatcaatcaggattttgtggtgtggatgagaaccgcagctctcccaacatttaggaaattgtatgcccgcatcaggcagggaaactactctgctggtctcccccggggggcctatcgcgttaatataacatacaactatcctgtcagagccttcggtggacataagttattgatcttttctagcatcagctggatgggcggcaagaacccattcctgggcattgcctatttagttgtgggctccctgtgtatcctgactgggttcgtgatgctagtggtgtatatccgctaccaagatcaggacgatgatgacgaagagtag

SEQ ID NO: 209435 - DNA, 342 bp, Artificial Sequence
  Description of Artificial Sequence: Synthetic coding sequence
atggaggagcgggcccagcactgcctgagccggctgctggacaacagcgctttgaagcaacaagaactgccgatacatcggttatacttcaccgctcgcagggtcctcttcgtcttcttcgccactggtatcttttgtttatgtatgggcattatactcatcctgagcgccaggagcacccaagagatcgagatcaactacacccggatctgcgcgaattgtgcgaaactgcgggaaaatgcctcaaattttgacaaggaatgcacctgttccatccccttttacctgagcggtaagatgatggtgggagagattcaagaaacgagacttaccctgcactag

SEQ ID NO: 209436 - DNA, 207 bp, Artificial Sequence
  Description of Artificial Sequence: Synthetic coding sequence
tgactgtgcatgggcatcatcctgatcctgagcgcccggagcacccaagagattgagatcaactacacaagaatttgcgccaattgcgctaagctgcgggaaaacgcgtcaaacttcgataaggaatgtacttgctccatacctttctacttaagtggtaaaatgatggttggagagatccaggaaacccgcctaaccctgcactag

SEQ ID NO: 209437 - DNA, 1203 bp, Artificial Sequence
  Description of Artificial Sequence: Synthetic coding sequence
atggccgccaactacagcagcaccagcacccggcgggagcacgtgaaggtcaagacctcttcacagccaggatttctggagcggctgagcgagacatcaggcggcatgtttgtgggtttgatggcctttttattgtcattttatttgattttcacaaatgaagggcgcgctctgaagacagcaacatcgctagccgaaggcctgagcttagtggtgtcacctgattctattcactccgtggctccagaaaatgaggggaggttagtgcatatcatcggggccctacggacatctaagctcctctcggatcctaactatggcgtacatttacctgcagtgaagctaagacgccacgtggaaatgtatcaatgggtggagacggaagagtctcgggagtatacagaagatggacaggttaaaaaggagacacgttattcctataacaccgaatggaggagcgaaatcatcaacagtaaaaactttgatagggaaataggtcacaaaaatcctagcgccatggcggtggaaagctttatggccaccgcgccatttgtgcagatagggagattctttctcagcagtgggttaatcgataaggtagacaactttaaaagcctgagcttgtcaaagctcgaagacccccacgtggacatcatccgacgcggtgactttttttaccattcagagaaccccaagtaccccgaggtcggggatcttcgggtgtccttttcatacgccggcctgagtggcgacgacccagacttgggacctgcccacgttgtcaccgtaatcgcccgtcagcggggagaccagctggtacctttcagtaccaagagtggtgatactctgttgttattacatcacggtgacttctccgctgaggaggtgttccacagagaattgcggagtaactccatgaagacttggggcctgcgcgctgccgggtggatggccatgtttatgggactgaatctcatgacacgtattctgtatacccttgtagactggttccccgtttttcgggacctggtgaatatagggctcaaggccttcgccttctgcgtcgcgacttcgctgactttactgactgtggccgctgggtggctgttttaccgccctctctgggccctactcatcgccgggctggctctagtgcccattctcgtagcaagaactcgagtacctgcgaagaaactcgagtag

SEQ ID NO: 209438 - DNA, 546 bp, Artificial Sequence
  Description of Artificial Sequence: Synthetic coding sequence
atggccagcgccggcagcggcatggaggaggtgcgggtgagcgtgctgacgccccttaagctcgttggactcgtgtgtattttcttagccctgtgcttagacttgggcgccgtgctttcaccggcttgggttacagctgatcaccagtattatctgtctctttgggaaagctgtcgtaaacccgcctccttggatatatggcactgcgagagcacactctcttctgactggcagatcgctactttggcactgctgctcggcggagctgctatcatacttattgccttccttgtgggtcttatatctatttgcgtgggatccaggaggagattctatagacccgtagccgtgatgctcttcgccgcggttgttttacaggtgtgcagtctagtattgtacccaatcaagtttattgagacagtctcattgaagatctaccatgaatttaattggggttacgggctggcctggggagccacgatttttagctttggaggggccatcttgtattgtttgaaccctaagaactatgaggattactattag

SEQ ID NO: 209439 - DNA, 2745 bp, Artificial Sequence
  Description of Artificial Sequence: Synthetic coding sequence
atgggccccttcaagagcagcgtgttcatcctgatcctgcacctgctggaaggagcattgtcaaatagcctaatacaacttaacaataatggatacgagggaatcgtagtagcaatcgatcctaacgttcctgaagatgagactctaatccagcaaattaaagacatggtaacacaggcctccctctaccttctcgaggcgacaggaaaaaggttttactttaagaatgtggctattctgattccggagacctggaagactaaggcggattatgtgaggccaaagctcgaaacttacaagaacgccgacgtactggtcgcagaatcaactccaccaggcaacgacgagccgtacacggaacagatgggtaattgtggtgagaagggagagagaattcacctgactcccgacttcatcgctggaaaaaaattagccgagtacggcccacaggggcgggctttcgtgcacgaatgggcccaccttaggtggggtgtctttgacgagtataataacgatgaaaagttctacctcagcaacgggcgcattcaggccgttcggtgctccgctggcattaccggtacgaatgttgtgaagaaatgtcagggagggtcttgttacaccaagcggtgtacatttaacaaagtgacaggactgtatgagaaggggtgcgagtttgttctccagtcccgccagactgagaaagcttctatcatgtttgcccagcacgtggactctatagtggagttctgtacagaacagaaccataataaggaagcgcctaacaagcagaatcagaaatgtaatcttaggtcaacatgggaagttatccgtgatagtgaagactttaaaaagaccacgcctatgaccacccagccacccaatccaacattcagcctgctgcaaatagggcagcgaatcgtatgtttagtcctggataaaagtggatctatggctacgggtaatagactgaatcgtctgaatcaggcaggccagctcttccttctgcaaaccgtggagctcggttcatgggtggggatggtcacctttgactctgccgcgcatgtgcagaacgagctgattcagatcaacagtggatcagacagagataccctggctaaaagattacctgcagccgccagcggcggtacctccatttgctcaggcttgagaagcgcgttcacagtcataagaaaaaagtatcccaccgacggatccgagatcgtcctgcttacagacggcgaggacaatacaatatctggatgcttcaacgaggtgaaacagagtggggcgattatccacacagtggcacttggacccagcgcagcccaggagctagaggagctgagtaagatgacaggcggactgcagacctatgcatccgaccaggtacagaataacggactcattgatgcatttggggctctgagctccgggaacggggccgttagccagaggagcatccagctcgagagcaaaggattgaccctgcagaattcacaatggatgaatggtacagtcatcgtcgatagcaccgtgggcaaggatacactatttcttatcacctggacaatgcagcccccccaaatcttgctttgggacccaagtggacagaagcagggaggtttcgtggtcgacaaaaataccaagatggcgtatctacagatcccgggcatcgcgaaggttgggacctggaaatattctctccaagcctcttctcaaacgctgacactgacagttacatcaagggcctctaatgccacactaccaccaattactgtgacgagtaaaacaaacaaggatacttcaaaatttccctctcccctggttgtttacgccaacattagacagggcgcctctcctatccttagggcttctgtcaccgcactgatagagtcagtgaacgggaaaacagttaccctggaattactggacaatggtgccggggccgacgcgaccaaagacgatggcgtgtactcccgatatttcacaacatacgacacaaacggaaggtacagtgttaaagttcgagctcttggcggcgtaaatgcagctcggaggcgggtaatcccccagcaatctggggctctttatattcccggctggattgaaaacgacgagattcagtggaacccaccgcggccggaaattaataaggatgatgtacagcataaacaggtctgcttcagccggacgtcttctggcggatcatttgtggcatcggatgtcccaaacgctcccatccccgacttgttcccccctggccaaattacggacctgaaggccgagattcacggcggctcactgataaacctgacttggacggctcccggggatgattatgatcatggcaccgcacacaaatacatcatcaggatttctacctccattctggatttgcgcgataagtttaatgagtctcttcaagtcaataccaccgctttaattccaaaagaggccaactccgaggaggtgttcttgttcaaacctgagaacatcacgtttgaaaacgggactgacctgttcatagcaattcaagctgtagataaggtggatctgaaatccgagatctctaatatcgcccgggtgtctctctttatccctccgcagaccccacccgagactccgtcaccagatgagacgtcagctccttgcccaaacatccacataaatagcactatcccaggcattcacatactgaaaattatgtggaaatggattggtgaactgcagctgtcaattgcctag

SEQ ID NO: 209440 - DNA, 1674 bp, Artificial Sequence
  Description of Artificial Sequence: Synthetic coding sequence
atggccaccgccgtgagccggccctgcgccggccggagccgggacatattatggagggtgcttggctggagaatagttgcctcgatcgtttggagcgtgctgtttctccccatctgtaccaccgttttcattatcttttcacgtatcgatttattccatccaattcagtggttaagcgactcattttctgatttgtactcgagctacgtcatcttctacttcttactgttatctgtggttataattatcatctccatttttaacgtggagttctatgcagtggtcccttccatcccttgctcccgtctcgccctgattggaaaaatcattcacccccagcagctcatgcactccttcatacatgctgctatggggatggttatggcttggtgcgcggccgtgattactcaaggacagtactcgttcctggtggtgccatgtactggaaccaactctttcgggtcacccgcagcacaaacatgtctgaacgagtaccacctgtttttcctcttaacgggggcgttcatgggatattcctactccctcctgtactttgtgaataacatgaactatttaccgttccctatcatccagcaatacaagttcctccgttttaggaggagccttctgctgctcgtgaagcactcttgtgttgagtcccttttcctggtgcgtaacttctgcattctgtactattttttgggatatattccaaaggcgtggatctccacagctatgaatctccacatagacgaacaggtgcatagaccacttgacactgtgtctggcctgctaaacctgtctctgctgtatcatgtttggttatgcggggtgtttcttcttaccacctggtatgtttcctggattctgtttaagatttacgctaccgaggcgcatgtcttccctgtgcaacctcctttcgctgagggttctgatgaatgcctcccgaaagtcctgaactcaaacccaccacctattattaagtatctggccctccaggacctcatgcttctttcccagtatagcccatccagacggcaagaggtatttagtctgtcccagcctggcggccatccacacaattggactgccatttcaagagaatgccttaatttgctgaacgaaatgactgaattttctaacccttctcccagcacctccatcagtgccgaaggcaagactatgcgacagccatcagttatctatagctggatccagaacaagcgagagcagataaagaatttcttaagtaaacgggtgcttatcatgtactttttcagtaaacacccagaggcaagcatccaagctgtgttcagtgatgcccaaatgcacatatgggccttggagggcttgagccacctggtggccgcctcgtttaccgaggacaggttcggcgtcgtgcaaacaacacttccagccatcttgaatacactcttgactctacaggaggccgtcgataaatactttaaattgccacatgcctcatccaaacctccacgtattagcggaagtttggtggataccagctataaaacattgcgattcgccttcagggcatcattgaagaccgctatatataggatcactactacgtttggggaacacctgaacgccgtacaggcttcagctgagcatcagaaacgactccagcaatttctcgagttcaaggagtag

SEQ ID NO: 209441 - DNA, 2025 bp, Artificial Sequence
  Description of Artificial Sequence: Synthetic coding sequence
atggccaccgccgtgagccggccctgcgccggccggagccgggacattctgtggcgggtgctgggttggaggatcgtggcctccattgtttggtccgtgttgtttctgcccatctgcactacagttttcatcatcttttccagaattgacctctttcaccctatccaatggttaagcgattcattttccgatctctactcctcctatgtgatcttttactttctgctactcagtgtggttattataatcattagtatcttcaacgtagagttctatgctgtcgtccctagtatcccctgcagcaggctggcgttgattggaaaaatcatccacccccagcagctgatgcatagctttatccacgctgctatggggatggtgatggcttggtgtgctgctgtcatcacacagggacagtacagcttcttggtggttccctgcacgggcacaaactcttttggctcacccgccgcccaaacctgtctgaatgagtaccaccttttcttcctcctgaccggagcttttatgggatattcttactcattactctacttcgtcaataatatgaattacctcccttttcccattatacagcagtataaattcctgcgctttaggagatctctcctgttgctggtcaaacatagctgcgtggaatccctgttcctggtccggaacttttgcatcctctactactttctcggatacatacctaaagcttggattagcacagccatgaatttgcacattgatgagcaagttcaccgcccactggataccgtttccgggctgttgaacttgagccttctgtaccacgtgtggctgtgtggggtttttcttctgactacctggtatgtgtcatggattctcttcaagatttatgctaccgaggctcacgtgttccctgtacaacctccattcgccgagggttcagacgagtgtttgccgaaagtgctgaactccaatcctcccccaattattaagtatctcgcattgcaggatcttatgcttctttctcagtatagtccaagtagaagacaagaagtattcagcttgtctcagcccggcggacatccccacaattggactgccattagtagagaatgcttgaatctgttaaatgggatgacccaaaagttaattctatatcaggaggctgccgcaaccaatggtagagtgagcagttcttatcctgttgagccaaaaaagttaaattctccagaggagactgcatttcagacccccaaatcctcccagatgccaaggcctagtgttcctcccctcgtgaagacctcactgttttcttctaaactttctacccctgacgtggtgagtcccttcggaacaccctttggatcctccgtgatgaacaggatggccggtatattcgatgttaacacatgttatggttcaccacagagtcctcaattgatccgcagaggcccaagactctggacctctgcttccgaccaacagatgactgagttctctaatccatctccaagcacatctatcagtgctgagggcaaaactatgagacaaccgagtgttatctatagctggattcagaataagcgggagcaaatcaagaattttttatccaaacgggtcctcatcatgtacttcttttctaaacatcctgaagcgtcaattcaggccgtgttctccgacgctcagatgcacatatgggccctggaaggcctctcacaccttgtcgcagcatccttcacagaggatcggtttggtgtggtgcagaccaccctgcccgcgatactcaatactctgcttacgctccaggaggccgtggataagtacttcaagctgcctcacgcaagtagtaagcccccaagaatttccggctccttggtggatacaagctacaaaactctgcgctttgcctttcgggcctccttgaaaacagcaatctaccgcatcaccaccacgtttggggagcaccttaacgctgttcaggcgtctgccgaacaccagaagcgcctacagcaatttttggaatttaaggagtag

SEQ ID NO: 209442 - DNA, 1020 bp, Artificial Sequence
  Description of Artificial Sequence: Synthetic coding sequence
atgctgctgagccagtacagccccagccggcggcaggaggtgttctccctctcccagccagggggccacccacataactggaccgcaatcagtagggaatgcctcaatcttctaaatggtatgactcagaagctgatcctctaccaagaggctgctgcgactaacggtcgtgtgtcatcgtcttacccagtggaaccgaaaaaattgaacagccctgaggagactgccttccagacccccaaatcatcacagatgcccagaccttctgtgcccccactggtgaagacctcgctgttcagcagtaaactttctaccccagacgtggtaagtccgttcggaactcccttcggctctagtgtgatgaaccgtatggctggtatcttcgatgttaatacatgttacggttcgccacagtctccacaactgatccggcggggcccccggctgtggacttctgcgtccgaccagcagatgacagagttctcaaatccgtccccttccacatcaatctccgctgagggcaaaaccatgagacagccttctgtgatctattcctggatccagaacaagcgagagcagatcaaaaacttcttgagcaagcgggtcctaatcatgtacttttttagtaaacatccagaagcatccatccaggccgtgtttagcgacgcgcagatgcatatttgggcgctcgaaggcctgtcccatctagtggccgcttcatttacggaggaccgcttcggcgtggtgcagaccaccttgccagctattctcaacacactgctcacgctccaggaggctgtggacaaatactttaagttgccccacgcaagcagtaaaccaccccgaatatctggttccctggttgacacatcttataagactctgagattcgcatttagggcttcactgaagactgcaatataccgtatcaccacaacattcggggaacatctgaatgctgtgcaggcgagcgcagagcaccaaaaaagactacagcaatttctggagttcaaagaatag

SEQ ID NO: 209443 - DNA, 1629 bp, Artificial Sequence
  Description of Artificial Sequence: Synthetic coding sequence
atggccaccgccgtgagccggccctgcgccggccggagccgggacatcttatggagagtactaggttggagaattgtcgcaagcattgtttggtcagtgctgttcctgccaatctgtacaacggtgtttatcatcttctctcgaattgacctcttccaccctatccaatggctcagcgatagtttctctgacctctatagcagctatgtgatattttatttccttttactgtccgtagtcatcattatcattagtatctttaacgtggagttttatgctgtggtcccgtccatcccgtgttcacgtctcgctctcatcgggaaaatcattcacccacagcaactgatgcacagttttatccacgctgccatggggatggtcatggcctggtgcgccgctgtgattactcagggacagtactcatttctggtcgtaccatgcaccggaactaacagcttcggcagcccagccgcccagacgtgcctcaacgagtatcatctctttttcctgctgaccggcgcatttatgggctactcctatagccttctgtacttcgtgaataatatgaactatctccctttcccaattatccagcagtataaattcttgagattccgtcggtcactgctcctgctggtgaagcattcctgcgtggagtctttattcttagttcggaatttctgtattctatattactttttgggttacatccccaaggcatggatcagcaccgcgatgaatctgcacatcgacgagcaggtgcaccgccccctggacaccgtgagcgggctgctgaatttatcattgctgtaccacgtttggctttgcggggttttcctgctcacaacatggtatgtgtcatggattcttttcaaaatctatgctacagaagcccacgtattcccagtgcaaccaccctttgcagaaggcagtgacgaatgcctccccaaagtcctaaactccaatccgccccctattattaaatatctcgctctgcaggaccttatgttgctgtcccaatactcccctagtcggcggcaggaggttttttccttgagccaaccaggcggacacccacataattggactgccatttcgagggaatgcctcaatctgctcaacggcatgacccaaaagcttatcctgtatcaggaggcagcggcgacaaacggtcgcgtgagctcctcatatcctgtggaacccaagaaattgaacagcccggaggagaccgctttccagaccccaaagtcttctcagatgcctagacccagtgtaccacccctcgttaagacctctctttttagttccaagttaagtactcctgacgtcgtctctccatttggaacacctttcggcagtagcgtcatgaatcggatggcgggcatattcgatgtcaacacttgctatggctcaccccagtctccacagctcatccgcagaggtcccagactttggacctccgcatcagaccagcaaatgacagagttctcaaatccaagtccatccacttcaataagtgcagaggccccacgcggccttcactcgggatgcttctttagatgtccaaacgcgtacctggggataaggcgctccgtggcactatcctcctctatcatatataggggatag

SEQ ID NO: 209444 - DNA, 1332 bp, Artificial Sequence
  Description of Artificial Sequence: Synthetic coding sequence
atgcggctgacccggaagcggctgtgcagcttcctgatcgccctgtattgccttttttcgctctacgctgcctatcacgtctttttcgggcgccgtcgacaggcgccggcaggctcaccccgcggtctgcggaagggtgcagccccggcccgcgaacgcagaggaagggaacagtcgacgctggaatcggaggaatggaatccgtgggaaggggatgagaaaaatgagcagcagcatcgctttaaaacatcgctgcagatactggacaaatctacaaagggcaagactgacctgagcgtccagatctggggaaaagctgccataggcctgtatctgtgggagcatatcttcgaaggattgctggatccttccgatgtgactgcccagtggcgggagggaaagagcatcgtgggccgcacgcagtatagctttatcaccggcccggctgtgatcccggggtattttagcgtagacgtgaataatgtcgtgcttatcctcaacggccgagagaaagctaaaatattttatgctacacagtggctactgtacgcccaaaacttagttcaaatacaaaagctacagcaccttgccgtggtcttgctgggtaacgaacactgcgacaacgaatggataaacccctttttgaagcgcaacggcggattcgtggagctcctgttcatcatttacgacagtccctggataaatgacgtggatgtcttccagtggcctctgggcgtcgccacatatcgtaatttccccgtggtggaagcgagttggtcaatgctccatgacgaaaggccctatctctgtaatttcctgggaaccatttacgagaattcatctaggcaggccctgatgaatattttgaaaaaggacggtaacgataagctgtgctgggtttctgcaagagaacattggcaaccacaggaaactaacgagagcctgaaaaattaccaggatgctcttcttcagagcgacctgaccctgtgccctgtaggtgtgaacaccgagtgttaccgtatctatgaagcatgcagttacgggtctatccccgtggttgaggacgtcatgacagctgggaactgcggaaataccagtgtgcatcatggtgcgccgttacaactgctgaagtccatgggcgccccatttatcttcattaagaattggaaggagctgcctgccgtcctggaaaaggaaaaaaccataattctccaggaaaagatagaacgccgtaaaatgctgttacaatggtaccaacacttcaagacagaactgaagatgaaatttactaacattttagaatcaagcttcttgatgaataacaagtcttag

SEQ ID NO: 209445 - DNA, 774 bp, Artificial Sequence
  Description of Artificial Sequence: Synthetic coding sequence
atggccgccgacggcgtggacgagcggagccccctgctgagcgccagtcattccggcaatgtgactccaaccgctccaccatacctccaggagtcctctccaagggccgagctcccccccccgtataccgccatcgcgagccccgatgcttccggcatacccgtgataaactgtagggtctgtcagtctcttattaacttggatgggaaactgcaccagcatgtggtaaaatgcactgtgtgtaacgaggccacccctattaagaaccctccaactggcaagaagtatgttcgttgcccatgcaattgtctcctcatttgcaaagatacctctcgcagaatcggctgcccccggcccaattgtaggcggattattaatctcggtcccgtaatgctgatctctgaagagcagcctgctcagccagccctgccaattcaacccgaggggacaagggttgtttgcgggcattgcggaaataccttcctgtggatggaactgcgttttaacaccctggccaagtgcccgcattgtaaaaagatcagcagtgtcggttctgcgttgcctcgccgcaggtgttgtgcatacattacaataggcatgatatgtatcttcattggggtgggactaactgtcggaactccagatttcgccaggcgttttcgggcaacgtacgtgtcatgggctattgcttacctcctgggcttaatttgtcttatacgcgcatgttattggggggccattagagtcagctatcctgaacactctttcgcatag

SEQ ID NO: 209446 - DNA, 2745 bp, Artificial Sequence
  Description of Artificial Sequence: Synthetic coding sequence
atgagcctgagccactggccctacttccggctggtgctgaacttccgcccacaagtgatctgccttccacagcctccaaaagtgctcggataccgcctggaacccccacatctcactctcgcctgcacactcgaagggatgtacaacattatcgaggaaattctggagagagatatcaacgggacactgctcagccaggcgacctgcgaactctgcgatggcaacgagaactcattcatggtcgttaacgccttaggcgaccggtgcgtgcgatgcgagcctacttttgtcaatacatcccgttcgtgtgcttgctccgagcctaatatccttactgggggactttgcttttcaagcaccggcaacttccctttgagaagaatctcggctgctcgatacggggaagtggggatgtccctgacgagtgaatggtttgcaaagtacttgcagagctccgccgccgcctgttgggtgtacgctaacctcacgagctgtcaggccctaggcaatatgtgtgttatgaatatgaacagctatgactttgctaccttcgatgcctgtgggctgttccagtttatcttcgagaataccgccgggctttcaactgtgcacagcatttcattctggagacaaaatctgccatggctgttctacggcgatcagctggggttagcaccccaggtactttcctctaccagtctacctacaaacttttctttcaaaggagaaaatcagaataccaagctgaagtttgtggctgcctcctatgatatccgaggaaatttcttaaaatggcagaccttggagggcggagtgctccagctgtgtcctgataccgaaacccgccttaatgctgcttactccttcggcaccacataccagcaaaactgcgagattccaatctccaagattctgattgactttcccaccccaattttttatgacgtgtacctggagtacaccgacgaaaatcagcaccaatatatcctggccgtgcctgtgctgaacctgaaccttcagcacaataagatcttcgtaaatcaggattcaaatagcggtaagtggttactcacaagaaggatctttcttgtcgatgccgtaagtgggcgagaaaatgatctgggaacacagccgagggttattagggtagccacacaaatcagcctgtcggtccacttggtaccaaatactatcaatgggaacatctatccacccctcattaccatcgcctactccgacatcgatattaaggacgccaactcccagagcgtgaaggttagcttctccgtaacatatgaaatggaccacggagaagcccacgttcagacagatattgccctgggtgtgctcggcggacttgccgtgcttgcatcattgctgaaaacagctggctggaaacgtcgcattggaagcccaatgatcgatctgcaaactgtggtgaaatttttagtatactatgcaggagatctggccaatgtattctttatcattaccgtgggtacagggctctactggctcattttttttaaggcccagaagagtgtgagtgtgctgctccctatgccaatacaggaggaaagattcgtgacatatgtagggtgtgcctttgcactcaaagccctgcagtttctgcacaaacttatttcccagattactattgatgtattctttattgattgggagcgccccaagggaaaagtgctgaaagcagtggaaggtgaggggggtgttcggagcgccaccgtgccagtttccatctggcgtacctactttgttgccaacgagtggaacgagatacaaaccgtacgaaaaatcaattccctcttccaggtcctgaccgttctgtttttcctggaggtggtcgggtttaagaacctggcattaatggatagtagcagctccctgtccaggaacccacctagctatatagcaccgtattcatgcatcctccggtacgctgtcagcgctgccctttggctggcgatcgggatcattcaagttgtattctttgcggtattctatgaacggttcattgaagacaaaattcgccaattcgtggacctgtgctccatgagcaatatctcagtgtttcttctatctcacaagtgtttcggatattatatacacggacgtagtgtccacggacacgcagataccaatatggaggagatgaacatgaacctgaagcgagaggccgagaatctttgttctcagagaggactggtgccaaacacagacgggcaaacgtttgagatcgcaatatctaatcagatgcggcagcattacgatcgaatccatgaaacactaattcgtaaaaacgggcccgctaggctgctttccagttccgcatccacattcgagcagagcattaaggcctatcacatgatgaacaagttcctgggtagtttcatcgaccacgtgcacaaggaaatggattacttcatcaaggataaactattactcgagcgcatcttgggaatggagttcatggagccaatggagaaatctattttttataatgacgagggctattccttctcgtccgtgctgtattacggtaacgaggccaccttgttaattttcgacctgcttttcttttgcgtcgtggatttggcttgccagaatttcatcttggccagcttcttgacttacctacaacaagagatatttcgttatatccgtaacaccgttggacagaagaatctggccagtaaaaccctggtggaccagcgtttcctgatttag

SEQ ID NO: 209447 - DNA, 2988 bp, Artificial Sequence
  Description of Artificial Sequence: Synthetic coding sequence
atggccacccggggcggcgccggcgtggccatggccgtgtggagcctcttatcggctagggctgtaaccgctttcctcctgctctttctgccgcgctttttgcaggctcagaccttctcttttccctttcaacagcccgaaaagtgtgacaacaatcagtatttcgacatctcagccctcagctgcgtcccctgcggggctaatcagcgccaagacgcacgggggactagttgtgtatgtcttccaggattccagatgatatccaataacggtggacctgctattatatgtaaaaaatgtccagagaatatgaaaggagttaccgaggacgggtggaactgcatctcctgcccatccgatcttactgctgaagggaaatgccactgtcccatcgggcacatccttgtggaacgagacattaatgggacactcctttcccaggccacatgtgaactgtgtgacggcaacgaaaattccttcatggtcgtgaatgccctgggcgacagatgcgtcaggtgtgaaccaaccttcgtcaatacctcccgcagctgcgcgtgtagcgaacctaacatcctgaccggtggcctgtgctttagcagcaccgggaactttccactgagaagaatttctgccgcaaggtacggggaagtgggcatgtccttgacatccgagtggttcgctaagtaccttcagtccagcgccgctgcttgctgggtctacgctaacctcacctcctgtcaagcgctggggaacatgtgcgtgatgaatatgaatagttacgactttgctacatttgatgcgtgtggcctattccaatttatattcgagaacaccgccggtctcagcactgtgcattccatttccttctggcggcagaacctgccatggctcttctacggagaccagttgggtctcgcaccgcaagtactgtcctctacaagcctccctaccaattttagcttcaaaggagaaaaccagaacactaagctaaagttcgttgctgcatcctatgatataagagggaattttctgaagtggcagaccctggagggaggtgtcctgcagctatgcccggataccgaaacccgcctgaacgcagcctattcatttggaactacctaccagcagaactgtgagatccctatttccaaaattctcattgattttcctactccaatcttttacgatgtttacctggaatacaccgacgagaaccagcaccagtacatcttggccgtccctgtgttgaatttgaaccttcagcataataagatcttcgtgaaccaagatagcaattctggaaagtggctgcttaccagaagaatttttttggtcgacgcggtgtccggccgtgagaacgatctcggtacccagcccagggtgatccgggtcgccacgcagatcagcctcagcgtacacctcgtgcccaatacgatcaatgggaacatttatccacccctcatcactatagcatactcggatattgatattaaagatgccaactcccagtccgtcaaggtttctttttccgtcacctacgagatggaccatggagaggcacacgttcagacagacattgccctcggcgttctcggcggcctggcagtcctggcctccctgctaaaaaccgcgggttggaagcgccgtattggttctcccatgatcgatctgcagaccgtagtcaagtttctcgtgtactatgccggtgatcttgctaatgtgtttttcatcatcaccgttgggactgggttatactggctgatattttttaaggcccagaaaagcgtaagtgtgttgctgccaatgcctattcaggaggagagatttgtaacctacgttggatgtgcatttgcactcaaggctctgcaattcctgcataagcttatctcacagataacaattgacgtcttctttatcgactgggaaagacctaaggggaaagtcttgaaagccgtggaaggtgaaggtggtgtgcggtcagcaacggtgccagtgtcgatctggaggacatacttcgtggccaacgagtggaacgaaatccagactgtccggaagataaactctttgtttcaggtgctgaccgttctttttttcctggaggtagtcggatttaagaatttggccctgatggatagctcttcgtcactgtctagaaacccgccttcctacattgccccgtatagctgcattttgagatacgctgtgagtgcggccttgtggttagcgatcggcatcatccaggtagtcttcttcgccgtgttctacgagcgatttatagaagataagattaggcagttcgtggacctatgttctatgtccaatataagtgtttttctactgtctcacaagtgcttcggctactacattcacggacgtagtgtgcacggtcacgcagatacgaatatggaagagatgaacatgaatctgaagagggaggccgagaacctgtgttcccagagagggttggtccctaacaccgatggacagacattcgagatcgctatctcgaaccaaatgcggcaacactatgataggatccacgagactttaatccggaagaatggccccgctcgtttgctgtcgagctctgcatccacttttgagcagagcattaaagcctatcatatgatgaataagttcctcgggtccttcattgatcacgtgcacaaagaaatggactatttcatcaaggataagctgctgctcgaacggatccttggcatggagttcatggagccgatggaaaagagtattttctataacgatgaggggtactccttcagctcagtcctttattacggtaacgaggccacattgctgatatttgatctgttatttttttgcgtggtagacctggcctgtcagaactttattttagcttccttcctgacctatttgcagcaagaaatcttccgctacattaggaacacagtgggtcagaaaaatctcgcctccaagaccctggtcgatcagcgctttttgatttag

SEQ ID NO: 209448 - DNA, 783 bp, Artificial Sequence
  Description of Artificial Sequence: Synthetic coding sequence
atgctgttcctggccctgggcagcccctgggccgtggagctgcccctgtgcgggaggagaacagccctgtgcgcggccgcagcactgcgcggccccagagcctccgtctcgagagcgagctcctcgtctggacctagtggccctgtagccggatggtctacagggccttcgggtgccgctcgtttgctacgacggcctgggagggctcagatcccagtctattgggagggatatgtgagattcctcaataccccgtcggacaagtccgaagatggacgattaatatataccggaaacatggcaagagctgtgttcggtgtaaaatgtttctcatacagtacctctttgatcggactcactttcctcccctatatatttactcagaacaatgccatctctgagtccgtgcctctccccatccagataatcttctacggcatcatgggatcgttcaccgtgatcacacctgtgcttttgcacttcatcacaaaggggtatgttatacggttgtatcatgaggcaacgacagatacatacaaggccattacctacaatgctatgttggccgaaacctcaaccgtcttccatcagaacgatgtcaagataccagacgccaagcacgtctttactacgttctatgccaagacgaagagtctgcttgtgaaccccgtcttgttccccaacagagaagattacatccacctgatgggatacgacaaagaggaatttatcctttatatggaagaaactagcgaagagaaacggcacaaggacgacaagtag

SEQ ID NO: 209449 - DNA, 324 bp, Artificial Sequence
  Description of Artificial Sequence: Synthetic coding sequence
atgctgttcctggccctgggcagcccctgggccgtggagctgcccctgtgtggcagaaggaccgctttgtgcgccgcagccgccctgcggggccctagagcctctgtcagtagggccagctcaagcagtgggccctcaggacctgtggccggatggtccaccggcccttccggcgctgcacgcctgttacgccgtcctggcagagcacagatcccggtgtattgggaaggctatgtgagatttcttaacacaccatcggataaatccgaagacggcaggttgatctacaccggcaacatggctagggcggtcttcggaaaatag

SEQ ID NO: 209450 - DNA, 918 bp, Artificial Sequence
  Description of Artificial Sequence: Synthetic coding sequence
atggagctgcactacctggccaagaagagcaaccaggccgacctgtgcgacgcgcgggactggagctcccgcggacttcccggagatcaggccgatacggcagccactcgcgctgctctttgttgccagaaacagtgtgcatcgactccccgtgctacagagatggagggatctaagctttcttcctcaccagcctcaccttcatctagtctacaaaactctacgttacaacctgatgccttcccacctggcctgttacactccggtaacaaccagattaccgccgagagaaaggtctgcaattgttgttcccaagagctggagaccagtttcacatacgttgataagaatatcaatctcgagcaacgtaataggtcctccccctcagctaagggacacaatcatcccggagagctaggctgggaaaaccccaatgaatggagccaagaagcggcgatttctctgataagcgaggaggaagacgacacgtctagcgaagccacttcatctgggaaaagcatcgattacgggtttattagtgcaattctgttcttggtcaccgggatccttctcgtcatcattagctacattgttccacgggaggtgactgtcgatccaaacactgtggccgcccgggagatggaaaggcttgagaaagaaagtgcgaggttaggcgcccatctggataggtgcgtcatagccggtttgtgtctgctgacgctgggtggcgtcattctgtcctgccttttaatgatgtcaatgtggaaaggagaactgtatagaaggaatcgcttcgcttcaagtaaagagagcgccaaactgtatggaagctttaatttcaggatgaagacctctacaaacgaaaatacactggagctctctctggtcgaggaggatgcactggccgttcaaagctag

SEQ ID NO: 209451 - DNA, 951 bp, Artificial Sequence
  Description of Artificial Sequence: Synthetic coding sequence
atgagcggcgacacctgcctgtgccccgccagcggcgccaagcccaagctaagcggtttcaaaggggggggtctgggcaacaaatatgtccagctgaatgtgggcggatcactgtactacacaactgtgagagctctgacgcgccacgacacaatgctaaaagcaatgtttagcgggagaatggaagtgctcaccgataaggaaggttggattctcatagaccggtgcggcaaacacttcgggacaattctgaattacttgcgggacgataccataactctccctcagaatcgacaggagattaaagaactgatggctgaggctaaatattacctgatacagggcctggtgaatatgtgccagagcgcgctgcaagacaagaaggactcgtaccagcccgtctgcaatattcctatcattactagtctgaaagaggaagagcggttaattgaaagctcaacaaaaccagtggtgaaattgttgtataaccggtcaaacaacaaatactcctacaccagcaatagcgatgaccatttactgaagaacatcgagcttttcgataagctgagtctacgttttaacggtcgggtgttgttcatcaaagacgtaatcggtgatgagatttgctgctggtccttttacggtcaaggaaggaaactggccgaagtgtgctgcaccagcatcgtatacgccacagagaaaaaacagaccaaagtcgagttccccgaagccaggatatacgaagagaccctgaacgttttgctctatgaaacaccacgggtcccggacaacagtttgctggaggccacaagtcgctcgcggtcgcaggcttctcccagcgaagacgaggagaccttcgagctgcgggacagggttaggaggatccacgttaagcgatactctacatatgacgataggcagctcgggcatcagtctacacatcgggactag

SEQ ID NO: 209452 - DNA, 210 bp, Artificial Sequence
  Description of Artificial Sequence: Synthetic coding sequence
atgaccaccctgatccccatcctgagcaccttcctgttcgaggacttttctaaggcaagcgggttcaaggggcagcgccctgagactctgcacgagcggctgactctggtctctgtctatgcgccctacctccttattccctttattctgctgatattcatgctccggagcccttattacaagtatgaggaaaaacgcaaaaaaaagtag

SEQ ID NO: 209453 - DNA, 1125 bp, Artificial Sequence
  Description of Artificial Sequence: Synthetic coding sequence
atggtgctgtgggagagcccccggcagtgcagcagctggaccctgtgcgaaggattctgctggctgctgcttctgccagtgatgctgctcattgttgctcgtcctgtgaaactcgccgccttcccaacttctctgagcgactgccaaaccccaaccggctggaactgttctgggtacgacgatagggaaaacgatctattcctgtgcgacacaaacacctgtaaatttgacggagaatgcttgcgtattggagataccgtaacatgcgtgtgccagttcaaatgtaataacgactatgtgccagtgtgtgggtccaacggagaatcgtatcagaatgaatgttatctccgccaagccgcttgtaaacagcagagcgaaattctcgtggtctcagagggttcttgcgccacagacgcgggcagcggcagcggtgatggtgtgcacgaaggaagcggagagactagccaaaaagaaacctctacctgtgatatttgccagttcggtgcagagtgtgacgaagacgctgaggatgtctggtgcgtctgtaatatagattgttcccagaccaacttcaacccactgtgcgcttctgacgggaagtcatacgacaatgcctgccagatcaaggaagcatcttgccagaaacaggaaaagatcgaggtgatgagcctggggcgctgccaggacaataccaccaccactactaaatccgaagacgggcactatgccaggactgactacgctgaaaacgcgaacaagttggaagagtctgcccgggagcatcatatcccctgccccgaacactacaacggtttttgcatgcacgggaaatgcgagcacagcatcaacatgcaagagccatcatgtcgttgcgacgcaggttacacaggccagcactgcgagaaaaaagattattcggtcttgtacgtagtccctggcccagttcgctttcagtacgtattgattgccgcggtgattgggactatccaaatcgccgtcatttgcgttgtagtgttgtgcatcactcgcaagtgtccacgatctaatagaatccaccggcagaaacaaaacaccggccattactctagcgacaatactacacgcgcttccactcggctgatctag

SEQ ID NO: 209454 - DNA, 528 bp, Artificial Sequence
  Description of Artificial Sequence: Synthetic coding sequence
atggtgctgtgggagagcccccggcagtgcagcagctggaccctgtgcgaggggttctgttggcttctgctccttcccgtgatgttgctgattgtggcccgtcccgtaaagctggcggccttcccaacctccctgtccgattgccagacccctacgggatggaactgtagcggctacgatgatagagagaatgacttattcttatgtgatactaacacttgtaagtttgacggagagtgtctgcgcatcggggacaccgttacctgcgtctgccagttcaaatgcaataatgactacgtgcccgtctgcggaagcaatggggagagctaccagaacgaatgctatctcaggcaggcagcatgcaagcagcaaagtgagatcttggttgtgagcgagggaagctgcgcaacagacgccgggtcgggctcaggtgatggaggacgctcctgcctgttcacgtacctgaaaatatactggtggatccttctgtgcatatttacttacgtctgttccatcagcgatatatag

SEQ ID NO: 209455 - DNA, 2427 bp, Artificial Sequence
  Description of Artificial Sequence: Synthetic coding sequence
atggccgagctgctggccagcgccggcagcgcctgcagctgggacttcccgcgtgctccaccctccttcccccctccagccgccagtaggggcggtctgggcggaacgcggagctttcgaccacacagaggcgctgaatctccacgcccgggacgggatagagacggtgtgagagttcccatggcgtcgagtcgatgtccagcccctagaggctgtcgctgcttgcccggagcatcactggcctggctcggtaccgtgctccttctgctggctgactgggtgctgctgaggaccgcactgccacgaatcttctctctgctggtgcccaccgccctgccactgttgagggtgtgggccgttggtctgtctaggtgggcagtgctgtggctcggtgcttgtggagtgctgagggccacagtggggtcaaaaagtgagaacgctggcgctcaggggtggctggctgctcttaaacctttggccgctgctctggggctggctctcccaggtctcgccctcttccgagagctgatttcctggggtgcacctggcagcgctgattctacccggctcttacactgggggtcacatcctactgcctttgttgtgtcttacgcagcagcactcccagccgcggccctgtggcacaaactgggcagcctgtgggtccctggggggcagggagggtcggggaacccagtaaggagactcctgggctgtttgggcagtgagaccagaaggttgtccctattcttggtgctggtggtgctctcgagcctcggagagatggcaatcccattcttcaccggccgcctgacagattggatcctgcaggatggcagtgccgacacattcacccgaaacctcaccctgatgtctattcttaccatcgctagcgctgtactcgagtttgtaggtgacggtatctataataataccatgggacatgttcacagccaccttcaaggtgaagtgtttggggctgttttacggcaagaaaccgaattcttccagcagaaccaaaccggaaatatcatgagtcgcgtgacagaggacacttctactctatcagattctctgagcgaaaatctgtcactgttcctgtggtatcttgtgagaggtctgtgcctccttgggatcatgctgtggggatctgtctctctcaccatggtgacactgatcactctgccacttctcttcctactccctaagaaggtcgggaaatggtaccagttgctggaagtccaagtaagggaatccctggcgaagagctctcaggttgctatcgaggctctgagtgccatgcctacagtgcggtccttcgcgaacgaggagggagaggcccagaagttccgcgaaaagctgcaggaaattaagaccctgaatcagaaggaggccgtggcttatgctgtgaactcttggaccacttcaatctctggaatgctgcttaaagtcggcatactgtatatcggaggacagttggtgaccagcggtgcggtaagttcgggcaatttggttactttcgtactgtatcagatgcagtttacccaggccgttgaggttctcctctccatctatccacgagtacaaaaggctgtgggctcttcagagaagattttcgagtaccttgatcgaacaccacgatgccctccgtctggcttactcacgcccctgcatctggagggtctagtccaatttcaggacgtctcttttgcctaccccaatcgccccgacgttctggtcctgcaggggctcacttttacactgcgtcccggcgaggtcaccgccctcgtgggaccaaacgggagcggcaaatccactgtcgccgcactcttgcagaatctctatcagccaacaggagggcagctcttgcttgacggcaagcccctgccacagtacgagcataggtacctccatagacaggtggcagcagtaggtcaagagccgcaggtgtttggtaggtccctgcaggaaaacatcgcatacggactgacccagaagccaactatggaggagataaccgccgcagccgttaaatccggcgcccattcgtttatttctggtcttccccaggggtacgatacagaggtagacgaggcagggagtcagctaagcggcggccagagacaggccgtggccctcgcccgtgctctgatccggaaaccctgtgtattaatccttgatgacgcaaccagcgccctcgatgctaactcccagttgcaggtagaacagctcctctacgagtcccctgaaagatatagcagaagcgtgctcctgattactcagcatctctctctcgtcgaacaggccgaccatatcttgtttctggaaggcggggcgatcagggaaggaggcacccaccagcagcttatggaaaaaaaaggatgttattgggccatggtacaagcgcccgcggacgctcctgagtag

SEQ ID NO: 209456 - DNA, 2427 bp, Artificial Sequence
  Description of Artificial Sequence: Synthetic coding sequence
atggccgagctgctggccagcgccggcagcgcctgcagctgggacttcccccgagccccgccatcctttcccccaccagcggcttccaggggcggcttgggaggtacacggtcatttagaccgcataggggcgccgaatcaccgcgtcccggtagggatcgagatggtgttcgagtgcctatggcgtcttcgcgctgtccagcccctcgcggttgtagatgtctcccgggggccagtctggcctggttgggcacggttctattgttactggccgattgggtgctgctccgcacagcattgccccggattttttccctacttgtacccacggcactgcccctcttgcgggtatgggcggtgggactcagtagatgggcggtactatggctgggcgcttgtggagtcttgcgggctaccgttggctccaagagcgagaatgcgggcgcacaggggtggttggccgcgctaaaaccactcgccgccgccctcggccttgcgctccccggtctggcactgtttagagagttgatcagctggggagcccctgggtccgcggatagtacccgcttgctccactggggcagtcaccccaccgccttcgtggtttcatacgctgctgcgctgcccgccgccgccctctggcataaactggggagtctctgggtgccaggtggccagggaggttctggtaatcctgtgaggcggttgctcggctgtttggggtcggagaccaggaggctgtctctctttctggtcctcgtggtcctgtcctcgttgggcgagatggcaataccattcttcacaggtaggctcaccgactggatcctgcaggacggttcagctgatacttttacaaggaacctgaccctaatgtcaatccttacgatcgcctcagccgtcctggagtttgtgggcgacggaatctacaacaataccatgggtcacgtgcacagccacttgcagggagaagtgtttggagccgtgcttcggcaggagactgaattttttcaacagaaccagacgggaaacattatgagtcgcgtaaccgaagatacttccactctatccgattcgctgtccgagaacttgtccctattcctgtggtacctggtgcgtggtctttgtctgctcggaatcatgctctgggggtctgtgtcgttgacaatggtcacactcattacactgcctctgctctttcttctccctaagaaagtcgggaagtggtaccaactcttggaagttcaagtccgcgagtccctagcaaaaagctctcaggtggctattgaggcactcagtgctatgccaacggtccgaagctttgcaaacgaggaaggcgaagcacagaaatttcgggaaaagctgcaggaaatcaagacactgaatcaaaaggaagcggtagcttatgcagttaattcttggacaacgagcattagcggaatgctcctgaaagtcggcattttatacatcggcggccagcttgtgacgagcggtgccgtgtcatccggaaatctggttacctttgttctttatcaaatgcagttcactcaggccgttgaggtgcttctgtcaatctatccccgggttcagaaagctgttggttcctcagaaaaaatcttcgaatatctcgacagaacaccacgatgtcctccctcaggactgctgacacccctccacctggaaggcctggtccaatttcaagacgtgtccttcgcatatcctaaccggcctgacgtcctggttctgcaggggctgacttttaccttgcgccctggtgaagtcacagcactcgtcggccctaacgggtccgggaagtcaactgtggcagccctccttcaaaacctgtaccaaccaaccggaggacagctactgctggacggtaaacctcttccacaatatgagcaccgctatctgcatcggcaggtggctgcagtgggtcaggaaccccaggtctttggccgctcattgcaggagaatatcgcatacggcctgacccagaagccaaccatggaggaaattacagcagcagctgtgaaaagcggggcgcattcctttattagcggactgccacaaggctacgatacagaggtggacgaagctggtagccaacttagcggaggccaaaggcaggcagtggccctcgctcgggctttgattcggaagccctgcgtacttatcctggatgacgcaaccagcgccttagatgccaatagccagctgcaagtggagcagttgctgtacgaatcaccggagcgttactcaaggagtgtcctgttgataacgcagcatctgagtctcgttgaacaggctgaccacattctgtttctggagggtggagcaatcagggagggagggacccaccagcagctcatggaaaaaaaggggtgctactgggcaatggtgcaggctcctgcggatgccccagaatag

SEQ ID NO: 209457 - DNA, 2427 bp, Artificial Sequence
  Description of Artificial Sequence: Synthetic coding sequence
atggccgagctgctggccagcgccggcagcgcctgcagctgggacttccccagggctcctccatcatttccgcctcccgctgcatcgcgaggggggctcggaggcacgcggtcctttcggccacatcggggggcagaaagcccgcgaccaggcagagatcgcgacggggtgagggtgcccatggcatccagcagatgcccagcccctcgtggctgccgatgtctccccggcgcctctctcgcctggctggggacggttttgctcctcctggccgattgggttctcctgaggactgcacttcctcgtatcttctctctgttggtgcccacagctcttcctctcctaagggtgtgggccgtgggactttctcgttgggccgtgctgtggctcggggcctgtggcgtgttacgcgctactgtgggtagtaagtcagaaaatgccggagctcagggatggctggcagctttaaagcccctcgccgcagcactggggctggctcttccaggacttgcactgttccgcgaactgattagttggggggcccccggaagcgctgactccacaagactgctacactgggggtcacaccctaccgcctttgtggtgtcatatgccgccgcgctcccagccgctgccctttggcacaagttaggtagtctctgggtaccaggcggccagggaggctccggaaaccccgtccgtcggctccttggttgtctggggtccgagacccggcggctctccctattcctggtgttagtggtcctaagctcccttggcgaaatggccattcctttctttaccggccggctgacggactggatcttgcaggacggctcagccgatacttttactcggaatctcaccctgatgtccattctgaccatcgcttcggccgtgctggagttcgttggtgacggtatctacaacaataccatgggccacgtccacagtcatctgcagggagaagtgttcggagcagttttgcgtcaggaaacggagtttttccagcagaatcaaacaggaaatatcatgtccagagtcactgaggataccagtacattaagcgacagcctcagtgagaatctgagcctatttctctggtacctcgtccgagggctgtgcttactgggaattatgctgtggggaagcgtgtcactcacaatggtcacgctgattaccctccctctgctctttctactacccaagaaggttggtaaatggtaccaactgctggaggtgcaggtcagggaatcattggccaagagctctcaagtagccattgaagccctgagcgcaatgcctacagtcaggtcttttgccaacgaggaaggggaggcccaaaagtttcgcgagaagttgcaggagataaaaacactgaaccaaaaggaagccgtggcctacgccgtgaactcatggaccacgagtatctctggcatgctcctgaaagtggggattctctatatcggggggcaattggtgacctccggagcagtgagcagcggcaaccttgtcacctttgtgttgtatcagatgcagttcacccaggcagttgaggtgcttctgtccatctatccacgcgtgcagaaagccgtggggagttctgaaaagatctttgagtacctggatcgcacgcctcggtgccctccatcagggcttttaacgcctcttcacttggagggcttagtgcaattccaggatgtgagttttgcgtatccaaatagaccagacgtgcttgttctacaaggacttacttttactttgaggcccggcgaagtgactgccttagtgggccctaatggctcaggaaagtcaaccgtcgcagcactcctgcagaacttgtaccagcccactggaggacagctactgctcgacggaaagccgctcccacagtatgaacacaggtaccttcaccggcaggttgctgccgttggccaggaaccccaggttttcgggcggagtctccaagagaatatagcgtacggcctgacccagaagccaacaatggaggagattacggcggctgctgtgaagtctggcgcgcacagctttatttcaggtctgccccaggggtacgacacagaagttgacgaagcgggctcccaattgtcaggcggccagaggcaagccgtggccctggcgcgggcgctcattcgcaagccttgtgtgctcatcctagatgacgccacctctgctttagacgctaacagtcagctgcaggtcgagcagctgctttacgaaagccctgagcgctactcacgatccgtgctgctgatcacacaacacctgtccctggtggagcaggctgatcacattctcttcctggaaggaggggctataagagaggggggaactcaccaacagcttatggagaagaaaggatgctattgggcgatggtgcaggctcccgctgacgctccagagtag

SEQ ID NO: 209458 - DNA, 2427 bp, Artificial Sequence
  Description of Artificial Sequence: Synthetic coding sequence
atggccgagctgctggccagcgccggcagcgcctgcagctgggacttccccagagcgccgcctagcttcccaccccccgcagcctctcggggaggcctaggtgggacacgatcatttcggccccaccggggggcggaatcccctagacccgggagggatagggacggagtgcgggtgcccatggccagctccaggtgtcccgccccgaggggatgtcgctgcctcccaggagctagccttgcttggctgggcaccgtgctgctgctgctggctgactgggtactgcttaggactgcccttcctcggattttctctctgctagttccaacggctctgcctcttctccgggtctgggctgtcggtctgtccaggtgggctgtgctctggttgggcgcttgtggggtgctacgcgccaccgtcggcagcaaaagcgagaatgccggcgcgcaggggtggctcgctgcacttaagcccctcgccgccgctctggggctcgcacttccagggctcgctttatttagggagctaatttcttggggggcccccggcagcgcggattccacaaggctcttgcactggggatcacatcccactgcatttgtggtgtcctacgccgcagctctgcccgctgctgccctttggcacaaactgggcagcctatgggtgccagggggacagggaggctcaggcaatccagtgcgacgccttttgggctgcttggggtcagagacccggcggctttccctgtttctggtgctggtcgtactgtcatcattaggtgagatggccataccgttctttacgggcagactgaccgactggatcctgcaggacggctccgctgacacatttacaagaaacctgacacttatgagcattctgacgatcgcctctgccgtgctggagtttgtgggcgatggcatttataacaacacgatggggcacgtgcatagtcacctgcagggcgaggtttttggcgcggtgctcaggcaggagacggagtttttccagcaaaaccagacgggaaatatcatgagtcgtgtgactgaagatacgagtacgctcagcgactctttatcggagaatcttagtctgttcttgtggtacctagtccggggactatgcctcctggggataatgttgtggggaagtgttagtcttaccatggtaacactgatcactttgccccttctcttcctacttcctaaaaaagtgggtaaatggtatcagctcctggaggtgcaggtcagagagtctctggcaaagagctctcaagtggccatcgaagccttgtctgcgatgcccacagtcaggtcttttgccaacgaggagggtgaggcccaaaagttccgggaaaaactgcaggaaattaagaccctcaaccagaaggaagccgtggcttacgctgtaaacagttggacaacttctatcagcggtatgctgctcaaagtcgggattttgtatattggcgggcagttggtaaccagcggggcggtctctagtggtaatctagtgacgttcgtgctgtatcagatgcagtttacacaggctgtggaggtccttctgtcgatctaccccagagttcagaaagcagtcgggagctcagagaaaattttcgagtatctcgatagaaccccgcggtgtccgccttcgggacttcttacacctctgcacctggagggcctcgtgcagtttcaggacgtaagctttgcctatcccaatcggcccgacgtgttggttctgcagggactgacatttacgctcaggcctggggaggtcaccgcattggtcggacctaacggatcaggaaagtcgactgtagcagctctactgcagaacctgtatcagccaacaggcggccagctgctgcttgatgggaagccgctgcctcaatatgagcacagatacttacataggcaggtggccgccgtcggccaggaacctcaggtgtttggccgttctctgcaggagaacatcgcttacggcctaacacagaaaccaacgatggaggaaatcactgccgccgcagttaagagcggagcacacagcttcatttctggactgcctcagggctatgataccgaggtggacgaagcgggaagtcagctcagcgggggccagagacaggccgtggccctggcccgggccctgattagaaaaccttgcgtgttgattctagacgacgccaccagcgccctcgatgccaattcacaactccaagtagaacaactcctgtacgaatctccagaacgctacagccggagtgtgctgctgatcacacagcacttgagcctagtcgaacaggccgatcatatcctgtttttggagggcggggccattcgggaaggtggaacccatcagcagctcatggaaaagaagggctgctattgggccatggtacaggcacctgcagacgcgccagaatag

SEQ ID NO: 209459 - DNA, 2427 bp, Artificial Sequence
  Description of Artificial Sequence: Synthetic coding sequence
atggccgagctgctggccagcgccggcagcgcctgcagctgggactttccgcgcgcccccccgtcgttcccccctcccgccgcaagcaggggtggattgggtgggaccaggtcgttcagaccacaccgcggggccgagtcccccagacccggcagagatcgtgacggggtgcgggttccaatggcttctagtagatgtccagccccaagaggctgcaggtgtctccctggagcctctctcgcttggctaggaacagtgttactgctcctggcggactgggtgctgctcaggacagcccttccacggattttcagtcttcttgtcccgacagccttgcctcttctgcgcgtgtgggcagtaggtctgtctcgatgggctgtgctttggctgggcgcttgcggcgttctgcgcgcaaccgtcggttctaagtccgagaatgccggagcccaaggatggctcgctgcccttaagcccttggcagccgcccttggtctggcactgcctggcctagcattgttccgagagctaatatcttggggcgcccccgggtctgctgacagcaccaggctgctgcattggggaagtcaccccactgcttttgtcgtgtcctacgcggctgccctgcctgcagcggctctctggcacaagctcgggtctctctgggtcccaggcggacagggcggcagtgggaatcccgtgaggcggctcctgggctgtttaggctctgagacgagacgtcttagtttgtttttggtactagttgttctgtcttcccttggggagatggccatcccttttttcactggccgactcacggattggatcctgcaggacggcagcgccgacacatttaccagaaatctgacactgatgagtatcctgacgatcgcctccgctgtcctggaattcgttggcgacggaatttacaacaataccatgggccatgtgcattcccatttgcagggagaggtcttcggggccgtccttcgtcaggagaccgaatttttccagcagaatcagacaggcaacatcatgtctcgtgtaacggaggatacgtccacactctccgacagcctctctgaaaacttgtctttgttcttatggtatctggttcggggcttgtgtctgctgggcataatgctgtggggtagcgtttccttaactatggtaacactgattactctacccctgctgttccttctccctaaaaaggtgggcaaatggtatcagctcttagaggtccaagttagagaaagccttgccaagtcaagccaggtggccattgaagccctcagtgcaatgcctacagtgaggagtttcgcgaatgaggagggcgaggcgcaaaagtttagggagaagcttcaggaaataaagacacttaaccagaaggaggcagtcgcatatgcagttaacagctggactacctccatttctgggatgctgctcaaagttgggattttgtacattggggggcaactcgtcacttcaggagcagtgtcatcaggaaatctggtcacctttgttctgtaccagatgcaatttacccaggccgtcgaggtgctgctctctatctacccaagagtgcagaaggcagttgggagttcagagaagatttttgagtacctagaccgcactccacgatgccccccaagcgggctgcttacgcccctgcatttggagggcctcgtacagtttcaggacgtcagcttcgcttaccccaaccgaccggatgttttagtgctccagggcttgaccttcaccttaagacccggagaggtcacggcactggtcggacctaatgggtcaggcaagtccacagtcgcagccctactccagaatttgtatcagccaacaggcgggcagctcctgctggacggaaaaccattgccccagtacgaacatagatacctgcaccgccaggtggccgccgttggacaagaaccacaggtcttcggccgctcccttcaggagaatatcgcctacggcctgacgcagaagcctactatggaagaaattaccgcagcagccgtgaaatcgggcgcccactccttcatcagcggcttgccccagggatacgacaccgaggtcgacgaagctggctcacagctgagcggcggccagagacaggcagttgctctggcacgagcattgatcagaaaaccttgcgtcctcatcctggacgatgcaactagtgcattagatgctaatagccaactgcaagtggaacaactgctatacgaaagccctgaacgatactctcggtctgtgctcctcattacccaacacctctccctagtggaacaggcagatcacatcctcttcttggagggcggagccattcgagagggcgggactcaccagcagctgatggaaaagaaaggatgctactgggcaatggttcaggcccccgctgacgctccagagtag

SEQ ID NO: 209460 - DNA, 1644 bp, Artificial Sequence
  Description of Artificial Sequence: Synthetic coding sequence
atggccatccccttcttcaccggccggctgaccgactggatcctgcaagacggctctgcagatacattcacaaggaatcttactcttatgtccatactgaccatagcgagcgctgtgctggaattcgttggcgacgggatctacaacaacaccatgggacatgtgcattcacacttacaaggagaagtatttggggccgttctaaggcaggaaaccgagtttttccaacagaaccagacaggtaatatcatgagcagagtgaccgaggatacatctaccctttcagattccctgagcgagaatctgtccttattcttatggtacctggtcagaggattgtgtcttctgggcattatgctttggggctccgtcagcctgactatggtgaccctaattactctgccccttttattcctactgcctaagaaagtgggcaagtggtatcagttactggaggtccaagtgagggagtccctggctaaaagtagccaggttgctatagaggccttgagcgcgatgcccactgtgaggtccttcgcgaatgaggagggcgaggcccaaaagtttcgcgagaagttgcaagagataaaaaccctaaaccagaaggaggctgtcgcctacgccgtgaactcttggacgacgtcgatttctggaatgctcctgaaagtgggtatactatacattggcggtcaactggttacctcgggtgccgtaagctcaggcaatctcgtgacttttgtcttatatcagatgcagtttactcaggcggtcgaggtcttgctgagcatctatccccgcgtacagaaggctgtggggagctcggaaaaaatttttgagtatcttgaccgaactccacgttgcccaccttcaggccttctcaccccactacacctggagggtctggtgcagttccaggacgtctcttttgcctaccccaatcggcctgacgtgctggtgttgcagggacttactttcacgttaagacccggcgaagtgacagccctggttggccccaacgggtctgggaaaagtactgtggcagccttacttcagaacttgtaccagccaacaggcgggcagctcctcctagacggcaaaccactgcctcagtacgagcaccggtatctccatcggcaagtggccgcagtcggccaggagccccaagtgttcggacgttcacttcaggaaaacatcgcttatggcctcactcagaaaccgacaatggaagagattacagcggccgcagtcaagtctggtgcacatagcttcatctccggcctgccccagggatacgacaccgaagtagatgaggcaggctcccagttaagtggaggccagagacaagccgtcgctctggccagagctctgattcgtaaaccatgtgtgctcattctcgacgatgcgacatccgccttagatgcaaatagccagttacaggtggagcaactactatacgagtctcctgaacggtattccagaagcgtgcttcttataacccaacacctgtccctggtagagcaggctgaccatatcctgtttctggagggaggagctattcgtgaaggcggaacgcaccaacagcttatggagaagaaggggtgctattgggcaatggtccaagcccctgctgatgctcccgagtag

SEQ ID NO: 209461 - DNA, 2427 bp, Artificial Sequence
  Description of Artificial Sequence: Synthetic coding sequence
atggccgagctgctggccagcgccggcagcgcctgcagctgggacttcccgcgcgctcctccctcatttcctccacctgccgctagcagaggcggccttggcggtactcgctcttttcgcccccataggggggctgaaagccctaggccagggcgggatcgagatggcgtgagagtgcctatggcctcctcccggtgccccgcgccacgggggtgccggtgcctgccaggcgcatctctggcttggctgggaactgtgttactcttgttggctgactgggtactgctacggacagctctgcctcgcatcttcagtctgctggtccctacagcactgccactcctgagggtgtgggcagtgggactctctcgttgggccgttctttggctgggagcgtgcggcgttttacgcgctaccggaggaagcaagtcggaaaacgccggagcccagggttggctggcagcactcaagccactggctgcagcccttgggctggccctaccaggcctcgcactctttcgggagctgatctcctggggtgcccccgggagtgccgattccacccgactgttgcactgggggagccaccctacggcttttgtagtctcttacgcagccgctctgcccgcagcagccctgtggcataaactggggtctttgtgggtacccgggggacagggtggcagtggaaatccggttcgtcgtctcttaggatgcttaggatcggagacaaggagactgtcactgtttctggtgctggtcgtcctatccagcctcggtgaaatggccatcccattttttactggccggctcacagactggattctacaagacgggagtgccgacacttttaccaggaaccttacccttatgagtatcttaactatcgctagtgcagtgctggagtttgtaggcgatggaatttataacaacactatgggacacgttcacagtcacctgcagggcgaagtttttggggccgttcttcggcaggagacggaattttttcaacagaaccagaccggaaatattatgagcagggtgaccgaagacacaagcacgctcagtgattccctgagtgagaatctgagcctgtttctatggtatttggtgcgcggcctatgtctgctaggcatcatgttgtggggctctgtctctttgactatggtcacgctgattacacttccactcttgtttttgctgcctaaaaaggtgggcaaatggtatcagctgctggaggttcaggtgcgtgaatcactggctaagtccagtcaagtggctatagaagcactcagcgccatgccaacggttcgcagctttgctaacgaagagggggaggcgcagaagttcagggaaaagcttcaggagataaagacattgaaccaaaaagaggccgtagcttatgccgtgaattcttggactacctccatatctggcatgctgcttaaagtggggatcttgtacatcggcggccagctggtaacctccggagcggtctcctctgggaacctggtgactttcgtgctgtaccagatgcagttcacccaggccgtagaggtactgttgagcatctaccctcgggttcagaaagccgtcggtagcagcgagaagatttttgaatatttggaccgcactccgaggtgtccgccaagcggcctcctgactcctctccaccttgaaggactggtacagttccaggatgtcagcttcgcctacccaaaccggccggacgtgctggttctacagggcctcacatttaccctcagacctggggaggttaccgcgttggtgggacctaacgggtctggcaagagtaccgtggccgccctgctacagaatctttaccagcccaccggcggtcagctgctgctggatgggaaacccctgcctcagtatgagcatcggtatctccacaggcaagtagctgcggtaggacaagaaccccaggtattcggtcgcagtctgcaggaaaacattgcctatggcttgacacagaagccaactatggaggagattacagccgctgctgtcaagtccggggcgcattctttcattagtggcctaccacagggctatgacactgaggtggatgaggctggcagccagctgagcggaggccaacgccaggccgttgccctggcaagggcactgatccgaaaaccgtgtgtgctaatcctggatgatgccacttctgcactagatgctaactcccaactgcaagtggaacagctgctctatgagagtccagagcgatattcgaggagcgtgctgctcatcacccagcatttgtccttggtggagcaagcagatcacatcttgttccttgagggcggcgccatacgcgagggaggtacgcaccagcagttaatggaaaagaagggctgttactgggctatggtgcaggccccagcagatgccccggagtag

SEQ ID NO: 209462 - DNA, 2427 bp, Artificial Sequence
  Description of Artificial Sequence: Synthetic coding sequence
atggccgagctgctggccagcgccggcagcgcctgcagctgggacttccctagagctcctcctagctttcctcctcccgctgccagccggggtggactcggcggcactcggagttttagaccgcaccggggtgccgaatcccctaggccaggtagagatagggacggcgtgagagtgccaatggctagttccaggtgtcccgccccccgagggtgtcggtgcttaccaggggcaagtctcgcttggttggggactgtcctcctgctgttggcagattgggtgttgttaagaacagccctccctaggatcttcagcctcctggtgccaaccgcgctcccactcctaagagtatgggctgttgggctgtcgagatgggctgtgctgtggcttggggcctgcggtgtactgagagcgacagtgggttccaaaagcgagaacgctggcgcacaggggtggttggccgctctcaaaccactggctgccgcactggggctggcgcttcccgggctggcccttttcagggagctgatctcttggggcgccccaggtagcgcagattcaactcggcttctccactggggtagtcaccccaccgcctttgtggtgagctacgcggcagctctgccggccgctgcactgtggcacaagttgggctctctctgggttccgggaggtcagggcggttccggaaaccccgtcagaagattgctcggatgtctgggatctgagacaagacgcctgtcgctgtttctcgtcttagtggtgctgtcatctcttggggagatggccattccttttttcacagggcgcctgacagactggatcctccaggatgggtcagccgacactttcacgcgcaatttgaccttgatgagtatcctgactatcgcttccgcggttctagagttcgtgggagatggcatctataataacaccatgggtcacgtgcattcgcatctgcagggggaggtgttcggggcagttcttcgacaggagacagagttttttcagcagaatcagacaggtaacatcatgtctcgggtgaccgaagacacttctactctgagcgactccctgtccgagaatctctcactgttcttgtggtatctggtacgagggctatgcttacttgggataatgctgtggggatctgtttcactgactatggtcaccctgatcacattgcccctgctcttcctcctccccaaaaaggtgggaaagtggtatcaattgcttgaggtgcaggtgagggaatccttagccaagtcaagccaggttgctatagaggccctttctgccatgcccaccgttcggtcattcgcaaacgaagagggcgaagcacagaagtttcgggagaagcttcaggaaataaagaccctgaaccaaaaagaggccgtcgcttacgctgtgaattcctggacaacaagcatctccggaatgttactgaaagtggggatcctgtacattggaggccaactggttacatcgggagccgtcagctcaggcaatctcgtcacctttgtactgtatcagatgcaattcacacaagctgttgaagtgctcctgagcatataccctagggtgcagaaggctgttggttcttccgagaaaattttcgagtatctggacagaactccgaggtgtcccccttcaggcctgcttaccccactgcatctcgagggactggtgcaattccaagacgttagttttgcctaccccaaccggccagatgttctcgtgctgcagggactcacctttacgctccgtccaggcgaggtgactgcactggtagggcctaatgggtccggcaagtccactgttgccgcactgttgcagaacctctaccagcccaccggcgggcagctcctgctcgatggcaagcccctgccccaatacgaacatcggtatctgcaccgccaggtcgcagccgtaggacaggagccccaagtgtttggaagatcactgcaggagaatatcgcttatggactgacacagaaacctacgatggaggaaatcacggcagctgccgtgaagagcggggcgcatagtttcattagtgggctgccgcaggggtacgacaccgaggttgacgaggcaggctctcaattgtctgggggccagaggcaggccgtggcactcgcaagggccttaatcaggaaaccatgtgtcctcattctggacgatgccacttccgccctcgacgctaattcacagctccaggtggaacagctgttatacgagtctcctgaacgctattccagaagtgtactcctcatcacccaacatctttctttggtagagcaggctgaccatatcctcttcctggagggaggagcaatccgagagggtggtacacaccagcagctgatggaaaagaaggggtgctactgggcaatggttcaggcccccgctgacgccccagagtag

SEQ ID NO: 209463 - DNA, 2427 bp, Artificial Sequence
  Description of Artificial Sequence: Synthetic coding sequence
atggccgagctgctggccagcgccggcagcgcctgcagctgggactttcctagggctcccccaagctttccaccacccgccgctagcagaggaggtctgggtgggacaagaagctttcgtcctcatagaggggcagagagtccccggccaggtcgggatagagacggagtgcgagttccaatggcaagctcaaggtgtccggccccacgaggttgtcgctgtctgcccggcgctagtctggcgtggctcgggactgtgctgctgctccttgcagattgggttttgctgaggactgctcttccacgcatctttagtctcctggtcccgacagcccttccattgctacgcgtctgggccgtgggcctgtcgagatgggccgtgctctggttgggggcttgcggggtactacgcgctactgtcgggtccaaaagtgaaaacgccggggcccaggggtggctagccgctctaaagcccttggccgctgccctgggcctcgctctgcccggattggcactgttcagggagctgatctcatggggagccccagggagcgccgatagtactcgactcctgcattggggctcacatcccacagcattcgtggtttcttatgccgccgcccttccggctgccgccttgtggcacaagttaggttccctgtgggtgcctggtgggcagggaggctccggaaatcccgtgcgcagacttttgggctgtcttggctccgagacacgccgtctctccctgtttctcgttcttgttgtgctcagttccctgggcgagatggcgatacctttttttacgggtagactgacagattggatcctgcaagatggcagcgcggacactttcacccggaatctcaccctcatgtccatcctgaccatcgcgagtgccgtgctggagtttgtgggggacggcatatacaataacaccatgggccatgttcactctcatttgcaaggtgaggtgtttggcgcggtgctgagacaggaaaccgaatttttccagcagaaccagactgggaatatcatgtcgagagtgactgaggacacaagcaccctgtcagattcattaagtgaaaatctgagcctattcctgtggtatctcgtgcggggtctctgcctgttggggatcatgctttggggctccgtctctctgacaatggtaactttgattacactgccgcttctgttcctgcttcccaagaaggtgggcaagtggtaccagctgctggaggtccaagtgagagagagtttggctaagtctagccaggttgccatcgaggccctgtccgctatgcccacagtgcgcagcttcgccaatgaagaaggcgaagcgcaaaaatttcgtgagaaactccaggaaatcaagaccctgaaccagaaggaagctgttgcctacgccgttaacagctggaccacttctatcagtgggatgctgctgaaagttgggatcttgtacattgggggacaattggtgacatcaggagcagtgtcttctgggaatctggtgacttttgtgctgtaccagatgcagtttactcaggcagtggaggtactcttgagtatatatcctcgagtgcagaaggccgtgggatctagcgaaaaaatatttgagtatttggacaggactccacggtgccccccttctgggctgctgacgccgctgcatctggaggggcttgttcagttccaagacgtgtcctttgcttacccaaatcgacctgacgttctggtgttgcaggggctcactttcactctccgacctggggaggtgacggccttggttggaccaaacggaagcggaaagagcacagttgcggccctcctccagaacctgtaccaacccacaggagggcagttgctccttgacggaaaacctttgccccaatacgaacaccgctatcttcaccgtcaggtagccgctgtgggccaagaaccccaggtatttgggcgcagtttgcaggagaacatagcgtacgggctgacccagaagccgaccatggaagagatcacagccgccgccgtgaaatcaggcgcccattcttttatttctggattgccccagggctacgacaccgaagtggatgaggccggcagtcagctgagtggcggccagcgacaggctgtagctctggctcgtgctctgattcggaagccatgcgttttgattttggatgacgctacatctgctctggatgccaattctcagctccaggttgaacagcttctgtacgagagccccgaaaggtactctcgcagcgtattactgattacacagcatttgagcctcgtcgagcaagctgatcatattctgttcctcgagggcggcgcaataagggaaggggggactcatcaacagcttatggagaaaaagggttgttattgggccatggttcaggcacccgcagatgcacccgagtag

SEQ ID NO: 209464 - DNA, 1644 bp, Artificial Sequence
  Description of Artificial Sequence: Synthetic coding sequence
atggccatccccttcttcaccggccggctgaccgactggatcctgcaggacggaagtgcggatacgttcactaggaacctgaccctgatgtccattctcaccatagcaagcgccgtcctcgagtttgtgggagacggcatctataacaacaccatgggacacgtgcatagtcacctgcaaggcgaagtctttggtgctgtcctccgccaggagaccgagtttttccagcagaaccaaactgggaacattatgtctagggtgaccgaagatacaagtacactgtcagactcactgtccgagaacttatctttatttctctggtatctcgttaggggcctctgtctattgggtatcatgctgtgggggtcagtttctctcaccatggtaaccctgatcacactgcccctgctcttcctgctgcctaaaaaagttggcaaatggtatcaactgttggaagtgcaggttagagagtccctggctaaatcctctcaagtggccatcgaggccctcagcgccatgcctaccgttcgaagtttcgcaaatgaggagggcgaagcacagaagtttagggagaaactgcaggaaatcaagactctgaatcaaaaggaagccgtcgcatacgccgtgaattcgtggaccacgagtatcagcggaatgctgctgaaggtcgggatactgtatataggcggacagctggtgacatccggagccgtgtcttcagggaacctggtaacctttgtcctctaccagatgcagttcactcaggcggttgaggttctgctctcaatctatccccgcgtgcagaaagccgtgggatcaagtgagaaaatcttcgaatacctggacagaactcccagatgtcccccttccgggctcctgactccgctgcatttggagggactggttcagttccaggacgtgtcctttgcataccccaaccggcctgacgtgttagtgttacagggattgactttcacgctgaggccaggcgaagtcactgccctcgtaggccctaacggtagcggcaaatccaccgtggctgccctcctgcaaaacctataccagcccaccggtgggcagctgctgcttgacgggaaacctctccctcagtatgagcatagatatttgcaccgacaggttgctgcagtcggccaggagccacaggtattcggtagatctcttcaggagaacattgcctacggtctcacacagaagccaactatggaggagataaccgctgccgctgtaaagtctggggctcatagttttattagcggcctcccccagggctacgacaccgaggtggacgaagctggatctcagctcagtggcgggcagaggcaggctgtggcactggcaagggcccttattaggaagccttgcgtccttattctggacgacgcgacatctgccctggacgccaattcacagctccaagttgaacagctcctttacgagtcaccagagaggtattcgcggagtgtactgcttataacccagcacctttcattggtagaacaggcggaccacatccttttcttggaaggaggggcaattcgggagggaggcacacatcagcagctcatggaaaaaaagggttgctactgggccatggtgcaagctcccgctgacgcacctgaatag

SEQ ID NO: 209465 - DNA, 1644 bp, Artificial Sequence
  Description of Artificial Sequence: Synthetic coding sequence
atggccatccccttcttcaccggccggctgaccgactggatcctgcaggacgggagcgctgacaccttcactagaaatctcaccttgatgagcatcctcaccattgcttcagctgtcctggaatttgtgggcgatggaatttacaacaatacaatgggccatgtacattctcacctgcaaggagaggtgtttggcgctgtcctgcggcaggagactgagttcttccagcagaaccagactggaaacatcatgagcagggtgacggaagatacatcaaccctttctgactccctgtccgagaacctgtccttgttcctttggtacctcgttcgcggcctgtgcttattagggatcatgctgtggggctccgtcagtctcactatggtgaccctcatcacgctccctcttttatttctccttcccaaaaaagtgggtaaatggtatcagcttctcgaggttcaagtgagagagtccttggccaaatcctctcaagtggctattgaagcgctgtctgccatgccaacagtcaggtcattcgctaacgaagaaggtgaggcccaaaagttcagggagaaattgcaggaaatcaagacgctgaaccaaaaagaagccgttgcttatgctgttaattcttggactacctctatttctgggatgctcctaaaggtggggattctgtacatcggaggccagctagtgaccagtggagcagtgagcagtggaaatctggtgacctttgttttataccagatgcagttcacgcaggcagtcgaggtactgttgtcgatctatccaagggttcagaaagccgtgggcagtagcgaaaaaattttcgaatatctcgaccgcaccccgagatgcccccccagtgggctcttgacccccctccacctggagggactagttcaatttcaggacgtatccttcgcctacccaaaccggccggatgtgctggtattgcaaggcctcacattcaccttgagaccaggtgaggttaccgccctggtgggacctaacgggtctgggaagtccactgtggcagcattgctccagaatctttatcagcctactgggggccagctcctgctggatggcaagccactcccccagtacgagcataggtatttgcatagacaagtggccgccgtgggccaggaaccacaggtttttggtagatcactacaggaaaatattgcttacgggcttactcaaaagcctaccatggaggagatcactgctgccgccgtgaaatcaggcgcacattccttcatcagtggattaccacaaggctacgataccgaggtcgatgaggcggggagccagctttctgggggtcagaggcaggctgtggcattagcccgcgccctgatccgtaagccctgcgtccttatcctggatgacgcgacaagcgccctggacgctaactcacagctccaagtagagcagctgctttacgagtcgcctgagcggtattctaggtccgtccttctcattactcagcacttgagtctcgtggagcaggccgaccatatcctgtttcttgaaggcggcgctatccgggagggaggcacacaccagcagctgatggaaaaaaaggggtgctactgggccatggtgcaggctcccgctgacgcccccgaatag

SEQ ID NO: 209466 - DNA, 1644 bp, Artificial Sequence
  Description of Artificial Sequence: Synthetic coding sequence
atggccatccccttcttcaccggccggctgaccgactggatcctgcaggatggctccgctgatactttcacacgcaatctgactctgatgagtatactgacgatagcttcagctgtgcttgagttcgttggggacggaatttataacaacacaatggggcacgtgcactcacacttgcagggcgaggttttcggcgcggtcctccgtcaggaaacggaattctttcagcaaaatcagactggcaatattatgagcagagtgaccgaagacacaagcactctttcagatagtttgagcgagaatctgtccctttttttatggtatctggtcagggggttatgcctgctgggcataatgctgtgggggagtgtttccctcacgatggtgacactgattacactgcctctgctgtttctcctgccaaaaaaggtgggcaagtggtatcagcttcttgaggtgcaggtgcgagaatcactggctaagtcctctcaggtcgctattgaagctctctctgcaatgcccactgtgaggtcttttgccaacgaggagggcgaggctcagaagtttcgtgagaaactacaggagatcaagactctgaatcagaaggaagccgttgcctacgccgtgaatagctggaccacttctatttccggcatgttgttaaaagttggcattttgtatatcggcggccagctagtgacctctggggctgtgtcctcaggtaacctcgtgaccttcgtgctctatcaaatgcagtttacccaggccgtggaggttctgctatccatctaccccagggtgcagaaggcggtgggctcctcagaaaaaattttcgagtacctcgataggacccccagatgcccgcccagcgggcttctgacccctctccatctcgagggattagtccaatttcaggacgtgtcattcgcctatcctaaccgacccgacgttctagtattgcaggggctgacctttacacttcgacccggagaggtgacagccctcgtggggccaaacgggagtgggaaatccaccgtggctgcgctactacagaacctttaccaaccaacagggggccagcttctgctggatggcaaaccgctaccacagtacgagcaccgatatctgcatcgccaggtcgctgcggtggggcaggagccccaggtgttcggccgatccctgcaggaaaacatcgcttacggcctgacccagaaacccacaatggaagaaataacggctgctgctgtaaaatcgggggcccattctttcatatctggattgccacaagggtatgacaccgaagttgatgaggccggctctcagttaagtggcggccaacgccaggctgtggctctggccagagcacttatccggaagccatgcgtgcttatccttgacgatgccacctcagcccttgacgccaatagccagctgcaggtagaacagttgctctacgaatctccagagcggtactcccgtagcgtgctgctgatcacccaacacttgtcgttagtggagcaggctgaccacatcctgtttctggaaggcggcgccataagggagggcggtacacaccaacagcttatggagaagaagggatgttattgggccatggtgcaggctccagctgatgcccctgaatag

SEQ ID NO: 209467 - DNA, 1644 bp, Artificial Sequence
  Description of Artificial Sequence: Synthetic coding sequence
atggccatccccttcttcaccggccggctgaccgactggatcctgcaggatggaagtgccgatacatttactcggaatctcaccctcatgtcgatcctcactatcgcaagcgccgttctggaatttgtgggggacggtatttataataatacaatggggcacgttcattcccatttgcagggcgaggtattcggtgctgtcctccgtcaagagaccgagttcttccagcaaaatcagacagggaatattatgagtagggttacagaagacacaagcacattgtcagacagccttagcgagaacctgtccctctttctttggtacctggtaagaggcttgtgcctgctggggatcatgctctggggttcggtctcacttacaatggttactttgataactttgcccttgctgttcctcctaccaaaaaaagtcggcaagtggtaccagctactagaagttcaagtacgggagagtctggctaagagtagccaggtggcgattgaggcgttatctgctatgccgacagtaagatcatttgccaatgaagagggcgaagctcagaaatttagagagaagctccaggagattaagaccctgaaccagaaagaggcggtcgcatatgccgtgaattcctggactacatccatctcgggtatgttactaaaggtcgggattctgtacatcggcggccagctcgtcacgtctggagccgtgagctctgggaacctcgttacatttgtgctgtaccagatgcagttcacccaagcagtggaggtattgcttagcatttaccctcgggtgcaaaaggccgttggcagctccgagaagatatttgagtatctggatcggacgccaaggtgtccaccttcaggccttttaactccccttcaccttgagggcctcgtgcagttccaggatgtttcctttgcctatcccaaccgccccgacgtgctagtcctccagggattgacgtttacgctgcggcctggggaggttaccgctttagtgggccctaatggcagcggtaagagtacggtggccgccctgttgcagaacctctaccagccaaccggaggtcagttgctgttggacggcaaacccctgccacaatacgaacaccgttatttgcaccgccaggtggctgccgtgggacaggagccccaggtatttgggcgctctctgcaagagaatatcgcgtatgggctgacccagaaacccaccatggaagagattaccgccgccgccgttaagtccggagcccactcattcatctccggactgccgcagggatatgacacagaggtcgatgaggcaggatcacagctttcagggggtcagcgacaggctgtggctctagctagggctttgatccgtaagccgtgtgtgttgatcctcgatgacgctaccagtgccctggacgccaactctcagttgcaggttgaacagcttctttacgagtctcctgagagatatagtcggagcgtcttactcattacacagcatttgagcctagtggaacaggctgaccacatactgttcctggagggtggagctattagggaaggcggcacacaccagcaattgatggaaaagaagggctgctactgggcaatggtgcaggcacctgccgatgcccctgaatag

SEQ ID NO: 209468 - DNA, 1644 bp, Artificial Sequence
  Description of Artificial Sequence: Synthetic coding sequence
atggccatccccttcttcaccggccggctgaccgactggatcctgcaggacggctctgcagatacatttactaggaaccttacactgatgtccatcctgacgatagcgtctgctgttctggagtttgtgggggacgggatctacaataataccatggggcacgttcacagccacctccagggcgaggtctttggcgccgtgttgcggcaggaaaccgagttttttcagcagaatcagaccggcaacattatgtccagagttacagaggatacctctactctgtcagattcactgagtgagaatctttcacttttcctttggtacctggtcagaggcctgtgcctgctcgggatcatgctgtgggggagtgtgtcactcaccatggtgaccttgatcacattacctctcctgttcttattaccaaaaaaggtggggaagtggtaccagctcctcgaagtccaggttcgagaaagcctggctaagagctcacaggtggcaatagaggcactgagcgcgatgcccactgtgcgctccttcgcgaatgaagaaggtgaggcccagaagttccgcgagaaattgcaggaaattaagaccctcaaccaaaaggaagccgtggcctatgcagtgaattcgtggacaacatccatatccggcatgcttctgaaggtcggtatcctgtacatcggcggccagctggtgaccagcggcgcagttagtagcgggaatctcgttaccttcgttctgtatcagatgcagttcacccaagccgttgaagtgttgctttctatctacccccgggtgcagaaagccgtcggcagttcagagaaaatttttgagtacttggacagaaccccgcgatgccccccttctggcctgctgacccccctccatcttgaggggttggttcagttccaggacgtaagcttcgcatatcctaaccgaccggacgtgctggttttgcaaggacttactttcactctgaggcctggggaagtgacagccttagtaggacccaacggctctggcaagtccacagtggctgcccttctgcagaatctgtatcaacctactgggggccagcttctgctcgacggaaagcctctgccacaatacgagcaccgatacttacaccgtcaagtcgcagcggttgggcaggaacctcaggtttttgggcggtcactacaggaaaacatagcttatgggcttactcagaaacccactatggaagaaatcacagccgcggctgtgaagagtggagcacacagttttatctcaggactgccacaggggtatgatacagaagtggacgaggcaggaagtcagttgtccggcggccagcgacaggcagtagctttggcccgcgccctaataaggaagccttgtgttctgatcctagacgatgccaccagtgctttggatgccaatagccaactgcaggtcgagcagctcctctatgagagccctgagcggtatagtaggagcgtccttctgataacccagcatctgtccttagtagagcaggctgaccacatcctctttctggagggaggtgccatacgcgaaggcggaactcatcaacagctcatggagaagaagggatgttactgggcaatggtgcaggccccagccgacgccccagagtag

SEQ ID NO: 209469 - DNA, 1644 bp, Artificial Sequence
  Description of Artificial Sequence: Synthetic coding sequence
atggccatccccttcttcaccggccggctgaccgactggatcctgcaggacggatcagcagataccttcacaagaaacttaactctgatgagtatcctgaccatagcctccgctgttctggagttcgtcggtgacgggatttataataatacaatgggacacgtacattcccacctgcagggagaggtgttcggcgccgtgttaaggcaggagaccgagttttttcaacagaaccaaaccggcaacataatgtcccgggtaactgaagatacatccactctctcagacagtctcagcgagaatctgtcccttttcctttggtacctcgtgagagggctgtgtctgctcgggattatgttgtggggtagcgtgtcactaacgatggtgacgctcatcactttacccctcctgtttttgctccctaaaaaagttggaaaatggtaccaattattggaggtgcaagttcgtgagagcttggctaagagtagtcaggtggcaattgaggccctgtccgccatgcccacagtccgctccttcgctaacgaagagggtgaggcccagaaattccgagaaaagctgcaagagattaaaacactgaaccagaaggaggcagtagcctacgcggtgaactcatggactacatcaatcagcggcatgctgcttaaagtcggcattctatatatcggaggccagctcgtaacctccggggccgtttcgtcaggtaacctggtcacattcgttctctatcaaatgcagtttacccaagccgtagaggttcttctcagtatttatcctcgtgtgcaaaaggctgtgggaagctctgagaagatttttgagtacctggacagaactcctaggtgccctccgagcggcctgcttaccccgctccatctggaagggttggtgcagtttcaggacgtgtccttcgcctaccccaacagacccgacgttctcgtgttacaggggcttacattcacactgcgccccggcgaagtaaccgccctggtcggccccaacgggagcggaaaatcaactgttgccgctctgttacaaaacctgtatcagcccaccgggggccaactcctattggatgggaaacctctgccacagtacgaacaccgttatttgcacaggcaggtggctgccgtcggacaggaaccccaggtcttcggtcggagcctccaagagaacattgcttacgggctgacccagaagcccacaatggaagagattacagctgctgcagtgaagagcggagcgcattcctttattagtggtctgcctcagggctatgacacagaagtggatgaggccggatcccagctcagcggcggacagagacaggccgtcgccctcgcaagggccctcatccgtaagccatgcgtgctgattctggacgacgctacatcagccctcgatgccaactcccagctacaagtggagcagttgctgtacgaatctcctgagcgatatagcagaagcgtgctcctcatcactcagcatttgagcctggtggaacaggcggatcacatactgttcctcgagggcggcgcaatccgtgaaggcggcacccaccagcaactcatggagaaaaagggatgctactgggccatggtccaagcccctgccgacgcgcctgaatag

SEQ ID NO: 209470 - DNA, 1644 bp, Artificial Sequence
  Description of Artificial Sequence: Synthetic coding sequence
atggccatccccttcttcaccggccggctgaccgactggatcctgcaagatggaagcgcggatacatttacaaggaacctgaccctgatgagtattttgactatcgcctcagcggtgctggagttcgttggcgacggcatttataataatactatgggccacgtccattcacacctccagggcgaggtgttcggcgcggtcttgaggcaggagacagagttctttcagcagaatcagacaggcaatattatgagcagggtgacagaagatacctccactcttagcgactctttgtcagagaacttgagcctgttcctgtggtacctggttcgggggctgtgcctgctcggaataatgctctggggctctgtcagcctcaccatggtgacactgatcacactgcccctactttttctcttgccaaaaaaagtgggcaagtggtatcagctcctcgaggtgcaggtccgagagagtttggcgaaaagcagccaggtggccatcgaggccctgtctgctatgcccaccgtcaggagcttcgccaacgaggagggggaggcgcagaaattccgagaaaagctgcaggagattaaaacactgaaccaaaaagaagcagttgcctatgcagtgaattcttggacgacttccatcagcggcatgctgcttaaggtgggcattctctatatcggcgggcaactggtgaccagtggcgcagtgtctagcgggaatctggttactttcgtactctaccagatgcagttcacacaggccgtggaggtgctgctgtctatctatccccgcgtccagaaggcagtgggatcgtcagagaaaattttcgagtacctggaccgcaccccccggtgtcctccgtccgggctcttgactcccctccaccttgagggcctggtgcagttccaagacgtctctttcgcttatccaaatcgccctgatgtactggttttgcagggactcaccttcactctgcgacccggagaggtgaccgcgctggtcggtcccaacgggtctggaaagtcaacagtcgccgcacttctccagaatctttaccagccaacaggaggtcagctgctcttggatggaaaacctctgcctcaatacgagcaccgataccttcatcggcaggtagccgccgtcggacaagagccccaagtgtttggacgcagcttgcaggagaacatcgcttatgggctgacacagaagcctacgatggaagaaattactgccgctgcggtgaagagcggagcacacagcttcatctccgggttaccgcagggctatgataccgaggtggacgaggcggggagccagctgagcggtggccagcggcaggcggtcgctctcgctcgggccttaattaggaagccatgcgtccttatcctagacgacgcgacttccgccctggatgcgaactctcaactacaggtcgaacagttgttgtacgaatcaccggaacgttactctagatcagttcttctgatcacccaacatctatcattagtcgagcaagctgatcacatcttgtttcttgagggaggtgcgatacgtgagggaggaacccatcagcagctgatggagaagaaaggatgttattgggccatggtccaggctccggccgatgcccctgagtag

SEQ ID NO: 209471 - DNA, 2061 bp, Artificial Sequence
  Description of Artificial Sequence: Synthetic coding sequence
atgcggctgcccgacctgcggccctggaccagcctgctgctggtggatgcagcccttctgtggcttctacagggccctctaggtaccctgctgccccagggactgccaggactatggctggagggaactctgagactcggcggcttgtggggactccttaaattacgcgggctgttggggtttgtgggaacgctcctgttgccactctgcttggctaccccactgactgttagcctgagagccctggttgctggcgcttcacgggctccacccgcccgtgtggccagtgctccctggtcttggcttcttgtgggatatggtgctgccggtttatcatggtctttgtgggccgttctgtctcccccaggcgcccaggaaaaagaacaggatcaggtgaataacaaggtgcttatgtggagacttctcaaattgtccagaccggacctaccgctactggtcgccgcgttcttctttttagtactggccgtgctgggcgagactctcattccccattacagcggaagggttattgacatactgggcggcgattttgatccccatgctttcgcatccgccatcttctttatgtgcctgttttcctttggcagctcactgagcgcaggatgtaggggcgggtgcttcacatataccatgagcagaatcaatctcaggattcgggagcagttgtttagcagcctgctccgccaggatttgggattctttcaggagaccaagactggcgaactgaatagtaggctctcatctgatacaactcttatgtccaattggctaccacttaatgccaacgtcttgctacgatcattggtgaaggtggtggggctatacggatttatgctctcaattagccctcgtctgactctgctgtccctgctccatatgcctttcaccattgctgcagagaaggtgtacaacacccgccaccaggaggtcctgagggagattcaggacgccgtggctcgagccggccaggtggtgcgagaagctgtgggcggcctgcagaccgtgaggagttttggggccgaagaacacgaagtatgccggtataaggaggcccttgaacaatgccggcaattatactggcgcagagatttggagcgagcactgtacctactggtacggagagttttgcacttgggcgtccagatgctcatgctgagttgtggcctgcagcagatgcaagatggcgagctgactcaagggagcctactctcttttatgatttaccaggaaagcgtgggaagctacgtacaaaccctggtctacatatatggtgatatgctgagtaacgttggtgccgccgaaaaggtgtttagctacatggaccgacagccaaacctcccttccccgggaaccctggcccctacaacattgcagggggttgttaagttccaggatgtgtctttcgcctatcccaaccgacccgacagacccgtgttgaagggactcacttttacccttagaccaggggaagtgactgccctcgtcgggccaaatggcagtggcaaatctactgttgccgcactgctgcagaacttgtatcagcccaccggtgggcaagttcttctggatgagaagccaatctcgcagtacgagcattgttatctccacagccaggtagtgtcggtcggtcaggagcctgttctgttcagcgggagcgtgcgcaacaacatagcctacggactgcagtcatgtgaagatgacaaagttatggccgcagcccaggccgcacacgccgacgattttatccaggagatggaacatggcatctatactgatgtgggcgaaaaggggtcacaactcgcggccgggcagaagcaacgtcttgccatcgcccgtgccctggtgcgcgacccaagggtacttatcctggacgaggctacctccgccctggacgtccagtgtgaacaagccttgcaggattggaactctagaggggaccggaccgtgctcgtcatcgcccacagactacagacggtacagcgagcccaccagatcttggtccttcaggagggtaagctgcaaaaactggcacagctgtag

SEQ ID NO: 209472 - DNA, 1962 bp, Artificial Sequence
  Description of Artificial Sequence: Synthetic coding sequence
atgcggctgcccgacctgcggccctggaccagcctgctgctggtggatgcagcactgctctggttattacagggtcctctggggacactactgccccaaggactccctggattgtggctggaagggaccctgaggctgggtggactgtggggtctgctgaagctccgcggtttgctcggttttgttggtactctgcttctgcccctgtgcctggccaccccccttactgtgagcctgcgtgccttagtggctggggcgtcacgcgcgccacccgccagggttgcatccgctccatggagctggctgctagttggctatggtgcagctggcctcagctggagtttgtgggccgtgctgagtcctccaggggcccaggaaaaggagcaagatcaggttaacaacaaagtactgatgtggcgcctcctaaaattgtctcgcccggaccttcccctgctggtggccgctttttttttcctggtccttgctgtgttgggggaaaccttaattccgcactactccgggcgcgtgattgatattctgggaggggattttgaccctcatgcatttgcctcagccatcttttttatgtgccttttctccttcggatcctcactatccgccgggtgccgaggaggttgttttacttataccatgtcgagaatcaatctcaggattagggagcaacttttctcgtcattgttaagacaggatctaggattcttccaggaaaccaagactggggaactgaattcacgactgtcttcagacacaactctaatgagcaactggctccctttgaatgccaatgtgctacttcgatccctagtgaaagtcgtaggactgtatggatttatgctttcaatttcgccccgcttgacacttttgagcctgttgcacatgccctttacgatcgccgctgagaaagtctataatactcgccaccaggaggtgctcagagaaatccaggacgctgtcgctagagcagggcaggtagtacgggaggccgtgggtggactccaaacagtgcgaagcttcggcgctgaggaacacgaggtttgtaggtataaagaggccctagagcaatgtaggcagctgtattggcgcagagatttggaacgggcgctgtatcttttggtgagacgcgtgctacaccttggggtgcagatgttaatgctgtcatgcggcctgcagcagatgcaagatggcgagctgactcaggggagcttactgtccttcatgatctaccaagaatcagtaggatcctatgttcaaacgctggtctacatctacggggacatgttgagcaacgtgggcgctgccgagaaagtattcagctatatggatagacagccaaatctaccgagcccaggcacactagccccaactaccctccagggtgtcgtcaagtttcaagatgtgtccttcgcttacccaaacaggcccgaccgcccagtgctaaaaggcctcacctttaccttgcgacccggagaggtcactgctctggttggaccgaatggaagcggcaaatccacagtggcggcactgttgcaaaatctgtatcagcccacgggtgggcaggttctactcgacgaaaaacctatctcacaatacgaacactgctatctccactcacaagtcgtgagcgtcgggcaagaaccggtgctattctcagggtccgtgaggaacaatatcgcgtacggactgcagtcttgtgaggatgacaaggttatggctgccgctcaggccgcacacgccgatgactttattcaggagatggagcatggcatctacacagacgtgggcgaaaaaggaagccagctcgcagcaggacagaaacagcgcctggcaattgccagggccctggttcgagacccccgcgtgctcatcctcgatgaggcgaccagcgcactagacgtccagtgtgagcaagcgaaaaccctttggaaattcatgatcttttag

SEQ ID NO: 209473 - DNA, 2061 bp, Artificial Sequence
  Description of Artificial Sequence: Synthetic coding sequence
atgcggctgcccgacctgcggccctggaccagcctgctgctggtggatgccgcgctgctgtggctgcttcagggcccgctgggcactttgctcccccagggtctgcccggactatggttagaaggaacgctgcggcttggtgggctctgggggctattaaaacttagaggattgctagggtttgttggcaccctgctgctgccactgtgtcttgccacccctctcacagtgtctttacgcgccttggtagcaggggcatcgcgagcgcctcctgcgcgcgttgcgtctgccccctggtcgtggctgctggtgggttatggagcggcagggctcagttggtccctttgggcggttttgtcgccccccggtgcccaagagaaggaacaagatcaggtgaataacaaagtactgatgtggcgactgcttaagctgagccgccctgatctgcccttattggtcgccgctttttttttcctcgtcctggccgtgctaggagagacactgattccacactactccgggcgggttatagacatcttggggggtgacttcgacccacacgcttttgcctctgccatctttttcatgtgtctgttctcgttcggcagctccctcagcgctgggtgtcggggtggctgtttcacgtacacaatgagcagaataaatctgaggatcagagaacagctctttagcagtttgctgagacaagatttaggattttttcaggagacaaagaccggagagctgaactccaggttgagcagtgatactacgttaatgtccaactggctcccactgaacgccaatgtgctgcttcggtcactcgttaaggtggtggggctgtatgggtttatgctttcaatttcacctcgactgaccctgctttccctgctgcatatgccctttacaatcgctgccgaaaaagtctataacactcgacaccaggaagtgttgcgcgagatacaagatgcagtagctagggctggacaagtggttagggaagcagtgggtgggcttcaaactgtgcgatccttcggggccgaagagcacgaggtgtgtagatacaaagaagctctggagcaatgccgacagctctattggagaagggacttggaacgcgccctgtacctactggtccgccgcgtcctgcatctcggggtgcagatgctcatgctctcctgcggcctgcagcagatgcaggacggagaattgactcaaggcagcttgctgagcttcatgatttaccaagagtctgtggggagttacgtgcagactcttgtttatatatacggtgacatgctaagcaacgtcggggccgccgagaaggtgtttagctacatggacagacaacctaacctgcccagtcctggcacccttgcccctaccacactgcagggagtggttaaattccaggacgtgtcattcgcctaccctaataggccggaccgcccagtgcttaagggcttgactttcactcttcgccctggtgaggtcacggctctcgtgggaccaaacggtagcggaaagtcaactgttgctgcactactgcagaacctgtatcagcctactgggggtcaagttctgttagacgaaaagcccattagtcagtacgaacactgttatcttcacagtcaagtggtttccgtcggccaggaacccgttctgttctcaggttccgtgagaaacaatatcgcctatggactgcaaagctgtgaagatgataaggtgatggccgctgcacaggccgctcacgctgacgactttattcaggagatggaacacggcatctatacggatgtcggggagaaggggtcgcaactggctgccggtcagaagcagagactggctattgcacgcgcccttgtgagggatccccgggttctgatactcgatgaagcgacatctgcactggatgtccagtgtgagcaagctttgcaggattggaatagcaggggtgatcggactgtgctggtgatcgctcacagactgcagacagtgcaacgggcgcatcagatcctggtgctgcaggagggcaaactgcagaagctggcacagttatag

SEQ ID NO: 209474 - DNA, 1962 bp, Artificial Sequence
  Description of Artificial Sequence: Synthetic coding sequence
atgcggctgcccgacctgcggccctggaccagcctgctgctggtggacgccgcattgctttggctgctgcaggggccacttgggacgctgctgccgcaagggttgcctggcctgtggctcgagggaacgctcagacttggtggcctgtggggcctgcttaagctcagaggacttctgggattcgtgggcactctcttgctccctctttgcctggcaactcctcttaccgtctcgctaagagcactggttgctggcgcatccagggctccccctgcacgggtggcctccgccccgtggtcctggctgctggtgggctacggggcagctgggctgagttggtcattgtgggcagtgctcagtccaccaggggctcaagagaaagagcaggatcaagtaaacaacaaggtcctcatgtggaggctgctgaaactctcacggccagaccttcctctgctggtagcggcgttcttctttctggtccttgctgtgcttggcgaaaccttaatccctcactactccggcagggttatcgacattctgggaggcgattttgatccgcacgctttcgcgtcggccattttttttatgtgcctgttttcctttgggagctctctctccgcggggtgtcgaggcggctgtttcacctatacaatgtcgcggatcaatctgcgtatacgggagcaacttttcagcagtctgcttagacaggacctgggattcttccaggagacaaagaccggagaactcaactcgcggttgagtagtgacacaaccctgatgtccaactggctcccactaaacgcaaatgtgctcctccgctcgctagtgaaggtcgtaggactgtacggatttatgttgtccatctcgcctcggttaaccctgctcagcctcctgcacatgccctttaccatcgcagctgaaaaggtgtataacactaggcaccaggaggttctgagagagatccaggacgcagtcgccagggctggtcaagtggtgcgcgaagcagttggcgggcttcagactgtgcgctccttcggagcggaggagcacgaggtctgtcggtacaaggaagcgctcgaacagtgtaggcagctgtattggagaagagatttggaacgtgcactttacctgttggtacgcagagtactccaccttggcgtgcaaatgcttatgctgtcatgcgggctgcagcaaatgcaggatggcgaactgacccagggctcgttgctgagtttcatgatctaccaggagtcggttggatcttacgtgcagaccctcgtctacatttatggagatatgctctctaacgtgggcgcagcagaaaaggtattctcatacatggaccgccagccaaacctgccgtcccctgggacattagccccaacaaccctgcagggtgttgtcaaatttcaagacgtaagctttgcctaccctaatcgacccgataggcccgttttgaagggcctgacattcaccttgagacctggggaagtgactgccctggtggggccgaacggatccggaaagtccacagtggctgcgttgttgcagaatctgtatcagccgacgggaggacaggttctcctggatgaaaagccaatttctcagtatgagcattgttacttacactcccaggtggtgtccgtcggacaggagcccgtgctgttttccggctcagtcagaaataacatagcttacggtctgcagtcttgtgaggatgacaaggtcatggctgctgcccaggcggcacatgctgacgattttatccaggaaatggagcacggaatctacaccgatgttggtgagaaagggagtcagctggccgcaggacagaaacaacgcttggccatcgccagggcactggtgcgggatcccagggtacttatcctggatgaagccacatcagcccttgatgttcaatgcgaacaggctaaaaccctgtggaagttcatgatcttctag

SEQ ID NO: 209475 - DNA, 2061 bp, Artificial Sequence
  Description of Artificial Sequence: Synthetic coding sequence
atgcggctgcccgacctgcggccctggaccagcctgctgctggtggacgccgccctgctgtggctgcttcagggtccactcggcactctattgcctcagggccttcctggcttgtggctggagggcaccctgcggcttggcggactatggggtctgctgaaactgcggggcttgttagggttcgtcggcaccctcctgttgccactctgtttagccactcctctgactgtgagcttacgggctttagtcgctggcgctagtagagccccccctgcccgagtggcctcagccccatggagctggctgttagtggggtacggtgcagccggtctatcttggagtctgtgggccgtgctgtctcctcctggagcgcaagagaaagaacaagaccaagtcaacaacaaagtcctgatgtggcgactgttaaagctctctaggcccgacctgcctctcctggtggctgccttcttctttctcgtgctggcagtgcttggggagacccttattccccactattcaggaagggtgattgatatcctcggaggcgacttcgatccacacgcatttgccagcgccatcttttttatgtgcctattttcctttgggtcatccctttctgcgggatgccggggaggctgtttcacatacaccatgtctaggattaacctgagaatcagggagcagctgttctctagtctgctccgccaggatctcgggttttttcaggaaaccaagacaggggagctcaactcccgattgagcagcgacactactttgatgtcaaattggctgccgctgaatgccaacgtcctgctacgttcacttgttaaagtggtcggcctatatggttttatgttaagcatatcacctagactgacattactgtctctcctacatatgccctttacaatcgccgccgagaaggtgtacaatactagacatcaggaggtccttagggaaattcaggacgctgtggcacgggcaggtcaggtggttcgcgaagcggttggcggacttcagacagtgcgaagctttggtgcagaggagcacgaggtgtgtcgctacaaagaggcactggaacaatgccgccagctgtactggaggcgggacttagaaagagccctctatctcctcgtaagaagggtgctccatctgggcgtgcaaatgctgatgttgagttgcggattgcagcagatgcaagatggggaactgacacaagggagccttctttcctttatgatctatcaggaatcagtgggctcctacgttcaaacactggtatatatttatggggacatgctgagcaacgtcggcgccgctgagaaggtgttcagctatatggatcgccagccaaatttaccaagcccaggcaccctggcacccaccaccttacagggggttgttaaattccaggacgtgtcctttgcatacccaaataggcctgaccgcccagtactcaaaggccttacgttcacgctcaggcctggagaagtgaccgcactggtgggcccgaatggttccggcaaaagcacagttgccgcgttgctgcagaacctgtatcagcctaccggcgggcaggttctactggatgagaagcccatcagccaatacgagcattgctatctgcatagccaggtagtgtcggtgggacaggagccggtgctgttttcaggttccgtaagaaacaacattgcctatgggctgcaatcctgcgaggacgataaggtgatggctgctgcccaggccgctcatgcggacgatttcatccaagaaatggaacatggcatttacacagatgttggtgaaaagggctctcaacttgccgccggccaaaaacagcgcctcgcaatcgcgcgtgctctcgtcagggatcctagagtcctgatccttgacgaggcaacctcagcacttgacgtgcagtgcgaacaggccctccaggattggaactcacggggggacaggactgtgctggttattgcccaccggctgcagactgtgcagagggcacatcagatcctagtgctgcaggaaggtaaactgcaaaagctggcgcagttgtag

SEQ ID NO: 209476 - DNA, 1962 bp, Artificial Sequence
  Description of Artificial Sequence: Synthetic coding sequence
atgcggctgcccgacctgcggccctggaccagcctgctgctggtggatgccgctctgttgtggcttctgcagggaccgttgggcaccctgcttcctcaaggcctgcctggcctctggctggagggtacgctgcgtttgggcggcctgtggggactgctcaaacttcggggcctgttaggatttgttgggacacttctgctcccgctatgtctagcaaccccgctgaccgtgtcattgcgcgccttggtggctggcgcctcaagagcaccacctgcccgcgttgcttcggccccttggtcttggctcttggtgggctatggagccgccggcctgtcctggtccctgtgggcagtgttatctcctcctggcgcacaggagaaagagcaggatcaagttaacaacaaggtacttatgtggcggctgttaaagctcagcaggcccgatctgcctttgctcgttgccgccttctttttccttgtgctggcagtcctgggggagaccctcatcccccactatagcggaagggtgatcgatattctgggtggagatttcgacccccacgcattcgcatcagccatattcttcatgtgtctgtttagtttcggttcatctcttagcgctggatgccggggggggtgttttacctacactatgtcccggattaacctgagaatccgggagcagctgttctccagtctgctgaggcaggacttgggcttcttccaggaaactaagacaggagaattaaatagccgattatccagcgacactacgctgatgtccaactggctccctctgaatgcaaacgtcttgctgcgaagtttggtgaaggtggtcggcctctacgggttcatgctgagcatttcaccacgcctgaccctgcttagcttgctgcacatgcccttcacgatcgccgccgaaaaggtgtacaacacaagacatcaggaagtacttagagaaattcaggatgccgtggcacgtgcaggacaggtggtgcgcgaagccgtgggtggtttgcagactgtccgcagttttggcgctgaggagcatgaggtatgccgctacaaggaagccctagagcagtgcagacaattgtattggaggagggatttggagcgggccctttatctgctggtgcgcagggtgttgcatctgggagtgcagatgctcatgttatcatgcgggctccagcaaatgcaggacggagagctaacacaggggagtctgttatcatttatgatctaccaagaatctgttggtagctatgtgcagacacttgtctacatctatggagacatgttgtctaacgtaggggccgcagagaaagtcttctcatacatggataggcaacctaaccttcctagtccaggcacgttagcgccaaccacactgcagggtgtcgtcaaatttcaagacgttagtttcgcatatcccaatcgccccgatcggccagtgctaaaaggactgacgtttaccctacgccctggcgaggtcacggccctcgtgggtcctaatggcagtggaaagagtactgtggccgcccttctgcagaacctctatcagccgacgggagggcaggtcctgctggacgaaaagcctatatctcagtacgagcactgctacttgcactcccaggtggttagcgtgggccaggagcctgtgctattttcaggtagtgtgcgtaacaatattgcatacggcttacaatcctgcgaggacgataaagtgatggcagccgctcaggccgctcatgctgacgactttatacaggaaatggaacatggtatttataccgatgtgggcgaaaagggttcccagcttgccgccgggcagaagcagcgactcgctatcgccagagctctcgtcagggaccccagagtcctgattctcgacgaggccacttcagcactggacgtgcaatgcgagcaggcaaagaccctatggaagtttatgatcttctag

SEQ ID NO: 209477 - DNA, 1962 bp, Artificial Sequence
  Description of Artificial Sequence: Synthetic coding sequence
atgcggctgcccgacctgcggccctggaccagcctgctgctggtggacgccgccctgctgtggctcttgcaaggaccactggggacactactgccccagggactgccagggttgtggctggaaggcaccctgcggctaggcggcttgtggggcctccttaagctgcgaggcctcttaggctttgtcggtactttgctgctgccactgtgtctcgccactcctttgacagtgagcttgcgggcgctggttgcaggggcctcccgagcaccccccgctagagtggccagcgccccttggtcctggctcctggtgggatacggggctgctggccttagctggagtctatgggccgtgctctcacctcccggtgcccaagaaaaggaacaggatcaggtgaacaacaaggtactaatgtggcggctgctgaaattgtctcgacctgacctacccttattggtggcagcgtttttctttcttgttctggccgtgctaggagagactttgataccacactactccggacgcgttatcgatattttgggcggagatttcgatccccatgctttcgcctctgcgatctttttcatgtgcttgttttcctttggttcttctttaagcgctgggtgcaggggaggttgcttcacatacaccatgtcacgaattaatctgaggattagggaacagttgttctcatccctgttaagacaagatttgggtttcttccaggaaacaaaaacgggcgagctgaactcgaggctgtccagcgataccacgctcatgagtaactggttacctctgaatgctaatgtgttgttacgctcccttgtgaaggtggtggggctatacggcttcatgctgtcgatctctcccaggctcaccctgctgtcccttctccacatgccattcacaattgcggccgaaaaagtgtacaacaccagacaccaggaagttctgcgcgaaatccaggatgccgtggcgagggctggacaggtggtgcgggaggccgtgggcggtctgcagaccgtccgctcttttggtgctgaggagcacgaggtttgcagatataaagaggcccttgagcagtgcaggcagctgtactggagacgggacctggagcgggcactgtaccttctcgtgcgtcgagtcttacacctgggagtgcagatgctgatgttgtcgtgcggactgcagcaaatgcaagatggcgagctgacgcaaggtagtcttttatcttttatgatttaccaagagtccgtcggaagctacgtgcaaaccctggtctatatctacggcgacatgcttagtaacgttggtgcggctgaaaaagtgttcagttatatggaccgtcagcccaacctgcccagtcctggaacactagctcctactacactgcagggcgttgttaagtttcaggacgtttcttttgcatatcctaatcgccctgacaggccggtgctgaaaggcctgaccttcacgctacgtcctggcgaggtgactgctctggttggacccaacggttctggcaagtctacagtcgccgcactcctacagaacctgtaccagccaacgggtgggcaggtactgctggatgagaaacctatctcacagtacgaacactgctatctacacagccaagtggtgtctgtgggacaggaaccggtcctgttcagcggctccgttcgtaacaatattgcatacggcctccagtcgtgcgaagatgacaaggtgatggctgccgcccaggccgcacacgcagatgactttattcaagagatggagcatggaatctacactgacgtcggagagaaaggcagccagctagccgccggccagaagcagaggcttgctatagcaagggctctcgtacgggatccccgggtcttaattctcgatgaggcaacttcggctttagacgtccagtgcgagcaagctaaaacattgtggaaattcatgattttctag

SEQ ID NO: 209478 - DNA, 2061 bp, Artificial Sequence
  Description of Artificial Sequence: Synthetic coding sequence
atgcggctgcccgacctgcggccctggaccagcctgctgctggtggacgccgccctgctctggctgctgcaaggtcctttggggaccctgctgccccagggcctcccaggcctctggcttgaaggcacattgcggctcggtggcctgtggggactactaaagctgcgaggtcttttgggatttgtgggaacactgctacttcccttatgcctcgccacccccttaaccgtcagtctgcgcgcactggtggctggtgctagtagggctccgccagcgagggttgcaagcgctccgtggagttggctactggtgggttatggcgcggctggcctgagttggtccttgtgggcagtcctatctccacctggagcccaggaaaaggaacaagaccaagtcaataataaagtcctgatgtggagattactgaagctgtcgaggcccgacctgcccctgctggtggctgcttttttctttctggttcttgctgtcctcggggaaacattgatccctcattactccggacgcgtaatcgacatactgggtggcgactttgatccacatgcatttgcttccgctatattcttcatgtgcctgttcagcttcggaagttctctgtctgccgggtgtaggggagggtgcttcacgtatacaatgagcagaattaatctccgaatcagggaacagctcttctcctccttgttgcgacaggatcttggttttttccaggagactaaaacgggcgaactgaactcccgcctctccagcgacaccactctcatgtccaactggctccccctaaatgctaatgtgttattacggagcttggtcaaggtagtcggcctctacggatttatgttatctatatcccccaggctgacgcttttatccctactgcacatgccatttactatcgccgcagagaaagtatataacacacggcaccaggaggttttgcgagaaattcaagatgccgtcgccagagccggacaggtggtgcgcgaggccgtgggaggtctgcagaccgttcgttcttttggcgccgaggagcatgaggtgtgtaggtacaaagaggctctggaacagtgccgccagctctattggagacgggacctggagagggcactgtaccttttgatccggcgggtgctgcatctgggcgtacagatgctcatgctcagctgtgggctgcagcagatgcaggacggtgagttgacgcaaggctctttgttaagctttatgatttatcaagagagcgtaggtagttacgtgcaaaccctggtctacatctatggcgatatgttgagcaacgtgggagccgctgaaaaagttttcagctacatggatcgccagcccaatctgcccagcccagggacccttgctcctaccacattgcagggggttgttaaatttcaggacgtatctttcgcatatcccaaccggcccgatagacccgttctgaagggactgacatttactttacgccctggagaggtgactgcccttgtgggacccaacggtagcggtaaaagtacagtcgcagcactgctgcagaacctgtaccagccaactggcgggcaagtcctcctggacgagaaaccgataagtcagtatgagcactgctacctccacagccaagtggtttcagtgggccaggagccggttcttttttcaggctccgttcggaataacattacctatggcctgcagagctgcgaagacgacaaggtgatggccgcagctcaggcagcgcacgccgatgacttcattcaggagatggagcatggcatatacacagacgtcggagagaagggcagtcaattggccgctggtcaaaaacagcgtctcgccattgcccgtgcactagtgcgtgatcccagagttcttatcctcgacgaggctaccagcgcattggacgtccagtgcgagcaggccctccaggactggaactctaggggcgacaggactgtgctggtgatcgcacacagactccagaccgtacagcgggcacatcaaatacttgtgttgcaggaagggaagctgcagaagttagcacaactgtag

SEQ ID NO: 209479 - DNA, 1962 bp, Artificial Sequence
  Description of Artificial Sequence: Synthetic coding sequence
atgcggctgcccgacctgcggccctggaccagcctgctgctggtggacgctgccctcctatggttactccagggccccctgggcacccttctgcctcaaggccttccagggctctggcttgagggcacgctgcgcctgggcgggctctggggcctgctgaagctgcgcgggctgctgggattcgtaggtacgctgctactccctctctgcctcgctacgccactcacggtctccttaagggcactggtggcaggtgcaagccgagcccccccagccagggttgccagcgccccatggtcttggttgctcgtgggctatggggccgcaggactctcatggtcactctgggccgtactctcccccccgggtgcacaagagaaagagcaggaccaggtgaacaacaaggtcctgatgtggaggctgctgaagctttcccgtcctgacctgccactgctagtggctgcgttcttttttctggtgctcgccgtgctaggtgaaaccctgatcccacactattctggcagggtgatcgatatcctgggaggcgacttcgacccccatgcgtttgcctccgcaattttttttatgtgtcttttcagcttcggtagttcactgagcgcaggatgccggggggggtgctttacttatactatgagtagaattaacctgagaatccgggaacagctcttttcttccttgcttcgacaggatctcggcttctttcaggaaacgaagaccggcgagctgaattccaggttgtcttcagacacgacactgatgtctaactggttgccgctgaacgccaacgtgctgctgcgctctttagtgaaagtagtgggcttgtatgggtttatgctgagcatctcccccaggcttacattgttgagcctgttgcacatgccatttaccattgccgccgagaaagtgtacaatacacgtcatcaggaggtactacgggagattcaggacgctgttgcccgcgccggccaggttgtgcgagaagccgtgggaggtttgcagaccgtccgctcttttggtgccgaggagcacgaagtgtgtaggtacaaggaagcactggagcagtgtagacagctatactggaggcgagacctcgagagggctctttatctgctggtgaggagggtgctccacctgggtgtccagatgctgatgctctcctgtggcctccagcagatgcaggacggagagctaactcagggaagcctgctgagttttatgatctaccaggaatcggtaggcagctacgtgcagacactcgtgtacatatacggcgacatgctaagtaacgtgggggccgctgagaaagtcttttcctatatggacaggcaacctaatctcccatcacctggcacactggcacctaccactctgcagggcgtcgtgaaatttcaggatgtatccttcgcctatccaaaccgtcctgaccggccagtactgaagggcctgaccttcactttgaggccaggtgaggtaaccgcactggtcggaccaaacggcagtggaaagtcgacagtagctgcactgctccagaatttgtaccaacccaccggaggccaggtcctgctagacgagaaacctatcagccagtacgagcactgttacctgcactcgcaggtggttagcgtaggacaagaaccagttctatttagtggctccgtcaggaacaatatcgcctatggtctgcaaagttgcgaagacgacaaagtgatggcagccgcacaggccgcacacgccgacgacttcattcaagagatggagcacggtatctatacagacgtcggcgagaaagggagccaactggcagcaggccagaagcagagactggcgatcgctcgggctcttgtgcgggacccacgggtgctcattctagatgaggctactagcgctctcgacgtgcagtgcgaacaggcgaaaaccctctggaaatttatgattttctag

SEQ ID NO: 209480 - DNA, 1962 bp, Artificial Sequence
  Description of Artificial Sequence: Synthetic coding sequence
atgcggctgcccgacctgcggccctggaccagcctgctgctggtggacgcagccttactgtggcttttacaaggaccattgggcacactgttgccacagggcttgccgggcctttggctggagggcactctgcgactcgggggtctgtggggccttctcaaactcagggggctgttggggtttgtgggaaccttgctcctccctctctgcctggcaaccccattaactgtcagcctcagggctctcgtcgcgggcgctagcagagctccccccgccagggtggcctccgccccatggtcttggctgctggtgggatacggagcagccggcttgagctggtccttatgggcagtgctttcaccccccggggcacaggagaaggaacaggaccaggttaataacaaggtcctgatgtggcgcctgctgaaactgagcaggcccgacctgccacttttggtggctgcattcttctttctcgtgctagcagtactcggggagactcttattccacattattcagggagggtgattgacatacttggcggggacttcgaccctcacgcattcgcgagcgctatcttttttatgtgtttgttcagcttcggcagcagtctttctgctggatgccgcggcgggtgttttacctatacaatgagccggattaacctgcgtattcgagagcagcttttttcctccctgctgcgccaggacttgggcttttttcaggaaacgaaaacaggtgagctgaactctaggctgtcctctgacacgacactcatgtctaactggctcccattaaatgcgaacgtgctcctgcggtctctggtcaaggtggttgggttgtatgggtttatgctctcgatatctccccgcctgactctgctcagtctgctgcatatgcccttcacaatcgctgccgagaaggtgtataacacccggcatcaggaagttttacgggagattcaagatgccgtcgccagagccggacaagttgtccgagaggcggtgggcggccttcagacggtgcggtcgtttggtgcagaagagcacgaagtttgccgatacaaagaggccctagaacagtgtcgccagctttattggagaagagacctggagcgggcactttatctgcttgtacgccgcgtgttgcatctgggggtccagatgctgatgttgagttgtggtctccaacagatgcaggatggcgagctgacccagggcagtttactgagctttatgatttaccaggagtcagtggggtcatatgttcagacgttggtttatatttacggggacatgctctccaatgtgggtgctgcagaaaaggtattttcatacatggaccggcagccgaatctgccctccccgggcacactagcccccaccacattgcagggcgttgtcaagtttcaggacgtctcatttgcctatcccaacaggcctgatcgaccagttcttaagggcctaacctttactctgaggccaggtgaagtcaccgctctggtaggcccaaacggcagtggcaaaagtaccgtcgccgcgctgttgcaaaacctctaccagcctacaggtggtcaggtgctgctcgacgagaagcctataagtcagtacgaacattgttacctccattcccaggtggtttcggtaggtcaagaacctgttctcttctctgggtccgttcgcaacaatattgcctatgggctgcagtcctgcgaagacgacaaggtgatggccgcagctcaggccgcgcacgctgacgacttcatccaagagatggaacacggtatttatactgacgtcggcgagaaaggctcacagctggccgccggacaaaaacaacggctcgccatagctcgtgcactggtgcgggacccaagggtgctgatcttagatgaagccacttccgctttggacgtgcagtgcgaacaagctaagacgctttggaagttcatgatattctag

SEQ ID NO: 209481 - DNA, 2061 bp, Artificial Sequence
  Description of Artificial Sequence: Synthetic coding sequence
atgcggctgcccgacctgcggccctggaccagcctgctgctggtggacgctgcccttctgtggctgctgcagggacctttaggcaccttactaccccaggggctaccaggtctctggttggaaggcacactccgtctcggcggactctggggattgctgaaattaagagggctgctgggctttgtcggtactctattgctgccgttgtgcctggccaccccgctaaccgtgagtttgagagcgctggtggctggagcatcccgtgcgccacccgctagggtcgctagtgccccatggtcttggctgttggtcgggtatggagctgccgggctgtcctggtcactgtgggccgtgctgtcccctccaggagcacaggagaaggaacaggatcaggtcaacaacaaggttctaatgtggaggctgctgaaactgtcccgtccagatctgccactacttgtggcagcatttttctttctggtgctggccgtgttaggcgaaacactcatccctcactactcgggaagggtaatcgatatcctggggggggacttcgatccccatgcctttgcttctgctatcttcttcatgtgcctgttttctttcgggtcatccctgtcggccggatgtcgcggtggctgcttcacctacacaatgagtcgcatcaatctgcgaatccgtgagcagcttttctctagtttgctgcggcaagacctgggcttcttccaggagaccaagacaggcgaactgaatagcaggctgtcttcagacaccaccttgatgtccaattggctgcctctgaatgctaatgtgctgctgagaagtctagtcaaggtcgtgggtctttacggattcatgctcagtatctcacctcgcctaaccctcctctcgcttctgcacatgccatttacgatcgctgcagagaaagtgtataatacacgccatcaggaggtgttgcgggaaatccaggacgccgtggcaagagcgggccaggtcgtgcgggaggccgttggcggcctgcagaccgttaggtcgtttggcgcagaggaacatgaagtttgtaggtataaggaggccctggaacagtgccggcagctatattggagacgggatctggaacgtgccttgtacttgctggtacgccgggtcttacacctgggggtgcagatgttaatgctctcctgtgggttgcagcaaatgcaagacggcgaacttactcaggggtccctgctgtcgtttatgatctaccaggaaagcgtcggaagctacgtccagacgctcgtgtacatctatggtgatatgctttctaatgtcggagcggcagagaaagtcttcagttatatggaccggcagccaaacctgccatcacctggcacactggctcctacaacccttcagggcgttgtcaagttccaggatgtgtcctttgcctacccgaacagacccgaccgccctgtgctcaagggccttacctttaccttgagacctggcgaggtcacggctctcgtgggacctaacggaagtgggaaaagcacggttgccgccctgctccaaaatctgtatcagcctaccggtggacaggtcctgctggatgagaaaccaatctctcagtatgagcattgttatttgcattcccaggtcgtatccgtgggccaggagccagtcctctttagtggctccgtgcggaacaacatcgcttatggactacaatcatgtgaagatgacaaagtgatggccgccgcacaggccgcccatgccgatgacttcattcaggagatggagcatgggatctacactgacgtgggcgaaaagggcagccagctggccgcaggtcaaaagcagcgcctagcgatagctagggccctggtgcgagatccacgcgtgttgatcctcgatgaggctacgagtgcccttgatgtgcagtgtgaacaagccctccaggattggaattcacgcggagaccgcaccgtcctggtgatcgctcatagactacagacggttcagcgagctcatcagattctggtactgcaggaaggaaagcttcagaaactagctcagctatag

SEQ ID NO: 209482 - DNA, 1962 bp, Artificial Sequence
  Description of Artificial Sequence: Synthetic coding sequence
atgcggctgcccgacctgcggccctggaccagcctgctgctggtggatgccgctttgctgtggctcctccaagggccactgggtacccttctaccccagggactgccagggctttggctagagggcaccctgcggctgggcggcctctggggcctgctgaaattaaggggtctgctgggcttcgtggggacactgctgttacccctgtgcttggccacaccccttacggttagccttagagccctcgtggctggtgcttccagggccccacccgcacgagtggcgtccgctccttggagctggctgctggtgggctacggcgctgccggcctgtcatggagtttgtgggccgtgctttcaccccccggcgcacaggaaaaagagcaggaccaggtcaacaacaaggtcctgatgtggcggctccttaagttgagccgccctgacctccccctgctggttgcagctttcttctttctggtcctggctgttctgggagagactctgattccccattattccgggagagtgatcgatatcctgggtggagatttcgacccccacgccttcgcttccgctatatttttcatgtgcctcttttcattcgggtcttccctctctgcaggctgcagaggcggctgctttacatacaccatgtcccgcataaacctccggattagggagcagttattctcatccctgctgcgccaggatctgggcttttttcaagaaactaagactggagagctcaactctaggctatcctctgatacaacactgatgtctaactggctgccattgaatgccaatgtgctgctgagaagtctcgttaaggtggtaggcttgtacggtttcatgctgtcaatcagccctaggcttacactgctgtccttgcttcatatgccctttactatcgccgccgagaaggtttacaatacccggcaccaggaagtcttgagagagatccaggacgccgtcgctcgggctggccaggtcgtcagggaagcggtcggaggtctgcagactgtgaggagctttggagccgaagagcacgaggtatgtcggtacaaagaagccttggagcagtgcaggcagctgtactggagaagggatttagaaagagccttgtatctactaatcagacgtgtgctgcacctcggcgtccagatgctcatgctttcatgtggtctccaacaaatgcaagatggcgagttaacgcaggggtccctactgagtttcatgatctatcaggagtctgtcgggagctatgtccagaccttggtatacatttatggcgatatgctctctaatgtgggagccgcagagaaagtgttctcctacatggaccgccaacccaatctgccctcgcccggtaccttggcccctacgaccctgcagggtgtggtgaagttccaggacgtgtctttcgcataccccaatagaccagaccggccagtcctcaagggcctgacatttactcttaggccaggagaagtcacagcccttgtcggtcctaacggatctggcaagagcactgttgctgccttgctgcaaaacctttatcagcccaccggaggccaagtgttactcgacgaaaaaccaatatcccagtatgaacactgctacttgcactcccaggttgtgtccgtggggcaggaaccggtgctgtttagcggatcagttaggaacaacattacctatggcctgcagagttgtgaggacgacaaggtcatggcagcagcccaggcagcccatgctgacgatttcattcaggaaatggaacacggcatatacactgatgtgggagagaaagggagtcagctcgccgcaggtcagaagcagcggcttgcgattgcccgggccctcgtccgcgacccccgtgtcttaatcctcgatgaggccacctctgccctcgacgtacagtgcgaacaagccaagacactgtggaaatttatgatcttctag

SEQ ID NO: 209483 - DNA, 1962 bp, Artificial Sequence
  Description of Artificial Sequence: Synthetic coding sequence
atgcggctgcccgacctgcggccctggaccagcctgctgctggtggatgcagcactcctgtggctcctacaggggccccttggcacacttctgccccaaggacttccagggctttggctggaaggaaccttgcggcttggggggctctggggcctgctcaaactgagaggactcctgggcttcgtgggaacgttgctcctgccgctctgtttagctacacctcttactgtctctctcagagcactggtggctggggcttcacgcgcccccccggctcgggtcgcctctgcaccctggtcatggcttctggtggggtacggggcagccggcctgtcctggtccctctgggctgttctgtccccaccgggtgcccaggagaaagaacaggatcaagtgaataataaagtgttgatgtggcggctgctaaagctgtctcgaccagatcttcccctgctggtggccgccttcttctttttagtgctagctgtcctcggagagacactaattccacactactccggcagagtgattgatattcttggcggcgactttgacccacacgccttcgcatctgctatcttctttatgtgtctgttcagcttcggatcttcgctctctgcaggatgtcgcgggggttgcttcacatatactatgagccgtattaacctccgtatccgcgaacaactattttcttcgctgctacgacaagacctggggttttttcaggagaccaagaccggggagttgaattctagactgtcatccgatacgacccttatgagtaattggttacctcttaatgccaatgtgttactgaggtccctagttaaagtcgtcgggctgtacgggttcatgctctccattagtcctcgcctcacactgctctcccttctccatatgccattcaccatcgccgccgagaaggtctacaacactagacaccaggaagtgctgagagaaatccaagacgccgtcgcgagggccgggcaggtggtgagggaagccgtgggcgggctgcagaccgtccgttcctttggcgcagaagaacatgaagtgtgcagatacaaggaagccctggagcagtgtcgccagctgtactggcgtagagatctggagagagcactttacttgcttgtgagaagggtcctgcacctgggagtgcagatgttgatgctgtcctgcggactgcaacagatgcaggatggagagcttacccagggctccctcctgagtttcatgatataccaagagtctgttggttcgtacgtccagacactggtttatatctatggggatatgctgtccaatgtcggagctgccgagaaggtgttctcctacatggaccgccagccaaatctgccatcccctggaacgctggcaccaaccaccctgcagggagtagtgaaatttcaggatgtgtctttcgcgtaccctaatcgcccagatcggcccgtgctgaagggcctcacatttacgttgcgcccaggcgaggtgaccgccctggtagggccgaacgggagtggcaaatctaccgtcgctgcactgctgcagaacctttatcagccaacaggcgggcaggtcctgctcgatgaaaagccaatatcgcagtacgagcactgctatctgcacagtcaagttgtgtctgtgggacaggaaccagttctgttctctggatctgttaggaataacatcgcgtacggtctgcagagctgtgaagatgacaaggtgatggcagctgcccaggccgcccatgccgatgattttattcaggagatggagcatggtatctacactgatgtcggcgagaaagggtcacagctagccgccggtcagaaacaacgcctcgccatcgccagagccctggtgagggatccaagggttttgatcctcgacgaggcaaccagcgctctcgacgtccagtgtgagcaggccaagacactctggaagttcatgatcttctag

SEQ ID NO: 209484 - DNA, 2112 bp, Artificial Sequence
  Description of Artificial Sequence: Synthetic coding sequence
atgcggctgcccgacctgcggccctggaccagcctgctgctggtggacgcagctctgctgtggctgcttcaggggcctctgggaacactactccctcagggcctgcccggcctgtggctcgagggcactctccgtctcggggggttatggggactgctgaagttgcgcggcttactggggtttgttggcacgcttctgctccccctgtgtctggccactccactgaccgtctctctccgggcactggtggctggggcctctagagcaccacccgcccgcgtcgcctccgccccctggagttggcttctcgtgggctacggcgctgccggcctgagttggagcttgtgggctgtgctgtctccacctggagcacaggaaaaagaacaagatcaggtgaacaataaagtgctcatgtggcgccttcttaaattgagtagacccgatcttccactactagtggccgcatttttcttcctggttcttgcagtgctcggcgaaacactaatcccccattactccggacgggtcattgacattctgggcggagacttcgatccccatgcgttcgcctcagccatcttctttatgtgtctcttttcgttcggctccagtctgtctgccggatgccgaggaggctgttttacctacacgatgtcgcgaattaacttacgcatcagagagcagcttttctcaagcctactgagacaggaccttgggttcttccaagagactaagacaggcgaacttaactccaggttgtcgtcggatacgacgctgatgtcaaattggctcccactgaatgccaatgtgttgctccgctctcttgtgaaagtggtgggcctttacggcttcatgctatcaatatcccctaggctcacacttttgagcctactgcatatgccctttactattgccgctgaaaaagtatacaacacgagacatcaggaagtgctgcgagaaatccaagacgcagtggcccgcgctggccaggtagttcgggaggcagtcggtggactccaaaccgtgcgctcttttggagctgaagaacatgaagtgtgccgatataaggaggcactggaacagtgcagacagctttactggaggcgcgacctggaaagggcattgtatcttcttgtgcgccgggtactacacctgggtgtgcaaatgttaatgctgagctgcgggctacagcaaatgcaggatggcgagcttacccagggttcactgctgtcctttatgatttaccaagagtcggttggatcttatgttcagacactggtctatatctatggcgatatgctgagcaacgttggtgccgccgaaaaggtattctcttatatggacaggcagcctaatctaccttcccccgggacactggccccaaccactttgcagggtgtggtaaagttccaagacgtgtcatttgcctatcccaacagaccagatcggccagtcttaaaggggttgacttttacattgcgtcctggtgaggtgacggctttggtgggcccaaacggcagtggcaagtccactgtggccgctctcctccagaacctttatcagcctacagggggccaggtgctactcgatgagaaacccattagtcagtacgaacattgttatttgcattcacaagtcgtctccgtcggccaggaacccgtgctctttagtggaagtgtgaggaacaacattgcgtacggcctgcagagttgcgaggacgacaaggtgatggccgccgcccaggctgcacatgccgacgattttattcaggagatggaacatggaatctacaccgatgtcggcgagaagggatcacagctcgctgcaggccaaaaacagcggttggctattgccagggcacttgtacgggacccccgggtacttatattggacgaagccaccagtgcacttgacgtccagtgtgaacaagccctgcaagattggaactcaagaggagaccggaccgtgttggtcattgcccacagacttcaggccgttcagcgggcccaccagatcttagtgctgcaagaaggtaagctgcagaagctggcacagctgcaggaaggacaggatctctattctcgtctggtgcagcaacgactgatggactag

SEQ ID NO: 209485 - DNA, 2112 bp, Artificial Sequence
  Description of Artificial Sequence: Synthetic coding sequence
atgcggctgcccgacctgcggccctggaccagcctgctgctggtggatgctgcactcttgtggctgctccaagggcccttggggacccttttgccacagggtctaccaggcctgtggctggaggggaccctacgcctgggagggctgtggggcctcctaaagttgcgcggtctcttaggcttcgtcggaactctgttactgcctctgtgcctggcgacccccctgacggtgtcactgcgcgccctggttgccggggcctctcgcgcaccaccagcacgggtagcatctgccccttggtcatggctgttagttgggtacggcgccgcgggcctctcctggtccctatgggccgtgctttcacctccaggggcgcaggagaaggaacaagaccaggttaataataaagtattgatgtggcgactactcaaactttcacgcccagacctgcctctgctggtagccgccttcttcttcttggtgctggccgtgctaggggagacgctgatccctcactattctgggcgtgtgatcgacatcctgggaggtgacttcgatccacacgccttcgcttcggcgattttttttatgtgtctgttttctttcgggtctagcctgtccgccggctgtaggggtggatgcttcacctacactatgtctcggataaacttgcgcatccgagagcagctgttcagcagcctactcaggcaggatctaggatttttccaggaaactaagaccggcgagctcaattcgcgtctctcctccgacactacactgatgagcaactggttaccgctgaatgcaaatgtcctcttgcgctcactggtcaaagtggtggggctttatggatttatgctgtcaatctctccgcggctgactctgctgagcttgctgcacatgcctttcactatcgctgccgaaaaggtctacaatactcggcaccaggaagtgcttcgggagatccaggatgccgtcgcccgagctggccaggtggtacgggaggctgtcggcgggctgcaaaccgttaggagctttggagccgaagaacacgaagtgtgtcgctacaaagaagctcttgaacagtgccggcagctctattggcgccgcgatctggagcgcgccctctacctgctggtgagacgggtcctgcacctgggcgttcagatgctcatgctgtcctgcggcctacagcagatgcaggacggagaacttactcagggtagtttgcttagctttatgatttatcaggaaagcgtcggctcctatgtacaaaccctggtgtacatttacggagacatgctgtctaatgttggggcagccgagaaggtctttagctatatggatcgtcaaccgaatctgccctctcctggaaccctagcccccaccactttgcagggggtggtgaagttccaagatgtgagctttgcttatccaaacagacccgataggcctgttcttaaaggtttgacattcaccctccgtccaggggaagtgacagctctagtcggtcccaacggcagtggcaagtccactgtggccgctctgttgcagaacctctatcagccaaccggaggacaggtactgctggacgaaaagcctataagtcagtacgagcattgctatctgcacagccaggtagtgagcgtcggccaggaacccgtgttgttttccggttctgtgcgtaacaacatcgcttatggcctccagagctgcgaagacgacaaggtgatggccgccgcacaggcagcccacgcggacgacttcatccaggaaatggagcatggtatttacaccgacgttggcgagaaaggttcccagctggccgctgggcagaagcagcggcttgctattgcaagggcacttgtgcgcgatccgcgagtactgatcctggacgaggctacaagcgctcttgacgtacagtgtgaacaagcactgcaagattggaattcgaggggtgataggacagtgttagtcattgcacacaggctccaggcagtacagagagcccatcagatcctcgtgctacaggaaggaaagctgcaaaaactagctcagttacaggaggggcaggatttatatagcagactggtgcagcagaggctgatggattag

SEQ ID NO: 209486 - DNA, 2112 bp, Artificial Sequence
  Description of Artificial Sequence: Synthetic coding sequence
atgcggctgcccgacctgcggccctggaccagcctgctgctggtggatgccgccttactatggctgctccagggcccactaggtactttactgcctcagggactacccggactgtggctcgaggggaccctcagactgggtgggctatggggtctactaaagctgagaggccttcttggcttcgtgggaacactgctcctgcccttgtgtctcgccacccccctcaccgtctccctccgagcactagttgccggcgctagtcgagccccacctgcccgcgttgcctccgctccatggagctggcttttggtgggatatggtgccgcaggtttgagttggagcctctgggcagtgctttcacctcctggcgcgcaagaaaaggagcaagaccaggtgaacaacaaagtgctgatgtggagactgttgaagctgagtaggccagacttacccctactggtagccgccttcttctttctggtgttagcagtgcttggcgagacgttaatcccacactacagtgggcgagtgatcgacatcctgggtggggactttgacccccacgcctttgctagcgcaatctttttcatgtgcttattcagtttcggctccagcctgagcgctggctgccgcggtggttgcttcacttatactatgtcccggattaacctaaggatccgtgaacagctgttctcctcgctgctgcgacaggatctgggcttctttcaggagacaaaaacaggggagctgaactctcggctctcatctgataccacgttaatgtctaactggctacccctgaatgccaacgtgctcttgcgatcactggtcaaagtggtgggactatatggatttatgctctcaatcagtccacggctgaccttgctgagccttttgcatatgcctttcaccatcgctgccgagaaggtgtacaacacccgacatcaggaagtgctgagagagattcaagatgcagtggccagggccgggcaagtggtaagagaggccgtgggcggccttcagaccgttcgcagttttggggccgaagagcacgaggtttgcagatataaagaagctctcgaacagtgtcgacaactctattggagacgagacctggagcgggccctgtatctgctggtccgccgtgtgctgcaccttggcgtgcaaatgctcatgctgtcatgtgggctacaacagatgcaggacggggaacttacacagggctcacttctgtcttttatgatataccaggagtctgtgggatcctatgtgcagactttagtgtatatctatggcgatatgttatcgaacgtcggtgccgccgaaaaggtgtttagctacatggatcgtcagccaaatttgccttcccccggcaccctcgcaccaaccaccttacaaggcgtcgtcaaatttcaagacgtgtcttttgcgtacccaaaccggccagaccggcctgtgttgaaaggccttaccttcactctgaggccgggcgaagtgacggccctcgtgggtcctaatggttctgggaaaagtacagtcgccgctctgctccaaaatctataccaaccaactggtggtcaggtactgctggatgaaaagccaatttctcaatacgaacactgttacctgcattcgcaggtggtttcagtggggcaggaaccagtcctgtttagcggtagtgtgcgcaataatatcgcatatggtctgcaaagttgcgaggacgataaggttatggccgccgcccaggctgcccatgcagacgacttcatccaggagatggaacatggaatctacacagatgttggagagaaaggcagccagctcgctgcaggacagaagcagcggttagctatcgcaagagccctagtgcgcgacccacgggtattgatactcgatgaagctacctcagctctcgacgtgcagtgtgagcaggccctgcaggactggaactcaaggggtgatcgtacggtgctggtcatcgctcaccggttgcaggcagtgcagagggcccaccagatcctcgtgctgcaggagggaaagctccagaaactcgctcagctgcaggagggtcaggatctttactcgcggctggtgcagcagaggttgatggactag

SEQ ID NO: 209487 - DNA, 2310 bp, Artificial Sequence
  Description of Artificial Sequence: Synthetic coding sequence
atgcggctgcccgacctgcggccctggaccagcctgctgctggtggatgcagccctactctggctcttacagggccctctgggtaccctcctgcctcagggcctccctggcctctggctggaagggaccctgcggctcggaggtttgtggggcctcctgaagctgcgggggttattggggttcgtgggaacactgcttctccctctctgcctggccaccccactgaccgtgagtttacgggctctggtggcgggcgcctctagagcccccccagcccgtgtcgccagcgctccttggagctggctgctggtgggatacggggcagctggtctgtcctggtctctgtgggcggtcctctcccccccaggggcccaagaaaaagagcaggaccaagtgaacaacaaagtactgatgtggcgcctgctgaaactttccaggcccgacctcccactgctcgtagctgcgtttttctttttagtgctggctgtgctgggggaaaccctcattcctcactactcaggcagagtcatcgacatcctcggaggggattttgacccccatgcattcgcaagcgccattttttttatgtgcctgttttcttttggtagtagcttaagtgcaggatgtagaggcggctgcttcacctacactatgagtcggattaacctccgtatccgggaacagctgttctcttcgctgttacgacaggacctgggcttcttccaagagacaaagaccggcgagctgaacagcagattgtcgagcgacaccaccttaatgtctaattggctcccactcaacgccaatgttctgctgcggagccttgtgaaggtcgtggggctgtacggcttcatgctctcaatctctccgaggctcaccctgctcagcctcctgcacatgccttttacgatagcagcggaaaaagtgtataatactcggcaccaggaggtgctcagggagatccaggatgccgtggcacgcgccgggcaggtagtaagggaagcagtgggaggcctccaaaccgttcgctccttcggtgccgaagaacatgaggtttgcagatacaaagaggcactcgagcaatgcaggcaactgtattggaggagagatttggaacgtgccttgtacctgctggtaagacgggtgctgcacctgggtgtccaaatgctaatgttgtcatgcgggctgcagcagatgcaggacggcgaactgacgcaaggttccctcttgtcatttatgatctatcaggaaagtgtgggatcttatgtccagacactcgtctatatatacggcgatatgttatctaacgtcggggccgcggaaaaggtgttttcttacatggaccggcagcccaacctgccgtctcccggaacactagctcctactaccctccagggggtggtcaagttccaagacgttagtttcgcttaccctaaccggccagacagacccgtcctgaaaggcctgacctttaccctgcgacctggagaggtgacggctctcgtcggaccaaacggtagtgggaaatccacagtcgctgctttactgcagaacctctaccagcccaccggagggcaggtgttactggacgaaaaaccgatctctcaatacgaacactgctatctgcattcccaagtcgttagtgtcggccaggagcccgttttgtttagcggctcagtgagaaataatatcgcctatggtctgcagagctgcgaagatgacaaagtgatggcagctgcccaggcagcccacgccgacgatttcatccaggaaatggagcacggcatctataccgatgtgggggagaaaggctctcagctcgccgccgggcagaagcagcggttagctatagccagggcactcgtgcgtgatccaagagtgcttatcttggacgaggccacgagtgctctggatgtgcagtgcgaacaggcaaacgggttttgggtcggcccactaggcggcgggtcagcaagcgaatcagatcccaccgggttccttcatgatagcagacacaggctttcaagtgacgtggggatgttcgttgccttgaccaaattgggccagccggacgcggagcagtggaatagtcgcctggacttactggaaagaagccgccaggctgtcgacggagtttgcaggcacaattatcgccttggggctccattcactgtggggaggaaggtccagccagaagtgactgtctatcctgaacggacacctctcctccaccagcacaatctcttgcattgttctgtgaccggcttttatcccggtgacataaaaattaagtggtttcttaacgggcagtag

SEQ ID NO: 209488 - DNA, 2310 bp, Artificial Sequence
  Description of Artificial Sequence: Synthetic coding sequence
atgcggctgcccgacctgcggccctggaccagcctgctgctggtggatgccgcactcctgtggctccttcaaggaccattggggacccttttgccccaaggccttcctggattgtggcttgaaggcaccctgcggctgggggggctgtggggcctgttaaagctgcggggcctcttaggatttgtcgggaccctgctcctccccttatgtctggccacccctctcacagtatctctgagagccctggtcgcgggagcatctcgagcaccaccagctcgcgttgcctccgcaccttggtcatggctcttagtgggctacggagcagccggcctgtcatggtctctgtgggccgtcctgagtccaccaggcgcccaggaaaaggagcaggatcaggttaataataaagtgctgatgtggagacttctgaagttgagccggccagatctgcccttgcttgtggccgccttcttttttttggtcctggctgtcttgggagaaaccttaattccacattacagcggcagagtgatcgatatcctcggaggggacttcgaccctcatgcctttgcttcagcaattttttttatgtgcctcttttcttttggatcttccttgtcagccggctgcagaggtggatgctttacttataccatgtcacgaatcaacctccgaattcgagagcagctgttctctagtctcctccggcaggatctcggatttttccaggaaacaaaaactggcgagctgaattccagactgtcttcggacactacgttaatgtctaactggttgcccttaaacgccaatgtgctcctgaggtctctggttaaggtggtgggactctacggctttatgctctccataagtccgcgtttgactctcctctccctgctccacatgccattcactatcgcggccgagaaagtgtataatactagacatcaggaagtcttgagggagattcaggatgcggtggccagggctggccaggtagtcagagaggcagtcggcggcttgcaaactgtgcggtctttcggcgccgaggagcacgaggtctgtcggtataaggaagcactggaacagtgccgccagctctactggcgcagagatctggagcgggctctgtacctgctagtccgcagagtccttcaccttggagtccagatgctgatgctatcatgtggtttacagcagatgcaggatggagagctgactcaaggctctctgctgtcctttatgatctatcaggagtctgtcgggagttacgtccaaaccctggtgtacatctacggggatatgttaagtaacgtgggtgccgccgaaaaggtgttctcctatatggatagacagcctaaccttccctcacccgggacactcgcacccacaacactgcagggtgtcgtcaagtttcaggacgttagttttgcgtatcccaatcgccccgaccgccctgtgttgaaaggtcttactttcacactgcggccgggagaggtcaccgccttggtggggccaaacgggtctgggaagtctaccgtagccgcactactccaaaatctgtaccagccaacaggcggccaggtgctgcttgatgaaaagccgatttcccagtacgaacattgttacctgcacagtcaggtggttagtgttgggcaggaaccggtcctcttctcgggcagcgttagaaacaatattgcttatgggttacaatcatgcgaggatgataaggtgatggctgccgctcaggcagcccatgctgatgacttcattcaggaaatggaacatgggatatacaccgacgtgggcgagaagggctctcaactcgccgctggtcaaaagcaacgattggctatcgcccgagcacttgtgagggatcctagagtgctgattctggacgaggcgacttctgcactggacgtgcagtgtgagcaggcaaacgggttttgggtaggccccctcggaggcggctcggcgtctgaatccgaccccacaggctttctacacgactccagacaccgattgagttcagatgtaggcatgtttgtagccttgacaaagctgggacagccagatgccgaacagtggaactccagactcgaccttctggagaggtcacggcaggcggtggatggagtttgcaggcataactatcggctcggcgcgcccttcactgtcgggcggaaagtacagcccgaggtgacagtatatccggagcgaacgcccctgcttcatcagcacaacttgctccactgttctgtgaccggtttttatcctggcgatattaagatcaagtggtttcttaatggacagtag

SEQ ID NO: 209489 - DNA, 2310 bp, Artificial Sequence
  Description of Artificial Sequence: Synthetic coding sequence
atgcggctgcccgacctgcggccctggaccagcctgctgctggtggacgcagccctgctttggttactgcaggggccactaggcactctgctgccccagggtctcccaggcctttggcttgagggcacactccgcttgggtgggctgtgggggctcctgaaactgcgtgggctgttaggttttgtgggcaccttactgttgcccctgtgtctggccaccccgcttactgtaagcctgcgcgctctggtcgctggggcctcaagggcaccacctgctagagtggcatctgccccttggtcttggctgctggtagggtatggtgcagctggcttatcatggagcctttgggcagtgttaagtcctcctggtgcccaggagaaggaacaagaccaggttaataacaaggtccttatgtggagactacttaagctcagccggcctgacctgccattgttggtggcggcatttttttttctcgtcctcgcggtgctgggtgagacccttattccacattattcagggcgtgtgattgacatcctggggggggacttcgatccacacgcctttgcaagtgccatcttttttatgtgtctattctccttcggaagtagtctctcagccggttgccgaggtgggtgcttcacctacactatgagccgcattaatctacgcattcgtgaacagctgttttcgtctctgctgaggcaggacctgggtttctttcaggagactaaaactggggagctgaactcccgtttatcgtccgacaccacattaatgagtaactggctgccactcaacgcaaatgtactcctccggtccttagtcaaagtggtcggtctgtatggctttatgctgagcatttctccccggctaacgctactctctctgctccacatgccctttacaatcgcagccgagaaggtgtacaatacacgacaccaggaagtgcttagggaaatccaggacgctgtggcaagagccggccaggtggtgcgggaagcagtcggtggccttcaaacagtgcgatcgtttggagcagaagaacatgaagtgtgcaggtacaaagaagccctcgaacagtgcaggcagctgtattggcgccgcgacctcgaaagggcactgtaccttctggtccgacgagttctgcaccttggggtgcaaatgttgatgttgagctgcggactgcagcagatgcaggacggggagcttactcaaggatcgctgctcagttttatgatctaccaggagagtgtggggagctacgtacaaacccttgtgtatatctacggtgacatgctgagtaacgtcggggcagcagaaaaagtctttagctatatggatcggcaaccaaatctgcctagtcccggcacccttgcccctacaacactccaaggggtggttaaattccaggatgtttcgttcgcctatcccaaccgacctgatagacccgttctcaaagggctgacatttaccctgaggcccggtgaggtcactgccttggttggcccaaacgggtcgggaaagtctacagtcgctgcactgctgcagaatttgtaccaaccgacaggagggcaggtcttgttggatgaaaaaccgatttcacagtacgagcactgttatctccactcccaggttgtgagcgtcgggcaggagccggtcctcttcagcggctcagtgcggaacaatattgcatatggcctccaatcctgcgaggacgataaagtcatggctgccgcccaggccgctcatgccgacgattttatccaagaaatggaacatggaatctacaccgacgttggcgagaaaggctctcaattggccgcggggcagaagcagagactggcaatcgcaagggctctggtgcgcgaccctagggtgctgatcctcgatgaagccacgtcagctctcgacgttcagtgcgagcaggccaacggcttttgggtggggcctctggggggaggatctgcgagtgagtcagatcccacaggctttctacacgacagcaggcatcgtctttcaagtgacgtgggcatgttcgtcgccttaacaaagttaggtcagcccgatgccgagcagtggaactctcgcctggacctacttgagcgctcccgacaggccgtcgacggcgtctgcaggcataattataggctgggagcaccattcactgtggggcggaaggtgcagcccgaagtcaccgtgtacccagaacgcaccccactgctccatcagcacaatctgctgcattgttctgtgacgggtttctacccaggagatatcaagattaaatggttcttaaacgggcagtag

SEQ ID NO: 209490 - DNA, 2310 bp, Artificial Sequence
  Description of Artificial Sequence: Synthetic coding sequence
atgcggctgcccgacctgcggccctggaccagcctgctgctggtggacgctgcgctgctctggctgttacagggtcctctgggcactcttcttcctcagggactccccggactttggctggaaggcaccctgcggctgggggggttgtggggacttctgaaactacgagggctgctcgggtttgtcgggactctgctgctgccgctctgtttagctacaccacttacggtttctttgcgggccctcgttgctggcgcctcacgggcacctcctgctagagttgcttcagccccttggtcttggctgcttgttggttatggcgccgccggtctgtcgtggtcgctctgggcagtgctctcaccaccgggcgcccaagaaaaggagcaggaccaagtgaataacaaagttttgatgtggcgactgttaaagctgtccagacccgacttacctttattggtggccgccttcttctttctagttcttgccgtactgggcgagacccttattcctcactattctggtagagttatcgatatcctagggggcgattttgacccacatgccttcgcgtccgccatctttttcatgtgcctctttagctttggctccagtctgagtgccgggtgtagaggcgggtgcttcacttacacgatgagccggattaacttaagaattcgcgagcagttgttttcttctcttctgcgacaagacctaggattttttcaggaaaccaagaccggcgaactgaacagccggctgagtagcgacacgacactgatgagtaactggctgccgctgaacgccaatgtcttgctccgatctttagttaaagtggtaggcctctacggatttatgctgagcatctcaccccggctgacactgctcagcctcctgcacatgccattcacgattgctgccgagaaggtctacaatacccgccaccaggaggttctgagggaaatccaggacgcagttgcccgcgccgggcaagtcgttagggaggcagttggcggcctgcaaactgtgaggtcattcggagccgaagagcacgaggtctgccggtacaaagaggcacttgagcagtgcagacaactctactggcgccgggacctggaacgagccctctatctgctaatccgccgcgttcttcacctcggggtgcagatgttgatgcttagctgcggactccaacagatgcaggacggcgagctgacacagggaagcctgctgagtttcatgatatatcaggagagtgtggggtcttacgtgcagactctggtgtacatctatggagacatgctgtctaacgtgggtgcagctgagaaagtcttctcatacatggacagacagcccaatcttccttcaccaggcacacttgcccctactacactccagggagtggtgaagttccaagacgtgtcattcgcgtatccaaatcgccccgatcgcccggtgctcaaaggccttacatttaccctgaggcctggcgaggttacggccctggtgggcccgaatggctcggggaaatcaaccgtcgccgctctccttcagaacctgtaccagcctactgggggccaggtgctgctggacgaaaaacccatttcacaatatgaacactgttatctccattctcaggtggtcagcgtgggacaagagcctgtcctgttcagtggatctgtgcggaacaacattacttatgggctccaatcatgtgaggacgataaagtcatggcagcggcccaggccgcccacgctgacgacttcatccaggagatggagcacggaatctataccgacgtgggggaaaaaggctctcagctggctgccggtcagaagcagcgtcttgccatcgctcgtgctctggtacgagaccccagagtcctgattctcgatgaggctaccagcgcactcgacgtgcaatgcgaacaggccaatggcttttgggtggggcctctcgggggagggtccgcatccgagagtgatccaaccgggttcctgcacgacagcagacataggctgtccagcgacgtcggaatgttcgttgccctgactaagcttggtcagcccgatgctgagcaatggaatagtagactcgacctactggaaagatctcgccaggcagtggacggagtatgccgccataattaccgactgggggccccctttacagttggaagaaaggtccagcccgaggttacagtgtacccagaacgcaccccgctccttcatcagcacaacctcttacactgcagcgtaaccgggttttacccgggcgatatcaaaattaagtggtttcttaacggccaatag

SEQ ID NO: 209491 - DNA, 2310 bp, Artificial Sequence
  Description of Artificial Sequence: Synthetic coding sequence
atgcggctgcccgacctgcggccctggaccagcctgctgctggtggacgctgcactactgtggctgctgcaggggcctctcgggacccttttgcctcagggattacctggtctgtggctggaaggtacacttagattgggcggcttgtggggactgctgaagctgcgggggcttttgggatttgtcggaactttgctgctcccattatgtttagcaactcccctgactgtctccttacgcgccctggtcgccggggctagtcgggcgcccccagccagagttgccagcgcaccatggtcctggcttctcgtgggatacggggcagccggattgtcttggtctctgtgggccgttctttcgccaccaggcgcccaggaaaaagagcaggatcaggttaacaataaggtgctgatgtggcgcttattgaaactcagccggcccgatcttcctctgctagtggcagcttttttcttcctagtgctggctgtactgggggaaacattaatccctcattactccggcagggtgatcgacattctgggaggtgatttcgacccccacgcattcgcatcagccatcttctttatgtgtctgtttagctttggttccagcctgtccgcaggatgtagaggcggctgcttcacttacaccatgtcccgcatcaatctgcgcattcgggagcaactgttttcaagtttactgcggcaggacctcgggttctttcaggagaccaaaacaggagaactcaattcccgcctctctagcgatacaacgctgatgtccaactggctccctttaaacgctaacgtcctgctccgatccttagtgaaggtggtaggcttatatgggtttatgctgtccattagccccaggttgactctgctcagcctccttcatatgccctttaccatcgccgcggaaaaggtttataatacaagacaccaggaagttttgagggagatccaggatgccgtggcaagagctgggcaggtagtgcgcgaggccgttggtgggctacagaccgtgaggtccttcggcgctgaggagcacgaggtctgtaggtacaaggaagctctggagcagtgtagacagttgtattggcggcgcgacctggagcgagcactgtatcttctcgtccggcgggtactgcacctgggcgtccagatgctgatgttatcttgcggcttgcagcagatgcaggacggtgaactgacacaaggctctcttctctcatttatgatctaccaggaaagtgtgggctcttatgtccagacccttgtgtacatatatggggatatgctgtcaaacgtgggagctgcagagaaggtctttagttacatggatcggcagcccaacctcccttctccggggacactggccccgactacacttcagggggtagtgaagtttcaggacgttagctttgcctacccgaaccgtcctgaccgtccagttctcaagggcctcacgttcaccttaagacctggggaggtgaccgctctggtcggacctaatggatctgggaagagcaccgttgccgctctgctccagaatctgtatcaacctacaggcgggcaggttctgttggatgaaaagcctatatctcagtacgaacactgctacctgcactctcaggtggtgtcagtcggccaagagccagtcctatttagcgggagcgtccgcaacaatatcgcatatggactgcaaagttgtgaggacgataaggtgatggcggctgcacaggccgctcacgcggacgacttcattcaagaaatggaacatgggatttatacagatgtgggcgagaaaggcagccagctcgctgccggacagaagcagcggctggctatcgccagggccctagtccgcgatccccgggttcttatcctagacgaagcgacatctgctcttgacgtccagtgcgaacaagcgaacgggttctgggtcggacctttgggaggcgggtcagcctccgaatcggaccctacagggttcctacacgacagccgacacagactgtctagtgatgttggcatgttcgtggctctcacaaagctgggacagccagacgcggagcagtggaattctcggttggatttgctggagcgctctaggcaggccgtagacggcgtgtgcaggcataactacagactcggcgcaccgtttacagtgggtagaaaagtccagccagaggttactgtatacccagagcgcacaccgcttcttcaccagcacaatctgttgcattgctcggtaactggattttaccctggagatatcaagatcaaatggttcctgaatggacagtag

SEQ ID NO: 209492 - DNA, 2310 bp, Artificial Sequence
  Description of Artificial Sequence: Synthetic coding sequence
atgcggctgcccgacctgcggccctggaccagcctgctgctggtggatgccgccctgctttggcttctgcagggacctttaggcactctcctgcctcaaggcctgccgggcctatggctagagggtaccctgcggcttgggggcctttggggcctcttaaaattgcgggggttgcttggcttcgtgggcacgctgctcctcccgctctgtctggctactccactcaccgtgagccttcgcgcgcttgtagcaggcgcatctagagccccacccgccagggtggcatctgccccctggtcttggctgctggttgggtacggtgcagcagggcttagctggtctctatgggctgtactatccccacccggggcacaggagaaggagcaggaccaggtaaacaataaggtcctcatgtggcgcctgctaaagctatcccgtcccgatctcccactcctggtggccgctttctttttcctggttcttgctgtgctcggtgagacattgatcccacactacagcggccgggtaatagacattctggggggtgactttgatcctcacgctttcgctagtgctatcttcttcatgtgtcttttttcctttggatcgagcttatctgctggatgtcgtggcggctgcttcacttacactatgtcccggataaatttgcgcatccgcgagcagctcttctccagcctgttgaggcaagatctgggcttctttcaagaaaccaaaaccggtgaactgaactcccgcctcagctcagacactaccctcatgtctaattggcttccgctgaatgccaacgtgttgcttagaagtcttgtgaaagtggtgggcctctacggcttcatgttgagcatcagtccacgtctcaccttgctgtcattgctgcatatgcctttcacaattgcagcggaaaaagtttacaacacaagacaccaagaggtcctccgcgaaatacaggatgccgtagcgcgcgccggacaggtggtgcgggaagcagttggtggactccagacggtgaggtcatttggggcagaagagcacgaggtgtgtcgttataaagaagcgctggaacagtgtagacaactgtactggcgcagagacttggagagggctctatacctgttggtgcgtcgcgtgctgcacttaggggtccaaatgctgatgctaagctgcggcctgcagcagatgcaggacggcgaacttacgcaaggctccctcttaagcttcatgatttatcaggagagcgtaggatcctacgtgcagacccttgtgtacatttatggggacatgctgtcaaacgtcggtgcagccgagaaggtcttctcctatatggacaggcagccgaatctccccagccctggaactctggcccctactacattgcagggagtcgtaaaattccaggatgtcagctttgcctacccaaatcggcccgatcgcccagtgctcaagggtcttacattcacccttcgacccggtgaggtgacggctctggttggccctaatgggtcaggcaagagcaccgtggcggcattactccaaaatttgtatcagcctaccggtggccaggtgctcttggatgagaaacccattagccagtacgagcactgctatctgcacagccaagtcgtgtcggtgggacaggaacccgtgctcttctcaggcagtgttcgcaataatatcgcatacggattgcagtcgtgcgaggacgacaaggttatggccgcggcccaggccgcccacgctgacgacttcatacaggagatggagcacggtatttataccgacgttggcgagaagggaagccagctagcagctgggcagaaacaacgcctggctatagccagagccctcgtccgagacccacgggtgctgatcttagacgaggctacctcggccctcgatgtgcaatgcgaacaagccaatggtttttgggtgggccctctcggtggggggtcagcttctgagtctgaccccacaggatttctgcatgattcccgacatagactgtcctcggacgtcggcatgtttgtggcactaactaagctcgggcagcctgacgccgaacagtggaatagccgcctggatctgttggaaaggtcaagacaagccgtggatggcgtttgtcgccataattatcggcttggtgccccttttactgtggggcgaaaagtgcagcccgaggtgaccgtttaccctgagaggaccccattgctacatcaacacaatctgttgcattgttccgttactggattctaccccggtgacatcaaaatcaaatggtttctgaatgggcagtag

SEQ ID NO: 209493 - DNA, 2697 bp, Artificial Sequence
  Description of Artificial Sequence: Synthetic coding sequence
atggtgtgggaccggcagaccaagatggagtacgagtggaagcccgatgaacagggtctgcagcagattctgcagttgttgaaggaatcccagagtccagacactacaattcagcgaaccgtgcagcagaagctcgaacagctgaatcagtaccccgattttaataactatctcatatttgtcctgaccaagctgaaatccgaggatgagccaacccgctcgctcagtgggcttatactgaagaacaacgtgaaggcccatttccagaacttccctaacggtgtaactgacttcatcaagtcagaatgtctgaacaatattggcgattccagccctctcattcgagctacagtgggcatattgattaccaccatcgcttcgaagggcgaattgcaaaactggcccgacttgttacccaagctgtgcagcctcctagacagtgaagactataatacttgtgaaggggcattcggggccctgcagaagatttgcgaagattcagccgagatcttagattctgacgttctggacaggcccctgaacattatgattccaaagttcctgcagttttttaaacactcctcccccaaaatccggtctcacgccgtcgcctgcgtgaaccagtttattatctcaagaacccaggctcttatgctccacatagacagctttattgaaaatctctttgccctggctggcgacgaagaacccgaggttcgcaaaaatgtttgcagggcgctggtgatgctcctggaagtccgcatggacagactcctccctcatatgcacaacattgttgagtatatgctccagagaacgcaagaccaagatgagaatgtcgccctcgaagcgtgcgaattttggctgactcttgctgagcagcccatctgcaaagacgtcctggtgcggcatttgccaaaactcatcccagttcttgtaaatggcatgaagtatagcgacatcgacattattctcttaaaaggggacgtggaggaggatgaaacaattccagactctgagcaggatatccgccccagatttcacagatcacgaaccgtggcccagcagcatgatgaagacggcattgaggaagaagatgatgacgacgacgaaatcgatgatgatgacaccatatcagattggaaccttcgaaagtgctccgcggccgccttagatgtgctagctaatgtgtacagggacgagcttttgccgcacatcctgcctcttcttaaagaactgctcttccaccacgaatgggtggtaaaggagagcggaatcctggtactgggggctatcgcggagggatgcatgcagggaatgattccctatctacccgagctgattccccatctgatacagtgcctttccgacaagaaggccctggtgagatcaatcacatgctggactctctcacgctatgcccattgggtcgtctcccaacctccggatacgtatctcaagcccctgatgacagagttattaaaacggatattggactctaataagcgggtacaggaagctgcgtgttctgccttcgctaccctagaggaggaggcatgcacagaattggtcccgtatttggcctacatactagatacattagtgttcgcgttttccaaataccagcataaaaacctgctcatcttatatgatgctattggcacgctggctgactcggttggccatcacctcaataagccggagtacattcagatgctgatgccccctcttatacagaagtggaatatgctaaaagatgaggataaagatcttttcccactgctggagtgtctctcctctgtggccactgctctccagagcgggttcctgccctattgtgagcccgtgtatcagaggtgcgtgaacttagtccagaagaccctcgcccaggctatgcttaacaatgctcaaccagaccagtacgaggcccctgataaagattttatgattgttgccctggacctcctgtctggcttggccgaggggcttgggggcaacattgagcagttggtggcacgcagtaacattttgacgcttatgtatcagtgtatgcaagacaagatgccagaggtgcgccagagtagtttcgctctgttgggagacctcacaaaggcatgtttccagcatgtgaaaccctgtatagccgattttatgccgatcctgggaacaaacctgaatcccgagttcatttccgtctgcaataatgcgacctgggctattggcgagatctcaattcagatgggaatagaaatgcagccatacatacctatggtgctccaccagttggtcgagattatcaaccgtccaaataccccgaagactcttctggagaatacggcgattacgatcggccgtcttgggtacgtatgtccgcaagaagtggctcccatgctgcagcagttcattaggccgtggtgtactagtctgcgaaacatcagagataatgaggagaaggactcagccttccgaggaatttgcaccatgattagcgtgaatcccagcggggtcatacaggacttcatctttttttgtgacgccgtcgcttcatggattaatccgaaggatgatctgagggacatgttttgcaaaattctccacgggttcaagaaccaagtgggtgatgaaaactggcgccgattttctgaccagtttccgttgcccttaaaagagcggctggctgctttttacggggtatag

SEQ ID NO: 209494 - DNA, 387 bp, Artificial Sequence
  Description of Artificial Sequence: Synthetic coding sequence
atggagtacgagtggaagcccgacgagcagggcctgcagcagatccttcagctgctgaaagaaagccagagcccagataccaccatccagagaacagtgcagcaaaaactggagcagctaaaccaatatccagacttcaacaactatctaatcttcgtcttgacaaagctaaagagtgaggatgagcccacccgctctctgtctgggctcatattgaagaataatgttaaagctcactttcagaattttccaaatggggtgacagattttataaagtcagagtgcttgaataacattggcgatagctcccctctcatcagggccaccgtggggttaactctgttgcatgtcagcattagtctctcttccgttggtctgaaactgtag

SEQ ID NO: 209495 - DNA, 2547 bp, Artificial Sequence
  Description of Artificial Sequence: Synthetic coding sequence
atggtgtgggaccggcagaccaagatggagtacgagtggaagcccgacgagcagggcttgcaacagattttgcaactgctgaaggaatcccaaagtcccgatacgacaattcagcgaaccgtacagcagaaactggaacagctcaatcagtaccctgactttaataactacttgatttttgtcttgactaaacttaaatccgaaggaatcttaatcacaactatagcaagcaagggagagctgcagaattggccagaccttcttccgaaactttgttcccttttggattctgaggattacaacacatgtgaaggggccttcggagcacttcagaagatttgtgaggattcagctgagattctcgactctgacgtcttagaccgcccactgaacatcatgatacccaaatttttacagtttttcaaacattcatcacccaagattcggagccacgctgtggcctgcgtgaatcagttcataatatcccgcacgcaggcactaatgctccacattgactcattcattgaaaacctctttgctcttgcaggggacgaggaacctgaggttaggaagaacgtttgccgagcactcgtcatgctcctcgaggttaggatggatcgtctgttgccccacatgcacaacatcgttgaatacatgcttcagcgaactcaggatcaggacgaaaatgtggcccttgaggcttgtgagttttggttgacccttgctgaacaacccatctgcaaggacgtgctcgtccggcacctcccgaaattaattcctgtcttggtcaacggtatgaaatattcagacatcgatattatcctgcttaaaggtgatgtggaggaggacgagacaatacccgactccgagcaggacatacgccctcgcttccacaggagcagaacagtggctcaacagcatgatgaggatgggattgaagaagaggatgatgatgatgatgagattgacgatgatgacaccatttcagattggaatcttcgtaagtgttccgctgccgcattggatgtgcttgctaacgtgtatagggacgagttactaccgcacattctgccgctgctgaaagaattactgttccaccacgagtgggtagttaaggagagcggcatcttggtgctcggagctatcgccgagggctgcatgcagggcatgattccgtacctcccagaacttattccccatctgattcaatgcctatcagataaaaaagcactggtacgtagtatcacctgctggaccctgtcccgctacgcacactgggtcgtatcacagcctcccgacacatatcttaagccactcatgaccgaattattaaaaagaattctcgacagcaataaacgggttcaggaagctgcatgttcagcgttcgctacgctggaagaggaagcatgcactgagctcgtgccatatttggcttatattctggatactttggttttcgccttttctaagtaccaacataaaaatctgctgattctgtacgatgccatcgggaccctggcagattccgtgggacaccacctgaataaaccagagtatattcaaatgctaatgccccctctgatccagaagtggaatatgctcaaggacgaggacaaagatctgtttcctctccttgaatgtctgtcttctgttgctaccgcgttgcaatccggcttcctcccctactgcgaacctgtctatcaacgttgtgttaatcttgtacagaaaaccctggcccaggccatgctcaacaacgcccagcccgaccagtacgaggcccccgacaaggactttatgatcgtggcactggaccttctgagtggactagcagaggggctggggggcaacattgagcagcttgtcgcacggtcaaacatcttaacgcttatgtatcagtgcatgcaggacaaaatgccagaggtgcggcaatcctctttcgcactcctaggtgatctcaccaaagcatgcttccagcacgttaaaccctgcattgccgactttatgcccattctgggtacaaacctgaaccctgaattcattagcgtctgcaataacgccacttgggccataggcgagatttccattcagatgggtattgagatgcagccctacattcctatggtcctgcatcagctggtagagatcattaaccgccctaatacccctaaaaccttgctggaaaacacggccatcaccatcgggagactgggctacgtttgcccccaggaagttgcccccatgctgcagcagttcattagaccttggtgcacttcactgagaaacataagggataacgaagaaaaagatagtgccttcagaggcatctgcacgatgatctccgttaacccttcgggagtgatccaggactttatctttttttgcgatgcagtagcttcttggattaatcccaaggacgatcttagggacatgttctgtaaaatcctccatgggtttaaaaaccaagtaggcgatgagaactggcgaagatttagcgatcagtttcctctaccactgaaagaaaggctggcagctttttacggcgtttag

SEQ ID NO: 209496 - DNA, 2673 bp, Artificial Sequence
  Description of Artificial Sequence: Synthetic coding sequence
atggagtacgagtggaagcccgacgagcagggcctgcagcagatcttacaactcctgaaagagagccagtctccggacacaaccatccagcgaacagttcagcagaaacttgagcagctgaaccagtatccagacttcaacaactacctgatttttgtgctcaccaagttaaaaagtgaggatgaacccacccggagcctgtcagggctgatcctaaaaaataacgtgaaagcacacttccagaatttccccaacggcgtgactgatttcatcaaaagcgagtgtctgaacaatatcggggactcctccccgctgattagggccactgtgggtatcctcattaccaccatagctagcaaaggtgaactgcagaactggcctgatctcttaccgaaattatgctcattgctggattccgaagattacaatacctgtgaaggggcattcggagccctccagaagatttgtgaagactcagctgagattctcgattccgacgtccttgacagaccccttaacattatgatccccaaattcttacagttcttcaaacatagttcgcccaagatccggagccacgcggtggcctgtgtgaatcagtttataatatcaaggacgcaggccctgatgctgcatatcgacagctttatcgagaacctgtttgccctcgctggcgatgaggagccagaggtgcggaaaaatgtctgtcgggcactcgtcatgctcctggaagtgcgcatggaccgtttgctcccacacatgcacaacatcgtggagtacatgctgcagcgaactcaggatcaagatgagaatgtggccttggaggcttgcgagttttggctgacactggctgagcaacccatctgcaaggacgttctcgtgcggcatcttcccaagctgattccagttctcgtgaatggcatgaagtactcagatatcgatataatccttctgaaaggtgacgtggaggaggacgagaccatccctgacagtgaacaagatattcgaccgaggtttcataggagcaggactgtagcccaacagcacgatgaggatggaatcgaagaagaggatgacgatgatgatgaaatcgatgacgatgacacaatttcagattggaatctgaggaagtgcagtgctgcggcgctcgatgtgcttgccaatgtttaccgagacgaactgcttccacacattctgccacttttgaaagaactgcttttccaccacgagtgggtggttaaagagagcggaattctggtgctgggggcaattgccgaaggatgcatgcagggtatgattccatacctgcccgagctcattccccatctcatccagtgtctctccgacaaaaaggcccttgtgcggagcatcacttgttggaccctgtcccgatatgcccactgggtggtgagccagccccctgatacgtacctcaagccgctgatgaccgagttgctgaagaggatactggacagcaataaacgggtacaggaggccgcttgtagcgccttcgcaaccctggaggaggaggcctgcacagaactcgtgccatacttggcatatatcctcgataccctggtgttcgcattttccaaataccagcacaaaaacttgttgattttatacgacgccatagggacgctggccgactcggtgggtcaccacctcaataagcccgaatatattcaaatgctcatgccaccgctgatccaaaaatggaatatgctgaaggacgaggacaaggacttattccctctcctcgagtgcctctcatcagtagccacagctctgcagagcggtttcttgccgtactgtgagcctgtctaccagaggtgtgttaacttagtacaaaagactttggcccaagcaatgctcaacaacgcccagcccgatcagtacgaggcccctgacaaggactttatgattgtggccctggaccttctgagtggactagctgaaggtcttgggggcaatatagagcagcttgtggctcggtccaacatccttacattgatgtaccagtgcatgcaggataagatgcccgaagtacggcagagcagctttgccttactgggagacctcacaaaagcctgttttcaacatgtgaagccctgtatagcggattttatgcccattctggggacgaatctgaaccctgagtttataagcgtctgcaataatgccacctgggcaatcggtgagattagtatccagatgggcatcgagatgcagccctatattccaatggtattgcaccagctggttgagataattaaccggcctaacaccccgaagactctgctggaaaacactgcaattactatcggtcgcttgggctacgtgtgccctcaagaggtggcccctatgctgcagcagtttatcaggccctggtgcacctccctccgaaacattagagataacgaagaaaaagactctgcatttcggggtatctgcactatgatcagtgtgaatcccagcggagtgatccaggatttcattttcttctgtgatgctgttgccagctggattaatccaaaggacgatctgagggacatgttttgtaagattttgcatggatttaagaaccaggtgggcgacgaaaactggagaagattctcagatcagtttcccctacctctgaaagagcgcctggcggcattttatggtgtctag

SEQ ID NO: 209497 - DNA, 2664 bp, Artificial Sequence
  Description of Artificial Sequence: Synthetic coding sequence
atggactggcagcccgacgagcagggcctgcagcaggtgctgcagctcttaaaggattcccagtcacccaatactgccacgcaacgaatcgtccaggataaactgaagcaattaaaccagtttccggacttcaacaactacttaatatttgtcttaacccgattgaagagcgaggacgagcccaccaggagcctgtcagggttgatcctgaagaataacgttaaggcccattaccaaagttttccacccccggtggctgatttcattaaacaagaatgcctcaacaacatcggcgatgcatcatccctgattcgtgcgactatagggattctgattaccaccattgcatccaagggcgagctccaaatgtggcccgaactgctgccgcaactctgtaacctgctgaatagcgaagattataatacttgcgagggcgccttcggagcgttgcaaaaaatctgcgaagactcctcggagctccttgattccgatgctttgaatagaccactgaatatcatgatacccaaattcctgcagttttttaagcactgttcccctaagatcaggtcgcacgctatcgcctgtgtaaaccaattcataatggaccgagcacaggctctcatggataacatagacacctttatcgaacatctattcgccctcgctgttgatgacgacccagaggtgcgtaaaaatgtgtgccgtgctctggtaatgctccttgaagtaaggatagaccgactcatcccacacatgcactcaatcatccagtatatgcttcagaggacgcaagatcacgacgagaacgtggctctggaggcttgcgagttttggttaacacttgccgagcagccaatctgtaaagaggtgcttgcgagccacttagtacagctgattcctattctagtgaacggcatgaaatactcagaaattgatataatactgctcaagggtgatgtcgaggaggatgaggcagtccccgattccgaacaggatatcaaaccccgtttccacaagtctcgaacagttaccctcccccacgaagcagaaaggcctgacggttcagaagatgccgaggacgatgacgatgatgatgcgctttccgattggaatctccgtaagtgcagtgcagctgctctcgatgttcttgctaatgtttttagggaagaacttctcccccatctgctgcccctgctgaaaggcctactctttcaccctgaatgggtggttaaggaatcaggaatcctagtgctcggagcaattgccgaaggctgtatgcagggaatggtgccttatctccccgaactgattccccatttaatccagtgtctatctgacaaaaaggctttggtccgaagcattgcttgttggaccctgtccagatacgcccactgggtcgtcagccagccgccagatatgcatctgaaaccacttatgactgagctcttaaaaaggatactcgacggaaacaagcgagtgcaggaggcagcctgctctgccttcgcaacccttgaggaggaggcttgcaccgagcttgtgccctacctttcgtacatactggatacgctggtcttcgctttcggaaagtatcagcacaaaaacctgctcatcctgtatgatgctatcggcacgctagcagattccgttgggcatcacttgaaccaaccggaatatatccagaagctgatgcctcccctaatccagaaatggaacgaattaaaagatgaggataaggatctattcccactccttgagtgtctgagctctgtcgcaactgcccttcagagtggcttcctgccttactgtgaaccagtgtaccagcgttgcgtgaccctggtgcagaaaactcttgctcaagcaatgatgtacacccagcaccctgaacagtacgaagcaccggataaggattttatgattgtggccctggatcttctgagcggtctcgccgaaggactcggaggtcacgtagagcagctcgtagcacgctccaacataatgacactgctgttccagtgcatgcaggacagcatgccagaagttcgacagagctccttcgcgctacttggtgacttgactaaggcttgcttcattcatgtcaagccctgtatcgctgaatttatgccaatcttgggtacaaacctgaaccctgagtttatctccgtttgtaacaatgctacatgggccataggcgagatctgtatgcagatgggtgctgaaatgcagccgtatgtgcagatggtgctgaacaacttagtagagattatcaatcgacccaacactcctaaaaccctcttagagaacaccgcaattaccatcggccgactggggtatgtttgccctcaggaagttgcccctatgctgcagcagtttattaggccatggtgcacgtccctgaggaacatccgtgacaatgaggagaaggactcagcattccggggaatttgtatgatgatcggggtcaaccccggaggagttgtgcaggactttatctttttctgtgatgctgttgcttcttgggtgagccccaaggacgacctgagagacatgttttacaagatactacacggatttaaagaccaggtaggagaggacaattggcaacaatttagcgagcagttccctccattgttgaaggagaggttggccgcattctatggggtctag

SEQ ID NO: 209498 - DNA, 2100 bp, Artificial Sequence
  Description of Artificial Sequence: Synthetic coding sequence
atggactggcagcccgacgagcagggcctgcagcaggtgctgcagctgctgaaagactctcagagtcccaacaccgcaacccagaggatcgtacaggataaattaaaacagctaaaccagttccccgattttaacaattacctcatattcgttctcaccagattaaagtcggaagacgaaccaactcgctctctgagtggcctgatcctcaaaaataacgtcaaggcgcattaccagagcttccctccgccggtggcagactttatcaaacaggagtgtctgaataatattggcgatgcatccagcctgatacgcgccaccatcggtattctgatcactactatcgcctccaaaggcgagcttcagatgtggccagagttactgccacagctgtgtaatctgttgaactccgaggactataacacatgcgagggggcgttcggggctctccagaaaatctgtgaggactccagcgaactgctcgatagcgacgccctgaaccggcctctcaacatcatgatccccaaatttttgcaattcttcaaacattgttctcccaagatcaggtctcacgcaatcgcctgtgtcaatcaatttatcatggatagggcacaagccttgatggacaacatcgatacgttcatcgaacacctcttcgcactcgcggtagacgacgatcctgaggttcgcaaaaacgtgtgtcgggcgcttgttatgcttctggaagtacggatcgatcgactgattcctcacatgcactctatcattcagtacatgctgcaaaggactcaagaccacgatgaaaatgtcgcacttgaagcctgcgagttctggctcaccttagctgaacagcccatttgtaaggaggtgctcgccagccacctagtgcagttgattcccattttggtgaatggcatgaaatattctgagattgacattatccttcttaagggagacgtggaagaggatgaggctgtcccagattcagagcaagacatcaagccccgcttccataagtccagaactgtcacactgccgcatgaagcagaacggcctgacgggagcgaagacgcagaagatgacgatgatgacgatgcactgtccgattggaatctcagaaaatgttcagccgccgcacttgatgtgctcgcaaatgtgtttcgcgaggagctcctacctcacttactgcctctcctaaaaggactcctgttccatcccgaatgggtggtgaaagaatcaggaattctggtgctgggggcgattgccgagggttgtatgcagggcatggttccttatctgccggaactgataccacacctaattcagtgtttgtcggacaagaaagctttagtaagaagcatcgcatgctggaccttgtccagatacgcacactgggttgtgagtcagccccccgacatgcatctaaaaccgttgatgacagaacttctgaaaagaattctggatgggaacaagcgcgttcaggaggcggcctgtagcgctttcgccaccctggaggaggaggcgtgcacagagcttgtgccatatctgtcctacatcctggacaccctcgtgttcgcctttggaaaataccagcacaagaacctgcttatcttatacgatgccattggtacacttgcggacagcgtaggtcaccacctgaaccaacctgaatatatccaaaagctgatgcctcctctaattcagaagtggaatgaattgaaagacgaggacaaggatctttttcccctcttggaatgcctgagtagtgtcgctactgctcttcaaagcggattcctgccctattgtgagcccgtttatcagcgctgcgtaactctggtacagaagacactcgcccaggcaatgatgtacacacaacacccagaacaatacgaagctcccgataaagacttcatgattgtggctctggatctgctttccggactggcagaaggcctgggcggacatgttgagcagctcgtggcacacagcccctcatttccacctcacccactgccaccggcaggatcccgggtgtgcccattcgtgaccgtcctttgttgggggctggctcccaggtggagagagattccgctagtttag

SEQ ID NO: 209499 - DNA, 2694 bp, Artificial Sequence
  Description of Artificial Sequence: Synthetic coding sequence
atggactggcagcccgacgagcagggcctgcagcaggtgctgcagttgttgaaagacagtcagagtccaaacaccgccacccagcggattgtgcaggacaaactgaagcagttgaatcaatttcccgactttaataattacttaattttcgtgttgactagactcaaatctgaggacgaacctaccaggagtctgagcgggctgatcttgaaaaacaacgtgaaagcccactaccagagttttcctcccccagttgcggacttcatcaagcaagaatgcctaaacaacattggcgacgcctcttccctcatccgcgctacaatcggcatcctgatcactacaatcgccagcaagggcgagctgcagatgtggccagagcttttgccccaactttgcaatcttctcaattcagaggattataatacatgtgaaggcgcctttggcgccctgcaaaaaatttgcgaagattcctctgagctcctcgatagcgatgcactgaatcggccgctgaatatcatgatcccaaagttcctgcaattctttaagcactgctcccccaaaattaggtcccacgcaatagcctgtgtgaatcagttcattatggatcgcgctcaggccctcatggataacattgatacattcattgagcacctcttcgctttagctgtggatgatgaccccgaagtcagaaaaaatgtgtgcagagctctggtaatgttgctggaggttcgcatcgatagactgattcctcacatgcacagtataatccagtacatgctgcagcgcactcaggatcatgacgagaatgtcgcactcgaggcctgcgagttttggctcaccctggctgagcagcctatttgcaaagaggtgctagcttctcatttagtccaactgattcctatcttggtaaacggcatgaagtactccgagatcgacattatccttctcaaaggcgacgttgaggaagacgaggccgtgcctgattccgagcaagatataaagccccgctttcacaaatctcgaaccgtgacactcccgcacgaagcagaacggccagacgggtcagaggacgccgaggacgatgatgatgatgacgcattgtccgactggaatctccgaaagtgttctgctgccgcgttagacgtgctggctaacgtgttccgcgaggagttacttccgcatcttctgcccttgctcaaaggtctgcttttccacccggagtgggtggtgaaggagtccggcatccttgtcctaggcgcaatcgccgaagggtgtatgcagggaatggtgccctacctgccagaactaattcctcacctcattcaatgcctcagcgacaagaaagccctcgttagatctatcgcctgttggacactatctaggtatgctcactgggtggtgtctcaacccccagacatgcacctgaaacccctgatgacagagctgctaaagcgcattctcgacgggaataagcgcgttcaggaggccgcttgctccgcgtttgccacactggaagaagaggcttgcacggaactggttccatacctgagctatatcctggacacactcgttttcgcgttcgggaagtatcagcacaagaatctcctgattttgtacgacgctattggcacattagccgattcagtgggtcatcatctcaaccagcccgaatatatccagaagctcatgccaccgctcatccagaagtggaatgagctcaaggatgaggacaaagacctcttccctctactcgaatgtttgagctccgtcgctaccgccctgcagagcggtttcctgccatattgtgaaccagtgtatcagcggtgtgtgactctggtgcagaagactctggcacaggctatgatgtatactcagcatcccgaacagtatgaagccccagataaggactttatgattgtggcactggaccttttaagcgggttggctgagggccttggaggacacgtcgagcagcttgtagcccgaagcaatattatgacactcctatttcaatgtatgcaggattcaatgcccgaagtgaggcagtcaagctttgcattgctcggcgacctgacaaaagcttgcttcattcatgtcaaaccatgtattgccgaatttatgcccatcctcggtaccaatttaaatcccgagttcatttcagtatgcaataatgctacctgggcaataggggaaatttgtatgcagatgggcgccgagatgcaaccctacgtgcagatggttctgaacaacttagtggaaataattaatcgccctaacacaccaaagaccctgcttgagaacacggggcgcttaacctctccatctgcgattcctgccataaccatcgggcgcttaggctacgtctgcccccaggaagtcgcaccaatgcttcaacagttcatccgcccatggtgcacgtcactgaggaacatccgcgataacgaggagaaggatagcgccttcagaggtatttgcatgatgatcggagtgaatcctggcggcgttgtccaagattttatctttttttgcgatgcggtcgccagctgggtgagtcccaaggacgacctccgggatatgttctacaaaattttacatggcttcaaggaccaggtaggagaagacaattggcagcagttcagcgaacaattcccaccacttctcaaagagcgcttggccgccttctatggcgtttag

SEQ ID NO: 209500 - DNA, 2664 bp, Artificial Sequence
  Description of Artificial Sequence: Synthetic coding sequence
atggactggcagcccgacgagcagggcctgcagcaggtgctgcagcttctgaaagattcccaaagcccgaatactgccacacaaagaattgtacaagacaagttaaaacaactgaatcagttccccgatttcaacaattaccttatttttgtgctgacaagattgaaaagcgaagatgaaccaacacgcagcctgagcggcctgatactgaagaacaacgtaaaggcacattaccaatcatttccaccacctgtcgcagattttattaagcaggagtgccttaataatattggtgatgcctcttccctcataagagcgactatcggaatcctgattacgactattgcctctaaaggagaactgcagatgtggcctgagctcctgccccagctctgtaatcttctgaacagtgaagactataacacttgcgaaggcgccttcggagctctgcagaagatctgtgaagattcctccgaactgctggattcagatgcgcttaatcggcctcttaatatcatgatcccaaagtttcttcaatttttcaagcattgcagccccaagatccgctcccacgcaatagcatgcgtaaaccagttcatcatggacagggcacaggccctgatggacaacatcgatacctttatagaacacctgttcgccttagccgttgacgacgatcccgaagtccgaaaaaacgtgtgtcgcgcactggtgatgctgctggaggttcgaatcgatcggcttatccctcacatgcatagcattattcagtacatgctgcaaagaacccaggatcacgatgagaatgttgcactagaagcctgtgagttctggctcactctggctgaacagccaatatgtaaagaggtgctcgcctcccacctggtgcaactgattccaatcctagtgaatggcatgaagtactcagaaatcgacatcattctgctgaagggcgatgtggaggaggatgaggctgttccagatagcgagcaggacatcaaaccaaggttccacaaatctagaactgtaacgctgccccatgaggctgagcgtcctgatggctccgaggatgcagaagacgacgacgatgacgatgccctgtccgactggaacctccgcaagtgcagtgctgctgcactggacgtcctggcaaatgtgttccgcgaggagctcctgcctcatttgctaccgctactgaaaggactgctgttccatcccgagtgggtggtaaaggagtctggtatcctggtcctgggcgctattgcagagggttgtatgcaggggatggtgccttaccttcccgaactcattccacacctgatccagtgcctgtcagataaaaaggcccttgtcaggtcaatagcctgttggactttgtctcggtacgcgcattgggtagtatcccagcctcctgacatgcatctgaagcctttaatgaccgagctgctgaagcggattttagacggaaataaacgggtgcaggaggccgcatgtagcgcgtttgctaccttggaggaggaagcttgcacagagctggtgccctacttgagttatattctggataccctcgtcttcgcattcgggaaatatcaacataagaacctcctcattctctacgatgcaattgggacactcgctgactcagtgggtcatcatctgaatcagcccgaatatatccaaaagttgatgccccccttgatccagaagtggaatgagctgaaggacgaggataaggatctgttcccattgctagaatgcctgtcatctgtagcgaccgcattacagagcggattcctgccctattgcgagcctgtttaccagcggtgcgttactcttgtgcaaaaaactctcgcccaggcaatgatgtatacccaacatccagagcagtatgaagcacctgacaaagatttcatgatcgtcgccctcgacctgctgtcgggcttagccgaggggctgggtggacacgtggagcaactggtagcccgctccaacatcatgactttgttgtttcagtgcatgcaggacagcatgccagaagtgcgccagagcagctttgccttgctcggcgacctcacaaaggcctgcttcattcacgtcaagccctgtatcgccgagtttatgcctatacttggaaccaatctgaatccggagttcatcagtgtctgcaacaatgctacatgggcaatcggagagatatgcatgcagatgggcgccgagatgcaaccttatgtacagatggtcctgaacaacctggtcgagattattaatcggccaaacacccctaaaactttactggagaatacagccatcacgattggtagactcgggtacgtttgccctcaggaagttgctcccatgctacagcagtttatacgcccttggtgtacgtctctgaggaacattagagataatgaggagaaggattccgccttccggggcatctgtatgatgattggggtgaatcctggaggggtggtccaggactttatcttcttttgtgatgcagttgcatcctgggtgtccccgaaggacgatctgagggatatgttctacaaaatcctgcacggcttcaaagaccaggtgggcgaagacaattggcagcagttcagcgagcagttcccccctctactgaaggagcgtctggcagctttttacggggtgtag

SEQ ID NO: 209501 - DNA, 2694 bp, Artificial Sequence
  Description of Artificial Sequence: Synthetic coding sequence
atggactggcagcccgacgagcagggcctgcagcaggtgctgcagctgttgaaggacagccagtcgcctaatacggccacacaacgtatcgtgcaagacaagctcaagcagctcaatcagtttcccgactttaataactatctgatcttcgtccttaccagactgaaaagcgaagatgagccaacgagatcgctgtctggtctgattctcaagaacaatgtgaaagcccactatcaaagcttccctccccccgtggctgattttatcaagcaggagtgtctgaacaacattggggatgcatcttcactgattcgagctaccatcggaatcctcatcaccaccatcgccagtaaaggggagctccagatgtggcctgaactgctgccgcagctatgcaacctgcttaactcagaagattataacacctgcgagggcgcctttggcgcactgcagaaaatctgcgaggacagttccgagttgttggactcagatgcacttaaccgccccctgaacatcatgataccgaagttccttcagtttttcaagcattgctctcccaagattcgctctcacgcaattgcatgcgtgaaccaatttattatggatagggctcaagctttaatggataatatcgatactttcattgagcacctatttgccctggctgtggatgacgatcctgaagtaaggaagaatgtttgcagagcccttgtcatgctcctcgaggtgaggatcgatagactcatcccccacatgcatagcattatccagtatatgctccagcgaacacaggatcacgacgagaatgtggctttagaggcctgtgagttctggctgacacttgccgagcagcccatctgtaaagaggtactggcctcgcaccttgtgcagcttataccgattctggtgaacgggatgaaatatagtgagatcgacatcattttgctcaagggcgatgtggaggaagatgaggctgttcctgacagtgagcaggatataaagccacggtttcacaaatctcggaccgtgacactccctcacgaggctgagcggccagacggaagcgaggacgcagaagatgatgacgatgacgatgctctaagcgattggaatctccgcaagtgcagcgccgccgccctcgacgtactcgcaaatgtctttcgggaagagttgctgccccatctactgccacttctcaagggcttgctgttccacccagagtgggttgttaaagaatcaggaattttagtccttggggcgatcgcagaaggttgcatgcaaggaatggtgccttacttgcctgagctgatcccgcatttaatccagtgcctcagtgataagaaggcattggtccgcagcatcgcttgctggaccctgagtagatacgcccattgggttgtgtcccaacctccagacatgcacctgaagccactgatgactgaacttctgaagaggatcctagatggcaacaagcgcgtccaagaggcagcctgcagcgcctttgccactctggaggaagaggcatgcaccgagttggtgccctatctgagctatatcctggacacgctggtcttcgccttcggcaagtatcagcataaaaacctactcatcctgtacgacgccatcgggaccctggcagacagtgtcggccaccacctgaatcagcccgaatacattcaaaagctgatgccccccttgattcagaagtggaacgagctaaaggacgaggataaggatctgtttcctctgctcgagtgcctgtctagcgtggcaactgcactgcagtccgggtttttgccttattgtgagccagtgtatcagcgttgtgtaacactggtccagaaaacactggcgcaggccatgatgtacactcagcatcccgagcagtacgaagcaccagataaggacttcatgattgtcgctctcgacctgctcagtggattggctgaagggctgggaggacatgtggaacaactcgtcgccagatccaatataatgacgctgttgttccagtgtatgcaagacagtatgcccgaagtgaggcaaagtagcttcgccctgcttggggacctgacaaaggcctgttttatccatgtgaagccttgcatcgctgaattcatgcccatcctcggcaccaatctgaatcctgagtttatcagcgtatgtaacaacgcgacttgggctataggagagatctgtatgcagatgggggcggaaatgcaaccctatgttcaaatggtactgaataacctggtcgagatcatcaaccgcccaaacactccgaaaacacttctcgaaaacacaggaagactgacgtcaccaagcgctatccccgcgattactatcggtcggctcgggtacgtttgcccccaggaggttgcccccatgttgcagcagttcattaggccttggtgcaccagcctccgcaatattagggacaacgaggagaaagattctgccttccgggggatctgtatgatgatcggcgtgaatccaggcggcgtggtccaggactttatctttttttgcgacgccgtggcctcctgggtgagtccgaaggatgatctgcgcgatatgttctacaagatcctccacggcttcaaggatcaggtgggggaggataactggcaacaattctcagaacagttccccccactattaaaagagaggctcgcagccttttacggggtgtag

SEQ ID NO: 209502 - DNA, 3156 bp, Artificial Sequence
  Description of Artificial Sequence: Synthetic coding sequence
ggccagagcgtgggcggccggggcctgttccgggactgcgcctgcatcgaagaaacaaccggcgcgggggcactttctcggtctggggccgggccgctggatgtggaggctgctggacctagcccgtctcgttgtgaaggcggaggatccctgcgcgccaggagcaggggccagcgacatgggcctccctgggacgaaggatcatcactggggcctatgcgcattaggagggccccaccaccaccccccgtcgctcggtttcacatcccccctccagccctcccaagtccacgacttcggggaaggggatggcgcagttggaggggacctcgcacctgggctggcgttgacaggagacccccaccagtgcgccgtggccgaagtagaaggcacgcagcgaccgctgctagcggagctccaccaggatcacataccgagcctcagaggccatctgctgacccaggaccgtacctgcgctcattaccgtgcgctatggactggcaacctgatgaacagggcctgcagcaggtactccaacttctcaaagatagccaatcgcccaataccgctacacagagaatcgtgcaggacaaattgaagcaactgaatcagtttcccgacttcaataactacctcatctttgtcctgacacggcttaaatccgaggacgaaccaacacgctctctgtctgggctgattctgaaaaacaatgttaaggcacattaccagagcttccctcctcccgtggccgattttatcaagcaggagtgtttgaacaacatcggggacgcaagcagtctcatacgcgcaacaattggcatactgataaccacaatcgctagcaagggagaattgcaaatgtggccggaactcctgccacagctgtgtaacttgctgaattctgaggactataatacctgtgaaggcgctttcggtgccttgcagaagatctgtgaggactccagcgagctacttgactcagacgcactcaacagacctctgaatatcatgattccaaaattcttacagttcttcaagcactgttctccaaagattcggtcacatgctatagcctgtgttaatcagttcatcatggacagggcccaggcactgatggataatattgatacattcatcgaacatctgttcgcactggctgtcgacgacgatcctgaagtcaggaaaaacgtgtgccgtgccctggtgatgctgctcgaggtgcggattgatagattgatccctcacatgcactcaataattcagtacatgctgcaaagaactcaggatcacgatgaaaacgtggctctggaggcatgcgaattctggttaacgcttgccgagcaaccaatctgcaaggaagtgcttgcaagtcacttggtccagctcattcccatcctcgtaaatgggatgaagtacagtgagatcgacatcattttgttgaagggagacgtggaagaagatgaagccgtccccgatagtgagcaggacattaaacctcgcttccacaaatccaggaccgtgacgctcccgcacgaagcagaacgacctgacgggagcgaggatgcagaagacgacgacgatgatgacgccctgtccgattggaatctacgcaagtgttctgcagcagccttagacgtgttagctaatgtatttagggaggaattgctacctcacctgttgccactgctcaagggtctgctgtttcatccagaatgggtcgttaaggagtcaggcatcctcgttctgggtgccattgcggaaggctgcatgcagggaatggtgccttatttgccggagctgattcctcatcttattcagtgcctctccgataagaaagccctggtcaggagcattgcatgttggaccctgtctaggtatgctcattgggtcgtttctcagccccccgatatgcacctcaagccactgatgactgagctactgaagcggatcttagacgggaacaaacgggtgcaggaggcagcttgttcggcatttgccaccctcgaggaagaggcctgcaccgagctagtgccttacctctcgtatatcctggataccttggtgttcgcatttgggaaatatcagcacaaaaatttgctgatattatacgacgccatcgggacactggcagattctgtgggccatcatctcaatcagccagaatacatccagaaactcatgcccccattgatccaaaaatggaatgagctgaaagatgaggacaaggatctgttcccactgctggagtgcctctccagtgtcgccacagctctgcaaagtggattcctgccatattgtgagcccgtttaccaaaggtgcgtgaccctagtccagaagactctggcccaagctatgatgtatactcaacaccccgaacagtacgaggcacccgataaggattttatgatcgttgcccttgacctactttcagggcttgcggagggccttgggggccatgtggagcaactggtggccagatctaatatcatgactcttttgttccaatgtatgcaagacagcatgcctgaagtaaggcagagttctttcgctttgctgggagatctgaccaaggcctgtttcatccacgtgaaaccttgtattgctgaatttatgccaatattgggcactaacctgaatcccgagtttataagtgtctgcaacaacgccacatgggctatcggagagatctgcatgcagatgggggccgagatgcagccttatgtccagatggtgctgaacaatctggttgagatcatcaatagacctaacactcctaagaccctattagaaaatacagccattacaattggaaggctcggttacgtgtgcccacaggaagtggcccccatgctacagcagtttatacgtccctggtgcactagtctgagaaacatccgtgacaacgaagaaaaagactctgcttttcgcggcatctgcatgatgattggcgtgaaccccgggggcgtggtccaggactttattttcttctgtgatgcagtcgcctcctgggtatctcccaaggatgacctgagggacatgttttacaagatcctgcacggattcaaggaccaggtgggggaagacaattggcagcagttttcagagcaattcccaccattgctaaaggagcgactggccgctttttacggcgtttag

SEQ ID NO: 209503 - DNA, 2316 bp, Artificial Sequence
  Description of Artificial Sequence: Synthetic coding sequence
atggactggcagcccgacgagcagggcctgcagcaggtgctgcagctgctcaaagacagccagagtcccaacactgccacccaaaggatagttcaggataaactgaaacagctgaatcagttcccagactttaacaactatctgatttttgtcctgactaggctgaagtctgaggacgaaccgacgcgctccctctccggtttgattttaaagaacaatgttaaggcccattatcaaagttttcccccaccagtggctgactttatcaagcaagagtgtctcaataatattggggatgcgagctcacttatacgtgcaaccatcggtatccttataacgaccattgcatctaaaggagagctccaaatgtggccagaattgcttccccagctttgtaacctcctgaactccgaggattacaacacttgcgagggagctttcggagctctgcagaagatctgtgaagactcttccgagctcctggactcagatgccctcaacagacctttgaacattatgattcctaaattcctgcagttttttaaacattgttctcctaaaatcaggagccatgccatcgcttgcgtgaaccagttcattatggacagggctcaggcactcatggataacatcgacaccttcattgagcatttatttgcactggctgtcgacgatgacccggaggtaagaaagaatgtgtgccgcgccctcgtgatgctactcgaggtgagaatcgaccggttgatcccacacatgcacagcataatccaatatatgcttcagagaacccaagaccacgatgaaaatgtggccctggaagcctgcgagttttggttgaccctagcggagcaacctatttgtaaagaggtgctcgctagccatttggtgcagctgatccccatcctcgtgaacggtatgaagtacagtgaaattgatattatcctgcttaaaggcgatgtggaagaggacgaagccgtgccagattccgaacaggacatcaagccccggttccataagagtaggacggttactctcccacacgaagccgagagaccagacgggagtgaggatgccgaagacgacgacgacgatgacgccctgagcgattggaatcttagaaaatgttccgccgccgcgctggacgtgcttgctaatgtgtttagagaggagctcctgccccatcttctccctctgctgaagggactcctctttcatcccgagtgggtggttaaggaatccggcatcctggttttgggggccatagctgagggatgtatgcagggtatggtgccctatctgccggaactgatcccccatctgattcagtgtttatctgataagaaggctcttgtccgtagcattgcctgctggaccctctctcgctatgctcattgggttgtttctcagccacccgacatgcacctgaagccactaatgactgagctactgaagagaatactggatggaaacaaacgcgtgcaggaggccgcatgctccgcttttgcgacactggaggaagaggcgtgcacagaactggttccatatctctcttacatcttggacactctagtgttcgctttcggcaaataccagcacaagaatttgcttatactctacgatgcgattggcaccctcgcagactccgttggacaccatcttaaccaacctgagtatattcaaaaactcatgcctcctcttatccaaaagtggaatgagctcaaagatgaagataaagacctgttcccactcctggagtgtctgtcgagcgtggccaccgctctgcagagcggttttctgccttactgcgagcctgtttatcagagatgtgtcactctcgtgcaaaagactctagctcaggccatgatgtacacccagcacccagaacagtacgaggcccctgataaggacttcatgattgtggcacttgacctcttgagcgggcttgccgaggggcttggaggccacgtagagcagttggttgctcgcagcaacattatgactctgctatttcagtgcatgcaggacagcatgcccgaggtgagacaaagtagtttcgccctcctcggagacctgactaaagcttgttttatccacgtgaagccatgtatcgccgagttcatgccgattctcggcacgaacctgaaccctgagtttatttctgtttgcaacaatgcaacctgggctatcggtgagatctgcatgcaaatgggtgccgagatgcaaccatatgtacagatggtcctgaataacctggttgagatcatcaaccgccccacaccaagtcaaaagcagaataagacaaagaagaataagtag

SEQ ID NO: 209504 - DNA, 2772 bp, Artificial Sequence
  Description of Artificial Sequence: Synthetic coding sequence
atggagggcgccaagcccaccctgcagctggtgtaccaggccgtgcaggctttgtaccatgaccccgacccgtccggaaaagaaagagcctccttttggctgggggagttacagcgaagtgtacacgcctgggaaatctcggaccagttactccagatcagacaggacgtggagtcctgctatttcgccgctcaaacgatgaaaatgaagattcagaccagcttctatgagcttcccaccgatagtcatgctagtcttcgcgatagcctgttgacacatatccagaatctcaaagacctgtcccccgtcatcgtgacccagctggcactggccattgcagacctggccctccaaatgccatcgtggaagggctgcgtgcagactttagtagagaagtactctaacgacgtgaccagcctgccttttctgttggagattcttaccgttttgcctgaagaggtgcactcacgctccctgcggatcggcgccaaccggcgcacagagattatcgaagatctggcgttctactccagtacagtggtcagtctcctgatgacctgtgtcgagaaagcaggaactgacgagaagatgttaatgaaggtgtttcgctgcctcggctcttggtttaatcttggtgttttggattccaattttatggccaacaataagttgctggcgcttttgttcgaggtgctgcaacaggataagacaagcagtaatttgcatgaggccgcctccgactgtgtgtgctcagctttgtacgcaatagaaaacgtagagaccaacctgcccctagcaatgcaactgtttcagggagtgctcacacttgagacagcataccatatggcggtcgcaagggaggacctcgacaaagtgttgaactattgccgcatcttcacagaactctgtgaaacgttcttggaaaaaatagtttgcaccccgggacaaggcctaggtgatttgcggaccctggagctcttgctgatttgtgccggacacccccagtatgaagttgtggaaatatcatttaacttttggtaccggctgggagaacatctgtataagacaaatgacgaagtgattcacggcatttttaaggcttacattcagcggctcttacacgctttagctcgccactgccagctggaacctgatcacgaaggcgtgcctgaggaaaccgacgacttcggggagtttaggatgcgagtttcagatctagtaaaggacctgatctttctcataggcagtatggagtgctttgcccagctctattcaactcttaaggagggcaatcccccatgggaagtcacggaagcagtcctgttcataatggctgcaatcgcaaaaagcgtggatcccgaaaataatcccactttggtggaagttctcgaaggtgttgtgcggctaccagagacagtccacactgctgtgaggtacacatctatagagttagtgggcgaaatgtccgaggtcgtcgatcgcaaccctcagttcctggatcctgtactgggttatctcatgaagggattatgcgagaaaccactcgcctctgcggccgctaaagccatccataacatctgcagtgtgtgtagagaccacatggcccaacatttcaatggtcttttggagatcgcacgatctttagattctttcttgctatcaccagaagccgcagtgggcctgctgaagggcactgccctcgtattggcgagactgcctttggacaagattaccgagtgtttatctgaactgtgctcagtccaggtcatggctttgaagaaactgctctctcaagaaccatccaatggcatctcaagtgatcctaccgtcttcctcgacaggctggctgtaatctttaggcacaccaacccaatagtagaaaacggccaaacacatccttgtcagaaagtcattcaggagatatggcctgtgctaagcgaaaccttgaacaaacaccgggctgataataggatcgtagaaaggtgctgccgttgtttgagattcgccgttagatgcgtcggcaaaggctccgcggcgttgctgcagccactggttacccagatggtcaatgtgtaccacgtccaccagcattcatgctttctctatctcgggagtattttggtcgacgaatacggaatggaggagggctgccgccaaggcctactggacatgttgcaggctttatgcatcccgacattccaattgctggaacagcagaacggtctccagaaccatcctgacaccgtcgacgacttgtttagactggcgacgaggttcattcagcgctctcccgtcactctgctccgaagccaggttgtgattccaatcctccaatgggctatagccagcacaactctggatcacagggacgcgaactgttctgtgatgcgatttctgcgggaccttatacatacgggtgttgccaacgaccacgaggaagactttgagcttcgcaaggaacttataggacaggtgatgaaccagctgggccagcagcttgtcagccagctgctccacacttgttgtttctgcttgcccccatacacgctacctgatgtggcggaagttctctgggaaatcatgcaggtggatagacccaccttttgccgatggctggagaattcccttaagggcctgccaaaagagactacggtaggcgcggtgaccgttactcataaacagttaacagacttccataaacaagtaacctcagccgaagagtgtaagcaggtgtgctgggcgttgagagattttacaagactgtttcgctag

SEQ ID NO: 209505 - DNA, 2874 bp, Artificial Sequence
  Description of Artificial Sequence: Synthetic coding sequence
atggagggcgccaagcccaccctgcagctggtgtaccaggccgtgcaggccctctaccacgaccccgacccctccggtaaggaacgggcttccttctggctgggcgagctgcaacggagcgttcatgcctgggagatatccgaccaattgttgcagattcgtcaggatgtggagagttgctattttgcagctcaaactatgaaaatgaagatacagacttccttttacgaactgccaaccgactcccatgccagtcttagagactcgctgctgacacatatccagaacctgaaagatctgtccccagtgatcgtcacacaacttgctcttgcaatcgcagatctggctcttcagatgccatcttggaagggatgtgtacaaaccctggtggagaagtattctaacgacgtaactagcctcccgttcttattggagattctgactgtgctccccgaggaggtacattcccgatccctgcggatcggggctaaccggaggactgaaataatcgaggacctggccttttattcttctacagttgtgtctcttttgatgacgtgcgttgagaaggctggcaccgacgagaagatgctcatgaaggtctttcgctgcctgggaagttggtttaatctgggcgtcttggactcaaatttcatggctaacaacaagttgctcgctctgctgttcgaagtgctgcaacaggataaaacaagttcaaatctccacgaagccgcctccgactgcgtctgcagtgccctatacgccatcgaaaatgtggagaccaatcttcctctggccatgcagctgttccaaggcgtgctcaccctggaaactgcttaccacatggcagtggcacgggaggatctcgataaggtactcaactactgcaggatattcaccgagctttgtgagacttttctggagaaaatcgtgtgcacacctggacagggacttggagacctgcggacactcgagctgctcctcatctgcgccggtcatccgcagtatgaagtagtggaaatatctttcaatttctggtaccgcctgggcgagcacctgtacaaaactaatgatgaggtcattcatggcatctttaaagcatacatccagcgcctccttcatgcattagcaaggcattgtcagttggagccagaccacgagggtgttcctgaggaaacagacgactttggcgaatttcgaatgagggtgtccgacctcgttaaggacctgatctttttgataggcagtatggagtgcttcgcgcaactatattccacactgaaggaggggaatccgccatgggaagtgactgaagctgtgttgttcattatggctgccatcgcgaaaagcgtagatcccaaaaagccattctccaatgccgtatgtcgtcattctctgctgttcggtcagaacattacgagcgagatcagtaattgtgagtatctgccgcccgtgctgcgggaaaataacccaactctggtcgaggttctcgaaggggtggttagactgccagaaactgtccacactgcagttcgctacacctcaattgaactagtaggggaaatgtctgaggtcgtggacagaaatccccagtttttggacccggtgctggggtacttaatgaagggactgtgcgagaagccgctagcttccgctgccgccaaggcgatacacaatatctgtagcgtgtgccgcgatcacatggcccagcactttaacgggctcttggaaatagcccgttccctcgactcgtttttattaagtccagaggccgccgttggactgttgaaagggaccgctctggtgctcgctagactgcctctggataagatcaccgagtgcttaagcgaactttgcagtgtgcaagtgatggcactcaaaaaactgttgtcacaggaaccttctaacggaatcagttcagatcccacagtatttctggatcggctggcggtcatctttcgccatacaaaccccatagttgagaacgggcagacccatccttgtcagaaagtgatccaggagatctggcctgtgctgagcgagacactcaacaaacacagggccgacaatagaatcgtggaacgatgctgtcggtgtctgcggttcgccgtgcggtgtgtaggcaagggatcagccgcactgttgcagccattggtcacacagatggtgaacgtataccatgtgcaccagcattcctgcttcttataccttggttcaatcctcgttgacgaatacggtatggaagaaggatgtcgccagggtcttcttgacatgctgcaggccctgtgtatccctacatttcagctgctcgaacagcagaacggattgcagaatcatccagacaccgtggacgacctgtttcgactggccaccaggtttattcaaagaagccccgtgacacttctgcgatcccaggtagttatccccatcttacaatgggctattgcttctaccacccttgaccatcgggacgccaattgcagtgttatgcgctttttaagagatttaatccacaccggggtggccaatgaccacgaggaggacttcgaacttcggaaggagctgatcggacaggttatgaatcaactgggtcagcagcttgtgtcccaactgctgcacacatgttgcttctgtcttcccccatacacgctgcccgatgtggccgaagtgctctgggagatcatgcaggtcgaccgccccactttctgtcgctggctagaaaattcattgaagggtctgcccaaggaaactactgtcggcgccgtgaccgtaacccacaagcagctgaccgatttccacaagcaggtgacgtccgccgaagagtgcaaacaggtctgctgggcactgcgagactttactcggctgttccgctag

SEQ ID NO: 209506 - DNA, 2874 bp, Artificial Sequence
  Description of Artificial Sequence: Synthetic coding sequence
atggagggcgccaagcccaccctgcagctggtgtaccaggccgtgcaggctctgtatcacgaccccgacccatccggaaaagaacgggctagcttttggctgggtgaactccagcgttcagtccatgcctgggaaatctccgaccagctcttgcagatcagacaggatgtggaatcttgctacttcgctgcccagactatgaagatgaaaatccagaccagtttctacgagctgccaacagactcccacgctagtctacgggattccctgcttactcatatccagaatctgaaggacctgtctcccgtcattgtcactcagcttgccctcgctatcgccgatctggcactgcaaatgcccagctggaagggatgtgtacagacccttgtggagaaatattctaacgatgttactagcctgccctttctgctagagatcctgaccgtgctgcctgaggaggtgcacagtcgcagtttgcgtatcggtgccaacaggcgcaccgagattattgaagacttggccttttactccagcacagtggtctctcttctcatgacttgcgttgagaaggccggcaccgacgaaaagatgctgatgaaagtgtttcgctgcctgggcagttggtttaatctgggagttctggactctaatttcatggctaataacaagttgctggctcttctgtttgaagtcctccagcaagacaagactagttctaacctgcacgaagccgctagcgattgtgtctgcagcgccctgtatgctatcgagaacgtggaaaccaacctgccattggccatgcagctgtttcagggggttttgacattggagacagcctaccatatggccgtcgcacgggaagacttggataaagtacttaactactgtcggattttcacagaactttgcgagacgtttcttgagaaaatcgtttgcaccccagggcagggcctgggagatctgaggacactagagctcctcctgatatgcgcaggccatccccagtatgaggtcgttgagatttcatttaacttctggtataggcttggggagcatttgtataagaccaatgacgaagtgatacacggaatatttaaggcatatatccagcgtctcttacacgccctcgccaggcactgccagctggaacccgatcacgagggagtacccgaggaaacagatgattttggcgagtttaggatgcgggtcagcgatctagtgaaagatttgatctttctgatcgggagcatggaatgcttcgcgcaactctactccacactgaaagagggtaatccaccatgggaggtcaccgaagccgtgctgttcatcatggcagcaatcgctaagagcgtggacccaaagaaacctttttcaaacgcagtctgtcggcactcgttgctctttgggcaaaacataaccagtgagatcagcaattgcgaatacctcccaccagtcctccgggaaaacaaccccacgctggtggaggttcttgagggggtcgtcagactgcccgagactgtgcacacagctgtgcgatacacatccattgagctggtgggcgagatgagcgaggtggtagataggaacccccagtttctcgatcctgtattaggctacttgatgaaaggactgtgtgaaaaaccactcgcctccgccgcagccaaagccatccacaatatctgctccgtttgcagggaccatatggctcagcatttcaacggattactggagatcgctcgttctctcgactcgtttttgttgtcgcccgaggcagctgttggtctcctcaagggaaccgccctcgtcctcgcaaggcttcctctggataagattacagagtgcctctccgagctttgtagcgtccaggtcatggctcttaaaaaactgctctctcaggaaccctccaacgggataagctcagatcctaccgtcttcctcgacagactggctgtaatctttaggcacacgaaccccattgtggagaacggccaaacccatccatgccagaaggtcatccaggagatctggcccgtgctgtcagagacactcaacaagcacagggccgacaatagaattgtggagagatgctgtcgttgtctgagatttgctgtgcggtgcgtgggcaagggtagcgcagctctgctccaaccactggtgacccaaatggtcaacgtataccatgtgcatcaacattcttgctttctctacctcggctccattttagtggacgaatatggaatggaagaaggctgcaggcagggacttttagacatgctgcaagccttgtgtatacctacctttcagctgttggagcaacagaacggactacagaatcatcctgatacagtggacgatctctttaggctggccaccaggtttattcagcgaagcccagtgacattactgcgatctcaagtggtgatcccaattctgcagtgggctatcgcgagcaccacactggatcacagggatgcgaactgttcagtgatgaggttcctgcgtgacctcatccacacaggcgtagccaacgaccatgaagaggactttgaacttcgcaaggagctgataggacaggtcatgaaccagctgggacagcagctagtgtcccagttgctgcatacttgctgcttctgtcttcccccctatacactccccgatgtagcggaggttttgtgggagattatgcaggtggacaggcctaccttctgcagatggctggagaactctttaaagggcctccctaaggagacaaccgtaggggcagtaacagtaacccacaagcagttaactgactttcacaaacaggtgacttccgcagaagaatgtaaacaggtgtgttgggccctaagggactttacacggttgtttagatag

SEQ ID NO: 209507 - DNA, 2580 bp, Artificial Sequence
  Description of Artificial Sequence: Synthetic coding sequence
atggagggcgccaagcccaccctgcagctggtgtaccaggccgtgcaggcgttgtaccatgatcctgatccaagcggaaaagagagggcctcattctggctgggagaactgcaacgcagcgtgcacgcatgggaaattagtgaccaactgctacagattcggcaggatgtggagtcctgctacttcgcggcccagactatgaaaatgaagatacagacaagcttttacgaattgcccactgattcacacgctagccttcgagactccctgctcacacatatacaaaacctgaaagacttgagcccagttattgtcacccaactcgcgctggcgatcgctgatctggcactccagatgccttcctggaaggggtgtgtccagacccttgtcgaaaaatattcaaacgatgtaacttccctcccattcctgttagagatcctaactgttctgccggaggaggtgcatagtcgatcgttacggattggagccaaccgacgcacagagatcatagaggatctggccttttactcttccacagtggtctctctgttaatgacctgtgtggaaaaggcaggaacggacgagaagatgctcatgaaggtgtttcgatgtctgggttcttggttcaacttgggcgttctggattccaacttcatggccaacaacaagctgctcgcgttgttgtttgaggtgttgcagcaggacaagacttctagtaacctccatgaagccgcttcagactgtgtgtgttcggctctgtacgctatagagaacgtggaaactaatctgcctcttgctatgcagctgttccagggggttctcactctggaaaccgcctatcacatggctgtcgcccgggaggatctcgacaaagtcctcaactattgtagaatcttcactgaactatgtgaaacatttcttgaaaaaattgtgtgcactcccggacaagggctgggtgatctcagaacactggaattgctactgatctgcgccggacacccacagtacgaggtggtcgaaatcagcttcaacttttggtatagactcggcgaacacctgtacaaaacaaatgatgaggttattcacggcatttttaaagcttacattcaaaggctccttcacgctctggccaggcattgccagcttgagccggatcatgaaggggtacccgaagagactgatgattttggagaatttaggatgagggtgagcgatctggtcaaagacttgatcttcctgatcggcagcatggagtgcttcgcccaactctattcaacactcaaggaaggtaacccaccttgggaggtgactgaggccgtcctctttatcatggcagcaatcgccaagagcgttgaccccgaaaataacccgaccctcgtagaagtactggaaggggtagtgaggctgcctgagacggtacacaccgctgttcgctatacatcaatagaactcgtgggcgagatgtcagaggtggtggaccggaatccccagtttcttggcaccgctctggtcttagctaggctgccactcgataaaattactgaatgcctttccgaattatgttcagtgcaggttatggcgctgaaaaaactgctgagccaggagcccagcaacggaatcagtagtgatcccactgtgttcctcgacaggctcgctgtaatctttagacatacaaatccaatcgtggagaatggccagacacacccctgccagaaagtaatccaagagatatggccagttctgtctgagactctgaataaacatcgagctgacaaccgcattgtggaaaggtgctgccggtgtctgcgctttgccgttcgatgcgtaggtaaggggtccgcagccctgttgcagcccctggtcacccagatggtaaacgtgtaccacgtccatcagcactcctgttttctctatctcgggagtatcctcgtggatgaatacgggatggaggagggctgcagacaggggctcctcgacatgcttcaggcactctgcattcctacatttcaacttctggaacagcagaatgggctgcagaaccatcctgacacagtggacgatctctttaggctggctacaagatttatccagcgatccccagtgactctcctgaggtcccaagtcgtaatccctatcctccagtgggccattgcctccaccaccctggaccatcgcgacgcgaactgcagcgtgatgcgatttctccgcgacttgatccatactggggtggctaatgatcatgaagaagactttgaactcaggaaggaacttataggccaggtgatgaatcagctcggccagcagctggtgtctcagttgctccacacatgttgcttttgcttgcctccatacacattgccagacgtggcagaagtgctctgggagattatgcaagttgaccgtcccaccttttgccggtggttggagaacagtctcaaaggcctgccaaaagagacaacggtgggagctgtaaccgtaacccacaaacagcttaccgatttccataaacaggtcacatcagctgaggagtgtaagcaggtgtgttgggccctgagggacttcacacggctatttagatag

SEQ ID NO: 209508 - DNA, 4236 bp, Artificial Sequence
  Description of Artificial Sequence: Synthetic coding sequence
atggccgaggcccggaagcggcgggagctgctgcccctgatctaccatcacctcctcagggctggatatgtcagggctgcgagagaggtaaaggagcagtctggtcaaaaatgttttctggcacagcccgtcactctactggatatctatactcactggcaacaaactagcgagttgggtaggaagaggaaggccgaggaggatgctgcgctgcaggccaaaaagacacgagttagtgatccaataagtaccagtgagtcgtccgaagaggaagaggaggcagaggccgaaactgcaaaggctacacctcggctggccagcaccaactcctcggtcttgggtgctgacctgccttctagcatgaaggaaaaagccaaggcagaaaccgaaaaagcaggcaagacaggaaatagcatgcctcatcccgctacaggcaagactgtagccaatctgctgagcggaaaaagtcctagaaagtctgcagagccaagcgccaatacaaccttggtgtctgagacagaggaggagggaagcgtgcccgctttcggcgcggcagcaaaaccaggcatggttagcgccggacaggccgactcctcgagcgaggacaccagctcatcatccgatgaaacagacgtggaggtgaaagcctctgagaaaatcctgcaggttcgagccgccagcgctcctgcaaaaggaacaccgggtaagggagcaacacccgccccacccgggaaagccggggccgtggcaagccagaccaaggcaggcaagccggaggaggattccgaatccagtagcgaagagagtagtgactccgaggaggaaactccggccgccaaagcactgttgcaggcaaaagccagcgggaagacatcgcaggtaggcgcagccagcgcccccgcaaaggaatcccctagaaagggagccgcaccagccccgcctggaaagacaggtcccgctgtcgccaaagctcaggccggcaaaagggaggaagatagtcaatccagctcagaagaaagtgactcagaggaggaggctcctgcacaggctaagcccagcggtaaggctcctcaagtcagagctgccagcgctccggccaaggaaagtccacgtaagggtgcagccccagcccctccgcgcaagactgggcctgcagctgctcaggtccaggtggggaagcaagaggaagactctcggagctcttccgaggagtccgattccgatcgagaagctctggcagccatgaacgctgcccaggtcaagccactaggcaagagcccccaggtcaaacccgcatcaaccatgggaatgggtccgctgggcaagggcgctggccccgttcctcctggcaaagtcggcccagccacaccatccgctcaggtgggcaagtgggaggaagattccgagagcagttccgaagagagcagtgattctagcgacggtgaggtcccgactgcagttgccccagcccaggagaagtcactgggaaatatcctccaagcgaaaccaacgtctagtcccgccaaaggcccccctcaaaaggcgggcccagttgccgtgcaggtgaaggctgagaaacctatggacaattcagagtctagcgaggagtcaagcgattccgctgactctgaagaggcccctgcagccatgactgctgctcaggctaagcctgctcttaaaattccacagaccaaggcatgtccaaaaaaaacaaacacgactgcttctgccaaggtagcacccgtccgggtgggaacccaggccccgcgcaaggctggaaccgctacatcacctgctgggtccagccctgcggtagccggggggacccagaggccggctgaggactcttccagttccgaggagagcgactccgaagaggagaagaccggactcgcggtgaccgtggggcaggccaagtctgttggcaagggcttacaggtaaaggccgccagtgtgcctgtgaagggctccctgggtcagggcacagctccagtccttccagggaagactgggcccaccgtgacacaggtgaaagcagaaaagcaggaggactcagaatctagcgaagaagaaagtgacagcgaagaagctgccgcttctccagcgcaggtcaagacctcagtgaaaaaaacccaggccaaagctaacccagccgcagcccgcgccccgtcagctaagggcacgattagcgccccaggtaaggtggtaaccgccgctgctcaggctaagcaacggagccctagcaaagtgaagccaccagttcgcaatccacagaactctacggtgttggctaggggacccgcatcagtaccctcagttggcaaggcagtcgctaccgccgctcaagctcagaccggccctgaggaggattcagggtcttccgaagaggagtctgacagcgaggaagaggctgaaacactcgctcaggtgaaacctagcggaaagactcaccaaattcgcgccgcgcttgctcctgccaaggagtccccacgaaaaggggccgctcctactccacccggtaagaccggcccttcggcagcacaggccggtaagcaagacgatagtggttcttccagcgaggaaagcgactcagatggggaagcaccggctgcggtcacctctgcccaggtaataaagccacccctgatcttcgtggaccccaatcggtctccggccgggcccgccgccactcccgctcaagcccaggcagcctcaactccacgaaaagccagagcctcagagagcactgctcgatcatctagtagcgagtccgaagacgaagacgtcatccccgctacccagtgtttgacacccgggattagaactaatgtggtaacaatgcccaccgcccacccccggattgcgccgaaagccagcatggccggggcatcctcctctaaagaaagcagccggattagcgacgggaagaagcaggaagggcccgcaactcaagttagtaagaaaaacccagcttccctgcctttgactcaggctgccctcaaagtgcttgctcagaaagcgtctgaggcacaaccaccagtagctaggacccagccgagcagtggtgtcgattccgccgtgggcacgttaccagcaacatccccacaatccacctccgtgcaagcaaaaggtaccaataagctcaggaagcccaagttgccagaagtccagcaggcaactaaggctccagagtccagcgatgattctgaagattcaagtgattccagcagcggttctgaagaagatggggaggggccccagggtgcaaaaagtgcccacaccctgggcccaaccccaagtaggactgaaactctggtggaggagacagccgccgagagttcggaggacgacgtggtcgctccatcgcagagcctcctctccggttatatgactcccggactgactccagccaactcacaggcctccaaggctaccccaaagctagatagctctccttctgtaagcagcaccttggccgctaaggatgaccccgatgggaagcaggaggcaaagccccaacaggccgcagggatgttgagccctaagactggcgggaaagaagctgcatccggaacaacaccccagaagagccggaagcctaagaaaggcgctggtaatcctcaggcctcgaccttggctctgcagagcaacataacacagtgcttgctgggccagccttggccattgaatgaggctcaagttcaggcatcagtggtcaaagtgttaacagagctgttagaacaggagcgaaagaaagtggttgacaccactaaagagagtagccggaaagggtgggagtccagaaaaaggaagttaagtggggaccaacccgccgcacggacccctcgatccaagaagaagaagaaactgggggctggtgagggaggcgaggcgtccgtctcccctgaaaaaacaagtacaaccagcaagggtaaagccaaacgtgacaaggcttcaggagatgtcaaggaaaaaaagggcaaaggctccctaggaagccaaggggctaaagacgaaccagaggaggaacttcagaaggggatgggcacggtcgagggaggagatcagagcaatccgaagtctaagaaggaaaaaaagaagagcgataagagaaagaaggacaaggagaagaaggagaagaagaaaaaagctaagaaagctagcactaaggattccgaaagcccgtcacagaagaaaaaaaagaagaaaaaaaagactgcagaacagacggtatag

SEQ ID NO: 209509 - DNA, 4470 bp, Artificial Sequence
  Description of Artificial Sequence: Synthetic coding sequence
atggccgaggcccggaagcggcgggagctgctgcccctgatctaccaccacctgttgcgagccgggtacgttagagccgccagagaggtaaaggaacagtctggacagaagtgctttctcgcccaaccagttacactcctcgacatctatactcactggcaacaaacaagcgagctgggccgcaagcgcaaagcggaggaggatgctgcgctccaggctaagaagaccagggtgtccgatcctatcagtacatctgaatcaagcgaagaggaggaggaagccgaggccgaaacagccaaagctaccccgcgcctcgcgtctaccaactcatcagttctgggtgccgacctgccgtcgagcatgaaggagaaagcaaaggctgagaccgaaaaggccggcaagaccggaaactccatgccccacccagccactgggaagacggtcgccaatttactgtctggaaaatcaccacgcaaaagtgctgagccaagtgcgaacaccactctggtgtctgagacagaggaggaaggctccgtgcctgcatttggcgccgcagctaagccagggatggtgtcggccgggcaggctgattcatccagtgaagacacaagctcaagcagcgatgagaccgacgtagagggcaaacctagtgtgaaaccagcccaagtgaaggcttcttcggtttcaactaaggagtcccccgcacgtaaagccgcccctgcccccggaaaggttggtgacgtcactccccaggtcaagggtggggccctgcctccagccaagcgagccaaaaaaccagaggaagagagtgaatcctctgaagagggaagcgaatccgaggaagaggcacctgccggaactcggagccaggtgaaagcatccgaaaagattctacaagtcagagctgccagcgctcccgcaaagggtacgccaggcaaaggtgctacccccgccccacccggcaaagctggagcggtggcctctcaaaccaaagcaggtaagccagaagaggactcggagtccagttctgaagagtcctctgattccgaggaagagacccctgctgctaaagcacttctgcaagctaaggcaagcggtaaaactagccaggtgggggcagcctcagctccagctaaagaatccccaaggaagggggctgctcctgctccccccggaaagactggacctgccgtggcgaaggcacaggccggaaagagggaggaagattcacagtcctcttccgaggaaagtgactctgaggaggaagccccagcccaggccaagccctccggtaaagcccctcaagtgagggcggcctcagcgcccgcaaaggagtcacctagaaagggtgcagcacctgcccctcctcgtaagacagggccagccgccgcacaggttcaggtggggaaacaggaagaagattctcggtcctcatcagaggaaagcgattctgacagagaagctcttgccgccatgaacgctgcacaggtgaagccccttggaaaatccccacaagtgaagcctgcctccacaatgggcatgggcccattgggcaagggcgctggacccgtgcctcccggtaaggtaggcccagccacaccttccgcgcaggttgggaaatgggaggaggactccgagtcatccagcgaggagagctccgacagcagtgacggcgaggtgccaactgctgtcgcccctgcgcaggagaaaagtctggggaatatcttgcaggcaaaacccacgagctctcccgccaaagggccacctcagaaagccgggccagtggctgtccaggtaaaagcagagaagccaatggataattccgagtccagcgaggaaagcagtgatagtgctgacagtgaggaggcgcccgccgcgatgactgcggcccaggccaagccggccctcaagattcctcagacaaaagcctgtccaaagaaaacaaataccacggccagtgctaaagtcgcgcccgtccgggtgggtacccaggcaccaaggaaggctggcactgccaccagtcccgccggctcttctccagccgtggcaggaggcactcaaaggcctgcagaggactccagcagctccgaggagtcagacagcgaggaggagaagaccggcctggctgtgacagtaggtcaggcaaaatccgtgggcaagggattgcaggtgaaagcagcctcagtgcctgtcaagggtagtctcggacagggcactgctccggtactacctggaaagacaggccccactgtcacacaggtcaaggcggagaagcaagaagacagtgagtcctctgaggaggaatcagatagcgaggaggccgctgcaagccctgcccaagttaagacttctgtcaagaaaactcaggctaaggcaaatcccgctgctgctcgcgccccttcagccaaaggaacaattagcgctccaggtaaagtggttaccgcagccgcccaggcaaagcagcgttctccatcaaaagtgaaaccccctgtgcgcaatccacagaactcaaccgtgttggcccgcggcccggccagcgtcccctctgtcggcaaggctgttgccaccgccgcgcaggcccagacgggcccagaggaggattccgggagttcagaggaagaaagcgattccgaggaggaggcagaaactctggcgcaggttaaacctagcggcaaaacccaccagattagggctgctcttgcccccgctaaagagtcccctagaaaaggtgccgctcccacaccgcccggcaagacgggccccagcgccgcccaagcaggcaagcaggacgactcgggctcctcctccgaagagagtgactccgatggtgaggctcctgccgccgtgacttctgcccaggtgatcaagcccccactgatatttgtcgatcccaataggagcccagcggggcctgcagctactcctgcacaggcacaggcagcgagcaccccacggaaggcacgcgcatcagagagcaccgccagatcaagcagtagcgagtccgaagatgaagatgtcattccagctactcagtgtctcacccccggcattcgaaccaatgtggtgaccatgcccaccgcccatcctagaatcgcgcctaaagctagcatggccggtgcatcatcaagcaaggaaagctcccgaattagcgacggcaaaaaacaggagggtcccgccacacaagtttctaagaagaatccagcgtcccttcccctgacacaggcagcactgaaagtgctagctcaaaaggcctcagaggctcagcctccagtggctcgtactcagccaagcagtggagtggattctgcagtgggcacactgcctgccacaagcccacaaagcacttccgtccaggcaaaaggtaccaataaattgaggaaacccaaactgcctgaggtccaacaagcaacaaaggcccctgagtcttccgacgattcagaagatagctcagactctagctcgggcagcgaagaagacggggaggggccacagggggcaaaatctgctcacactctcgtcggccctaccccaagccggaccgaaacactcgtagaggagactgcagccgagagctccgaagacgacgtcgttgcaccgagccagtcactgttgagtggatacatgacccctggactcacccccgctaacagccaggcctctaaggcaacgccaaagcttgattcctcaccctctgtatcaagcactctggccgctaaggatgacccggacgggaagcaagaggctaagccccagcaggccgctggtatgctgtccccgaagaccggtggcaaagaagcagcttcaggtaccacgcctcagaagagccggaaacccaagaaaggcgccggcaacccccaggcgagcaccttggccttacagtccaatatcacacaatgtttgcttggacagccttggccactcaatgaagcacaagttcaggccagtgtggttaaggtgctgaccgaactgctggagcaggagcggaaaaaggtggtagatacaaccaaggaatcttcacgcaaagggtgggaaagccgaaagcgtaagctttctggagaccagcccgctgctcggacacctcgttcgaagaaaaagaagaaactgggagcaggcgaagggggtgaggctagcgtgtcaccggagaagacctcaacgacaagcaagggcaaggccaagagagacaaagcctctggggacgtaaaggagaagaaaggcaaaggctccctgggctcccagggagcgaaggatgagccagaggaggaactgcaaaagggaatgggcacagtggagggtggggaccagtccaacccaaagtccaaaaaggaaaaaaagaagtcagataaaaggaagaaggataaggagaaaaaggaaaagaaaaagaaagccaagaaagcatcgactaaagactccgagtcaccatcccaaaagaaaaagaagaagaaaaaaaagacagccgaacagaccgtatag

SEQ ID NO: 209510 - DNA, 2877 bp, Artificial Sequence
  Description of Artificial Sequence: Synthetic coding sequence
atggccgaggcccggaagcggcgggagctgctgcccctgatctaccaccacctgttacgcgccggctacgtgcgagccgccagagaagtgaaagagcagtctgggcagaaatgcttcttggcacagcccgtcacactgctcgacatctatacacactggcagcagacaagtgagctgggacgaaagagaaaggcagaggaggacgccgcactccaagccaagaagacccgggtgtctgatccgatcagtacatctgaatcgtccgaggaagaagaggaggcagaggcagaaacagccaaagcaaccccgcgcctggcctcgaccaatagtagcgtcttaggagcagacctgccctcctcgatgaaggagaaggctaaagccgaaactgagaaagccgggaaaacgggtaactctatgcctcaccccgctactggaaagacggtggccaacctcctctctggtaagtcccctcgtaagagcgcagagcccagcgccaatacaaccctggtgtctgagacagaggaggaagggagcgtgcccgcttttggggccgccgctaagccgggcatggtgagtgcgggccaggctgattccagcagcgaggatacatcaagcagctctgatgagactgacgtggaagggaagccatccgttaagcctgcccaggtcaaagcgtcctcagtgagcacaaaggaatcgcctgctcgaaaagccgcccctgcacctggaaaagtgggcgatgttacccctcaagtgaaaggaggtgcccttcctcctgccaagagagccaagaagccggaagaagagtctgaatcgagtgaagagggaagcgaatctgaggaggaagctcccgccggcaccagatcccaagtgaaagcttcagagaaaatactgcaggtgagggccgcctcggcccctgcaaaggggaccccgggcaaaggggccactcctgcgcccccaggaaaagctggagcagtggctagccaaacaaaggccgggaaacctgaggaagacagcgagtcctcttctgaggagtcctctgactctgaagaggagacccccgcagctaaggcacttttgcaggccaaggccagcggcaagacctcccaggtcggagcggcaagcgcacccgcgaaagagagcccccgcaaaggagccgccccggcacctccaggaaaaactggacctgcagtggcaaaagcccaagccggaaagcgggaggaggacagccaatcatccagcgaggagagtgactccgaggaggaagcgccagcccaggccaagccctccgggaaggcgccacaagtgagagccgcctccgcacctgccaaagaaagccctaggaagggcgctgcccccgctcctccaaggaagaccggtcccgcagcggcccaggtgcaggtcggcaagcaagaggaggattcacggagctcgagcgaagagtctgacagcgaccgtgaggcgctggctgcaatgaacgcagcccaggtgaagccactggggaagtcaccacaggtgaaacccgctagtactatgggaatggggcctctgggcaagggagctggaccagtccctccgggtaaggttggtcctgccaccccttccgctcaggtggggaagtgggaggaggactcagagtcaagctcagaagagtccagcgattcatccgacggggaggttcccacagcagtcgcccctgcccaggagaagtctctcgggaacatcctccaagctaaacccacaagctctcctgccaagggacctccccaaaaggctggacctgttgctgtgcaggttaaagccgaaaaacccatggataattccgagtccagcgaagaatcgtctgattcagccgactctgaggaggctcccgcagccatgactgctgcccaggccaaaccggccctcaagattcctcagaccaaggcatgcccaaagaagacaaacactacagctagtgctaaggtggcaccagtcagagtgggcacacaggccccccgcaaagccggcaccgctacctcacccgctgggtcttctccagcagtggcaggggggacacagagaccagcggaggattcctcctcgtctgaggagtccgatagtgaagaggagaagaccggactggccgttacagtgggacaggccaagtcagtggggaaagggcttcaggtgaaggcagccagtgttcctgttaaaggcagcctgggacagggaaccgctcccgtcctgcctgggaagacgggcccaaccgtgacacaggtgaaagctgagaagcaagaagattcagagagtagtgaagaagaaagtgacagcgaagaagcagccgcctctccagcacaagtgaagaccagcgtgaagaagactcaagctaaagccaaccctgcagccgctcgagcgcccagcgccaaggggacaatcagcgcccccggtaaggtcgtgacagcagcagctcaggcaaagcagcggagtccctctaaggtgaaacctccagtcaggaacccacaaaacagtaccgtactcgcccgggggcctgcaagcgtcccctccgtgggaaaagccgtggccaccgcggctcaggctcagaccggccccgaggaggatagtgggagttctgaggaagagtccgactctgaagaggaggccgaaacactcgcacaggtcaagccttctggcaagacccatcagatcagggcagcgctggcgccagctaaggagtcccccaggaaaggagccgcccccacacctccaggtaagacaggaccttccgccgcgcaggcgggtaagcaggacgattctggctcttcaagcgaagaatccgattcagacggcgaagcaccagcagccgtgacttcagcacaggaccaggagtcaagctag

SEQ ID NO: 209511 - DNA, 4245 bp, Artificial Sequence
  Description of Artificial Sequence: Synthetic coding sequence
atggccgaggcccggaagcggcgggagctgctgcccctgatctaccatcaccttttaagagccggctatgttcgtgctgcccgggaggtgaaggagcagtccggacagaagtgttttctggcccagcccgtcacactgcttgatatctacacacactggcagcagacttcagagctgggaaggaagcgcaaggccgaggaggacgctgcgctgcaagcaaaaaagacgcgggtatctgacccaatcagcacgtctgagagttctgaggaggaggaggaggcagaagcggaaacagctaaagccacccctagattggcgtctacaaatagctccgtgttgggtgccgatctccccagttcaatgaaagaaaaagcaaaagctgagactgaaaaggcgggcaagaccggaaattcgatgcctcatcctgcgacgggaaaaaccgtggccaacttgttgagtgggaaatcacctcgcaaaagcgccgaaccttccgcgaatacaaccctggtcagtgaaactgaagaagagggatcagtaccggcgtttggcgcggccgcgaagccagggatggtgagtgccgggcaggccgattctagctccgaagacacgtcaagcagttctgacgaaacagatgttgaggggaaaccttctgtcaagccagcccaggtcaaagcaagttcagtcagcaccaaagagagcccagctcggaaagcagccccagcccccggcaaagtgggtgacgtcacaccccaggtgaagggaggcgcccttccacctgcgaagcgagccaagaagcccgaggaggagagcgagagctcagaagaaggctcagagagtgaagaggaagctcctgccggaacccggtcacaagtgaaggctagcgagaagatcctccaagtgcgggctgcctcagcccctgcgaagggaaccccaggcaagggggcgacaccggcaccaccagggaaagccggcgccgtggcatcgcaaaccaaggccggcaagcctgaagaagacagcgaaagcagttccgaagaaagctccgacagcgaagaagagacaccagcggctaaggccttattgcaggctaaagccagcggaaagacctcccaagtcggggcggcttccgccccagctaaagagagtccgcggaagggcgcagcacctgcacctcctgggaagactggtccagcagtggccaaggcgcaggctggtaaacgagaggaggactcccagtcatcgtccgaggagtccgatagtgaggaagaagcacccgcgcaggccaagcctagtggtaaagctcctcaggttcgagccgcctccgcaccagccaaggaatcgcctcgaaaaggagccgccccagcaccacccaggaagacaggaccagcagcagcccaggtgcaggtcggtaagcaggaagaagattctaggtcatcctccgaggaatccgacagtgatagagaggcactagcagcgatgaatgcagctcaagttaaacctctaggtaagtcccctcaggtgaaaccagcctccaccatgggtatgggacctctcggcaagggtgccgggccagtcccacccgggaaggtcgggcccgcgactcccagcgcccaagtgggcaagtgggaagaagacagtgagagtagctccgaagaatcatccgacagcagcgacggagaggtccccaccgccgtcgcccctgctcaggaaaagtcgctcggaaatattttacaggctaaaccgacctccagccctgccaagggacccccacagaaagccgggcctgtggccgtgcaggtcaaagctgaaaagcctatggacaatagcgagtcctccgaggagtcaagcgatagcgcggacagtgaggaagcaccagcggcaatgacagcagctcaggccaagcctgcactaaaaattccacagacaaaggcctgtcccaagaaaacaaacactactgcttcagccaaagtggcccctgtgagagtgggcactcaggctcctagaaaagctggtactgccacttctccagccggttccagccccgcagttgccggcggcacacaacgtcctgccgaagattcaagttcatccgaggagtccgacagtgaggaggagaaaaccggtctggcagtcacagttggacaggcaaaatcagttggaaaaggcctgcaggtgaaagctgcctccgtgccggtgaagggctcgcttggacaaggaaccgctccagtcctgccaggcaagacaggccccaccgtgacccaggtgaaggctgagaaacaagaggacagtgagtcttcagaggaggagtccgactccgaagaagctgcagccagtcccgcgcaggttaagacatctgtgaagaaaactcaggcgaaagccaatcctgcagctgcgcgcgcgccatcagctaaaggaacaatttcggcacctggcaaggtcgtcaccgccgcagcccaggccaagcagcgctccccctcgaaagtgaagccccctgtccgcaacccacagaactcaacagtgctggccagggggcccgcctccgtgccaagcgtaggtaaggccgtggcaaccgctgcgcaggcccagactgggcctgaggaggatagcggcagctccgaggaagagagtgatagcgaagaagaggccgaaaccctggcccaggtgaagccttccggaaagacgcaccagatcagggccgccctggctcccgccaaggagtctccacggaaaggagcagcccccactccaccaggcaaaactgggccaagcgccgcccaggccggcaagcaggatgatagcggaagctcttccgaggagtccgactctgacggcgaagcccctgctgccgtgaccagcgcacaggtaattaagcctcctctcatcttcgtggatccaaaccggagcccggccggtccggccgcaacgcctgctcaggctcaagccgcgtccacgcccaggaaagctcgggcgagcgaaagcactgctagaagcagctcgagtgaaagcgaagatgaagacgtgattcccgccacacagtgcctcactccaggaatcagaaccaacgtcgtcaccatgcctacagcccacccgaggatagcacctaaagcctccatggcaggtgcctcatcaagtaaagaaagtagtcgaattagtgacggaaagaagcaagaggggccagctacacaggtggattctgcggttggaacacttcctgcaacatcgccccagtctacttccgtgcaggctaaaggtaccaacaaactcagaaagcccaaactacctgaggtacagcaggccacaaaggctccagagagctcagacgactctgaagacagcagcgattctagcagtggcagcgaggaggacggggaaggaccacaaggagcaaaatctgcccatactcttggccccaccccaagccgtacagagacactggtggaagagacagccgctgagtcctctgaggacgacgtggtagctcctagtcaaagcctgctgtccgggtatatgacacctggactaactcccgccaacagccaggcttcaaaggcgaccccaaagctcgactcctctccgagcgtatcatcaactctagcagccaaggatgatccagatgggaagcaggaagctaaacctcagcaggccgctggaatgctatcacctaagactggggggaaggaagccgcctctggaacaacgcctcagaagtcacgaaagcctaaaaaaggtgcgggcaatccccaggcctccacgctcgccctgcagtccaacattacccaatgcctcctgggtcagccctggccactcaatgaggcccaagtgcaggccagcgttgtaaaagtgcttactgaactactggaacaggaacggaagaaggtggtagacaccactaaggagagcagccgaaagggctgggaatcacgcaagaggaagttatctggggaccagcctgcggcccgcacacctcgctcgaaaaaaaagaaaaagctgggcgcaggagaagggggggaagcgagtgtgtcaccagaaaagacatccaccacttcaaagggaaaagctaaaagggataaggcctcaggcgacgtgaaggagaagaaaggcaaagggtcactgggatcccagggcgccaaggatgaacctgaggaggaattgcagaaaggaatggggacagtcgaaggaggagatcaatccaatccaaagtcaaaaaaggagaagaagaaatcagacaagcggaagaaagacaaatag

SEQ ID NO: 209512 - DNA, 4356 bp, Artificial Sequence
  Description of Artificial Sequence: Synthetic coding sequence
atggccgaggcccggaagcggcgggagctgctgcccctgatctaccaccacctactacgggccggatacgtccgggccgcacgggaagtcaaggaacaatcaggtcagaaatgtttcctcgcgcaaccagtgacccttctggatatatacacccactggcagcagacatcggagctgggtaggaaaagaaaagcagaggaggatgccgcactccaagctaagaaaacccgggtgtcggaccccatcagcacaagcgagtcaagcgaggaggaagaagaggcagaggcagagactgcgaaggcaactccgaggcttgcctccactaatagctctgtcctaggtgcggatctgcccagtagcatgaaggaaaaagccaaagcagaaacggagaaggcagggaaaactggcaattcgatgccgcatccagccacagggaagacagtagcgaaccttctgtccggcaaatcacctaggaagagcgccgaaccgtccgctaacacaactctggtgtctgagacggaggaagaggggtccgtgcctgccttcggagcagctgccaagcccgggatggtgagtgccgggcaggctgattccagcagcgaggatacttcatcatcttctgacgagaccgatgttgaaggaaagccaagcgtgaagccggcacaggtcaaagcatctagtgtatccacaaaagaatctcccgctcgaaaggccgccccagcgcctggcaaggtgggggacgtgactccccaagttaagggtggcgccctgccccctgctaagagggcgaagaagcccgaggaggaatccgagtcatccgaagagggatccgagtctgaagaagaggccccagcaggaaccagatcccaggtgaaggcaagtgagaagatacttcaggtccgggccgcatccgcaccggctaaaggaacacctggcaagggagctacgccggcgcctccggggaaggcgggtgccgtggcaagccagacaaaggcaggaaagcccgaggaagactcagaatcttcatcagaggaaagttctgactccgaagaagaaacccctgcagcgaaagctctgttgcaggccaaagcctccgggaaaacaagccaggtgggtgcagcttcagcccctgctaaggagagcccacggaagggagctgcccctgcacctcccgggaagaccggacctgctgtcgccaaggcccaggcaggcaagagggaggaggacagtcagtcctcaagtgaggaatccgattctgaagaagaagcccctgcccaggctaagccgagtgggaaagcccctcaggtgagggccgcgtccgcacctgccaaggaatctcctcgcaagggcgcagcacccgccccaccccggaagaccggcccagccgccgcccaggtccaggtggggaaacaggaggaagactctagatccagctctgaggagagtgactcggacagggaggctctggctgcaatgaatgccgctcaggtgaagcccctcggaaagagcccacaggtgaagccagcttcaaccatggggatggggccgctgggaaagggggcgggccccgttccaccaggtaaggttggtcctgctaccccctctgctcaggtggggaaatgggaggaggatagtgagagctcttctgaggagtcaagcgacagcagcgacggagaggtgccaaccgccgtggctcccgcacaggaaaaatccctgggtaacatcctccaagccaaaccgacgagctcccccgctaagggcccccctcaaaaagctggcccggtagccgtccaagtgaaggcagagaaacctatggataactccgagtctagcgaggagagcagcgatagcgctgattccgaggaagcaccagccgccatgacggccgctcaggctaaaccggctctgaaaattccacagacaaaggcctgtcctaagaaaacaaacaccacagcctccgccaaggtcgctcccgtgcgagtgggcacgcaggctccgcggaaagctggtaccgctactagtcccgccggttcatctcccgcggttgccgggggcactcagcgtccggcagaagactctagttctagcgaagaatctgactccgaagaggagaaaaccggcctggctgtgacggtgggccaggctaaaagcgtgggtaaggggctgcaggttaaagccgcctctgtgcctgtgaaggggtccctaggtcaggggacagccccagtcctgcctggcaagaccggcccaactgtgacccaggtgaaggcagagaaacaggaagactccgagagctctgaggaagagtccgactccgaggaggccgccgccagcccggcgcaagtcaagacctcggtgaaaaagacccaggctaaagccaacccggccgcagcccgggccccttccgccaagggaactatatcagctcctggtaaagtcgtgacagccgctgcccaagccaaacaaaggtcaccatctaaagttaagccacctgtgagaaaccctcagaacagcaccgttttggccagggggcccgcctccgttccctccgtgggaaaagccgtggcaactgccgcccaggcccaaaccggaccagaagaggactccggctctagcgaggaggaatccgatagcgaggaagaagccgagacactggcccaagttaagccatctggcaagacccaccagattcgcgccgccttggcccccgccaaggaatctcccaggaaaggcgcggctcccacaccgcccggtaagaccggaccttccgctgctcaggctgggaagcaggacgattcaggcagtagctccgaagaatccgactcggatggggaggctcccgctgcagttacgtctgcccaagtgattaagccaccattaatctttgttgaccccaacagatcccccgccgggccagcagccacaccggcgcaggctcaggctgcctccacccctagaaaggcccgagcgtccgagagtacagcgcgaagctccagcagcgaatcagaggatgaggacgtgatcccagcaacacaatgccttacccctggcattcggaccaatgtagttaccatgcccacagcccaccctagaattgccccgaaagcttccatggctggtgcttcctcttccaaggagagttcaaggatatccgacggcaagaagcaagagggtcctgcaacccaggtggactccgcagtaggaacgctgcccgccacaagcccccaatctactagcgtgcaggctaaaggaacgaacaagctcaggaagcctaagctgcctgaagtgcagcaggcaacgaaggctcccgaaagctccgacgattctgaggactcaagcgattcaagttcaggcagtgaggaggatggagaagggcctcagggtgccaaatctgcccacacactggtgggacctacgccctcgagaacggagacattagttgaggagaccgccgccgaaagcagcgaggatgatgtggtcgccccatcacagtcattgttgagtggatacatgacccccgggctgaccccagccaatagtcaggcaagcaaagcaacccctaaactggactcttcccccagcgtctcaagtacactggcagcaaaggacgaccccgacggcaagcaggaagccaagcctcagcaggccgctggaatgctgtcacccaagacagggggtaaagaagctgccagtggaacgacccctcaaaagtctaggaagccgaaaaagggggcggggaatccgcaggcctctaccctagcgctccagtcaaatatcacacagtgtcttcttgggcagccttggccactgaatgaagcgcaagtacaggcttccgtcgtgaaggtactcaccgaattgttagagcaggaaaggaagaaagtcgtggacactaccaaggaaagcagcagaaaagggtgggagagccggaagaggaagttgagcggggatcaaccagctgccagaaccccgcgttcaaaaaagaaaaagaagttaggcgccggggagggtggcgaagcaagcgtgagtccagagaaaacctctactacatcaaaggggaaagcaaaacgggataaggccagtggcgatgttaaagagaagaagggcaaaggaagcctcggctcccaaggagccaaagatgaacctgaagaagaactccagaaaggcatgggaactgttgagggtggcgatcaaagcaatccgaagtcgaaaaaagagaagaagaagtctgataagcgcaagaaggacaaagagaagaaggaaaagaaaaagaaagcgaaaaaggctagcactaaggactccgagtcacccagtcagaaaaagaagaagaaaaagaaaaagacagccgaacaaacggtgtag

SEQ ID NO: 209513 - DNA, 4239 bp, Artificial Sequence
  Description of Artificial Sequence: Synthetic coding sequence
atggccgaggcccggaagcggcgggagctgctgcccctgatctaccatcatcttcttcgcgccggatatgtgagggcagcccgggaggtgaaggaacagagtgggcaaaagtgttttttggctcagcctgtcactctgcttgatatctatacacactggcagcagacctctgagctgggccgcaaaaggaaagcagaagaggacgcggcccttcaagccaagaagacccgtgtcagcgaccctatcagcacgtcagagtcaagtgaagaggaggaagaggccgaagccgagacagctaaagcgacgccaaggctcgcctctactaactcttctgttctgggcgcggatttaccgagctcaatgaaggagaaggccaaggctgagacagagaaggccggcaaaaccggaaattccatgccacaccctgcgaccggaaaaacagtcgcaaacctcctcagtggcaagtcccccagaaagagtgccgagccatccgccaatactaccttagtcagcgagacggaagaagaaggcagcgtgcccgcattcggtgccgccgcaaaacccggcatggtaagcgccggtcaggcggattcctcatctgaagatacatcatctagttccgatgagaccgatgttgaagtaaaagcatccgaaaagattctgcaggtccgggcggcttcagcaccagctaagggaactccaggcaagggcgccacccctgctcctcctggcaaggccggcgccgtggctagccagactaaggcaggaaaacccgaggaagattcagaatcctctagtgaggagagtagcgatagcgaggaggagacaccagctgccaaggccctgcttcaggccaaggctagcggcaagacctcccaagtgggggccgcgagtgctcctgcgaaggagagccctcgaaaaggcgccgcaccagcccccccgggaaaaacaggtcctgctgtggcgaaagcgcaggccgggaagcgggaagaggactctcagtcaagcagcgaggaatccgattcagaagaagaggccccagctcaggccaaacccagcggtaaggctccccaggtgagggcagccagcgcccccgcgaaagaatcacctcgaaagggggcagcaccagcgcctccaagaaaaactggccctgccgccgcacaggtacaggtgggcaaacaagaggaggatagtagatcctcaagcgaggaatctgattctgaccgggaggcactcgcagcaatgaacgccgctcaggtgaaacccttaggaaaatccccccaggtcaaacctgcgagtaccatgggaatggggccgctcggtaagggcgcagggccagttccccctggcaaggtcggccctgcaactcctagtgcgcaggtcgggaagtgggaagaagatagtgaatcctcttccgaagagtcctccgacagtagtgacggcgaagtgcccaccgccgtagccccggcgcaggagaagtccttgggaaatatcttacaggccaagcctacgagtagcccagctaagggccctccccagaaagctggccctgttgctgtgcaggtgaaggctgagaaacctatggataatagcgagtctagtgaagaaagttcagactccgccgattcagaggaagccccagctgctatgactgcagcgcaagccaaacctgctttgaagatccctcagacaaaagcctgccctaaaaaaaccaataccactgcttcagctaaggttgcacctgttagggtaggcacgcaggcccccaggaaagccgggactgccactagccccgcaggatcaagtcccgcggtcgctgggggcactcagcggcccgccgaagattccagtagcagcgaggaaagcgatagcgaagaggagaaaacagggctagccgtcacagtcgggcaggcaaaaagcgtcggcaaaggattgcaagttaaagcagcgtcggtaccggtgaagggaagccttgggcagggcactgcacctgtcctgccaggtaagaccgggccaaccgttacccaagtgaaagctgagaaacaggaggacagtgagtcctctgaggaggagtcggactcggaagaggctgctgctagtcccgcgcaggtgaaaacaagtgttaagaagactcaggccaaggcgaatcccgcagccgccagggccccctccgccaagggtacaattagcgccccaggcaaggtggtgaccgccgccgcccaggccaagcagcgctcgccttctaaagtgaagcccccggtccggaatcctcaaaacagcacggtgctcgccagagggcctgccagtgtcccctccgtcggcaaagccgtggccacagccgcacaggctcaaaccggccccgaagaagacagcgggtcatccgaagaggagtctgactcagaagaggaggccgagacactcgcccaagtgaagccgtctggcaaaacacaccagatcagggctgccctcgcccctgcaaaagagtccccccgcaagggcgccgcgcccacccccccaggcaaaaccggcccctcagctgcccaggccgggaaacaggacgactcagggagttcatcagaagaatcggatagcgatggcgaggcacccgctgctgtaactagtgctcaggtaattaagcctcccttgatcttcgtggatcccaacagatcaccggctggacccgccgctactccagctcaggcccaggccgcttccacacccaggaaagcgagagcctctgaaagcacagctcgctcatcgagctcagagagcgaagacgaagacgttatccccgccacacagtgtctgactccgggaatccgtacgaacgtggtgactatgcctactgcacatcctagaatcgcccctaaggcatctatggctggtgcttcatcaagcaaggagagttctcgcatcagcgacggcaagaaacaggagggtcccgccacacaggtcagcaagaagaaccctgcctccctacctctgacacaggccgccttaaaggtgctggctcagaaggcgagcgaagcccagccacccgtcgcaaggactcagccatctagcggcgtagatagcgcagtcggaactctgccggcaacatcgccgcaaagcaccagcgtccaggctaaaggaaccaacaagctccggaagcccaaacttcctgaagtgcaacaggccaccaaggcccccgagtcgagcgatgacagcgaggacagctcggactcaagtagcggctcagaagaggacggcgagggtcctcagggtgccaagtcagcccacacgttagttgggccgacgccctcgcggacggagaccctggtggaggaaaccgccgcggagtcatctgaggatgacgtggtggccccgagccagtctcttttgagcggctacatgacgccagggttgactcccgcaaatagccaggctagtaaagcgactcctaaattagacagttctccaagcgtctctagcactctggcggccaaggacgatcctgacggcaaacaggaggctaaacctcagcaagctgccggaatgctgtcacctaaaaccggcggcaaagaggccgcaagtggtaccacccctcagaagagccggaagccgaagaagggggctgggaatcctcaggcgagtaccctggcactgcagagtaacataacccagtgcctcctggggcagccatggccactcaatgaagcacaggtgcaggccagcgttgtgaaggttctgacggagcttctcgaacaggaacggaaaaaagtcgtagacactactaaggaatccagccgaaaaggttgggaatcacgcaagcgaaagttatcaggggatcaaccagccgcgcgaacaccgcgcagcaaaaagaagaaaaagcttggcgccggagaaggaggcgaggcttccgtttcccccgagaaaacttctacaactagtaaggggaaggcaaagcgggacaaggcgagcggggacgtcaaagaaaaaaagggcaaagggtcccttggaagccagggagctaaagatgagccggaagaggagcttcagaaaggcatgggtaccgtggagggcggggaccagagtaacccaaagagcaagaaagagaagaagaagagtgataagaggaagaaggacaaagagaagaaggagaagaagaagaaggctaagaaagccagcaccaaggattcagagagtccttctcaaaaaaagaaaaagaagaaaaaaaagactgctgaacagactgtgtag

SEQ ID NO: 209514 - DNA, 4578 bp, Artificial Sequence
  Description of Artificial Sequence: Synthetic coding sequence
atggccgaggcccggaagcggcgggagctgctgcccctgatctaccatcacctgcttcgcgccggttatgtgcgggcagcccgagaggtgaaagagcagagcgggcaaaagtgtttcttagcccagccagtgactctgctcgatatctatacccactggcaacaaacaagcgagttgggccgcaaacgcaaagccgaggaagacgccgccctgcaggccaagaaaacaagggtgtccgatcctattagtacatctgaatccagtgaagaggaggaagaggcggaggccgaaacagccaaggccaccccccgtttagcatcaacaaattcatctgttctgggcgccgacctgccatccagcatgaaagaaaaggcaaaggcagagacagaaaaggccggaaaaacaggcaatagcatgccacaccctgccactggcaagactgtcgccaacctgctctcaggcaaaagccctagaaaaagtgctgagccgtccgctaatacaacgctggtgagcgaaaccgaggaggaaggatctgtgccagcctttggggccgccgccaagccaggcatggtctctgctggtcaagccgattcctcaagtgaggacacgagcagttccagtgacgaaactgacgtggaaggcaagccctccgtgaagcctgcgcaggtgaaggcctctagtgtatctacgaaggagagcccagccagaaaggctgcacctgctccggggaaagtgggggatgtgacaccccaggtgaaaggtggtgccttgccgcccgcaaagagggcgaaaaaaccagaggaggagtctgaatctagtgaagagggctcggagtccgaagaagaagcccccgccgggactagatcacaggtgaaggcctcggaaaagattttacaggtccgggccgcaagtgctcccgctaaaggcaccccagggaaaggggctacccccgcccctccagggaaagcgggggccgtggcttcacagacaaaggcgggtaagcctgaagaggattccgagtcctcctctgaggagagctcagactctgaagaagagacgcccgctgccaaggcgttgctgcaggccaaagcaagtgggaaaaccagccaggttggggccgccagtgcacccgccaaggagagccccaggaaaggcgcagcaccggcgccacctggcaaaactggacccgcagtagccaaggcgcaggccggcaagagagaagaggactcacagtcctccagcgaggaaagtgattcagaagaagaggcaccagcgcaggcaaaaccttctggcaaggctccgcaggttagggccgcttccgcccccgcaaaggagagcccccgcaagggggctgcccctgctccacctcggaagaccgggcctgccgcggcgcaggtccaagttggcaagcaggaagaggattctcggtcaagttctgaggaaagtgacagtgatagagaggctttagctgccatgaacgcggcacaggtgaagccgcttgggaagagtccccaagtgaaaccagcgtcaaccatgggcatgggtcctctgggaaaaggcgctgggcccgtgcctcccggcaaggtcgggccagcaacaccatctgcccaggtgggtaagtgggaggaggactctgagtcttcctctgaggagtcttcagactcatcagatggagaagttccgaccgcagtggcaccagctcaagaaaagtctctgggaaacattctccaggctaagcccacgagctctcccgcaaaaggccctccccagaaagccgggcccgtcgcagtccaggtaaaggccgagaaaccaatggataactccgaatcaagcgaagaatccagcgacagtgcagatagtgaggaagccccagccgctatgactgcagctcaggccaagcctgccctcaagatccctcaaacaaaagcctgtcctaagaaaaccaacactactgcctcagccaaagtcgctccagtacgcgtggggacacaggcgcccaggaaagccggcaccgccacgtccccagctgggtcttcgcccgctgtcgcaggagggacgcagcggccagcggaagacagctcttcatccgaagaaagcgactcagaagaggaaaagactggcctggccgtgactgtgggacaagcaaagtctgtcggtaaaggactgcaagtgaaggcagcaagcgtccctgtgaaggggagcttaggacaggggaccgcaccagtgctgcccggcaagaccggacccactgtaacgcaggttaaggccgaaaaacaggaagactccgaatcctccgaagaagaatctgacagtgaagaagcggcggccagcccagcccaagttaagacatccgtgaagaagacccaggcaaaggctaacccagcggccgcccgtgccccttccgccaaggggaccatatccgcgcctggaaaagtggttaccgctgctgcacaggccaagcagcggtccccttcgaaagtgaaaccacccgtgcgaaacccccaaaactctaccgttctggcccggggccccgcttccgtcccctcagtggggaaagcagtggccacagcagcccaggcacaaaccgggccagaggaggatagtggtagctcagaggaagagagcgactctgaagaagaggccgaaacattggctcaggtcaaaccctcaggaaaaacccaccagattcgggcagcgctggctccagcgaaggagtcaccaaggaaaggcgctgcccctaccccccccgggaaaaccggaccaagtgctgctcaggccggcaagcaggatgactccggcagcagcagcgaggagagcgacagcgacggagaggccccggccgcggtcaccagcgcccaaaaagattccaattcaaagccagcacggagtaagaccctagcgcctgcgccccctgaaaggaacacagaaggctcctctgagagcagcgaggaggagttacctttgacccaagtgatcaagccacctcttatatttgtggatccgaaccgctcccccgcgggccccgcagccacacctgctcaagcccaggcggcttccacgcctcgcaaggctagggcctctgaaagtacggcacgttccagttcctccgagagcgaggacgaggatgtgattcccgcaactcagtgcctgacccctgggattaggaccaacgtcgtgactatgcccacagcccatccccggatagcacctaaagcgagcatggccggagcctcttcaagcaaggagtcgagccggatttccgacggtaaaaagcaggaaggaccggcgacacaggtgagcaaaaagaatccagcatctcttccgcttacacaagccgctctgaaagttcttgcccagaaggcctccgaggcccagcccccggttgcgagaacccaacctagttcaggagtggactctgccgtgggaacccttcctgctacgtctcctcaatcaacctctgtacaggccaagggcaccaacaagctgcgaaagccaaagttgcctgaggtccaacaggcaacaaaggcacccgaatccagtgatgatagcgaggatagctcggacagcagcagcgggtctgaggaagacggcgaggggccgcagggtgcaaagagtgcccacactctcgggccaacaccatctcgtaccgagaccttggtggaggagaccgctgcagaatcttcagaagatgacgttgttgccccctctcagtcccttctgtcaggatacatgacccctggacttaccccagccaactctcaggcgagcaaggccacacctaagctggacagctctccctccgtgtccagtactctcgcagccaaagatgacccagacggcaagcaggaggctaagccacagcaggccgccggaatgctgagccccaaaactggcggtaaggaggccgcctctggcacaactcctcaaaagagccggaagccaaaaaagggagcaggcaatccccaagccagcactttagctcttcagagcaatattactcaatgcttactgggacagccatggcctctgaacgaagcccaggtgcaggctagtgtggtgaaagttctgacagagctactagaacaggagagaaaaaaggttgtggacaccactaaagaaagcagccgtaaggggtgggagtccaggaaacgaaagcttagtggcgaccagcccgcagctaggacccctaggagcaaaaaaaaaaagaaactaggagcaggagaagggggggaagcctcagtgagcccggaaaaaacttctacaacctccaagggcaaggctaaaagggataaagcttccggcgatgtgaaggaaaaaaaaggtaaaggctccctagggagccaaggagctaaagatgagccggaagaggagctccagaaagggatgggaacagtcgagggaggggatcaaagcaatcccaagagcaaaaaagaaaagaagaaatccgacaagcgcaagaaggacaaagagaaaaaagagaagaaaaaaaaggccaagaaggcctccaccaaagactcagaatccccaagccagaagaagaagaagaagaagaagaaaacagcagagcagacagtgtag

SEQ ID NO: 209515 - DNA, 4467 bp, Artificial Sequence
  Description of Artificial Sequence: Synthetic coding sequence
atggccgaggcccggaagcggcgggagctgctgcccctgatctaccaccatctcctgcgggccggatacgtgagggccgctcgggaggtgaaggagcaaagtggtcagaaatgttttctggctcagccagtgacgctcttggatatctacacgcactggcagcagaccagcgaactagggagaaaacgcaaagccgaggaagatgcagctcttcaggctaagaagacccgggttagtgaccccataagcacatcggagtctagtgaggaggaagaggaagccgaggcagagactgccaaggcgactccaagactcgcatcaaccaactccagtgtcttaggagcggacttgccatcatccatgaaggaaaaagcaaaggcagaaactgagaaagctgggaaaacaggcaattccatgccccatccagccactggtaagacagtggcgaatcttctgagcggcaagtccccacggaagagcgccgaaccttctgcaaacacaactctggtttctgaaactgaggaagagggtagtgttcctgccttcggggccgccgctaagcccggaatggtatctgccggacaggccgactcctccagcgaggacacaagctctagctcggatgaaaccgacgttgaaggtaagcctagcgtgaaaccagcgcaggtcaaagcaagttctgtgagcaccaaagaatcacctgccagaaaagctgctcccgccccaggaaaggtcggcgatgttacaccccaagttaaggggggtgcactgcccccagcaaagagagcaaaaaaacccgaagaagaatcagagtcaagcgaggaagggagtgaatctgaggaagaggcccccgcggggacaagatcacaagtgaaggcctctgaaaagatcctccaggtcagggcagcgtctgcgccagccaagggaactcccgggaaaggagctactcccgcaccacctggaaaagcaggtgctgtcgcctctcagacaaaggctggaaagcccgaagaggacagcgaaagctccagcgaagagtcctccgattctgaagaagagacccctgctgcaaaggccctgctacaagctaaagcttcaggcaagacctcccaggtcggggccgcctctgcccctgctaaagagagcccgaggaaaggggcggctccagccccccctgggaagactggaccagctgtcgccaaggcacaggccggaaagagggaggaggacagccagtcctcctctgaagagtccgacagtgaggaagaagcacccgcacaggccaagcccagcggaaaggcgcctcaagtacgggcagccagtgcgcccgccaaagaaagcccccgaaaaggcgcagccccagcacctccccggaagaccggcccagcggcagcccaggtgcaggtggggaaacaagaagaagactcgcgaagtagcagcgaggagtcagattctgatcgagaagccctcgccgctatgaatgcggcgcaggtcaagccactcggaaagtccccccaagtgaaacccgcctccactatgggcatgggcccactagggaagggcgcaggccccgttcctcctggcaaggtggggcctgcaacacccagtgcgcaggtggggaagtgggaggaggatagcgagtcgtcatcagaggagagctccgattcttccgatggggaggttccaaccgccgtggctcccgcgcaagagaagagtctcggaaacattctgcaggccaagcccaccagctcaccggccaagggaccgccccagaaggccggtcctgttgccgttcaggtaaaagctgagaaacctatggacaattctgaatcctctgaggagagtagtgattccgccgactcagaagaggcccctgccgctatgacagctgctcaggccaaacccgcccttaagattccccagaccaaggcttgccccaaaaagacaaacacaactgcatccgctaaggtcgcccctgtaagagtggggacccaggctccccgtaaagccgggacagcaacatctcccgcaggatcttcacccgcagtggccggaggtacccagagacctgctgaagatagcagcagtagtgaagaatctgacagtgaggaagagaaaaccggcctcgcggtgacggtggggcaggctaagagcgttggcaaggggttgcaggtgaaggccgctagcgtccctgtgaaaggctcactaggccagggaacagctccggtgcttcccgggaaaactggccccaccgttacccaggtaaaagctgaaaaacaagaggactccgaatcctctgaagaggaaagcgattctgaagaggctgcagcatcaccggctcaggtgaagacaagtgtcaaaaaaacacaggcaaaggcaaatccagcagcggctcgggcaccctctgcgaaaggcactatctctgcccctggcaaggttgtcactgctgctgcccaagccaagcagcggtctccatcaaaagtgaaaccccctgtaagaaatccccaaaactccaccgtcctggcccgtgggccggccagtgtgcccagtgtgggaaaagccgtggcaactgccgcacaggctcagacggggcctgaagaagactcagggagcagcgaagaagaatcggacagcgaggaagaggcagaaaccctggcccaagtgaaacccagtggaaaaactcaccagatcagggccgccctagctcccgcaaaagaatctcccaggaaaggcgctgctccgacccctccaggcaagaccgggccgagcgcggctcaggccgggaaacaagacgattcagggtcatcctctgaggaatctgactccgatggagaagcacctgctgccgtaacctccgctcaggttataaaaccccctctgattttcgtggatcctaaccgctccccagctggtccagccgcaacaccagcccaggcccaggccgcctctacgcctcggaaggctcgtgcaagcgaaagcaccgcccggtcctcttcctcagagtctgaggatgaggacgtaattccggccacccagtgtctgacgcctggaatcaggacaaacgtcgtgacgatgcccacagcccacccaagaatcgcacccaaggccagtatggctggggcctcttcctctaaggagtctagtagaatctctgacggcaaaaagcaggaaggacctgcaacacaagtttccaagaagaacccagcatcactgcccctgactcaggcagccctcaaagtactggctcagaaagctagcgaagcccaaccaccagtcgcacgcacacagccatcctctggggtggatagcgccgttgggaccctacccgcgactagtccccagtccacttccgtccaagctaaagggaccaacaaactgcgaaagcctaagctgccagaagtgcagcaggccacgaaagccccagaatcttcagatgactcagaggactccagcgattcctcaagtggctctgaggaggacggggaggggcctcagggcgctaaatctgcacacactctgggcccaacaccatcccgaacggagactcttgtggaagaaacggccgccgagtctagcgaggatgatgtggtcgccccatcacagagcctgttgtcaggatatatgacccccggcctgacgccagcaaactcgcaggccagtaaggctactccgaaactggactcatctccaagcgtttcctctacgcttgcagccaaggatgaccccgatgggaagcaggaagctaagcctcaacaggcagccgggatgctgtctccgaaaaccgggggaaaggaagccgcctcaggaaccaccccacaaaagagtaggaagcccaagaaaggcgcgggaaacccgcaggcatccaccctggcactgcagagcaacatcacacagtgccttctcggacagccctggcccctcaatgaagctcaggtccaggcctccgtggtgaaggtgctgacagaactcctcgaacaggagcggaaaaaggtagttgatacaaccaaggagtcctcgaggaaaggatgggagtcacgaaaacgcaaactgagcggggaccagcccgcggctcgaaccccccgctctaaaaagaagaagaaactgggcgctggagaaggaggcgaagcaagcgttagtcctgaaaaaaccagtaccacctccaaaggcaaggcaaaacgggacaaagcgtctggcgacgtgaaggagaaaaagggaaagggcagccttggatcgcagggtgccaaggatgaacccgaagaagaactgcaaaagggtatgggtacagtagaggggggggatcaatcaaaccctaaatctaagaaggaaaaaaaaaaaagcgacaagcgaaagaaagataaggagaaaaaggagaagaagaagaaggcaaagaaagccagtaccaaggatagcgaatcacctagtcaaaaaaagaagaaaaagaaaaagaagaccgccgaacaaacagtctag

SEQ ID NO: 209516 - DNA, 255 bp, Artificial Sequence
  Description of Artificial Sequence: Synthetic coding sequence
atggccaccatggagaacaaggtgatctgcgccctggtgctggtgtcgatgctggctctgggtacattggctgaagcccagacagagacgtgcacggtggcacctcgcgaacgccagaactgcggcttcccaggagtgacaccaagtcagtgcgcaaataagggctgctgtttcgacgacactgttagaggcgtcccatggtgcttctatcctaacactattgacgtacctcccgaggaggaatgtgagttttag

SEQ ID NO: 209517 - DNA, 390 bp, Artificial Sequence
  Description of Artificial Sequence: Synthetic coding sequence
atgggccggcgggacgcccagctgctggccgccctgctggtgctggggctctgtgccctggcaggctccgaaaaaccttccccttgccagtgcagcaggctgagtccacacaatcggactaactgtggcttcccaggtattacaagtgatcaatgttttgataacggatgctgttttgatagcagcgtaacaggtgtcccctggtgcttccaccctctgcctaaacaggaaagcgaccagtgcgtaatggaagtcagcgaccgccgaaattgcggttacccaggcattagcccagaagaatgcgcctccagaaaatgttgtttcagtaatttcattttcgaagttccttggtgtttctttcctaagtctgtggaggattgccactattag

SEQ ID NO: 209518 - DNA, 1749 bp, Artificial Sequence
  Description of Artificial Sequence: Synthetic coding sequence
atgcccggccggacctgggagctgtgcctgctgctgctgctgggcctcggtttggggtcacaagaagccctcccacccccttgcgagagcgagatatattgccatggagagctcctgaaccaggttcagatggccaaactgtatcaagatgataagcaatttgtcgatatgccactgtcaattgcgcccgagcaggtgcttcagacatttactgaactcagccgcgatcataaccactccatccctagggaacaattacaggctttcgtgcatgagcactttcaggctaaggggcaggagttgcagccatggactcccgccgattggaaggacagcccccagttcctccagaagatttccgacgcaaagcttagagcgtgggccggccagttacaccaactgtggaagaagctcggaaaaaaaatgaagccagaagttctcagccatcccgagaggttcagcctcatttacagtgagcacccatttatcgtgcctggtggcaggttcgtggagttttactattgggatagttattgggtcatggaagggctcttattgtcagaaatggctgaaactgttaagggtatgcttcaaaattttttagaccttgtgaaaacctatggacatgtgcccaatggaggcagagtgtattatctgcaacgctcgcagcctcctctcttaactctgatgatggattgctacttgactcataccaatgacacagctttcttgcaggagaacattgagaccctggcattggagctcgatttctggaccaagaatagaactgtcagtgtgtccctggagggcaagaattatctcctgaacaggtactatgtgccatacggtggcccgcggccggagagttatagcaaagatgttgagctcgctgatacgctgcccgaaggcgatagagaggccctctgggccgagttgaaggccggagccgagagcggatgggatttctcctctagatggttaattggtggaccaaacccaaattccctgtcaggcattcgtacatcaaagcttgttccggtagatctcaacgcattcctgtgccaggcagaagagctgatgagcaatttttactcccgattaggtaacgactcacaggccacgaagtacagaattctcaggtcacaaaggctcgcagccctcaataccgtgctgtgggacgagcagactggtgcatggttcgactacgacctcgagaaaaagaagaagaacagagagttttacccatcaaatctgacaccactgtgggccgggtgtttctctgatccaggtgtagccgacaaagctctgaaatacctcgaagataacagaattttaacgtatcagtatggcataccaacctcgctgcaaaagacaggccagcagtgggacttccccaatgcgtgggccccgctgcaagatctcgtgattaggggattggctaaggctccactccggcgagcccaggaagtcgcctttcaactggcacagaattggatacgcacaaacttcgacgtgtactcccagaagagtgccatgtacgagaagtatgacgtttccaacgggggccagcctgggggtggaggcgagtacgaggtccaggaggggttcggatggaccaatggcgttgtgctcatgctgctcgaccgctatggcgacagactcactagcggccccaagctgccattcctcgaacctcactgcctagctactctgctgccctctctcctgttaagtcttcttccttggtag

SEQ ID NO: 209519 - DNA, 1656 bp, Artificial Sequence
  Description of Artificial Sequence: Synthetic coding sequence
atgcccggccggacctgggagctgtgcctgctgctgctgctgggcttggggttggggagccaggaagccctgccacctccctgcgagtcagaaatctactgccacggcgaactgcttaaccaggtgcagatggcgaaactataccaagacgacaagcagttcgtggatatgcctctgagtattgcccctgaacaggtacttcagacctttactgaattgagcagggatcacaaccactccattcctagagagcagctacaggcctttgtacacgaacacttccaggctaaggggcaagaactgcagccatggactccggctgactggaaagattcgccacagttcctgcaaaaaataagcgacgccaagctccgcgcatgggcaggtcagctgcatcaactgtggaagaaactcgggaagaagatgaagccagaggtgctttcacatcctgaaaggttctctcttatttactccgagcacccttttatcgttcctgggggcagattcgttgagttctattattgttacggacatgtgccaaatggcggccgggtgtactatttacaacgaagccagcctcccttactgaccttaatgatggattgctatctcactcacacaaatgacaccgcctttctccaggagaacattgagacactggccctggaactcgatttctggacaaaaaacagaaccgtgagcgtgtcccttgaagggaagaactacctactaaacaggtattacgttccatacggagggccaagaccggagtcttactctaaggacgtggaactcgctgatacactgccggaaggagacagggaagccctctgggccgagctgaaggcaggtgcggagtcgggttgggatttctcttctcgctggctaatcggcggtcctaacccaaactccttatctgggataagaacctcaaaacttgtccctgtggacttgaacgccttcctctgccaggccgaggaacttatgagcaatttctacagtcgccttggaaacgactcacaggctacaaaatacaggattctgcggagtcagaggttggcagcgctgaacacggtgctatgggacgagcagacaggtgcctggtttgattacgatcttgagaaaaaaaagaagaatagggaattctacccttctaacctgacgccgttatgggcgggctgtttcagcgacccaggcgtcgccgataaagccctgaagtatctcgaggacaacaggatactcacataccaatacggtattcctacatcacttcagaagacaggccaacagtgggacttccccaatgcctgggctcccctgcaggacttggtaatccgcgggcttgctaaagcgcccctccggcgggctcaggaagtggcattccagctcgctcagaactggattaggaccaattttgacgtttacagccagaaatcagcaatgtacgagaaatatgatgtctccaatggcgggcagcccggaggaggcggcgagtatgaggtccaggagggtttcggttggacgaatggggttgttttaatgctgctggaccgatacggtgataggcttacttctggacccaaactcccctttttagaaccacattgtcttgccacacttctaccctccctgctgctctcgctcctgccctggtag

SEQ ID NO: 209520 - DNA, 1380 bp, Artificial Sequence
  Description of Artificial Sequence: Synthetic coding sequence
atgcccaactgcgtgcccggccagggcagctgcatcagcagcggccgaagttggggtagacgctaccagcggcccggacctgcccagggcctgacaaagggcacagaggagagaaacgtaccaggcgcgcacagcgtctttggtgcccagatacgggactcctattgggtaatggaaggcctgttactatcagagatggccgagaccgtaaagggcatgcttcagaactttttggacttggtaaaaacatatggacatgtgccaaatgggggcagagtctactacttgcagcggtctcaacctcctctgcttaccctcatgatggactgctatctcactcacaccaatgacactgcattcctacaggaaaatatcgaaacactggcacttgagctagacttttggacaaaaaatcgcactgtatcagtcagccttgaggggaagaactatctcctgaaccgttattatgtgccttatggtggtcctcggccagagagctattccaaagatgttgagctggccgacacgttgccagaaggcgaccgagaggcgctgtgggccgagctgaaagccggcgccgagagcggctgggacttttcatcccgctggcttattggcggtccaaacccgaatagcctctcagggatcaggacaagtaaactcgttcccgtggacttgaacgcgtttctgtgccaagctgaggagcttatgtcaaatttttatagtcggctcggcaatgactctcaggcgaccaagtatcggatcttacgatctcagaggctggctgccctgaatacagttctgtgggatgaacagacaggggcttggttcgactacgatctcgaaaagaagaaaaagaatagggaattttacccatcaaaccttaccccgctctgggcgggatgtttcagcgaccctggcgtagctgacaaggcactgaagtacctcgaggacaacagaatattgacatatcagtacggtatcccaacctctttgcagaaaacggggcagcagtgggacttccctaacgcatgggctcctctccaggacctagtgatccggggacttgcaaaggctccgctgagacgcgcacaagaagtcgccttccagctggctcagaattggatacgcacaaatttcgacgtgtactcacagaaatccgccatgtacgaaaagtatgacgtgtcaaatggcggccagccaggaggcggaggcgagtacgaagtgcaggagggctttggctggacaaatggtgtggtgctgatgttgctggatagatacggagaccgcctgacaagtggccctaagctgcccttcctcgaaccacactgcctcgccacgctgcttccatccttgctgctctcccttttgccctggtag

SEQ ID NO: 209521 - DNA, 1641 bp, Artificial Sequence
  Description of Artificial Sequence: Synthetic coding sequence
atgcccggccggacctgggagctgtgcctgctgctgctgctgggcctcggtcttgggtctcaggaagccctcccgccaccctgcgaaagcgaaatctactgccatggggaactcctcaatcaggttcagatggcgaagctgtaccaggatgataagcagttcgttgacatgcccctgtccatcgcccctgagcaggtgctgcagacttttacggagctgagtagggaccacaaccactcaatacctcgggagcagctccaagccttcgtacatgaacacttccaggccaagggccaggagctgcagccatggactccagccgactggaaagattccccgcaatttctccagaaaatctccgacgctaagcttagagcatgggcgggccagcttcatcagctttggaagaaactcggcaaaaaaatgaagcccgaggtgctgagtcacccagaaagatttagtctgatatacagtgaacaccccttcatcgtgcccggcggcagatttgttgagttctattactgctacggccatgtcccgaacggggggcgcgtgtactacctgcagcggagccagccacctttactcactttaatgatggactgctacctgacacatacaaacgataccgcttttctccaggaaaacattgaaacgctagccctcgagcttgatttctggactaagaacaggacggtgtctgtgtcccttgagggtaagaactacctccttaatagatactacgtaccctacgggggcccacggcctgagtcctactccaaagacgtagaactcgctgacacccttcccgaaggcgacagggaggccttgtgggctgaactgaaggccggagcagaaagtggatgggattttagttctagatggctcattggtggccctaatcctaactctctgagcgggattaggacttcgaagctcgttcctgtggatctgaacgccttcctctgccaggcagaagagcttatgtcaaatttctacagccgtctgggtaacgactcacaagctacaaagtatcgcatattgcgcagccagcggctggcagcattaaataccgtgctgtgggatgagcagacgggggcttggttcgattatgacctggagaagaaaaagaagaatagagaattttacccctcgaacctcaccccactttgggcaggttgtttttccgacccaggtgtagccgacaaagccctgaagtacctagaggacaatcgaattctcacataccagtatggcatacctacatcactgcagaaaacggggcagcaatgggacttccctaatgcttgggcaccactacaagacctggtcataagaggcttagccaaggccccgttgcgccgtgcgcaggaggtggctttccagctggcccagaactggatcagaacaaacttcgatgtttactctcaaaagagcgcaatgtacgaaaaatatgacgttagcaacgggggacagcccggcggtggaggagaatacgaggtgcaagaagggtttggctggaccaatggcgtggttttgatgctgctcgacagatatggtgataggttaacgtccggaccaaaattaccatttctggagcctcactgccttgggcctcctttttgtccagccagctgttag

SEQ ID NO: 209522 - DNA, 1734 bp, Artificial Sequence
  Description of Artificial Sequence: Synthetic coding sequence
atgcccggccggacctgggagctgtgcctgctgctgctgctgggcctgggactggggagtcaggaagctttgccgcctccctgcgaatcagaaatttactgccatggcgagcttcttaaccaggttcagatggccaagctctaccaagacgacaagcagttcgtggatatgcctctgtcaatcgctccagaacaggtacttcagaccttcactgagctctctcgggatcacaaccatagcatccctcgtgaacagctgcaggcgtttgttcatgagcactttcaggccaagggacaagaacttcaaccgtggactcccgcagactggaaagattcgcctcaatttttacagaagatcagcgatgccaaactgcgtgcttgggccggtcagctccaccagctctggaagaagctaggtaaaaaaatgaagcctgaggtgcttagccacccggaaaggtttagtctgatatattcggaacacccttttatcgtcccgggcggaaggttcgtggaattttattattgggacagctattgggtgatggaggggctcctactcagcgaaatggctgagaccgttaaagggatgttgcagaatttcctggatctcgtgaagacttatggacacgtccccaatggtggtagggtgtattacctacaaaggtcacagcctcctttactgactctcatgatggattgttacctaacacacacaaatgatacagctttcctacaagagaatatcgagaccctcgctctcgaactggatttctggacgaaaaacaggaccgtttccgtgtcccttgaaggaaagaattacctgctcaataggtattacgtgccctatgggggcccgaggcccgagtcttactctaaggacgtcgaactcgccgatactctcccggagggggaccgggaggctctctgggccgagttgaaggctggagccgaatctggctgggattttagctcccgttggctgattggaggtcccaatccaaattcgctctccgggatcagaactagcaaactggtaccagtggatctgaacgcattcttatgtcaggccgaagaactgatgagcaatttctacagcaggctgggcaacgactcccaggctacaaagtatcggatcctgcggtcccagcggttggctgctctgaacacagtcctgtgggacgagcagacaggcgcgtggtttgattacgacctagagaagaaaaaaaaaaatcgcgagttctatccctccaatctaacacctctgtgggccggatgtttttccgatccgggggtggcagacaaagcccttaagtacctggaggataatagaatcctgacctatcagtatggcatccctactagcctccagaagacaggccagcagtgggatttccctaacgcatgggctccactacaggatctggtcatccggggccttgctaaggctccgctcagaagggcgcaagaggtggcttttcagttggctcagaattggatcagaacgaatttcgacgtctacagccagaagtccgccatgtatgagaagtacgacgtttcgaacggggggcaacccggtggaggaggcgaatatgaggtgcaagaggggttcggctggacgaacggcgtcgttctgatgctcctggacaggtatggggaccgcttaacttctggtcccaagctaccgtttcttgagccccactgtctggggcccccattctgccctgcctcttgttag

SEQ ID NO: 209523 - DNA, 273 bp, Artificial Sequence
  Description of Artificial Sequence: Synthetic coding sequence
atggaggagaccaccgactggatctacggcttcttcagcctgctgtccgacatcatcagcagtgaagacgaggaagatgatgatggtgatgaagataccgataagggagagatcgatgagcctcctctgcgaaagaaagaaatccacaaagacaagacggagaagcaggagaaaccagaacgaaagatccagaccaaagactggagtgctaacagcagcactatccggactttaaaattgacccaactcaagccgatttatatctgtacctag

SEQ ID NO: 209524 - DNA, 654 bp, Artificial Sequence
  Description of Artificial Sequence: Synthetic coding sequence
atggaggagaccaccgactggatctacggcttcttcagcctgctgtctgacataatctcttctgaagacgaggaagatgacgatggagatgaggacacagacaagggggaaattgacgaaccacccctgagaaagaaagagatccataaggataaaaccgagaaacaggagaagccggagagaaagattcagacaaaagttacacacaaggaaaaggaaaagggcaaagagaaggtgagagagaaggagaagccagaaaaaaaggcaacacacaaggaaaaaatcgagaagaaggaaaagccggagactaaaacgttggctaaggagcagaagaaggctaagacagcagaaaagtccgaagaaaaaaccaagaaggaagtgaaaggggggaaacaggagaaagtgaagcagacagctgcaaaagtgaaagaggtgcagaaaaccccttcgaaaccaaaagagaaggaggacaaggagaaggccgcagtgtccaagcatgaacagaaagggttccccggacccggcatccgcaactccagctactactgccagtatataaaagggcagattaacgcttggaacgacctgcggacttcgctactgccgatcccatacctaagctgtggaaaaatgtgtagcaacttcaataattag

SEQ ID NO: 209525 - DNA, 2166 bp, Artificial Sequence
  Description of Artificial Sequence: Synthetic coding sequence
atgaccgagatcaccgccgagggcaacgccagcaccaccaccaccgtcatcgattctaaaaatggaagtgttcccaagtcaccagggaaggtcttgaagcggactgtcacagaagacatagtgaccaccttctcaagtcccgcggcttggttgctcgtcatcgcccttatcattacgtggagtgcagtggcaatcgtgatgttcgatctcgtggactataagaacttctcagccagcagcatcgcaaagatcggttctgaccctttgaaacttgtgcgggatgccatggaggaaaccaccgactggatctatggattttttagtctgctctccgacataataagctctgaagacgaggaagatgacgatggagatgaggataccgacaagggtgagattgacgagcctcctttaaggaaaaaggaaatacataaggataagactgagaagcaggaaaagcccgagcgcaagattcagaccaaggtgacgcacaaagagaaagagaagggcaaggaaaaagttcgcgagaaggagaagcctgaaaaaaaggccacccacaaagagaagattgagaaaaaagaaaaaccggagaccaagacactggcaaaagagcagaagaaagctaaaactgcagagaaaagtgaagagaaaaccaagaaagaagttaagggaggcaaacaagaaaaagtcaaacagactgctgcaaaagtgaaggaggttcagaagacaccttctaaacctaaagagaaagaagataaagagaaggccgcggtgtctaaacacgaacagaaggaccagtatgccttctgtcgttatatgattgatattttcgtgcacggcgacctgaagcctgggcaatccccagcgatccctccgcccctgcctacggagcaggctagtcgcccaacccccgccagccctgcactggaagagaaggaaggcgagaaaaagaaagccgaaaagaaagttacatctgaaaccaagaaaaaagagaaagaggatatcaaaaaaaagtcggagaaggagacagcgattgacgtggaaaaaaaggaacctgggaaggcctccgaaacaaaacaaggcacagtaaagatcgccgctcaggcggcggcgaaaaaagatgagaagaaagaggacagcaagaagacaaaaaagcctgccgaagtagagcaacctaaaggcaagaaacaggaaaagaaggaaaagcacgtggaacctgcaaagtctcccaagaaagagcattctgtgccctctgacaagcaggtgaaagccaaaaccgagcgggctaaggaagagatcggtgccgtgtctattaaaaaagctgtacccggcaaaaaagaagaaaagaccacgaagaccgtagagcaagaaattcgcaaggagaaatccgggaaaacctcctctatcttgaaggataaagagccaatcaagggtaaagaagagaaggtgcccgcgtcattgaaagagaaggagccggagaccaaaaaggatgagaagatgtccaaggccggcaaagaggtcaaaccaaagcccccccagcttcaaggaaagaaagaggagaagccagagccccagatcaaaaaagaggccaagcctgctatcagcgagaaggtgcaaatacataagcaggacatcgttaagccagagaagacagtgtcccacgggaaacctgaagaaaaggtgttaaaacaggtaaaggcggtgaccatcgagaaaacggcaaagcctaaacccacaaagaaagccgaacatcgtgagcgggagcctccaagtatcaagactgacaaacctaagcctaccccaaaggggactagtgaagtaacagaaagtggcaagaaaaagacagaaattagcgagaaggagagcaaagaaaaagctgacatgaagcatttacgtgaggaaaaggtaagcactagaaaagaatccctgcagctgcacaacgtaaccaaggaagacgtcgaggacgtccccgccagtaagaaggcgaaggaaggaaccgaggatgtttctccaaccaaacagaaaagccctatttcattctttcagtgcgtgtacctggacggatacaacggctatggatttcaattcccgttcacaccagccgacaggcccggagagtcctctggccaggcgaacagtcccgggcagaaacagcaggggcagtag

SEQ ID NO: 209526 - DNA, 81 bp, Artificial Sequence
  Description of Artificial Sequence: Synthetic coding sequence
tgaatccacaaggacaagaccgagaagcaggagaagcccgagcggaagattcaaacaaaagaagtggggcactccagctag

SEQ ID NO: 209527 - DNA, 456 bp, Artificial Sequence
  Description of Artificial Sequence: Synthetic coding sequence
tgaacccacaaggagaaggagaagggcaaggagaaggtgcgggagaaggaaaagcctgagaagaaagcgacccacaaggaaaaaattgagaaaaaggagaagcctgagaccaagactcttgctaaggagcaaaagaaggccaagacagccgagaaatctgaagaaaagaccaaaaaggaggtgaaaggtgggaagcaggagaaagttaagcagaccgccgccaaagtcaaagaggtgcagaagacacctagcaaacccaaggaaaaagaggataaagagaaggcggcggtgagtaaacatgagcaaaaggggttccccggcccaggtatcaggaacagctcttactactgtcaatatatcaagggccaaatcaatgcctggaacgatctgcgcacgtctctcttgcccatcccctacttgtcatgtgggaaaatgtgctccaactttaacaactag

SEQ ID NO: 209528 - DNA, 2196 bp, Artificial Sequence
  Description of Artificial Sequence: Synthetic coding sequence
atcgtggagatctacccccagggcaacgccagcaccaccaccaccgtcatcgatagcaaaaacggttctgtgcctaagtccccgggaaaagtgctgaaaagaactgtgaccgaggacatcgtaaccactttttccagcccagctgcatggctcttagttatcgcattgatcataacctggagcgccgtggcaatcgtgatgttcgatctggtggattataagaacttctctgcctctagcattgccaagatcggttctgaccccctaaaactcgtccgggacgctatggaggagaccaccgattggatctacggctttttcagtcttcttagcgatattatcagctctgaggatgaggaggacgatgatggggacgaagatacagacaagggcgaaattgacgagccccccctcagaaaaaaggagatccacaaggacaaaacagagaaacaggagaaaccagagcggaagattcagacaaaagtgacgcataaagaaaaagaaaaagggaaggagaaagttagagagaaagaaaaacctgaaaaaaaggctacacacaaagaaaagatcgagaagaaggagaagcctgagactaagacgcttgcaaaggaacaaaaaaaagccaagaccgctgaaaaaagcgaagagaaaactaagaaggaagtgaagggcggaaagcaggaaaaggttaaacagactgcagcgaaggtcaaagaggtgcagaaaactcctagtaagcctaaggagaaggaagataaggagaaggccgcagtctccaaacacgagcaaaaggatcagtatgctttttgtcggtacatgattgatatcttcgtccatggcgacctgaaacctggccagtctcccgccatcccaccgcctctgcccaccgagcaggcatcccggccgaccccagcaagccccgcgctggaggagaaggagggcgaaaagaagaaagcggagaagaaggtaacctccgagaccaaaaaaaaagagaaggaagatatcaagaaaaagagtgaaaaagagacagccatcgacgtggaaaagaaagtccaggaacccggcaaggcctcagaaactaaacaagggacagtgaaaatcgcagcccaggcagccgctaagaaggatgaaaagaaggaggacagcaagaagaccaaaaagcctgctgaagtagaacaacccaaaggcaaaaagcaagagaagaaggaaaaacacgttgagcctgccaagagccccaaaaaggaacattctgttccatcagacaagcaggtcaaagctaagactgaacgtgccaaagaggagatcggcgctgtctctattaaaaaggccgtccccggcaagaaggaagagaagaccacaaaaacagtcgaacaagagatacgtaaagaaaaaagcggaaaaactagctcaattcttaaggacaaggaaccaattaaagggaaggaggaaaaggtgccggcctcgctcaaagagaaggaacctgaaaccaaaaaggacgaaaaaatgtcaaaagccggtaaggaggtcaaaccaaagcccccacagttgcagggtaaaaaggaagagaaaccagagccccagatcaaaaaggaggccaaacccgccatttccgagaaagtgcaaatccataaacaggatatcgtaaagccagagaaaaccgttagccatggtaagcccgaggagaaggtgttgaagcaagttaaggcagtcacgatcgaaaaaacagcaaagcctaagcccacaaagaaggccgagcacagagagcgagagcctcccagtattaagacagacaaacccaaaccaacgccaaagggaacaagcgaggttactgagtcagggaaaaagaaaacagaaattagcgagaaggaatccaaagagaaggcagacatgaagcacttgcgcgaggaaaaggtgtctactagaaaggagtcattgcagttacataatgtaaccaaagctgaggaggtggatagcaccctggaagatgttgaagacgttccggcgagcaagaaagcgaaggagggcactgaggatgttagccctaccaagcagaaaagcccgatctcattttttcagtgtgtgtaccttgatgggtacaatgggtacggcttccaattcccctttactccagccgatagaccgggggaatcgtctgggcaggccaattctccaggccagaagcagcagggccagtag

SEQ ID NO: 209529 - DNA, 2190 bp, Artificial Sequence
  Description of Artificial Sequence: Synthetic coding sequence
atgaccgagatcaccgccgagggcaacgccagcaccaccaccaccgtgattgatagcaagaacggatcagtaccgaagtcacctggaaaggtattaaagcgcaccgtgacagaggacatcgtgacaaccttctcctcaccagcagcctggctcttagtgatcgccctgatcatcacatggagcgctgtggccatcgttatgttcgacctcgtcgattacaagaatttttcagcctcttccattgcgaaaattggctccgacccattgaaactggtgagagatgcaatggaggagactacggactggatatatgggttcttctctctgttgtcagacataattagcagcgaggatgaggaagatgatgatggggatgaggacacggataaaggtgaaatcgatgagccccctctgaggaagaaggaaatccacaaggataaaacggaaaaacaggagaaacccgagcgcaagattcagacaaaggtaacacataaggagaaggaaaaagggaaagagaaggtgcgtgagaaggagaagccagagaagaaggccacgcataaggaaaagattgaaaaaaaagaaaagccagaaaccaaaaccctagccaaagagcagaaaaaggcaaaaaccgcagagaaaagcgaagaaaaaactaagaaggaagtcaaaggcggaaaacaggaaaaagtgaaacaaacagccgccaaggtgaaggaggttcagaaaaccccgtctaaacctaaggaaaaagaagacaaagaaaaagccgccgtgtctaagcacgagcagaaagatcaatatgcattctgccgttatatgattgatatctttgtacatggcgatctgaaaccggggcagtctccagcaatcccacctccactgcccactgaacaggctagccgtcccaccccggcttcccccgccctggaggagaaagaaggcgaaaaaaaaaaagctgaaaaaaaagtcaccagtgagaccaagaaaaaggaaaaggaggatatcaagaagaagagcgagaaggaaacagctatcgatgtagagaagaaagagcctggcaaagcatccgagacaaaacaaggcaccgttaaaattgcagctcaggccgcagccaaaaaagatgaaaaaaaagaagattcgaagaagacaaagaaaccggcggaggtggaacagcccaaagggaagaagcaagagaaaaaagaaaaacacgtggagcctgcgaagtcgcctaagaaagaacacagcgtgcccagcgataagcaagtaaaggcgaagaccgagagagccaaagaggagatcggcgcagtcagcattaagaaggccgtccctggcaaaaaagaagaaaagacaaccaaaacagtcgagcaagagattcggaaagagaagtcagggaaaacgagtagtattctcaaggataaagagcccatcaaaggaaaggaggaaaaagtgccggcatctctgaaggaaaaggagcccgagacaaagaaagatgaaaagatgtccaaagctgggaaggaggtgaagccaaagcctccccagctccagggaaaaaaggaagaaaagcccgaaccccagattaagaaagaagctaagcctgctattagtgaaaaggtgcagatccataagcaggatattgtaaagcctgagaagactgtgtcacacggtaaacctgaggaaaaagtcctgaagcaagtgaaagctgtgactatcgagaaaaccgctaagccaaagccaacaaaaaaagccgaacacagagagcgagagccgcccagcattaaaaccgataagcccaaacctacgccaaaaggcacctccgaagtgactgagtccggcaagaagaaaactgaaatcagcgagaaggagagcaaggagaaggcagacatgaagcacttacgcgaagagaaagtttcaacacgcaaggagtcgctgcagcttcataacgtgacaaaggccgagaagccagcccgtgtatctaaggatgtagaagatgtgccagccagtaagaaggcaaaagagggcactgaggacgtgtcccccaccaagcagaaatcgcccatctcctttttccaatgcgtttatctcgacggatacaacggttatggtttccagttccccttcacccccgccgataggccaggggagtcatcggggcaagctaattcccccggtcagaagcagcagggtcagtag

SEQ ID NO: 209530 - DNA, 135 bp, Artificial Sequence
  Description of Artificial Sequence: Synthetic coding sequence
tgaatccacaaggacaagaccgagaagcaggagaagcccgagcggaagatccagaccaaggattggtctgcaaacagtagcaccataagaacactgaagctgacacagctgaaaccaatctacatttgcacttag

SEQ ID NO: 209531 - DNA, 1038 bp, Artificial Sequence
  Description of Artificial Sequence: Synthetic coding sequence
atcgtggagatctacccccagggcaacgccagcaccaccaccaccgtcattgattctaaaaacggcagtgttcccaaatctcccgggaaggttctgaagagaactgtgacggaggatatcgtcactacctttagcagccctgccgcctggctcttagtgatcgctcttattatcacctggagtgccgtggccattgttatgttcgatctggtggactataaaaacttctccgcaagctcgatagcgaaaattggttctgaccccttaaagctggtgagggatgccatggaggaaacaacagattggatttacggttttttttcattgctctccgacatcatttccagcgaggatgaggaggatgacgacggcgacgaagacacagacaaaggcgagatcgacgagcctccactgagaaagaaagagattcataaagataagaccgaaaagcaggaaaaacctgaacgaaagattcagacgaaggtgacgcataaagaaaaggagaaaggcaaagagaaagtgcgggaaaaagagaagccagagaagaaggctactcataaagaaaagattgagaaaaaggagaagcctgaaacaaagacactcgccaaggagcagaaaaaagcgaagacagccgagaaatctgaggagaaaaccaaaaaagaagtcaaaggcggaaaacaggagaaagtcaaacagaccgccgccaaagtaaaggaggtgcaaaaaaccccctcgaaacctaaggaaaaagaagacaaagaaaaggctgccgtgtctaagcacgagcagaaagaccaatatgctttttgtagatatatgatagacatcttcgtccacggtgatctgaagcccggtcagagcccagccatcccgcccccgttgcctactgagcaggcatctaggcccactcccgccagtcccgccctggaggagaaagagggagagaagaaaaaagctgaaaagaaggtcacttctgagacaaagaaaaaagagaaggaggacatcaaaaagaagaagaagaagaaaaagaaaaaatag

SEQ ID NO: 209532 - DNA, 504 bp, Artificial Sequence
  Description of Artificial Sequence: Synthetic coding sequence
atgaccgagatcaccgccgagggcaacgccagcaccaccaccaccgtaatagatagtaaaaatggcagcgttccaaagagtcctgggaaagtccttaagcgcaccgtgactgaagatatagttacgacattctcctcccctgcagcgtggctcctggttatagccctcattattacctggagcgccgtggccatcgtgatgttcgatcttgtggactataagaacttcagtgctagttccattgcaaagatcggcagcgatccactgaagttggtccgcgacgcaatggaagaaactaccgactggatatatggttttttcagcttactttctgatattatttcaagtgaggatgaggaggacgacgatggggatgaggatactgataagggcgagatcgatgagcctcccctccgaaaaaaggagatccacaaggataagaccgaaaaacaagagaaacctgaacggaaaatccaaacaaaggaagtgggccactccagttag

SEQ ID NO: 209533 - DNA, 987 bp, Artificial Sequence
  Description of Artificial Sequence: Synthetic coding sequence
atgaccgagatcaccgccgagggcaacgccagcaccaccaccaccgtgatcgactccaaaaatggttctgttcctaaatccccgggaaaagtcttaaaacgaacagtgactgaggacatcgtcaccaccttctctagcccagccgcttggttgctggtcatcgccttgattattacctggagcgccgtggcgatcgtgatgtttgatctggtagactacaagaatttctctgccagtagcatcgctaaaataggatctgatcctctcaaattagtgcgggacgctatggaagagacgacggactggatctacggatttttctcgctgctatccgatatcatcagctccgaagatgaggaagacgacgatggagatgaggacactgacaagggcgaaatcgatgagccgccactgagaaaaaaggaaattcataaagacaagactgagaagcaagaaaagccagaaagaaagatccaaacgaaagtcacacataaggaaaaagaaaaaggcaaagagaaggtgagagagaaggagaagcctgagaagaaggctactcacaaggagaaaattgagaaaaaagagaaacctgagaccaaaacactggccaaggagcagaaaaaggcaaagaccgccgagaagagcgaagagaagactaagaaagaagtgaaggggggaaaacaggagaaagtcaagcaaaccgccgccaaggtaaaagaagtacagaagactccttctaagcccaaggaaaaggaggacaaagaaaaggctgctgtctccaagcacgagcaaaaggaccagtacgctttttgccgttatatgatcgatatcttcgtacacggcgatctcaagcctggacagagtcccgccatccctccaccccttccgactgagcaggcgagccgccctaccccagccagtcccgccttggagggcgataaggcctccaaagagaagaagaggaagatgaagcggatgtccgagaaatag

SEQ ID NO: 209534 - DNA, 894 bp, Artificial Sequence
  Description of Artificial Sequence: Synthetic coding sequence
atgaccgagatcaccgccgagggcaacgccagcaccaccaccaccgtgattgactctaagaatggcagcgtacctaagtcccccgggaaggtgttgaaaaggaccgtgaccgaagatattgtgaccactttctcctctcctgccgcatggctgctcgtgatagctttaattatcacctggtctgcggtggctattgtgatgttcgatctggttgattacaaaaacttttctgcatctagtatagctaaaattggctcagatcctcttaaactcgtccgtgatgcaatggaagagaccacggattggatttacggattttttagtttactgtccgatatcatcagctcagaagatgaagaggacgacgacggagacgaggataccgataagggcgagatcgatgagcctcccttaaggaagaaagagatccataaggacaagaccgaaaaacaggaaaaacctgagcggaagattcagaccaaagtgactcataaggagaaagagaaaggtaaggagaaggtgagagagaaagaaaaaccagaaaagaaggccacacataaagagaagatcgagaaaaaggaaaaacccgaaactaaaaccctggcaaaagagcagaaaaaagccaagaccgccgagaagagtgaagaaaaaactaagaaggaggtcaaaggtggtaagcaggaaaaagtgaagcaaaccgctgctaaagtaaaagaagtgcagaagactccttccaaacccaaagagaaagaggacaaggaaaaagctgcagtatccaagcatgaacaaaagggtcagagcccagcgatccctcctcctcttccgaccgagcaggccagcagaccaacccccgcctcacctgcactggaaggtaaatacttctttttctcctag

SEQ ID NO: 209535 - DNA, 5832 bp, Artificial Sequence
  Description of Artificial Sequence: Synthetic coding sequence
atgagccccctgctgcggagcatctgcgacatcaccgagatcttcaatcagtacgtatctcatgactgcgatggcgctgctctgacaaagaaggacttaaagaacctccttgaaagggaatttggtgctgtactgagaaggccacacgaccctaagacagtcgaccttattctggaacttttggacctggattctaatggacgagtggacttcaatgagtttctcttatttatctttaaagtggcacaggcttgttattatgccctcggacaggctaccggcctggatgaggaaaagcgcgctaggtgcgacgggaaggagagcctgctccaagaccgcagacaagaagaggatcaacggaggttcgaacctcgcgacaggcagctcgaggaggaacccgggcagcgaaggagacagaagcgtcaagaacaggaaagagaactggccgagggagaggagcaatctgagaagcaagaaaggcttgaacagagggatagacaacgaagagatgaagagctgtggcggcagcgccaagagtggcaggagcgggaagagaggagagccgaagaggagcaacttcagtcctgtaagggtcatgaaacggaagagtttccagacgaggaacagcttcggcgtagggagctgctcgagttgcggcgcaagggccgcgaggagaagcaacagcagaggagagagcgacaggatcgcgtgttccaggaggaggaagaaaaggagtggcgcaagagagaaacggttttacggaaagaagaggaaaagctccaggaggaagagccccaacggcagagggagcttcaggaggaggaggagcagttgcggaaactggaacggcaggaacttagacgggaacggcaggaggaggagcagcagcaacagagactgagacgcgaacagcagttgagacgaaagcaggaagaagagaggcgcgagcagcaggaggaaaggagggaacagcaagaaaggcgggaacagcaagaggaaagacgggaacaacagttgagaagggagcaggaggagcggagagagcagcagctccggagagagcaggaagaggaaagaagagagcagcagctgaggagggaacaagaagaagagaggcgcgagcagcagttgagacgcgagcagcagttgaggagggagcagcaactcagaagagagcagcagcttaggcgggagcagcagctgcggcgggaacaacagctgcgcagggagcagcagctgcgacgcgaacagcagctccgaagggaacagcagctccgaagggagcaagaagaggagcggcatgaacaaaagcacgagcaggagaggcgggagcagaggttgaagcgcgagcaggaggagcgacgagactggctgaagagagaagaggagacggagaggcacgagcaagagaggcggaagcagcagttgaaacgggatcaggaggaagagcgaagagaaagatggcttaagcttgaggaggaggagcgcagggagcagcaggaacgtcgggaacagcaattgcgacgcgagcaggaggagagacgcgagcagcggctaaagcgccaggaagaagaggagagacttcagcagaggctgcggtcagagcaacaactcagaagagagcaggaggagagacgtgagcagttgctgaagcgggaggaggagaagcgcctggagcaggagcgtcgggaacaacgccttaagagggagcaagaagaaagacgcgaccagttactaaaacgagaagaggagcgccggcagcagcgcctgaaacgcgaacaagaagagcgactggagcagcgcctgaagcgtgaagaggtggagcggctcgaacaggaagaaaggagagagcaacggttgaagagggaagaacctgaagaggagcgcagacaacaattgctgaaatcggaggaacaagaggagcgtcggcaacagcagctgagacgggaacagcaagaaagacgagaacagcggcttaagcgcgaggaagaggaagagaggctcgagcagaggctcaagagggagcatgaggaagagcggcgggagcaggaactggccgaggaggaacaggagcaggctagagagcgtataaagagccggatacccaagtggcagtggcaacttgaaagtgaggcagatgccagacagtctaaagtgtattccaggcctaggaaacaggagggccaacggcgtagacaggagcaggaggagaaaaggcggcgcagggaatcagagttgcagtggcaggaagaggagcgggcacatcgccaacaacaggaggaggagcagagacgcgacttcacttggcagtggcaggctgaagagaaaagtgagcgaggtaggcaaagactgtctgcgagacctcccctgcgtgagcagagagaacgacaactgagagccgaagagcgccagcaacgagagcagcgcttcttgcctgaggaagaggagaaggaacagcgccgaagacaacgcagagagcgagagaaagagttacagttcttggaggaggaagagcagttacagaggagggaaagagcccagcagttgcaggaggaggaggacggactccaggaggaccaagagcggcggcgcagtcaagagcagcgcagagatcagaagtggaggtggcagttggaagaggagcgcaaacggcgtcgtcacacactctatgccaagccagcccttcaagagcagctgcgaaaagagcagcagctcctgcaagaggaagaggaggaactacagagagaggagcgagagaaacgccgtagacaggaacaggagcgccagtaccgggaagaagagcaactacaacaggaggaggaacagctcctgagggaggaacgggaaaagcggcgtaggcaggaacgtgaaagacagtataggaaggataaaaagctccagcagaaagaggagcaactgctgggggaggagcccgaaaagagacgtaggcaagagcgcgagaaaaaatacagagaagaggaggagttacagcaggaggaggagcagttgctgcgagaagaacgcgaaaaacggcgtagacaggagtgggagcgacagtatcggaagaaggacgagctgcagcaggaggaggaacagctgctccgggaggaacgtgagaaacgaagacttcaggagcgcgagcgtcaatacagggaagaggaggagcttcagcaagaagaggaacagttgttgggagaagagcgagagacgcgccgccgccaggagctggagaggcagtatagaaaggaggaagaactccagcaagaggaagagcaactgttgagggaggagcctgaaaagagacggcggcaggagagggagcggcaatgtcgcgaagaagaggagctgcagcaggaggaggaacagctgctgcgcgaggagcgtgagaagaggcgcagacaggagcttgagcgtcagtacagggaggaggaggaagtgcagcaagaggaagaacagctattgagagaggaaccggagaagagaaggaggcaggaactcgagcgccagtatcgcgaggaggaggagctgcaacaggaagaggaacagctgcttcgggaggaacaggaaaaacgacggcaggaacgtgagcgacagtacagagaggaggaggaactccagcgacagaaaaggaaacagaggtaccgggatgaggatcaacggagcgatctcaaatggcagtgggagccagaaaaagagaatgctgtacgcgataacaaggtgtactgcaaaggaagggaaaatgaacagtttcgacagctggaagactcccagctccgggataggcagagtcagcaggatctgcaacatctgctcggagaacagcaagagcgcgaccgggagcaggaacggcgcagatggcagcaaagggatcgacacttccccgaagaggaacagctggagagggaagaacagaaagaagcaaagcgaagggataggaagagccaggaggaaaaacagcttttgcgggaggagagagaggagaaacgacgccgccaggagacagacaggaagttcagagaggaagaacagctgttgcaggagcgtgaggagcagcctcttcgtcgccaggagcgtgataggaagtttagagaggaagaacttaggcaccaagagcaaggtcgcaagttcctggaggaggagcagcggttacgcagacaagagagggaaaggaagtttctgaaggaggagcagcagcttcgctgtcaagaacgagagcaacagttgcgccaggaccgagatagaaaattcagggaagaagaacagcagctgtctcgccaagaacgcgatcgtaagttccgagaggaggagcagcaggtgagaaggcaggagagagagagaaaattcctcgaggaggaacagcaactgcgccaagagcggcaccgaaagttccgagaagaagaacaattactacaggaaagagaagagcagcagctgcacaggcaggaaagagatcgtaagttcctagaagaggagcagcagcttcgtaggcaagagcgggacaggaagttccgagagcaggagcttaggtctcaggaacccgaacggaaattcttggaggaggagcagcaactccatagacaacagcgccagcgcaaatttctacaggaggaacagcaactccgccggcaagaacgagggcagcagcggcgccaagaccgcgatcgaaaatttcgagaagaggaacaactgaggcaagaacgggaagagcaacaactgtcccgacaggaacgggaccgcaaattcaggttagaagaacagaaggtcaggcggcaggaacaggagagaaaattcatggaagacgaacagcaactcagaaggcaggaagggcagcagcagctccgccaagagagggacagaaagtttcgagaagatgagcaattactgcaagagcgggaggagcagcaactgcataggcaagagagggatcgcaaattcttggaagaagaacctcagctcaggaggcaagaacgcgagcagcagctaaggcacgacagggataggaaatttcgggaggaagagcagctgctccaagaaggtgaagagcaacagctgagacgacaggagcgtgacagaaaatttcgggaagaagaacagcagttacgacggcaggagcgggagcgaaagtttctgcaagaggaacagcaattgcggaggcaggagctcgagagaaagttcagagaggaggaacagcttcggcaggagactgaacaagaacagctacgccgacaagagaggtaccggaagatcctggaggaagaacagctgcggcccgaaagagaggagcagcagctgcggaggcaggagcgcgaccgtaaattcagagaggaagagcagctccggcaggaacgggaggagcagcagctgcgaagtcaagagtctgacaggaagttcagggaggaggaacagttgcgtcaagagcgcgaggagcagcagttgaggccgcagcagagggatggaaagtatcgctgggaggaggaacagcttcaacttgaagaacaggagcagcgcctgagacaagagagagatagacagtaccgtgcagaagagcagtttgctactcaggagaagagcaggagagaggaacaggagctatggcaagaggaggaacagaagagaagacaggagcgcgaacggaaattgcgggaggagcacattagaaggcagcagaaggaagagcagcgtcatcgccaagtcggtgagatcaaatcacaggagggcaaagggcacgggaggctcttagaacctggcacgcaccaattcgctagcgtccccgtcaggagttcgccgctttatgaatacattcaagagcagcgaagccagtacagaccctag

SEQ ID NO: 209536 - DNA, 540 bp, Artificial Sequence
  Description of Artificial Sequence: Synthetic coding sequence
atggccaagaccgccatggcctacaaggagaagatgaaggagctgtcgatgctgtctctgatttgttcatgtttctaccctgagcctagaaatatcaacatttatacttacgatgatatggaagtgaaacaaatcaataagcgggcatcagggcaggcattcgagcttatactgaagcctccaagcccaatatctgaagctccccgcacgctagccagtcctaaaaaaaaagatttgtcccttgaggaaatccaaaagaaactggaagccgccgaggaaagaaggaaaagtcaggaggcccaggttctaaagcagttggcagagaagagagagcacgagagagaagtgctgcagaaagccctcgaagagaataacaacttttctaagatggcggaggaaaaactgatattgaaaatggaacagattaaggagaacagggaggctaacctcgccgctatcatcgagagactgcaggagaaggaacggcacgctgcagaagtccgcaggaacaaagagctgcaagtagagctgtcaggttag

SEQ ID NO: 209537 - DNA, 3885 bp, Artificial Sequence
  Description of Artificial Sequence: Synthetic coding sequence
atgccctacgaggtgaacgccggctacgacttcaccaacatggtgaggaagaagaatccccccctccgaaacgtggcctccgagggcgagggccaaatcctcgagccaatcggaaccgagtcgaaggtgtctgggaaaaataaggagttttcagccgatcaaatgagtgagaatacggaccagagcgatgctgccgagttaaaccataaggaagaacacagcctgcacgttcaggatccatcaagtagttccaaaaaagatttgaaaagtgctgtgctctcagagaaggccgggttcaattatgaaagcccctccaaaggggggaattttcctagctttccacacgatgaggttacagaccggaatatgttagcctttagtagtcccgctgcgggtggagtgtgtgaacctctcaagtcgcctcagcgagctgaagcagacgacccccaggatatggcttgcacaccctcaggagactcactcgaaacgaaggaagatcaaaaaatgagtcctaaggcaaccgaggaaacagggcaagctcagtccggccaggccaattgtcagggcctgtcacccgtctcggtagctagcaagaatcctcaggtgcccagtgatgggggcgtaaggctgaataagtcaaaaacagacctgcttgtgaacgataacccagatcctgctcctctttctccagaacttcaggacttcaagtgcaacatttgcgggtacggttactacggcaacgaccccaccgatctgataaaacatttccggaagtatcatctaggactgcacaacaggacaagacaagatgccgagctagacagcaagatcctggccctgcacaatatggtccagtttagccattccaaggatttccaaaaagtgaacagatcagtctttagcggagttctgcaggatattaactcttcaagaccggtactccttaatggaacatacgatgtgcaggtgacatcaggcggtacatttattgggataggcagaaagacacctgattgccagggaaataccaaatatttccgctgcaaattttgcaattttacctatatggggaacagctccaccgagttagaacaacactttctgcagactcaccctaataagatcaaggccagtttgccttctagcgaagttgccaaaccttcagagaagaattcaaataagagtatacctgccctgcagtccagtgactctggggatctcgggaagtggcaggacaaaattaccgtcaaagcaggagatgataccccggtgggttactccgtacctatcaagcctctggactcatcgagacagaatggcactgaggctactagctactactggtgtaagttctgcagcttttcttgtgagtcatcctcaagtctaaaattgctggaacactatgggaaacagcacggagccgtccagtccggcggcctgaaccctgaactgaatgataagctgtcacgaggctcagtgatcaaccagaatgaccttgccaagtcttctgaaggcgaaacaatgacaaaaaccgacaagtcctctagcggggctaaaaagaaggatttctcttccaaaggagcggaagataatatggtgaccagttacaattgccagttttgcgactttagatacagcaagtctcatgggcccgatgtgatagtggtggggcctttgcttagacactaccagcagcttcacaatatacacaaatgcacgattaaacactgtccattctgtccccgaggactgtgttctccggaaaagcatcttggcgaaatcacctatccctttgcctgtagaaagtcaaattgctctcactgcgccctattacttctgcatctctctccgggcgccgccggctcctcacgagttaaacatcagtgtcatcagtgctccttcactaccccagacgtagatgttctcctttttcactatgaaagcgtgcatgagtctcaggcatcagacgttaagcaggaagctaatcaccttcaaggttcagacgggcagcagtctgtgaaagagtctaaggagcactcatgcactaaatgcgactttattacccaggtcgaggaagagataagtcgtcattaccggagagcacatagttgctataagtgtagacagtgttccttcactgctgctgacactcagagcctccttgaacactttaacaccgtgcactgccaggaacaggatataactaccgcaaatggcgaagaggatggacatgcaataagtaccattaaagaagagcctaaaatagattttcgcgtatataatctccttacgcctgattcgaaaatgggggagcccgtgtctgagtctgttgtcaagcgggagaagttagaggaaaaggacgggcttaaggagaaagtgtggacagaaagttccagcgatgatctgcgcaatgtaacttggcgaggtgctgacatcctgagaggctcacccagctatactcaggcctccctgggtctgctcaccccagtttctggaactcaggagcagacaaagactctcagggactctcctaatgtcgaagcggcccacctcgctcggccgatttacggcctggccgttgaaacaaaaggcttcttgcagggggcacctgctggcggtgagaaaagtggagccctgccccagcagtacccagcttccggcgagaacaagagcaaggatgagtcccaaagcctgcttcgcagacggcgcggctctggggtgttttgcgcaaattgcctgactacaaagaccagcctttggagaaagaatgccaatggcggatacgtatgcaatgcctgtgggctgtatcagaagctgcattctactccgaggccactgaatattatcaagcagaacaatggcgagcagattattagaagacgaacaaggaaacgattaaatcctgaagctctgcaggctgagcagctgaataaacagcaacgaggatccaacgaagagcaggtcaacggaagtcccctcgaacgacggtcggaggaccacctcaccgaatcccaccagcgcgaaatccccctgccctctctgagtaaatacgaggcccagggcagccttacaaaatcccactctgcccagcaacctgtgctggtgtcccagaccctcgacatccataagcggatgcagccgctgcatatccagatcaaaagcccacaagaatctacaggggatcccggaaatagctcatccgtgtctgagggtaagggtagttccgagagaggttcccccatcgagaagtacatgaggccagctaagcatccaaactattcaccacccggcagtcccattgaaaaatatcaatacccattgttcggtctcccttttgtacacaatgattttcagtcagaagctgattggctcaggttctggtcgaagtataagctgagcgtgccaggtaacccgcattacctcagccacgtgcccgggcttcctaatccttgtcaaaattacgttccctatcccacctttaatctgcccccccatttctctgcagtgggatctgataatgatataccactcgatctggctatcaagcattcaaggccggggcctacagctaatggagcatccaaagaaaagaccaaagctcccccaaatgttaagaacgaagggcccctcaatgtggttaagactgaaaaagtggatcggagcacccaggatgagctgtcaaccaaatgcgtccattgtggaatcgtttttttggacgaggtgatgtacgccctccatatgagctgccacggggatagcgggccctttcagtgttccatctgccagcatctgtgcaccgacaagtatgactttaccactcacattcagagggggttgcatagaaataatgcacaagtcgaaaagaacggcaagcctaaggaatag

SEQ ID NO: 209538 - DNA, 3858 bp, Artificial Sequence
  Description of Artificial Sequence: Synthetic coding sequence
atgcagagcaacatggtgcggaagaagaacccccccctgcggaacgtcgccagcgaaggcgagggccagattttggaacctatcggaacagaatccaaggtgagcggcaaaaataaagaatttagcgcggatcagatgagcgagaataccgatcaatccgatgccgccgaattgaatcacaaagaggagcattctttgcacgtgcaggatccctcctcctcctctaagaaggatctgaaatctgccgttctcagcgagaaagctggtttcaattacgagtccccctcaaaggggggtaacttcccttctttccctcacgacgaagtgaccgaccggaacatgctggctttctcctccccagccgccggaggcgtgtgcgagcccctgaagtcaccgcagagggctgaggccgacgatcctcaggatatggcgtgcaccccaagcggcgacagtctcgaaactaaagaggaccagaaaatgtctccaaaagccactgaggagacaggtcaagcccagtccggtcaggccaattgtcagggcctgtcacccgtgagtgtggccagtaaaaatccacaggtgccatcagatggaggcgtgaggcttaataagtcaaaaaccgatttgctcgttaacgataatcccgacccagccccactgtcccccgagctgcaagacttcaaatgcaacatttgcggctacggttattatggaaacgaccctaccgatctgatcaagcactttcggaagtatcacctcggcctccacaacagaactcggcaggacgcagaattagattcaaaaattctagcgctccacaacatggtccaattttctcatagtaaagattttcagaaagtgaacaggtcggtgttcagcggtgtgctgcaggatattaacagttcaagaccagtgctgcttaatgggacatatgacgtgcaggtgacatctggaggcacgttcatcggaatcggccgcaaaacaccagactgtcagggtaacacaaagtattttagatgcaaattttgtaacttcacttatatggggaatagctccaccgagctggaacagcatttcttgcagacgcacccaaataagattaaagcctccctgccctcctctgaagtggctaagccgtctgaaaaaaattccaacaagtcaattcctgcccttcagagctccgattcgggtgatcttggtaagtggcaagacaagataacagtcaaagccggcgatgacacacctgttggctactcagtaccaataaagcctctggatagctcacgccaaaatggaaccgaggctactagctactattggtgtaagttctgttcctttagctgtgaaagctcttcaagtctaaagttgctggaacattacggcaagcagcatggagcagtgcagtccggcggcctgaaccccgagttaaatgacaagctgtctcggggcagcgttattaaccagaacgacctcgcaaagtcgtccgaaggtgaaaccatgaccaagacagataaatcctcgtccggcgcgaagaaaaaagacttcagttccaagggtgcagaggacaatatggtcacatcctacaattgccagttctgcgattttaggtattcgaagagtcacgggcccgatgttatcgtggtgggtcctctgctgagacattatcaacagcttcataatattcataagtgtactattaaacactgccccttctgtcccagaggtctgtgcagccccgagaagcacctgggagagatcacctatccctttgcttgcagaaagtctaactgttcacactgcgccctactcctgctgcacctctctcccggggctgctggttccagcagagtcaagcatcaatgtcaccaatgttctttcactactccagacgtcgatgttttgctcttccactatgaaagtgttcacgagtcccaggcgagcgatgtgaaacaggaagcaaatcatttacaggggtccgatggacagcagagtgtcaaagagagcaaagagcatagctgtacgaagtgtgattttatcactcaggttgaggaggagatatccagacattaccggagagcccactcctgctacaaatgccgccagtgttcctttaccgccgccgatacccaatctttactggaacactttaatacagtccattgtcaagagcaggacatcacaaccgccaacggagaggaggatgggcacgctatttcaacaattaaggaggagcccaagatagattttcgcgtatacaatctgctcacccctgatagcaaaatgggtgagccagtaagtgagtcagtcgtgaaaagagagaaactggaagaaaaagacggtctaaaagaaaaagtgtggaccgagtcaagctcagacgacctgcgcaatgttacgtggcgcggcgcggatatcctgcgcgggagccctagctacacccaggcaagcttaggtttactcactcctgtctcaggaacgcaagagcagacaaagactttgagagacagtcccaacgtagaagctgcccacctggcaaggccaatctacgggctggctgtagaaacaaagggatttctgcaaggagctcccgctggcggcgagaaatccggcgctctcccgcaacagtatcctgcttccggggagaataaatctaaagatgagtcccagtcactcctgaggagaaggaggggttccggcgtcttctgcgcgaattgtcttacgactaaaacatccctttggcggaagaatgcgaatggcgggtatgtgtgcaacgcctgtggtttgtatcagaaacttcactcgaccccgaggccactcaatataatcaaacagaataacggcgaacagatcatcaggcggcgcacacgaaaaaggctgaatcctgaagcactgcaggctgagcagctaaacaagcagcagcggggctccaacgaagagcaggtgaatggttctccattagaaagacgctccgaggaccacctgaccgaaagccaccagcgagagatccccctcccctcgttgtccaagtacgaagcacagggatccttaacgaagagccactccgcacagcagccagttctcgtctctcagactctggacatacacaaacgtatgcagcctttacatatccagatcaagtccccgcaagaatccaccggcgatcctggaaattcttcaagcgtgagcgaaggcaagggctcttcagaaagaggcagccccatagagaagtacatgcgtcccgcaaagcacccaaattatagcccacccgggagtcctatagaaaagtatcagtacccccttttcgggttgccttttgttcataacgacttccagtctgaagcagactggctccgattctggtctaagtacaagttgtctgtacctggcaatcctcattatttgagccacgtgcccgggctccccaatccttgtcagaattatgttccttaccctacatttaatctccctcctcactttagtgctgttggatctgataacgacattccactggacctcgccataaagcattctcgtcccggtcccaccgcaaatggagcaagcaaagagaagaccaaggccccccctaacgttaaaaatgagggccctctgaatgtggttaagaccgaaaaggtggacagatctacacaggatgagttgtcaacaaaatgtgtgcattgcgggatcgtgttcttagacgaggtgatgtacgcactgcatatgtcctgtcacggcgactccgggcccttccagtgtagcatttgtcagcacctgtgcacggataaatacgatttcacgactcatatccagagagggttgcatcgtaacaatgcacaggtagagaaaaacggcaaacccaaagagtag

SEQ ID NO: 209539 - DNA, 705 bp, Artificial Sequence
  Description of Artificial Sequence: Synthetic coding sequence
atgcggaagacccggctgtggggcctgctgtggatgctgttcgtgagcgaattacgcgcggccacaaagctcacggaggagaagtacgagctcaaagaagggcagaccttagatgtaaagtgcgactataccctcgagaagttcgcttctagtcagaaggcctggcagatcattagagacggcgagatgcccaagacactagcatgtactgagcgccccagcaagaactcacatcccgtgcaggtcggcaggatcattctggaagattaccatgaccatgggctgctgcgcgtcagaatggtgaacctgcaggtggaagactccggcttgtaccagtgtgtgatctaccagcccccgaaagaaccacacatgctgttcgaccgcatcaggctggtggtcacaaagggattctccggaacgcctggatctaatgagaacagtactcagaacgtgtataagattcctcctacaactacgaaggccctctgcccgttgtacacatcgccgagaaccgttactcaggccccccctaagtccacagcagacgtatcgactcccgacagcgagatcaatttaaccaatgtgaccgatatcatcagggttccggtgttcaatattgttatactcctcgccggaggcttcctctcgaagtcactggtgtttagtgtcttatttgctgtgaccctcagatcctttgtaccctag

SEQ ID NO: 209540 - DNA, 453 bp, Artificial Sequence
  Description of Artificial Sequence: Synthetic coding sequence
atgcggaagacccggctgtggggcctgctgtggatgctgttcgtgtctgagctgcgcgccgccacgaagcttacggaggagaagtatgagctcaaggagggtcagaccctagacgtgaagtgtgattacaccctcgagaagtttgcatcttctcaaaaagcgtggcagatcattcgcgacggagagatgcccaagaccctggcttgcactgaacgacccagcaaaaattctcacccagtgcaagtgggtcgaattatcctggaagactaccacgaccacgggcttctgagggtccggatggtaaaccttcaagtggaggatagtggactgtatcagtgcgtgatttaccagccaccaaaggagccacatatgttattcgatagaattcggctcgtcgtcaccaaggggttcaggtgtagcacactttcattcagttggctggtcgacagctag

SEQ ID NO: 209541 - DNA, 678 bp, Artificial Sequence
  Description of Artificial Sequence: Synthetic coding sequence
atgcggaagacccggctgtggggcctgctgtggatgctgttcgtgtctgaactccgggctgctacaaagctgactgaggagaagtatgagctgaaggaaggtcagacgctggacgtcaagtgcgactatacactggaaaaatttgcgagctctcagaaagcatggcagatcatccgggatggggaaatgcctaagaccctcgcctgtactgaacgtccttctaaaaattctcacccagtgcaagtcggccgcattattctggaggactaccacgatcatggtctcctgcgggtgcggatggtgaatctacaggttgaagactccggtctgtatcagtgtgttatctatcaaccaccgaaagagccccacatgctgtttgaccgtatccggctggttgtgaccaaggggtttagtggaactcctggtagcaacgaaaactccacccagaatgtatataagatccctccaactaccacaaaggccctatgccccctgtatacaagcccgcgaacggtgacccaggctcctcccaagtccaccgctgatgtcagtactcccgattccgagatcaaccttaccaacgttactgatatcatacgctattcctttcaggtaccgggacctctcgtatggactctgagtccactgtttcccagcctttgtgccgaacgcatgtag

SEQ ID NO: 209542 - DNA, 501 bp, Artificial Sequence
  Description of Artificial Sequence: Synthetic coding sequence
atggagcccctgcggctgctgatcctgctgttcgtgaccgagctgagcggggcccataatacaactgtgtttcagggcgtggccggccagtccctgcaggtgtcttgcccgtacgacagcatgaaacattggggcaggagaaaggcatggtgcagacaactgggcgaaaaaggaccttgtcaacgggtggtttctacacacaatctatggctgctaagtttcctacgaagatggaatggctccacagcaattacagatgacactcttggaggaaccctcaccatcactctccggaatctgcaaccccacgatgccgggctttatcagtgccagtcgctgcatggtagcgaagcagatacactccgaaaggtcttagtcgaggtattagcagacccgcttgaccatcgggacgcgggcgatctgtggttccccggggagtctgaatcttttgaagatgcccacgtcgagcacagcatctcaagggcagagcgacacgtttag

SEQ ID NO: 209543 - DNA, 693 bp, Artificial Sequence
  Description of Artificial Sequence: Synthetic coding sequence
atggagcccctgcggctgctgatcctgctgttcgtgaccgagctgagcggcgcccacaacactaccgtcttccaaggagtcgctggacagagcctgcaagtgtcctgcccctacgactcaatgaagcattgggggagacgcaaggcctggtgccgccagctcggcgagaagggaccttgtcagagggtggtttcaactcacaatctgtggctgctaagcttcttgcgacggtggaacggcagtactgcgatcaccgacgatacacttggcggtacgcttaccattacactaagaaaccttcagccgcatgacgcaggtctctatcaatgtcagtccctgcacggctcagaagctgatacattgcgaaaggtactcgtagaggttctggccgacccactggatcacagagatgcaggagacctctggtttcccggggaaagcgaatccttcgaggatgcacacgtggagcacagtattagcagatctctgttagaaggcgagatcccgttccctccaacgagcattcttcttctcctcgcctgtatctttctcatcaagattctggcagccagcgccctttgggccgctgcttggcacggccagaagcctggaacccatccaccttctgagctcgactgtggccacgacccagggtatcaactgcagacgctccctggcctccgagacacgtag

SEQ ID NO: 209544 - DNA, 660 bp, Artificial Sequence
  Description of Artificial Sequence: Synthetic coding sequence
atggagcccctgcggctgctgatcctgctgttcgtgaccgagctgagcggagctcataacactactgtgttccagggagtcgccggacagtctttgcaggtgagttgtccatatgactccatgaagcattgggggaggcgcaaagcttggtgcaggcagctcggagaaaaaggaccctgtcaacgggttgtgtccacacataatctctggttactttcttttctgagaaggtggaacgggagtactgctatcactgatgacacattgggtggtaccttaacaatcactctgcggaatctgcagcctcatgatgccggtctgtaccagtgccagagcctgcacggctccgaggcggatacactgcggaaagtgttagtggaagttctggccgaccccttagatcatagggacgccggtgatctgtggtttcctggcgaatctgagtccttcgaggatgcccatgttgagcattcgattagtagggccgaaaggcatgtcaaagaggacgatggacgcaagagccccggagaggtgcctcccggaacctcccctgcctgtatactcgccacttggccacctggtctcctggtcctgctgtggcaggaaaccacactccctgaacattgtttctcctggaccctggaagccggtacagggtag

SEQ ID NO: 209545 - DNA, 936 bp, Artificial Sequence
  Description of Artificial Sequence: Synthetic coding sequence
atgggcctgaccctgctgctgctgctgctgctgggcctggagggccagggcatcgttggctccctgccagaagtgcttcaggccccagtgggatcctcaatccttgtacaatgccattacaggttgcaggacgtgaaggcccaaaaagtgtggtgccgctttctgcccgagggttgtcagccgttagtgagttctgcggtggatcggcgggcccccgcgggacggcggacgtttctgacagatttgggaggcggcttgctgcaagttgagatggtgaccctgcaggaagaggacgcaggagaatacggatgcatggtcgacggcgccagaggccctcaaatcctgcatcgggttagccttaacatcttgccccccgaggaggaggaggaaacccataagatcggatcactcgccgagaatgcgttcagcgaccccgctggtagcgctaacccactggagcccagtcaggatgaaaagtctattcccttaatctggggtgccgttttactggtggggctgttggtggctgccgtggtgctgttcgccgtgatggccaagaggaagcaaggcaataggcttggagtatgtggaaggttcctctcatcccgtgtttctggaatgaacccaagctcagtcgtgcaccacgtgagcgatagcggaccagccgctgaattgccacttgacgtccctcatatcaggctggattccccaccttcattcgacaacacaacttatacttccctgccacttgattcaccttccgggaaaccttctctgccagcaccctcctctctcccccctttgcctcctaaagtgctggtgtgcagtaaacccgtgacatacgccactgtgatctttccaggagggaacaaaggcggcggaaccagttgtgggccagcccagaacccaccaaataaccagaccccttcatcttag

SEQ ID NO: 209546 - DNA, 600 bp, Artificial Sequence
  Description of Artificial Sequence: Synthetic coding sequence
atgggcctgaccctgctgctgctgctgctgctgggcctggagggccaaggcattgtaggctcccttccagaggtgttgcaggccccagtgggctcttccatcctggtacagtgtcactacaggttgcaggacgtgaaagcgcagaaagtctggtgcaggttcctgccagagggttgccagcctctggtctcttccgctgttgatcgccgggcacctgctggcaggcgaaccttcctgacagatctcggagggggactgctgcaggtcgagatggtgacgcttcaagaagaagatgctggtgagtacggctgtatggtcgacggggcgcgcgggcctcagatcctccatagggtgagtctgaacattcttcctcctgaagaagaagaagagacccacaagatcggctcattggccgaaaacgccttttctgatcccgccggctccgctaaccctttggaaccttcccaagacgaaaagagcatcccgctgatttggggcgccgtactgcttgttgggctgctcgtcgctgcagtcgtgctgtttgctgtgatggctaagaggaagcaggaaagcttgcttagcggaccaccccgccaatag

SEQ ID NO: 209547 - DNA, 603 bp, Artificial Sequence
  Description of Artificial Sequence: Synthetic coding sequence
atgggcctgaccctgctgctgctgctgctgctgggcctggaggaggaagaggaagagacccacaagattggttctctggccgagaacgccttttctgaccctgcagggagtgcaaacccactggagccgtcccaggacgaaaagtcaattccacttatttggggagcagtgttgcttgtagggctgctggtcgcagccgtggtgctgtttgcagtaatggccaagcgtaaacaagggaacagattaggtgtctgtggcagatttctatccagcagagtgagcggcatgaacccaagctctgtggtccatcacgtgtccgattctgggccagcggccgagcttccacttgatgtgccccacatcagactcgatagcccaccttcgttcgataacacaacttatacctctcttcctttggactcaccaagcggcaagcccagcctgcccgcgccatccagcctgccccccctgccccccaaagtgctggtgtgtagtaaaccagttacttatgctacagttatcttccccggcggaaataaaggagggggaacaagttgcggtcctgcacagaaccctcctaacaatcaaaccccaagttcttag

SEQ ID NO: 209548 - DNA, 966 bp, Artificial Sequence
  Description of Artificial Sequence: Synthetic coding sequence
atggcccccgccttcctgctgctgctgctgctgtggccccagggctgtgttagcgggccaagcgctgattctgtgtacacaaaggtgaggcttctcgaaggcgagactctgagcgtgcagtgtagttataagggatacaaaaacagggttgagggcaaggtgtggtgtaagataagaaaaaaaaagtgtgagcctgggtttgctcgcgtgtgggtaaaagggccccggtatctcttgcaggacgatgcccaagcaaaggtggttaatataaccatggtggccctcaagctacaagatagcggacggtactggtgcatgagaaacacgtccggcatcttatatccccttatgggctttcagttagacgtctctcctgccccacagaccgaacgcaatatcccttttacccacctcgacaacattctcaagagtggtactgttacaacaggccaagcccctacaagcggccctgacgccccgtttaccacgggcgtgatggtgttcactcctgggctgataaccttaccacggcttctggcttctactagaccagcatctaagaccggatattcttttacagctactagcacaacttcacagggcccccgacggacaatggggtcccaaaccgtcacagcctctccttcaaatgcacgcgatagttctgcaggaccagagagtatttctacgaaatccggtgacctgtccactcggtcccccactactggtctgtgcctcacctcacggagccttctgaaccgcctgcctagtatgccgagcattcgtcaccaagatgtttactcaacagtgttaggagttgtgttaacgctgctagtcttgatgctcattatggtgtacggattttggaagaaacgccacatggcctcctactcaatgtgcagtgatccgagtactagggatccaccgggccggcccgagccttacgttgaggtgtacttgatatag

SEQ ID NO: 209549 - DNA, 2562 bp, Artificial Sequence
  Description of Artificial Sequence: Synthetic coding sequence
atgtgctgcgagaagtggagccgggtggccgagatgttcctgttcatcgaagagagggaggattgtaagattctttgcctatgcagtagggcctttgtggaggatagaaagctgtataacctaggtctgaagggatattacatccgagattcaggcaacaattccggggatcaagcaacagaagaggaagagggaggatactcatgcgggaccgccgaatcccatgactcgaaaggaatcgggctcgatgaaagcgagctggattccgaggctgagttgatgcgctccatgggacttccactccagtttgggcgcatcaccgcccacaaagattttgaggtcagtatgaatactcgcaataaggtcaagataaagaaaaagaagcaccagaagaaatatctagatgagatcgtccaggaaagctggcgaaaggaatacgaggaggatgatattctagcatcagacgatccttcatctattgaacaatacgaaaacacaaggacgtacgagttgcagtccaagaaagacactgaaacagaaaacccacccgtggagaacactctgtccccaaagcttgagatcacggagaaatgggaaaaatactggaacgagtacggtgggggcctcctgtggcagtcctggcaggagaagcatcccggccaggcactgagtagtgagccctggaacttccccgataccaaggaggagtgggagcaacattattcacaattgtactggtactacttagagcagttccagtactgggaagcacagggatggacgttcgacgcctctcagtcttgtgatactgacacgtacacctctaagaccgaagccgatgataagaatgacgaaaaatgtatgaaagtcgatctcgtgtcattcccatccagtcccattatggtcgataatgacagctcaggaacttctgacaaggatcattctgaaatcctggacggaatcagcaatattaaactaaatagcgaggaggtgactcagtctcagctggatagctgcacctcacacgatggccaccagcagctgtcagaggtgtcatctaaaagagagtgccccgcttcaggtcagtcagaaccccgcaacggagggacaaatgaggaatccaacagttccggaaataccaacacagatcccccagcggaagacagtcagaagagctcaggcgcgaatactagcaaggatcggccgcatgcctccggcacagacggcgatgagagcgaggaggatcccccagagcacaaaccttcaaaactaaaaagatcccacgagctggatatcgacgaaaatcccgcctctgatttcgacgattcagggtctctgcttggcttcaagtatggatctggccagaagtacgggggcattcccaacttttctcaccgccaggtaagataccttgagaagaacgtgaaactcaaatccaaatacttggatatgcggcggcaaataaaaatgaaaaacaagcacatcttcttcactaaggaatctgagaagcccttctttaagaagtcaaagatcctctccaaagtcgaaaaattcctgacttgggtgaacaagccaatggacgaagaagcttcccaagagtcatcctcacacgataacgtccacgatgccagcacatcttccgattcagaggaacaggatatgagtgtgaaaaagggcgatgacttgcttgaaactaacaacccagaacccgagaagtgccagtctgtgagcagcgccggggagctggagacagagaactatgagcgggacagcctcctggctacagtccccgatgaacaggactgtgtcacccaggaagtgccggatagtcgccaagcggagacagaggctgaagtcaaaaaaaagaaaaataagaaaaagaacaagaaggtgaacggactgccaccagagattgccgccgtccccgagctcgcaaaatactgggcacagagatatagattgttctctcgctttgatgacgggattaaactggacagagaaggctggttctccgttacacccgagaagatcgcggaacatatcgcagggagagtttcgcaatctttcaagtgtgatgtagtcgtagatgcattctgcggcgtcggcggaaacacaattcagttcgccctgacggggatgcgcgtcatagctattgacatcgaccctgtgaaaatcgcattggcccgaaacaacgccgaagtgtacgggatcgctgacaaaatcgaattcatatgcggagatttcttgctgctggcatcatttttgaaagccgacgttgtgttcctctcacctccttggggcggacccgattatgccaccgcagagactttcgatattagaacaatgatgtcccctgatggctttgaaatctttagactcagcaaaaagattactaacaatatcgtgtactttctgccgaggaacgctgatatcgatcaggtggcaagtctggccggcccaggggggcaggtggagattgagcaaaattttctgaacaacaagctgaagactatcacagcgtacttcggcgacctgattaggcggccagccagcgaaacctag

SEQ ID NO: 209550 - DNA, 1266 bp, Artificial Sequence
  Description of Artificial Sequence: Synthetic coding sequence
atgtggtaccaccggctgagccacctgcacagccggctgcaggacctgctgaaaggcggggtgatctatcccgcccttccgcagccaaatttcaagtctcttctccctttagctgtccactggcatcatactgcctccaagagcttgacttgcgcctggcagcaacatgaggatcacttcgagttaaagtatgccaacacggtgatgcgatttgactatgtgtggctcagagatcactgccgcagcgccagctgctataattctaagactcaccagcgatctctggacacagcttctgtagacctctgtattaaaccgaaaaccatccgactggatgaaaccaccctgttcttcacttggccggatgggcatgtgacgaaatacgatcttaattggctcgttaaaaactcctatgaaggccaaaaacaaaaggtaattcagccccgcatactgtggaatgcagagatttatcaacaggctcaggtgccatccgtggactgccagagttttttggagaccaacgagggactcaaaaagttcttgcaaaactttttgttgtacgggatagcttttgttgaaaatgtcccccccacccaggaacacacagagaaactcgccgagcgcatcagtctgattagggagaccatttatggcaggatgtggtatttcacgagcgatttctcccgcggtgacactgcgtacactaagctcgccctagaccggcacaccgatacaacctactttcaagagccatgcggtattcaggtgtttcactgcttaaagcatgaagggaccggcggccggaccttacttgtggatggcttctatgccgccgaacaggttttgcagaaggcccctgaagagttcgaactgttatcgaaggtcccgctgaaacacgagtacattgaggatgtaggggagtgccacaaccacatgataggaattggtcctgtgctgaacatatacccttggaacaaggagttgtatctcatccggtacaataattatgaccgggctgttatcaataccgttccttacgacgtggtccaccggtggtataccgcacatcgaactctcactatcgagctgcgcagaccagaaaacgagttttgggtcaaattgaaacctggacgggtgttgtttatcgacaattggcgcgtgttgcacggtcgagagtgcttcacaggctaccgccagctgtgcggctgctatctcacaagagatgatgtgcttaatacggcgcgcctgttgggcctacaagcctag

SEQ ID NO: 209551 - DNA, 1131 bp, Artificial Sequence
  Description of Artificial Sequence: Synthetic coding sequence
atgtggtaccaccggctgagccacctgcacagccggctgcaggacctgttgaagggcggggtgatctacccagcactgccgcaaccaaacttcaagtcactcttgcctttggccgtgcattggcaccacaccgcgtccaagtccctcacttgtgcatggcagcaacacgaagaccacttcgagctcaagtatgctaacacagtgatgcgatttgattacgtatggcttagagaccattgcagaagcgcttcatgctacaacagcaaaactcatcaacgctcgctagataccgcatcagtggacctgtgtattaaacccaagacaattaggctagacgagacgaccctgtttttcacttggcccgatggccatgtgaccaaatacgacctgaattggctggtcaagaacagttacgaaggccagaagcagaaagttattcagccccgtatcctgtggaacgcagaaatctatcagcaggcgcaagtcccgtcagtggattgccagagcttccttgaaacgaacgagggcctgaagaagttcctgcagaatttccttctgtacggcattgcgtttgtggagaatgtacccccaacccaggaacacactgagaagttggctgaaagaattagcctgatccgagagacgatttatgggcgtatgtggtactttacctccgatttttctcgcggagatacggcttatactaaacttgctcttgatcgccataccgacacaacttactttcaggaaccatgtgggatccaggtgttccattgcttgaagcatgaggggaccggcggccggaccctgctcgtggacggattctacgcagctgaacaggtgttgcagaaagccccagaggagttcgaattactgtcaaaagtgccattgaagcatgaatatatagaagatgtgggcgagtgccataaccacatgatcggcatcggacccgtgctcaatatctatccctggaacaaggaactgtatctaatccgcctgtttaaggaaaagcagaacacagtgaatagacaatggaattcttctctccaatgcgacattcccgagcggatactgacatatcgccacttcgtgtctggaacaagcatagaacaccggggaagcctgatttag

SEQ ID NO: 209552 - DNA, 5889 bp, Artificial Sequence
  Description of Artificial Sequence: Synthetic coding sequence
atgcgggagctggaggccaaggccaccaaggacgtggagcggaacctctccagggatctggtgcaagaggaggaacagctgatggaagaaaagaagaagaagaaagatgataagaaaaagaaggaggctgcacagaaaaaggctactgagcagaagattaaagtgcctgagcagatcaagcccagtgtatctcagccccagcctgccaattccaataacggtacctcaactgccacgtctacaaataacaacgccaaaagagccacagcaaataaccagcagccccagcagcagcagcagcagcaacaaccacagcaacagcaaccacagcaacaaccgcagcctcagcctcagcagcagcagcctcaacaacagcctcaggcactcccaagataccccagggaagtacctcccaggtttaggcaccaggaacataaacagctgttgaaaagggggcagcatttccctgtaattgcggcgaatctggggagcgctgtcaaggtgcttaacagccagagtgaatcttctgcactgacaaaccagcagcctcaaaataatggcgaggtccagaactctaagaatcagagtgatattaaccactccacctccgggtcccactacgagaatagtcaaagggggcctgtatccagcacaagcgactcatccacaaattgtaaaaatgcagtggtctctgacctttcagagaaggaggcctggccaagcgcaccaggatctgaccccgagctggcttcagagtgtatggacgcagattccgccagttcgagtgagagcgaaagaaacatcacaattatggcctctggaaacaccggcggcgaaaaggacggtcttcggaattctaccggtctgggatcgcagaacaaattcgttgtgggatcgtcctcaaataatgttgggcacgggtcctctaccgggccatggggcttcagccacggagcaattatctcaacttgccaggtcagtgtggatgctcccgagtccaagtctgagagcagcaataataggatgaacgcttggggaacggtgtcttcctcgtcgaatggaggcctgaacccgagtacccttaactccgcctcaaaccatggagcctggccagtgttggagaacaatggcttagccttgaagggaccagtgggttctggcagctcaggtatcaacatccagtgtagcactatcggccagatgccaaataaccagtcaatcaactcgaaagtgtcgggagggagcacccacgggacgtgggggtcactccaagagacctgtgagagcgaagtctctggaactcagaaagtctccttctccgggcagcctcagaacataactaccgaaatgaccggtccgaacaacacaaccaatttcatgacatcatcactgccgaactccggatcagttcagaacaatgaacttcccagttcgaatacaggagcctggagagtgagcacaatgaatcaccctcaaatgcaggcaccgagcggaatgaatggtacatccttgtctcatctgtcaaatggtgagagcaaaagcggcggaagctacggcaccacatggggagcctacgggtctaattatagcggcgataagtgctctggaccaaatggacaggcaaacggagatacagtgaacgctaccctgatgcaacccggtgtaaacggacctatgggtacgaactttcaggtgaacactaataagggcggaggcgtgtgggagagcggggctgccaattcgcaatcaacgtcatgggggtccggtaatggagcaaactccggcggcagccgccggggctggggaaccccagcccaaaataccggaacgaatctcccaagtgtcgagtggaataaactgccttcaaaccaacattccaatgatagtgccaatggcaatggtaagactttcactaatgggtggaagagtacagaggaggaagaccagggctctgcaacctcccagaccaatgagcagtcctcggtatgggccaagacaggcggtacggtcgaaagcgatggatctactgaatccacgggcagactagaagaaaagggtactggtgagtcacagtccagggacagaagaaaaattgatcagcacaccttgctgcaaagtatcgtgaatcgcactgatttggacccgagggtactcagcaattccggatgggggcagacaccaatcaagcagaatactgcctgggacaccgaaaccagcccacgcggcgagaggaaaacagataacggcaccgaagcctggggatcatcagccacgcagacatttaacagtggggcatgtatcgacaagacctctccgaatggcaatgatacatctagtgtctcagggtggggagatccgaaacccgctctgcggtggggggacagtaaaggaagcaattgtcaagggggctgggaagatgattctgctgccactggcatggttaagtcaaaccaatggggtaactgcaaagaagaaaaagctgcgtggaacgatagtcaaaagaataagcagggatggggcgacggccagaaaagctctcagggatggagtgtttcggcttccgacaactggggcgaaacctcccgcaataatcattggggcgaggctaataagaaatcttcatccggaggtagcgattccgaccgcagtgtgtctggttggaatgaactgggcaaaacaagctcttttacttggggcaataatattaatccaaacaattcctctggatgggacgaatcatccaagcccaccccttctcagggttggggggatccccctaaaagcaaccagagcctagggtggggggactcctctaaaccagtgtcgtccccagactggaacaaacaacaggatatcgtgggttcctggggaattccacccgctacggggaagccacctgggacaggttggctgggcggtcccatccccgctcccgcaaaggaggaagaaccaaccggatgggaggagccttctcccgaaagtatacgacgtaaaatggaaatcgacgacgggactagtgcgtggggcgatccatctaagtacaactataaaaacgttaacatgtggaacaagaacgtgcccaacggcaattcccggagtgaccagcaggcccaagtgcatcagctcctgacccccgcaagcgcgatatcaaataaggaagcttcatccggctcaggatggggcgaaccttggggggagcccagcacgcccgctaccacagttgacaatggaacgtccgcctggggcaaaccaatcgattccggcccctcctggggagagccaattgcggctgctagcagcacctccacctggggatccagcagtgtgggccctcaagccttaagtaagtctggtccaaagagcatgcaggacggttggtgcggcgatgacatgccgctgcccgggaacaggcctactggctgggaggaagaagaagacgtcgagattgggatgtggaactctaatagcagtcaagagctgaattcttcgcttaattggcctccctataccaagaaaatgagttctaagggattatctggtaagaaaagacgtcgagagcgcgggatgatgaagggtggcaataagcaggaagaagcttggattaacccctttgtcaagcagttcagtaacatctccttctctcgcgattccccagaggagaacgtgcaaagtaataaaatggatctcagtgggggcatgttacaggataaacggatggagatcgacaagcacagcttgaatataggagactataatcgcactgtagggaaaggtccagggagccggcctcagatctcaaaagagtcttccatggagcgaaatccgtactttgacaaggacgggattgtggctgatgaaagtcagaacatgcagttcatgtcaagccagagcatgaaactgcccccttcaaacagcgccctgcccaaccaagctctgggaagcatcgccgggctgggcatgcagaacttgaattccgtgagacaaaatgggaacccctctatgttcggggtgggcaacaccgccgcccagcccagaggaatgcagcagccacctgcacagcctctgagctctagccagcctaacctgcgggcccaagttccgccaccactactgtctccccaagtgccagtcagcctgctcaaatacgcccccaataatggaggcctgaatcctttgttcggcccccaacaggtggctatgctcaatcagctgagccagctaaatcagctctcgcagatctcccaacttcagcgcttactggctcagcagcaacgtgcacagtcacagcgctcggtgccctcagggaaccgcccccagcaggatcagcagggcaggccactgagcgttcagcagcagatgatgcagcagtcacgccagctggaccccaatttgcttgtgaaacagcagacccccccgtcccagcagcagcctctgcatcagcctgcgatgaaatctttcctcgacaacgtgatgccacacacaactcctgagctgcagaagggcccaagccccatcaacgccttcagcaactttcccattggcttgaattcaaacctgaacgtgaatatggatatgaacagcatcaaagagccccagtcccgcctgagaaagtggacgaccgtcgactcaatcagcgtgaatacaagtttggaccagaatagctccaagcatggagctatcagcagtggattccgcctggaagaatcgccctttgtgccgtatgactttatgaacagcagcacgtctccggcctctcccccgggtagtatcggagatgggtggccgcgggctaagtctcccaacggctcttcttcggtgaattggcctcctgagttcaggcctggcgagccttggaaagggtacccaaacattgacccggagactgacccatacgtgacccccggtagcgtgatcaataacctaagcatcaacaccgtgagggaagtcgaccatttacgagaccgcaactctggaagttcatccagcctgaatacaacattgccatccacttctgcctggtcgtccatccgcgccagcaattataatgtccctctcagcagtacagctcagagcacatccgcccgcaactctgatagtaaacttacctggtctcctggctcagttaccaacacatcactagcacacgagctgtggaaagtgcccttgcctcctaagaatattacagcccctagtaggccccctcccggactgacgggccagaaaccgccactcagtacttgggataactcccctcttagaatcggaggcggatggggcaatagcgacgctaggtacactcccgggtcctcctggggagagtccagttccggccggatcactaattggctcgtactgaagaatcttaccccacagattgacggaagtaccctgcgcaccctctgcatgcagcacgggccactaatcacctttcacctgaatctgccacatggcaatgctctagttagatactcatccaaggaggaggtggtcaaggcacagaagagtctacacatgtgtgtgcttgggaacactactatcctggctgagttcgcctctgaggaggaaatttccagattcttcgcccagagccagtccttgacgccatcgccgggctggcagagcctggggtcttcccagagccgcttgggttcactggactgctcccactctttcagctcgcggactgacttgaatcactggaacggggccggactgtctgggactaactgcggcgacttgcacggcactagtttgtgggggaccccgcactatagtacatcactttggggacctccatcttcttctgacccccgtggtatttccagtccctcaccaatcaatgcattcctgagcgtggaccacctgggaggaggtggcgaatccatgtag

SEQ ID NO: 209553 - DNA, 1323 bp, Artificial Sequence
  Description of Artificial Sequence: Synthetic coding sequence
atggacatgaacagcatcaaggagccccagagccggctgcggaagtggaccacagtggacagtatcagcgttaacacgtctttggatcagaactccagtaaacacggtgctatcagcagtggcttccggctggaggagtcaccctttgttccctatgacttcatgaactcgagcacttccccggccagtcctcctggaagcattggtgatggctggccccgcgccaagtctccaaacggatctagctctgtgaattggccacccgaattccgtccaggtgaaccgtggaagggctatccgaacatagaccccgaaacggatccatacgtgacccccggaagcgtgatcaacaatctgagtattaacaccgttagggaggtggaccacctccgcgatagaaacagtggatcttcctcgagcctgaatacaaccttaccatctacgtcagcgtggtctagcattcgtgcctctaactacaatgtgccgctctccagtaccgcacagagtactagcgctaggaatagcgactccaaacttacatggagcccaggatctgtgacaaatacatccctggcccatgagctgtggaaggtccccctcccacccaagaacataacggccccttcgaggccccctcctggattgaccggacaaaagcctcctctttctacgtgggataacagtccactccgtatcggaggtggctggggcaactctgacgcacgctacacaccaggttctagctggggggagtcctctagtggtaggatcaccaactggctcgttttgaagaacctgacccctcagattgacggatctacgctgaggacgttgtgcatgcagcacgggcccctgatcacattccacctaaatcttcctcacggaaacgcactggtgcgctatagctcgaaggaagaggtggtaaaggcacagaaatctcttcatatgtgtgtgctcgggaacacaaccatcctggccgagttcgctagtgaagaggagatctcaagatttttcgcccagtctcagtctctgacccctagtcctggctggcagtccctgggatcgtctcagtccaggctgggaagtttagattgttcccacagtttcagctctcggacagatctcaaccactggaatggggccggccttagcggtacaaactgcggggacctgcacggcaccagtttatgggggaccccccattatagcacaagtctgtggggcccgccctcaagcagcgacccaaggggcatttcgagccctagtccaatcaatgcctttctcagtgtggatcaccttgggggcggcggggaatcaatgtag

SEQ ID NO: 209554 - DNA, 5073 bp, Artificial Sequence
  Description of Artificial Sequence: Synthetic coding sequence
atggccaccggcagcgcccagggcaacttcaccggccacaccaagaagaccaacgggaataatggaaccaacggggccttagtgcagtccccatcgaatcagagcgctctcggcgcaggcggcgccaactccaatgggtctgcagctcgggtgtggggagttgccacagggagttcctcggggttggcccactgcagcgtatctggaggagacgggaaaatggacaccatgatcggggacggacgatctcagaactgttggggagcatcgaactctaacgctggaattaatctcaatctgaaccctaacgcgaatccagccgcgtggcccgtgctcggtcacgaggggaccgtcgcaacaggcaacccctcttccatttgctctccggtgagcgccattggtcaaaatatgggcaatcagaacggcaaccctaccggtactctcggagcctgggggaatctgctgccccaggagtccactgaacctcagaccagtaccagccagaacgtgagcttttccgctcagccacagaatctcaatactgatggcccaaacaacactaatcccatgaacagtagtcccaaccccattaatgccatgcagaccaacggcttgccaaattggggcatggccgtgggtatgggggcaattattcccccacatctgcagggcttgccgggcgccaacggcagcagcgtaagtcaggtgagcggcgggtcagccgagggtatctcaaattcagtctggggattgtcacccggcaacccagctacagggaatagcaactcaggattctcacaagggaatggcgacaccgtcaattctgcactgagcgctaaacagaacggctctagctctgccgtgcagaaggagggatccggcggcaatgcatgggatagtgggcctccagccggacccggaatacttgcttggggcagggggtccggcaataatggagtcggcaacatccatagcggagcctggggacacccttcaagatctactagtaacggagtgaacggtgagtgggggaagccaccaaatcagcacagtaactccgacatcaatggaaaaggatccacaggttgggaatccccctcggtgacttcccagaatcctaccgtgcaacctggcggtgagcacatgaatagctgggccaaggccgcaagctccgggacaaccgcctctgagggctcctccgacgggagcggcaaccataacgaaggatccacaggcagggaaggaactggagaagggcgacgacgggataagggaatcatcgaccagggccatattcagctacctaggaacgatttggacccccgtgtgttgagcaacaccggctggggacagactcctgtcaagcagaacacagcttgggaattcgaggagtcaccgcgctccgagcggaagaacgacaatgggacggaggcgtggggttgcgcagccacacaggccagcaattcggggggaaagaatgacggctcaataatgaattcgactaataccagttccgtgtcagggtgggtgaatgcacctcctgccgccgtgcccgctaacaccggctggggggatagcaacaacaaagccccaagcggccccggcgtttggggcgacagcatttcatctaccgccgtctcaacagcagcagctgctaagtccggacacgcttggtccggcgccgccaaccaggaggacaagagtcccacttggggggaaccacccaagccgaaatcgcagcactggggtgatggacagagatcaaaccccgcttggtctgcaggaggaggagactgggctgacagctcatcggtactcggccatctgggagacgggaagaagaacggatccggttgggatgcggacagtaacagatccgggtccggctggaacgataccactcgctctggaaactctggctggggcaatagcaccaacaccaaagccaacccaggaaccaactggggtgagacccttaagccaggacctcagcaaaactgggcatcaaaacctcaggataataatgtgtccaattggggcggcgccgcatccgtaaagcagaccggcactgggtggattgggggcccggtcccagtgaagcagaaagatagcagcgaggcaaccggctgggaggagccctccccaccctccattcggcgtaagatggagatcgacgacggcacctctgcatggggcgacccttccaattacaacaataaaactgtgaacatgtgggaccgcaataaccctgttatccagagttcgacaacgaccaataccaccacgaccacaaccaccaccacatcaaatacaacacatcgcgttgaaaccccccccccccaccaggcaggaactcagctgaatcggagcccactgctgggacccggtcgcaaagtaagcagcggctggggcgagatgcccaatgtgcatagtaagacagagaactcttggggcgagcctagcagcccatccaccctggtcgacaacggcaccgcagcctgggggaagccaccctcctctggcagtggatggggcgaccatcctgccgaaccaccagtggccttcggcagggctggggccccggtggcagcgagcgcactgtgtaagccagcctccaaatctatgcaggaaggctgggggagcgggggggacgagatgaatctttcgactagtcagtgggaagacgaggagggggatgtttggaacaatgctgcctctcaggagagtacctctagctgttcaagctggggcaatgcgcccaagaaaggcctgcagaaggggatgaagacatctggcaagcaagatgaggcctggatcatgtctaggctgattaagcagttgaccgacatgggttttccgcgagaacccgctgaagaagccctgaagagtaacaacatgaatcttgatcaggctatgagcgcgctcctggagaagaaagtggacgttgacaagagaggcctcggagtgacagatcataacggtatggcagctaagccactagggtgccggcctcctatctccaaggaatcctctgtcgaccgaccgacgtttttagacaaggacggcggacttgtcgaggagcctacaccctcaccttttctgccctcaccaagcttaaaactccccctttctcattcagccttaccctcccaggctctgggtggaatcgcttcaggcctaggcatgcaaaatttgaatagctctaggcagatccctagcgggaatctgggcatgtttggcaactccggcgcggctcaagcccgcactatgcagcagccaccccagcctcctgtacaacccctgaattcgtcccagcccagcttgcgggctcaggtcccccagtttctgagcccccaggtgcaagctcaactgctccagttcgccgctaagaacattgggctgaatccggccttactcacatctcccatcaatccacagcacatgaccatgcttaatcaactgtatcagttgcagctggcataccagaggctgcagatccaacagcagatgctacaggctcagaggaacgttagcggttccatgcgacagcaggagcaacaagtggcccgcacgatcacaaacctccaacagcaaatccagcagcaccaaaggcagctggctcaggctcttctcgtgaaacagcctcccccgcctcctcctcctccccacctcagcttgcatccaagcgccgggaaatcggctatggattccttcccctctcaccctcagacacccggactgcccgacctccagacgaaagagcagcagtcttcaccaaacaccttcgccccttatccactggccggcttgaatcctaacatgaacgtgaattctatggacatgacagggggtctgtccgtcaaagacccttcacagtctcagtctcggctcccacagtggacacacccaaattccatggacaacttgcccagtgcagcttcaccgctggagcagaatcctagtaagcacggggccatacctgggggcctctctatcgggccgccgggcaagagtagcatcgacgatagctacggcagatatgatcttatccagaatagtgaaagtcccgcctccccccccgtcgccgtcccgcattcttggagtagagcaaaatccgattccgataagatttccaacggatccagcatcaactggccacctgagttccacccaggtgtgccttggaaggggctacagaatatcgatcccgagaacgatcctgatgtcacccctggatccgtgcctaccgggcccacaataaacacaactattcaggacgtgaatcgatatttactgaagagtggcggaaaactgtccgatatcaaaagcacatggagctccggtccaacgagccatacccaggcgagcctgtctcatgagctttggaaggtcccgcggaattcaaccgctccaacacgcccacccccaggtctgacaaacccgaaacccagttcgacctggggggcatccccacttggctggacctcttcgtacagctccggttcggcgtggtccactgatacttccgggcgaacgtcttcctggttggtactgcgtaacttgacccctcaaattgatggaagcactctccgtactctttgtctccagcacggcccactcataacattccacctcaacctgactcaagggaatgcggttgtgaggtattcttcgaaagaggaagccgccaaggctcagaagagtcttcacatgtgcgtgctgggcaacacaactatcctcgctgaatttgccggagaggaggaggtgaatcgattcttggcccaagggcaggcccttccgcctacttcttcatggcagtccagctcagcctcatcacagcctagactgtcagcggccggtagctctcatggcctcgttcgctcagatgccggacactggaacgccccttgcctgggggggaaaggcagttccgaattactgtggggtggggtcccgcagtattcgtctagcctctggggcccgccatccgccgatgactcaagagtgatcggatccccgacccccctgaccacactgctaccaggcgatcttctgtcgggggagtccctgtag

SEQ ID NO: 209555 - DNA, 5181 bp, Artificial Sequence
  Description of Artificial Sequence: Synthetic coding sequence
atggccaccggcagcgcccagggcaacttcaccggccacaccaagaagacaaacggcaacaacggaacaaacggtgctctggtgcagtcacccagtaaccagtccgcactgggagccgggggagccaattcaaacggctccgccgcccgcgtttggggggtggccacgggatcatcaagtgggttggcccactgctcagtgagtggaggggatggaaagatggacactatgattggcgatggacgctcccagaactgttggggagcaagcaattctaatgctggaattaacctcaaccttaaccctaatgccaacccggctgcatggccagtgctcggccatgagggcacggtcgccactgggaatccctcttcaatctgttcccccgtcagcgctatcggccagaacatggggaaccagaatggcaatcccaccggaaccctgggagcatgggggaacttgctgccacaggagtctaccgaaccacagacttctaccagccagaacgtctcgtttagcgctcagcctcagaatctcaatactgacgggcctaacaacactaaccccatgaatagttcaccaaacccaattaatgcaatgcagaccaacggtctgcccaactggggcatggctgtgggcatgggtgctataataccacctcacctccagggtttgcctggagccaacggatcgtctgtctctcaggtcagcggaggcagcgcagaagggatatccaacagcgtgtgggggctgtcgcctggaaacccagccaccggcaatagtaacagtggcttttcacagggaaatggcgacactgtgaactccgcactctctgccaaacagaatgggtcttcttccgccgtacagaaggaaggcagtgggggcaacgcctgggactctggcccacctgctgggcctgggatacttgcctggggcagaggaagcggcaacaatggcgtgggtaatatccacagtggtgcttgggggcaccccagccggagtacttctaatggcgtcaacggggagtggggaaaaccaccgaaccaacacagtaactctgacataaacgggaaaggctctactggatgggaatctccgagcgtgacttctcagaatcctactgtacagcctgggggcgaacacatgaattcctgggcaaaggccgcaagttccgggaccaccgcatcagagggttcctcggacggcagtggaaaccacaatgaggggtctactggaagagagggaactggcgaaggaaggagaagagacaagggtattattgatcagggccatattcagctcccgagaaatgacctggaccctcgggtgctatccaacacgggatgggggcagacgccggtgaaacagaacacagcgtgggagttcgaggagtctccccggtcagagcggaagaatgataatggtacagaggcctgggggtgcgcagcgacccaggcatccaatagcggggggaagaatgacgggtcaattatgaatagcactaatacttccagtgtcagcggctgggtgaatgcccctcctgctgcagtgcccgcaaatactgggtggggggatagtaacaacaaggcgcccagcggcccaggcgtctggggcgattccatttcctctactgccgtgtcgaccgcagcggcggccaaaagcggccacgcctggtccggggctgccaaccaggaggacaagtctcccacatggggggagccgcccaagcccaaaagccagcattggggcgacgggcagagaagtaatccggcatggtccgccggaggaggcgattgggccgactcctcctcagtcctgggccacttaggtgacggcaaaaagaatggctcaggatgggacgctgacagtaatcggtcagggtctgggtggaatgacacaaccaggtcagggaatagcggctggggcaatagcacaaatacaaaagcaaatcctgggacgaattggggcgaaactctgaagccagggccgcagcagaactgggcgtctaaacctcaggataataacgtatcgaactggggaggggcggctagtgtgaaacagacaggtaccgggtggattggcggacccgtcccagtaaaacagaaggattcctccgaggccacaggatgggaagagccatctcctccaagcatccgacggaagatggaaatagacgacggtactagcgcctggggcgacccttccaactataataacaaaaccgtcaatatgtgggaccgtaataatcctgtcatccagagttccacaacgacaaatacaaccactacaacaacgaccactacatccaataccacacatagggttgagacccctccccctcaccaagcaggcactcagctcaatcgtagccccctgcttggccctgtgagtagcggctggggcgagatgcctaacgtccactccaaaaccgagaacagctggggcgagccaagttccccctcaactttggtggacaatggaacggctgcatgggggaaacctcctagctccggctctggctggggggatcaccccgccgagcccccggtcgcttttggccgagctggcgcacccgttgctgccagtgccctatgcaaacccgccagtaagtcaatgcaagagggatggggctccggaggggacgaaatgaacctttccacctcccaatgggaagatgaggaaggtgacgtctggaataacgccgcctctcaagaaagtacctccagttgttcttcctggggtaacgctccaaaaaaggggttgcagaaaggcatgaagacctcaggcaagcaggacgaggcatggattatgtctagacttatcaaacaactgacagacatggggtttcctagggaacccgctgaagaggcattaaagagtaataatatgaatctggatcaagcaatgagcgccctcttggagaagaaagtggatgtagataagaggggcctgggagtgacagatcacaacggtatggctgccaaacctctcggctgcaggcctccgatatccaaggagtcctcagtggaccgtcccacatttctggataaggatgggggattggtggaggagccgactccctctccatttctgccttcaccatccctgaaactgccactgtcgcacagcgccttaccctcgcaggccctgggcggtatcgccagcgggctgggaatgcagaatctgaacagttccaggcaaatcccgtcaggtaacctggggatgttcggtaattcgggcgccgcccaggccagaaccatgcagcagccgccacagcctccagtgcaaccattgaattccagccagcctagcctgagagcccaagttccgcaatttctgtcaccacaggtgcaggcccagctactccagtttgccgcaaagaatatagggctcaaccctgccctgcttacatcgcccattaatccgcagcatatgaccatgctaaatcagctctatcagctgcaacttgcctatcagagattgcagatccagcaacaaatgctgcaggcccagcgcaatgtcagtggatccatgcggcagcaagagcaacaggttgctcggactataacgaacctgcagcagcagatccagcaacatcagcgacagcttgctcaggcacttctggtcaaacaaccaccacctcctccgccgccaccgcatctgagtctgcacccctctgccgggaaaagcgccatggactccttccccagccacccacagaccccaggtctaccggacctgcagactaaggaacaacagagcagccctaatacttttgcaccctatcccctggctgggcttaatccaaatatgaacgttaacagcatggatatgacaggtgggctctctgtgaaagaccccagtcagtcccagagccggctccctcagtggacgcaccctaacagtatggacaatctcccatccgctgcctcccctctagagcagaacccgtcaaagcatggcgcaattccaggcggcctctccatcggcccacctggaaagtcatctatcgacgacagttatgggaggtacgatctgattcagaatagtgaatctcccgcctcacccccggtggctgtcccacactcctggagcagggccaaatcagattctgataaaatttctaacggcagctctattaattggcctccagagtttcaccccggcgtcccttggaaaggcctccagaacatcgaccccgagaatgatccagacgttacgccaggcagcgttccaacaggccccacaattaacaccaccatccaagacgtcaacagatacctgctaaaatcagggggctccagtccccccagctcgcaaaacgctacattgcctagctcgagtgcctggcctctctccgcaagcggttatagtagcagcttcagcagtatagcctccgctccttccgtcgcagggaaactaagcgacatcaagtcaacgtggagtagtggaccaacctcacatacacaagcaagtttaagtcatgagctttggaaggtccctcgcaattctaccgcacctactagacccccacccggccttaccaatcctaagccttcttcaacttggggcgcaagtcctttagggtggaccagtagctattcgtctggatctgcatggtcaacagatacttctggcaggacgtctagctggctagtgctgcgcaatctaactccccagatcgacggctcgaccctgcgaaccttatgtctacaacacggtccattgatcacctttcacctgaatctgactcaaggaaacgctgtcgtgaggtactcgagtaaagaggaagctgcaaaggcacagaagagcttgcacatgtgtgtgctggggaatacaactatcttggccgaatttgctggtgaagaagaggtgaatcgtttcctcgcccaaggacaggccctcccgccaactagttcctggcagtcatcgtccgccagctctcaaccacgactatccgctgccgggtcctcccacggtctggtacgctccgatgccggccactggaacgccccttgtctcggcggtaagggttcatcggagttgctgtggggaggagtcccacaatatagttcaagtctgtgggggccgccctctgccgatgattcaagagtgatcggttctcccacccccttaaccacactcctgcctggagacttgctttctggcgaatctctgtag

SEQ ID NO: 209556 - DNA, 5181 bp, Artificial Sequence
  Description of Artificial Sequence: Synthetic coding sequence
atggccaccggcagcgcccagggcaacttcaccggccacaccaagaagaccaatggcaataatggcacgaacggtgccctggtgcagagtccttcaaatcaaagtgccttgggcgccgggggtgcaaactctaacggatccgctgccagagtatggggggtggctacaggctcttcctcaggcttggcacattgcagtgtgtctggcggcgatgggaagatggatactatgattggagatggacgctcccagaattgttggggtgcgtcaaacagcaatgcagggatcaatttaaatctaaacccgaatgcaaaccctgccgcctggccagtcttggggcatgaggggactgttgccaccggaaacccttcgagcatctgtagccccgtctctgccattggacagaatatgggaaaccagaatggaaaccctaccggcactctaggagcgtgggggaatcttttgcctcaagaatctactgagcctcagacaagcacttcacagaacgtgagcttcagcgcacaaccccaaaacctgaacacagacggacccaataacaccaatcccatgaattcatcccctaacccaatcaatgcaatgcagacaaatggactacctaattggggcatggctgtgggtatgggagccattatacctccccatttacagggccttccgggcgctaatggttcaagtgtgtcccaggtcagcggtggaagtgccgaggggatctccaacagcgtctggggtcttagcccaggcaaccctgccaccgggaacagcaattctggattctcacagggtaacggcgatacagtgaattctgctttaagcgctaagcaaaacgggtccagctccgcggtccagaaggaaggaagtggcgggaacgcctgggattcagggcccccagccggccccggaatcctcgcctggggtcgcggcagcggcaataacggtgtggggaatatacatagtggggcatggggtcatccttcacggtctacttccaatggggtcaatggtgagtggggaaaaccccccaatcagcactctaatagcgacatcaatggtaaaggatctacaggttgggaatcccctagcgttacatcacagaacccaacggtgcagcccgggggcgagcatatgaactcctgggccaaggctgcatcgagtgggaccacagcttctgaaggctccagtgatggcagcggtaaccacaatgaagggtccacaggaagggaaggcacaggagaaggacgcaggcgagacaagggcattatagatcagggccacatccagctgccccggaatgacctggacccccgtgtcctttctaacactggatggggccagacaccggtcaaacaaaataccgcttgggagtttgaagaaagccctcgctcagaacggaagaatgataacggaactgaggcctggggatgcgcggccacacaggcaagtaattctggaggcaaaaacgacggatcgatcatgaattcaaccaacacctctagcgtttcagggtgggtgaatgctccccccgccgctgtaccagcaaacacaggctggggcgacagtaataacaaagctccatccggccctggagtatggggggacagtatcagcagcaccgccgttagcaccgcggccgcagccaaatctggtcacgcctggtcgggcgccgcgaatcaggaagataaatcacctacatggggcgaaccaccgaaacctaagtcccagcactggggcgatgggcagaggtccaacccagcttggagcgcaggcggaggagattgggctgatagtagctccgttttggggcacttaggagacggcaagaagaacgggtcaggctgggacgctgatagcaacagaagtggaagcggatggaacgacacaactaggtcaggcaactccggatggggcaactccactaataccaaagcaaatcccggcaccaattggggtgagacccttaagccagggccacagcagaattgggcctcgaaaccgcaggacaataacgtcagtaactggggtggcgcggcctccgtaaaacagaccggtaccggatggatcggcgggcccgtgccagtgaaacagaaagatagttcggaggccaccggatgggaagagccttcacctccctcaatccggagaaagatggagatagatgatggcacgagtgcttggggtgacccatctaattacaacaataagactgtgaacatgtgggatcgtaacaaccccgtaattcagagtagcacaaccacaaatacaaccaccaccaccaccacgactacttctaacaccacacaccgagtcgaaacgcctccccctcaccaggccggtacacaactcaacaggagccccctgctcgggccggtgtcttcgggatggggagaaatgccaaacgtgcacagcaaaactgaaaactcgtggggcgaaccttcaagccccagtaccctggtggataatggaacagccgcctgggggaaacctccatcttctggctccggatggggagaccaccccgccgagcctccagtggcctttggacgtgcgggagcgcctgtggccgcctctgctttatgtaagccagcctccaagtcgatgcaggaggggtggggtagtggaggggacgaaatgaatttatccaccagccagtgggaagacgaagaaggagacgtttggaacaacgcagcgagccaagagagcaccagcagctgcagctcttggggcaacgctccgaagaaagggctacagaagggcatgaaaacctccggtaagcaagatgaagcatggataatgagccgcctcatcaaacagttaaccgatatggggttcccgagagagcctgccgaagaagcgctcaaatctaataatatgaacctcgaccaagcgatgagcgctctgctggaaaagaaggtagatgtggacaaacgggggctcggggtgaccgaccataacgggatggcggcaaaacctctgggctgtaggcccccaattagcaaggagtcatcagttgaccgacctaccttcttggataaggatggcggactggttgaagaacctactccatctccattcctcccctctccaagcctcaaattgcctctgtcacatagtgccctaccttcgcaggccctgggaggcatagcctccgggctcggtatgcagaatcttaactcatcaagacagatccctagcggaaaccttggcatgttcgggaattccggggcagctcaggctagaactatgcaacagcctcctcaaccccccgtccagcccctgaatagttcccagccaagcctccgtgctcaggtcccacaatttctgtcaccgcaggttcaggcccagttactgcagtttgccgcgaaaaacatcgggctgaacccagccctgctgacttctccgatcaacccacaacacatgacaatgcttaaccagctgtatcagcttcagctagcgtatcaacgactgcagatccagcagcagatgttgcaggcccagaggaacgtaagtggatccatgaggcaacaggaacaacaggtggccaggaccatcaccaacttacaacaacaaatacaacaacaccagcgacaactggctcaggcactcctcgtcaagcagccaccgccgcccccaccacctcctcacttaagtctgcacccaagcgctggaaaatccgccatggacagctttccctcgcatccccagactcccggcctcccggaccttcagactaaagagcagcaatctagccctaacacctttgccccatatccattggcgggcctgaatcctaacatgaacgtgaattccatggacatgacagggggcctgagcgttaaggatcccagccaatcacagagcaggctgcctcaatggacccacccaaacagcatggacaacctgccttcagccgcgtcacctctggaacagaatcctagtaagcacggggccattcccggaggcctttccatcgggcccccaggaaaatcttcaatcgatgactcatacgggaggtacgatctcatccagaactctgaaagtcccgcttccccgccggtggccgtacctcactcttggtcacgagccaaatccgactctgataaaatttcaaacgggtctagcattaattggccaccggaatttcatcctggagttccatggaaaggcctgcagaacatcgatcctgagaacgatcctgacgtcacaccagggtcagtccccacgggccccaccataaatactacaatccaagacgtcaataggtacctcctaaaatcggggggatcctcacccccatcatcccagaacgcgacactcccatcatcctcagcctggcccctgtcagcttctgggtactcaagcagtttctcatcaattgcttcagctccctccgtggctgggaagcttagcgatatcaaatccacatggtccagcgggcctacatctcacacccaggccagcttaagccatgagctttggaaagtgccacgcaactccacagcccctacaaggccaccacccgggcttacaaatcccaaaccatcctcgacgtggggcgcttcacctttagggtggaccagttcatactcttccggttccgcatggagtaccgacacttctggccgcacttcctcctggcttgtactcagaaatctcactccacagatagacggcagcactttacgcactctgtgcctccagcacggcccactcattacattccacctgaacctgacacagggtaacgcagtcgtgagatattcttctaaagaagaggccgcgaaagctcaaaagagcctgcatatgtgcgtgttgggaaacaccactatactcgctgagtttgccggtgaggaagaggtgaaccgcttcctcgctcagggccaggccttgccccccaccagctcctggcaatcctcatccgcctcctcccagccacgattgtcagccgcaggaagttctcacggcttggttagatctgacgccgggcactggaacgcaccttgtttgggtggcaaggggtcatccgagctgctgtggggcggggtgccccagtattcgtcctcactttggggacctccaagcgccgatgacagccgggtgatcgggagcccaaccccactgaccacactcctgccaggagaccttctcagcggagagtcattgtag

SEQ ID NO: 209557 - DNA, 5073 bp, Artificial Sequence
  Description of Artificial Sequence: Synthetic coding sequence
atggccaccggcagcgcccagggcaacttcaccggccacaccaagaagacaaacgggaataatggtacaaatggcgctctggtgcagtctccgtccaatcaaagtgcgttgggcgcgggcggagctaatagtaatggtagcgccgcccgagtgtggggggtggctaccggctcctcttcagggttggcccattgctctgtaagcggaggcgacggcaagatggataccatgattggtgatggcaggtcgcagaactgctggggagccagcaactccaacgccggcattaacctaaatctgaaccccaatgccaatcctgccgcgtggcccgtgcttgggcatgagggcacagtagcaaccggaaacccttcgagcatctgcagtcctgtgagcgcaatcgggcagaatatgggaaatcagaatggaaatccaaccgggacgctaggagcttggggaaatctgctgccacaggagtctacagagcctcaaacgtctacttcccagaacgtaagtttctcggctcagcctcagaacctgaataccgatggtccaaacaacaccaatccaatgaattcctcccccaacccaattaatgccatgcaaactaacggactgcccaattggggtatggctgttggcatgggcgcaatcatcccgccgcacctacagggcttgccaggggccaacggcagctctgttagccaggtgagcggcggctccgcggagggcatctccaattcagtctggggattaagtcccggaaatcctgctaccggcaacagcaattcaggctttagtcagggtaatggtgatacagtaaacagtgccctttccgccaagcaaaacgggtcatcatccgccgtccaaaaggagggcagcggggggaacgcatgggatagcggtcccccagcgggacctggtatcctggcttgggggagaggatcaggcaacaatggggtggggaacatccacagtggcgcctggggccacccttctcgttcgacaagcaacggggtgaatggcgaatggggcaaaccacccaatcagcatagtaatagcgacatcaatggaaagggaagcaccggttgggagtccccgagcgttacctcgcagaatcctacggtccaacccggtggcgagcacatgaactcctgggccaaggccgccagtagcgggactacagcatctgagggaagctctgatggctccgggaaccataacgaagggtccaccgggcgcgaggggaccggtgaagggcgccgaagagacaagggtatcattgaccaaggacacattcagctgccccgcaatgatctggaccccagagtgcttagtaacaccggctggggccagactcctgtgaagcagaatactgcttgggagtttgaggaaagcccacgtagtgaacgtaaaaacgataacggcactgaggcgtggggatgtgccgcaacccaggccagcaactccggaggcaagaacgatggcagtatcatgaactccacgaacaccagttctgtgtctggctgggtgaacgccccacctgctgccgtaccagccaacacagggtggggcgattcgaacaacaaagcgcccagcggccccggagtgtggggagacagcataagcagtactgctgtgtcaaccgccgccgctgctaagagcggacacgcctggtcaggtgcagcgaaccaagaagacaaaagccccacttggggtgaacctcctaagccaaagtctcaacattggggggatggtcagaggagcaacccggcttggtcagccggcggcggcgactgggcagattctagcagcgttttgggccatctgggtgacgggaaaaaaaatggctccggatgggatgccgactcgaatcggtccgggagcggttggaatgatactacaagatcaggcaactcaggctggggcaattctaccaacactaaggccaatcctggtacgaattggggagagacactgaagcccggcccccagcagaactgggcctccaagccacaagacaacaacgtatctaactggggaggggccgcatcggtgaaacaaacaggaacagggtggatcgggggacctgttccagtaaagcagaaggactcatcagaggctacgggatgggaagagccaagccccccatctatccggcggaagatggagatagatgacggtacttcagcctggggcgatccttctaattacaataacaaaacagtgaacatgtgggatagaaacaatcccgtgatacaaagctctactaccacgaacacaaccacaacaaccactaccaccacatccaacaccacccatagagtggaaactcccccgccacatcaggcaggaacccagcttaaccgctctcctcttctgggaccagggaggaaggtttcgtccggctggggtgaaatgccgaatgtccactccaagacagagaactcatggggagagccgtcgagtccctccaccctggtggataatggtaccgccgcatgggggaagcccccgagctccggctcgggatggggcgaccatccagcagagccacctgtggcctttggcagggcaggggccccggtcgcagcatcagccctctgtaagccagccagcaaatctatgcaggaggggtgggggtctggcggagatgagatgaatctgtccacttcccagtgggaagacgaagagggtgatgtttggaacaatgcagcctcccaggagtccacttcctcctgttcgagttggggcaacgcaccgaaaaagggtctgcaaaagggtatgaaaacaagcggtaagcaggatgaagcatggattatgtctcggctgatcaagcaactcaccgacatggggttcccacgcgagcctgccgaggaagccctgaagagcaataacatgaacctggaccaggccatgtctgctctgctggaaaagaaagtcgacgtggataaacggggcctgggtgtgacagaccacaacggaatggccgccaaaccactcggatgtcgaccaccaatatctaaggaatcctctgttgaccgccccaccttcttggataaagatggggggctagtggaagaacccaccccttccccgtttctgccatccccatcccttaagctcccccttagtcattctgctctgccttcccaggccctgggaggaatcgccagtggattgggtatgcagaacctgaactcaagtcggcagatcccctccggtaaccttggaatgttcggaaattccggggcggcccaggcccggactatgcagcagccaccacaaccccctgttcagcctctgaacagctcgcaacctagcctgagagcccaggtgccacagtttctgtccccgcaggttcaagcccaacttctgcagttcgccgcaaaaaacattggcctaaatccagctcttctgacgtcaccgataaatccccaacacatgacgatgcttaaccagttataccagctccagctggcatatcagcggctgcaaatccaacagcaaatgttgcaggcgcagcgtaacgtgagtgggtccatgcgtcagcaggagcagcaagtagcccgcactataaccaatcttcagcagcaaatccagcagcatcagaggcagttggcccaggcgctcttggtgaaacagccccccccaccaccacctcccccacacctctcattgcaccctagtgctggcaagtccgccatggattctttcccgagtcacccacagaccccagggcttcccgaccttcagacaaaagagcaacagtctagccccaacaccttcgcaccctacccactggctggcttgaacccgaacatgaatgttaacagtatggacatgaccgggggactgtctgttaaagatccatcccaaagtcagtctcgcctgccacagtggactcacccaaatagtatggataacttaccatcagccgccagcccgctggagcagaacccaagcaaacacggggcaatacctggcgggcttagtatcggtcctccaggcaagtcctccatagacgactcctacggcaggtatgatcttattcagaactcagaatctcctgcctcccctcccgtcgctgtgccccatagctggagccgcgcaaagtccgactcagataagatttcgaatggctcgtctataaattggccacccgagttccatcccggcgtgccatggaagggtctgcagaatattgaccccgagaatgacccagatgttactccaggttctgttcctacagggcccaccatcaataccacaatacaagacgtcaacagatacctgctgaaatccggtggcaaactgtctgacatcaagagcacctggagctccggtcccactagccacacgcaggcgtccctcagccatgagttgtggaaagtgccccggaatagcacagcgccaacccgaccgccgcccggtctcacgaacccgaaaccgtcttctacatggggagcaagcccccttggctggacctcatcctatagctctggttccgcgtggtccaccgacacctctgggaggacaagctcatggctggtcctgagaaatttgacgccacaaattgatggatctactctacggactctgtgcctgcagcacggacctctgatcacttttcacttaaatctaactcagggcaatgcggtggtgagatatagttccaaggaggaggccgctaaggcgcagaagtccctccatatgtgtgtgctcggcaatacgacaatcctcgcagaattcgccggggaggaggaggtgaatcgctttctggcccaagggcaggccctcccccctacttcatcctggcagagttccagtgcaagcagccagccaaggctgagtgccgctggctcctctcacggactggtgaggtcagacgccggccactggaacgccccctgcttgggcgggaaagggagtagcgagctcctgtggggaggagtgccccagtacagttcttcgctgtgggggccgccctctgcggatgacagtcgggtgatcggctcgccaaccccattgacaacgctactgccaggggatttgctgtctggggagtccttatag

SEQ ID NO: 209558 - DNA, 5073 bp, Artificial Sequence
  Description of Artificial Sequence: Synthetic coding sequence
atggccaccggcagcgcccagggcaacttcaccggccacaccaagaaaaccaatgggaacaacggaaccaatggtgccctggtgcaatcacccagcaatcaaagcgcactcggtgctggcggcgcaaacagcaacggcagtgcagcccgcgtgtggggcgtggccacgggatcctcatctggattagctcattgttctgtgtctggcggagatggcaagatggataccatgatcggcgatggccgtagccagaattgttggggtgcatccaatagtaatgctggaatcaacctgaatctcaaccccaatgccaacccggccgcttggccagtgctgggacatgaggggacagttgcaactggaaatccaagctccatctgctcccccgtaagcgccattggtcagaacatgggaaatcaaaacgggaatccaacgggcacactgggtgcctgggggaatctcctgccccaggaatcaacagagccacagacgtcaacatcacaaaacgtctcattttccgcgcagccacagaacctgaatactgacgggcccaataacacaaatcctatgaattcctctcctaaccccatcaacgctatgcagacaaatggcctacctaactggggaatggcggtcgggatgggcgctataatccctcctcacctgcaggggcttcctggcgcgaacggatcctctgtctcccaggtgtctgggggctccgctgagggaattagtaattctgtgtggggtttatctcctggcaatccagccactgggaactccaattcagggttctcgcaggggaatggagacaccgtgaatagtgctctgagcgccaaacagaacggctctagtagcgctgtgcaaaaggagggttcaggtggaaatgcttgggactcaggaccccccgccggacctgggattctcgcttggggaagagggtcgggcaacaatggcgtggggaatatacattctggtgcttgggggcaccctagccgcagcacatcgaatggtgtaaatggagagtggggtaagcctccaaaccagcactcaaatagtgacatcaatgggaaaggttccacggggtgggagtcacctagcgttacctcgcaaaacccgaccgtgcagcccggtggagagcacatgaattcatgggccaaagctgcctcatctggtacaactgcgagtgagggctcctctgacggatcagggaaccataacgaaggttccacgggaagagagggaacgggagaggggaggcggagagacaaaggtattatcgatcaaggccacatccagctcccacgcaatgacctggatccccgcgtgctgagcaacacgggatgggggcagaccccagtgaagcagaataccgcgtgggaatttgaggagagcccgaggagcgaacgcaagaatgataatggaacagaggcttggggctgtgccgccactcaggcctctaatagcggaggaaaaaatgatggttcaatcatgaatagcactaacacgtcatctgtgagtggttgggtcaacgcgcctccagccgcggttcccgcaaatactggatggggcgactcaaacaacaaggctccctccgggccgggggtgtggggagacagcatctctagcactgccgtgagtaccgccgccgccgctaagtcaggacacgcatggtccggcgccgcgaatcaggaggacaaatcacctacttggggagaaccgcccaagccaaagtcccagcactggggagatggacaacggtctaatcctgcatggtcagctgggggcggagattgggccgattcctctagtgtgttgggccacctgggggatggtaagaagaatgggtctgggtgggatgccgacagcaatcgctccggtagtggttggaatgatacgacccgaagcgggaattccggatgggggaactcaaccaacacaaaggctaacccaggcaccaattggggtgaaacccttaagcctggtccacagcaaaattgggcatccaaacctcaggataataacgtttctaactgggggggtgcagcctctgtgaagcagacaggcacaggttggattggcggtccagtcccggtaaagcagaaagattcgtcagaggcgactggttgggaggagcccagtcccccttccatcaggcgcaaaatggagatcgatgatggaaccagcgcctggggggacccatctaattataataataagactgtgaacatgtgggacaggaacaaccccgtgatacaatcttcaaccaccacaaatacgaccacaaccaccacaacaacaacctctaacacaactcaccgcgtggagacccctcctccgcatcaggccggaactcagctgaatcgcagtccactcctggggcctggccggaaagtgtcatctggctggggcgaaatgcccaacgtccattccaagacagagaacagctggggcgaacctagctccccctccacgcttgttgacaatggcaccgcagcctggggcaaacctcctagttccggatctggctggggagatcaccctgctgagcctccagtagcctttggtcgggcgggtgctccagtggccgcttctgctttatgtaaacccgcctccaaatctatgcaagaggggtggggctctggtggtgatgaaatgaacctgtcaactagtcagtgggaggatgaagagggagacgtctggaacaatgcagcatctcaggagagtactagttcatgcagctcatggggtaacgcccctaagaagggcctgcagaaaggtatgaaaactagtgggaagcaggacgaggcatggattatgtcacgtctcatcaaacagcttacggacatgggctttccgcgggagcctgccgaagaggctctgaagagcaacaatatgaacttggaccaggctatgtctgctttgctggaaaaaaaagtagatgtggataagcgcgggcttggagtgacagatcataacgggatggccgcaaaacccctgggatgccgtccccccatcagtaaagagtcctccgttgacaggcccacatttctggacaaagatggcggtcttgtggaagagccgacacccagcccctttctcccatcaccatccttaaagctccctctcagtcactcagcccttccaagtcaagccttgggaggcatcgcaagtggcctgggtatgcagaatctaaatagcagtaggcagattccctctgggaacctgggaatgttcggcaacagcggggccgcccaagcaaggacaatgcagcagccaccccagccacctgtccaaccacttaatagcagccagcctagtctgcgagctcaggtaccacaatttctgtctccccaggttcaggcccaactgctccagtttgccgctaaaaacatcggcctgaacccagccctgctgacaagccctatcaatccacagcacatgactatgctgaaccagctgtaccagctccaactggcgtaccagcgactacagattcagcagcagatgctacaggcccagcgcaatgtgagcggtagtatgcggcaacaggaacagcaggtggccaggaccataacaaacttacagcagcagatccaacagcaccagcggcagctagcccaggctttactggtgaagcaacccccccctcccccacctccgcctcacctgagtctgcatccctctgccggtaagagcgccatggacagctttccgagccaccctcaaacccccggactgcctgacctgcagacaaaagagcagcaatcctcccctaacacgtttgcaccctaccctttggctggacttaatcccaacatgaatgtcaatagcatggacatgacaggtggccttagcgtgaaggaccccagtcagtcacaatctcggttgccacaatggacacaccctaattcaatggacaatcttcccagcgctgccagtcctctggaacagaacccgtccaagcacggggcaatcccagggggattgagcattggccctcccgggaaaagttctatcgacgattcatatggccgttacgacctcatacagaacagcgagtctcctgcatctccccccgtggccgtgcctcatagctggtcacgcgccaagagcgatagtgataaaatcagcaatggtagcagtatcaactggcctcctgaatttcacccgggagtaccgtggaaaggcctgcaaaatatcgacccggaaaatgacccggatgttaccccaggaagtgtcccaactggaccaaccattaacactacaatacaggacgtgaacagatacctgctcaaaagcggcggcaaattgtctgatattaagagcacttggtctagtggtcctaccagccacactcaggcaagtctcagccacgaactttggaaggtgccacgcaactccacagctcccacgcgtccaccccctggcctgacaaatccaaaacctagctccacttggggggcttccccgctcggatggacaagctcttattcatctggttcagcctggtcaaccgacacatctggcaggaccagtagttggctcgtcctcaggaacctgacaccgcagatcgacggttcgacccttaggacactgtgtctccagcacggtccactgataacctttcacctcaatcttactcagggcaacgctgtggtgcggtactctagtaaagaggaggccgctaaggcgcagaagagcttgcatatgtgcgtgctgggaaacaccacaatcctagcagaatttgccggcgaagaagaagttaaccgctttctagcacaagggcaggctttaccccctacaagcagctggcagtcatccagcgcctcttcacagcctaggctgagtgcggccggttcaagccacggtctggtccggagtgacgcaggccattggaacgccccatgtctgggtggaaaggggagtagcgaactgctgtggggcggggtgccacagtacagttcctctctctgggggcccccctccgccgatgacagtcgggttattggaagccccacgcctctgaccactctcctgccgggggatctgttgagtggtgaaagcctgtag

SEQ ID NO: 209559 - DNA, 5181 bp, Artificial Sequence
  Description of Artificial Sequence: Synthetic coding sequence
atggccaccggcagcgcccagggcaacttcaccggccacaccaagaaaaccaacggaaataatggtaccaacggtgctctggtgcagtcccccagcaatcagtccgccttgggtgccggcggggccaatagcaacggctctgcggcaagagtgtggggcgttgcaaccggctcttcttccggtctcgcccattgttctgtttcggggggagacggtaagatggatacaatgattggggatgggagatctcagaactgctggggcgcctccaactcgaacgccggaattaatctgaacttgaatccgaatgccaaccccgccgcatggcccgtactgggacacgaagggaccgtcgccaccgggaatcctagttctatttgttcccccgtcagcgctatcgggcagaatatgggaaaccagaacgggaaccccacaggcacgctgggcgcctggggcaacctgctgccccaagaaagcaccgagccccagaccagcacaagccagaatgtatctttctcagcccagccccagaatcttaatacagacggaccgaataatactaatccaatgaactcaagccccaaccctatcaacgccatgcagaccaatggtctccccaactggggtatggctgtggggatgggcgccataatacctccacatctgcaggggctgcccggtgccaatggatcatcagtttctcaagtctcaggaggatccgcagaaggaatcagcaattctgtatggggtctgagcccagggaaccccgccacagggaactctaacagtggattttcacagggtaatggcgacaccgtcaactccgcccttagcgcaaagcaaaatggctcgtcttcagccgtccaaaaagagggctccggaggcaatgcctgggactcaggccctcccgctggacctgggattctggcttggggaagagggtcaggcaataatggtgtaggcaacattcatagtggcgcatgggggcatccctctagatctacatcaaacggggtaaatggcgaatggggaaagccacctaaccaacattcaaatagcgatattaatggaaagggctccactggttgggaaagtccaagcgtaacatcccaaaacccgacagtgcaaccaggtggtgagcacatgaacagttgggctaaggccgcctcatctggcacaaccgcatcagaaggctctagcgacggttcgggcaaccataacgaaggatcaacaggcagagaaggcacgggggaaggtagacgtagggacaaggggattatcgatcaggggcacatccagctgcccaggaatgatctggatccacgggtgttgtctaataccgggtggggtcagacacccgtgaaacagaacacggcctgggaattcgaggaatccccccggagcgagagaaaaaatgacaacggtaccgaagcttgggggtgcgcagcaacacaggccagtaacagtggagggaaaaacgacggctccatcatgaattccaccaatacctcctccgtgtctggctgggtgaacgcccctccggcagcggtgcccgctaatactggatggggggacagcaacaacaaggccccgagtggaccaggggtgtggggcgactctataagctccactgcagtctctactgccgctgccgcaaagtctggccatgcctggtccggagcagctaatcaggaggacaagtcccccacatggggagagcccccaaagccaaaaagtcagcattggggcgacggtcagcgatccaatcccgcatggtcagcgggaggcggagattgggcagacagttcctccgtcctgggccatctgggcgatgggaagaagaacggaagcggatgggacgctgactcgaatcggtcagggtcaggctggaacgacaccacacgctctggcaattctgggtggggcaactcgaccaatacaaaggccaacccaggcacaaactggggtgagacattgaagcctggccctcaacaaaattgggcatctaagccacaagacaataatgtctcaaattggggcggcgcggcctccgtcaaacagaccggaaccggatggataggtggacccgttcccgtaaagcaaaaggactccagcgaagcaacgggatgggaggagccatccccgccgagcataagacgtaagatggagatagacgatggaaccagtgcttggggcgacccctcaaactacaataataagacggttaacatgtgggatagaaacaacccggtcatccaaagtagtacaactacaaatactacgacaactacaacgaccaccacatctaataccacacaccgagtggagacccctcctccacatcaggcagggacacagctaaacaggtcgccattgttaggaccggtgagcagcgggtggggagaaatgccaaacgttcattctaagaccgaaaactcatggggagaaccttccagccctagtaccctggtcgacaacgggaccgcagcctggggtaagcctccgtcttctggttcaggttggggggatcaccccgcagagccgccggtcgcattcgggcgcgcgggcgctccagtggcagcctcagccctatgtaagccggcttctaaatcaatgcaagagggctggggttccggtggggacgaaatgaacctgtccacttcgcaatgggaggacgaggagggggacgtgtggaataatgctgctagccaggagagtaccagtagctgctcatcatggggcaacgctcctaagaaagggctgcaaaagggcatgaagacttctggtaagcaggacgaagcgtggattatgagccggcttataaagcagctcacagacatgggattccctcgagagccagcagaggaagcgctaaaaagcaataatatgaatcttgaccaggccatgtccgccctcctggagaaaaaggtggatgtggataaacgcggcctcggcgtgactgaccacaatgggatggctgctaaacccctgggctgtagaccccctatttccaaggaatcgtcggtagatcgcccaactttcctggacaaggacggaggcctcgtggaagaaccaacaccttcccccttcctaccctccccaagcctcaagctccctctgtcacacagtgccttgccttcgcaggccctgggaggcatagccagcggactgggaatgcaaaatctcaactcatccaggcaaatcccctcaggaaacttgggtatgtttggcaacagcggagccgctcaggcgcgcacaatgcagcagccccctcagcctcctgttcaacctcttaacagctcacaaccttcactgcgcgcacaagtcccccagtttctatctcctcaggtacaggctcagttgcttcaatttgcggccaagaacattggcctgaatcccgcgttgctgacctccccaatcaatccccagcacatgactatgctcaatcagctgtaccaactgcaactggcctatcagcgcctccagattcagcaacagatgctgcaagcccaacggaacgtttctggatctatgagacagcaggagcagcaggtggccagaaccataaccaacttgcagcagcaaatccagcagcatcagagacagctcgctcaggcccttctggtgaaacagcccccacctccgcctccgcccccccacctgtctctgcacccatccgccggaaaatccgcaatggatagtttcccaagtcacccccagacaccaggcttgccggatctgcagaccaaagaacagcagtccagtcccaatacgtttgccccataccctcttgcgggcctcaatccaaatatgaacgtcaacagtatggacatgaccgggggtctaagcgtgaaagacccctctcagagtcagtccagactccctcagtggacccaccctaactcaatggataatttgccatcggcagcctctccactggagcagaatcccagtaagcacggcgcaatccccggtgggctttccataggcccgccaggcaagtctagcatcgacgattcttacgggcggtacgatctgatacagaattccgaatctccagctagccctccagtggccgtgccccattcttggagtagagccaagtcagactctgataagatttctaatggttcatctatcaattggcccccagaatttcaccccggcgtcccatggaagggacttcagaatatagaccctgagaacgatccggacgtgacacctgggtcagtgcctacgggcccgacaatcaacaccactatccaggacgtgaataggtatttactgaaatcagggggttcctccccccccagtagccagaacgccaccctccccagctcttcggcctggcctctgagtgccagcgggtattcctcatccttttcgagtatcgcatccgccccctccgtggctggaaagctctctgacattaagagtacttggagctctggccctactagtcacacccaggcatccctgagccatgaactgtggaaggtcccgcgaaactcaaccgcccccacaagaccgccccctggcttaactaatccaaagccgtctagtacctggggcgcatctcccttaggatggacctccagctactccagtgggtctgcctggagtactgatacaagtggacgtacctcctcctggctcgtgctgaggaacttgactccgcaaattgatggaagtacactgcgtaccttgtgtctgcagcacggacccctgataacctttcacttaaacctaactcagggaaatgcagtggttaggtactcatctaaagaagaagccgctaaggcacagaagtcgttgcacatgtgtgtgctcggcaatacaactattctggctgagtttgctggcgaggaagaggtgaaccggtttctggctcagggccaggcactacctcctacttcgtcctggcagtcaagctctgccagttcgcagccgcgtctcagtgctgctggttcttcccatggactggtcagatcagatgctggacactggaacgcaccctgcctgggcggcaaaggctccagcgaactcttgtggggcggggtcccccaatactcctcctcactatggggacccccaagtgccgatgactccagggtaataggctcccccactcctttgactacccttttaccgggggacctcctgagtggggaatcgttatag

SEQ ID NO: 209560 - DNA, 1959 bp, Artificial Sequence
  Description of Artificial Sequence: Synthetic coding sequence
atgggcggctggaagggccccggccagcggcggggcaaggagggcccagaggcgagacgacgggccgccgaacggggaggtggcggaggcggtggcggagtgccagcccctcggtccccagcacgcgaaccaaggcctcgaagttgtctgctgctcccaccaccttggggagctgctatgactcccgatctcctgaactttaagaaaggctggatgtcaatcctggatgagcctggtgagccacccagtccgtccttgacgaccactagtacttcacagtggaaaaagcactggtttgtgttgactgactcctctctgaagtactacagagactccacagcagaagaagcggacgaactggatggtgagatcgacctccgcagctgtacagacgtgacagagtacgccgtacagcggaattacggcttccagatacatactaaggacgcagtctatactctttcagctatgacgtctggtatccgccggaattggatcgaagctctgcggaaaacagtacgacctaccagcgctcctgatgttacgaaattgtccgattccaataaggagaatgccttacattcctactccacacagaaaggccctctcaaagcgggggaacaaagagctggctctgaagtgatctccagaggaggacctaggaaggccgatggccagcggcaggcactggattacgtggagctgtccccacttacacaagcttcaccccagagagcccgaactcctgcccgaacacctgaccgtcttgctaaacaggaggaattagagcgggacctggcccagcgcagcgaggagagaagaaagtggttcgaggcaaccgattccaggactccggaggtgccagcaggtgaggggccccgccgcggccttggtgctccgctaactgaggaccaacagaaccgactgagtgaagaaatcgagaaaaagtggcaagagttggaaaagctgccactgagagaaaacaagcgagtgcccttgacagcactgctgaaccagtctcgcggggagagacgaggccctccttctgatggacacgaggcactggagaaggaagtgcaagccctacgggcccaattggaggcctggaggctccagggagaggccccccaaagcgctctgcggagccaagaggacggacatatccctcctgggtacatctcccaggaagcttgcgaacgtagtctggctgaaatggaatcctcccaccaacaggtgatggaagaacttcagcggcaccacgagcgggagcttcaacggttgcagcaggagaaagaatggctattggcagaggaaacggcagcaacagcgtccgctattgaggccatgaaaaaagcttaccaggaggagctctctcgggagctgagcaagacccgtagcttacagcagggacctgatggcctgaggaagcagcaccaatctgacgtggaggctctgaagagagagctgcaagtgctgtctgaacagtacagccaaaagtgtctcgaaattggggccctcatgcgacaggccgaggagcgggagcatacgctgcgacgatgccaacaggagggccaggagctgctgcgtcataatcaagaactgcatggaagactttctgaagagattgatcagctgagggggtttatcgcatctcaaggaatggggaacggttgcgggcgcagtaatgagcgttcttcatgcgagctggaagtgttgcttagagttaaggagaatgagctgcagtacctcaaaaaagaggtccagtgcctgcgcgatgagttgcagatgatgcagaaagataaacgcttcacgagcggcaagtaccaggacgtttatgtcgagctatcacacattaagactaggtccgaaagagaaatcgaacaacttaaggagcatctgcgccttgccatggctgcccttcaggagaaagaatcaatgcggaattcactagcggagtag

SEQ ID NO: 209561 - DNA, 7098 bp, Artificial Sequence
  Description of Artificial Sequence: Synthetic coding sequence
atggaggaggtgcccggcgacgccctgtgcgagcacttcgaggccaacatcctaactcagaaccgctgccagaactgttttcatcccgaagaggctcacggagcgcgctatcaggagctcaggagcccatccggcgcagaggtgccatattgtgatctgccaagatgcccacctgccccggaggaccccctgagcgcctccactagtggatgtcagtccgtagtggaccctgggctgagacctggccctaaaagaggcccaagcccttctgccggcttgcccgaagaaggaccaaccgcagcgcctcggagccggagcagagaactggaagctgtgccctatctggagggattgaccaccagcctttgcgggtcttgcaatgaggatcctggatccgaccctaccagctccccagactctgccactcctgacgatacttccaacagttcgtctgtggactgggacacagtggaaaggcaggaggaggaagcaccctcatgggatgagttggctgtgatgattccccggagaccgcgtgagggcccaagggctgactcctctcagcgtgctccgagccttctaactcggtcacccgttggcggtgacgctgctggccagaaaaaggaggacacagggggcggtggacggtctgcgggacagcactgggctaggctcaggggcgagtccggcctgagcctggaacgccatagaagtacactgactcaggcgagctctatgacacctcacagcgggcctagaagcactacttctcaggcaagccctgcccaaagggacaccgcacaggctgcaagcaccagggagattccacgggctagtagtccccatcgcattacccagagagacacatcaagagcctcatcgacacagcaggagatcagccgagcttcaagcacacagcaggagacgtcccgggcttctagcacacaggaagacacccctcgcgcctctagcacacaagaggacacccccagggcaagctcaactcagtggaatacccccagggcctcaagcccaagtcgtagcacgcagctcgataacccccgcacatcctcgacccagcaagataatccacaaacaagcttccccacatgtactcctcaaagggaaaatccacgcaccccgtgcgtgcaacaggacgatcccagggcttcatcccccaataggaccacacagcgggagaattctcggacaagttgtgcccagcgtgacaatccgaaagctagtagaacaagctctcccaaccgagcaacccgggacaacccaagaacctcctgcgcgcagcgcgacaacccacgggcctctagcccaagtagagcaacccgagacaaccccaccaccagctgcgctcagagggacaacccccgcgctagtcggacatcctcacctaaccgggctacaagggataacccaagaacaagctgtgcccagcgggacaaccctcgggcaagtagcccctcccgtgctacgcgggacaacccaaccacctcctgcgcccaacgggataatccacgcgctagtaggaccagctcgcctaatcgggcaaccagagataatccgcgcacgtcttgcgctcagagagataacccccgggcctccagtcccaatcgcgccgccagggacaacccgacaacctcatgcgcccagcgggacaatccccgcgcgagtcgcacatcaagcccgaaccgggccactagagataatccccgaaccagctgtgctcagcgggataacccgagggccagctcccctaaccgagcgacacgcgacaatccaaccacgtcctgtgcccagcgggacaatcctagagccagccgtacgtcaagtcctaatcgcgccactcgggataacccacgcacctcttgcgcccagagggacaatccacgagcctcatcacccaatcgcacgacacagcaggactctccaaggacatcatgtgcccgcagagatgatccccgagccagttctcccaatcgtaccatccagcaggagaatccacggacaagttgcgcactgcgtgataatccaagggcatcttcgccgtccagaaccatccaacaagagaaccccaggacttcctgtgcccagcgagacgatcccagggcatcatcaccaaaccggacaactcagcaggagaatcctagaacctcctgcgctaggcgcgacaatcccagggcctcgtcccggaatcgcacaatacagcgcgacaatcccagaacaagttgtgcacagcgcgataacccccgagcatcatctcccaacaggaccattcagcaggagaacttgcgcacaagctgcaccaggcaagacaacccacgaacctcttcccctaaccgcgctacaagagacaaccccaggacaagttgcgcgcagagggacaacctgagagcctcttccccaatccgcgccactcagcaggacaatcccagaacttgcatccagcagaatatacctagatcgagcagcacacagcaggacaatccaaagacaagctgtaccaaaagggataatctgaggcccacctgtacacaaagggaccggacacaatctttttcttttcaaagagataacccaggaaccagttcgagccagtgttgtacacaaaaggagaacctgagaccatcgtcaccacacagaagtacccaatggaataacccaagaaattccagcccacaccgcaccaataaagacattccttgggcaagtttccccctgcgtcctacgcaatccgacggaccacggacaagcagtccatctaggtcaaaacaatcggaagtcccatgggcgtcaattgccctgagacctactcagggggacagaccgcaaaccagcagtccttctaggccagctcagcacgaccctccccaatcttcattcggccccacccagtataatctgccttctcgtgctacctcttccagccataatcccggccatcagtctacttctagaactagcagccctgtgtaccctgccgcttatggcgctccgctgacttcccccgagcccagtcaaccaccttgtgccgtgtgcatcgggcatcgggacgccccacgggcaagctccccacctaggtacctacaacacgaccctttccccttctttcctgaaccgcgcgcaccagagagcgaacccccccaccacgagcctccttacattccaccagctgtgtgtattgggcaccgggatgcgccgagagccagctcaccaccgcgacacacccagttcgatccttttccgtttttacccgatacaagcgacgccgagcatcaatgtcagtctcctcagcatgagcctctgcagcttcctgcaccagtgtgcattgggtaccgggatgcgcctcgggcatcgagcccaccacgacaggccccagagcctagccttctcttccaggatctcccaagggctagcaccgagtccctcgtgccttcaatggattctcttcacgagtgtccgcacatccctacccctgtatgcattggccacagggatgctccatcattctccagcccacctcgacaggcaccagaaccgagcctcttctttcaggaccctccgggcacctcgatggaatctctggccccctcgacggactcattgcacgggtcccctgtgctcattcctcaagtgtgcatcggtcatcgcgatgccccacgtgctagttcgccccctcgccacccccccagcgacctggcctttctggcaccatctcctagtccaggaagctccggcggaagtcgtgggtccgcacctccgggcgagaccagacacaatctcgagcgcgaagagtacacagtccttgctgaccttccaccgcctcggagactcgcccaaagacaacctggaccccaggcacaatgttccagcggcggacgcacacacagccctgggcgggccgaagtggagcgccttttcggccaggagcggcgaaaaagcgaggctgcaggcgcattccaggcccaagatgaggggagatcacagcagccaagccagggtcagagccagctcctccgcaggcagtcatccccagcacccagtaggcaagtgaccatgcttcccgctaagcaggcagaactgacccggaggtcccaggccgaaccaccacatccgtggtcacctgaaaagcgcccagagggagatcggcagctgcaagggtctcccttacctccccgaacttcagctcgtacaccagagcgagagctgaggacacagagacccctggaaagcggccaggccggcccccggcagcctctgggcgtatggcaaagtcaggaggagcctcccggaagccagggaccacacaggcacctggagaggtcttggtcttcccaggaaggcgggctgggtccaggtgggtggtggggttgtggggagccctccctgggtgctgcaaaggcgccagagggagcatggggcggtacgagtagagagtacaaagaatcgtgggggcagccagaggcctgggaagagaagccgacccatgagttgccacgagaactcggtaagcgctccccattgacgagcccgccagagaattggggcggccctgcagaaagtagtcaatcttggcattccgggacacctactgccgtgggttggggtgctgagggcgcatgtccatacccccgaggctctgaacgaaggccggaactggactggcgggacctcttaggcttgttacgcgcacccggagagggcgtctgggcccgggtgccgtctctagattgggagggtctgctggagttactacaggcaagattaccgagaaaggatccagctggccaccgtgatgacctggctcgagctcttgggcctgaactgggccctcctggaaccaatgacgttcccgagcaggagtcccacagccagccggagggctgggccgaagcgacccctgtaaatggccactcccccgctcttcaatcacaaagtcctgtgcaactgccaagccctgcatgcactagtactcagtggcccaagattaaagtgacccgtgggccagcaaccgcaaccctagcagggttggagcagacaggacccctaggtagtcgttcaacagcaaagggcccctccctacctgagctgcagttccagccagaagaacccgaggagagcgagccttctaggggccaggatcctctgacggatcagaagcaggccgattctgccgacaagcggccagcagaggggaaggcaggaagccctcttaaggggagactggtgactagctggaggatgcctggggatcgccccaccctgttcaatccttttctcctttctttaggagtgctcagatggaggcggcctgatcttctaaacttcaaaaaaggttggatgtcaatattggatgaacccggtgagcctccatccccaagtcttaccacaacctctacgtcccagtggaagaaacattggtttgtactcaccgattccagcctgaaatattaccgggattctaccgcagaagaagcagatgagttagacggcgaaattgacttacggtcgtgtacagatgtgacggagtatgccgtgcagcgtaattacgggttccagatacacactaaagacgctgtgtacacgctgtctgctatgacatctggcatcaggagaaactggatcgaggctctgagaaagactgtacgccccacaagtgctcccgacgtgacaaagctgtcagattctaataaggagaacgccctgcacagctacagcacccagaaagggcccctcaaggctggcgagcagagagccggctccgaggtaatttctaggggcggaccaagaaaggcggatggacagaggcaggctctggactatgtggagctgtctccacttacccaagccagtccacagcgagccagaacgccagcccgaaccccggatcggctggccaagcaggaggagctcgagcgagacctggcccagcggtccgaagagcggaggaaatggttcgaggctaccgactctagaacaccggaggttcccgcaggtgagggccccaggcggggactaggcgcccctcttacagaagaccagcagaacagactgagcgaggagatagagaagaagtggcaggaattagagaaactgcctttgcgggaaaacaaaagagtccctctgactgccttgctcaaccagtccaggggagagcgacggggccccccatctgatggccatgaagctcttgagaaggaagttcaggccctcagagcacagctggaagcttggaggttacagggtgaagccccccagagcgctttgaggagccaagaagacggccatatacctcccggctatatctcccaggaagcgtgtgagcgaagcctggcggagatggagtcatcacatcaacaggtgatggaggagctccagagacaccacgagcgggagctgcagcggctgcagcaggagaaggagtggctccttgccgaggagaccgcagcaaccgcctctgctatcgaggctatgaagaaggcctatcaggaggaattatcccgggagcttagtaaaaccagatccttacagcaaggccccgacggcctccgtaagcaacaccaatcagatgtcgaggcgctgaaacgggagcttcaggtgctatctgaacaatatagtcaaaaatgccttgaaatcggcgccctgatgaggcaggccgaagagcgagagcacaccctgcggcgctgccagcaggaaggccaagagctccttagacataaccaggagttgcatggtcgcctcagcgaggagatcgatcagctgcgcggtttcatcgccagccagggcatgggcaatggttgcggtagatcaaacgaacggtcctcatgcgaattggaggttcttttaagagtcaaagagaacgagctccagtacctgaaaaaagaagtgcagtgcctgcgggacgagcttcagatgatgcagaaagataaacgcttcacttcgggaaagtaccaggacgtgtacgtggagctcagccacataaagaccagatcggaaagggaaatcgaacagctaaaagagcacctgaggctagcgatggccgcattgcaggaaaaggagagcatgaggaacagtttggctgagtag

SEQ ID NO: 209562 - DNA, 1296 bp, Artificial Sequence
  Description of Artificial Sequence: Synthetic coding sequence
atgggcggctggaagggccccggccagcggcggggcaaggagggccccgaagcccgacggcgagccgccgagcgggggggcggcggtggaggcggtggtgtgcccgctcctcggagtcctgcacgggagccaagaccacggagctgcttgcttctgcctcccccatggggagccgcaatgacgccagacttgctgaacttcaagaagggctggatgtccattttggatgagcccggggagcctcccagtcctagtttaaccacaacttctacatcccagtggaaaaaacactggttcgtgctgacggatagttctctgaaatattacagagattcgaccgccgaagaagccgatgagctcgacggggaaatcgacttacggagttgtacagacgtcaccgagtacgccgtccagcgcaactatggattccagattcatacaaaagatgccgtttataccttatcagcaatgacctccgggattaggcgcaactggattgaagcactccggaagacggtgcgcccaacttctgcacccgacgtaacaaagctgtcagacagcaacaaggagaatgctctgcattcctattcgactcagaaaggaccccttaaagccggggagcaaagggccgggagtgaagtgattagtaggggcggccctcgcaaggccgatggccagcgccaggcactggactacgtggagctgagccctctgacccaggcatcccctcagagggccagaacaccagcgcggacccccgataggctcgcgaagcaggaagagctcgagagagacctggctcagcgcagcgaggagcgacgcaagtggtttgaggcaacagattcccggactccagaggtcccggctggggagggccctcgaagagggctgggcgcgccgctcaccgaggaccaacagaatcggctgtctgaagaaatcgaaaagaaatggcaagaactggaaaaactgccactccgcgagaataaacgggtaccactgactgcccttctgaatcagtccagaggagagagacggggccccccatctgatgggcacgaagcacttgagaaggaggtacaggctctgagagctcagcttgaggcttggagattgcagggtgaggcaccgcagtcagccctcaggagccaggaggacggacacatcccacctggctacattagccagctggtgggtgtgataactgtgcccgttctgcagacgaggccgcttagctctgagaggctgtgcgacctccccaaggtcacccctccagctgggctgaagggtggcatatag

SEQ ID NO: 209563 - DNA, 5070 bp, Artificial Sequence
  Description of Artificial Sequence: Synthetic coding sequence
atggaggaggtgcccggcgacgccctgtgcgagcacttcgaggccaacattctaacccagaaccggtgtcaaaattgtttccatccagaggaagcccatggggcacggtatcaagagctgcgttctccgagcggtgcggaggtaccctattgtgacctgccgcgttgcccaccagcccctgaagacccgctaagcgcaagtactagcggatgtcagtcagttgtggatccgggcctgcggcctggacccaaacgaggaccatcacccagcgcagggctacccgaggagggtccaaccgccgcaccgaggtctaggagccgtgagctcgaagccgtcccatacctggagggcctgaccacgagcctgtgcgggagctgcaatgaggacccagggagcgatcctacttccagtcccgatagtgcaacgcctgatgacacgagcaattccagtagtgtcgattgggatacagtggagcggcaagaagaggaagcaccttcctgggatgagctggctgttatgattcctcgccggcctcgtgaggggccaagagctgatagttcccagcgagcaccctcgcttttaaccaggagccctgtggggggcgacgctgccggacaaaagaaagaagatactggtggcggcggccggagcgctggccaacattgggcccgcctccggggcgaatcgggcctcagcctagagaggcacagatcaacactgactcaggcctcctcaatgactccacactctgggccccgctctaccacaagtcaagcttctcccgcgcaaagagatactgcccaggccgcaagcacacgggaaatccctcgcgcttctagcccacacaggatcacccagagggacaccagccgagcatcgagcacgcagcaggaaatctccagggcctcatcgacccagcaggagaccagccgtgcctcctcaacccaggaagacactccacgcgcatcctccactcaggaagacaccccccgagcttcatcgacacagtggaacaccccccgagcaagttcaccaagcaggtccacacagctggacaacccccgcacctctagcacccagcaggataacccccagactagttttccaacttgcacgccgcaaagagaaaatccccgcacaccgtgcgtgcaacaggacgacccccgagcatcttcccctaataggacaacgcagcgggagaacagcagaacatcctgcgcccagagggacaatcccaaggcctccagaacgagtagtcctaacagagcgacacgcgacaatcctagaacttcatgcgctcagcgcgataatcccagggcaagttcgcccagccgggctacccgggacaaccctacaacctcttgtgcacaacgcgataaccctcgagcttctcgaaccagctctcctaacagagctactcgtgacaacccgaggacgagctgcgcccaacgcgacaatccaagggcttcttcccccagtcgcgcaacacgcgacaaccccacaacaagttgtgcacaacgggacaaccctagagcttccagaacctcgtctccaaaccgggccacacgggacaatcctaggactagctgcgcacagcgggataatccacgggctagcagtccaaaccgcgctgctcgcgacaatcctacaaccagctgtgcccaacgggacaaccctcgggcctctcggaccagttcccccaatcgcgcaacccgggacaatccccgcacttcatgcgctcagcgcgacaatccccgcgcctcctcgcccaaccgggcaacgcgggataatcccaccacatcctgtgctcagcgcgacaacccccgggcctccaggaccagttcaccaaacagagctacaagggacaaccctcgcactagttgtgcgcagcgggataatccacgggcatcttctcctaaccgcactacccagcaagattctccgaggacatcatgtgctagaagggatgatcccagggcttcatcgccgaataggaccattcagcaggagaaccccagaacctcttgcgccctgagagataatcctcgagctagcagccccagtcgcaccattcaacaggagaaccctcgaacttcatgcgcacaacgggacgatccacgggccagctcccccaaccggacaacacagcaggagaatcctaggacaagctgtgccagacgcgacaacccacgagcgtcatcacgaaatagaacaatccagcgcgacaaccccaggacttcatgcgcacagagagacaatccgcgggccagtagccccaaccgcacaatccagcaagaaaatcttcgcacctcatgtactagacaggacaatccacgcacctccagcccaaaccgggctactcgcgacaatcctagaaccagttgcgcccagagggacaatcttcgggcctcaagtccaatcagggcaacccagcaggataacccgaggacatgtatacagcagaacattccccggtcctcaagtacccagcaagataaccctaaaacctcatgtacaaagcgcgataatttgcgcccaacatgtacacagcgcgatagaacgcagagcttctcatttcaaagagacaacccaggaacctcttcttcccaatgttgcacacagaaggagaatttacgccccagcagcccgcatagatcaacccagtggaacaatcccaggaatagttctcctcacagaactaacaaggatattccctgggcgagcttcccattgcggcctactcaaagcgacggacccaggacaagttcaccctctaggtcaaaacaatcagaagttccgtgggcctctattgctctgcggccaacccagggcgatagacctcagaccagctctccctctcggccggctcaacacgatccaccccagtcttctttcgggcctacacaatataacctcccatctcgcgccacttctagctctcataatcctggccatcagtcaacaagtagaacatccagccccgtgtatccggccgcatacggcgcaccactgacgagccctgagccatcccagccgccatgcgctgtgtgtataggccatcgggacgcgcctagagcgagtagtcccccccgctacctgcagcacgaccccttccccttctttcctgaaccacgagctcccgaatcagagccgcctcaccacgagcctccttatattccgcccgctgtatgtatcgggcatcgcgatgcaccgagggcgagtagcccacccagacacactcagttcgaccccttccccttcctgccggacactagtgacgcggaacaccagtgtcagtctccacagcatgaaccactgcaactaccagcgccagtgtgcatcggatacagagatgctccgcgggcatctagcccccccaggcaagctcctgagccttctcttctgtttcaggacttaccaagagcatctacagaaagcctcgtgccctcaatggacagcctgcacgaatgtccacacatcccaactcctgtctgtatcgggcatcgcgatgctccaagttttagtagcccccccaggcaggcacctgaacccagcctgttctttcaggatcctccaggtacaagcatggagagcctcgctcccagtacagacagtcttcatggatcacccgtgctgatccctcaggtgtgtatcgggcaccgcgacgccccccgtgcatctagcccaccccgccatcccccctctgatttggcttttctcgcccctagcccatcacccggatcaagcggggggtcccgaggttcagctccaccgggagaaactcggcacaatctcgaacgagaagagtatactgtgttggcagatctacccccccctagacgccttgctcagcggcagcccggaccacaggcccagtgttcttccggcgggaggacccactcgcctggcagagctgaggtcgagcggttatttgggcaggaacgacgcaccatgcttccggctaaacaagccgaactgacccgaagatcccaagctgagcctccgcacccatggtcccctgagaaacgaccggagggtgatcgccaattacaaggctccccgctgccacctaggaccagcgctaggacaccggagcgcgaactgcgtactcagcgcccgctggagagcgggcaggccggtccgcgtcagcctctgggagtgtggcagtcacaggaggaacctccgggctcccagggaccccatagacatttagagagatcctggtcgtcgcaagaaggcggtttgggccccggagggtggtggggttgtggcgagccttcactcggggcagcaaaggccccagagggcgcttggggcggtacttccagagagtacaaggaaagctggggacagcctgaggcgtgggaggaaaaacctacacacgaacttccaagggaattagggaaacgtagccctcttacaagccctccagagaattgggggggacctgcagaatcttcgcagtcatggcattctggaactccgaccgccgtgggttggggggcggaaggcgcctgcccttacccccgaggaagcgagcgccgccccgaattagattggcgcgacctcctaggcctgcttagagccccgggagagggggtctgggcacgggtgccatcacttgactgggaaggtctcctggaactgctgcaagcccggctgccccgtaaagaccctgccggtcacagggatgatctagcccgagctcttggcccagaattaggccctcccggtaccaacgacgtgccggaacaggaaagccatagtcagcccgaggggtgggccgaggctacgccagtgaacggacattctcctgcccttcagtcccagagcccagttcagctgcctagccctgcttgcacctctacccaatggcccaagatcaaggtgacacgcggacccgcaaccgcaaccttggccggtttagaacaaacgggacctctgggttctcggagtaccgcgaaagggccaagtctcccggagcttcaattccagcccgaggaaccagaagagtctgagcccagcagaggccaagaccccctgacggatcagaagcaggctgactcatag

SEQ ID NO: 209564 - DNA, 771 bp, Artificial Sequence
  Description of Artificial Sequence: Synthetic coding sequence
atgagcatcctggacgagcccggcgagccccccagccccagcctgacgaccacttcaacatctcagtggaaaaagcattggtttgtgttgaccgatagcagcctgaaatactaccgggactctacagcagaagaggcagatgaactggatggcgagatagacctgcgtagctgtaccgatgtgactgaatacgctgtgcagagaaattacgggtttcagatccatactaaggatgcagtttacaccctctcggccatgacaagcggaatcaggcggaattggattgaggcgttgcgcaaaaccgtgagaccaacttccgcgcccgacgtgacaaagttatcagattcaaacaaagagaacgcccttcactcctattcgacacagaaagggcccctgaaagcaggcgagcaaagggctgggtccgaagtgatctcgaggggtggcccaagaaaagccgatggacagcggcaggcattggattacgtggaactctctccccttacacaggcctcacctcaacgggcaaggactcctgcacgcaccccagataggcttgctaaacaagaggagcttgagcgagacctagcgcagaggtccgaggaacgtcggaagtggtttgaggccactgactcacggacccccgaggtccccgccggggaaggtcctcggcgtggcctgggcgcccccctgaccgaagaccagcagaataggttatcagaagagattgagaaaaagtggcaagaactggaaaagctgcccctacgggaatag

SEQ ID NO: 209565 - DNA, 252 bp, Artificial Sequence
  Description of Artificial Sequence: Synthetic coding sequence
atgagcatcctggacgagcccggcgagccccccagccccagcctgacaacaacttctacatcgcagtggaaaaaacactggttcgttctgacggacagtagcctgaaatattacagggacagcacggcagaggaggctgatgagctagatggcgaaatcgacctgcgttcctgtacagatgtcaccgagtacgcagttcagcgcaactatggattccagattcacaccaaagatgcagtgtatacgttgtag

SEQ ID NO: 209566 - DNA, 2577 bp, Artificial Sequence
  Description of Artificial Sequence: Synthetic coding sequence
atggccgagctgagcgaggaggccctgctgagcgtgctgcccaccattagggttcccaaagccggcgacagagtgcataaggatgagtgcgcattttcatttgacactcctgagagtgagggaggcctgtacatctgtatgaacaccttcctcgggttcggaaagcagtacgtggaaagacacttcaataaaacaggccagagggtctacctacacctgcgcagaactagaagaccaaaggaagaagatcccgccaccgggaccggagacccacctaggaaaaaaccaacacgcctggccatcggagtggaaggtggtttcgacctaagtgaggagaagttcgagttggacgaggacgtcaaaattgtgattcttcccgactatctcgagatcgcccgggatgggctggggggtctccctgacattgtacgcgatagagtgacaagtgcagtggaggccctgctttctgcagacagcgcctcacggaaacaggaggtgcaggcatgggacggcgaagtgaggcaggtctccaaacatgcttttagcctgaaacagcttgataatcctgctcggatccctccctgtggttggaagtgctcaaaatgcgatatgcgagagaacctgtggctcaacctcacagacggctcaatcttgtgtggtagaaggtacttcgatggcagtggtggaaacaatcatgccgtcgaacactatcgcgagaccggctacccgcttgcagtgaagctgggtacaattacccctgacggcgccgacgtctactcctatgatgaggatgatatggtgctggatcctagtcttgcagaacacctgtcccactttggcatcgacatgctgaagatgcagaaaacggacaagacaatgacggaactcgaaattgatatgaatcagaggatcggggagtgggaactgattcaggagagcggcgtgccccttaaacccctcttcggtcccggctacacaggaatcaggaatctgggaaactcctgttaccttaactctgtggtacaagtactgttcagtatcccggactttcagcgcaaatacgtggacaagttggagaaaatctttcagaacgcccctacggaccctacacaggatttctctacgcaggtggccaaactaggccacggactgctgagtggggaatacagcaagccggttcccgagagcggagacggagagagagtcccagagcaaaaagaagttcaggacggaatagcccctcggatgttcaaggctttgatcggaaaggggcacccagaattcagtacgaataggcaacaggacgctcaggaattctttctgcatcttattaatatggtagagaggaattgtcgttcctctgagaatccaaacgaggtctttcgctttttagtagaggagaagatcaagtgcctggccacggaaaaggtaaagtacacacagcgtgtagattacatcatgcaactgccggtccccatggacgctgcgctgaacaaagaagaactgcttgagtacgaagagaaaaaacgtcaggctgaggaagagaaaatggcactgcccgagctggttagagcacaggtgccattctcatcatgtctggaagcctacggagcccctgagcaggtggacgacttctggtccaccgccctgcaggctaagtcagtggccgtaaagacgacccgctttgcgagctttcccgactacctggtcatccagatcaaaaaattcacctttggtctagactgggtgcccaaaaagttggatgtaagcattgagatgcccgaagaattagatatcagtcagctacggggcacaggcttgcagccaggggaggaggaactcccggacattgcacctcctctcgtgactcctgatgaacctaagggctctttgggcttctacgggaacgaggacgaggactcattctgctctccccatttctcatccccgacatcccccatgcttgacgagtccgtgatcatacagcttgtggaaatgggattccccatggatgcatgcaggaaggccgtttattatacgggcaacagcggagcagaggctgcaatgaattgggttatgagccacatggacgaccccgacttcgcgaacccgctcatcctccccgggagctcaggaccagggagcacttccgcagctgctgatccaccacccgaggattgcgttaccacgatcgttagcatggggttctccagggatcaagctcttaaggccctacgggccacaaacaattccttggaacgggcagtcgactggatttttagccatattgacgatcttgacgcagaagcagcgatggacatctcagagggccgcagcgctgccgacagcatctcagagagcgtcccagtgggacccaaggtgcgggacggcccagggaaatatcagctatttgcattcattagccacatgggcacgtcgaccatgtgcggacattacgtctgccacattaaaaaggaaggacgctgggtgatttataatgatcagaaagtttgcgccagcgagaagccccctaaagaccttggctacatttacttctaccaaagagtcgccagttag

SEQ ID NO: 209567 - DNA, 750 bp, Artificial Sequence
  Description of Artificial Sequence: Synthetic coding sequence
atggcccccagccggaagttcttcgtgggcggcaactggaagatgaacgggcgcaaacagtctctcggtgaattaatcggcaccctaaatgctgccaaggtccctgccgataccgaagtggtttgcgcaccacccaccgcttacattgactttgcccgacagaagctggaccctaagatcgcagtcgctgcccaaaactgctataaagttaccaatggggcttttaccggtgagatcagtcccggtatgatcaaggactgtggggcgacatgggtggtgttgggacacagtgaaagacgccatgtgttcggagagtccgacgagctgattggtcagaaggtggcacacgccttagctgagggcctcggagtcattgcatgcatcggtgaaaaactggacgagcgagaggcaggcatcaccgaaaaggtggtctttgaacagaccaaagttatagcagacaacgtaaaggattggtccaaagtagtgctggcttatgagcctgtctgggccataggcactggaaagacagccacccctcagcaggcccaggaggttcacgaaaagcttagaggctggcttaagagtaacgtttcagatgccgtggcacaatctaccagaattatctatgggggtagcgtgactggggctacctgtaaagagttggccagtcaaccagatgttgatgggttcttggtcggaggagcctctctcaagcccgaattcgtggacatcataaatgcaaagcagtag

SEQ ID NO: 209568 - DNA, 504 bp, Artificial Sequence
  Description of Artificial Sequence: Synthetic coding sequence
atgatcaaggactgcggcgccacctgggtggtgctgggccacagcgaaaggcgccatgtcttcggcgagtctgacgagctgattgggcaaaaggtagctcatgctctagccgaggggcttggcgttatcgcatgtatcggagaaaaattggacgagcgcgaggcagggataaccgagaaagtggtattcgagcagaccaaggtgatcgccgacaacgttaaggactggtccaaggtggtgttggcttacgagcctgtttgggccatcggtaccgggaagaccgcaacacctcagcaggcccaggaggttcatgaaaaattgcgcggctggttgaagagtaatgtcagtgatgctgtagcccagtccaccaggattatttatgggggcagtgttaccggagccacttgtaaggagctggctagtcaaccagacgtggatgggtttctggtcggaggtgcctccctgaagccggaattcgtggacatcattaacgcaaagcagtag

SEQ ID NO: 209569 - DNA, 1233 bp, Artificial Sequence
  Description of Artificial Sequence: Synthetic coding sequence
atggacgtgatggagctgctggaggaggacctgacctgccccatctgctgtagcttgttcgacgatcctagggtgctcccctgctcccataatttttgcaaaaagtgtttggaaggaattttagaagggagcgttcggaatagcctatggcgtcctgccccattcaagtgccctacatgccgaaaagaaacctccgccactggcataaattctctccaggtcaactatagcctaaagggcatagtggagaagtataacaagattaagatctcaccgaaaatgccagtgtgtaagggacatctggggcagcctctgaacatcttctgcttaactgacatgcagctgatttgtggaatctgcgctaccagaggcgaacataccaaacacgttttctgcagcattgaagatgcctatgctcaggagcgcgacgcattcgagtccctattccagtcttttgagacctggcgccggggggacgcactgtcaagactggatacactggagacctcaaagagaaaaagcctgcagttactgacaaaggattccgataaggtcaaggaattcttcgaaaagctgcagcacaccttagatcagaagaaaaacgagattcttagcgatttcgaaacgatgaaactggcagtaatgcaggcctatgatcctgagatcaataagttgaataccatcctccaggaacagaggatggccttcaatattgccgaagcctttaaggatgtgtctgagcccatcgtgttcctgcaacagatgcaggaattcagagagaagatcaaggttattaaggagacccctctgccgccctcaaaccttccagctagccccctcatgaagaatttcgacacaagccaatgggaagatattaagctggttgatgtggacaagttgtctctgccacaggataccgggacattcatttcaaagattccctggtcattctacaagctgttcctgcttatcctgctgttaggattggtaatagtgtttggccctactatgttcctggaatggtcactattcgacgacctggcaacttggaaagggtgtctgagcaacttctcctcttatctgaccaaaacagccgacttcattgagcagtcagtgttttactgggaacaagtgacagatggtttctttatctttaatgaacgattcaagaactttacgctggtggtcttgaacaacgtggctgaatttgtatgtaagtataagcttctgtag

SEQ ID NO: 209570 - DNA, 1233 bp, Artificial Sequence
  Description of Artificial Sequence: Synthetic coding sequence
atggacgtgatggagctgctggaggaggacctgacctgccccatctgttgtagcttgttcgatgatccacgcgttcttccttgcagccacaacttttgtaagaagtgcctggagggtattctcgaggggtctgtgaggaacagtctgtggcgcccggcaccctttaagtgtcctacatgccgaaaagaaacaagtgctacaggcatcaactcgctgcaggtgaactacagcctgaaagggattgtcgagaaatacaataagattaaaatttcacccaaaatgcctgtatgtaaggggcacctaggccaaccactgaatatattttgtttgaccgacatgcagctgatttgtgggatatgcgcaacccgtggcgagcacaccaagcacgtgttttgcagcatcgaagacgcctacgcccaggaacgagacgcctttgaaagtctgtttcagtcattcgagacctggaggaggggagatgcactgtcccggctcgacactctcgaaacatcaaaacgtaagtctctgcagctgctaactaaggacagcgacaaagtgaaggaattctttgagaagcttcagcatacactggatcagaaaaagaacgagattctctctgactttgagaccatgaaactagccgttatgcaggcctatgatcctgagatcaataaactgaatactattctgcaagaacaaaggatggcttttaacatcgccgaagccttcaaagatgtgagcgagccaatagtgtttttacagcagatgcaggaatttcgtgagaagatcaaagtgatcaaggaaacccctttacctcccagcaatctccctgcaagccctctgatgaagaactttgacacgagtcaatgggaggacattaagttggttgatgtggacaaattatctttacctcaagataccgggactttcatctctaagattccatggagtttctataaacttttcctgctgatcctgttacttgggctggtgattgtgtttggccctacaatgtttttggagtggtccctctttgacgatcttgcgacctggaagggatgtctaagcaattttagctcttatctgactaagacagcagacttcatcgagcaatcagtgttctactgggaacaagttacagacggatttttcatcttcaacgagcgctttaagaactttactttagtagtcttaaataacgtggctgaatttgtgtgcaaatacaagctgctctag

SEQ ID NO: 209571 - DNA, 1224 bp, Artificial Sequence
  Description of Artificial Sequence: Synthetic coding sequence
atggagctgctggaggaggacctgacctgccccatctgctgcagcctgtttgacgatcccagagttctcccatgctcccataacttctgtaagaagtgcctggaaggaattctagaaggcagcgtccgcaacagcctgtggaggcccgcaccgttcaagtgtccaacgtgtaggaaggaaaccagtgccactggcatcaactctttgcaggtgaactacagcttaaagggcatcgtggaaaaatacaacaaaattaagatctctccgaagatgccagtatgtaagggacacttggggcagcccctgaacatcttttgcctgaccgacatgcagttaatttgtggaatttgtgcaacacggggggaacacacaaagcacgtgttctgtagtatcgaagatgcatatgcgcaagagagggacgctttcgaatcactgtttcaatcttttgagacctggcgcaggggcgacgctctctctaggctcgacaccttggaaacttcaaagcgaaagtctctgcaactgttgacgaaagattctgacaaggtcaaggagttctttgagaagctgcagcataccctggaccaaaagaaaaatgagatcctctccgacttcgagactatgaaacttgccgttatgcaggcatacgacccagagataaacaaattaaatacaatcctgcaagaacagaggatggcatttaacatcgcagaggctttcaaggacgtatccgagccgattgtgtttctgcaacaaatgcaggagttccgcgagaagattaaggtgattaaggaaacccccctcccaccgagcaatttaccggcttctccccttatgaagaacttcgatacctcacagtgggaagacatcaaacttgtcgatgtcgacaagcttagccttccacaggataccgggacatttatcagtaagattccctggagtttttacaaattattcctccttattttactcctggggcttgtaatcgtgttcggacccacaatgtttctggagtggagcctcttcgacgacctcgccacatggaaaggctgcctgtctaacttttccagttatctgaccaagacggccgacttcatagagcagtctgtgttctattgggagcaggtgacggacgggttctttatctttaacgagagattcaaaaacttcacattggttgtgttgaataacgtggccgaatttgtctgtaagtataagctgctgtag

SEQ ID NO: 209572 - DNA, 801 bp, Artificial Sequence
  Description of Artificial Sequence: Synthetic coding sequence
atggagctgctggaggaggacctgacctgccccatctgctgcagcctttttgacgaccctagagtgctgccatgcagtcataatttttgcaaaaagtgtctcgagggtatactggagggaagtgtgcgaaatagcctgtggaggcccgctcccttcaagtgtcctacgtgcagaaaggaaacctccgctacaggcatcaactcccttcaggtaaactacagtctcaagggcatcgtggagaaatacaacaagattaaaatctctccaaagatgccagtttgcaagggtcacctgggacagcccctgaacattttctgcttaacagatatgcaactaatctgtggaatttgcgcaacaagaggagagcataccaagcacgtcttttgttcaattgaggatgcgtatgcgcaggaaagagacgctttcgagtccctgtttcagtccttcgaaacatggaggaggggggacgccttgagtcgtctggacaccctggagaccagcaagcgtaaatccctgcagctcctcacaaaggactccgacaaggtaaaagagttctttgaaaagcttcagcacactcttgatcagaaaaaaaacgaaatactgagcgactttgagactatgaaactcgccgtgatgcaggcttacgaccccgaaatcaacaagctgaacacaattcttcaggaacagcgaatggcctttaatatagccgaagctttcaaggacgtcagtgaaccaattgtctttctgcagcagatgcaagagttcagagagaagatcaaggttataaaagaaactccctag

SEQ ID NO: 209573 - DNA, 1224 bp, Artificial Sequence
  Description of Artificial Sequence: Synthetic coding sequence
atggagctgctggaggaggacctgacctgccccatctgctgcagcctcttcgatgaccctcgggtgttaccatgctcccacaatttctgcaaaaagtgtttggagggcatcctcgagggttcagttaggaactctctgtggcgtcccgcacctttcaagtgtcctacctgtcgcaaggagacatccgccacaggcatcaattcactgcaagtcaactattccttgaaggggattgtggaaaagtataacaaaatcaagattagccccaagatgcccgtgtgcaagggacacctgggacagcctttgaacatcttctgtctgaccgacatgcaattgatatgtggcatctgcgcaacccggggggagcacaccaagcatgttttctgctctatcgaagatgcgtatgcacaggagcgagacgctttcgagtctctcttccaatctttcgaaacatggagaaggggggacgccctaagtagacttgacacgctcgagacctctaaaaggaaatccctccaactcttgacaaaggacagcgataaggttaaggaattctttgagaagctccagcataccctcgatcagaaaaagaacgaaatcctctccgatttcgagaccatgaagctcgccgtcatgcaagcctatgaccccgagataaacaagctgaacaccatcctgcaggaacagcgaatggcattcaatatcgccgaggccttcaaggatgtgtccgaaccaattgtgtttctccagcagatgcaggagttcagagagaagatcaaggttataaaggaaacccctctcccaccttctaacctccccgcttctcctcttatgaaaaacttcgacaccagtcagtgggaggacatcaagctggtggatgtagataagctctcactacctcaggatacagggacgtttataagcaagattccctggagcttctacaagcttttcctgttgatccttctgctgggcctcgtgatagtgttcggaccaacaatgttcttagaatggtctctctttgacgatttagctacttggaaaggatgcttgagcaacttctcttcatatctgactaaaaccgctgatttcatagagcagtcagtcttctattgggaacaggtgacagatggattctttattttcaacgagcggttcaaaaactttacactcgtggtgctgaacaatgtggccgagttcgtttgtaaatacaaactgttgtag

SEQ ID NO: 209574 - DNA, 390 bp, Artificial Sequence
  Description of Artificial Sequence: Synthetic coding sequence
atggagctgctggaggaggacctgacctgccccatctgctgcagcttgttcgacgatccaagagtgctgccctgttcccacaacttttgtaaaaagtgcctagaaggaattctcgagggatcggttcgtaactcactgtggcgtcccgccccatttaagtgcccaacttgccgaaaggagactagcgcaactggaatcaactctctgcaggtgaattatagccttaagggaatcgtggagaagtataataagattaaaatctctccaaaaatgccagtgtgtaaaggccaccttggtcagcccctcaacatcttttgtctgacagatatgcagctcatctgtgggatttgcgccacacgcggggagcataccaagcacgtattctgctag

SEQ ID NO: 209575 - DNA, 1224 bp, Artificial Sequence
  Description of Artificial Sequence: Synthetic coding sequence
atggagctgctggaggaggacctgacctgccccatctgctgcagcctgttcgatgatcctcgcgtccttccgtgttctcataatttttgcaaaaaatgtctagaagggatcctggaggggtccgtgagaaacagcctgtggcggcctgcacctttcaaatgtcccacatgccgtaaggagacatccgcaaccggaataaactctcttcaggtcaactatagccttaaaggcatcgtggagaagtataacaagataaagatttcacctaaaatgccagtctgtaaaggccatctcgggcagccactgaatattttctgtttgacagacatgcaactaatctgtggtatatgcgcaaccaggggggaacacaccaagcacgtattttgtagcattgaagatgcctatgctcaggagcgggacgccttcgaatctctctttcagtcctttgagacatggcggaggggcgatgccctgtctcgacttgatacattggagacctcgaagaggaagtccctgcagctgctaaccaaagacagtgacaaggtaaaagaattttttgaaaagctgcagcataccctggatcagaaaaagaatgagatcctctccgattttgagactatgaagcttgctgtgatgcaggcttatgaccctgaaattaacaagctaaacactatcctgcaggaacaacggatggcattcaatatcgctgaggccttcaaggacgtgtccgagcctatcgtcttcctgcagcagatgcaggagttcagggagaagatcaaggtaatcaaagagacaccacttcctccatctaaccttccggcctcacccctgatgaagaacttcgacaccagtcaatgggaggatattaaactcgttgacgtggacaaactctctttacctcaggatacgggaacattcattagcaaaatcccctggtctttttataagctcttcctgcttatcctgcttctgggactggtcatcgtgttcgggccaaccatgtttctggagtggagcctgtttgatgacttagccacttggaaaggctgcctgtctaactttagctcctatctcactaagaccgccgattttattgaacagtctgtgttctactgggagcaggtgacagacggtttttttatcttcaatgaacggtttaaaaattttactctggtggtgcttaacaatgtggccgagtttgtgtgcaagtataagctgctgtag

SEQ ID NO: 209576 - DNA, 669 bp, Artificial Sequence
  Description of Artificial Sequence: Synthetic coding sequence
atgaacgacctgagcaaccgggtgtggagcatcagccaggagcccgatcctgtccagcggctgcaggcatataccgccaccgaacaggagatgcaacaacagatgtctttaggcgaactatgtcacccggtgccactgtctttcgagccggtgaagagcttctttaagggactggtggaagctgtggaatctacactgcagacacccctcgacatcaggttgaaagagtccatcaactgtcagctgtcagacccttcaagcaccaagccaggcactttactgaaaacatcccccagccctgagagatcccttctgctgaaatcctgttgggcagcctggggtccatgtccatgttgcggcagcacacgttccggcaagtgttggctggtcacagcatccccccccgccgccactactggtcggcttacctgcagaaggcgagcccccgccgggggatgggctaggcccacccccccattcggcgctgcaggacctcggccacccccagcttgggcagcaacagcgtctcctggcgcatcaagtgcaactacgctgtctacaggaccttctaccacggcctctgccgcagcatgtggcccagcaaccacaagcaccgggagtgctagcagctggacgactagaccagcctcttcaccttccaccacatag

SEQ ID NO: 209577 - DNA, 1329 bp, Artificial Sequence
  Description of Artificial Sequence: Synthetic coding sequence
atggccggcgccgccaccggcagccggacccccggccggagcgagcttgtggaggggtgtggctggcggtgccccgaacacggagaccgagtggcagaactgttctgccggagatgccgcaggtgtgtgtgcgcactgtgtccggtgctgggggcacaccgggggcacccagtaggtttggccctcgaggctgctgttcacgtacaaaaactgtcacaagagtgtctcaagcagctggcaatcaaaaagcagcagcacatcgacaatattacacaaattgaggacgccaccgaaaaactgaaggccaacgcagagtcctctaaaacttggttgaagggcaaattcactgagctgagattgctgctggacgaagaggaagcactcgcgaagaaatttatagataagaacacccagctgactctacaggtctacagggagcaggctgactcttgtcgcgaacagctggatatcatgaatgatctgagcaaccgcgtgtggagcatttcccaggagcccgatcctgtgcaaagactgcaggcctacaccgctacggaacaggagatgcagcagcagatgagcctgggggagctgtgtcatccagtaccactgtcgttcgagcctgttaaaagcttcttcaagggcctagtcgaagccgtcgagtctaccctgcagacaccactggacattcgcctcaaggaaagtattaattgtcagcttagcgacccgagctccactaaaccgggcaccctgctcaagacatcgccatcacctgagaggagcctcctgctaaaatatgcaaggacacccactctcgatcccgacactatgcatgctagactgcgcctgagcgcagacaggctgactgttaggtgcggtctgctgggaagtctgggtcccgtgcctgtgcttcggtttgacgcattgtggcaggtgctggcgagagactgttttgctactggaaggcactattgggaggtggatgtgcaagaagcgggagctggatggtgggtaggagctgcctacgcttcattgcggcgacgcggagcgtcagctgcggcccgcttggggtgcaaccgccagtcttggtgtctgaagcgatacgacctcgagtactgggcctttcacgacgggcagaggagccggttgagacccagggacgatttagacaggctaggcgtctttctcgattatgaagctggagtcctggcattttatgacgtaaccgggggcatgagccacttgcatacttttagagccactttccaagaaccactttaccccgccctccggctatgggaaggagctatatcgataccgcgccttccgtag

SEQ ID NO: 209578 - DNA, 1329 bp, Artificial Sequence
  Description of Artificial Sequence: Synthetic coding sequence
atggccggcgccgccaccggcagccggacccccggccggagcgagctggtcgaggggtgcggatggcgctgtcctgagcatggagaccgggtggccgaactgttttgtcggcgatgtcgacgttgcgtgtgcgcactttgcccagtactgggcgcgcacagaggtcaccctgtggggttggcattggaagctgctgtacatgtgcagaaactatcacaggagtgtctgaagcagctcgctatcaagaagcagcagcatattgataatatcactcagatcgaggacgctaccgagaaactcaaggccaatgccgaatccagcaagacctggctgaagggaaagttcactgagttgagactgctgctagatgaagaagaggccctggccaagaagttcatagataagaacacccagcttactcttcaagtgtatagggagcaagcggactcttgcagggagcagcttgatatcatgaacgatttaagcaaccgcgtgtggagcataagccaggaaccagaccctgtgcagagactccaggcttacacagcgacagaacaggagatgcagcagcagatgtcactgggcgagctgtgccatcctgtgcctctctcctttgagcctgtgaagagcttcttcaaaggactggtggaagctgtggaaagcaccctgcaaacaccgctggacatacgtttaaaggagtcaatcaattgtcagctcagcgacccctcgagcaccaaacctggcactctccttaagacatctccctctcccgagcggagccttctgctgaaatatgccagaaccccgacgctcgacccggacaccatgcatgctcggctacgcctcagcgcggacagacttaccgtgcgctgtgggctgcttggatcactgggacccgtacctgtgctaaggttcgatgcactgtggcaggtcttagcccgcgactgtttcgccaccgggagacattactgggaggttgacgtccaggaggcaggagctggatggtgggtcggtgccgcttacgcatctctgagacgccggggggcgtctgccgctgcacggcttgggtgcaatcggcagtcttggtgcctgaaacggtatgaccttgagtattgggccttccacgacggccaacgctcaagacttcggcctcgggacgacctggaccgtctgggcgtgtttctcgactacgaagccggagtcctggccttttatgatgtgacaggaggcatgtcacacctccacacatttcgcgccactttccaagagccactttacccagctctccgactgtgggagggcgccatttccatcccaagactgccatag

SEQ ID NO: 209579 - DNA, 1221 bp, Artificial Sequence
  Description of Artificial Sequence: Synthetic coding sequence
atggccggcgccgccaccggcagccggacccccggccggagcgagctcgttgaaggctgtggttggcgctgccctgaacatggcgacagggtggcagagctcttctgccggagatgtagacgatgcgtgtgcgccctatgtccagttctgggcgcgcatcgcggtcatcccgtaggccttgctctcgaagccgccgtccatgttcagaaactctcacaagaatgcctgaaacagttggccataaagaaacaacagcatatcgataacatcacacaaattgaagacgctacagagaaactcaaggccaatgccgaatctagcaaaacttggctcaagggaaagtttaccgagttgaggcttctgctggatgaggaggaggccctggctaagaagttcatcgataagaacactcagctcaccttacaagtgtatagggagcaggctgacagctgcagagaacaactggacatcatgaatgacctgagcaatcgcgtttggagcataagtcaggagcccgacccagtgcaacggttacaagcttacactgcaacagaacaggagatgcagcagcagatgagtctgggcgagctgtgccatcccgttcccctttctttcgagcctgtgaagtccttctttaaagggcttgtagaggcagttgaaagtactctccagaccccgctcgatattcgcttaaaggagagcataaattgtcaactttccgacccctcgtcaacaaaacccggaacgctgcttaagacttcaccaagcccagaaagatcgctgctgctgaaatatgcgcgcacccccacactggatcccgacaccatgcacgcaaggcttcggctctctgcggatcggctaacagtaagatgtggactactgggctcactcgggccggtgcctgtgctcagatttgacgccctgtggcaggtgctcgcaagagattgcttcgccacaggacggcattattgggaagtcgacgttcaagaggctggagccgggtggtgggtcggcgcagcctacgctagcttaagaagaaggggggcatcagccgcggctcgactcggctgcaatcgccagtcctggtgcctgaagagatatgacctggaatactgggcttttcacgatggccaacgatcggcatgtggacccgctaccacaagcactggatccgcttcatcatggacaacaaggcccgcttcttcaccgtctacgacatag

SEQ ID NO: 209580 - DNA, 762 bp, Artificial Sequence
  Description of Artificial Sequence: Synthetic coding sequence
atggccggcgccgccaccggcagccggacccccggccggagcgagctggtggagggctgcggatggaggtgtcccgaacacggtgatcgagtggcagagctgttttgccggcgttgccgcaggtgcgtgtgtgccttatgtccagtgttaggggcacacaggggacaccctgtcgggttggcgctggaagcggctgtgcacgtacagaagctgtcccaagaatgccttaagcagcttgctatcaaaaagcaacaacacatcgataacataacccagatagaggacgctactgaaaagttgaaggctaatgccgaatcatctaaaacttggttgaaaggaaagttcaccgagctcaggctgctgctggatgaagaggaggccctcgcaaagaagttcatcgataagaatacacaacttactctccaagtgtacagggagcaagctgatagttgcagggaacagcttgatatcatgaatgacttgtcaaacagggtctggagtatatctcaggagccagatcctgtgcaacgattacaggcgtacactgctactgagcaagaaatgcagcagcagatgtctctgggggaactgtgtcaccctgtccccttaagtttcgagcctgtgaagtcctttttcaaggggttagtggaagctgtggagtcaaccctgcagacccctcttgacatcaggctgtcaccaacaaaccacgcctattctgccctcaaggtttcatccccccgcctggtatccaataggccatag

SEQ ID NO: 209581 - DNA, 1329 bp, Artificial Sequence
  Description of Artificial Sequence: Synthetic coding sequence
atggccggcgccgccaccggcagccggacccccggccggagcgagctcgtggagggctgcggctggagatgccctgaacatggcgatcgggtggcagaattgttctgccgtagatgccgccgatgcgtgtgtgccctttgccctgtgttgggcgcacacagagggcaccctgtgggcttggctctggaggctgccgtacatgtgcaaaaactgagccaggagtgcctcaagcagctagctattaagaaacagcagcacatcgacaatatcacccagatagaggacgccaccgaaaagctgaaggcaaacgccgaatcgtccaagacttggctgaagggtaagtttacggaactcagactgctgcttgatgaggaagaagccctcgccaaaaaattcatcgacaagaacacccaactgaccttgcaggtctatcgagaacaggctgacagctgccgcgaacagctcgacatcatgaatgacctgtccaaccgcgtgtggagcatttcacaagagccggaccctgtccagcgactgcaggcttataccgccaccgagcaggaaatgcagcagcagatgtctttaggggaactctgccatcccgttcccttgagctttgagccagttaagagcttctttaagggcttagtagaggcggtcgaatctacccttcagacacctctggacatcagactaaaggagtccattaattgtcagctatctgatccatcttccacaaagccaggtaccttgcttaagacaagtccaagccccgagcgcagtctcctgctgaaatacgcccgaacgcccacgctcgaccccgacaccatgcatgcaagattgcggctcagtgccgaccggttgacagtccgctgtgggctgctgggttccctgggtccggtacccgttctccgattcgacgctctgtggcaggtattggcgcgagactgcttcgctaccggccggcactactgggaggtcgacgtgcaggaggcaggtgcaggctggtgggtgggtgccgcctacgcttccctgcggaggcgcggggcgtccgcagctgcacgattgggttgcaatagacagtcctggtgcctcaaaagatacgatctagagtactgggctttccacgacggtcagcgctcacgcttacggcctcgggacgacctggaccgcctcggcgtgttcttggattatgaggccggcgtgctcgcattctacgacgttacgggaggaatgtcccatctccataccttccgagccacctttcaggaaccattgtatcccgcactaaggttgtgggaaggtgccatatctatcccccggctgccttag

SEQ ID NO: 209582 - DNA, 672 bp, Artificial Sequence
  Description of Artificial Sequence: Synthetic coding sequence
atgagcgccggcagcgacggcggcggccggcacttctgcggcggcatcaactgccaattgtccgatccttcttccactaaaccagggaccttactcaaaacatcccccagtcccgagcgtagcttgctgcttaaatatgctaggacacctactcttgaccccgacactatgcacgcaagactgcgactctccgctgaccgcctaaccgtgcgttgcggcttactcgggagtttgggccccgtgcctgtgctccgcttcgatgcactctggcaggttctggctagggactgtttcgcgacaggtcgccattattgggaagtggatgtgcaggaggctggagcaggatggtgggtgggcgccgcttatgcctctctccggaggagaggggcaagcgcagctgcaagactgggctgcaaccgccagtcctggtgtctcaagcgttacgacctggagtactgggcatttcacgacggccagcgttccaggctgcgaccgcgagacgacctggaccgcctgggcgtgtttctggactatgaggctggcgtcctagccttctatgatgtgacagggggcatgagccacttacacaccttcagagcaacctttcaggagccactttacccagctctgcgtctgtgggagggagctatttcgatccctcgactcccatag

SEQ ID NO: 209583 - DNA, 2316 bp, Artificial Sequence
  Description of Artificial Sequence: Synthetic coding sequence
atgcaccggagcggccggtacggcacccagcagcagcgggccggctctaaaactgctgggcccccttgccaatggagccggatggctagcgaaggtaccaatatcccttcccccgtcgtgagacaaatagataagcaattcctcatctgctcaatctgtctagaacggtacaaaaaccctaaagtcttaccatgcttacacaccttctgcgaacgctgtctccagaactacattcctgcccactctctgaccctgtcgtgtccagtctgcaggcagacgtccatactgccagagaaaggggttgctgcccttcagaacaactttttcatcacaaacctaatggacgtgttgcagcgaactcccgggtctaatgcggaagaatcctccatcctggagactgtcacagctgtcgctgctggcaaacctctcagttgccctaatcatgatggcaatgttatggagttttactgccaaagctgcgaaactgctatgtgcagagaatgcacagagggtgaacacgctgaacacccaacagtgcctctcaaagacgtggtcgagcaacacaaagcatcactgcaggtgcagctggacgcggttaacaagaggctgcccgagatcgactctgccctgcagttcattagtgagatcattcaccagttaaccaaccagaaagcctctattgtggatgatatccattccacctttgacgaactgcaaaaaaccctaaatgtgcgcaaatcagttctgctgatggagctggaggtaaactatggcctgaaacataaagttctgcagtcacagctggacaccctcctgcaggggcaggaatctatcaagagttgctccaactttacagctcaggcactaaatcacggcacggagactgaagttcttcttgttaagaagcagatgagcgaaaaactgaacgagctcgcggatcaggattttcccctacatccccgcgaaaatgaccagctggactttatcgtcgaaacggagggtctcaagaagtccatccacaatttggggactattctaaccactaatgccgtagcatctgagaccgttgcgactggcgaggggctccgacaaaccatcatcggacagcccatgtcggttactattaccaccaaagacaaagatggagagctgtgtaaaaccgggaatgcgtacctcacagcagagctaagcacgccagatggcagcgtggccgacggcgaaatcctggacaataagaacgggacctatgaatttctttacactgtccagaaagagggcgactttacactttccctgagactatacgaccagcacattcgtggaagtccttttaaactgaaggtaatccggagcgctgacgtctcgcccaccacagaaggagtgaaaagacgggtcaagtcccccgggtccgggcacgttaaacaaaaggctgttaaacggccagcgagcatgtactctaccggtaagaggaaagagaacccaatagaagatgaccttatcttccgggtgggtacgaagggaagaaacaaaggagaattcaccaacttgcagggggttgcagcaagcacaaatggaaagatcttgattgcagactcaaataaccaatgcgtgcagattttctccaatgatgggcagtttaaaagcaggtttggtatccgaggtagatccccaggccagttacagagacctacgggagtcgccgtgcacccctcaggagacatcataattgctgattatgataataaatgggtgtcaattttttcttcagacgggaagttcaagaccaaaatcggctccggaaaacttatgggaccaaaaggcgtgtctgtcgatcgcaatggtcacatcattgttgttgacaataaggcttgttgcgtgtttatattccaaccaaatgggaaaattgtgaccagattcggctcacggggcaatggcgataggcaatttgcaggaccacattttgctgcggtgaattctaacaacgagatcatcattaccgactttcataatcatagtgttaaagtttttaatcaggaaggggaattcatgctgaaattcgggtcaaatggggagggtaatggacagttcaacgccccaacaggggtggccgtcgactcaaatggaaacatcattgtcgctgattggggcaacagccgaatccaggtgttcgacggttctggcagtttcctgagctacatcaataccagcgcggatcccctctatgggccacaggggctggcccttacctcggacggccatgtagtggtggcagactctggcaaccattgttttaaggtgtatcgatatctgcagtag

SEQ ID NO: 209584 - DNA, 2235 bp, Artificial Sequence
  Description of Artificial Sequence: Synthetic coding sequence
atggccagcgagggcaccaacatccccagccccgtggtgcggcagattgataaacaattcctgatttgttccatttgcctggaacggtataagaatcccaaggtcctgccctgtcttcacactttttgcgagcggtgcctccagaactacattcccgcccactctctgactctctcatgccccgtatgccggcaaactagtatattgcctgagaagggagtggccgctctgcaaaacaatttttttataaccaatttgatggatgtgttgcaaaggacacccggtagcaatgcggaggaatcttcgatcctggaaacagtgaccgctgttgctgcagggaaaccactgtcatgtccaaatcacgacggcaatgtaatggagttctactgtcagtcatgtgaaaccgcgatgtgtagagagtgtactgagggtgagcacgcagagcatccgactgtgcctcttaaagacgttgtggagcaacacaaagcaagcctgcaggtgcaactggacgccgtgaacaagaggctgccagagattgactctgcgctgcaattcatatcagagatcatacaccagctaaccaaccaaaaagcttctattgtggatgacatccactctaccttcgatgagctgcagaagacactgaatgtgcgcaaatccgttctgctaatggagctggaagtgaactacggcttgaagcataaggtcctccagtcccagctggacaccctgctgcaggggcaggaatccattaaatcctgctccaattttactgcccaggcgctgaaccacgggacagagacagaagtgctcctggtcaagaagcagatgtccgagaagctgaacgagctagccgaccaggactttccactgcatccccgagagaatgatcagttggattttattgtcgaaaccgaaggcttaaagaagtctatccataatcttggaaccatcttgacgactaatgcggtagctagtgaaacagtggcaaccggagaaggcctcagacagacaattatcggacagccaatgagtgtgactatcacaaccaaagacaaagatggagaactttgcaagaccggcaatgcatatctcacagccgagctgagcacacccgatggctcagtcgccgatggggagatcttggataataaaaatggcacatacgagtttctctataccgttcagaaagagggggattttaccctctccctacggctatacgatcagcatattagaggcagcccgtttaagctgaaggtcattcggtcagcagacgtgtccccaacgaccgaaggtgtgaaaagacgagtcaaatcgcctggctcaggccacgtcaaacagaaggcagtcaagcgcccggccagcatgtattctaccggtaagcgcaaagaaaacccaattgaggacgacctgatattccgggtggggacaaagggcagaaataagggtgaattcaccaatctgcagggggtggccgcttctactaacggcaagattttgattgcggactctaataatcagtgcgtacagattttttccaatgacggccagttcaagtcccgttttggcattcggggtcgatcccccgggcagcttcagaggcctacaggagtggcagtacacccatccggcgacattatcatcgcagattatgacaacaagtgggtgtccatcttctcttccgatggtaaatttaaaactaagattgggagcggaaaactgatgggacccaaaggtgtctcggtagatcgcaacggtcacatcattgtcgtagataataaagcatgctgcgtcttcatatttcagcccaacggcaagattgtgacacgctttggaagtcgtggcaacggggatcgacagttcgcgggaccacactttgcggcggtgaattccaataacgagatcatcatcaccgacttccacaatcactccgtaaaagttttcaatcaggagggggaattcatgttgaaatttgggtccaatggagagggcaatggacagttcaacgcccccactggagtggcagtggattctaatggcaatattattgtcgccgactggggaaattcacggatccaggtgtttgatgggagcggatcctttttgtcttacataaatacttctgccgacccactgtatgggccacaggggctggccctgacgtctgatgggcatgtggttgtcgctgacagcggaaatcactgtttcaaggtctacagatacctgcagtag

SEQ ID NO: 209585 - DNA, 1428 bp, Artificial Sequence
  Description of Artificial Sequence: Synthetic coding sequence
atggccagcgccgcccggctgaccatgatgtgggaggaggtgacctgtcccatctgtctggatccatttgtagaacccgtctcgattgagtgcggacatagtttctgtcaggagtgcatttctcaggtgggcaagggcggcggctcggtgtgccccgtgtgcagacagcggtttctgttgaagaatttacgccccaataggcagctggccaatatggtcaacaacctgaaggagatatctcaggaggcaagagagggcacacaaggggagcgatgcgccgtccacggcgagagacttcacttattttgtgagaaggatggaaaagccttatgttgggtctgcgctcagtccaggaagcatagggaccacgcaatggtgcctctggaggaggccgctcaggaataccaggagaaactccaggtcgccttgggggagttgcgcaggaaacaggagctcgccgagaaattggaagtagaaattgccataaaaagagctgactggaaaaagaccgttgagacacagaagtccaggattcatgccgaatttgttcagcagaagaacttcttggtcgaagaggagcagcggcaactacaggagctggaaaaggacgagcgcgaacaactgagaattttgggcgagaaggaagcaaaactggcacagcagtcacaagctttgcaggaactcatctctgagctcgaccggcgttgccattccagtgctctcgagttgctacaggaggtaatcatcgtgctggagcggtcagaaagctggaacctcaaggatctcgatatcacaagccctgagttacgctccgtgtgccacgtgcctgggctcaagaagatgttgagaacatgtgctgtacacattaccttagacccagataccgcgaacccctggctcattctttccgaagaccggaggcaggtgcggctcggagacacccaacagtcgatcccagggaacgaggaacggtttgactcttaccctatggtactcggagcccagcatttccacagcggcaagcactactgggaagtcgacgttacggggaaggaagcttgggatcttggagtgtgtagagactcagtgaggcgcaaaggccatttcttgttgtcctcaaagtccggcttttggaccatctggctttggaacaagcagaagtatgaggccgggacttacccccagaccccactgcacctgcaagtaccgccctgccaagtgggcatcttccttgattacgaagcaggcatggtgtctttctacaacatcaccgatcatggctcgcttatatacagcttctctgagtgtgccttcactgggccgctcagaccgtttttcagccccggatttaacgacggaggaaagaatacagccccgctgacactttgtccgctgaacatcgggtcacagggtagtaccgattactag

SEQ ID NO: 209586 - DNA, 1428 bp, Artificial Sequence
  Description of Artificial Sequence: Synthetic coding sequence
atggccagcgccgcccggctgaccatgatgtgggaggaggtgacctgtcccatctgcttagatcctttcgtagaacccgtctccattgagtgcggccatagtttttgccaagagtgtatcagtcaagtcggaaaggggggcggatccgtgtgccccgtgtgtcgacagcgctttttgctgaagaatctgcggcccaacaggcagctcgcgaacatggtgaacaaccttaaagagatttcccaagaagcccgcgagggcacccagggtgaacggtgcgccgtgcacggtgagaggctccacttattttgtgaaaaggatggcaaggcactgtgctgggtgtgcgcccagagccgtaaacatcgggaccacgccatggtccccctggaggaagcagctcaggaatatcaggagaaactacaggtggcactcggggagttacggcggaagcaagagctcgccgaaaagttagaggtcgagatagcaattaagagggctgactggaagaagacggtggaaacacaaaagtccaggatacacgccgagtttgtgcagcagaaaaatttcctagtggaggaagagcagcgccagcttcaggaattggaaaaggatgagcgagaacagttgcgaattctgggggagaaagaagctaagctggcccaacagtcccaggctctccaggagctgatctcagagctagacagaagatgtcacagcagcgccctggagctcttacaggaagttatcgtgctgggccctcggagtgaaagctggaatcttaaagatcttgacatcaccagccccgaactacgttccgtgtgtcatgtgcctggtttgaaaaagatgctgcgtacctgtgctgtgcacatcaccctggatcccgatacagcaaacccctggctgatccttagtgaggacagaaggcaagtgcggttaggagatacacagcagagtatacctggaaacgaagagagattcgattcataccctatggtgctcggagctcagcacttccatagcggaaaacattattgggaagtcgacgtaaccggaaaggaggcatgggatctgggggtttgtagggactctgtccgcagaaaaggacattttttgctgagttcaaaaagcggcttctggaccatatggctctggaataaacagaagtacgaagccggaacatatccacagactcctttacatctgcaagtgccaccctgccaggtgggtatattccttgattatgaagccgggatggtgtccttctacaacatcacggatcatgggagccttatctacagcttcagcgaatgtgctttcaccgggcccttgcggccgttcttcagtccagggtttaatgatggcggtaagaacacggcgccactgactttgtgtcctttgaatattggatcgcaaggcagcacagattactag

SEQ ID NO: 209587 - DNA, 1497 bp, Artificial Sequence
  Description of Artificial Sequence: Synthetic coding sequence
atggacttcagcgtgaaggtggacatcgagaaggaggtgacctgccccatctgtctagaactgctcaccgagccgttatctctcgattgcggacatagcttctgccaagcctgcataacagccaaaatcaaagagagcgtgataatatccagaggagaaagtagctgcccagtgtgccaaacacgctttcagccaggtaatctgcgccctaataggcatttggccaatatcgtcgaacgggttaaagaggtcaagatgtcacctcaggagggacagaagagggacgtgtgcgaacatcatgggaaaaagcttcagatcttttgtaaagaggatggcaaagtaatctgctgggtgtgtgagttgagtcaagagcaccaggggcatcaaacattccgaatcaatgaggtagtgaaggagtgccaagaaaaactgcaggtcgcattacagcgtttgatcaaggaagatcaggaggctgagaaactggaggatgacattagacaggaaagaaccgcttggaagaattacatccagatcgagcggcaaaagatcctgaagggcttcaacgaaatgagagtgatccttgacaacgaagagcaaagagaactgcagaagcttgaggaaggggaggtgaacgtcctagacaacctggccgctgcaaccgatcaactggtgcaacagcgtcaggatgcctctacactgatttcggacctgcagaggcgcttgcgtgggagttcagtggagatgctccaggacgtaattgatgtaatgaagcgcagcgaatcctggaccctgaagaagcctaagtctgtgtccaaaaaactcaaatccgtgtttagggtacctgatctgtcaggtatgcttcaggtgctgaaggagctgaccgacgtgcaatattactgggtggatgtgatgctgaatccaggtagcgcgactagcaatgtggcaatttcagtagatcagcggcaagtaaagacggttcgtacctgcactttcaaaaacagcaacccatgcgatttttctgctttcggggtcttcggctgccaatatttttccagcggaaagtattactgggaagtagacgtttccgggaaaatagcctggatcctgggggtgcactccaagattagctctctgaacaaacgcaaatcctctggttttgccttcgatccatcagtcaactacagtaaagtgtactccaggtaccggccccagtatgggtactgggtgatcggacttcagaacacatgcgaatataatgcttttgaagattctagcagtagcgaccctaaagtgttgaccctgttcatggctgtacccccgtgtcggataggagtttttcttgactacgaagccggcatagtgtctttcttcaacgtgactaaccatggcgcgctgatctacaaatttagtggctgtcggtttagccggcctgcatatccttattttaatccttggaattgcctcgttccaatgacagtgtgcccccctagttcatag

SEQ ID NO: 209588 - DNA, 684 bp, Artificial Sequence
  Description of Artificial Sequence: Synthetic coding sequence
atggacttcagcgtgaaggtggacatcgagaaggaggtgacctgcccgatatgcctggaactgctgacagagccattatctctggactgcgggcattccttctgccaggcttgcattacagccaaaattaaagagagcgtgattatttccagaggggaaagctcttgccctgtctgccagacacggttccagcctggcaatctgcgccctaaccgccaccttgcaaacattgtggagcgcgtcaaagaagtcaagatgtctccccaggaaggccagaagagagacgtgtgtgagcatcatggaaaaaagttacaaatattttgcaaagaggacggcaaagtgatttgttgggtgtgcgagctctcccaggagcaccagggccaccagacattccggatcaacgaggtggtgaaggagtgccaggagaagctgcaagtggccctgcaacggctgatcaaggaagatcaggaagcggagaagctcgaggacgatatccggcaagagaggacggcttggaaaaattatattcagatagagcgacaaaagatcctgaaaggcttcaatgaaatgagagtaatcctggacaatgaggagcaaagagagttgcagaaactggaggagggagaggtgaatgtgctggacaaccttgccgcagccacagaccagttggtgcagcagcggtag

SEQ ID NO: 209589 - DNA, 612 bp, Artificial Sequence
  Description of Artificial Sequence: Synthetic coding sequence
atggacttcagcgtgaaggtggacatcgagaaggaggtgacctgccccatttgtttagagctattgactgagcccctttccttggactgcggccactcattctgccaggcctgcatcaccgcgaagatcaaagagtctgtaatcatctcccggggggagtcatcttgtccagtatgtcagacaagatttcagccaggaaacctgcggcctaaccggcacctggccaacatcgtggagagggtcaaggaggtgaaaatgagccctcaggagggacagaagcgggatgtctgcgaacatcatggaaagaagctccagattttttgtaaggaggatggaaaagtgatctgttgggtatgcgagctgagccaggaacatcaggggcatcagactttcaggattaacgaggtggtgaaggaatgccaggagaagctccaggtcgccctgcagcggttaattaaagaagaccaggaggccgaaaagctggaggacgacattcgccaggagcggaccgcgtggaaaaattacattcagatagagcgccagaagatactaaagggattcaacgagatgcgggttattctggacaatgaggagcagcgcgaactacaatag

SEQ ID NO: 209590 - DNA, 1263 bp, Artificial Sequence
  Description of Artificial Sequence: Synthetic coding sequence
atggacttcagcgtgaaggtggacatcgagaaggaggtgacctgccctatatgcttggaattgctgaccgaacctctcagcttggactgcggccattcgttttgccaggcctgtatcacagcgaagataaaggaaagtgtcattatttcccgaggagaatcctcatgcccagtctgccaaacgcggttccagccagggaatttgcgacccaacagacatcttgccaatatagtcgaacgagtaaaggaagtcaagatgagtccccaggaaggacagaagcgggacgtttgtgagcatcacggaaagaaacttcagatattctgtaaggaagatggcaaagttattttggacaatgaggagcaaagagaactccagaagctggaggaaggagaggtcaatgtgttagataacctggcggccgccaccgaccaactggtgcagcagcggcaggacgccagcaccctgatcagcgacttgcagaggcggctgcgcggatcctccgtggaaatgctccaggatgtaatcgatgtaatgaaaaggtccgaaagctggacgctcaaaaaacctaaatccgtgtctaagaaactgaagtcagttttccgagtccccgacctgagcggcatgctgcaggtcttgaaagagcttaccgatgtccagtattactgggttgacgtgatgctgaatccgggtagtgccaccagcaatgtggccatttctgttgatcagagacaggtgaaaaccgtgcgcacctgtacattcaagaactccaacccgtgtgatttctccgcattcggcgtcttcggctgtcagtatttctcttcaggcaaatattattgggaagtagacgtgagcggtaaaatcgcctggattctgggggtccatagtaaaatctcttctctcaacaagagaaaaagctctggcttcgctttcgaccccagcgtgaactactcaaaggtgtactcacgttataggcctcagtatggctattgggttataggactccagaatacatgtgagtacaacgccttcgaagacagctctagtagtgatcccaaagtccttacgttgtttatggctgttccgccctgtaggattggagtgtttctggattatgaggcgggcatcgtgtccttcttcaacgtaaccaaccatggagcactcatttacaagttttccggatgtagatttagccggccagcttacccgtactttaacccctggaactgtctcgtccccatgacagtgtgccccccctcttcctag

SEQ ID NO: 209591 - DNA, 930 bp, Artificial Sequence
  Description of Artificial Sequence: Synthetic coding sequence
atgcgggtgatcctggacaacgaggagcagcgggagctgcagaagctcgaggaaggtgaggttaacgttctcgacaatcttgctgccgccaccgaccagctcgtgcagcaacggcaggatgcttcaactctgattagcgacctgcagcggcggctaagaggcagctctgtagaaatgttacaggatgtcattgatgtcatgaaacgcagtgagtcatggaccctcaagaaaccgaaatctgtatctaagaagctgaagtccgtcttccgtgtgccagatctgtcaggtatgctgcaagtcttgaaggagctgacagacgtgcagtactactgggttgacgtgatgctgaatcccggttccgccacctccaatgtcgctatcagcgtggaccagaggcaggtgaaaacagtcaggacctgcacctttaagaactccaatccatgcgacttttcagcattcggtgtgttcggctgtcagtatttttcttcaggcaagtactattgggaggtcgatgttagcggaaaaattgcgtggatcctgggagtgcactctaagattagctcactaaacaagaggaagtctagcggcttcgcctttgaccctagcgtgaactacagcaaggtttatagccgctacaggcctcagtacggatactgggtcataggtttgcaaaacacctgtgagtacaacgcctttgaggacagttccagtagcgatccgaaagtcttaactctgtttatggccgttccaccttgccgaatcggtgtgtttcttgactacgaggccggaatcgtgtcattttttaacgtcacgaatcacggcgcgctgatatacaagttttccggctgtcgctttagtaggccagcttatccatacttcaatccttggaattgcctggtccccatgaccgtctgcccacccagcagttag

SEQ ID NO: 209592 - DNA, 1893 bp, Artificial Sequence
  Description of Artificial Sequence: Synthetic coding sequence
atggccgagctgtgccccctggccgaggagctgagctgcagcatctgtttggaaccctttaaggagccagtgacgacaccttgtgggcataacttctgtggcagctgtttgaacgaaacctgggccgtgcaaggctcaccatacctctgcccgcagtgtcgggctgtctatcaggcacggccgcaacttcacaaaaataccgttctatgtaacgtcgtcgaacagttcctgcaggccgatttggctagggagcctcctgccgatgtgtggactcctccggcgagagccagtgcgccttcccctaatgcccaggtggcctgcgaccactgtctgaaagaggcggcagtgaaaacttgtcttgtatgcatggcctctttttgccaagaacacctgcagccccactttgactccccagcctttcaggatcatcccttacagccccccgtccgtgacttactgagaagaaagtgttcacagcacaatagactaagggagtttttctgcccagagcactcagaatgtatatgccacatttgcctagtcgaacacaaaacctgcagtcccgcctctctaagtcaggccagcgcagacttggaggcaaccctcagacataaattaacagtgatgtattcccagatcaacggagcatctagggcgctggacgacgtgagaaatagacagcaggacgttcgtatgacggctaatcgaaaggtggagcagcttcaacaggagtatacagagatgaaagccttacttgacgccagtgagacgacgagcactcgaaagattaaagaggaagaaaagcgtgtgaacagcaagtttgatacaatctaccagattctgctgaagaagaaatccgaaatccagaccctcaaggaagagatcgagcagtcacttactaaaagagatgaatttgaattcttggagaaggcgagtaagttaaggggaatctctaccaagcctgtgtatattccagaggtggagctgaaccacaaacttataaaaggtatccatcagagcacaatcgacctgaagaatgagttgaaacagtgcataggacgtctgcaagagcccactcctagctctggggatccaggcgaacatgatcccgctagtactcacaagagtacccggcctgtgaaaaaggtgtctaaagaagagaagaaatctaaaaagccccccccggtcccagcccttcctagtaaactgcctactttcggagctcctgaacagttggtggacctgaagcaggccggactggaggccgcagcgaaggctaccagctctcacccgaatagcactagcttaaaagctaaagtgctagaaaccttcctcgctaaatctcgacccgaacttctggaatactatattaaagttattctcgactacaacacagcccacaataaggtcgccctgtcagagtgttacaccgttgcatcagttgccgaaatgcctcagaactaccgaccacatccccagagatttacttattgttcccaagtgctcggtctgcattgttataaaaaagggattcactattgggaggtcgagctgcagaaaaacaatttctgtggtgttgggatctgctacggctctatgaataggcaggggcctgagagtaggctgggaagaaactcagccagttggtgcgtcgagtggttcaatacaaaaatctcagcatggcacaataacgtggagaaaaccctgccaagcaccaaggctacccgggtgggagtactcctcaactgtgatcacggatttgtgatcttcttcgcggtcgccgacaaggtgcacctcatgtataagtttcgcgtggactttacagaggctttatatcccgccttttgggtgttttctgccggggctactctgagcatttgcagtccgaagtag

SEQ ID NO: 209593 - DNA, 1893 bp, Artificial Sequence
  Description of Artificial Sequence: Synthetic coding sequence
atggccgagctgtgccccctggccgaggagctgagctgcagcatctgcttggaaccttttaaggaacctgttactaccccctgcggccacaacttctgtggcagttgcttgaacgagacctgggctgtgcagggcagcccatatctctgtcctcaatgccgggctgtttaccaggccaggccacaattacacaagaatacagtgctgtgtaacgtagtggagcagttcctgcaggctgatctggctagggaaccccccgctgacgtgtggaccccgcccgcccgcgcatccgccccgagccctaacgctcaggtggcctgtgatcactgtctgaaggaagccgctgtaaagacgtgtctggtctgcatggctagcttctgccaggaacacttgcagcctcacttcgattcacccgcctttcaagatcaccccttgcaacccccggtgcgcgaccttcttaggcgcaagtgcagccagcacaatcggttacgcgaattcttctgccctgagcacagcgagtgtatctgccatatttgcctggtcgagcataagacctgttcacctgcgtctctcagtcaggcttccgcagacttggaagccacattgcggcataaactcaccgtgatgtacagtcaaattaatggcgcctcacgggcattggacgatgtgaggaatcgtcagcaggatgtgagaatgacagcaaatcgaaaagtggaacagttgcagcaggaatatactgaaatgaaagcgctcttggatgcgagcgagactacttccacaagaaaaataaaagaagaagagaagagggtcaactcaaagttcgataccatttaccagatcctcctcaagaaaaagtctgaaatccaaaccctgaaggaggaaattgagcaaagcctcacaaaacgcgacgagttcgagttcctggaaaaggctagcaagttaagggggatctctaccaagcccgtgtatattcccgaagtagagctcaaccataagctgattaaaggtatccaccagagcacaattgacctaaaaaatgagctcaaacaatgcataggcagactgcaggagccaacaccgtcttcgggcgaccccggtgagcatgatccagctagcacccacaaatctacacgtccagtaaagaaggtgagtaaagaggagaagaaaagtaagaagcctccccccgtgcctgctctacctagcaagttacctactttcggcgcacccgagcagcttgttgacttgaagcaggcaggtttagaggcagccgctaaggcaacctctagccatcctaattccacctctcttaaagctaaggtactggagacctttttggctaagtcaaggcctgaattactggaatactacatcaaggtcattctggattataacaccgcccataataaggttgctcttagcgagtgttacaccgtggcctcagtcgcagagatgccacagaactatagaccacacccacaacgctttacgtactgcagtcaggtgctgggcttacattgctataagaaaggaatccattactgggaagtggaactacagaaaaataatttttgcggagtcggaatctgttacggttcaatgaatcgacagggacccgaaagtagactcggcaggaacagtgcatcctggtgtgtggaatggtttaacacaaaaattagcgcatggcataataatgtggagaaaacattgccatctacgaaggcaacacgcgtcggagtcctgctgaattgtgaccatggatttgtaatattcttcgctgtggcggacaaggtacatctgatgtacaaatttagagtagattttacagaagccctctacccggctttttgggtattctccgcaggcgcgacactctcaatctgttcccctaagtag

SEQ ID NO: 209594 - DNA, 1077 bp, Artificial Sequence
  Description of Artificial Sequence: Synthetic coding sequence
atggccagcggcagcgtggccgagtgcctgcagcaggagaccacctgccctgtatgtttacaatattttgcagagccaatgatgctggactgtgggcacaatatttgttgcgcctgtctggctcgttgttggggcacagccgagacaaatgttagttgcccacaatgccgtgagacctttccacagcggcacatgagacccaataggcacctcgctaacgtgacccaactggtcaagcaactccgcactgaacgcccatccggcccagggggcgagatgggcgtgtgcgaaaaacatagagagccactgaagctttactgtgaagaggatcagatgcccatttgcgtggtatgtgaccggagtagggagcatcgcggacactccgtgttgcctttggaggaggccgtggaggggtttaaagaacagatccagaaccaactagatcacttaaaaagggtcaaagatcttaaaaagagaagacgggctcaaggggagcaggccagagctgagctgttgtccctgacacagatggaacgcgaaaaaatcgtttgggagttcgagcaactttaccactccctgaaagaacacgagtatcggcttctcgcaagactagaggaactggacctggccatttataattccattaatggtgccattacccaattttcgtgtaacatatcacacctgagtagccttatagcacagctcgaagaaaaacagcagcagccaacacgcgagctactgcaagacatcggcgacacactcagccgggccgaacggatcagaatacccgaaccttggatcacgccgcccgacctgcaggaaaaaatacatatattcgcccagaagtgcctgttcctcaccgagtccttgaaacagttcaccgagaaaatgcagagcgatatggaaaagatccaggagctgcgcgaagcccagctgtacagcgttgatgttactcttgaccctgataccgcatatccgtctttgattctgtctgacaacctgcgacaagtacgctactcctacctacaacaagacttgcctgacaacccggagcgaagcccctcaacaacttag

SEQ ID NO: 209595 - DNA, 1542 bp, Artificial Sequence
  Description of Artificial Sequence: Synthetic coding sequence
atggccagcggcagcgtggccgagtgcctgcagcaggagaccacctgccccgtgtgcttacaatatttcgctgaaccgatgatgctggactgcggacataatatatgctgcgcatgcttagcacgatgctgggggactgccgagaccaatgtttcctgccctcaatgtcgcgagacattcccgcaaaggcatatgagacctaaccgccatctggccaatgtcacccaactggtaaagcaactgcgcaccgagaggccgtcgggacctggcggcgaaatgggagtgtgtgaaaagcatcgggagcccctcaagctgtactgtgaggaagaccagatgccgatctgcgttgtgtgtgaccggagcagagaacaccgaggacatagcgtgctgcccctggaggaagccgttgagggctttaaggagcaaattcagaatcagctcgaccatttaaaacgtgttaaggacctgaagaagcgtagaagagcccagggggagcaggcacgtgccgagttactctccctcactcaaatggagagggagaaaatcgtgtgggagttcgagcagttgtaccattccctgaaagaacatgaatacagactgctggctagacttgaggaactagacttagcaatctataatagtatcaatggcgcaattactcagtttagctgtaacatcagtcatctgtcttctcttatcgcacagttggaagaaaagcagcagcaacccactagggaactcttgcaggatattggtgataccttgagtcgagccgagcgtatcagaatccctgaaccatggataactcctcccgatttgcaggagaagattcacattttcgcccaaaaatgcctgtttttgactgagtctttgaaacagttcacagaaaagatgcagtccgatatggagaagatccaggaactacgggaagcacagttatactcagttgacgtaaccctcgaccccgataccgcctacccatccctgattctgtctgataacttacgtcaggtaagatacagttatttgcaacaggaccttccagataatcctgagaggtttaacctgttcccttgtgtgcttggaagcccttgcttcattgccggacgacattactgggaggtcgaggttggagataaagcaaagtggactatcggagtttgtgaggatagcgtctgtaggaaggggggcgttaccagcgcacctcagaatggcttctgggcagtttctctctggtacggcaaagaatattgggcattaaccagccccatgaccgcgctgccattgaggacgccactccaacgcgtagggatttttcttgattatgacgctggcgaagttagcttttataacgtgactgagaggtgtcatactttcactttctcacacgccacattctgcggacccgtaagaccatatttcagcctttcgtactctggtggcaagtccgcagctccccttatcatttgcccaatgtctggcatcgacggtttcagcggccatgttgggaatcatggccactctatggagacatctccctag

SEQ ID NO: 209596 - DNA, 1542 bp, Artificial Sequence
  Description of Artificial Sequence: Synthetic coding sequence
atggccagcggcagcgtggccgagtgcctgcagcaggagaccacctgccctgtctgccttcagtacttcgctgagccaatgatgctggattgcggtcataacatttgctgtgcctgtctggcccgctgctggggaaccgcagaaacaaacgtgtcttgcccgcaatgcagggagacgttcccgcagagacatatgaggcccaataggcacttggccaacgtgacccaactggtcaaacagctacggacggaacgaccctcaggtcctgggggcgaaatgggagtgtgcgaaaagcatcgtgagcccttaaagctgtactgcgaggaggatcaaatgccgatttgcgtggtttgtgaccgctcaagagagcatagaggacactccgtgctgcccctcgaggaggcggtggaggggtttaaggaacaaattcagaaccaactggaccacctgaagcgagtgaaagatttgaaaaaaagacggagagcccaaggagagcaagcgcgtgctgaactgttgtccctgacacagatggagcgagaaaaaattgtgtgggagtttgagcagctgtatcactcccttaaggagcacgagtacaggctgttagctaggctggaagagctggaccttgcgatctacaacagtatcaacggcgccatcacccagttttcctgcaacatctcacacctgtccagccttatcgcccaactggaggagaaacagcagcagccgactagggagctgctccaggacatcggtgatactctgtcaagagccgaaaggatcagaattcccgaaccatggattacccctcccgacctgcaagaaaagatccacatctttgcacagaaatgtctcttcctgacggaatccctgaaacaattcaccgaaaagatgcagagcgacatggagaagatacaagagctgcgcgaggctcagctgtactctgtcgatgtgacactggaccctgataccgcatatccatctttgattttgagcgacaacctgcgccaagttagatactcatatctgcagcaggatctgccagacaatccggaaagatttaacctcttcccatgcgtactgggctccccttgtttcattgctgggcgccattattgggaggtggaggtcggggacaaggcgaaatggactattggggtgtgtgaggacagcgtgtgtcgaaaagggggagtgacgtctgcaccacagaacggcttttgggctgtttctctgtggtatgggaaagaatactgggccttgacatccccgatgacagcccttccattacgcaccccgctgcagcgcgtgggaatcttcttagattacgacgcaggtgaggtctccttctacaacgtgacagagaggtgtcatacatttaccttttcccacgcgaccttttgcgggccggtgagaccctatttcagcctttcctattctgggggaaagagtgccgccccacttatcatttgccctatgagtggtattgatggtttctcaggacacgtgggtaatcatggccacagtatggagacgtctccttag

SEQ ID NO: 209597 - DNA, 1077 bp, Artificial Sequence
  Description of Artificial Sequence: Synthetic coding sequence
atggccagcggcagcgtggccgagtgcctgcagcaggagaccacctgccccgtctgtctccaatactttgctgaacccatgatgctcgactgcggacataacatctgttgcgcatgtttggccaggtgttgggggacagcggaaaccaacgtgagctgccctcagtgccgggaaacgttcccccagaggcacatgcggccaaaccggcacctggccaatgtcacacagcttgtcaaacaactgaggactgagcgaccatctggacccggcggcgaaatgggcgtgtgcgagaaacatagggagcctctcaaactgtattgcgaggaggatcagatgcctatttgcgttgtttgtgataggagccgcgaacatcgcggccactccgtgttacctctggaggaagcagtcgaaggattcaaggagcagatccagaaccagttggatcacctgaaacgggtgaaggacctgaagaagcgaagaagggcccagggcgagcaggccagggcagagctgctctccttgacccagatggaacgcgaaaaaatagtttgggagttcgagcagttataccactcgctgaaggagcacgagtatcgtttgctggcccgcctcgaggagctcgatcttgccatttacaattctattaatggcgccattacccagttctcgtgcaacatcagccacctttccagtctgatcgcacagttggaagagaaacagcagcagccaacccgggagcttcttcaggatatcggcgatactctgagtagggccgagcgtatccgaattcctgagccatggattacacccccagatctccaagagaagatacacatattcgctcagaaatgcctcttcctgacagagagtctcaagcagtttaccgagaagatgcagagcgacatggaaaagattcaggaactgagagaagcgcagctttactccgttgatgtaacactggaccccgataccgcgtacccttcactaatcttgtctgacaatctgcgccaggtcaggtatagttacttgcaacaggacctgcccgacaacccagagagaagcccgagcactacctag

SEQ ID NO: 209598 - DNA, 747 bp, Artificial Sequence
  Description of Artificial Sequence: Synthetic coding sequence
tgactgaagcagttcaccgagaagatgcagagcgacatggagaagatccaagagagcgctgactccttagagggagggatcttagacctgggaagcgtgctgtcacacatcctccccgtctccgaactgcgcgaggcacaattgtactcagttgatgtgactctagaccctgacaccgcctacccatcccttatcctgagtgacaatttacggcaggtgagatatagctatctgcaacaggatttacccgataatccggagaggtttaacctcttcccgtgtgtcctcggaagtccttgttttattgccgggaggcattactgggaagttgaggtgggagacaaagccaagtggacgattggtgtttgtgaggactccgtatgtcggaaggggggcgtgacgtccgctccacaaaacggtttttgggccgtctccctttggtatgggaaagaatactgggcactgacctctcctatgaccgccctgccactgcgaaccccactgcagcgcgtgggcattttcctcgactatgacgctggagaggtgtcattttacaatgtgacagagcggtgtcacaccttcacattttctcatgccactttctgtggaccagtgaggccttacttttccctctcatatagtgggggaaaatccgccgcacccctaattatttgtcctatgtcgggcatcgacggattttctggccatgtcggcaaccacggccattccatggagacttcaccctag

SEQ ID NO: 209599 - DNA, 1077 bp, Artificial Sequence
  Description of Artificial Sequence: Synthetic coding sequence
atggccagcggcagcgtggccgagtgcctgcagcaggagaccacctgccccgtatgcctccagtacttcgctgagccaatgatgctggattgcgggcacaacatctgctgtgcctgcctcgctcgctgttggggcacggccgagacaaatgtgtcttgcccgcagtgcagagaaacctttccacagagacacatgcgcccaaatcggcacctggccaatgtaactcaactggtcaagcagttacggacagagcgtcccagtggacccggcggcgagatgggagtgtgcgagaagcatagggaacctttaaaattgtattgtgaagaggaccagatgccaatctgcgttgtgtgcgatcggagccgcgagcaccggggacattccgtgttgccgttggaagaggctgtcgagggtttcaaagagcagatccagaaccagttagatcacctgaagcgagtcaaagatctgaaaaaaagacggcgcgcgcagggcgagcaagcgagggctgagctgctgagcctgacccaaatggagagggagaaaattgtctgggaattcgagcagctgtaccatagcctcaaggagcacgaatataggctccttgctaggctcgaggagctggacttagcgatctataattctatcaacggtgccataacacagttctcctgtaacatatctcacttgtcctccctgattgcacagctggaagagaagcagcagcagccaacccgcgaacttctgcaggacatcggcgacacactcagccgcgcagagaggatccgcatcccagagccatggatcacgccacctgacttgcaagagaagatccatatttttgctcagaagtgtctcttcctcactgaaagcttgaaacaatttacagagaagatgcagagtgacatggaaaagattcaggagctgagagaagcccagctctactcagttgatgtgacacttgatcccgacacagcctatccatctctcatcttgagcgacaacttgcggcaggtacggtattcctacctgcagcaggatcttcccgacaatccggaacggtctcccagcactacctag

SEQ ID NO: 209600 - DNA, 747 bp, Artificial Sequence
  Description of Artificial Sequence: Synthetic coding sequence
tgactgaagcagttcaccgagaagatgcagagcgacatggagaagattcaagagagcgccgactctttggaagggggcatattggatttggggagcgtgcttagccatattttacccgtatctgagttacgggaggcccagctgtattctgtagatgtcaccctggatcctgacacggcgtaccctagcctgatcttgagcgataacctgcgacaggtcaggtattcttacctccagcaggatctgccagacaaccccgagcggttcaacctctttccctgtgttctggggtccccctgcttcattgcaggtaggcactactgggaagttgaagtgggtgataaagcaaagtggaccattggagtgtgcgaagattccgtgtgtagaaaaggtggcgtgacttctgccccacaaaatggcttctgggctgttagcctctggtacgggaaggaatactgggccctcaccagcccaatgactgctttgccactcagaacccccctgcagagagttggaatctttctggactacgatgctggagaagtgagtttctataacgtgactgagaggtgccacacttttacctttagtcatgccaccttctgtgggcctgtccggccatattttagcctgtcttactccgggggaaagtctgcagccccactgattatttgcccgatgtctggaatcgatggttttagtggccacgtcggcaatcacgggcactctatggaaacttctccgtag

SEQ ID NO: 209601 - DNA, 1077 bp, Artificial Sequence
  Description of Artificial Sequence: Synthetic coding sequence
atggccagcggcagcgtggccgagtgcctgcagcaggagaccacctgtcctgtttgtctgcagtactttgccgaacccatgatgctcgattgtggccataatatatgctgtgcatgtcttgcccgatgctggggcacagccgaaaccaacgtaagctgccctcagtgtagggagacgttcccccagcgccatatgaggcccaacagacacttagccaatgtcacacagttagtgaagcaactcagaaccgaacgaccatccggccccggcggggagatgggggtttgtgaaaagcaccgagagcccttgaagctctactgcgaggaagatcagatgccaatttgtgtggtttgtgaccggagccgcgaacaccgtggacacagtgtgttgcctctcgaagaggcagtagaggggttcaaagagcaaatccagaaccagctagaccatcttaagcgagtcaaggacctcaagaaaaggaggagggctcagggggagcaggcccgggccgaattgcttagccttactcaaatggagcgcgaaaaaattgtgtgggaattcgaacaactgtaccactctttaaaggagcacgagtacaggctcttggcaagactcgaagaacttgatctggccatatataactcaataaatggcgcaattactcagtttagctgcaatatctctcacctgagctcactaatcgcacaactcgaagaaaaacagcagcagcccactagggagcttttgcaggacattggtgacaccctctcacgtgcagaacggatcaggattcccgaaccttggattacacctcctgacctgcaggaaaagatccacatctttgctcagaagtgccttttcctgaccgagtctcttaagcagttcactgaaaaaatgcaatctgatatggagaaaattcaagagcttagagaggcccagctgtacagcgtcgacgttacacttgatcctgataccgcctaccccagtttaattttatctgacaatctccggcaggtgaggtactcatatcttcagcaggatctgccggataaccccgaaagatctcccagtacaacctag

SEQ ID NO: 209602 - DNA, 747 bp, Artificial Sequence
  Description of Artificial Sequence: Synthetic coding sequence
tgactgaagcagttcaccgagaagatgcagagcgacatggagaagattcaggaaagcgcggacagtcttgagggtgggatcctcgacttaggttcagtactcagccacatactgcccgtgagcgagcttcgcgaagcacagttgtactcagtggatgtgacgcttgaccccgacaccgcatatccatcactgatcctctccgataatcttagacaggtgcgctactcttatttgcagcaggaccttccggataatccagagcggtttaacttgtttccctgtgttctcgggtctccttgttttatcgctggtagacattactgggaggtggaagtgggggataaagctaaatggacaatcggcgtctgtgaagacagcgtctgcagaaaggggggcgtgactagtgccccacagaacggattttgggctgtgagtctctggtatggaaaagaatactgggcccttactagtcctatgacggcactgcccctgcgaacacccctgcaacgcgtaggtatctttctcgactacgacgcaggagaagtgtcgttttataacgtcactgagcgctgccacaccttcacctttagccacgctactttttgcggtccggtacggccttactttagcctctcctacagtggcggtaaatcggctgcacccctaatcatttgtccaatgtctggcatcgatggtttctccggccatgtggggaaccacggccactctatggaaacaagcccatag

SEQ ID NO: 209603 - DNA, 750 bp, Artificial Sequence
  Description of Artificial Sequence: Synthetic coding sequence
atggccagcggcagcgtggccgagtgcctgcagcaggagaccacctgcccggtctgcctccaatacttcgctgagccgatgatgctggactgcgggcacaacatctgctgtgcctgcctagctcgctgttggggaacagcagagacaaacgtcagctgcccccagtgtcgtgagacctttccgcaaagacatatgcggcctaacaggcacctggctaacgtgacccaactcgtgaagcaattgagaacggagagacccagcggaccaggaggagagatgggtgtctgtgagaagcaccgagaacctctcaagctctattgcgaggaggatcagatgccaatctgtgtggtatgcgatcgctcgcgcgaacataggggacattctgttttacctttggaggaagcggtcgagggctttaaggagcaaatccagaatcaactggaccacttaaagcgcgtcaaagacctcaagaagcgcaggcgcgctcagggtgagcaggccagagctgaactcctgtcactgacacagatggaaagagaaaaaatcgtgtgggaattcgagcagttgtaccactctctaaaagagcatgagtatcgactgctggctagactagaagagctagacctggccatatataattctatcaatggtgcaattacacagtttagctgtaacatctcccaccttagctctcttatcgcccagctcgaagaaaagcagcagcagccgactcgtgaactccttcagtag

SEQ ID NO: 209604 - DNA, 1542 bp, Artificial Sequence
  Description of Artificial Sequence: Synthetic coding sequence
atggccagcggcagcgtggccgagtgcctgcagcaggagaccacctgccctgtctgtctccaatacttcgccgagccaatgatgctagattgcggccacaacatttgttgcgcatgcctagcccgttgttggggcaccgcagagaccaacgtcagctgtcctcagtgtcgcgaaacatttccgcagaggcatatgcgacctaatcgccatcttgccaacgttactcagttagtgaaacagctccgaactgaaagaccatccggccccgggggtgaaatgggcgtttgcgaaaagcaccgggagcccttgaaactgtactgtgaggaagaccagatgcctatctgtgttgtgtgtgatcgctcacgggagcacaggggccatagcgtgcttccactcgaagaagcagtggaagggtttaaggagcagatccaaaaccagctagatcatctaaagcgtgtcaaagatctgaagaaacggaggcgagcccaaggagaacaggctagagccgaactgctctctctgacccaaatggaacgcgagaagatcgtgtgggagttcgaacaactataccactctctgaaggagcacgaatacaggcttttggccaggttggaggagcttgacctggccatctacaactccatcaatggtgccattacccagttctcttgcaatatttctcaccttagctctctgatcgcccagttagaggaaaaacagcaacagcccacgcgagagctgctccaagatattggtgacacactcagtagggcggaaagaattcgcattcctgaaccttggataactcccccagatctgcaggaaaaaattcacatttttgctcagaagtgtctgtttctgactgagtctctgaaacaatttactgagaaaatgcaatcggacatggagaagattcaggagctcagagaagctcagttgtactctgtggatgtgactcttgaccccgatacggcctatccgtccctcattctgagtgacaaccttaggcaggtccgttattcttatctccaacaggaccttccggataatcctgagcgattcaacctgtttccatgcgtcctggggtcaccctgcttcatcgctggtcggcactactgggaggttgaggtgggtgataaggccaagtggacaatcggggtttgcgaggatagtgtgtgccgcaagggaggagtcaccagcgcccctcagaacgggttctgggctgtcagcctgtggtatggcaaagagtattgggcccttaccagtcccatgacagccctgcctctgcgcaccccactgcagcgagtgggcatcttccttgattacgacgcaggagaggtctcattctataacgttacagagagatgtcacacatttactttctcccacgccactttttgtggtcccgtcagaccctacttctctctgtcctattccggcgggaaatccgccgcgccactgatcatctgcccaatgtcaggaatcgatggttttagcgggcacgtcggcaaccacggccattctatggagacatccccgtag

SEQ ID NO: 209605 - DNA, 1542 bp, Artificial Sequence
  Description of Artificial Sequence: Synthetic coding sequence
atggccagcggcagcgtggccgagtgcctgcagcaggagaccacctgtcctgtgtgccttcagtatttcgctgagcccatgatgctggactgcggacacaacatatgttgcgcttgcttagcgcgctgttggggaaccgccgagacaaatgtctcctgtccgcagtgtcgcgagactttccctcagcgccatatgaggccaaatcggcatctggccaacgtgacccagttggtgaaacagctgcgcactgagaggccgtcaggccccggaggggagatgggggtatgtgagaagcatcgagagccactgaagctctattgcgaagaagatcagatgcctatatgtgtggtctgtgacaggtcacgggagcatagagggcatagcgtgttgcctctagaagaagctgtcgagggctttaaagagcagatccaaaaccagttggatcacttaaagagggtcaaggatcttaagaaaagacgtcgtgcccagggcgagcaagccagagccgagctcctaagcctgacccagatggagagagagaaaatcgtgtgggagtttgagcagctataccacagtttaaaagaacatgagtaccgactgttggctaggttggaagagctggatctcgccatctacaacagtatcaatggagctattactcagtttagttgtaacattagtcacctaagcagtctcatcgcccagctcgaggagaagcagcagcagcctacaagagagcttctgcaggatatcggcgacaccctgtccagggctgaacggatccgtatcccagaaccttggattacaccacccgatttgcaagagaaaatacacatctttgcccagaaatgtcttttcctgaccgagtcgctgaaacagttcacagaaaagatgcagagcgacatggaaaagattcaggaactgagagaagctcagctatatagcgtggacgttacgcttgatcccgatacagcctacccctccctgatactctccgataacttacgccaggtccgctactcctatcttcagcaggacctgcccgataatccagaaagattcaatctgtttccgtgcgtcctcggatccccgtgcttcattgccggacggcactactgggaagtcgaggttggagacaaggccaagtggaccattggcgtctgcgaggacagtgtctgtcgaaaagggggagtgacttctgcaccacagaacggcttttgggcagtgtcattgtggtatgggaaggagtattgggccctgacgagccccatgactgcactgcctctccgtactcccctacagagagtggggatctttttggactacgacgccggggaggtatccttttacaatgtgactgaaagatgtcatacattcacattttctcatgctactttttgcggaccagtacgcccttacttttccttatcttactcaggaggaaaatccgccgcccctttaattatttgcccgatgtccggaatcgatggattttctggtcatgtagggaaccatggtcactccatggagacatccccctag

SEQ ID NO: 209606 - DNA, 750 bp, Artificial Sequence
  Description of Artificial Sequence: Synthetic coding sequence
atggccagcggcagcgtggccgagtgcctgcagcaggagaccacctgtcctgtgtgtctccagtattttgcagagcccatgatgctagattgcgggcataacatctgctgtgcctgcctcgccagatgctggggaacggcagagacaaatgtttcctgcccccagtgccgtgagactttcccgcagcgtcacatgagacctaatagacacttagccaatgtgactcagctagtgaagcaacttagaaccgaacggccaagcggacccggtggagaaatgggcgtgtgtgaaaagcatcgggagccgctgaagctgtactgtgaggaagaccagatgcctatctgtgtcgtctgcgacagatcaagggaacaccgaggtcacagcgtgcttcctctagaggaggccgttgaggggtttaaagagcaaatccagaaccagcttgaccatctaaagcgagtgaaggacctgaaaaaacggagacgggcacagggggaacaggcaagggcggaattactcagcttaactcagatggagagggaaaaaatagtatgggagtttgaacagctctaccactcattgaaagagcacgaatatagactgctggcgaggctcgaggagcttgatctagccatctacaattccattaacggggctattacacagttttcctgcaacatttcacacctctcaagcttaattgcacagctggaggaaaaacagcagcagcctacccgagagctcctccaatag

SEQ ID NO: 209607 - DNA, 1542 bp, Artificial Sequence
  Description of Artificial Sequence: Synthetic coding sequence
atggccagcggcagcgtggccgagtgcctgcagcaggagaccacctgtcctgtatgcttgcagtattttgcagagcccatgatgttggattgcggacacaacatctgctgcgcctgtctggcccggtgctggggtaccgcagagacgaatgtttcatgcccgcagtgtcgtgagaccttcccacagagacatatgcgcccaaatcgtcacctcgctaacgttacccagctggtgaagcagctgcggaccgagaggccttctggccccggcggcgaaatgggcgtgtgcgaaaaacatagagaaccgctgaaactgtattgtgaagaagaccagatgcccatttgtgtggtctgtgatcgatcccgagaacacagagggcattccgtcctgccactagaggaagccgttgaaggattcaaggaacagatccagaatcagctcgatcacctgaagagggtcaaggacctcaagaaacggcgaagagcgcagggggagcaggctcgcgccgaattacttagtctgacgcaaatggagagagaaaaaatcgtatgggaattcgagcagctgtaccattcactgaaagaacatgaatacagattactagctagacttgaagaacttgacctggccatctacaactcaattaatggagcaatcacgcaattcagctgtaatataagtcatctgagctcgctcattgcccagctggaagagaagcagcagcagcccacgcgcgagctcctgcaggacattggcgacactttgagtagagccgagagaattaggataccagaaccctggattacaccccctgacctgcaggagaagatccatatttttgcccagaaatgcctgttcctcaccgagagtctgaagcagttcacggaaaagatgcagtctgacatggagaagatacaggaactacgcgaagctcagctctacagcgttgacgtcacgctcgatccagataccgcctacccttctcttatcctttccgacaatcttcggcaggtacgatatagttacctgcagcaagatctgcccgataatcccgaaaggtttaacctcttcccctgcgtgttaggttcaccttgcttcattgcgggtcgccattattgggaagtggaggtgggtgacaaagctaagtggacgattggggtgtgcgaggacagtgtgtgccgtaaggggggagtcacctctgctccgcagaacggtttttgggctgtcagtctgtggtatggaaaagaatactgggcacttacatccccaatgacagcccttccactgagaactcccctgcaaagagtcggaatattcctggactatgacgcaggcgaggtcagtttctacaacgtgacagaacggtgccataccttcacattcagccacgctactttttgcggcccagtcagaccgtacttttccctttcatattccggtggaaagtcagccgcccctctgattatttgccccatgagtggtattgacggcttttccgggcatgtagggaaccatggccactcgatggagaccagcccctag

SEQ ID NO: 209608 - DNA, 744 bp, Artificial Sequence
  Description of Artificial Sequence: Synthetic coding sequence
ctgaagcagttcaccgagaagatgcagagcgacatggagaagatccaggaaagtgcagacagtttggaaggcggcatcttggatctgggctctgtgctgtcacatattttgcccgtttcggagctgagggaggctcagctctattcagtcgacgtgaccttggacccggacacggcctatccatcattgattctaagcgacaatctgaggcaggtgcgatattcctatcttcagcaagacttaccagacaaccccgagcgcttcaatctcttcccgtgcgtactcggctccccctgttttatcgccggccgacactactgggaagtcgaggtgggagacaaggcgaagtggactattggggtctgtgaggactccgtatgccgtaagggcggcgtcactagcgcaccgcagaatggcttctgggccgtgtctctgtggtatggaaaagaatactgggctttaacctcaccaatgacagccctgccgttaaggaccccattgcagagagttgggatttttctggactatgacgcgggggaagtgtcgttctataatgtgactgagagatgtcacacattcactttttcacatgcgaccttctgcggacccgttagaccatatttcagcctgagttattctggcgggaagtcagccgccccccttattatctgtcccatgagcggcatcgacggattttccggtcatgtaggtaaccatgggcattctatggaaacatccccctag

SEQ ID NO: 209609 - DNA, 750 bp, Artificial Sequence
  Description of Artificial Sequence: Synthetic coding sequence
atggccagcggcagcgtggccgagtgcctgcagcaggagaccacctgtcctgtgtgcctccagtacttcgcggaacctatgatgctcgactgcggacacaacatttgttgcgcctgtttggctcgctgttggggtactgcagagacaaacgtcagctgcccccaatgtagagaaacctttccacagaggcatatgaggcccaaccgccacctcgccaatgtgacccaactcgtgaagcagctccggaccgagaggccaagcggccccggcggggagatgggggtatgcgagaaacatagggaacccttaaagctgtactgtgaagaggaccagatgcccatttgcgtcgtgtgtgatcgctcccgggagcataggggccactctgtgctgcctctggaggaagccgtggaaggatttaaagaacagatccagaatcagctggaccacctgaaacgggtgaaggacctcaagaaaaggaggcgcgcacaaggtgagcaggctagggcagaactgcttagtctgacacagatggagagggagaagattgtctgggaattcgaacagctgtatcactcccttaaagaacatgaatatcgtctgctcgctcgcctggaagagctggacctggctatttataactccattaatggcgctataacacaattttcttgcaacatatcccacctaagttccctgatcgctcagctggaagaaaagcagcaacagcctacccgcgaactcctgcagtag

SEQ ID NO: 209610 - DNA, 159 bp, Artificial Sequence
  Description of Artificial Sequence: Synthetic coding sequence
tgactgcgggaggcccagctgtacagcgtggacgtgaccctggaccctgacaccgcatatccgagcctgatcctaagcgataacctgcggcaggtacgatacagctatctgcagcaggatctccctgataacccagaacgcagcccctctaccacttag

SEQ ID NO: 209611 - DNA, 696 bp, Artificial Sequence
  Description of Artificial Sequence: Synthetic coding sequence
tgaagcgccgacagcctggagggcggcatcctggacctgggcagcgtcctctctcatatcctccccgttagcgagcttcgagaagcccaactttattcggtggatgtgacactggatcccgacaccgcttatcctagcctgattcttagcgataatttgaggcaggtgcgctacagttatctgcagcaagatctgcccgacaatccggaacgcttcaatctcttcccttgcgttctaggaagcccttgtttcatagcaggtcgtcattattgggaagttgaggtgggtgataaagcaaagtggacaattggtgtttgcgaggacagcgtctgtcgtaagggaggagtgacttccgcgccacagaatggcttttgggcggtgtcactctggtacggtaaagaatactgggccctgacatcccctatgacagcattgcctctgcgcacaccactgcagagggtaggcatctttctcgattacgatgccggagaagtgagtttttacaatgtcaccgagcgctgccatacatttaccttcagccacgcaacattttgcggtcccgtgcggccatactttagcttgagttactccggcggtaagtcggctgcacctctgatcatttgccctatgagtggcatcgatggcttctccggccacgtggggaatcatgggcattcaatggaaacgagcccctag

SEQ ID NO: 209612 - DNA, 624 bp, Artificial Sequence
  Description of Artificial Sequence: Synthetic coding sequence
tgactgcgggaggcccagctgtacagcgtggacgtgaccctggaccctgacaccgcctatccaagtctgatcctttccgataacctgaggcaagtgagatattcctatcttcaacaagaccttcctgacaatcctgagaggttcaatttgtttccatgcgttctcgggtctccctgtttcatcgccggacggcattactgggaagtcgaagtgggcgacaaggcaaagtggactattggcgtgtgcgaggactctgtgtgcagaaaaggcggtgtgacctctgcaccccagaacgggttctgggctgtgagtctgtggtatggcaaggaatactgggccctgacttctccaatgacggccctccccttgagaactccactgcaaagggtggggatatttctggactatgacgccggggaggtcagtttctataacgtgactgaacggtgccacacatttacgttttctcacgcaaccttctgcgggcccgttaggccatacttttctttgtcctactccgggggcaagtctgctgccccacttataatctgccccatgtccggaatcgacggcttctctgggcacgtcggtaaccatggacattccatggagaccagcccctag

SEQ ID NO: 209613 - DNA, 1077 bp, Artificial Sequence
  Description of Artificial Sequence: Synthetic coding sequence
atggccagcggcagcgtggccgagtgcctgcagcaggagaccacctgcccggtttgcctgcagtacttcgcagagccaatgatgctcgactgcggccataatatctgttgtgcctgtttggcaaggtgctggggcactgctgaaacaaatgtgtcttgtccccagtgcagagagacctttccacagagacacatgaggcccaacagacacctcgccaacgtgacccagcttgttaaacaactccgaacagaaagaccttctggacccggtggcgagatgggcgtttgcgaaaagcaccgagagcctctgaaactttattgtgaagaagatcagatgcccatctgcgtagtgtgcgataggtcgcgagaacaccgaggccactcggttttgcccttagaggaggctgtggaggggtttaaggaacaaatccagaatcaactggaccatctgaaacgcgttaaagatctgaagaagcgccgcagagcccagggtgagcaagcgcgcgctgagctcctctctttaacccagatggaacgcgagaaaattgtgtgggagttcgagcagctgtaccactctttgaaggaacatgagtaccgtcttctcgctcggctcgaagaactggatctcgctatttacaatagtattaacggggccatcacccaattttcttgcaatatttcccacctgtcctcactaatcgcacagttagaggaaaagcaacagcagcctacaagagagctgttacaggacatcggcgacactctgtcgagggccgaacggattaggattcctgagccctggatcaccccaccagacttacaggagaagatacatatattcgcgcagaaatgtttattcctcacggaaagccttaagcagtttacggaaaaaatgcagtctgatatggaaaaaatacaggagctgcgtgaggcccagttatacagcgtggatgtcacacttgacccagacacggcttacccttcactgattttgtccgataacctgaggcaggtgcgttattcataccttcagcaggacttgcccgacaatcctgagagaagcccatcgacgacgtag

SEQ ID NO: 209614 - DNA, 747 bp, Artificial Sequence
  Description of Artificial Sequence: Synthetic coding sequence
tgactgaagcagttcaccgagaagatgcagagcgacatggagaagatccaagagagcgcagatagtctagagggcggcattctggaccttggatcagtgcttagccacattctgcctgtgagtgagctgcgggaggctcagctttactctgtcgatgtgaccctggacccggacactgcatatcctagtctcattctgtctgataatctaagacaggtccgatattcctatctgcagcaagatttacctgataatcccgaacgtttcaatctgttcccttgcgttctgggctctccatgctttatcgccggaaggcactattgggaggtcgaagtcggcgataaggccaaatggacaattggagtatgcgaggacagtgtgtgtcggaaaggtggggtgacttcagccccacagaatggcttctgggccgtgagtctgtggtatggcaaagagtattgggcacttaccagccccatgacggcccttcctctccggactcccctgcagcgggttggtatttttctagactatgacgctggggaggtcagcttctacaatgttactgagcgttgccatacctttacattctcccacgccaccttctgcggcccagtacgtccctacttcagcctgtcctattccggcggcaagtccgcagcccctcttatcatctgccctatgtctggcatagacggattttcaggccatgtaggaaatcacgggcactctatggaaaccagtccctag

SEQ ID NO: 209615 - DNA, 750 bp, Artificial Sequence
  Description of Artificial Sequence: Synthetic coding sequence
atggccagcggcagcgtggccgagtgcctgcagcaggagaccacctgtcccgtttgcctgcagtactttgccgagccaatgatgctggattgcggacacaatatctgttgcgcatgcctcgctaggtgctggggtactgcagagacaaacgtctcatgtccgcagtgcagagagactttccctcagagacatatgcgccccaaccggcacctggccaacgtgacgcagctggtgaagcagctcaggaccgagaggccctccgggccaggaggagagatgggtgtatgcgaaaaacacagggagcctttgaaactctactgtgaagaagatcaaatgcccatctgcgtggtttgtgatcggtcaagagagcatcgcggtcattctgtgctccctctggaagaggccgtcgagggcttcaaggaacagattcaaaatcagctggaccacctaaaaagagtgaaagaccttaaaaaaaggcgccgagcccagggtgaacaggccagggcggagctgctgagccttactcagatggagagggaaaagattgtgtgggaatttgaacagctgtaccacagcctcaaggagcacgaataccgcctgttggctcggctggaagaactcgacttggccatctacaattccattaacggtgccattacccagttctcatgtaatatcagccaccttagttctctgatcgctcagctcgaggaaaagcaacaacagcctactcgggagctgctgcagtag

SEQ ID NO: 209616 - DNA, 2202 bp, Artificial Sequence
  Description of Artificial Sequence: Synthetic coding sequence
atggccaagcgggaggacagccccggccccgaggtgcagcccatggacaaacagtttctggtgtgcagcatctgcctcgatcgctatcagtgcccaaaggttctcccttgcctgcatacattttgcgaaaggtgcctgcagaactacatccctgcccagtcccttactctttcctgtcctgtatgtcgccagacttccattctacctgagcagggtgtcagcgctcttcagaataattttttcattagctccctcatggaagctatgcagcaggcgccggatggggcccacgatcccgaagacccacatccgctgagtgtggtggccggacgtcctctgagctgcccaaaccatgagggtaagaccatggaattttactgtgaagcttgcgagacagccatgtgtggcgaatgtagagccggcgaacatcgggagcagcataaagcagccttgcagcggcaactggaagccgtgcgaggtcgtttacctcagttaagcgctgccattgccctcgtcggggggatctcacagcaactgcaggagcgcaaagctgaagctttagctcagatctccgctgcatttgaagacctggagcaggcactgcagcagagaaagcaggctcttgttagcgacctggaaacgatctgtggcgcaaagcaaaaagttcttcaaagtcagcttgatactctgaggcaaggacaagagcacattgggtcctcttgctcgttcgccgagcaggctctgcgccttgggagtgcacctgaggtactcctggtgcggaagcacatgagagagcgattggcagccttagctgcccaggcgttcccagagagacctcacgaaaacgcccaactggaattggtcctggaagtggacggtctccggaggtcagtcctgaacctgggcgccctcttgactacttctgctacagcccatgagactgtcgccactggcgagggtctgagacaggccctcgtgggccaaccggccagcctgaccgtgacaacgaaggacaaggacggccgcttagttaggacgggatctgctgaactccgggctgagattaccggcccagatggcacccggctgcctgttcccgtggtagaccataagaatggtacatacgagctggtttacaccgccaggacggaaggagaattgttgctgtcagtactgctttacgggcaaccagttcgtggatcccctttcagggtgcgagcacttagacccggcgacctgcctccatcccccgatgatgttaaacgacgcgtgaagagccccggggggcccggatcacatgtgcggcagaaagctgttcggcggccttcctccatgtacagtaccggcggtaagagaaaagataatccgatcgaggacgagctcgttttcagggtcggaagccgcggacgggaaaagggcgaatttaccaatctgcaaggcgtctcagcggccagttccgggcggattgtggttgcggacagcaataaccagtgtatccaggtcttcagcaacgaagggcagttcaagttccgctttggcgtgcgtggacgatcacccgggcagctccagaggcccacaggagtggcagtcgacacaaatggagatattatcgtggctgattacgataacagatgggtaagtatttttagtcccgaaggcaaatttaaaactaagatcggggccggtagactgatgggcccaaagggagtcgctgttgaccgcaacggacatatcatcgtggttgataacaaatcttgctgtgtgttcaccttccaacctaatggcaaattagtgggtcgcttcggcggacgaggtgccaccgatcggcatttcgccggaccccatttcgttgccgtcaacaataagaatgaaattgtggtgaccgacttccacaatcattccgttaaggtgtatagcgccgatggggaatttttgtttaagttcggctcacacggggaagggaatggacagttcaacgctcctaccggagttgcggttgattccaatggtaatattatcgtggccgactggggaaacagcaggatccaggtgtttgatagtagtggctctttcctgtcctacatcaataccagtgccgaacccttgtacggcccccagggcttagccctgacctccgatgggcacgttgtggtcgcagatgccggcaaccactgttttaaagcctaccgctatctgcagtag

SEQ ID NO: 209617 - DNA, 2235 bp, Artificial Sequence
  Description of Artificial Sequence: Synthetic coding sequence
atggccaagcgggaggacagccccggccccgaggtgcagcccatggataagcaattccttgtatgctcaatttgtttggatcgttaccagtgcccgaaggtgctgccatgccttcacaccttctgtgagagatgccttcagaactatattccggcgcagagtcttacattatcatgcccggtgtgcagacagacctccatacttcctgagcagggagtctccgctctccagaacaatttttttattagcagcttgatggaagccatgcaacaggcccccgatggggctcacgacccagaagatccccatcctttatccgtcgtcgcaggacggcccttgtcatgtcctaaccacgaaggaaagacaatggaattttattgtgaagcctgtgaaacagccatgtgtggagagtgcagagcgggcgaacaccgagaacacgggacagtgctgctccgagacgtggtcgagcagcacaaggccgcactgcagcgccagttagaggcagttcgtggacggctgcctcaactcagtgccgccatagctctggtgggcggtataagtcagcagctgcaggagagaaaggccgaagcacttgcacagatctccgcggccttcgaagatctcgaacaggctctacagcagcgaaagcaggccctagtgtcagatttagaaactatctgcggtgccaaacaaaaggtgctccagagccagctggataccctcagacagggccaagagcatattgggagttcttgcagcttcgccgagcaggccctgaggctgggctctgccccggaggtactgctcgttcgtaagcacatgcgagagcgcttggcagccttggccgcacaggccttcccagagcggccacatgaaaacgctcagctggaactcgttctcgaggtcgacggactgcgccgctccgtactaaatctcggcgccctactcacaacatcagctacggctcatgagacagtggccaccggagagggcctgcggcaggccctggtggggcagcccgctagcctgactgtgactacaaaagataaggatgggcggctcgtgcgtacggggtccgctgagctgcgcgcagagatcaccggacctgatggaacacgtctccctgtgccggtggtggaccacaagaatggcacctacgagcttgtctacacggcccggaccgaaggggaactgctgttgtcagttctgctctatggtcagccggtgcggggctctccctttcgggtccgcgccctgagaccaggcgacctgcctccaagcccggacgacgttaaaagaagggtgaagagccctggggggccaggaagtcatgtgcgacaaaaggcagtcagaaggccctctagcatgtatagcactggaggcaaacggaaagacaacccgattgaggacgagctggtattcagagtcgggagtcgaggccgagaaaagggcgaattcaccaatttgcagggagtgtctgctgctagctccggcagaattgtcgtcgctgactccaataaccagtgcatccaggtcttctccaacgagggccagttcaagtttcgcttcggcgtacgagggaggtcgcccggacagctgcaacgacctacgggagtcgccgtggatactaatggggatattattgtggcagattatgacaatcgctgggttagcatcttctccccagaaggtaaattcaagactaagatcggcgccgggagactcatgggcccgaagggagtggcggtggatcgcaacgggcacatcatcgtcgtggataataagagttgctgtgtgttcacttttcagccaaatggaaaattggtgggaagattcggcggtaggggggccacggatcggcattttgcaggcccccatttcgtggctgtgaataacaaaaatgaaatcgtggtgacagactttcataatcatagtgtgaaagtgtatagtgcagacggcgaatttttgtttaaattcggctctcacggcgagggcaatggtcagttcaacgcccccactggcgttgccgtcgacagtaatggcaacatcattgtcgccgactggggcaactctcgtattcaagttttcgattcgagcggaagttttttaagttatataaataccagtgctgaacccctgtatggaccgcagggtctggcgttaacctccgacgggcatgtcgttgtggctgacgccggcaaccactgtttcaaggcttaccgatatctgcaatag

SEQ ID NO: 209618 - DNA, 2235 bp, Artificial Sequence
  Description of Artificial Sequence: Synthetic coding sequence
atggccaagcgggaggacagccccggccccgaggtgcagcccatggacaagcaattccttgtgtgtagtatctgcctggacaggtaccagtgcccgaaggttctcccgtgcctacataccttctgcgagagatgtctgcaaaattacataccagctcagtctctcaccctctcctgtcctgtatgcaggcaaacgagcatcttgcccgagcagggcgtgagcgcactgcagaataacttttttataagttcccttatggaggccatgcaacaagccccggatggcgctcatgatcctgaagacccacacccacttagcgtggtggccggtcgtcccctgtcctgtccgaatcatgagggaaaaacgatggagttttactgcgaagcctgcgaaaccgccatgtgcggagaatgcagagccggcgaacatagggagcacggtaccgttctgttgcgggatgtagtggaacagcacaaagcagcactccagcggcagcttgaggccgtaagagggagactcccacaactgtcggctgccatcgcacttgtgggggggatctctcagcagctacaagagcgtaaggccgaagcattagcccaaatcagcgcagccttcgaggacctagagcaggcgttgcagcagcgtaagcaggctctcgtctctgatctcgagaccatctgtggcgcaaagcagaaagtcctgcagtcccagctcgacaccctgcgccagggccaagagcacatcggaagctcctgtagtttcgccgaacaggcacttcggcttggcagcgctcccgaggtactactcgttcggaaacacatgcgggaacgactggccgccttagcagcgcaggcttttcctgaacggccgcacgagaacgctcagctggagttagtattggaggtcgatggactgcgtcggagcgtgctgaacctcggcgctttgctgacaacgagcgccacagcacacgaaactgtggccacaggggaagggttacggcaggcattggtgggacaacccgctagccttacggtgaccaccaaggataaagatggtcgcctggtgcggactggttctgcggaactcagggcggagattacaggacctgatggtacaaggctgccagttcccgtggtcgaccacaagaacggaacatacgaactggtgtatactgcccgcacagagggagaactgctcctgtccgtgctgctgtatggacagcccgtgcgtggtagtccatttcgggttagagcgctgcgaccgggggatctacccccaagccctgacgatgtgaagagacgcgttaaatctcccggcggaccgggaagccacgtgcgccaaaaagctgtcagacggccctcttccatgtattccaccggggggaaacgcaaagataacccgatagaggacgagcttgtgttccgagtaggctctcgcggccgggagaaaggggaatttacgaatttgcagggagtgtccgccgcatcttctggtcgtatcgtggtagcagactcaaataatcaatgcattcaagtgttttcgaacgaagggcagttcaaatttaggtttggcgtgagaggtcgaagcccgggacagctgcagcgcccgacaggcgtggcagtggacactaacggcgatatcattgtggccgattacgataatcgatgggtgtctatcttttcacctgaagggaaattcaagacaaaaatcggtgccgggcgacttatgggccccaagggagtggccgttgaccggaacgggcatatcatagttgtggataacaagtcttgctgcgtgttcacattccaacccaacggcaagctagttggccgctttggcgggagaggtgccaccgaccgccatttcgctggccctcacttcgtcgccgtgaacaataaaaacgagatagtagtgaccgatttccataatcactccgttaaggtctactccgccgatggggagttcctctttaaatttggtagtcatggggagggaaacggtcagtttaacgcgcccacaggggtagctgtagactcaaatggcaacataatcgtcgctgactggggaaacagcagaatccaggtgttcgatagctctgggagcttcctctcgtatattaacacctcagcggagcctctgtatggcccgcaaggtttggccctgaccagcgacgggcacgtggttgttgctgacgcaggcaaccactgtttcaaagcatacaggtacctgcagtag

SEQ ID NO: 209619 - DNA, 2235 bp, Artificial Sequence
  Description of Artificial Sequence: Synthetic coding sequence
atggccaagcgggaggacagccccggccccgaggtgcagcccatggataaacagttccttgtctgcagtatttgcctcgatcgctatcagtgccccaaagttcttccgtgcctgcataccttctgcgaaaggtgcctgcagaattatattcctgcacagtctctcacactctcatgtcccgtgtgccggcagacttctattctccctgagcaaggtgtaagcgcactccagaataacttcttcatttcatcactgatggaggcgatgcagcaggcaccagacggcgctcacgatccagaggacccacaccccctgtctgttgtagccgggaggcccctttcctgcccaaatcatgagggcaagactatggaattttactgcgaggcttgcgagactgcaatgtgcggcgagtgcagggcaggtgaacatcgcgaacatgggactgttttgctgcgggatgtggtagagcagcataaggcagccctacagcggcaattagaggctgtgcggggtcgactgccacagttgagtgctgcaatcgcattggtgggcgggatcagtcagcagctccaggaacgtaaagcggaagccctggcccagatttccgctgcctttgaggacctggagcaggctttgcagcagaggaaacaagcactggtttctgacttggaaacaatatgcggcgccaagcaaaaggtacttcagtcacagctggacactctgcgccagggccaggagcatattggctcctcgtgttcattcgccgagcaggcactgcgactggggtcagcacccgaggtactcctcgtccggaagcacatgcgggagcgactggccgccctggcagcccaagcctttccggagagaccccatgaaaacgcccagctggaacttgtcctcgaagtggatgggctccgacggtctgtgctgaatcttggcgcactcttgaccacatcggcaacagcacatgagaccgtcgccacgggcgagggtctgcgtcaagctctggtcggacagcctgcctctctcacagtgactaccaaggacaaagacggccgcctcgtgaggacaggctcagccgaattacgagcagagatcaccggacctgacggcaccaggctgcccgtgccagtggttgatcacaagaatgggacatacgagctggtctacaccgccaggaccgagggcgagcttctcctgtccgtcttgctctacggtcagcctgtccggggcagtccattccgtgtgcgagcattgcgcccaggtgatttgcccccctccccggatgatgttaagagaagagtcaaatccccaggagggcctggctcgcacgtgagacaaaaggcagtgagacgccctagctctatgtatagtactgggggcaagagaaaggataatcctatcgaggacgaactggtgttccgtgtagggtctcgcggcagagaaaagggcgaatttaccaacctccagggagtgagcgcagccagttcagggaggatagtagttgcagatagcaataatcagtgtattcaggtttttagtaacgaggggcaattcaagttccggttcggtgttcgcggaagaagccccgggcagcttcagcgccctacgggtgtggccgtggacaccaacggcgatattatcgttgccgattacgacaatagatgggtgtcaattttctcccctgaggggaaattcaagacaaagatcggggccggacgcctcatgggccctaagggagtcgcggttgatagaaatgggcacatcattgtcgtggacaataaaagttgttgcgtgttcacctttcagccaaacggaaagctggtaggccgttttggaggcaggggcgcaaccgacaggcattttgcgggtccccacttcgtagccgtcaacaacaaaaacgagatcgtcgtcaccgactttcacaaccacagcgtgaaggtgtacagcgcagacggagagtttttattcaagtttggctcacatggagagggtaacggtcaattcaacgctcccacaggtgtggcggtagatagcaatggcaacattatagtggcagactggggcaattctagaattcaagtctttgactcgtccggtagtttccttagttacattaacaccagcgcagagcctctttacggaccacaaggcctggctctgactagcgatggccacgtggtcgtcgccgatgctggcaaccactgttttaaggcctaccgatatttgcaatag

SEQ ID NO: 209620 - DNA, 2229 bp, Artificial Sequence
  Description of Artificial Sequence: Synthetic coding sequence
atggccaagcgggaggacagccccggccccgaggtgcagcccatggacaagcaatttctggtgtgttctatatgcctagacagatatcaatgtccgaaggtgctgccatgcctgcacactttctgtgaacgatgcttgcagaattacattccagcacagagcctcaccctgtcttgccccgtatgccgccaaacttcaattctgcccgaacagggcgtcagcgcacttcagaataatttcttcatttcttccttgatggaggcgatgcaacaagcaccagatggcgcccatgatcccgaggacccacatcccctgagcgtggtggcagggagaccactcagctgtccgaatcacgagggaaaaactatggaattctactgcgaagcttgtgaaacagctatgtgtggggagtgtcgagccggagagcaccgagagcatgggactgtgttgctcagggatgtcgtggagcagcataaggccgccctccaacgccagctggaagccgtgagggggcgccttccacagctgtcagcagctatagccctggtgggtgggattagtcagcaactgcaagagaggaaagcagaagccttagctcaaatctcagccgctttcgaggacttagagcaagccctgcaacagagaaagcaagcattggtttccgatctcgagactatctgcggcgctaagcaaaaggttttgcagtcccagctcgataccctgaggcagggtcaggagcatattggcagttcttgctcctttgccgaacaggccttaagactggggagtgcgcccgaagtgctgctggtgcggaaacatatgagagagagactggctgccctggctgcgcaggcttttcccgaacgtccccacgaaaacgcgcagctagaattggtactggaggtcgacggactgaggcggagtgtgcttaacctgggtgcactgctgacaacctctgctacagcgcacgaaacggtggcaactggggaggggctcaggcaggcactggtgggacagcccgcatcattgacggtgaccactaaagacaaagacggcaggctggtgagaacaggcagcgccgagctcagagctgagatcaccggtcccgatggcactcgcctgcccgtgcccgttgtggaccacaagaatgggacgtacgagctcgtctacacggccaggaccgagggggagcttcttctatcagtacttttgtatggacaacccgtgcgcggatcgccctttcgggtgagagccctccggcccggcgacttacccccttcaccagacgatgtgaaacgtcgcgtgaaatctcctggcgggcccggatcacacgtgagacagaaagcggtgaggaggccatcatcaatgtacagcaccggaggaaagcggaaagacaatccaattgaagatgaactagtcttccgggtgggttcgcgtggccgggaaaagggcgaatttactaatctccagggcgtctccgcagccagttcagggaggatcgtggttgctgattccaataaccagtgtattcaagtgttcagcaatgaaggtcaatttaaattccgctttggggtgcgggggcgtagccctggacagttgcaacgccccactggagtcgctgtcgatacgaacggagacattattgtagctgattatgacaacaggtgggtgtccattttcagcccagagggcaaattcaaaacaaagatcggcgccggcagactgatggggcctaaaggtgttgctgtcgatcgtaacggtcacatcatcgtagtggacaataagagctgctgcgtctttaccttccaaccaaacggcaaactcgttggacgatttggtggccgaggagccaccgaccgccactttgccggcccccactttgtcgctgttaataataaaaatgagatcgtggttacagactttcacaaccattccgtgaaggtgtattccgcagatggtgagtttctgttcaagtttgggtcacatggggagggtaatggacaatttaacgctcccactggcgtcgctgtcgacagcaacggcaacattattgatgtttgcagggcttcgccatacccctcttataccccaccacacccctgtcaaagtgccccccatcctcctgcctggggacagaactctctgccacaggacagaagcccctcgtcctgcttaccaaccacattgtatacattgactgaaactgctataccacatcccccctactag

SEQ ID NO: 209621 - DNA, 1878 bp, Artificial Sequence
  Description of Artificial Sequence: Synthetic coding sequence
atgaagaccatggagttctactgcgaggcctgcgagaccgccatgtgcggcgagtgccgagcaggagagcatagagagcacggaaccgtccttctgagggacgtcgtggagcagcataaagcagccttgcaacggcaactggaagcggtacgtggtcgactcccgcagctgagcgccgctatcgctctggtgggggggatctcccagcagctgcaagagcggaaggccgaggccctagctcaaatctctgccgcatttgaagacctcgaacaggctctgcagcagcgcaagcaggccctcgttagcgatctggagacaatctgcggtgccaagcagaaggtgctgcagtcccaactagataccttgcgacagggtcaggagcatattggaagtagctgttcctttgctgagcaagctctgagactgggaagtgcacctgaagtgctattagtgcgcaagcatatgagggaaagactcgctgcattggctgcccaggcctttccagaaaggccccacgagaatgcccagttggagctcgttctggaggtggacgggctccggaggtccgtgttaaatcttggcgcactcctaacaacgagcgccacggctcacgaaaccgtagccaccggtgaaggtctcaggcaggccctggtaggccagccagcttcacttacagtgacgacaaaggacaaagacggtaggctcgtacgtacgggctcagccgagcttcgagctgaaatcaccggcccggatgggaccagactgccagtacctgttgtcgaccataaaaacgggacctacgagctggtttacactgctcgaactgagggagagttgctacttagcgtgcttctctacggtcagccagtgcggggcagccccttccgcgtcagggccttacggcccggcgacctgcctccttcccctgatgacgtcaaaagacgagtcaagagtccagggggacccggatcccatgttcgacagaaggccgtacggcggccctcctctatgtattccaccggcggaaaacgcaaggacaacccgatagaagacgaattggtgtttcgggttgggtcgcgcggacgcgaaaaaggtgagttcactaatttgcagggtgtgagcgccgccagttccggacggatagtggttgcggattccaacaaccagtgtattcaggtgtttagcaatgaaggtcaattcaaattccgattcggtgttcgcggaaggagtcccgggcagcttcagaggccgactggagtggccgttgacaccaatggcgacattattgtcgccgattatgacaaccgctgggttagcattttcagtcccgaaggcaagtttaaaacaaaaattggcgcagggcggctgatgggacctaagggagtcgccgtcgatcgcaacggccatattattgtggtggataataaatcctgctgcgtgttcactttccagcctaatgggaagctagtgggtcgttttggcggtagaggtgcgacagataggcacttcgctgggccgcacttcgtggccgttaataataagaatgagattgtggtgacggacttccacaaccactccgtcaaggtgtactccgctgacggcgagtttctattcaaatttggatcgcacggcgaaggaaacggtcagttcaatgcccctacaggcgtggccgtggacagcaatggaaacataatcgtcgccgattggggtaacagccgaattcaagtcttcgactccagcgggtcattcctgagttatataaacacatcagccgagccactttacggaccacaaggattagcactgacatcggacggtcacgtggtggtggcagatgccgggaaccattgctttaaggcctaccgttacctgcagtag

SEQ ID NO: 209622 - DNA, 2001 bp, Artificial Sequence
  Description of Artificial Sequence: Synthetic coding sequence
atggccaagcgggaggacagccccggccccgaggtgcagcccatggacaagcagtttctggtctgtagcatctgccttgacagataccaatgtcccaaggttctcccatgcctgcacacattttgtgagcggtgcctgcagaattatattccagcacaatctctcacactttcttgcccagtttgccgacaaaccagtatcctgcctgaacaaggcgtgtccgcgttgcaaaataattttttcatttcgagcctgatggaggccatgcagcaagcacctgatggagcccacgatcctgaggatccacatcctctctctgtggtcgccggacgacctctgtcttgtcccaatcatgagggcaagacaatggagttctattgcgaggcttgtgaaaccgccatgtgtggcgagtgtcgcgcgggggaacacagagaacacggaaccgtgctgctccgtgatgttgttgagcagcacaaggctgcgctccagcggcagttagaagccgtgcgtgggcggttgcctcagctgtccgcggcaatagctctggtgggcgggatatctcagcaactacaagagaggaaagctgaggctttggcccagatttcagccgcctttgaggatctagaacaagctctgcagcaacggaaacaagctttggtcagtgacctggttgacggcttacgtagatctgtgctgaacctgggcgcacttctcacaacatccgctacagcccatgaaacagtggccaccggagagggcctcagacaggcactcgtggggcagcccgcgagcctcaccgtcacaaccaaagataaggatggccggctggtcaggactggcagcgccgagctaagggcagaaatcaccgggcccgacggcaccagattacccgtgcctgtcgtcgaccacaagaacgggacgtacgaattggtgtataccgcaaggaccgaaggcgaacttctgctctcagtacttctgtatggtcagcctgttagaggaagcccctttcgcgttagggcactgagacctggggatctccccccctcgcctgacgatgtgaagagaagggtgaaaagcccaggaggacctggcagtcacgtccgccagaaggccgtaagaagaccatcctctatgtactctactggaggcaaacgtaaggataaccccatcgaggatgagctagtgttccgggtagggagtcgtggaagggaaaaaggcgagttcacgaatctgcagggcgtgagtgccgcctcctcagggaggattgtggtggccgattcaaacaaccagtgcatccaggtattttccaacgaagggcaattcaagttccggttcggtgttaggggtcgatctccgggccaactgcagcgccccaccggcgtcgctgttgataccaatggagacattatcgtggcggattatgataaccggtgggttagcatattttccccagaagggaagttcaagactaaaattggcgcagggcgcctcatgggtcccaaaggggttgcggttgaccgcaacggccacattatcgtcgtagacaataaatcatgctgcgtatttactttccagcctaacggtaagctagttggtcgatttggagggcgcggcgccacggaccgacatttcgctggcccacatttcgtagccgtcaacaataaaaatgaaatagtggttaccgatttccacaaccactcagtgaaagtatattcggccgatggggagttcctcttcaagtttggatcccacggcgaaggaaacggccagtttaacgccccaactggcgtagcggtggattccaatgggaacatcatcgtggccgattggggaaattcccgcatccaggtctttgatagttccgggtcatttctcagctatatcaatacctctgcagagccgctgtacggaccacagggtcttgccctgactagcgatgggcatgtcgttgtagcagacgcaggaaaccactgctttaaagcatatcgctacctgcagtag

SEQ ID NO: 209623 - DNA, 2226 bp, Artificial Sequence
  Description of Artificial Sequence: Synthetic coding sequence
atggccaagcgggaggacagccccggccccgaggtgcagcccatggataagcaattcctggtgtgtagtatttgcttggaccgctaccagtgccctaaggtccttccatgcctgcataccttctgcgaaaggtgtctacagaattatatcccagctcagtctctgacgctgtcctgccctgtgtgtaggcagaccagcatactgcccgagcagggagtttctgctctacagaacaacttttttatcagcagcctcatggaggcaatgcagcaggccccggatggggcccatgacccggaagacccccatcctttatctgtggtggcaggcaggccccttagttgccccaaccatgaggggaagactatggagttttattgtgaagcgtgtgagaccgctatgtgtggggaatgtcgggccggcgagcatagggagcacggtaccgtcttattgcgggatgtcgttgaacagcacaaagctgctttgcaaagacagcttgaagctgtgagagggagactgccgcagctttcagccgcgatcgctctggtgggaggcatttcgcagcagctacaagagagaaaggctgaagctcttgcccagattagcgccgctttcgaagatctcgaacaggcgttgcaacagcggaagcaggctttggtttccgacctggagacgatttgcggagcgaaacagaaggtcctgcaatcccaattagacacactcaggcagggccaagagcatataggaagctcttgtagcttcgctgagcaggccctccggctgggtagcgctcctgaggtcctgctcgttcgcaagcacatgagagaacgcctggccgctcttgctgcacaggctttcccagaacgaccacacgaaaatgcccagcttgaacttgtcctggaagtggacggacttcggaggagtgtgctcaatttaggcgctttgttgactacctcggccactgcccacgagactgtcgctacgggggaagggttacgtcaagccctcgtgggccaacccgcttcgcttacagtgaccaccaaggacaaggacggtaggttggtgcgtactggttcagccgaattgagagctgagatcaccggcccagatggaacccgactgccggtccccgtggtcgaccacaaaaatggtacttacgagcttgtatatactgccaggacagagggagagcttctcctcagtgtcctactgtatggccagcccgtccgggggagcccatttagggtgagggccttgagacctggtgacttacccccttcacctgacgacgtgaagagaagagtgaagtcaccagggggacctggtagccacgtcagacagaaagccgttcggcgcccttcgtctatgtattccaccggcggcaaacggaaagataacccgatagaagacgagttagtgttcagagtgggcagtcgagggagagagaaaggggagttcacaaacctccagggggtgagtgctgcttcatcgggccgcatcgtggtggccgattcgaacaatcagtgcatccaggtgttcagtaatgagggtcagttcaaatttcgcttcggtgtgaggggcagatctccaggccaactgcaacgaccgaccggagtggctgtggacactaatggggacattatcgtggccgactatgataataggtgggttagtatcttttcgccggagggcaagttcaagacaaaaatcggcgctggaagactaatgggtccgaagggcgtcgctgtcgatcggaacggccacattattgtcgtggataacaaatcatgttgcgtatttacctttcagccaaacggcaaactggtgggtcggttcgggggccgtggagcaactgacagacactttgcgggtcctcactttgtcgcagtaaacaacaagaatgagattgtggtcactgatttccataaccacagcgtgaaagtttattccgcagacggggaatttctgtttaagttcggctctcacggtgaagggaatggacaattcaatgcacctaccggagttgccgtggatagcaacggaaatatcatcgtctgccgggccagcccatacccctcttacacgccacctcacccctgtcagtctgcgcctcacccccccgcatggggccaaaatagtctgccgcaggatcggagtccctcaagctgcttgccaaccaccctgtatacactcaccgaaaccgcaattccccacccgccttactag

SEQ ID NO: 209624 - DNA, 1278 bp, Artificial Sequence
  Description of Artificial Sequence: Synthetic coding sequence
atggccagcggccagttcgtgaacaagctgcaggaggaggtgatctgccccatctgcctagacatcctgcagaaaccagtgacgatcgattgtggacacaatttttgtctgaagtgcattacacagattggcgagacgagctgtggcttcttcaaatgtccactgtgcaagacctctgtacgcaaaaacgcaatacggttcaatagtctcctcaggaacctggtggaaaagatccaagctctccaggccagtgaagtgcagtctaaaaggaaggaggccacatgccccaggcatcaggagatgttccactatttctgcgaggacgacggaaaatttctgtgttttgtgtgctgcgagagcaaggatcacaaatctcacaatgtgagtctgatcgaagaggctgcccagaactaccagggtcagattcaagagcagatccaggttctccagcagaaagaaaaagaaacggtgcaggtaaaggctcagggagtacacagggtggatgtattcaccgatcaggtggagcacgagaagcaaaggattttaactgaattcgagctcttgcaccaggtgctcgaggaggaaaagaacttcctgctcagcaggatttactggttgggtcatgaaggtacggaagcggggaagcactacgtggcgtccaccgagccccagctgaatgacttgaaaaaactcgtggatagtctcaagacaaagcagaatatgcctccaagacagctccttgaagacatcaaagtcgtcctgtgccgcagcgaggaatttcagttcttaaaccccaccccagtgcccctcgagcttgagaagaaactctctgaggccaaatcgaggcacgactcgattacaggctccctgaaaaagttcaaggaccaattgcaggcggacagaaaaaaggatgaaaaccggtttttcaagtcaatgaacaagaatgacatgaagtcctggggactactccaaaagaataaccacaaaatgaacaagacaagcgaacctgggagctctagtgccggagggcgaacgacgtcggggcctcccaaccatcacagtagtgctccaagccatagcttatttagggcctcatctgctggcaaggtcacttttccagtctgtctgcttgccagttatgacgaaatttcaggacagggtgcttcttcacaggataccaagaccttcgatgtggcgcttagcgaggagttgcatgcagcgctcagcgagtggctgactgcgatccgagcttggttttgcgaggttcccagctcctag

SEQ ID NO: 209625 - DNA, 1278 bp, Artificial Sequence
  Description of Artificial Sequence: Synthetic coding sequence
atggccagcggccagttcgtgaacaagctgcaggaggaggtgatctgtcctatatgcctggatatccttcagaagccagtcacaatcgactgcggacataacttttgcctcaagtgcattacccagattggcgaaactagttgcgggttcttcaaatgtcctctctgcaagacaagcgtgaggaaaaatgccatccgttttaattccttgctgaggaacctggtggagaaaatccaggctctccaggccagtgaagtgcaatcaaaaaggaaggaggccacgtgcccacgacatcaagaaatgtttcattacttctgtgaagacgatggtaagttcctttgctttgtctgcagggaatctaaggaccataaatcccataacgtgtccttaatcgaagaggccgcacagaactaccagggccagatccaggagcagatacaagttttgcagcaaaaggaaaaggaaacggtacaggtgaaggcccagggggtgcaccgtgtggacgtcttcaccgatcaggtggagcatgagaaacagaggattttgacagagttcgagctgctccatcaggtcctcgaagaagaaaaaaactttcttctgtctaggatttactggttaggccatgaaggtactgaagcagggaaacattacgttgcttctaccgagccacagctcaatgatctgaagaagctggtggattcccttaagactaagcagaacatgccgccccggcagttactcgagcccgcccaaccgcacctgccacggtcagaggagttccagtttctcaatccaactcccgtgccattggagctggagaaaaagttatcagaagccaaaagcagacacgatagtatcaccggcagcctgaaaaagttcaaggaccaactccaggctgacaggaaaaaagacgagaacagatttttcaaaagcatgaataaaaacgacatgaaaagctggggccttctacagaagaataaccacaagatgaacaagacaagcgaacccggctctagcagcgccggcggccggaccacatcaggcccccctaaccatcactcctcagccccttctcacagcctgtttcgggcttcttccgctggcaaagtgactttccccgtctgtctactcgcttcctacgacgaaatttctggccagggtgcgtcaagtcaggacaccaaaaccttcgatgttgcgctcagcgaggaactacatgccgctctcagcgaatggctaaccgccatccgtgcctggttctgcgaggttccctctagttag

SEQ ID NO: 209626 - DNA, 1278 bp, Artificial Sequence
  Description of Artificial Sequence: Synthetic coding sequence
atggccagcggccagttcgtgaacaagctgcaggaggaggtgatctgcccaatatgtttggatatccttcagaagccagtgacaattgactgtgggcacaatttttgtttaaaatgcatcactcaaataggggaaaccagctgcgggttttttaaatgtccactatgcaaaacaagtgttcgcaaaaacgccattaggtttaattctctcctacgcaatctcgttgagaaaatacaggctttgcaggcctctgaggtgcaatccaaaaggaaagaagccacatgcccgcggcaccaggagatgttccactacttctgtgaagacgacgggaagtttctgtgtttcgtatgccgcgaatcgaaggaccacaagtctcacaacgtgtctctaatagaggaggcagcccagaattaccagggccaaattcaggagcaaatccaagttctgcagcagaaggagaaagaaacggtccaggttaaggcgcagggtgtccatagggtggacgtgttcaccgaccaagtggagcacgaaaagcaaaggatcttgaccgagttcgagctgttgcaccaggtgctggaggaagaaaaaaactttctactgtccagaatatattggctgggccacgagggaaccgaggcaggaaagcactacgtggccagtactgaaccacagctgaatgacctgaagaaattggtggattcactaaaaactaaacaaaacatgcccccccgtcagctactagaagacatcaaagtagtgctgtgccgttctgaggagttccagtttcttaacccaacaccagtccctctggagctggagaaaaaacttagcgaagcaaaatctcgacacgattccatcaccgggtctctgaagaaatttaaggaccaactgcaggcagaccgcaagaaggacgaaaatcgattcttcaagtccatgaacaagaacgatatgaaatcttgggggctgctgcagaagaacaatcataagatgaataagaccagcgagcccggctcttcctctgctggcggccgaactacgagcggaccacccaaccaccacagctccgccccttctcattctctgttccgcgcaagctccgctggtaaggttacattcccagtctgcctactcgccagctatgacgagatctccggtcagggagctagcagtcaggacacaaagacgtttgacgtggcactctctgaagaactgcacgcggccctatcagagtggctgaccgccatacgtgcatggttttgcgaggttccttcaagctag

SEQ ID NO: 209627 - DNA, 747 bp, Artificial Sequence
  Description of Artificial Sequence: Synthetic coding sequence
atggccagcggccagttcgtgaacaagctgcaggaggaggtgatctgtcccatttgtctggatatcctccagaaaccggtgaccattgactgcggccataacttttgtctgaagtgcatcacccagatcggcgagacctcttgtggcttcttcaaatgtccactgtgtaagacttcagtgaggaagaacgccatcagattcaacagcctcttaagaaacttggttgagaagatccaagctctgcaagccagtgaggtccagtcaaagcgaaaagaggccacttgcccacggcaccaggagatgtttcactacttttgcgaggatgatgggaaattcttgtgtttcgtatgcagggaaagtaaagatcacaaatctcacaacgtgagcctgatcgaagaggccgcccagaactaccagggccagatccaggagcagatccaggtgctgcaacagaaagaaaaggaaacggtgcaggtgaaggcccagggggtacaccgggtggatgtcttcacggatcaggtggaacacgagaaacaaagaatcctgacagagttcgagctgctgcatcaagtcctcgaggaggagaagaacttcctcctctcccgtatatattggctcggccacgaagggacagaggccggaaaacactatgttgcatctactgagccacaactcaatgacctcaagaagctcgtcgacagcctgaaaaccaagcagaatatgcctcccaggcaacttctcgaatag

SEQ ID NO: 209628 - DNA, 1278 bp, Artificial Sequence
  Description of Artificial Sequence: Synthetic coding sequence
atggccagcggccagttcgtgaacaagctgcaggaggaggtgatctgtcccatttgtttggatatccttcaaaagcctgttaccattgactgtgggcataatttctgtctcaaatgtattacacagattggtgagacaagctgtggctttttcaaatgccctttatgcaagacgtcagtgaggaagaatgcaatccgtttcaactctctgttgagaaatctggtcgagaagatccaggctctccaggctagtgaggtgcagagcaaacgcaaagaggccacctgcccaagacaccaagaaatgttccactatttttgcgaggatgacggtaaattcttgtgtttcgtgtgcagggaatcaaaagatcacaaaagccacaacgtgtctctcatcgaggaagccgctcaaaattatcaaggtcaaatccaggaacaaatccaagtgctccagcagaaagagaaagagaccgtacaagtaaaagctcagggggtgcatcgcgtcgatgtgtttactgaccaggtcgaacacgagaaacagcgtatcctgaccgagtttgaattgctgcatcaagtgctggaagaagaaaaaaactttctgctgagccggatttattggctcggacatgaggggaccgaggctggcaagcattacgtcgcaagcactgagccacagttaaatgatttgaagaagttagtcgactctctgaaaactaagcaaaacatgccacctagacagttactggaagacatcaaggttgtgttgtgtcggtcagaggagtttcagtttttgaaccctactccggtgccgctcgaattggagaagaaactttctgaagccaagagcaggcatgattccattactggttctcttaaaaaattcaaggatcaactccaggctgatcggaaaaaagatgaaaatcgattctttaaatcgatgaacaagaatgatatgaaatcgtggggtctccttcaaaagaacaaccacaaaatgaacaaaacatctgaaccagggtcttcctcagccggaggtcgaacaacaagtgggcctccaaatcaccacagcagcgcgccatctcattccctgttccgggcgtctagtgcaggcaaggtcactttcccggtctgtctcttggcatcttacgatgaaatctcggggcagggggcttctagccaggatacaaagacgttcgacgtcgctcttagcgaagaactgcatgccgcactttctgaatggctgaccgccatccgtgcgtggttctgcaaggttcctagttcctag

SEQ ID NO: 209629 - DNA, 1278 bp, Artificial Sequence
  Description of Artificial Sequence: Synthetic coding sequence
atggccagcggccagttcgtgaacaagctgcaggaggaggtgatctgtcctatctgcttggatattcttcagaagcccgtgacaatagattgcgggcataatttctgcctgaaatgcatcacccaaatcggcgaaacaagctgcggctttttcaagtgccctctgtgcaaaacttccgtgcgcaaaaatgccatccggtttaactccctgctgaggaatttagtcgagaaaatccaggcgctgcaggctagcgaggtgcagtccaaaagaaaggaagccacttgtccacggcaccaggagatgttccactacttctgcgaggatgatgggaaatttctctgcttcgtttgtcgcgaatcaaaggaccacaaatcacacaacgtatcactcatcgaagaggcggctcaaaactaccaagggcagatccaggaacaaatccaggtcctccaacagaaggagaaagaaacggtacaagtgaaggcccagggggtgcatcgcgtggacgtcttcactgaccaggtggaacatgaaaaacagaggattttaacggaattcgagctcctgcatcaggtcttggaagaggagaagaatttccttctgagcagaatctattggctgggtcacgagggcacggaggccggaaagcactatgtggcatcaaccgaaccacaacttaacgatttgaagaagctggtggacagcttaaaaacaaaacagaacatgcctcccaggcagctgctcgaggatatcaaagtggttttatgtagatctgaggaattccagtttctaaatcctactcccgtgcctctggaacttgaaaagaagttgagcgaagcgaagtcacggcatgattcgattaccgggtccctcaagaaattcaaagaccagctccaggcggacagaaaaaaagacgagaatcgctttttcaagtccatgaacaagaacgatatgaagagttgggggctgttgcagaagaataaccataagatgaataaaacttcagaacctgggtcatcatctgccggaggccgcaccacttctggcccacctaaccatcactcatctgctccttctcacagtctcttccgggcaagctctgcaggaaaggtgactttcccggtgtgtctgttggcttcctacgacgaaattagtgggcaaggagccagctcacaggataccaaaacctttgatgtcgccctgagcgaagagctacatgctgccctgagcgagtggctgaccgctatcagggcgtggttctgcgaagtaccaagctcctag

SEQ ID NO: 209630 - DNA, 1278 bp, Artificial Sequence
  Description of Artificial Sequence: Synthetic coding sequence
atggccagcggccagttcgtgaacaagctgcaggaggaggtgatctgtcccatttgcctagatatcctccaaaaaccagtgacgattgattgtggacataatttctgcctcaaatgtatcacccagattggagaaacatcgtgcggcttcttcaagtgccccctgtgcaagaccagcgtcagaaaaaatgccatccggtttaattcgctgttgagaaacctcgtcgagaagatccaggctctccaggccagcgaggtgcagagtaaacgcaaggaagctacctgccctcggcaccaggagatgtttcattacttctgtgaggatgatgggaagttcctgtgtttcgtgtgccgtgaatccaaagatcacaagagccataatgtgagcttgatagaggaagctgcgcagaattaccaaggccagatccaggagcaaatccaagtgctgcagcaaaaggagaaggagacggtgcaggtcaaggcacaaggagttcacagagttgatgtgtttacggaccaggtcgaacatgagaaacagcgaattcttaccgaattcgaacttctgcaccaggtgctcgaggaagagaagaatttccttctgtcgagaatttactggctaggacatgaaggtacagaagccggcaaacactacgttgccagcacggagcctcagctgaatgaccttaaaaagctggttgactctcttaagactaagcagaacatgccacctaggcagctcctggaagacataaaggtcgttctgtgtaggtctgaggaattccaattcctgaaccctaccccggttccgttggagctggagaagaagctgagtgaagcaaaaagtcgccatgactccattaccggcagccttaaaaagtttaaggatcagttgcaagctgataggaaaaaagacgagaacagattctttaaaagcatgaacaagaacgatatgaaatcctggggactactccagaagaataaccataagatgaataagacctctgagcccggatctagttctgcaggcggccggacaacttctggcccaccgaatcaccattcttctgccccaagtcacagtttattccgggcatcctcggctggcaaagttacctttccggtatgcttgttagcttcgtatgacgagataagcggacaaggggcttcgtcacaggatactaagacattcgacgttgccctcagtgaagagctgcacgctgctctcagcgagtggctgacggcaatccgagcttggttctgtgaagtgcccagttcctag

SEQ ID NO: 209631 - DNA, 1278 bp, Artificial Sequence
  Description of Artificial Sequence: Synthetic coding sequence
atggccagcggccagttcgtgaacaagctgcaggaggaggtgatctgccccatctgtctggatattttacagaaaccagtcaccatcgattgtggccacaacttctgcctcaaatgcatcacacagatcggggaaacaagctgtggattcttcaagtgcccattgtgcaagacttccgtgagaaaaaatgctatacgatttaattcccttctgagaaaccttgttgagaaaattcaagcgctgcaggctagcgaagttcaaagtaaacgtaaagaggcaacttgtcctcgacaccaggagatgttccactatttttgcgaagacgacggaaagttcctttgctttgtttgtcgggaatccaaggatcataagtcacataatgtgagcttaatcgaggaggcagcccaaaattatcagggccagatccaagaacagatacaggtgctccaacagaaggaaaaggaaacagtccaggtaaaggcccaaggtgttcacagggtggacgtctttaccgatcaggtagagcatgaaaagcagcggatccttactgagtttgagctgttacatcaggtgctggaggaggaaaagaattttctgctgtctaggatctactggctggggcacgaaggaactgaagctgggaagcattatgttgcctccactgaaccccagctcaatgacttgaaaaaactcgtggattcactgaagactaagcaaaacatgcccccacgtcagctgctcgaggacataaaggtggtactgtgtcgatccgaggaatttcagtttctcaatccgactccagtcccactagaactggagaagaaactatcggaggccaaaagtaggcacgattcaatcacaggttcccttaaaaagtttaaggaccagcttcaagcggaccgaaagaaggacgagaaccgcttttttaaatccatgaataagaatgacatgaaaagctggggcctgctgcagaaaaataaccacaagatgaacaagacaagcgagccaggcagctcaagtgcgggcggaagaaccaccagtggaccacctaatcaccacagtagcgccccgtcccactctctgttcagggcctcctcagccggcaaggtgacctttccagtgtgcctcctggcctcttatgatgagatttcaggacagggcgccagctctcaggacaccaaaacctttgacgtggccctgagcgaagaactgcacgccgccctaagcgaatggctgactgccattcgggcatggttctgcgaggtccctagttcgtag

SEQ ID NO: 209632 - DNA, 1278 bp, Artificial Sequence
  Description of Artificial Sequence: Synthetic coding sequence
atggccagcggccagttcgtgaacaagctgcaggaggaggtgatctgtccaatttgcctggacatcctgcagaagcccgtgacaatagactgcggccataatttctgtctgaagtgtataacccagattggggagaccagctgtggcttcttcaagtgtcctttatgtaagacatctgttaggaaaaacgccatcaggttcaattcactgttgcgaaatctcgtggagaaaatacaagccttacaggcctcagaggtgcagtctaagcgtaaagaggcaacctgtcctcgtcaccaggagatgttccattacttctgcgaagacgacggaaaatttttgtgctttgtatgtcgtgagtcgaaagatcacaagtctcacaacgtgtctctgatcgaagaagcagctcaaaactaccaaggtcaaattcaggagcagattcaggtcctacagcagaaggaaaaagagactgtgcaggttaaagcacaaggcgtccacagagtcgatgtgttcacagaccaggtggagcatgaaaagcagagaatcttgacggagttcgagctgctgcatcaggtcttggaagaagaaaagaatttcttgctctcaaggatctactggctggggcatgagggcacagaggctggcaagcactacgtggcctccacagaaccccagctgaatgacctgaaaaaactgattgactccttaaagaccaaacagaatatgccacccaggcagttactcgaggatatcaaggtggtactctgccgcagcgaagaattccagttcctcaatcccacccctgtacccctggagttggaaaagaaactttcagaggcaaaatctcggcacgattccatcactgggtcattaaagaagtttaaagaccagcttcaggctgatcgcaaaaaagacgaaaaccgcttttttaaatcaatgaacaagaacgacatgaaatcttggggcctgttacaaaaaaataaccacaaaatgaataagacttcggagcctggaagtagcagcgcagggggccgcactacctccggtccgccgaaccaccattcctccgccccctcccactctttgttcagagccagctcagcggggaaggttacgttcccagtatgcctgctcgcatcttacgacgagatttccggtcagggcgcgagttctcaggacactaagacatttgatgtggccctgagtgaggaactccatgccgccctatccgagtggcttactgcaattcgcgcatggttctgtaaggtgccatccagttag

SEQ ID NO: 209633 - DNA, 1278 bp, Artificial Sequence
  Description of Artificial Sequence: Synthetic coding sequence
atggccagcggccagttcgtgaacaagctgcaggaggaggtgatctgcccaatttgtctggacatcctccagaagccagtgactatcgactgcgggcacaatttctgtctgaagtgcataacccaaattggagaaactagttgtgggttcttcaagtgtcccctctgcaagacttccgttcgaaagaacgccattcgatttaattccctgctacggaatctcgtggaaaaaatccaggctcttcaagcaagtgaagtgcagagtaagaggaaggaagccacatgtcctcgacatcaggaaatgttccactatttttgcgaagatgacggaaagtttctgtgttttgtgtgccgggaaagcaaggaccataagagtcacaacgtcagcttaattgaagaagccgcacagaattatcaaggccaaatacaggagcagatccaggttttgcagcagaaagaaaaggaaacggtgcaagtaaaagcccagggtgtccatcgggtcgatgtctttaccgaccaggtggagcacgagaagcagcgcatcctgaccgaattcgaactcttgcaccaggtcttggaagaagaaaagaactttctgctatcgagaatatactggctcggtcatgagggcacagaggctggcaaacattacgtggcttctaccgagccccagctgaatgacctaaagaagctcgttgattctctgaagactaagcagaacatgccaccccgtcagctcctggaagatataaaggttgtgctttgcaggagcgaggagttccagtttttgaatcctacccccgtcccgcttgaactggaaaagaaactgagtgaggccaagtcacgacacgattcgataaccggcagcctaaagaaattcaaagatcagttgcaggctgatcggaaaaaggatgagaataggttctttaagtccatgaacaaaaatgacatgaaaagctggggcctgctgcaaaagaacaatcacaagatgaacaagacaagcgaacctggttctagctctgccgggggccgcacaacgtcaggacccccaaaccaccactcctcggccccgtcccacagtctgttccgagcctcctccgctggtaaagtcacttttcccgtgtgtctcttggcctcttacgatgaaatctccgggcagggcgcaagcagccaggacacgaagacgttcgatgtggccctttcggaagagctacacgccgctctatctgagtggctgacagcaatacgggcctggttctgcgaagtgcccagctcctag

SEQ ID NO: 209634 - DNA, 1278 bp, Artificial Sequence
  Description of Artificial Sequence: Synthetic coding sequence
atggccagcggccagttcgtgaacaagctgcaggaggaggtgatctgcccaatttgcctcgacattctgcagaagcccgttactatcgactgcggacacaatttctgcctcaagtgcatcacgcaaatcggcgagaccagctgtggctttttcaaatgtcccctctgtaagactagcgtgcggaagaatgccatacggtttaatagcctgctccgtaatctggtagagaagattcaggcccttcaagcctccgaggtgcaaagtaaaagaaaggaggccacgtgccccagacaccaggagatgttccattatttctgtgaggacgacggaaagttcctttgctttgtgtgccgtgagtctaaagatcataagtctcataacgtttcgctgattgaggaggccgcacagaattatcagggacaaattcaggaacaaattcaggttctccagcagaaagagaaggagaccgtgcaggtgaaagcacagggcgtgcaccgggtggacgtgtttaccgaccaggtcgaacatgagaaacagcgcatcctgactgagtttgagctcctgcaccaggtacttgaggaagagaagaactttctcctgtcacgaatctattggttgggacacgagggcaccgaggcaggcaaacattatgtagcttcgactgaaccccagctcaacgatttgaaaaagttggttgacagtcttaaaactaagcagaatatgcctcctagacagctacttgagccagcacagccacatctgcccagatccgaagagtttcagttcctcaaccccacaccagtgcccctcgaactcgaaaaaaagttatccgaagcgaagagccgtcacgactcgataaccggctctcttaaaaagttcaaagaccagttgcaggccgaccgaaaaaaggacgaaaaccgattctttaaatcgatgaacaaaaacgatatgaagtcctggggcttgctccagaagaataaccataaaatgaacaaaactagcgaacctgggtctagtagcgccggcgggaggacaacaagcggacccccaaatcatcactcttccgcccctagtcattctcttttccgggcctcatctgccggcaaggtgacatttcctgtttgtctcctggcttcttatgacgagatttctggtcaaggggcttcaagccaggacactaagacctttgacgtggccttgagtgaagaactacatgccgccctgagcgagtggctcactgctatacgggcctggttctgcgaagtgccttcttcgtag

SEQ ID NO: 209635 - DNA, 1278 bp, Artificial Sequence
  Description of Artificial Sequence: Synthetic coding sequence
atggccagcggccagttcgtgaacaagctgcaggaggaggtgatctgcccgatttgccttgacatactccagaaacccgtaactatcgattgtggacataatttctgcctgaagtgtattacccaaatcggggagacatcatgcgggttctttaaatgccctctgtgtaaaacgtctgtgcgcaagaacgctattcggtttaattcgctgttgcggaacctcgtggagaaaattcaggccctgcaggccagcgaagtgcagtccaaacggaaggaagctacttgccctaggcatcaagaaatgttccactacttttgcgaggatgacggaaagtttctgtgctttgtgtgtcgtgaatccaaggatcacaagtcacacaatgtgagtctcattgaggaagcagcccaaaattaccagggacagattcaggagcagatccaagtcttgcaacagaaggaaaaggaaactgtgcaggtgaaggcacagggggtgcatagagtggacgttttcactgatcaggtggaacatgagaaacagaggatcctgactgagttcgaacttctgcatcaggtgctggaggaagagaaaaattttttgctctccaggatctattggttgggacatgagggcacagaggctggaaagcactacgtcgccagcactgagccccagctgaatgacctaaagaaactcgtggacagcctcaagaccaagcagaatatgccaccacgccagctgttggaggacatcaaggttgttctctgcagatcagaggaattccagttcttgaaccccacacccgtgcccctggagctggagaagaagctctcagaggcaaagagccgacatgacagtatcaccggcagcctcaaaaaattcaaggaccaactgcaggctgaccgaaagaaggacgagaatcggttctttaagtctatgaacaagaacgatatgaagagctggggcttactacaaaaaaataatcacaagatgaataagacatcagagccgggaagctctagcgccggcggccgcacaaccagcggccctcctaaccatcactcttcagctccgtctcactctcttttcagagcttcgtcagccgggaaggtgacgtttcctgtatgcctgctggcgtcctacgacgagatttcggggcagggtgcttcttctcaggacacaaagaccttcgacgttgcactctctgaggagcttcatgctgccctaagtgaatggctcacagccattcgagcttggttttgcaaggtcccttcatcctag

SEQ ID NO: 209636 - DNA, 1278 bp, Artificial Sequence
  Description of Artificial Sequence: Synthetic coding sequence
atggccagcggccagttcgtgaacaagctgcaggaggaggtgatctgtccaatctgcttagatatcttgcagaagccagtgacaatcgactgtgggcataatttttgcctcaagtgtatcactcagataggcgaaacctcctgcggtttcttcaagtgcccactctgtaagacaagcgtgcggaagaatgctattcgatttaacagcctgctgcgcaacctggtagagaaaattcaggcactgcaggcctccgaggtgcagtcaaaacgcaaagaggcaacctgcccaagacaccaggagatgtttcactacttttgcgaagacgatggcaagtttctctgcttcgtgtgcagggagtccaaagaccacaaatctcataatgtgtctttgatagaagaggcagcccaaaattaccagggtcaaatccaggaacaaatccaagttctgcagcagaaagagaaagaaacagtacaggtcaaagcacagggggtgcacagagtggacgtctttactgaccaggtggagcacgagaaacagagaatcttgaccgagttcgaactgcttcaccaggtgctcgaagaagagaagaactttctgctgagtcgcatttattggcttggccatgaaggcacagaggctggaaagcattatgtagcctccacggagccccagctgaatgacttgaagaaactggtcgactccctgaagaccaaacagaatatgccacctcgtcagctcctcgagcccgcccagccccacctgccccggtctgaggagttccagttccttaatccgacacccgtccccttggagctggaaaaaaagttgtccgaggccaagagcaggcacgactccataactggaagcctgaagaaatttaaagaccagctacaagccgacaggaagaaggacgagaaccggttcttcaagtctatgaacaagaacgacatgaaaagttgggggctgttgcagaaaaataaccataaaatgaacaaaacttccgagcctggtagttcttcagcaggggggaggactacaagtggaccccccaaccatcactcctcagcgccgagccattcgctgtttagagccagctctgcggggaaagttaccttcccggtgtgtctgctagccagctatgatgagatttctggccagggcgccagcagccaagataccaaaacgtttgatgtggcactctcagaagagctgcacgcagccctgagcgagtggcttactgccatacgcgcttggttctgcgaggtaccaagcagctag

SEQ ID NO: 209637 - DNA, 1278 bp, Artificial Sequence
  Description of Artificial Sequence: Synthetic coding sequence
atggccagcggccagttcgtgaacaagctgcaggaggaggtgatctgccctatctgcctcgacattctacagaaacccgttacaatagactgtggtcacaatttctgtctgaaatgtatcacccagatcggggaaacctcgtgcgggtttttcaaatgccccctatgcaaaacatcagtgaggaagaatgccattcggttcaactcattactccggaacctggttgagaagattcaagccctgcaggcttcagaggtgcagagcaagcgcaaagaagccacctgcccccgtcaccaggagatgtttcactacttctgcgaagatgatgggaagttcctgtgctttgtgtgtcgtgaatctaaagatcacaaaagccacaacgtctcgttgattgaggaagccgctcagaattatcagggacaaatccaggagcagatccaggttctacagcagaaagagaaagagacagtgcaggtgaaggcccagggagtgcaccgggttgacgtgtttaccgaccaggtcgaacatgagaagcagaggatcttaaccgaattcgagctgctgcaccaagtcctagaggaggagaaaaatttcttactgagtcggatttactggctcggtcacgaaggcaccgaggcaggcaagcactacgtcgcttcaaccgagccccagctgaacgatctcaagaagctgattgactcactgaaaaccaagcagaatatgcctccacgccaactgctggaaccagcacagcctcacctgcccagatctgaagaatttcagttcttgaaccccactcccgtgccgctcgaactcgagaagaagctgtccgaggcaaagagtcggcacgacagcattacaggctcccttaagaaattcaaagatcagctgcaagccgacaggaaaaaagacgagaaccggttctttaaaagcatgaacaagaacgacatgaagagttggggccttctgcaaaagaataaccacaagatgaacaaaacttctgaaccagggtcttcatcagctggagggcgtaccacctcagggccccccaatcatcattctagcgcaccctcacattcccttttccgtgctagctctgccggcaaagtcacgtttcctgtttgcctgttggctagctacgacgagatcagtgggcaaggcgctagctcgcaagatacaaagaccttcgatgttgccctgtctgaagaacttcacgccgccctgagtgagtggctgaccgctatacgagcatggttttgtaaagtgccctcttcatag

SEQ ID NO: 209638 - DNA, 1278 bp, Artificial Sequence
  Description of Artificial Sequence: Synthetic coding sequence
atggccagcggccagttcgtgaacaagctgcaggaggaggtgatctgccccatttgtctggatattcttcaaaagcccgtaacaattgactgcggacataacttctgtttaaagtgcattacacagatcggcgaaacctcttgtggattcttcaaatgccctctttgtaagacttcagtgcggaaaaacgctattagattcaactcactgctgcgaaacctggttgagaagattcaggccctccaggccagcgaggtccagtcaaaacgcaaggaagctacgtgcccacggcaccaagaaatgttccactatttttgtgaagacgacggcaagttcctctgtttcgtatgctgcgagtccaaagatcacaaaagtcataatgtatccctcatagaagaagctgcccagaactaccaaggccagattcaggagcagatccaggtgctgcagcagaaagagaaagagaccgtccaggtgaaggcccaaggagtgcatcgagtagacgtgttcacggatcaggtcgaacatgagaagcagcgtatactcacagaattcgaactgttacatcaggtcctggaggaagagaaaaacttcctcctttcacggatttactggcttggacacgagggtaccgaggctggcaagcattatgtggcatctactgagccacaattgaacgatctgaagaagcttgtggacagcctcaagaccaaacagaacatgcctccacgacagctactagagcccgcacagcctcatctgccgaggagcgaagaattccagttcctgaatcctacaccggttcccctcgagctagaaaagaaactcagcgaagcaaagagccgccatgacagcattactgggtctcttaaaaaattcaaggatcagctccaagccgaccggaagaaagacgagaacagattcttcaagagcatgaacaaaaatgacatgaaaagttggggactgctgcagaagaacaaccataagatgaacaagacctccgaacccggtagttcctcggctggagggagaactacatcaggccccccaaaccaccactcaagcgctccttcacattcacttttcagagcctcgtccgcaggcaaagtcacttttcctgtgtgccttctggcctcttacgatgagattagcggccaaggagcttcttctcaagacacgaagactttcgacgtcgccttatcagaggagcttcatgccgctctctcagagtggctgacggcaatccgtgcctggttctgcgaagtgccatcgtcctag

SEQ ID NO: 209639 - DNA, 1278 bp, Artificial Sequence
  Description of Artificial Sequence: Synthetic coding sequence
atggccagcggccagttcgtgaacaagctgcaggaggaggtgatctgcccaatttgcctggacattcttcaaaagccagtgactattgattgcggacacaatttctgcctgaagtgtataacacagataggagagacaagctgcgggttctttaagtgtcccctttgcaaaacctcagttagaaagaacgccatccggttcaactccctgttgcgcaatttggtcgaaaagatacaggctcttcaagcctcggaggtccagtccaaacgcaaagaagcaacctgtccaagacatcaggagatgtttcactacttctgtgaagacgacggaaagtttttatgctttgtgtgtagggaatccaaagatcacaaatctcataatgtgagtctgattgaggaagcggctcagaactaccagggtcagattcaggaacagatccaggtgctacagcagaaggaaaaagaaacagtgcaggtcaaggcacagggagttcatcgcgtggacgtctttacagaccaagtggagcatgaaaaacagcgaatcctgaccgagttcgagctgctccatcaagtcctggaggaggaaaaaaacttcctgctgagccgtatatactggctggggcacgagggaacagaagccggcaaacactacgtggcatcaactgaacctcagctgaatgatcttaagaaactggttgattccctcaaaaccaaacagaatatgccacccaggcagctcctggaagacatcaaagtggtactttgtaggtctgaggaattccagttcctcaaccccacccccgtgcccttggagcttgagaagaagctgtcagaggcgaaatcacggcacgactccataaccgggtcattgaaaaaattcaaggatcagttgcaggcagaccgcaagaaagatgagaatagatttttcaagtctatgaataagaacgatatgaagtcatggggcctgctgcagaaaaataatcacaaaatgaacaaaacatccgaacccggctcttcctccgcagggggtaggaccactagcggaccacccaaccatcactcctcagccccttcgcactcactgtttcgtgctagcagcgctggcaaagtaacattccctgtgtgcctcctggccagctacgatgagattagtggacaaggcgctagctcccaggataccaagacctttgatgtcgccctgtctgaagagctacacgcggccctgagtgaatggctgacggcgatcagagcctggttctgtgaagtccctagcagctag

SEQ ID NO: 209640 - DNA, 1278 bp, Artificial Sequence
  Description of Artificial Sequence: Synthetic coding sequence
atggccagcggccagttcgtgaacaagctgcaggaggaggtgatctgtcccatttgtctggacatcctgcaaaaaccagtcacgatcgattgcgggcacaatttctgtctgaagtgtattacacaaatcggggagacgagctgtggcttcttcaaatgcccactgtgcaagactagcgttcggaaaaatgccatccgcttcaacagtctccttcgaaatctggtggagaagatccaagcccttcaagcatctgaagtgcagtcgaaacgcaaggaggccacctgtccacgtcaccaggaaatgtttcattatttctgtgaggacgacggcaaattcctgtgcttcgtgtgtcgagagtccaaggaccataaatcccacaatgtcagccttatcgaagaggccgcgcagaactatcaggggcagattcaagagcagatccaggtcctgcagcagaaggaaaaggagactgtacaggtaaaagctcagggggtacacagagtggacgtttttaccgaccaggtcgaacacgagaagcagcgcatcttaaccgagttcgagcttctgcatcaggtcctcgaggaggaaaagaacttcctgcttagccgcatatattggctgggccacgaagggaccgaggctgggaagcattacgttgcttcaacggaaccgcaacttaacgatcttaagaagttagttgattcgcttaagaccaaacaaaatatgcctcctcgccagcttttagaacctgctcagcctcacctccctcggagcgaggaattccagttcctgaaccctacaccggtccccctcgaattagagaagaaactcagcgaagccaaatctcggcatgacagcatcactggttcccttaagaaattcaaggaccaattacaggcggataggaagaaagatgaaaataggttttttaaaagtatgaataagaatgacatgaagtcctggggactgttacagaagaacaatcacaaaatgaacaaaactagtgaacctggtagctctagcgccggaggccggactaccagcggcccaccgaaccaccatagctcagccccgtcccactcactgttccgcgcctcttctgccggaaaggtgacctttcctgtatgcctcttagcttcctacgacgaaatatccggacaaggtgcctcatcgcaggacactaagacatttgacgtggcccttagcgaggaactgcacgcagctttgagcgagtggctcaccgcgatccgtgcctggttctgcgaggtcccgagtagttag

SEQ ID NO: 209641 - DNA, 1278 bp, Artificial Sequence
  Description of Artificial Sequence: Synthetic coding sequence
atggccagcggccagttcgtgaacaagctgcaggaggaggtgatctgtcctatctgcctcgacattttgcagaagcccgtgacaatcgattgcggccacaacttttgtttaaagtgtatcacccagatcggcgagactagttgcgggtttttcaaatgtcccttatgcaaaacaagcgtgcggaaaaacgccatccgctttaatagtctgctaaggaacttggtggaaaaaattcaggctctgcaagccagcgaggtgcaatcaaaaaggaaggaggccacgtgtcctagacaccaggaaatgttccattacttctgtgaagatgacggtaaattcttatgcttcgtttgttgcgagtccaaagaccacaagtcccataacgtctccctgatcgaggaggcagcacagaactatcagggccaaatccaggagcagatccaggtgctccagcagaaggagaaggagaccgtgcaagtcaaggctcaaggcgtgcaccgggtcgatgtgttcacagatcaggtagaacacgaaaagcaacgcattttgaccgagtttgaactgttgcaccaggtgctcgaagaggagaagaattttctactgagtaggatatactggttagggcacgaaggaacagaagctggtaagcattatgtggcctcaacagaacctcagttgaatgacctcaagaagctcgtagactccctaaaaacgaagcagaacatgcctccaaggcagctgttagaggatattaaagttgtgttgtgcaggagtgaggaatttcagttcttaaatccgacccctgtgcctttggagctggagaagaagttgtctgaagcaaagtcacgccatgactcaatcacaggaagcttgaaaaagtttaaagaccagctgcaggccgatcgcaagaaagatgagaatagattcttcaaaagcatgaataaaaatgacatgaagtcctggggtctcctgcaaaagaacaatcacaaaatgaacaaaacctcagagcctggctcaagctctgccggcggtcgaaccactagcggtccgcccaaccaccacagtagcgcgccctctcactccttatttcgcgcatcaagcgccggaaaagtcacatttccagtctgtcttctcgcgagttacgacgagatctcaggccaaggcgccagtagtcaagacactaagacctttgacgtagctctgagtgaggagctgcatgcagccctgtccgagtggctgaccgcgatccgtgcatggttttgcgaagtgccatcttcatag

SEQ ID NO: 209642 - DNA, 1278 bp, Artificial Sequence
  Description of Artificial Sequence: Synthetic coding sequence
atggccagcggccagttcgtgaacaagctgcaggaggaggtgatctgccccatttgtctggacatattacagaagcccgtcacaatcgactgcggccataatttctgccttaagtgcatcacacagattggagagacgagttgcggatttttcaagtgccctctgtgtaagacttctgttcgaaaaaacgctattcggtttaacagcctcctgagaaacctggtcgaaaagattcaggccttgcaggcctctgaagtccagtctaagaggaaggaggcgacatgtcctcgtcatcaggaaatgttccattacttctgcgaagacgatggaaaatttctgtgctttgtgtgccgggagtccaaggaccacaagagccataatgtaagcctcattgaggaggctgcccagaattatcagggccaaattcaggagcaaatccaggttctacaacagaaagaaaaggaaacagtgcaagtcaaggcacagggagtgcatcgggtcgacgtattcactgatcaggtggagcacgaaaaacagcgcatcctcacagaatttgagctgctgcaccaggtcctggaggaggagaaaaattttctgctttcccggatatactggctgggacatgaggggactgaggccggcaagcattacgtggcctccacagagccccagctgaatgacctgaagaaacttatcgactcactgaagaccaagcagaatatgccaccccggcaactgctcgaggatattaaagtcgtgctgtgtagatctgaagagtttcagtttctcaatccaacaccggtgccgctggaactcgaaaaaaagttgtctgaggctaagtcaagacatgatagcattacagggtctctcaagaagttcaaggaccagttgcaggcagatcggaaaaaggacgagaatcgcttttttaagtcaatgaacaaaaatgacatgaaaagttggggactgcttcagaagaataaccacaagatgaacaagacttccgagccaggcagctcttccgcgggcggacggactacaagcggcccccctaatcatcactcgagcgcaccatctcacagcctattccgggcaagctcagccggtaaagtgacattcccagtgtgcctgcttgcgtcttacgatgaaatcagcgggcagggcgctagtagtcaggacacaaagaccttcgacgtggcgctgagcgaagaactgcatgcggccctctctgagtggttaacggccatccgagcgtggttttgtaaagtgcccagcagctag

SEQ ID NO: 209643 - DNA, 1278 bp, Artificial Sequence
  Description of Artificial Sequence: Synthetic coding sequence
atggccagcggccagttcgtgaacaagctgcaggaggaggtgatctgtccaatctgtctcgatatactccagaagccagtgaccattgattgtggacacaatttctgtcttaaatgcataacccaaatcggcgagacttcatgcggattctttaaatgccctttgtgcaagacaagtgtaagaaagaatgccattcgctttaatagcctcctgcgcaatctggtggagaaaatccaggcgttgcaagcatccgaggtgcaatccaagagaaaggaagctacctgccctagacaccaagagatgttccattatttctgtgaggatgacggcaagttcctttgcttcgtttgcagggagtctaaggatcacaagtcacataacgtctcattgattgaggaggcagcacagaattaccagggccagatccaggaacagatccaggtgctgcagcagaaggagaaggagaccgtacaggtgaaagctcagggggtccatagggtagatgtgttcactgaccaagtcgaacacgagaagcaaagaatccttacggagttcgagctcctgcaccaggtgctggaagaagaaaagaactttctgttgagccggatttattggttgggccatgagggaaccgaggcggggaagcactatgtcgcgtctaccgaacctcagctcaacgatcttaaaaagttggtggattccctgaagactaaacagaatatgccaccacgccagctgctggagcccgcacagccccacttgcctcgaagtgaggaatttcaattcttaaatccaacaccagttccgctggagctggaaaagaaactgtcagaggctaaatcccgacatgatagcataacgggctctctaaagaagttcaaggaccaactgcaggcggataggaaaaaggatgaaaatcggttctttaaatcaatgaataagaacgacatgaaaagttgggggctcttacaaaaaaataaccacaagatgaacaagacgagtgaacccggctctagctccgccggaggacgaacaacaagtggtccaccaaatcatcactccagcgctccctcacactcgctcttcagagcctcctctgcggggaaagtcacattcccagtatgcctgctcgccagctacgacgaaatttctggccagggcgcttctagtcaggacacaaaaacatttgatgtggctctgtcagaagagctacatgccgcacttagcgaatggttgacagccatccgggcctggttctgcaaggtgccctcttcctag

SEQ ID NO: 209644 - DNA, 1278 bp, Artificial Sequence
  Description of Artificial Sequence: Synthetic coding sequence
atggccagcggccagttcgtgaacaagctgcaggaggaggtgatctgccccatctgcttggacatcttacaaaaacctgtgaccatagactgcggacacaatttttgtctaaagtgtataactcagataggagagaccagttgcggctttttcaagtgcccgctttgtaaaacatccgtacggaaaaacgccattagatttaactcactgctgcgtaatctcgtggagaagatccaggcacttcaggcatctgaggttcaatcaaaaaggaaagaagctacctgtccaaggcatcaagagatgtttcactacttctgtgaagatgacgggaaattcctctgcttcgtgtgtcgtgagagtaaagaccataagtcccataacgtgtcccttatagaggaagcagctcagaattatcaaggacagatccaggagcaaattcaagttctccaacagaaagaaaaggaaaccgtgcaggtcaaggctcagggagtgcatcgggtggacgtcttcacagatcaggtcgagcacgagaaacagagaattcttactgagttcgagctgttgcaccaggtgttggaggaggagaaaaattttctcctgagtaggatttactggcttggccacgagggaacagaagccggaaagcactatgtcgcaagcaccgaaccgcagttaaatgatcttaagaaattggtggatagtctgaaaacaaagcagaacatgcccccgcggcaactgctggaagacattaaggtcgtcttgtgcaggtctgaagaattccaatttctcaatcccacgcctgtcccattagaattggagaaaaagctgtccgaggccaaaagccgacacgactctatcactggaagtctcaagaagtttaaggaccagctgcaggcagaccgcaaaaaagatgagaacagattttttaaaagcatgaacaaaaatgatatgaaatcatggggattgttacaaaaaaataaccacaagatgaacaaaacttctgagcctggatcaagctctgccggaggccgtacgacgtcagggcccccgaaccaccacagtagtgcgccctcgcattccttattccgagccagtagcgcaggcaaggtcacattccctgtttgtctccttgcatcatacgacgagatcagcggacagggcgcgtcaagccaggataccaagacgttcgacgttgcgctcagtgaggagctccatgccgctcttagtgagtggttaaccgctattcgggcatggttttgcgaggttccatcttcgtag

SEQ ID NO: 209645 - DNA, 1278 bp, Artificial Sequence
  Description of Artificial Sequence: Synthetic coding sequence
atggccagcggccagttcgtgaacaagctgcaggaggaggtgatctgtccaatctgccttgacatactgcagaagcctgtcaccattgattgtggacataacttctgtttgaaatgcatcacccagatcggggaaacatcatgtggcttttttaaatgcccactctgtaagacctccgtgcgaaagaacgcaatccgattcaatagccttttgcgaaacttggtcgagaagattcaggccctccaggcgtccgaagtgcagtccaagcgaaaagaggccacctgtcctcgtcatcaggagatgtttcattacttttgcgaagatgatggaaagttcttatgctttgtgtgtcgggaaagcaaagatcacaaatctcataacgtaagtctgatcgaggaagcagcacagaattaccagggtcaaatacaagaacagatccaggtgctccaacaaaaggaaaaggaaaccgtgcaggtcaaggcgcaaggtgtccaccgggtcgacgtctttaccgaccaagtggaacacgaaaaacagagaattctgaccgaatttgaactactccaccaggtccttgaggaagaaaaaaattttctgttgtcccgcatctactggcttggccacgaagggaccgaagcagggaagcactacgtggcaagtacagaacctcaactgaatgacctgaaaaagttggtggatagtctaaagacaaagcaaaatatgcctccgcggcagttactggaggatatcaaagtggtgctgtgccgctcggaagagtttcagtttctgaatcctaccccggtgcccctggagctggagaaaaaactgtcagaggcaaagtctagacacgactccatcactggcagtttaaagaaattcaaggaccaattacaggcagacaggaagaaggacgaaaacaggttctttaaatcaatgaataagaatgatatgaaaagctggggccttctccagaagaacaatcacaaaatgaacaagacttctgagccgggctcttccagcgccggaggcagaacaacctccgggcctcccaatcaccactcaagtgcccctagccactctctgttccgagcttcttctgcaggaaaggttacatttcctgtgtgtctgttggcctcctacgacgagatcagtggccagggcgcctcctcgcaagacacgaaaacctttgatgttgcgttaagcgaggaactgcacgccgctctaagtgaatggctgactgcaatcagggcctggttctgcgaagttccaagcagctag

SEQ ID NO: 209646 - DNA, 1962 bp, Artificial Sequence
  Description of Artificial Sequence: Synthetic coding sequence
atggccgccgccgccgccagccacctgaacctggacgccctgcgggaggtactggaatgtccaatttgtatggaatcctttaccgaagagcagctgaggccaaagctgctgcactgcggccacacgatttgtcgacagtgcttggagaagctgcttgccagcagtatcaacggggtgaggtgccccttttgtagtaaaattacccgcatcacatccctaacccagctcacagataacctcactgtgttgaagatcatcgatacagcgggcttgagtgaagccgtggggctgctgatgtgccgatcttgtggaagaagactgcctcgacagttttgtcgcagctgcggactggtactctgtgaaccgtgtagagaagcagaccatcagccgcctgggcactgcacactgcccgtgaaggaagctgcagaggaaagacgaagagattttggggagaaattgacgagactgagggaactaatgggcgagctgcagcgtcggaaggccgctctggagggggtgtcaaaggaccttcaagcgagatacaaggcagttctgcaagagtatggtcatgaagagcgacgggtccaggacgagctagctcggagtagaaagttttttacggggagcctggcggaagtcgagaaatccaattcacaagttgtggaggagcagagctatctattaaatatagctgaggtgcaggctgtttcaagatgtgattacttcttagcaaagatcaaacaggccgacgtggctctcttggaagagactgcggatgaggaagaacccgaattgaccgcttcactgcctagggaattaacattgcaggacgttgaattgctcaaggtgggacacgttggccctttgcagatagggcaggctgttaagaagcctagaaccgtcaacgtggaggactcttgggctatggaagccacagcctccgcggctagcactagcgtgacctttagagagatggatatgagtcctgaggaagtcgtggcttccccgcgggcatccccagcaaagcagaggggccctgaggctgcgtctaatatacagcaatgcctcttcctaaagaaaatgggggcaaagggttctacgccaggtatgtttaatttgccggtgagcctgtacgtgacttctcagggcgaggtcctggtcgccgaccgaggaaattacagaatacaagtgttcacacgaaagggcttcctgaaggagattaggcggtctccgtctgggatcgattctttcgtgcttagttttctcggagccgacctgcccaatctgactcccctttccgtcgctatgaactgccagggcctgattggggtgacagacagttacgataatagccttaaagtgtatacactcgatggacactgcgtggcctgtcatcggagccaactcagcaaaccatggggtataacggccctacctagtggccagttcgtagtgaccgacgtcgaaggtggcaaactgtggtgctttaccgtcgaccgagggtccggggtggtgaaatactcgtgtctttgcagtgccgttcgtcctaagtttgtcacctgcgacgctgaggggacagtgtacttcactcagggactagggctgaatttggaaaatcgccagaacgagcatcatcttgaggggggtttcagtatcggttctgtgggaccagatgggcagctggggagacagatttcacacttcttttcggagaacgaagatttcagatgcattgcaggcatgtgtgtggacgcccggggcgacttgatcgtggccgacagttcaagaaaggagatcctgcactttcccaagggaggcggatactctgttctgatccgcgagggcctgacctgtcctgtaggaattgcattgacaccaaagggtcaacttcttgttttggactgttgggatcactgcataaagatctattcctaccacctccggcggtacagcacaccttag

SEQ ID NO: 209647 - DNA, 522 bp, Artificial Sequence
  Description of Artificial Sequence: Synthetic coding sequence
atggccgccgccgccgccagccacctgaacctggacgccctgcgggaggtgctcgagtgtccaatttgtatggagtccttcaccgaagagcaactacgtcctaagctgctccactgcggccacaccatctgccgccaatgtctggagaagctcctggcctcatctattaatggggtgcgatgtcctttttgctcaaagatcacccgcattacatcattgacgcagctgactgacaatctcactgtcttgaaaataattgacactgccggattatccgaagcagtgggtctgctgatgtgcagatcgtgtgggcgtagactgcctagacagttttgccggtcttgtgggctagtcctatgtgagccatgtagggaagcggatcaccagccccccgggcactgtacattacctgtcaaagaagccgctgaagagaggcgaagagacttcggcgagaagttaacaagactgagggaactaatgggcgaacttcaacgaagaaaggccgcactggaaggggtgtag

SEQ ID NO: 209648 - DNA, 1962 bp, Artificial Sequence
  Description of Artificial Sequence: Synthetic coding sequence
atggccgccgccgccgccagccacctgaacctggacgccctgcgggaggttctggagtgccccatttgtatggaatcttttaccgaagagcagttaagacccaagttactgcactgtggccataccatttgccggcagtgcttggaaaaattgctggcgagctcaatcaatggcgtcagatgtccattctgcagcaaaataacaaggatcacatcccttactcagcttacagacaacttaacggtgctcaagatcatcgacaccgcggggctaagcgaggctgttgggctgctgatgtgtcgcagttgtggccggagactgccacggcaattctgccggagctgcgggcttgttctctgtgagccctgtagagaagccgatcatcagccacctgggcactgcacacttcccgtaaaggaggccgcagaggaaaggcgccgcgacttcggcgagaagctgacaaggctgcgagaattaatgggggagctacagagacgcaaggctgcactcgagggcgtgagcaaggatcttcaggctcgctacaaggcagtgttacaggagtatggccatgaggaacgtcgggtacaagacgaattggctcgaagtcgcaagttttttacaggctccttagccgaagtcgagaagtctaattcacaagtggtggaagagcagtcttatcttctgaacatcgcggaggtacaggctgtgagccggtgcgactacttcttagccaagatcaagcaggcagatgttgcactcctggaagaaactgctgatgaggaggaacctgagctgacagctagtttgccacgagagctcacactgcaggacgtcgaattgctgaaggtaggtcacgtcggcccattacaaattggtcaggctgttaagaagccccggaccgtgaacgtagaagattcatgggccatggaagcaaccgccagcgctgccagcaccagcgtcacttttagggagatggatatgtctccagaggaagtagtcgcaagccctcgtgcatccccggccaagcagaggggacccgaggctgcctccaatatccagcagtgcctgtttctcaagaaaatgggagccaagggaagtacaccaggcatgttcaacctgcccgtaagtctctatgtgacttcgcagggcgaagtgctcgtggctgatcgaggcaactatcgaattcaggtcttcactcgcaagggatttcttaaggagatccgtagaagccccagtgggattgactcatttgttctttcatttcttggcgccgatttacccaaccttacccctttgtccgttgccatgaactgccagggccttatcggcgtgaccgattcgtatgacaattcactcaaagtttacaccttggatggccactgcgttgcctgtcacagatctcagttgagtaagccttggggaataacagctcttccatccggccagtttgtggtgacagatgtggaaggcggcaaactctggtgtttcacggtggatcgcgggtctggcgtggtgaagtactcctgcctgtgttctgcggtgaggccaaagtttgtgacctgcgacgcagaaggcactgtttactttacacagggactggggttgaatttggaaaaccgccagaatgaacaccatttagaggggggtttcagcattggttctgtcggcccggatgggcaactcggacggcagattagccacttttttagcgaaaacgaggactttaggtgtattgcaggtatgtgcgtggatgccagaggcgaccttattgttgctgacagctcaagaaaggagatcctgcacttccccaagggggggggctattcagtgcttatcagagagggcctgacctgtcctgtgggtatcgccttgacccctaagggtcagctcctggtgctggattgttgggatcactgcattaagatctacagctatcatctacgtcgctattcaactccatag

SEQ ID NO: 209649 - DNA, 3384 bp, Artificial Sequence
  Description of Artificial Sequence: Synthetic coding sequence
atggccgagaacaagggcggcggcgaggccgagagcggcggcggcggctccggatcagctcctgtgacagccggcgctgcaggtcctgcagctcaggaggccgaacctcctcttactgctgtattggtagaagaagaagaggaggaaggaggacgcgctggggccgagggcggcgccgcaggcccagacgatggcggggtggccgccgccagttccgggtctgcccaggctgcctcctctcccgcagccagtgtggggacaggtgtagccgggggtgccgtgtccacccctgcaccagctcccgcctccgctcctgctccaggtccaagtgccggcccaccgcccggaccacccgcctcactgctggatacctgcgccgtttgccagcagtcgctgcaatctcgacgcgaagccgagcctaagttgcttccttgcctccactcgttctgcctcagatgtcttcccgaaccagagaggcagttgtccgtccctatcccaggtggctctaatggagacattcagcaagttggcgtgattagatgtcccgtttgcagacaggagtgccgccagatcgacctggtggacaactacttcgtgaaagatacgtcagaggctccctcatccagcgacgagaagagcgaacaggtttgcacttcatgtgaggacaacgcctcagcagtggggttctgcgtggagtgtggggaatggctgtgtaaaacatgcatcgaggcccatcagcgtgtcaagtttacgaaagaccatctcatccgaaagaaagaggatgtcagcgaatctgtgggagctagtggccagcggcccgtgttctgtccagtgcacaagcaggagcagctgaaactgttttgcgagacatgcgaccgcctgacttgtcgtgattgtcagcttctggagcataaagagcataggtaccagttccttgaggaagcctttcagaaccagaaaggagctatcgaaaacctgcttgccaaactgctggaaaagaagaattacgtgcactttgccgctactcaggtgcagaataggataaaggaagttaacgagaccaacaaacgcgtcgaacaggaaatcaaggtcgctatcttcactttgatcaatgagattaacaaaaagggaaagtcccttctccagcagcttgaaaacgtcacaaaagaacggcagatgaaactcttgcagcagcagaatgatatcaccggcctgtccaggcaagtgaagcatgtgatgaactttacgaactgggccattgcctcaggctcaagtacagcattgctgtacagtaaaaggctgatcacattccaactccgccatattctcaaggctaggtgcgatcctgtccccgcagcaaacggggcaattcgctttcactgcgatcctactttctgggccaagaacgtcgtgaacctggggaatcttgttatcgaatcaaagccagctccaggctacacgccgaacgtggtggtcggccaggtgcctccagggaccaaccatatctccaagacgcctggtcagattaacctggcacagctccgattacagcacatgcagcagcaggtgtacgcccagaagcatcaacagctgcagcagatgcgtatgcagcagcccccagcaccagttcctaccaccacgactaccacacagcaacatccccggcaggcagccccccagatgttacagcagcagccacctcgcctgatctccgtccagacaatgcagcgcggtaacatgaattgtggcgcctttcaagctcaccaaatgagactggcacagaatgccgctcgtatcccaggaatcccacgccattctggtcctcaatactccatgatgcaacctcacctgcagaggcagcacagcaaccccgggcacgccggtcccttccccgtagtgagtgttcacaacacaaccataaacccaactagcccgactaccgccacaatggccaatgctaacagaggaccaacctccccctccgtcacggccatcgagctgataccctccgtaacgaacccggaaaacctccctagtctccctgatatcccccctatacagctggaggatgcaggcagcagtagcttggacaacctcctcagtcggtatatatctggctctcacctcccccctcagcccacctccacaatgaacccgtccccaggcccctccgccctttccccgggctcctcaggactttccaattctcacaccccagtgcggcctcctagcacatcgagcaccggatcacgcggctcttgtggcagcagtggtcgaactgccgagaagacatcgttaagcttcaagtccgaccaggtaaaggtgaaacaagaacccggaacagaggacgaaatctgttcctttagcggtggcgttaagcaggaaaagacggaagatggtcgaaggtccgcatgcatgctgagctcacccgaaagctcccttactccacctctcagcacgaacctgcaccttgagagtgaactggatgctctggcatcgcttgaaaaccatgtcaagatcgagccagctgacatgaacgaatcctgcaagcagagcggcctgtcatccctggtaaacggtaaatctccaatacgatcattgatgcaccgttctgcacggatcggaggtgacggcaacaataaagatgacgaccccaatgaggactggtgcgctgtctgtcaaaatggcggagacttactttgttgtgaaaaatgcccaaaggttttccacctgacatgtcacgtacccacactcctctcgttcccatcaggtgactggatctgcaccttctgtcgggatattggcaaaccggaggtagaatacgactgtgacaacctgcagcattctaagaaagggaaaaccgctcaggggctgtcacccgttgaccagcggaaatgcgagaggctcctgctctacctgtactgccacgagctgagtattgagttccaggagccagttcctgcctccatccccaactactataagattattaagaagcccatggacctttcaactgtaaagaaaaagctccagaaaaagcatagccagcactatcagattccagacgattttgtggcggatgtccgactcatctttaagaattgtgaaaggttcaacgaaatgatgaaggttgtgcaggtatatgctgacacccaggagattaatctgaaggcggattccgaggtggcccaagcgggcaaagcagtggctctctactttgaggacaaactcaccgagatttactctgaccggacattcgcacctcttccagagttcgagcaggaggaagatgacggagaggtgacggaggattccgacgaagattttatccaacctcgcagaaagagattaaagtccgacgaacgccccgttcatataaagtag

SEQ ID NO: 209650 - DNA, 3333 bp, Artificial Sequence
  Description of Artificial Sequence: Synthetic coding sequence
atggccgagaacaagggcggcggcgaggccgagagcggcggcggcggcagcggttccgcgcctgtcaccgcgggcgctgcaggccctgcggcccaagaggccgaacccccacttacggctgttttggtggaggaggaggaagaggaaggagggagagccggggccgagggcggagcagccgggcctgacgatggaggcgtcgctgcagccagttctggatccgcacaggcagcctccagcccagcagcctcagtcggcacgggggtcgccggtggtgccgttagtacccccgcacccgctcccgctagcgcgcccgcccccgggcctagtgccggccctccccctgggcccccagcctcactgctcgatacatgtgccgtttgtcaacagtctctccagtcaagaagggaggcggaacccaagttattgccctgcctccattcattttgccttcggtgcttgcctgagcctgagagacagctgtcagtccctattcctggcggaagtaatggcgatatccaacaagtgggagtgatacgatgtcccgtttgtcgccaggagtgtaggcagatagacctcgtcgataactattttgtcaaggatacatctgaagctccatcgtcctccgatgaaaaaagcgaacaggtatgtacatcttgcgaggataatgcgtccgcagtagggttttgtgtggagtgtggggagtggctttgcaagacatgtatcgaggcccatcagagggtaaagtttaccaaagaccacctgatcaggaagaaggaggatgtgtccgaaagcgtcggagcctcggggcaacgcccggttttttgcccggttcacaaacaggaacagctcaagcttttctgtgaaacatgtgataggctgacttgccgcgattgtcaactgcttgaacataaagaacaccggtaccagtttctggaggaggcctttcaaaaccagaaaggcgctattgaaaacctgctagctaagctgctggaaaagaagaattatgtccatttcgccgctacccaggtccagaacagaattaaagaggtgaacgagactaacaaacgcgttgagcaggagattaaggtggccatttttacccttattaacgagatcaataaaaaaggcaagagcctgctccaacagctggagaacgtgacaaaggagcgccagatgaaacttctacagcagcaaaacgatatcacaggactgtcaagacaagtgaagcatgtcatgaattttacaaactgggcaatcgcatccgggtcttccacagccttgctgtattctaaacgcctgattacatttcagctgcgccatattttgaaagccaggtgcgaccccgtgccggccgccaatggggccatccgctttcactgtgaccctaccttctgggctaagaacgttgtgaacctgggcaacctcgtcatagaatctaagccggcaccagggtacactccgaacgttgtggtaggtcaagtgcccccagggactaaccatatctccaaaactccagggcagatcaatcttgctcaactgcgactgcagcatatgcagcagcaggtctacgctcaaaagcatcagcaactccaacaaatgcggatgcagcagccaccggcccccgttcctacgacaaccacgactacccagcagcatcctcggcaggctgccccccaaatgttgcaacagcagccccccagacttatatccgtgcaaaccatgcaacgagggaatatgaattgcggagcttttcaagcccatcagatgagactggcccagaacgccgctagaatacctgggatcccgaggcactccggaccccaatactcgatgatgcagccccacttgcaacgccaacactcaaacccaggacacgctggtcccttcccagttgtttctgtgcacaacaccaccatcaaccctacttcccctactacggcaaccatggcaaatgcaaaccggggccctacatctccatcagtgaccgccatcgagctgattcctagtgtgacaaatcccgagaatctgccaagcctcccagacatacccccaatacaactggaagacgcaggctcgtcctctctcgataatctgctttcccgttatatttcaggctctcatctcccgccacaacctaccagcactatgaatccctctcctggaccctccgccctgagtccaggctcctcagggttgtctaattctcatacgcctgtccgacctccttctacatcatcaacaggttcaaggggatcttgtggctcttccggtaggactgctgagaagacatccctgtctttcaaatccgaccaagtgaaggtgaagcaggaacctggtaccgaagatgagatttgctctttctccggtggtgtcaagcaggagaaaacagaagacggtaggcggagcgcctgcatgctgagctctccagaatcaagcttgacccctcctctcagtaccaacctccacctggagtcagagctcgacgctctggctagcctcgagaatcacgtgaaaatcgaacccgccgacatgaacgaaagctgcaagcagtccggcctgtcatcattagttaacgggaagtcacccatccggtccctcatgcatcgcagcgcgcggatcgggggggatggaaacaacaaagatgatgaccctaacgaggactggtgtgcagtttgtcagaacgggggcgacctgttgtgttgcgagaaatgtccgaaggtgtttcatctcacctgccacgtgcccaccttactgagcttcccatccggcgactggatatgtacattttgtagagatatcggaaaacctgaggtggagtacgactgcgacaatctccaacacagtaaaaaggggaaaactgctcagggcctgagcccggtcgaccagagaaagtgtgaacggctcttgctctacctgtactgtcatgaacttagcatagagttccaggaaccggtccccgcctccattcccaattactacaagattatcaagaaacctatggatctgtctaccgtgaaaaagaaactgcaaaagaagcactcccagcattatcagatccccgatgatttcgtagctgacgttaggctcatcttcaagaactgcgaaagatttaatgaagcagattctgaggtagcccaggctgggaaagccgtggccttgtattttgaggacaagctgaccgagatttatagtgaccggacgtttgcccccttgcccgagttcgagcaggaggaggacgacggagaggtgacagaggatagcgacgaagactttattcaaccccgaaggaagcggctcaagtctgacgaacgaccagttcacattaaatag

SEQ ID NO: 209651 - DNA, 2667 bp, Artificial Sequence
  Description of Artificial Sequence: Synthetic coding sequence
tgaagcgtgggcgccagcggccagcggcccgtgttctgccccgtgcataagcaggagcagctgaagctcttctgcgagacctgtgatcgtttgacatgcagagactgccagttgctagagcacaaggaacacagatatcagtttctggaggaagctttccagaatcagaagggagctattgaaaacctcctggctaaactgcttgagaagaaaaactacgtccactttgcggccacacaggtacaaaatcgaattaaagaagtcaacgaaaccaataagcgtgtagagcaggagatcaaagtggccatcttcactctcatcaatgagattaacaaaaaaggcaagagcttgctgcaacagctggagaacgtgacaaaggagaggcagatgaagctcctgcagcagcagaacgacattaccggactgtcacgtcaggttaagcacgtgatgaacttcaccaattgggctattgcctccggctcaagcactgctctcctgtattcaaaaaggttaattacctttcaactgcgtcatattttgaaagcccggtgcgatcctgtccccgctgctaatggggccatcagatttcactgcgacccaactttttgggccaaaaacgtcgtgaacctggggaacttggttatcgagtccaagcccgcccccggttacactccaaatgttgtggttggccaggtcccaccagggaccaaccacatcagcaagacgccaggccagataaacttagctcagctgcgcttgcagcatatgcagcagcaggtttatgcccaaaaacatcagcagctacagcagatgaggatgcaacaaccacccgcaccggtgccaacaacaactactacaactcagcagcaccctcgacaggctgcacctcagatgctgcagcaacaacccccgcgtctgataagtgtccaaacaatgcagcgcgggaatatgaactgtggagcgtttcaggcacaccagatgcgacttgcccagaacgcggccagaatacctggaatcccgcgccattcggggcctcagtactcaatgatgcagccacatttacagcggcaacacagtaaccctgggcacgcaggcccatttccagtggtaagcgtgcacaacacaaccatcaaccccacctcccccacaaccgctactatggcaaatgcaaaccggggccccacatcaccatcagtcaccgccattgaattgattccctccgtcacaaaccctgagaacctgcctagtctcccagacatacctcccattcaggctaacgtggtgcctatgatgcactcctggtatgagtttggtgctcgcgagaaaactcaggatcagaatgtgctagaagacgcaggtagttccagtctggacaaccttctcagcagatatatctcaggttcccacctcccccctcaaccaacttctacaatgaatccatcacctggaccatcagcactgtctcccggcagctcagggttatccaactcccataccccggtgcggccacccagcactagctccacaggatcacgaggatcatgcggctcatccggacgaacggcagaaaagactagcctgtcgtttaagtccgaccaggttaaagtgaaacaggagccaggcacagaggatgagatctgtagttttagtggcggcgtcaaacaggagaagacggaggatggacgtcggagcgcctgcatgttgtcaagtcccgaatctagcttaactcccccactctctacaaatctacacctggaatcagagttagacgctctggcttccttggagaatcatgtgaagatcgaacctgcggatatgaacgagtcatgcaaacaaagtggtttaagttcgctagtgaatgggaaaagtcctatccgcagcttgatgcaccgcagcgcacgcattggaggtgatggcaacaataaagacgacgacccaaatgaagactggtgcgcggtgtgccagaatggtggcgatttgctgtgctgcgagaagtgtccgaaggtgttccatctgacgtgccacgtaccaacactcttatccttcccctcaggtgactggatctgcaccttctgccgagatatcgggaaaccagaggtcgagtatgattgtgataacctgcagcatagtaagaaaggtaagaccgcccagggtctgtctcccgtcgaccagcgcaagtgtgaaagacttctactgtacctgtattgtcatgaactgtctattgaatttcaggaaccggttccagcctccatacctaattactacaaaatcattaaaaaacccatggatttaagcacggtgaagaagaaactgcagaaaaaacatagtcaacattaccagatacccgatgactttgttgcggacgtgagactgatcttcaaaaattgcgagaggtttaatgagatgatgaaggtcgttcaggtctacgcggatactcaagagattaatctgaaggcagattccgaggtggcgcaggctgggaaggctgtggctctgtacttcgaggacaagttgaccgagatctactcagatcgaacatttgctcccttgcccgaatttgagcaggaagaggacgacggagaggttacggaagactccgacgaagactttatccaacctcgccggaaaagactgaagtccgacgaaaggcccgtacacatcaaatag

SEQ ID NO: 209652 - DNA, 2280 bp, Artificial Sequence
  Description of Artificial Sequence: Synthetic coding sequence
atgaagctgctgcagcagcagaacgacatcaccggcctgagccggcaggtgaagcatgtcatgaattttaccaattgggctattgcctccggatcatctacggcactgctgtactccaagaggctgatcacatttcagcttcgacacattttaaaagcgcgctgcgaccccgtccccgccgctaatggagctatccgattccattgtgatcccacattctgggcgaaaaatgtagtcaatctgggcaatctggtgattgagagtaagccggcccctggttacacaccgaatgtggtcgtcgggcaggtgccccctggcaccaatcacataagcaagacgcccggccagatcaacctcgcacagcttcggttacagcatatgcagcaacaggtgtacgctcagaaacaccagcagctgcagcagatgaggatgcagcagccacccgcacctgtccccacgaccaccacaactacacagcaacacccccggcaggcggctccacaaatgctgcagcagcagccaccacggctgatctctgtccagacgatgcagcggggaaatatgaactgcggcgcgtttcaggcccatcagatgcggctcgcacagaacgctgctcggattcctggaatcccgcgtcattcaggaccacagtactcaatgatgcagcctcacctgcagcggcagcactcaaaccctggacatgccggcccatttccagttgttagcgtgcacaacacaacaatcaatccaacatcacccacaacagccaccatggcaaacgccaatcggggccctacaagtcctagcgtgaccgcaatcgaactcatcccctctgtaactaatcctgaaaacctcccgagcctgcctgatattcctccaattcaagccaatgtggtgccgatgatgcattcttggtacgagtttggcgcacgggagaagactcaggatcagaacgtgctggaggatgccggttccagctctctggataatctattgagtagatacatctcagggagccaccttcctcctcagcccacctctacaatgaatccgagtccaggtccctctgctctctccccaggttctagcggacttagcaactcccacactcccgtgagaccaccttcaacctcttcaacgggctcaaggggtagttgcgggtccagcggtcgcacagctgagaagacctccctcagcttcaagtccgaccaggtcaaggtcaaacaagagcctggcactgaagacgaaatttgttcatttagcggtggcgtgaagcaggagaagactgaggacggtaggcgatcagcttgtatgctctcgtcccctgagagttctctcaccccacctctttccacaaatctgcatctcgagtctgaacttgatgcattggcctcccttgaaaatcatgttaagattgaaccggccgacatgaatgaaagttgtaaacaatctgggctctcttctcttgttaacggcaagagccctatccgttccctgatgcatagaagtgccagaatcggaggcgatggcaataataaggatgacgacccaaacgaagactggtgtgctgtgtgtcagaacggaggggacctcctgtgttgcgagaagtgtccaaaagtatttcacctcacctgtcatgtgccaaccctgttgagttttccaagtggagattggatttgcaccttctgcagggacattgggaagcccgaagtggagtatgattgtgataacctgcagcatagcaaaaaaggtaagacagcccaaggattatcaccagtcgaccagaggaagtgcgaacggctgctactctatctgtattgccacgagctatcaatagaattccaagaacctgttcctgcatctatccctaactactataaaataatcaagaaaccaatggacctgtcaaccgttaaaaagaagctccagaagaaacacagccagcactaccaaatacctgatgacttcgttgcagatgtcaggctcatttttaagaattgcgagcgtttcaatgagatgatgaaagtcgtgcaagtgtatgccgacacacaggaaatcaatctcaaggccgatagcgaggtcgctcaggctggcaaggccgtcgcactgtatttcgaagataagctgactgagatatattcagacagaaccttcgccccgctacctgaattcgagcaagaagaggacgacggagaagttaccgaagacagcgacgaggactttattcaacctcggagaaagcgactcaagagcgacgaaaggcccgtgcatatcaagtag

SEQ ID NO: 209653 - DNA, 2529 bp, Artificial Sequence
  Description of Artificial Sequence: Synthetic coding sequence
atgtgcggcagcgagcggatcctgcaggccggcaacatcctggagattagggttggacaagccggagctagaagggtagcgacaatgacctctcccgtgctggtggatattagagaggaagtcacttgtccaatctgtctagaactccttacggaaccgcttagtatagattgcggccattcattctgtcaggcgtgtattactcccaacggccgcgaaagtgtaatcggtcaggaaggggaaaggtcttgtccagtgtgccagacgagttatcagcctggcaatttacgtccgaaccggcacctggctaatattgtacggcgcctgcgggaggttgtgctcggtcccggcaaacagctcaaggccgtgctctgtgccgatcatggagagaagctgcagcttttttgccaggaggacggcaaggttatatgctggctgtgtgagagatcgcaggagcatcggggacatcacaccttcctcgtggaagaggttgcccaggaataccaggaaaagtttcaggaaagtttgaagaaactcaaaaacgaagaacaggaagctgagaagctaaccgcgtttatccgggaaaaaaaaaccagctggaagaaccagatggagcccgaacgttgccgcatccagacggaattcaatcaactgcgaaatattctggacagggtagagcaacgtgaactgaagaaattggaacaggaagagaaaaagggcctgcgcatcatcgaggaggctgaaaatgacctagtccaccaaacccaatctctgagagagctcattagtgatctggagagaaggtgtcaggggtctacgatggagctccttcaagacgtgtccgatgtgaccgagcgaagcgagttctggactctcaggaagcctgaggctctgcccaccaagcttagatccatgttcagggcccccgaccttaagcgcatgttacgagtgtgtagggagctcaccgacgtgcaaagttactgggcaatccaggggtcactgacacgtagggaaaggcgcgcttcaggagtccgtacacgcagatctcagggtagtagtgctatggcctccaagatactcctgaacgtccaggaggaagtcacatgtcccatctgcctggaactgctgacggagcctctgagtctcgactgtggccactctctctgtcgcgcctgcattactgtgtcgaataaggaagcagtgacatccatgggcggcaaaagctcctgtcccgtatgcggaatatcctattcatttgagcacttacaagctaatcaacacctggccaacattgttgaaaggctcaaggaggtaaagctgtctccagataacggaaagaaaagggacctgtgcgaccatcatggagaaaagttattgctgttttgtaaggaggataggaaagtaatttgttggctctgtgaaaggtcacaggagcaccgggggcatcacacagtgctaacagaagaagtgttcaaggagtgtcaggagaagctacaggccgtgttgaagcggcttaagaaggaggaggaagaggccgagaaactggaagcagatatccgagaggaaaagaccagctggaaataccaggtgcagacagagcgacagaggatccagacggaattcgaccagctgcgatctatcctgaataacgaagagcagcgagaactgcagcgtcttgaggaggaagaaaagaaaaccctcgataaattcgcagaagctgaggacgagctcgtgcagcagaagcaactggtcagggagctgattagcgacgtcgaatgccgctcccagtggtcaacaatggagctgctgcaggacatgagcggaatcatgaagtggtccgaaatatggcgcttgaagaagcccaagatggttagtaaaaagcttaaaactgtgtttcacgcacctgatctgtcccggatgcttcagatgttcagggaattaacagccgtacgctgttattgggttgatgtgacactgaacagtgttaacctgaatcttaaccttgtactgagtgaggatcagcgccaagtgatctccgtgccgatctggccgtttcagtgttataattatggagtgttaggttcacaatattttagctccggcaagcactactgggaagtagatgtttctaaaaaaaccgcgtggatcctaggggtttactgtagaacctatagccgccacatgaaatacgtcgtgagacggtgcgccaacagacagaacctgtacactaagtataggcccctcttcggctactgggttatcgggttgcagaataagtgcaagtatggagtctttgaagaaagcctgtccagcgacccagaagtgctgaccctgtctatggccgtgccaccttgtcgggtgggcgttttcctggactacgaggccgggatcgtctccttcttcaacgtcaccagccatggcagcctgatctacaagttctcgaagtgctgtttttcacagcctgtgtacccttatttcaatccatggaactgtcctgctcctatgaccttatgccccccttcttcctag

SEQ ID NO: 209654 - DNA, 1467 bp, Artificial Sequence
  Description of Artificial Sequence: Synthetic coding sequence
atggccagcaagatcctgctgaacgtgcaggaggaggtgacctgcccgatttgtctggagcttctgacagaaccactgagcctggattgcgggcactccctctgcagagcatgtatcacagtgtccaacaaggaagcggtaaccagcatggggggcaagtctagttgtcctgtgtgcggaatatcatactccttcgaacacctgcaagctaaccagcacctcgccaatatcgttgagcggttgaaagaagtcaaactgtcacccgataacgggaagaagcgtgacctgtgtgatcatcacggtgagaaattgcttctcttctgtaaggaggaccggaaggtgatttgttggctctgtgaacgttcacaggaacacaggggacaccatactgtacttaccgaggaggtattcaaggaatgccaggagaagcttcaggcagtgctaaagagactgaagaaagaggaggaggaggctgagaaattggaggctgacatcagggaggagaagacttcatggaagtatcaggtgcagactgagagacagcggattcagacggaatttgaccagttgcggtcaattctcaataacgaggagcagagggagctgcaacgcctggaagaggaagagaaaaaaacactggataagtttgctgaagcggaagatgaactggtacagcagaaacagctcgtgagggagcttatatctgatgtggagtgcagaagtcaatggagcacaatggaacttctgcaagacatgtctggtatcatgaaatggagtgagatctggagactgaaaaaacctaagatggtctccaaaaagcttaagacggtcttccacgccccagatctgagccgaatgctgcagatgtttcgagagctcacggccgtgcgctgttactgggtagatgtcaccctcaactccgtgaatctcaaccttaacctggtcctgagtgaggatcagcgccaggtgataagcgtgcccatttggcctttccagtgctacaattacggggtacttggctctcaatatttctcctccgggaaacattactgggaggtcgacgtgtccaagaagactgcatggatcctgggggtctattgccgcacttatagtagacatatgaaatacgtggtgagaaggtgtgctaatcggcagaacttatacactaaatatcgcccgctctttgggtactgggtgattggactgcaaaacaaatgtaagtacggagttttcgaagaatcgctgtcaagcgatccagaggtcttgacactgagcatggcggtgcccccgtgcagagtgggggtttttctggactacgaagccggaatcgttagcttcttcaatgtaacctctcatggttcgctgatttacaaattttcaaagtgctgtttctctcagcctgtctacccttattttaatccctggaactgcccagccccaatgactctttgccctccctcttcctag

SEQ ID NO: 209655 - DNA, 1467 bp, Artificial Sequence
  Description of Artificial Sequence: Synthetic coding sequence
atggccagcaagatcctgctgaacgtgcaggaggaggtgacctgccctatttgccttgagctcttgacagagcctttgagtcttgactgcggccatagcctatgcagagcttgcatcacggtcagcaacaaagaggcagtgacctccatggggggcaagagctcctgtcctgtttgcggaatttcttacagttttgagcacctccaagccaaccagcatctcgcaaatatagttgagcgtctgaaagaagtgaaactgtcgcctgataatggaaagaagagagacctgtgtgatcaccatggcgagaaactgttgttattttgtaaagaggacaggaaggtgatctgttggctgtgtgaacgatcccaggagcacagaggtcaccacacggtgttaaccgaggaggtgtttaaggagtgtcaggagaagctccaggccgtgcttaagagactgaaaaaagaggaggaagaggcagaaaagctagaagccgacattagagaggagaaaaccagctggaagtaccaggttcagacagagcgccagagaattcagaccgagttcgatcaactgcgctccattctgaacaacgaagagcagcgggaacttcagcgtctggaggaggaggaaaagaagactcttgataaattcgcagaagcagaagacgaactcgtccagcagaagcaactggtgcgggaactgatctccgacgtggaatgccgatctcagtggtcaaccatggaactcctacaggacatgagtggtatcatgaagtggtctgagatttggagattgaagaaacccaagatggttagcaaaaagctgaaaacagtattccatgcacccgacctcagccgcatgttgcagatgttccgtgaactcacagctgtgcgatgttactgggtcgacgtgacactgaactccgtgaacctaaacctaaatttggtgttgagcgaggatcagagacaggtcatcagcgtccctatctggccattccagtgttataattatggagtgttaggctctcagtattttagctcaggcaagcactactgggaggtggacgtgtctaagaaaaccgcctggatcctgggggtgtattgccgaacctactcgaggcacatgaaatatgtggtgagacgatgcgcaaatagacagaacttgtacaccaagtataggcctctcttcggctactgggtaatcggtctgcagaataaatgcaaatatggtgtattcgaagaatccctaagctctgaccccgaagtgctaaccttgtctatggccgttcctccctgcagggtgggcgtttttctggattacgaagcaggaatcgtgtccttttttaatgttaccagtcacgggtccctgatttataagttcagtaaatgctgtttctcacagcctgtgtacccgtattttaacccctggaattgtccagcaccaatgacattgtgtcccccttcttcctag

SEQ ID NO: 209656 - DNA, 1467 bp, Artificial Sequence
  Description of Artificial Sequence: Synthetic coding sequence
atggccagcaagatcctgctgaacgtgcaggaggaggtgacctgccccatctgtttggagttactgaccgagccgctctcgttagattgcggccactctctgtgccgcgcatgtatcaccgtgagtaacaaggaagccgtaacctcaatgggtgggaaaagttcttgtcctgtgtgtggaatctcatactctttcgagcacctccaggcaaaccagcaccttgccaatatcgtcgaacggttaaaggaggttaaactctcccctgacaatggtaagaaacgtgacctttgcgaccaccacggagaaaagctcctgctcttctgcaaggaagaccggaaggtgatttgttggctctgcgaacgaagtcaggagcaccggggccatcacacagtgctaacggaggaagtctttaaagaatgccaggagaaactccaggcggtgttaaaacgtcttaagaaggaggaagaggaggcggaaaaacttgaggccgacataagggaggaaaagacgagttggaagtaccaggtgcagaccgagcgtcaaaggatccagacagaattcgatcagctgcggagtatccttaataacgaagagcagcgcgagctacagaggctcgaagaagaagagaagaaaactttggataagtttgccgaggccgaggacgaactagtgcaacagaagcagctagtacgtgaactcatatcagacgtggaatgtcggtctcagtggagtacgatggagctgctccaggacatgtccggtatcatgaagtggtcagagatctggcggttaaagaagcctaagatggtcagtaaaaaattgaagacggtgtttcacgcccccgatctgtcgcggatgcttcaaatgtttcgggagctcacagcagtgcgttgctactgggttgacgtgactttgaactctgtgaacttaaatctcaatttggtgttgagcgaagatcagcggcaagttatatcagttcccatctggccattccagtgttataactacggggtccttggcagccaatacttctcttcaggcaaacactactgggaggtcgatgttagtaagaagactgcctggatcctaggggtctactgtcggacatattcgaggcatatgaagtacgtcgtccgccggtgtgcaaatagacagaacctttatacaaagtatcgtccactcttcgggtactgggtcattgggctccagaataaatgtaagtacggcgtcttcgaggaatccttatcgtctgatccagaggtgctaacgctgtcaatggctgttccaccatgtagggtgggagtgttccttgattacgaggccggtattgtgtccttctttaatgtgacctcccacgggagcctgatatacaaattcagcaagtgttgttttagtcagccagtttacccgtactttaatccctggaattgccccgccccaatgactctgtgtcctccctcctcctag

SEQ ID NO: 209657 - DNA, 2187 bp, Artificial Sequence
  Description of Artificial Sequence: Synthetic coding sequence
atgagcgagagcggcgagatgagcgagttcggctacatcatggagctgatagctaaaggtaaagttacgatcaagaatatcgaaagagagctcatatgtcccgcgtgtaaggaactttttactcaccccctgatacttccttgtcagcactctatatgtcacaagtgcgttaaggagctgctgttgacgctggatgatagtttcaatgacgtgggttccgacaactctaatcaaagttccccccgactgcggctgccttctcccagcatggataagatagacagaattaacaggccaggctggaagcgaaacagcctgactccccggaccaccgtgtttccttgccctgggtgcgagcacgacgtggacctaggcgagaggggtataaatggactcttccgtaatttcacattggaaacgattgtcgaacgctataggcaggccgcgagagcagctactgcaatcatgtgcgatttgtgcaaaccaccaccccaggaaagtaccaagtcctgcatggactgcagcgccagttactgcaacgaatgttttaagatacaccacccatggggcactataaaagctcagcatgagtacgtcggccccactacaaacttccgccccaagattctaatgtgccctgagcatgagactgagagaatcaatatgtattgtgagctgtgtcgaaggcccgtatgtcacctttgtaaactcggggggaatcacgctaaccatcgcgttaccacgatgagctcagcatacaagactctaaaggagaaactttccaaggatatagattacctcattggcaaggaatcccaagtcaaaagccagatatcggaactgaaccttctcatgaaggagacagagtgtaatggtgaacgcgcaaaggaggaggcgatcacccatttcgagaagctgtttgaagtactggaggagaggaaaagctcggtgctgaaggctatagattctagtaaaaagctcaggttggataagtttcaaacgcagatggaagagtatcaaggactgctcgagaataatggattggtgggctatgcccaggaagtgctgaaggaaaccgatcaatcgtgctttgtccagacagccaagcagttgcacttgagaattcagaaggccacggaatccctgaagtctttccgacccgctgctcagacaagcttcgaagactacgtcgttaatactagtaaacagacagagctgctgggcgaactgtcctttttttccagtggaattgatgtccccgagatcaatgaggaacaatcaaaggtgtacaacaacgcactgatcaactggcatcaccccgagaaggataaggcagatagctatgtactggagtatcgcaagattaaccgtgacgatgagatgagctggaacgaaattgaggtttgtggaacctctaaaataattcaagaccttgagaactcatcaacttacgcatttagggtgagggcttataaaggatccatttgcagtccatgttccagagagttaatcctgcacactcctcctgcacccgtcttttccttcctgttcgacgaaaaatgcggatataacaatgagcaccttcttctcaatcttaaacgcgaccgggtcgaaagccgggctggctttaatctcctgcttgccgcagagcggatccaggtggggtattatacatccttagattatatcattggtgataccggcattacaaaggggaaacacttctgggcattccgtgtggaaccatatagttatctggtgaaggtcggggtggcatcaagtgataagctccaggaatggctgagaagtcctcgcgacgcagtttcacctcggtacgagcaggattctggccacgactctggctctgaggacgcatgctttgatagctctcaacccttcaccctggtgactataggtatgcagaagtttttcattccaaaatctcctactagctctaacgagcctgagaacagagtgttgcctatgccaaccagtatcggcatcttcctggactgtgacaagggaaaggtggatttctacgacatggaccagatgaagtgtttatacgagagacaggttgattgctcccatacattgtaccccgcattcgctctgatgggctccggcgggatccagcttgaagagccaatcacagcgaagtacctggagtatcaggaagatatgtag

SEQ ID NO: 209658 - DNA, 186 bp, Artificial Sequence
  Description of Artificial Sequence: Synthetic coding sequence
atgagcgagagcggcgagatgagcgagttcggctacatcatggagctgatcgctaagggcaaagcttctgcaatgggactacagcagacccacgagcactctcggctcacctccaagggaggggaagcccgctgcccttttgaaatctcggaggtgggaaaacagagccttcctcggcgcacatag

SEQ ID NO: 209659 - DNA, 183 bp, Artificial Sequence
  Description of Artificial Sequence: Synthetic coding sequence
atgagcgagagcggcgagatgagcgagttcggctacatcatggagttgatcgccaaagggaagatgcccgattggcgcagaggatatagatgtcggcagggctgcggaaaaactaccgaacttgccactgcaacagactttagccagacaggcaataagagcgggaagcatttcaagacgtag

SEQ ID NO: 209660 - DNA, 2895 bp, Artificial Sequence
  Description of Artificial Sequence: Synthetic coding sequence
atggacgagcagagcgtggagagcatcgccgaggtgttccggtgctttatatgcatggaaaaattgcgggacgcccggttgtgccctcattgctctaagctctgctgtttttcctgtattaggaggtggcttaccgaacagagagcacagtgcccccattgtcgggctcctctgcagctccgtgagttggtcaactgtcgctgggcagaggaggtcacccagcaactggacaccctgcagctgtgtagcctcacaaaacacgaggagaacgaaaaggataaatgtgagaaccatcatgagaagctgtccgtgttctgctggacatgtaaaaaatgcatttgccatcagtgtgctctgtggggagggatgcacggcgggcacacatttaaaccactggcagagatttatgaacagcacgtaaccaaggtgaacgaagaggtcgcgaaactgcgacggagactgatggaacttattagtctggtgcaggaggtggagcggaatgtggaggctgtgcggaacgccaaagacgaacgagtccgcgaaatccgaaatgctgttgaaatgatgatcgcccgcctcgacacccaacttaagaacaagttaattaccctgatgggtcagaaaaccagcctcactcaggaaaccgagctgctggagtctctcctgcaggaggttgagcatcagctgcggtcctgcagcaaaagtgaactgatctctaagagttctgagattctgatgatgttccagcaggtgcatcgcaagccgatggctagcttcgtcactacaccggtcccgcctgattttaccagtgaacttgtaccaagctacgactctgccacttttgtgctcgagaatttttctaccctgcggcagagagcagatccggtgtattctccaccgttgcaggtctcagggttgtgctggcgcctaaaggtgtacccagatgggaacggggtggtgaggggctattacctctcagtgtttcttgagctgtcagcaggtctgcccgagaccagcaaatacgagtaccgagtagagatggtccatcaatcttgcaatgaccccacaaaaaacataatccgagaattcgcgtctgactttgaggttggcgagtgttggggctacaatcgcttttttcgcttagacctgctagccaatgaaggatacctgaatccccaaaacgataccgtaatacttcggtttcaggttcgatctccaacattctttcagaagtcgcgcgaccagcattggtatattactcagctcgaagcagcccaaacatcttacatccagcagatcaataaccttaaggagcgactgacgattgagctgtcaagaactcaaaagagtagggacctttcccctcctgacaaccatctctctcctcagaatgacgatgccctcgagaccagagctaagaagagtgcgtgttctgacatgctcttagaaggcgggcctactaccgcttcagttagagaagccaaagaagacgaagaggacgaggagaaaatacagaatgaggactatcaccacgagcttagtgacggagacctggacctggaccttgtttacgaagacgaggtaaatcagttggacggcagctcaagtagtgcctcttcaacggcaaccagcaatactgaagaaaatgatatagacgaggagactatgagcggcgaaaatgatgtggagtacaacaacatggagctggaggaaggagaattaatggaggacgcggcagcagcagggcctgccggaagcagccatggttacgtggggagctcaagccggatcagccgtagaactcatctgtgctctgccgctacctcgagcctgctggacatcgaccctttgatcctcatacatctgctggatttaaaggataggtcatctatcgaaaatttatgggggctacagcctcgaccaccggcatcgctgttgcagcccactgcaagctactctcggaaagacaaggaccagaggaagcagcaggctatgtggcgggtaccttcagatctgaagatgctgaagaggctaaaaacacagatggcggaggttcgctgcatgaagaccgacgtcaagaatactttaagcgagattaagagcagcagtgcagcctcgggtgacatgcaaaccagcctgttttcagctgatcaggccgcgctggctgcctgtggaaccgaaaattcagggcggctgcaagatctggggatggagcttctcgccaagtccagcgtggcgaattgttatatccgaaattccaccaacaagaagtctaattcaccaaagccagcccgatctagcgtagcaggatccctgagcctcaggagggccgtggatcccggggaaaacagccgatcaaaaggcgactgtcagacattatcagaaggaagcccagggtcatctcagagcggatctagacattcatcaccccgcgcgttgatacacgggagtatcggtgacatcctgcccaaaaccgaggacaggcaatgtaaggcattagacagcgacgccgtcgtggttgcagtcttttccggcttaccagccgtggaaaagcggaggaagatggtgacacttggcgccaacgctaaggggggccatctggaaggactgcaaatgacggatttggagaataatagcgagacgggagagttgcaacccgtgctgcccgaaggcgccagtgccgctcctgaagagggcatgagtagcgatagcgacatcgaatgcgatacagagaatgaggagcaggaggagcatacaagcgttggaggtttccacgatagcttcatggtcatgactcaaccacccgatgaggatacgcatagcagtttccccgacggggagcagattggcccggaggacttgtccttcaataccgatgaaaatagcggcagatag

SEQ ID NO: 209661 - DNA, 2412 bp, Artificial Sequence
  Description of Artificial Sequence: Synthetic coding sequence
atgcacggcggccacaccttcaagcccctggccgagatctacgagcagcatgtcacgaaggttaatgaggaagtcgccaagctgcgtcgtaggcttatggagctgatcagcctggtgcaagaggtagaaaggaacgttgaggctgtgaggaacgctaaagatgagagagttcgggagattagaaacgccgtcgagatgatgatcgccaggctcgatacacaattgaaaaataaactcataactctgatgggacaaaagacctcacttactcaggagaccgagctgctcgaaagtctgctgcaagaggtggaacaccaattacggagctgtagcaaatcggaattgatcagcaagtcttcagagatcctaatgatgttccagcaggttcatcggaagcccatggccagcttcgttaccactcctgtcccgccggacttcacaagcgagctggtaccctcttatgacagcgccacatttgtgctggaaaacttttccacccttcggcagcgtgcggaccctgtgtattccccacccctccaggtgtcaggactttgctggcgtctcaaagtctaccccgacggcaatggggttgtgaggggatactatctgagtgttttcctcgaactgagtgcggggttgccagaaacatctaagtatgagtaccgggtggaaatggtgcatcaatcctgtaacgacccgactaaaaatattatcagggaattcgcctcagacttcgaggtgggggaatgttgggggtacaaccgcttcttcagactggatctcctggcaaacgaggggtatctgaacccacagaacgatacggtgatcttgagattccaggttagatctcctacattctttcagaagtcaagggatcagcactggtatatcacacagctcgaagctgctcagacatcttacattcagcaaattaacaatctgaaggaacggttaactatcgagctgtcaagaactcagaaatcccgggatctctcacctcctgataaccacctaagtcctcagaacgacgacgccctggagacaagagccaagaagagcgcctgttcagacatgttattggaaggtggtccaaccacggcaagcgtgcgcgaagcaaaagaggacgaggaagacgaagaaaaaatacagaatgaagactaccaccatgaactcagtgacggggatctagatttggacctggtgtacgaggatgaggttaaccagttagatggctcttcctcctctgcctcttccactgccaccagcaacacagaggaaaatgacattgacgaggagacaatgagcggggaaaatgacgtagagtataataacatggaactcgaggagggcgagctcatggaagatgctgccgccgccgggcccgccggttcttctcacggctacgtcggttccagcagtcggatctcaaggagaacccacctctgtagcgcagccaccagctccctgctggatattgaccctctgatcctgattcacttgctcgacttaaaagaccgtagttccattgagaacttgtggggtctgcagccccggccacccgcctccctgctgcaaccaacagccagctactcaaggaaggacaaggatcagcgcaaacagcaggcgatgtggagggttccgtccgatctgaaaatgttgaaaaggctcaagacacagatggccgaagttcggtgcatgaagactgatgtcaaaaatactctatcggagattaagtcctcgagtgcagcgtctggcgatatgcagacatcactgttttctgctgaccaggccgccctcgccgcttgtgggacagaaaacagcggccgcctgcaggacttagggatggagttgcttgccaagtcatccgtggctaattgctacatcagaaattccacaaataaaaagtcgaatagtcccaagcccgcccgatccagtgtggctggcagtctcagtctcaggagagctgtggaccctggagagaatagcaggagcaagggagattgtcaaaccttatccgaggggagtcctggctcttcccagtccggatccagacattcgagtccaagagccctcatccacgggtcgataggagacatcctccctaaaacagaggatcggcagtgcaaagcactggacagcgacgccgttgtagttgcagttttctcagggctgccagcagtggagaagcggcgaaagatggtgaccctgggcgcgaatgcgaagggtggacaccttgaaggtctgcagatgacggacctggagaacaactcggagaccggcgagttgcaacccgtccttccagagggagcaagcgccgctcctgaggaggacacccacagctcctttccggacggtgaacaaatcggtccagaggatctgagcttcaacactgacgagaactccggtcgttag

SEQ ID NO: 209662 - DNA, 2793 bp, Artificial Sequence
  Description of Artificial Sequence: Synthetic coding sequence
atggacgagcagagcgtggagcggtggctgaccgagcagcgggcccagtgcccccactgtcgtgccccactccagctcagggagctggtgaattgtaggtgggcggaggaggtgacccagcagcttgatacactgcagctgtgctctctgacaaagcatgaggaaaatgagaaggacaagtgcgaaaatcatcacgaaaaactctccgtgttttgctggacctgcaagaaatgcatctgtcaccaatgtgccctgtggggtggtatgcacggaggacatacattcaagcctttggctgagatttacgagcaacacgtgacaaaggtcaacgaggaagtagccaagctgcgacggagactcatggaactgatctcactcgttcaggaagtggagcgaaacgtcgaggcagtccgaaacgccaaggatgagcgggtcagggagatccggaatgccgtcgagatgatgattgccaggttggatactcagctgaaaaacaaactgatcaccctcatgggtcagaaaacaagcctcacgcaggaaaccgagctgctagagagtttgcttcaggaggtggaacaccagctccgatcatgtagcaagagtgaactgatcagcaaatcctcggagatactgatgatgttccagcaggtgcatcgtaagccaatggcgtccttcgtgactacaccagtgccccctgactttacaagcgagctggtgccaagctatgactcagccacatttgtgctcgagaattttagcaccctgaggcagcgtgctgatcctgtctatagccccccgctacaggtgtccggactgtgttggagactcaaggtgtaccccgacgggaacggagtggtgagaggttattacctttctgtgttcctggaattatctgccggacttcctgaaacctctaagtacgagtacagggtggaaatggtccaccagagctgcaatgatcccacgaaaaatatcataagagagttcgcgagtgactttgaagtaggcgagtgctgggggtataaccggttctttaggctcgatctgctcgcaaacgaaggatacctgaatccacagaacgatacagtgattctcaggttccaagtcaggtcccctaccttctttcagaagtccagggaccagcactggtatataacgcagttagaagcagctcaaacctcctatattcaacaaatcaataacctcaaggaacggctaacaattgaactctctcgtacccaaaagagcagggacctctccccccccgacaaccacctgtctcctcagaacgatgacgctcttgaaacaagggccaagaagagtgcctgctccgacatgctgctggagggaggacccacgaccgcgtcagtacgggaggctaaggaagacgaagaagatgaagaaaagatccagaacgaggactatcatcatgaactgtcggatggcgatctcgatcttgatctggtctacgaagacgaagttaatcaacttgacggctccagcagcagtgccagttccaccgccacctccaatacggaggaaaacgacatcgacgaggagaccatgtctggggaaaatgacgttgaatataataacatggagctcgaagaaggagaactgatggaggatgcggcagcagcagggccagctggcagcagccacgggtacgtgggaagttcctccagaatttctcggaggacccacctgtgcagtgccgcaacttcctccttacttgatattgatccacttatcctgatccatttactggatctgaaagacagaagcagcatcgagaacctctggggactgcagcctaggcctccagcgtcccttctccaacccaccgcctcatactcacgaaaggacaaggatcagagaaagcagcaggctatgtggcgcgtgcccagtgacctgaaaatgctgaaacgtttaaaaacccaaatggctgaggtgcgctgcatgaagactgacgtgaagaacacgctgtccgagattaagagcagcagcgccgctagcggcgatatgcagactagcctattcagcgccgaccaggctgctctcgccgcttgcgggacagagaatagcggccgtttgcaggatcttggaatggaactcctggctaagtcttcggtggcaaactgttacattaggaacagcaccaataagaaaagcaacagccccaaacctgcgcgcagctcagtcgctgggagtctgtccttacgtcgggcagtggaccccggtgagaatagtagatccaagggggattgtcaaacgctgtccgaaggctctccaggcagttctcagagcggcagtaggcattcttcaccccgtgccctgatccacggatctattggagacattctgcctaaaacagaagatagacagtgtaaagccttggattctgacgccgtcgtggtggccgttttctcaggccttcctgcggtcgaaaagaggcgcaagatggtgacattgggcgccaatgcgaagggcggccacttagagggactgcagatgaccgatctggaaaacaatagtgaaaccggcgagctacagccagtgctgcccgagggagcgtccgccgctccggaggaaggcatgtcatccgattccgacatcgaatgtgatacggagaatgaggagcaagaggagcataccagtgttggcggatttcacgattcttttatggtgatgacgcagccgcccgatgaggacacccactcctcgttcccggatggcgaacagatcggtccggaagatcttagttttaatactgatgaaaattctggtcggtag

SEQ ID NO: 209663 - DNA, 2895 bp, Artificial Sequence
  Description of Artificial Sequence: Synthetic coding sequence
atggacgagcagagcgtggagagcatcgccgaggtgttccggtgcttcatctgtatggaaaagctacgcgacgccagactatgtccgcattgctccaagttatgttgctttagctgcatccggcggtggctgaccgaacaacgggcacagtgcccccactgcagggctccgctgcaactgagagagctagtgaattgccgatgggccgaagaggtgacccagcagcttgacaccttacaactctgttctttaacaaaacatgaggaaaatgaaaaggacaaatgtgaaaaccatcacgaaaaattgagtgtcttctgttggacctgcaaaaagtgtatttgccaccaatgcgcactgtggggaggcatgcacggtggacacacattcaaaccgcttgcagagatctacgaacaacatgtgacaaaggtcaatgaggaagtcgcaaaactacgacggaggctgatggagctaattagcttggtgcaagaagtggagcggaatgttgaggccgtaagaaatgctaaagacgagcgagtgcgggagattcgcaacgctgtggaaatgatgattgccaggctcgacacacagctgaagaataaactgattactctgatgggccagaagactagtctgacacaggagacagagttgctcgagtccttattgcaggaggtcgagcatcagctgcgctcatgcagtaaaagtgagctcatatccaaaagctcggagatcctcatgatgtttcagcaggtgcatcgaaagcccatggcgtcatttgtgaccacgcctgtcccacctgacttcacctccgagctggtcccgagctatgactccgctaccttcgtgcttgaaaactttagcacactgagacaaagggcagaccccgtatacagccctccgctgcaagtatcaggcctttgctggcggctgaaagtgtacccagatgggaatggagtggtcagaggctactacctaagtgttttcctagagctgtccgctggactcccagagacctccaaatatgagtatagggtcgagatggtgcatcagtcgtgcaacgaccctactaaaaatatcatcagagaatttgcatccgactttgaggtaggggagtgttgggggtacaacagattctttaggttggacctgctcgccaatgaaggctacttaaacccccagaatgataccgtcattctacgctttcaggtacgatctccaacctttttccagaagagcagggatcagcattggtacattacccaactcgaggcggcccagacatcttacatccagcagattaacaacctgaaagagcgcctgacgattgagctcagtcgaactcaaaaatcaagagacctgagccctccagataaccatctcagtccacagaacgatgacgctctggaaactagggcgaaaaaatcggcctgcagtgatatgctgctggagggcgggccgactaccgcttctgtccgggaggccaaagaagatgaagaagatgaggagaaaatccagaacgaagactaccaccatgaactctccgacggggacctggacctcgacttggtgtatgaggatgaagtcaatcaactggatggaagttcaagttccgcaagctccacggctacttcaaacaccgaagaaaacgatatagacgaggagacgatgtcgggagaaaatgatgtcgaatacaataacatggagctcgaagagggggaactgatggaagacgcagccgctgccggcccagctggcagttcgcatggctacgtcggctctagttccagaatcagtcggaggactcacctttgctccgccgctacatcttctctgctggatattgatccccttatcctcattcacctacttgatctgaaggaccgaagctccattgaaaatctgtggggtttacagccgaggcctcccgcctcgctgctgcagcctacagcgagttatagcaggaaagacaaggatcagaggaaacagcaggcgatgtggagggtaccttctgatttgaagatgctgaaacgcctgaagactcagatggccgaagtgcggtgtatgaaaaccgacgtcaaaaatacattatcagagattaaatctagcagcgcagcctccggggacatgcagacatccctcttctctgccgaccaggccgcccttgcagcctgtggcacagaaaatagcgggaggttacaggatttagggatggaactgctggcaaagagttcagtagctaattgttatatccgcaactccacaaataagaagtcaaactcccccaagccggcacgatcctctgttgcaggttcactctcactgcgtagagcggtggatcctggagagaacagccgatccaagggcgactgtcagactctcagcgagggaagtcccggtagcagccagtctggctcacgccactcttccccccgtgctctgattcacggatctattggcgacatactgccaaagacagaggaccgccaatgcaaagccttggattctgatgctgttgtcgtggccgtgttttccggcctaccggccgtggagaagcgccgcaaaatggtgacattgggagccaatgcgaagggtgggcatctcgaggggttacagatgactgatttggaaaacaacagtgaaacaggagagctccagccggtgctgcctgaaggagcatccgcagctccagaagaggggatgtcgtcagacagcgatattgagtgcgataccgaaaacgaggagcaggaagagcatacatccgtggggggttttcatgattcctttatggtgatgacgcagcctcccgacgaagacacacacagctcattccctgatggagaacagattggcccagaggacctaagcttcaacacggatgagaacagtggccggtag

SEQ ID NO: 209664 - DNA, 1557 bp, Artificial Sequence
  Description of Artificial Sequence: Synthetic coding sequence
atggccgagaccagcctgctggaggccggcgccagcgccgccagcaccgccgccgcactggaaaacctccaggtggaggccagttgtagtgtgtgccttgagtatcttaaggaaccagtgattattgagtgcggtcataacttctgcaaagcctgtatcactagatggtgggaagatctggagcgggacttcccttgtcccgtgtgtcgtaagaccagcagataccgttctcttaggcccaaccgccagctgggcagcatggtcgaaatcgcaaagcaacttcaggcggtgaagaggaagataagagacgaatccctgtgtcctcagcatcatgaagccctgtctctgttttgctacgaggaccaagaggctgtgtgtttaatttgcgctatttcccatacacaccgtgcgcatacagttgtccccctggacgacgctacccaggaatacaaagaaaagctccagaagtgtctggagccactggaacaaaaactgcaggaaattacaagatgcaagtcttctgaagaaaagaagcccggggaactgaagcgactggtagagtctcgtaggcagcaaatcctgagagagttcgaggaacttcacagacgcttagatgaggaacaacaagtcctgctgtcccgtctggaagaagaggagcaagatatccttcagaggctgagagagaacgcagcccacctgggggacaagcggagggacttagctcatctggccgctgaagttgagggtaaatgcctccagtcaggctttgagatgctgaaggacgttaaatcaaccctggaaaagaatatcccccgcaaatttgggggcagtctgagcactatatgtccaagagatcacaaggcccttctcgggcttgtaaaggagatcaatagatgcgaaaaagtgaagactatggaagtaacatccgtgtctatagaactagagaaaaacttctctaacttcccccggcagtactttgccctgagaaagattctcaagcagctgatcgcagacgtcacgctcgatcccgagaccgcgcatcccaatctggtactaagtgaagaccggaaatccgttaagttcgtcgagactagactacgcgacttgcccgacactccaaggcgcttcacattctacccctgcgtcttagcaacggaagggtttacgtctggccggcactattgggaggtggaagtaggcgacaagacacactgggccgtaggggtgtgtcgggattccgttagcaggaaaggggagctcacaccgctccccgaaactggttactggcgagtgcgcctgtggaatggcgacaaatatgctgcaaccacgacaccattcaccccactgcatattaaagtgaaaccaaaacgcgtgggaatctttctcgattatgaggcgggcaccctctctttctacaatgttaccgacagaagccacatatacacttttactgacacgttcacagaaaaactgtggcctctcttctacccagggatccgggcggggcgtaagaatgcagcaccactcaccattagacctcccactgattgggaatag

SEQ ID NO: 209665 - DNA, 1467 bp, Artificial Sequence
  Description of Artificial Sequence: Synthetic coding sequence
atggccgagaccagcctgctggaggccggcgccagcgccgccagcacagcagccgctctcgaaaatctccaggtggaggccagttgctcagtctgtttggagtatttgaaagaaccagtgattattgaatgtggccacaacttctgtaaggcttgtatcacaagatggtgggaggaccttgagagggactttccttgccctgtctgtcgcaaaacgagcaggtatagatcactcaggccaaacagacagcttgggtcaatggtcgagatcgctaagcagctgcaagcagtgaaacgaaagattcgagacgagtcactgtgcccccagcatcacgaggccctgtcacttttctgttatgaagatcaggaagcggtgtgcctgatttgcgccatctcgcacacccatcgggctcacacagtagtgcctctggacgatgccacacaagaatataaagagaaactccagaagtgcctggaaccgctcgaacaaaagcttcaggagattacccgttgtaagtccagcgaggaaaaaaaaccgggagagctgaaaaggctggttgaaagtaggaggcagcagattctgagagaattcgaagagctgcacagacgcctagacgaagaacagcaggtgctgttgagccggctggaagaagaagagcaggacatcctgcagcgtctccgagagaacgcggcccatcttggagacaagcggcgagatctggctcacttggcagccgaagttgagggcaaatgtcttcagtccgggtttgagatgctgaaggatgtgaagagtactctggaaaaatgtgaaaaggtcaagacgatggaggtgacatccgtgtcaatagaattggagaagaacttttccaatttccccaggcagtactttgccttgcgcaagattctgaaacagcttatcgccgatgttacacttgacccagagacagcgcaccctaatctggttttatcggaagatcggaagtctgtgaaatttgtcgaaactagactgcgtgatctgccagacactccccgccggtttacattttacccctgcgttttagcaaccgagggcttcacgtccggacggcattactgggaggtggaagtcggcgataagacacactgggccgtgggagtttgtcgagacagcgtgtcccgcaagggcgagctcactcccttacctgaaaccggatactggcgggtacgtctgtggaatggcgacaagtatgctgcgactactacaccgtttaccccgctgcacatcaaggtgaaaccaaagcgggtcgggatatttctggattacgaggcaggcacgctgtcattttataacgtcacagaccggagccacatatacactttcaccgatactttcaccgagaagctttggcccctattctaccccggaatccgagcagggcggaaaaacgccgcgcccctgacaattcggcctccgacagactgggaatag

SEQ ID NO: 209666 - DNA, 1467 bp, Artificial Sequence
  Description of Artificial Sequence: Synthetic coding sequence
atggccgagaccagcctgctggaggccggcgccagcgccgccagcacggctgcagccttggaaaatctccaggtagaggctagttgctctgtctgcttggagtacctcaaggaacctgtgattatagagtgtggacacaatttttgtaaagcatgcataacacggtggtgggaagatttggagagggattttccctgtccagtgtgtcgaaagacatccagatatcgtagtctccgcccgaaccgccaattgggcagcatggtcgaaatcgcgaagcagctgcaggcggtgaagcgaaaaatccgtgacgagagtctgtgcccccaacatcacgaggcactaagtctattttgctacgaagaccaggaggccgtttgcctcatatgcgctatttcgcacacccaccgagcccatactgtggtacccttggatgacgcaacacaggagtataaggagaaattgcagaagtgcctcgaacccctggagcagaagctgcaggagattactagatgtaagtcttctgaagagaaaaaacccggcgaattgaagagactcgttgaatcccgccggcagcagatcttgcgagaatttgaggagttacaccgccgactggacgaggaacagcaggtgctgctgtcaagactcgaagaggaggagcaggacatcctccaaaggctgagggagaacgctgctcacctgggtgataagaggcgggacttggcccatctcgccgccgaggtcgaaggcaaatgtcttcagagtggattcgaaatgctcaaggatgttaagtctaccctggagaaatgcgagaaagtcaaaacaatggaggtcaccagcgtatcaattgagttggagaagaatttttctaactttcctaggcagtactttgcgctccggaaaatactcaagcagttgattgctgacgttaccttggatcctgaaactgctcatcctaacctggttttgagtgaggaccggaagtctgtcaagtttgttgagacaaggctgagagatctccctgacacaccaaggcggttcacgttctacccctgcgtactggctaccgagggttttacgtctggtcggcattactgggaggtggaggtgggagataagacacattgggctgttggcgtctgccgggactctgtgagccggaaaggagagctgaccccactcccggagaccggctactggcgcgtgcgattgtggaatggcgacaaatatgcagctacaacgacccccttcactcctcttcacattaaggtgaagcctaagcgggtggggatttttctggattatgaggctggcacattgtctttttacaacgtcaccgatcggagccatatttacacattcacagacacatttacagagaagctgtggcctcttttctaccctggaatccgggcgggccggaaaaatgccgcgccactcaccatcaggccccccacagactgggagtag

SEQ ID NO: 209667 - DNA, 1557 bp, Artificial Sequence
  Description of Artificial Sequence: Synthetic coding sequence
atggccgagaccagcctgctggaggccggcgccagcgccgccagcactgccgccgccctcgagaacctacaggtggaggcctcgtgcagtgtgtgtctggagtatctgaaagaaccagtgattattgagtgcggccataatttttgcaaggcatgtattactcgttggtgggaggatttagagcgggacttcccctgtccagtgtgccgcaagacatctcgttatcgcagtctccgccctaaccgtcaactgggctccatggttgagatcgcaaaacaacttcaagcagtaaaaagaaagatccgcgatgaatctttatgtccgcagcatcacgaggctttgtcattgttctgctacgaggatcaggaggccgtgtgcctgatctgcgccatatctcacactcaccgcgcccacacggtagttccactggacgatgcgacccaggaatacaaggaaaagcttcaaaagtgcttggagcctctcgagcagaagctccaggaaattacccgctgcaaatcctccgaggagaaaaagccaggagagcttaagaggctcgtggagtcaagacggcagcagatcctgcgcgagttcgaggagctgcacagaagactggatgaagaacaacaggtcttgctctctcgtttagaggaggaggagcaagatatcctgcagaggttaagagaaaacgcggcgcacctaggtgataagcgaagagatttggcacatctggcagctgaggttgaagggaagtgtcttcagtctggctttgaaatgctcaaagatgtgaaaagcacattggagaaaaacatccctcgaaaatttggaggttccctgagcacaatttgcccaagggaccacaaggcattgcttggcctcgtgaaggaaatcaatcggtgtgaaaaggtcaaaacgatggaagtaacttccgtgtcaatcgaactggaaaagaacttcagtaacttccctcggcagtactttgctcttcgcaagattttgaaacagctgattgccgacgtaacactagatcccgaaaccgctcacccgaatctggttttgtccgaggatcggaagagtgttaagtttgtggaaacccgcctgcgggacctccctgatacccctagacgtttcaccttctacccgtgtgtgctcgccaccgaaggcttcacaagcggacgccattattgggaggtggaggttggagataagacccattgggccgtaggcgtttgcagggactcagtctcacgaaagggggagctcactcccctcccagagactgggtattggagggtgcggttatggaacggagataagtacgccgccactaccactccattcacgcctttacatattaaggtcaagccaaagagggtggggatcttcctggactatgaggcagggacacttagtttttataacgtgaccgaccggtcgcatatctacacttttacagacactttcacagaaaaactctggcctctcttttatcctggcattagagctggccggaagaatgccgccccgctcaccatccggccacctaccgattgggagtag

SEQ ID NO: 209668 - DNA, 1467 bp, Artificial Sequence
  Description of Artificial Sequence: Synthetic coding sequence
atggccgagaccagcctgctggaggccggcgccagcgccgccagcactgctgctgccctggagaacctgcaggttgaagcctcctgttcggtctgtttggagtacctgaaagaacccgtcataatcgaatgcgggcacaatttctgcaaggcttgcataactcgctggtgggaagatttggaacgcgactttccctgccctgtatgtcgcaagacgagccgataccggagcctgaggcccaatcgacagctcgggagcatggtagagatcgcaaaacaactgcaggcagtgaaaagaaagatccgcgacgagtccctgtgccctcaacaccacgaggccttgtccctgttctgctacgaggatcaagaggccgtttgcctgatctgcgcaatttcacacacccatcgcgcgcataccgtcgtgccattagacgacgcgacacaggagtataaagaaaaattacagaagtgtctggagcccctggaacaaaaattgcaggagatcacaaggtgcaagtcttcggaagagaaaaaacctggcgagctcaagcgactcgtggaatccaggcgccaacaaatactgagggagtttgaggaactccacagaagactggacgaggaacagcaggtgctgctgtccagactggaggaggaggaacaggatattctccagcggctcagggaaaacgccgcccacctgggcgacaagcgcagggacctggcccatctggccgctgaagtagaaggtaaatgtttacagtccgggtttgagatgctcaaggatgtcaagtcaaccctggagaagtgcgagaaggtgaagactatggaggtaactagcgtttccatcgagttggaaaagaattttagtaacttcccacgccagtacttcgcacttcgcaaaattctcaagcagttaattgcagatgttacacttgacccagaaacagctcatcctaacttggtgctgtctgaggacaggaagtccgtgaagtttgtggagactagactgcgcgatctgcccgacaccccgcggcggtttaccttttacccctgcgtgctggctactgaaggatttaccagcgggaggcactactgggaggtcgaagtcggagataagactcactgggccgtgggagtttgccgagactctgtgtccaggaaaggcgagctgacacctctcccagagaccggctactggagagtgcgcctttggaatggcgacaaatacgctgccaccactacgccattcacccccctgcatatcaaggtcaagcccaagagggtgggcatcttcctcgactatgaggcgggtacattatcattctataatgtcaccgataggagtcatatatacacatttactgacacgttcacagagaagctttggcctttattttacccgggcattcgggcaggccggaagaatgctgccccattaacgatccggcctccaactgactgggaatag

SEQ ID NO: 209669 - DNA, 1557 bp, Artificial Sequence
  Description of Artificial Sequence: Synthetic coding sequence
atggccgagaccagcctgctggaggccggcgccagcgccgccagcacggccgccgcccttgaaaacctccaagttgaggcttcttgttccgtgtgccttgagtacctgaaggaaccagtgataattgagtgtgggcataacttctgcaaggcctgcataacaaggtggtgggaagacctcgagcgtgattttccttgcccagtttgtcggaaaacttcaaggtatcgctctctgagacctaatcgtcagctaggctcaatggtcgaaattgcgaagcagctgcaggcagtaaagcggaagatccgagatgagtcactgtgcccacagcaccatgaagctcttagtttattctgctatgaggaccaggaggccgtttgtttgatctgtgccatctcccacacccaccgtgcgcacacggttgtcccattagacgatgcgacacaggagtacaaggaaaagctacaaaaatgccttgagcctttggagcaaaagttgcaggaaattacccgatgtaaatctagtgaggagaagaagcccggggagttaaaaagacttgtcgaaagcaggagacagcaaattctgcgggagttcgaggagctgcaccgtcgccttgacgaagagcagcaagtcctgctgtccagactggaagaagaggaacaagatatcctgcaaagactgagggaaaacgctgctcatctgggagataaacgccgagatttagctcacctcgcggcggaagtcgaagggaagtgtctgcagagcggcttcgagatgctcaaagacgtgaaaagcaccttggaaaagaatatccctcggaagttcggaggatcattaagtacaatctgtccgcgggaccataaggcactgctgggtctcgtgaaagagattaataggtgtgagaaggtgaagacaatggaggtgacctccgtatctatagagctggagaaaaacttttctaattttccacgtcaatacttcgctttaaggaaaatcttgaaacagcttatagcagatgtgaccctggaccctgaaacggctcacccaaacctagttctctccgaagatcgaaagtccgtgaagttcgtggaaacccgcctcagggacctacccgacaccccccggcggtttaccttttatccttgcgtcctcgcaacggaggggttcacaagcggcaggcactattgggaagtcgaggtgggagacaaaacgcactgggcagtcggcgtgtgtcgagactccgttagtaggaagggggagctaaccccactgcctgagactggttattggcgggtccgcctctggaacggggataagtacgctgctactaccactcccttcacccctttgcacattaaagtcaagccaaagagggttggcatcttccttgactacgaggctggcacactgtccttttacaacgtgaccgatcgtagccatatctataccttcactgacaccttcactgagaaactgtggccactgttctaccccggcatcagagccggccgtaagaatgcagccccacttacaattaggccacccaccgactgggagtag

SEQ ID NO: 209670 - DNA, 1467 bp, Artificial Sequence
  Description of Artificial Sequence: Synthetic coding sequence
atggccgagaccagcctgctggaggccggcgccagcgccgccagcacggctgccgcacttgaaaatctgcaggtggaggcttcctgctctgtatgtttggaatacttaaaagagcctgtcatcatcgaatgcggccacaacttctgtaaggcctgtattacaaggtggtgggaagacctcgaaagagactttccttgtcctgtatgccgcaagacatcgcgatatcgcagtttacggcctaacagacaactaggaagtatggtagaaatagctaaacagctccaggccgtaaagcgtaagattcgggacgagagcctctgtccacaacatcatgaggctctgagccttttctgttacgaggatcaggaggccgtgtgtctcatctgtgctatcagccatactcatagagcgcacactgtcgtgcctctagacgacgctacacaggagtacaaggagaaattgcaaaagtgcctcgaacctttagagcagaagctgcaggagatcacacgatgtaagtcttcggaggaaaagaagccgggggagttaaagagactcgttgagtccaggagacagcaaatattacgcgaattcgaggaactgcacagaaggctggacgaggagcagcaggtgctactttctaggctggaggaggaggagcaggatatccttcagagactccgtgagaacgccgcccacttaggcgataagagaagggacctggcacacttggctgccgaagtggaaggtaaatgcctccagtcgggcttcgaaatgctaaaggatgtcaaaagcacgctggagaaatgtgaaaaggttaaaactatggaagtgactagcgtgtcgattgagcttgagaagaatttctccaattttccccgccagtactttgctcttagaaaaatattaaaacagctgattgcagatgtcacattggacccagagacagcccaccccaacctggtcctttccgaggaccgcaagtctgttaagtttgtggagacccgcttacgagatttaccagatacccccagacggttcacgttttatccttgcgtgctcgcaaccgagggatttacatctggccggcactattgggaggtagaggtgggcgacaaaacacactgggccgtgggggtgtgccgggactcggtgagcaggaagggagagctaaccccactgcccgaaaccgggtattggcgcgtgcggctgtggaacggcgacaagtatgctgccacaaccaccccttttacaccccttcacatcaaagttaaacccaagagggtggggatcttcctggactacgaggctggcacattatctttctataacgtcactgatagatcccatatttacacgtttacagacacgttcaccgagaagctatggcccctgttctatcctggaatcagggccggcaggaagaatgccgctcctctgacaatccggccacctacagactgggaatag

SEQ ID NO: 209671 - DNA, 1467 bp, Artificial Sequence
  Description of Artificial Sequence: Synthetic coding sequence
atggccgagaccagcctgctggaggccggcgccagcgccgccagcaccgccgctgctttggagaatctgcaggttgaggcttcttgtagcgtctgcttggaatatcttaaggaacctgttatcatcgagtgcggtcacaatttctgtaaggcatgcattactcgctggtgggaggatttggaacgagacttcccttgtccagtgtgcaggaagacctcgagatatcgtagtctacgcccaaaccgccagctagggtctatggttgaaattgccaagcagctacaggcagtcaagaggaagatcagagacgaaagtttgtgtcctcaacaccacgaagccctgtcccttttttgctatgaggatcaggaggcagtctgtctcatctgtgccatatcccatacacaccgagcacatacagtggtacctttggacgatgccacccaggagtataaggaaaagctgcagaaatgtctagagccactggaacagaaactgcaagagattacacgctgtaaatcttccgaagagaaaaagcctggcgaattgaaaagattggtggagtcccgtaggcagcagatattaagggagtttgaagagctccatcgccggctggatgaggagcagcaggtgctgctcagcaggctggaagaagaggagcaggatattcttcagcgtctgagggagaatgcagcccacctcggagataaacgacgggacctcgcccatttagccgcagaagtggagggaaaatgtttacagagcggtttcgagatgttgaaagacgttaaatctacactcgagaaatgcgagaaagtgaagacaatggaggtgacctcagtgtctatcgaattggagaagaacttcagcaattttcctcgacagtacttcgctctgcgcaagatccttaaacagttaatcgcagacgtgaccttggaccccgaaaccgctcatccaaatctggtgctatccgaagatcgcaaatctgtgaagttcgtcgagactagactgagggatctccccgataccccgaggagattcaccttttatccgtgcgtacttgccaccgaaggctttacctcgggcaggcactattgggaggtggaagtcggagacaagactcattgggcagtcggggtgtgtcgcgattctgtgtctcggaagggggagttaactccattacccgagacaggttactggagggtgcgtctgtggaatggagacaaatatgctgccacgaccacaccattcactcccttacatatcaaagtgaagccgaagagggtcgggatcttcttggactacgaggccgggaccctctccttctataacgtgacggacaggtcccatatatacacttttactgacaccttcacggagaaactctggccattgttctatccagggattcgtgcgggccggaagaacgctgctcccctcaccattcgccctcccacggattgggagtag

SEQ ID NO: 209672 - DNA, 1467 bp, Artificial Sequence
  Description of Artificial Sequence: Synthetic coding sequence
atggccgagaccagcctgctggaggccggcgccagcgccgccagcacggctgccgcgttggagaatctccaggtagaggcctcctgttctgtgtgccttgaatacctgaaagaacccgtcatcattgaatgtggccataatttctgcaaggcgtgcatcacgcgatggtgggaggacctcgagagggatttcccctgtcctgtgtgcaggaagacgagtaggtaccggagtctcagaccaaatcggcagctaggtagcatggtggagatagccaagcagctccaggcggtgaagcgtaaaatccgcgacgagtcactatgccctcagcaccatgaagcgctatccttgttctgctatgaggatcaggaagccgtgtgcctgatctgtgctatcagtcatactcacagagcccatacggtcgtgccgctggatgacgccacacaggaatacaaagaaaaactgcagaagtgcctggaaccactggagcagaagctgcaggaaatcactaggtgcaagagctccgaggagaagaaacctggtgaactgaagaggttggttgagtctagacgacagcagattttgagagagtttgaagagctccatcgtagattagatgaagagcaacaggtcttactgagccgacttgaggaggaggaacaggacatcctccagaggctgcgggaaaatgcggcccatctgggagacaaacgcagagacttagcgcatttggcggccgaagtggaaggaaagtgtcttcagtctggatttgaaatgctcaaggatgtcaaaagcacgctggagaaatgcgagaaggttaagactatggaagttacctctgtctccattgaactggagaaaaatttttccaattttccgaggcaatactttgcacttcgcaagatccttaaacagcttatagctgacgtgacactggaccctgagactgcccatcctaacctcgtactgtcagaggatcggaagtccgtcaagttcgtggagacaaggctacgcgacttgccagacacccctaggcgctttactttctacccctgtgtccttgctaccgagggcttcacttcagggagacactactgggaggtcgaggtgggagataaaacccactgggcggtaggggtctgtcgcgatagcgtgagccgtaagggtgagctgaccccgttaccggaaaccggctattggcgggtgcggctctggaatggagacaagtatgcggccactacaaccccttttacccccctgcatattaaggtaaaacctaaaagagttggcatcttcctcgactacgaagcaggtacgttgagcttctataatgtgacagacagaagccatatctatacttttaccgacaccttcacggagaaactgtggcccctgttctaccccggtatccgcgctggacgaaagaatgcagcccccttgactatcaggcctccaacggactgggagtag

SEQ ID NO: 209673 - DNA, 435 bp, Artificial Sequence
  Description of Artificial Sequence: Synthetic coding sequence
atggccgagaccagcctgctggaggccggcgccagcgccgccagcaccgccgcagctctggaaaatctccaggtcgaggcatcctgctctgtttgtctggagtatctcaaggaacctgtgattattgagtgtggacataacttttgtaaggcatgcattacgcgatggtgggaagacctggagagagatttcccttgcccagtgtgccggaagacttccagatacaggagtcttagaccaaatagacagttggggtctatggtcgagattgccaagcagctgcaagcagttaagcggaagattcgagatgaatctctgtgtccacagcaccacgaagctctttccctgttctgctatgaggatcaggaggctgtgtgtctgatttgcgcgatctcccacacacatcgagcacacacagtcgtcccactcgactag

SEQ ID NO: 209674 - DNA, 684 bp, Artificial Sequence
  Description of Artificial Sequence: Synthetic coding sequence
tgaaccagccggtaccggagcctgcggcccaaccggcagctgggctcgatggtggaaattgccaagcagttgcaggccgttaagaggaagattcgggatgaatctctctgcccccagcatcatgaagcactgtcccttttctgttatgaagatcaggaggccgtctgcctcatttgcgcaatctctcatacacatcgggcccacacggtggtgcccctggatgacgctactcaggaatacaaggagaaactgcagaaatgtctggagcccctcgagcagaaacttcaggagattactaggtgtaagtcctcagaagagaagaagccaggtgaacttaaacgactggtggaatcacggaggcaacagatcctacgcgagttcgaagaacttcaccgcaggttggatgaggaacaacaggttttactgtcacgtctggaggaggaggagcaggatatcctacaacgcctgagagagaatgctgcccacctgggcgacaagagaagagacctagcacaccttgcggcagaggtggagggaaaatgtctgcagtcaggttttgagatgctgaaggatgtaaaatccacgctggaaaaatgcgaaaaagtgaagaccatggaggtgactagcacgacaccctgcaccagtctacacagcgagatcaacgacaacgtgcgcggtcggtag

SEQ ID NO: 209675 - DNA, 225 bp, Artificial Sequence
  Description of Artificial Sequence: Synthetic coding sequence
atggccgagaccagcctgctggaggccggcgccagcgccgccagcaccgctgctgccctggaaaaccttcaggtcgaagcctcttgtagtgtgtgcctagaatatctgaaggaacccgtgatcattgagtgtggtcataatttctgcaaggcgtgtattactagatggtgggaagatctagagcgcgacttcccatgccccgtgtgccgcaaaacttcgcgatag

SEQ ID NO: 209676 - DNA, 1254 bp, Artificial Sequence
  Description of Artificial Sequence: Synthetic coding sequence
atggtggagatcgccaagcagctgcaggccgtgaagcggaagatccgcgacgagtctctatgtccacaacaccatgaggctcttagcctgttctgttacgaagaccaggaagcagtgtgcctaatatgcgccatcagtcacacccacagggcacacactgttgtgcccctcgacgacgctactcaggaatacaaggaaaagctgcagaaatgcctggagcccctagagcaaaaactgcaagagatcacccggtgcaagtcaagtgaagagaagaaacctggggagctcaagaggctggtggagagcaggagacaacagattcttagagaattcgaagaactgcatagaagacttgacgaggagcagcaggtgctgcttagccggctggaagaagaggaacaggatatcctgcaaagactgagagaaaacgccgcccacctcggagataagcgaagggacctggctcatctggcagctgaagttgaaggaaagtgtctccagtctggttttgaaatgctgaagcccgttctgagtgctcgggaagagtgcgagaaagtgaagacgatggaagtgacgtcagtgtccatcgagttggaaaagaatttctcaaacttcccccgacagtatttcgctctgaggaagatcctaaaacagctgatagcagacgtgacccttgaccctgagactgcacatcccaacctagtgctgtccgaagaccgaaagtccgtcaaattcgtcgaaacaaggttacgggatttaccggacaccccacgacgatttaccttctacccctgtgtcctggccacggagggcttcacttctggccgccattactgggaggtggaggccgcccactgcgtgctggctcaagaccctgaaaatcaggccctggctaggttctattgctataccgaacgtacgattgctaaacgcttggtgctccgcagggatccttcagtcaagcgcaccctgtgtcgaggttgcagctccctcctggtgcctggactcacatgtacacagaggcaacgcaggtgccgggggcagcgctggaccgtgcagacatgcctgacctgccaacgctctcagcgattccttaacgacccgggccacttgctgtggggggatcgtccagaagcacaactgggtagtcaggcagactccaaacctttacagcctctgccaaacacagcccactctatttcggaccgcctccccgaggagaaaatgcagacgcagggctcttccaaccaatag

SEQ ID NO: 209677 - DNA, 1557 bp, Artificial Sequence
  Description of Artificial Sequence: Synthetic coding sequence
atggccgagaccagcctgctggaggccggcgccagcgccgccagcactgccgctgcactagaaaacctacaggtggaagcttcctgttcagtctgcttagaatacctcaaggagccagtgattatcgaatgcggccacaatttctgtaaggcctgtatcactcgttggtgggaggatttggagagggattttccctgcccggtctgtcggaagaccagtagatatagatcactgcgaccaaatcgccagctcggcagcatggtcgagatcgcaaaacaactgcaggccgtcaagcgcaaaatccgagacgagagcctgtgccctcagcatcacgaagctctgtcattattctgttatgaggatcaagaggcagtgtgtctgatctgcgctatctctcatactcatagagcccatacggtagtccccctggacgacgccacacaggagtataaggaaaaactccagaaatgtctggagccccttgagcaaaagcttcaggagattacacggtgcaagtcatccgaggaaaagaagccgggggaactcaagcgcctggtcgagtcacgtcgtcagcagatactgagggagtttgaggaattacacagaagactcgatgaggagcagcaggtgcttttgtcaaggctggaagaggaggaacaggacatcctccaaaggttacgagagaatgccgcacacctcggcgacaaaagacgcgacctcgctcaccttgctgcggaagtcgagggaaagtgtctgcagagcggatttgagatgctgaaggatgtaaagtctacattggagaaaaacatcccccggaaatttggcgggagtcttagtacgatctgcccccgcgatcacaaagcactgctggggctggtgaaggaaataaatagatgtgagaaagtcaagaccatggaagtgaccagtgtgtctatcgagctggagaagaacttcagcaatttccccaggcagtacttcgccctgagaaagatccttaagcagcttatcgccgacgttacactcgacccagagaccgcacacccgaacctggtgctgtcagaagataggaagtccgtgaaattcgtggagacacgcctcagggaccttcccgacactcccaggcgattcacattttatccctgtgttctcgcaacagaggggttcactagcggcaggcactattgggaggtggaggtgggagataagacgcattgggcagttggtgtttgcagggacagcgtgtcacgtaagggcgaactgacaccgctaccggagactgggtactggagggtcaggctttggaatggagataagtacgccgccacaaccactcccttcacacctttacacatcaaggttaagcctaagagagttggcatttttcttgactatgaagctggaactctctccttctacaacgtaactgatagatcccacatttacacgttcaccgacactttcaccgaaaagctttggccgctgttctaccccgggataagggccgggagaaagaacgccgccccattaacaatcaggccaccaactgactgggagtag

SEQ ID NO: 209678 - DNA, 1467 bp, Artificial Sequence
  Description of Artificial Sequence: Synthetic coding sequence
atggccgagaccagcctgctggaggccggcgccagcgccgccagcactgcagccgctttagagaaccttcaggttgaagctagctgttctgtctgtctagaatacttgaaggaaccggtgattattgaatgtggccataacttttgcaaggcctgtattacgaggtggtgggaggacctcgagagggatttcccctgcccagtatgtcggaagacctcgagatacaggagcttaagacccaaccggcagcttggcagtatggtggagatcgctaagcagttgcaggctgtgaagagaaaaatccgtgatgagtctttgtgcccacaacatcacgaagcactgagtctattctgttatgaagaccaagaggccgtctgtctgatctgcgctattagtcatacacatagggctcacacagtggtgcctctggatgacgcgacccaggagtacaaggagaaattgcagaagtgcctggaacctctggagcagaaactgcaagagattaccaggtgtaagtccagcgaggaaaaaaagcctggtgagcttaagcggcttgtcgaatccaggaggcagcagatacttagggagtttgaggagctacacaggaggctggatgaagagcagcaggttttattgtctagacttgaggaggaggagcaggatattctgcaacgcttgagagaaaatgcggcccacctgggcgataaacgccgggatctagcccatctggctgcagaggttgagggtaagtgcctccagtccgggtttgagatgttaaaggacgtcaagtctaccctggagaaatgtgagaaggttaaaacgatggaggtgacctccgttagcatcgagttagaaaagaacttttctaatttccccagacagtattttgccctccggaaaattctcaaacagttaattgccgatgtgacactggatcctgagacagcccaccctaacctggtgctctcagaagataggaaatctgtgaaatttgtcgagacacggctgagggatcttcctgacacgcccaggagatttactttttatccctgcgtcctcgcaacagaaggttttactagcgggagacattactgggaagttgaggttggcgacaagactcactgggccgtgggcgtgtgtagagactcagtgagtcgtaagggggaattgacacctttaccagaaactggctactggcgtgttcgcttatggaacggggacaagtatgctgcaacaaccacgccttttacgccactgcacattaaggtaaagcccaaacgcgtgggaatctttctcgactatgaggccgggaccctatccttctataacgtgaccgacaggagtcatatctacaccttcaccgacacctttaccgaaaagctgtggccattgttctatcccggtattagagccggtcggaaaaacgccgcaccactcaccattcgcccccccactgactgggaatag

SEQ ID NO: 209679 - DNA, 435 bp, Artificial Sequence
  Description of Artificial Sequence: Synthetic coding sequence
atggccgagaccagcctgctggaggccggcgccagcgccgccagcacagcagctgctttggagaatctgcaagtggaggcgagctgttcagtctgcctcgaataccttaaagagccagtcatcatagagtgtggacataatttttgtaaagcgtgtattacccggtggtgggaggatttagagcgcgattttccttgcccagtttgtcggaagacgtccagatacaggtcacttaggcctaaccgtcaactgggttccatggtagagatagcaaaacagctgcaggctgtgaagagaaagataagagacgagagcctctgcccccaacatcatgaggccctctccctcttttgctacgaggaccaggaagccgtgtgcctcatctgtgcgattagccacacgcaccgcgcgcatactgtggtgcccctagactag

SEQ ID NO: 209680 - DNA, 225 bp, Artificial Sequence
  Description of Artificial Sequence: Synthetic coding sequence
atggccgagaccagcctgctggaggccggcgccagcgccgccagcaccgctgctgccctagagaaccttcaggtggaggcctcatgcagtgtgtgtttggagtatctcaaggagccggtcattattgaatgtggccacaacttttgcaaggcttgtatcactcggtggtgggaggacttggagagagatttcccctgtcccgtgtgtcggaagacaagcagatag

SEQ ID NO: 209681 - DNA, 147 bp, Artificial Sequence
  Description of Artificial Sequence: Synthetic coding sequence
atggccgagaccagcctgctggaggccggcgccagcgccgccagcactgctgccgcgctggaaaatctgcaggttgaggcctcttgttccgtgtgtctggagtatctaaaggaaccggtcatcattgagtgcgggcacaacttttag

SEQ ID NO: 209682 - DNA, 1467 bp, Artificial Sequence
  Description of Artificial Sequence: Synthetic coding sequence
atggccgagaccagcctgctggaggccggcgccagcgccgccagcaccgccgccgcactggaaaacttgcaggtggaggccagttgcagcgtgtgcctggaatacctgaaggaaccagtaattattgagtgcgggcataacttctgcaaggcttgcatcaccaggtggtgggaagacctcgaacgtgattttccctgcccagtctgtcgcaaaacatctcggtatcgtagcttgagacctaatcgacagctcggcagcatggtggaaatagctaagcagcttcaggcagttaaaaggaaaattagagatgagtcattgtgtccacaacaccacgaggccttgtcgctgttttgttatgaggatcaagaagcggtatgcctcatttgcgccatttctcatacccatcgggcccatactgttgttcccctggacgacgctacgcaagagtacaaagaaaagctgcagaaatgtctcgagcctctcgagcaaaagcttcaggagataactaggtgtaagtccagcgaagagaagaagcccggggaactgaagagactggtggaatccaggcggcagcaaatacttcgagagttcgaagagctgcacagacgcctagatgaggagcagcaagtactattgtcacgccttgaggaagaggagcaagacattctgcagaggctgcgggagaatgctgcccacctgggcgacaagaggagagaccttgcccacctggcagctgaggtggaagggaagtgtttacagtctggctttgagatgcttaaggatgtcaagtctactctggaaaagtgtgaaaaggtcaagactatggaagtgacttccgtgtcaattgagctggagaagaattttagtaattttccccgccagtactttgccctcaggaaaatcctgaagcagttgattgccgatgttactttagaccccgagaccgcacatcccaatctagttcttagtgaagatcgcaaatctgtgaaatttgtggagacaagactccgggaccttcctgatacaccccgccggttcactttctatccatgcgtgctggccacagagggttttacttccgggaggcactactgggaagtcgaagtaggggataagacccattgggccgtgggggtgtgtagggacagcgtttctcgcaagggagagctaacgccactgcccgagactgggtattggcgggtgcggctgtggaacggtgacaaatatgccgccacgactacccccttcaccccgctccacataaaagtcaagccaaagcgggttggaatcttcttggattatgaagcagggacactgtctttctacaacgtgactgatcggagtcatatctacactttcacagatactttcactgagaagttgtggccactcttctacccagggattcgcgccgggaggaagaacgctgcaccacttaccataagacctcctaccgattgggagtag

SEQ ID NO: 209683 - DNA, 684 bp, Artificial Sequence
  Description of Artificial Sequence: Synthetic coding sequence
tgaaccagccggtaccggagcctgcggcccaaccggcagctgggctcaatggttgagatcgccaaacagctgcaggcagtgaaaaggaagatcagagacgagtcactttgtccccagcaccatgaggctctctcactgttttgctacgaggaccaagaagctgtttgcctgatttgtgcaatcagccacactcaccgggcccataccgtggttccattggatgacgcaacacaggaatataaggagaagcttcagaagtgtctcgaacccctggagcaaaagctgcaggagatcactcggtgtaagtcctccgaagagaagaagcctggggagctaaagcggctcgttgagtctaggaggcagcaaattctaagggagtttgaggagctacaccgacggctggatgaggaacagcaagttctactctctcggctggaggaggaggagcaagacatcttgcagagattgagagagaacgccgcacacctgggggacaaacgacgggaccttgcccatctggcagccgaagtggagggcaagtgcttgcagtcaggttttgagatgcttaaagatgtgaagtccacactggaaaagtgtgaaaaggttaagactatggaggtgacgtccaccacgccatgcacctcattacatagcgagatcaacgataatgtgaggggccgatag

SEQ ID NO: 209684 - DNA, 147 bp, Artificial Sequence
  Description of Artificial Sequence: Synthetic coding sequence
atggccgagaccagcctgctggaggccggcgccagcgccgccagcacagccgcggcactggaaaatctccaggtcgaggccagctgtagcgtgtgtctggagtacctgaaggagcctgtgattattgaatgcgggcacaacttttag

SEQ ID NO: 209685 - DNA, 147 bp, Artificial Sequence
  Description of Artificial Sequence: Synthetic coding sequence
atggccgagaccagcctgctggaggccggcgccagcgccgccagcacagccgccgcattggagaatttacaagtcgaagccagctgctccgtgtgtctggagtatctcaaggaacctgtgattatcgagtgtgggcataatttctag

SEQ ID NO: 209686 - DNA, 180 bp, Artificial Sequence
  Description of Artificial Sequence: Synthetic coding sequence
atggccgagaccagcctgctggaggccggcgccagcgccgccagcacagctgctgcgctggaaaacctgcaggtggaggcctcatgttccgtctgccttgaatatctcaaggaacccgttataatcgagtgcggccataacttctgtaaggcatgcatcactaggtggtgggaggattag

SEQ ID NO: 209687 - DNA, 180 bp, Artificial Sequence
  Description of Artificial Sequence: Synthetic coding sequence
atggccgagaccagcctgctggaggccggcgccagcgccgccagcacagccgcggcattagaaaacctgcaggttgaagcgagttgttctgtgtgcctggagtacttaaaagaacctgtcatcatcgagtgtggtcataacttttgtaaggcttgtattactcggtggtgggaggactag

SEQ ID NO: 209688 - DNA, 435 bp, Artificial Sequence
  Description of Artificial Sequence: Synthetic coding sequence
atggccgagaccagcctgctggaggccggcgccagcgccgccagcaccgccgccgcccttgaaaacctgcaggtggaggcgtcttgttcggtttgtttggaatatttaaaggagcctgtcattatcgaatgtggacacaatttttgtaaagcttgtattacgaggtggtgggaggacttggaacgcgatttcccctgtccagtctgccggaaaacttctcgatatagaagcctcagacctaataggcagttaggatctatggtggaaatagctaagcagttgcaggccgtgaaaaggaagatcagagatgagtcgctgtgtccacagcaccacgaggctctctctctcttttgttatgaagatcaggaagccgtttgtctgatctgcgcaatcagccacacacacagggctcacaccgtggtccctcttgactag

SEQ ID NO: 209689 - DNA, 1557 bp, Artificial Sequence
  Description of Artificial Sequence: Synthetic coding sequence
atggccgagaccagcctgctggaggccggcgccagcgccgccagcactgcggcagctttggagaatttgcaggtggaggcctcctgctccgtgtgtctggagtacctaaaggagcctgtgattattgaatgtgggcataacttttgtaaggcatgtataacgaggtggtgggaggacctggaacgtgatttcccatgtcccgtatgtcggaagacttcccgttaccggtccttaagacctaaccggcagctcggtagcatggtggagattgctaagcagttgcaggctgtcaaacgaaaaatcagagatgagtctttatgcccacagcaccacgaagcactgtcactattctgttacgaggaccaggaagcagtgtgcttaatttgtgctatttcgcacacacacagggctcataccgttgtgcctctcgatgatgctacccaggaatacaaagagaagcttcaaaagtgcctggaacctctggaacagaaactccaagagattactcgatgtaagtcaagtgaggagaagaagcccggtgagctcaaacgtctggtggaaagtcggcgccagcagatcctaagggaattcgaggagttgcacagacgcttagacgaggagcagcaggtgctcttaagcagactcgaggaggaggaacaggacattcttcagagactgcgcgagaatgctgcccatttgggtgataaacgccgggacctcgctcatctcgccgctgaggtggagggcaaatgtttacagtccgggttcgaaatgctgaaggatgtgaagtccaccttggagaaaaacataccgcggaaatttggaggcagtctgagtacgatttgccccagagaccataaggcacttttgggactggtgaaggagattaaccgttgtgaaaaagttaaaacgatggaggtcacttcggtatccattgaactggagaagaactttagtaattttcctcgccaatacttcgccttgcgaaagattctaaagcagcttatagctgacgtgactttagatccagaaaccgcccatccaaatctggtgctctccgaggatagaaagagcgtgaaattcgtagagacaagactgagagatctgcctgatactccacgccgattcactttttatccttgcgtgttagccactgaagggttcaccagcgggcgccattattgggaagtcgaggtgggcgataagactcattgggctgtgggggtgtgtagagattcggtgagtcggaagggagagttaacccctttgcccgagactgggtattggcgcgttaggctctggaacggagacaagtacgcggccaccaccacacctttcacccccctgcacatcaaagtgaagcccaagcgcgtagggatctttctggactacgaagctggcaccttgagtttctataacgtcacagacaggtcacacatttacacattcaccgatacgttcactgaaaaactgtggcctcttttctaccctggcatacgggccggacgcaaaaacgcagctccccttaccatccggcctccgaccgactgggagtag

SEQ ID NO: 209690 - DNA, 684 bp, Artificial Sequence
  Description of Artificial Sequence: Synthetic coding sequence
tgaaccagccggtaccggagcctgcggcccaaccggcagctgggctccatggtagaaatcgcaaaacaactgcaggcggtcaagcggaaaataagggacgagtctttgtgcccccagcaccacgaggcattaagtctgttttgctatgaggatcaggaggccgtctgcctgatttgcgccatcagccacacccaccgcgctcacacagtggtgcccctggacgacgccacccaggaatacaaggagaagctccaaaaatgtttggagcctttagagcagaaactgcaggagataacaagatgtaagtccagtgaagagaagaaaccaggcgagttaaagaggctcgtggaaagcaggagacagcaaattctacgggaattcgaagaacttcacagacgactggacgaagagcagcaagtgctgctgagccgtttagaggaagaagagcaggatatcctgcagcgtcttagagaaaatgcggcacatctgggtgataagcgccgtgatttagcccatctggccgccgaagtcgagggaaagtgtctgcagtccggattcgaaatgctgaaggatgtgaaaagtaccctggagaaatgcgaaaaagtgaagactatggaagtcacgtccactacaccatgtacctcactgcactcagagatcaatgacaacgtacggggaagatag

SEQ ID NO: 209691 - DNA, 684 bp, Artificial Sequence
  Description of Artificial Sequence: Synthetic coding sequence
tgaaccagccggtaccggagcctgcggcccaaccggcagctgggctctatggtggaaatagcgaagcaactacaagctgtcaagagaaaaatcagagatgagagcctatgccctcagcaccacgaagccctgagccttttctgctatgaagaccaggaagctgtctgcctgatatgcgccatatcccatacacacagagctcacaccgttgtcccgctggatgacgccactcaagaatacaaagagaagctgcaaaagtgtttggagccccttgagcagaagcttcaggagattacacgatgcaaaagctctgaggagaaaaagcccggagaactcaaacgcctggtggaaagccgaagacagcagatactgagggagttcgaggagctgcaccggcgactggatgaggagcagcaagtgcttctaagccggttggaggaagaagaacaggatattctacagagactcagggagaatgccgctcacttgggggacaagagacgcgatctggctcatcttgccgcggaggtcgagggaaaatgtctgcagtctggcttcgaaatgctgaaagatgtcaaaagtaccctcgagaaatgtgagaaggtaaaaacaatggaggtcacaagcaccactccctgcacgtcattgcatagcgagattaacgacaacgtgcgcggtcggtag

SEQ ID NO: 209692 - DNA, 147 bp, Artificial Sequence
  Description of Artificial Sequence: Synthetic coding sequence
atggccgagaccagcctgctggaggccggcgccagcgccgccagcactgccgccgccctcgagaatttacaggtggaggctagttgctccgtctgtctcgaatatctgaaagagcctgtcatcatcgagtgtggccataacttctag

SEQ ID NO: 209693 - DNA, 1557 bp, Artificial Sequence
  Description of Artificial Sequence: Synthetic coding sequence
atggccgagaccagcctgctggaggccggcgccagcgccgccagcactgcagcagcattagagaatttgcaggtggaggcttcatgcagcgtttgcctggagtacctgaaggaacccgttattattgagtgcggccacaatttttgcaaggcctgcatcacgcgctggtgggaagatctcgagcgggactttccttgccccgtgtgcaggaagacttccaggtatagaagcctcaggccaaacagacagttgggctcaatggtggagatcgctaaacaactgcaggccgtaaaaaggaagatccgcgacgagtccctctgcccccaacaccacgaggccctctctctgttttgctacgaggaccaggaggccgtgtgcctaatctgcgccatcagtcacacccatagagcccataccgtcgtcccccttgatgatgctactcaagaatacaaggagaagctccaaaagtgtctggaacctctggagcagaagttgcaggagattacgcggtgcaagtctagtgaggagaagaagccgggagaactgaagaggcttgtagagagtagaaggcaacagatcctgagggaattcgaagagctgcaccgaaggctcgacgaggaacagcaggtgctcttaagccgtctcgaggaggaggagcaagacatactacaacgtctcagagagaacgcagcgcacctgggtgataagaggagagacctcgcccaccttgctgccgaagtggaaggcaaatgtctgcaaagcggattcgaaatgctgaaagacgttaaatccactcttgagaaaaacattcctcggaagttcggtgggagcctcagcacgatctgtccacgggaccacaaggccctcttgggactagtcaaagagattaatcgttgtgagaaggtgaagaccatggaggttacaagtgtgagcatcgagcttgagaaaaatttcagcaattttccacggcaatatttcgcactccgcaaaatcttgaagcagctaatcgcagatgtcacccttgatcccgagacggcccacccaaatcttgtcttgtcggaggatcgtaaaagtgtaaaatttgttgagacaaggctgcgggatcttccagacacccccaggcggttcactttttacccgtgcgttcttgcgacagagggattcactagcggacgacattattgggaagtcgaggtgggagacaagacccattgggcagtaggggtgtgccgcgattcagtatcacggaagggcgagctcaccccattgcctgagacaggctactggcgggtacgactttggaacggagacaaatatgccgcgaccaccaccccttttactcccctgcatatcaaagtgaagcccaagcgtgtgggaatttttcttgattacgaagcaggcaccctgagcttttataacgtaactgaccggtctcatatttacactttcacggatacttttactgagaaattgtggccactgttctaccccggaattcgagccggacggaagaacgctgcccccctcactatacgaccccccactgactgggaatag

SEQ ID NO: 209694 - DNA, 225 bp, Artificial Sequence
  Description of Artificial Sequence: Synthetic coding sequence
atggccgagaccagcctgctggaggccggcgccagcgccgccagcaccgccgccgccctcgaaaacctacaggtggaggcctcatgttcggtctgtctggagtaccttaaagaaccagtgattatcgaatgtggacataacttttgtaaggcctgtattaccagatggtgggaagacttggagagggatttcccctgcccggtctgccgcaagaccagccggtag

SEQ ID NO: 209695 - DNA, 180 bp, Artificial Sequence
  Description of Artificial Sequence: Synthetic coding sequence
atggccgagaccagcctgctggaggccggcgccagcgccgccagcacagccgctgcattagagaatctccaggtggaggccagctgttcagtttgcctggagtacctaaaagagcccgtcattatcgagtgcggccacaacttctgtaaagcgtgtattacccgctggtgggaggattag

SEQ ID NO: 209696 - DNA, 147 bp, Artificial Sequence
  Description of Artificial Sequence: Synthetic coding sequence
atggccgagaccagcctgctggaggccggcgccagcgccgccagcaccgctgctgcacttgaaaacctgcaggtggaggcttcgtgttccgtgtgccttgagtacttgaaggagccagtcatcatagagtgcggccataacttctag

SEQ ID NO: 209697 - DNA, 786 bp, Artificial Sequence
  Description of Artificial Sequence: Synthetic coding sequence
atggccgagaccagcctgctggaggccggcgccagcgccgccagcacagcggcagccctggaaaatctgcaagtggaggccagttgcagcgtatgcctggagtatcttaaagagccggtaattatcgaatgcggacataatttttgtaaggcatgcattacacgctggtgggaggatctagagcgagatttcccatgtcccgtatgccgtaagactagcaggtatcggtctttacggcccaatcggcaactcggctccatggtggagatcgccaaacagctacaagcagtgaaacgcaaaatccgggacgaatccctgtgcccccaacaccatgaggccctcagtctgttctgttacgaagaccaggaagcggtctgccttatctgtgcaatctctcacacacatagagcgcatacagttgtgcccctggacgacgccacccaagaatacaaggaaaaactgcaaaagtgcctggagccgctggagcagaagcttcaggagattacccgatgcaagagctcagaagagaagaaacctggagagctgaaaaggcttgtggaatctagaaggcaacagatacttcgggagtttgaggagttgcaccgcaggctggacgaggagcagcaggttctgctcagtaggttagaagaggaggaacaggatattcttcagcgcctgcgggaaaacgccgctcatctgggtgataagagaagggatctcgctcacttggctgctgaagtcgaaggtaagtgtctgcagagcggcttcgaaatgctcaaagtttag

SEQ ID NO: 209698 - DNA, 180 bp, Artificial Sequence
  Description of Artificial Sequence: Synthetic coding sequence
atggccgagaccagcctgctggaggccggcgccagcgccgccagcaccgctgctgccctggaaaatctgcaggtggaggccagttgctccgtctgtctagaatatcttaaagagcccgtcatcattgagtgtggtcataatttctgcaaggcgtgcattacacgatggtgggaggactag

SEQ ID NO: 209699 - DNA, 435 bp, Artificial Sequence
  Description of Artificial Sequence: Synthetic coding sequence
atggccgagaccagcctgctggaggccggcgccagcgccgccagcaccgccgctgcgctagagaatctacaagtcgaggccagttgcagtgtctgtcttgaatacctcaaggagcctgtcattatcgaatgcggccataacttttgtaaagcatgcattaccagatggtgggaagatctggaacgcgattttccctgtcccgtgtgcaggaagacctctcggtatcggtcactgcgcccaaataggcagcttgggagcatggtggaaatcgccaagcagctgcaagcagtgaagagaaagatcagagatgagtctctgtgcccccagcaccacgaggctttgagtcttttctgctacgaggaccaggaggcagtgtgcctgatctgtgcaatctctcacacacacagggctcacaccgtggtcccactcgattag

SEQ ID NO: 209700 - DNA, 1467 bp, Artificial Sequence
  Description of Artificial Sequence: Synthetic coding sequence
atggccgagaccagcctgctggaggccggcgccagcgccgccagcacagcggccgcattagagaatctccaggttgaggcctcttgtagcgtgtgtctcgaatacctgaaagaacccgttattatcgaatgtggacacaatttctgcaaggcttgcatcactcggtggtgggaggatctggagagagatttcccatgtccggtctgccgcaagacttccaggtacagaagtctcagaccaaacagacaattgggttcgatggtggagatagccaagcagttgcaggcagtgaagcgcaagattcgcgatgaaagcctgtgccctcagcaccatgaggcactgagtctcttctgttatgaggaccaggaggcggtatgtctgatatgtgccatttctcatacccaccgcgcccatactgtagtgccgctggatgatgccacgcaagagtacaaggaaaagctacagaagtgcctggaaccgctggagcagaagcttcaagaaataactcggtgcaaatcttctgaggaaaagaagcctggggaattgaagagattagtcgaaagccgaagacagcaaattctgcgggagtttgaggaactacatcggagattggatgaggagcagcaagttttgctctcccgtctcgaggaagaggaacaggatatcctccagaggctgcgggaaaatgcagcacacttgggcgataagaggagagatctcgcacacttggctgctgaggtcgaggggaaatgtctgcaatcaggttttgagatgctgaaggacgtgaagtctaccctggaaaaatgcgagaaagttaagaccatggaggtgaccagcgtttctattgaactggagaaaaatttctcgaattttccgagacaatattttgcactgcgcaagatcctcaagcagctgattgcagacgtcactctggatccggaaacagctcatcccaacctcgtgctcagcgaagatcgaaagtccgtcaagtttgtggagacgcgactgcgagacctaccagatactcctcgcaggtttactttttacccatgtgttcttgctactgaaggcttcactagcggtagacactattgggaagtggaggtgggcgacaaaacccactgggcagtgggagtctgcagggacagtgtgtcccgcaagggggaactgactcccctccccgagacagggtattggcgagtgagattgtggaacggcgacaaatacgccgccactaccacacccttcacccccttgcacataaaggttaaaccgaagcgggttgggatatttttggattacgaagctggtacacttagcttctataatgtgaccgaccgcagtcacatctacacgtttacggacaccttcaccgaaaaactctggcccctgttttaccctggtattcgggccgggaggaaaaatgctgcccctctgactattagaccccccaccgattgggagtag

SEQ ID NO: 209701 - DNA, 1467 bp, Artificial Sequence
  Description of Artificial Sequence: Synthetic coding sequence
atggccgagaccagcctgctggaggccggcgccagcgccgccagcacagccgccgccctggagaacttacaagtcgaggcttcatgttcagtgtgtctggaatacctgaaagaacctgttattattgaatgtggtcacaatttttgcaaggcatgcatcacaagatggtgggaagacctggaaagagacttcccatgtccggtctgcaggaagactagcaggtacaggtccctgcgtcctaaccgccagctgggcagcatggtggaaattgccaaacagctgcaagctgtcaaaagaaagatccgcgacgagtctctctgcccacagcaccacgaagcattgtccctcttctgctatgaggatcaggaagccgtgtgcctcatatgcgccattagccacactcatagagcccacaccgttgtgccactcgatgatgctactcaagagtacaaggagaagcttcaaaagtgcctggaaccactggagcagaagctccaggaaattactcggtgcaagtcgtccgaggagaaaaagcctggggaactcaagcgactcgtggaatcacgccgccagcagattctgagggagttcgaggagctgcatcgccgattggatgaagagcagcaggttctgctctctaggctggaggaagaagagcaggacatcttgcagcgcctgagggagaacgccgctcacctgggcgacaagcgtcgggacctcgcccacctggcagcagaggtggaagggaagtgcttgcagtccggattcgaaatgctcaaggatgtgaaaagtacacttgaaaaatgtgagaaggtaaagactatggaggtcacctccgtatccattgagttggagaaaaacttctcaaattttcctcgccagtactttgcactgaggaaaatcctgaaacaacttattgccgatgtgacgttggatccagagacagcccacccaaatcttgtcctgtcagaagacagaaagagtgttaagttcgtcgagaccagactgcgggatttgcctgacactccacggaggttcacattttatccatgcgtacttgccacagaggggtttactagcggtcgtcactattgggaagtagaagtgggggataagacgcactgggcagtcggtgtgtgcagggattctgtctcccggaaaggtgagttgacacctttaccagagacaggttattggagggtccggctgtggaatggtgacaaatacgcggctacaaccactccttttacaccgctccatattaaggtgaagccaaaaagggtcggcatctttttagactatgaggcaggtacgctttctttctacaacgtgacggaccgatcccacatttatacattcactgacacattcacagagaaactgtggccactgttctatccaggaatccgggctggaaggaagaatgctgctccacttactattaggcctcctacagactgggagtag

SEQ ID NO: 209702 - DNA, 786 bp, Artificial Sequence
  Description of Artificial Sequence: Synthetic coding sequence
atggccgagaccagcctgctggaggccggcgccagcgccgccagcacagccgcagctctcgagaacctgcaggtagaggcctcttgtagcgtgtgcctcgaatacctgaaagaacctgtaataatcgagtgtgggcataatttctgcaaagcctgcatcaccaggtggtgggaagatctggaaagagatttcccctgtcctgtgtgtcggaagacttcaagataccgctccctacggccaaacaggcagctgggaagtatggtggaaatcgccaaacagttacaggccgtgaagaggaaaatcagggatgaaagtctctgcccgcaacaccacgaagctctatctctgttctgctatgaagaccaggaggccgtatgtctgatctgcgcaatctcccatactcacagggcccacacggtcgttcccctagacgatgcgacccaagagtacaaagagaagctgcagaagtgcctggagccattggaacaaaagttgcaagaaattactcgttgtaagtcctcagaggagaagaaacccggcgaactgaaaaggctggtcgagtctagaaggcagcagattctcagggagtttgaggagctgcaccggaggttggacgaagagcagcaggttttgctgagccgcttagaggaggaggagcaggatattctacagcgacttcgggagaacgcagctcatttgggcgataagagaagagatctagcgcacttagccgcggaagtcgaaggcaagtgtctgcagagcggctttgaaatgttgaaggtttag

SEQ ID NO: 209703 - DNA, 1467 bp, Artificial Sequence
  Description of Artificial Sequence: Synthetic coding sequence
atggccgagaccagcctgctggaggccggcgccagcgccgccagcacagcagcagcactcgaaaacttgcaggttgaagccagctgctcagtgtgtttggagtacctgaaggagccagtcataattgagtgtggacataatttttgcaaggcgtgtattactcggtggtgggaagacttagaacgggatttcccttgtccagtgtgtcggaaaacttctcgctatcgctcattaaggcccaacagacagttggggtcaatggttgaaatcgccaagcagctgcaggcagtcaagcgcaaaattagagacgaatccctctgtccccagcatcatgaggctttaagcctcttctgctatgaggatcaagaagctgtttgccttatttgcgcaattagccatacccaccgagcccacactgtcgttccactagacgacgccacacaggagtataaagaaaagcttcagaaatgcctggagccactggagcagaagttacaggagatcacacgatgcaagtcgagcgaagagaaaaagccgggagagcttaagcggctcgtggagtcaagacgccagcagattctgcgggagtttgaggaactacaccggaggctcgacgaggaacagcaggttctactttctcgccttgaggaggaggaacaggacattttacagcgcttacgggagaacgcagctcaccttggcgacaaacgcagagatctggcccacctggctgctgaggtcgagggtaaatgtttacagtccgggtttgagatgcttaaggacgtgaaatctacacttgagaagtgtgagaaggtcaagactatggaggtgacctctgtctcaatcgagctggaaaagaacttctcgaactttccccgacagtactttgcacttagaaagatcctgaaacagctcattgcagacgtcaccctcgacccagagaccgcccatcctaacctggtgctcagcgaggaccgcaagtccgtgaaatttgtggaaacacgattgcgcgacctgcctgatacaccaagaagatttacgttctatccgtgcgtgctcgcgactgagggtttcacttcaggccgacattactgggaggtcgaggtcggagacaagacacactgggctgtaggcgtttgcagggactccgtcagtcgaaaaggcgaactcactcccctgcccgaaacaggttactggcgggtacggctgtggaacggtgacaaatatgctgctactactactccgtttactccactccacattaaagttaagccaaagcgggtcgggatcttcctcgactatgaggccggaacgctttccttttacaacgttactgacagatcccatatctacacatttacagatactttcactgaaaagctgtggcctctgttctatccagggattagagctggaaggaaaaatgcggccccactcaccatccggccccctaccgactgggagtag

SEQ ID NO: 209704 - DNA, 180 bp, Artificial Sequence
  Description of Artificial Sequence: Synthetic coding sequence
atggccgagaccagcctgctggaggccggcgccagcgccgccagcacagccgccgcactggaaaatctgcaggtggaggcttcatgttccgtctgcctggaatatcttaaggagcccgtgatcatagagtgtgggcacaacttctgcaaagcctgtattacaagatggtgggaggactag

SEQ ID NO: 209705 - DNA, 180 bp, Artificial Sequence
  Description of Artificial Sequence: Synthetic coding sequence
atggccgagaccagcctgctggaggccggcgccagcgccgccagcactgcagctgccctggagaatttacaagtggaggctagctgctccgtgtgcctggagtacctgaaagagcccgtaatcattgagtgtgggcacaatttttgtaaagcctgtatcacacgttggtgggaggattag

SEQ ID NO: 209706 - DNA, 684 bp, Artificial Sequence
  Description of Artificial Sequence: Synthetic coding sequence
tgaaccagccggtaccggagcctgcggcccaaccggcagctgggctctatggtggagatagccaagcagctccaagccgttaaacgcaagattagggacgagagcttgtgtccgcaacaccacgaggccctttcactgttttgctacgaggaccaggaagccgtgtgcttaatctgtgccatcagccatacgcacagagctcacacagttgtgcccctcgatgacgctacccaggagtataaagagaaattgcaaaaatgtctggagcccttggagcagaaactgcaggagattacccgatgtaaaagtagcgaagagaagaaacccggcgagctgaaacgactagtcgaatctcgcagacaacagatattgcgtgagttcgaggagctgcacaggcggcttgacgaggaacagcaggtgctgctgtcccgtctggaagaggaagagcaagacattctgcagcgccttagggagaacgcagctcatctcggagacaagcgcagggatctggcccatctcgccgctgaggtggaggggaaatgcctgcagtcggggtttgagatgctcaaggatgtgaagagcaccctcgagaagtgcgagaaggtcaaaaccatggaggtcacttcaacaaccccgtgtacaagcctccatagcgagattaatgacaatgttcggggcagatag

SEQ ID NO: 209707 - DNA, 1467 bp, Artificial Sequence
  Description of Artificial Sequence: Synthetic coding sequence
atggccgagaccagcctgctggaggccggcgccagcgccgccagcacagccgcagccctcgaaaacctacaggtagaggcaagctgttccgtgtgcctcgagtacctgaaggaacccgtgatcattgaatgtggtcataacttctgtaaagcgtgtataacccgttggtgggaggatcttgagagagacttcccgtgccctgtctgtcgaaaaactagtaggtacaggtcactcagacctaatcgccagctgggaagtatggtggaaattgctaagcaacttcaggccgtgaagcgcaagattagagatgagtctctgtgtcctcagcaccacgaagccctcagtctgttctgctacgaggatcaggaagccgtgtgccttatctgcgccatctcccatacccacagggcacataccgtggtacccttggacgacgcgacgcaagaatacaaggagaagctgcagaaatgcctcgaaccactcgaacagaagctccaggaaattaccagatgtaagagcagcgaggaaaagaaacctggagaactgaaacggctcgtggagagcagacggcaacagatcctgcgggaatttgaggaacttcacaggcggttggatgaggagcaacaggttctgttatcccggctcgaggaggaggaacaggacatactgcagcgcctacgcgagaatgctgcacacctcggggacaagagacgggatctcgctcacctggccgccgaagtggagggaaaatgcctacagagtggatttgaaatgttgaaggatgtaaaatccacccttgaaaagtgtgagaaggttaaaactatggaggttacaagcgtgtcgatcgagctagaaaaaaatttcagtaatttcccccggcaatattttgccttaagaaagatcctgaaacagcttatagcagacgtgactctcgatcccgagacagcccacccgaatcttgtgttaagtgaggaccgcaaatccgttaaattcgtggagactcgcctcagggatctgccggacaccccccgcaggttcacattctacccttgcgtgttggcaacagagggcttcacgtctggccgccattactgggaggtcgaggtgggggacaagactcattgggctgtcggtgtgtgtcgcgacagcgttagccgtaagggcgagttgacacccttgcccgagacggggtactggcgggtccgcttatggaacggtgataaatatgccgctactacgactcccttcactccactgcacatcaaagtgaaaccaaaaagggtggggatcttcttggactatgaagccggcacattatccttctataatgttaccgacagatcccatatttatacgttcactgacactttcaccgagaagctgtggcctttgttctaccctggaatccgggctggcagaaagaacgccgccccactgacaatacggccccccacggattgggagtag

SEQ ID NO: 209708 - DNA, 225 bp, Artificial Sequence
  Description of Artificial Sequence: Synthetic coding sequence
atggccgagaccagcctgctggaggccggcgccagcgccgccagcactgctgctgcattggaaaacttacaggttgaggctagctgctcagtatgcttggagtatctgaaggagccggtgatcatagagtgcggtcataacttctgtaaagcctgtattacacgatggtgggaagacctagaaagggatttcccgtgccccgtgtgtaggaagacatcccgctag

SEQ ID NO: 209709 - DNA, 684 bp, Artificial Sequence
  Description of Artificial Sequence: Synthetic coding sequence
tgaaccagccggtaccggagcctgcggcccaaccggcagctgggcagtatggtggagattgctaagcagctacaggctgtaaagaggaagatcagggacgagagcttgtgtccgcaacaccacgaggcactttcgctgttttgttacgaagatcaggaagctgtgtgtcttatatgtgctatttcccatacccacagagcccacactgttgtgccgttggacgacgccacacaagagtacaaagagaaattacagaagtgcctggaaccccttgaacagaagctgcaggagatcaccaggtgcaaaagcagcgaggaaaaaaagccaggagagctgaagcggctcgtggagagcagacgccagcagattctcagggagttcgaggagctccacaggaggctggatgaggaacagcaggtgctccttagccggttggaggaggaagagcaagatatcctgcagagattgagagagaatgccgctcatttgggagacaaacgtagggatctcgcacatttggcagctgaagtagagggcaagtgcttgcagagcggtttcgagatgctcaaagatgtgaagagcaccctcgagaagtgcgaaaaagtcaagactatggaagtgacatccactaccccctgcacttcgctccacagtgagattaatgacaatgtccgcggtagatag

SEQ ID NO: 209710 - DNA, 1467 bp, Artificial Sequence
  Description of Artificial Sequence: Synthetic coding sequence
atggccgagaccagcctgctggaggccggcgccagcgccgccagcacggcggctgccctggaaaacctgcaggtagaggctagctgttctgtgtgtttggaatacctcaaagagccagtcattattgagtgtggacataatttctgcaaggcatgtatcactaggtggtgggaggacctggaacgcgacttcccttgtccagtgtgcagaaaaacctctagatatagaagtcttagaccaaaccggcagctgggcagcatggtagagatcgccaagcagctccaggctgtgaagagaaagatcagggatgagagtttatgtccccaacatcatgaagcattgtccctgttctgctacgaagatcaggaggctgtgtgccttatttgcgctatctctcacacccacagagcgcatactgtggtgcccctggatgacgcaacccaggagtacaaagaaaaactccagaaatgtctggaaccactcgaacaaaaactccaggagataacaagatgtaaaagttccgaagagaagaagcccggcgaattaaagcgtttggtggaaagcaggcgtcagcagatcttacgtgagtttgaggaattacacagaaggttggacgaagaacaacaggttttgctctctcgcctggaggaagaagagcaagatatcctccagaggctccgagagaacgcggcccacctgggggataagaggagggacctggcccacctggcagctgaagtcgagggcaagtgcttacagtctgggtttgaaatgctgaaggacgtcaagagcactctcgaaaagtgcgaaaaggtcaaaacaatggaagttacctctgtgtccattgaactcgaaaaaaatttctcgaattttcctaggcagtattttgcacttagaaaaatcttgaagcaactgatagccgacgtcaccctggatcctgaaaccgctcatccaaaccttgtgctttctgaggatcggaaaagcgtgaaatttgttgagacccggctgcgggaccttccagacacccccaggcgcttcactttttatccatgcgtgctggcaactgagggcttcacaagcggacggcattactgggaggtagaagtcggcgataagacccattgggctgtcggcgtgtgtagggattcagtgtcccggaagggggaactgactccacttcctgagaccggttattggagagtccggctctggaatggcgacaagtacgctgccactaccaccccattcaccccattgcacattaaggtgaagcctaagcgggttggcatctttctcgattatgaggcaggaaccctctccttctacaacgtcaccgacagaagtcatatctacacgttcacagatactttcacggaaaagctctggcccctgttctacccgggcatcagggctgggagaaaaaacgcagctccactcactatccggcctcccaccgattgggagtag

SEQ ID NO: 209711 - DNA, 1467 bp, Artificial Sequence
  Description of Artificial Sequence: Synthetic coding sequence
atggccgagaccagcctgctggaggccggcgccagcgccgccagcacagccgccgccttggagaacttgcaagtggaggcgtcgtgcagcgtgtgtctcgaatatctgaaagagccggtgatcatcgagtgcggtcacaatttctgtaaggcgtgcatcactcggtggtgggaggatctggagcgggatttcccctgtcccgtgtgtcgtaaaacctccagatacaggtcacttaggcctaaccgccagctgggctcgatggtggagatcgcaaagcagcttcaggctgtcaagagaaaaattagagacgagtccctgtgtcctcagcatcacgaagccctgtccctcttctgttacgaggaccaggaggccgtttgtctgatttgtgccatatcccacacccatagagctcacaccgtggtgcctttagatgacgccacacaggagtataaggaaaaactgcagaaatgtctggagcccctggaacagaagctgcaggaaatcacaagatgtaaatcgtcagaggaaaagaagcccggcgagctgaagcggctcgtcgagtcaaggcgacagcagattctgcgggagtttgaggaactccaccgaagactggacgaggaacaacaggttctgctgtccagactcgaagaggaggagcaggacatacttcagagattacgcgagaatgctgcccaccttggggacaagcgcagggacctcgcccacctggccgccgaggttgagggcaagtgtctgcagagcggctttgaaatgcttaaggatgtcaagtctacactggaaaagtgtgaaaaggtgaagacaatggaagttacttcagttagcattgaactcgagaagaactttagcaatttccctcgtcaatacttcgcacttagaaaaattttaaaacagttaatcgccgacgttacattggaccctgagactgcccatcctaatctcgtgctctccgaggatcgaaaatcagttaaattcgtcgagacacggctgagagacctcccggatactcctcgaagattcactttctacccatgcgttcttgccacagaaggcttcacatcaggaagacactattgggaggtcgaggtaggggataaaacccactgggctgtgggggtatgcagggattctgtatcacgcaagggcgagctcacccccttgcccgagacaggatattggcgggtgcggttgtggaacggtgataagtatgccgcgactaccacaccgtttactcctctacacataaaagtgaagccgaagagggtcggaattttcttagattacgaggcgggaacactctctttttataatgtgactgatcgaagtcatatatacacatttacagatacttttactgagaaactgtggccccttttctatccaggaattcgggccggacgaaagaacgctgcaccacttacaatcagaccccctacagattgggaatag

SEQ ID NO: 209712 - DNA, 786 bp, Artificial Sequence
  Description of Artificial Sequence: Synthetic coding sequence
atggccgagaccagcctgctggaggccggcgccagcgccgccagcacggcagctgccctggaaaaccttcaggttgaggcctcctgcagcgtctgcctggagtatctcaaggaaccagtaataatcgaatgcggccataacttttgtaaagcatgcattactcgttggtgggaggatcttgagcgggactttccttgcccagtttgcaggaagaccagccgatatcggtctctccggcctaatcgccaattaggatcgatggttgagatcgccaagcagctgcaggcagtcaagagaaaaatccgtgatgagtctctgtgtccacagcatcacgaggccctctcgctcttttgttatgaagaccaggaggccgtgtgtctgatctgtgctatttcacacacgcaccgagcacatactgttgtcccactcgacgatgcaacccaggagtacaaagaaaagttgcagaagtgtttggagccgcttgaacaaaaactgcaggagataacccgctgtaagtcctcagaggagaagaaaccgggggagctgaagagactcgtggagtcgcgccgtcagcaaattcttcgagaatttgaggagctgcataggcgacttgacgaagagcagcaagtgctgttgtctcgactggaggaagaggaacaggacattttacagcgcctccgcgagaacgccgctcacttaggcgacaagaggagggacctggcccatctggccgcagaggtcgaaggcaaatgcctgcagtccggtttcgagatgctgaaggtgtag

SEQ ID NO: 209713 - DNA, 225 bp, Artificial Sequence
  Description of Artificial Sequence: Synthetic coding sequence
atggccgagaccagcctgctggaggccggcgccagcgccgccagcactgcagctgccctagagaatctgcaggttgaggcttcctgcagcgtatgtctcgaatatctcaaggaacctgtaatcattgagtgtggccataacttttgtaaggcctgtattaccaggtggtgggaggatctagaaagggatttcccgtgccccgtgtgcagaaagacctctcgatag

SEQ ID NO: 209714 - DNA, 180 bp, Artificial Sequence
  Description of Artificial Sequence: Synthetic coding sequence
atggccgagaccagcctgctggaggccggcgccagcgccgccagcactgccgctgcactcgagaacctacaagtggaggcaagctgctccgtctgtctcgagtacctgaaggagccagtcattatcgagtgtggtcataacttttgcaaggcctgtattacccgatggtgggaggactag

SEQ ID NO: 209715 - DNA, 786 bp, Artificial Sequence
  Description of Artificial Sequence: Synthetic coding sequence
atggccgagaccagcctgctggaggccggcgccagcgccgccagcactgccgccgcccttgagaacctgcaggtggaagcctcttgctcagtttgccttgagtacctgaaggagccagtcattatcgagtgcggtcataatttctgcaaggcttgcattacacgctggtgggaagatctggaaagggacttcccatgtcctgtgtgcagaaaaacctcccggtacagatcccttcgcccgaatcgccagctgggaagtatggtggaaatcgcaaagcagttacaggctgtcaaaagaaagatccgagatgagtctctgtgtccacaacaccatgaagccctgagtctgttctgctacgaggatcaagaggctgtttgtctgatttgcgccatctcccacacacatagggcacacacagtggtgccactcgacgacgcaacccaggaatacaaagagaaacttcagaagtgtctggaacctctggagcaaaagctccaggagattacccggtgtaaaagctccgaagagaaaaagccaggagaactgaagagactggtggaatctcgccggcagcagatcctgcgcgagttcgaagaactacataggcgtttggacgaagaacagcaggtgctcctttcaagacttgaggaagaagaacaggacatcctccagaggctgcgggagaatgcagctcacctgggtgacaagcggcgggatctggcccacctggctgcggaagtggaggggaagtgtctgcagagtggcttcgagatgttgaaagtctag

SEQ ID NO: 209716 - DNA, 1467 bp, Artificial Sequence
  Description of Artificial Sequence: Synthetic coding sequence
atggccgagaccagcctgctggaggccggcgccagcgccgccagcaccgccgctgctttggagaacctgcaggtcgaggccagttgttcagtgtgcctggagtacctgaaagaacccgtgatcattgagtgcggacataacttttgtaaggcctgcattacccgctggtgggaagatctggagagagatttcccttgccctgtatgtcggaagactagccggtacagaagcctgcggccaaatagacagctggggtcgatggttgagattgcaaaacagttgcaggctgtcaaaagaaagatcagagacgaatcactgtgcccacagcatcatgaagctctgagcttgttttgctacgaagatcaagaagccgtttgtctgatctgcgccatcagtcacacccacagggctcatacagtggtacccctggacgatgccactcaagaatacaaggagaaactacagaagtgcctcgaacctctcgagcagaagctacaagaaatcacccgatgcaagtctagcgaggagaaaaaaccaggggagctgaagcggctggttgagtcacggaggcagcagattctgagagaattcgaggaactccaccgacgcttagacgaagagcagcaggtcctcctgtctagactcgaggaggaagaacaggacattctccagaggcttcgcgagaacgctgcccatttgggcgataagcgccgcgacctagcccatctggccgccgaagttgagggcaaatgccttcaatctggtttcgaaatgctcaaggatgtcaagagcactttggagaaatgtgagaaggttaagactatggaagttacctctgtcagcatcgagctggagaagaattttagcaatttcccgaggcaatacttcgccctgcgcaaaatattgaaacagctcattgccgacgtgactttagaccccgagaccgcccaccctaacctcgtactatcagaagacagaaagtccgtgaagtttgtggaaactcggctcagagatttgcccgatacaccaaggagattcacattttacccttgtgtgctggcaacagaaggctttacctcgggcaggcactattgggaagtggaagtcggggataagacacattgggccgtgggcgtctgccgcgattccgtgagtcgcaagggagaattgacaccattgcctgagaccggatactggagagtgcgtctgtggaacggcgacaaatacgccgcaactaccacaccatttacgccccttcacatcaaagtgaaacctaaacgggttggtattttcctggactacgaagccggaacactctccttttataacgtgacagacaggagccacatttacacctttactgatacatttacagagaagttgtggcctctcttctaccctgggatcagggcggggcgcaaaaatgctgcaccactgaccattcggccccccaccgactgggagtag

SEQ ID NO: 209717 - DNA, 1557 bp, Artificial Sequence
  Description of Artificial Sequence: Synthetic coding sequence
atggccgagaccagcctgctggaggccggcgccagcgccgccagcaccgccgccgcgctcgaaaacctgcaggtggaagccagctgttccgtgtgtctggagtatttaaaagagcctgttattattgagtgtggacataatttttgcaaggcctgcatcactcgatggtgggaggacctcgaaagggacttcccttgtccagtctgccgaaagaccagccgatatcgcagcctccgcccaaataggcagttaggatccatggtggagatcgcaaaacagctccaggccgttaaacgcaaaatacgggacgaaagtctctgccctcaacaccacgaggcactgagcctgttttgctatgaagaccaggaagcagtgtgtctcatctgtgccattagccatacacaccgcgcccataccgtggtgcccctggatgacgccactcaagagtacaaggagaaacttcaaaagtgtttagagcctctggagcaaaagctgcaggagataacgaggtgtaagagcagtgaggagaagaagccaggagagctcaagcggctggttgaatcgcggcgccagcagatcttgcgagaattcgaggagctgcatcgcaggcttgacgaggagcaacaggtcttactttcccggcttgaagaagaggaacaggacattctgcaacgcctgagagaaaatgctgcccatctgggcgataagaggagagatcttgcccatcttgccgccgaggtagagggcaagtgcttgcagtcagggtttgagatgctcaaagatgttaagtccactttagaaaaaaacattcctagaaagtttggagggagcttatcgaccatttgccctcgcgatcacaaggcgttgctggggttagttaaggagatcaacaggtgtgagaaggtgaagactatggaggtaacaagcgtctctattgaactggaaaagaatttctctaattttccccgccagtattttgcccttaggaagatactaaagcagttgatcgcagatgtaaccttagaccctgagaccgcccatcctaatttggtgctgagcgaagatcgcaaatctgtgaagtttgtggagactaggctgcgggacctgccagacacccctcggcgcttcactttttacccctgtgtgcttgccacagaaggtttcacttctgggagacactactgggaggtcgaggttggcgataaaactcactgggccgtcggggtttgtagagatagcgtcagcaggaaaggagagctcaccccgctacccgagaccgggtactggcgcgtcagactctggaacggtgataaatacgccgcaacaacgaccccctttacaccgctccacatcaaggtgaagccaaagcgcgtggggattttcctcgattacgaagccggaaccctcagtttttataatgtaactgacaggagtcatatatacacgttcacggacaccttcacagagaagctgtggcccctgttttaccctggaattcgcgcagggaggaagaatgccgcgcctttgaccatccgcccccctaccgattgggaatag

SEQ ID NO: 209718 - DNA, 1467 bp, Artificial Sequence
  Description of Artificial Sequence: Synthetic coding sequence
atggccgagaccagcctgctggaggccggcgccagcgccgccagcaccgccgctgcactggagaatctgcaggtggaggcctcatgttcagtgtgcctggagtacctgaaagagcctgtgattatagagtgtggacataacttctgcaaagcgtgtataacacgatggtgggaagatcttgagcgtgacttcccatgcccagtctgcaggaagacatcccgttataggtccctgcggcccaacagacagctcggctcaatggtcgaaatcgcgaaacagcttcaggccgtgaaaaggaaaatcagagacgaatctttatgtcctcagcatcacgaagcactgagcttattttgctacgaagatcaggaggctgtctgccttatctgtgccataagtcacacccacagggcacatacagtggtgccattggacgatgcaactcaggaatacaaggagaagctacagaaatgtttggaacctctggagcagaaacttcaagagataacaagatgcaaaagttccgaggagaagaaaccaggagagttaaaaaggctagtggagtctagaaggcaacagatcttgcgggagttcgaagaactccaccggagactggatgaagagcaacaggttctgctgtcccggctcgaagaagaggagcaagacatcctgcagcgcctccgcgaaaacgctgcccacctgggagataaacgccgggacctggctcatctggctgcagaggttgagggtaagtgcctgcaaagtgggttcgaaatgctcaaagatgtgaagtctactctagagaaatgcgagaaggtgaaaaccatggaggtgacctcagtgagcattgagctagagaagaacttctctaacttcccaagacagtatttcgcactgaggaagatattgaaacaactcattgccgacgtgaccctagaccctgagacagcacatcccaatcttgttctttccgaagaccgcaaatctgtaaaattcgtcgagactcgcttgcgggacttgccggataccccacggcggtttacattctacccctgcgttcttgccaccgaaggtttcacttccggacggcattattgggaggtggaggtcggcgacaaaacgcattgggccgtgggtgtctgcagggatagcgtgagccgcaagggtgaactcacgcccttacccgagacaggatattggcgggtgagattatggaatggagataagtacgccgccaccacaactccatttaccccccttcacattaaagttaagcccaaacgggtggggatttttctggattacgaggcaggcactcttagcttctataatgtaactgaccgttctcacatttatacattcacggacactttcacggaaaagctgtggccactattttatcctggaataagggccggacggaagaacgcagctccactgactattagacccccaactgactgggaatag

SEQ ID NO: 209719 - DNA, 786 bp, Artificial Sequence
  Description of Artificial Sequence: Synthetic coding sequence
atggccgagaccagcctgctggaggccggcgccagcgccgccagcacggcggcagccctagagaacctgcaagtggaggcatcatgttctgtatgtttagagtacctaaaagagccagtcatcatcgagtgtggccacaacttctgtaaagcatgtattaccagatggtgggaagacctggagcgcgattttccttgtcccgtgtgccgaaaaaccagcagatatagaagcctgcgtcctaacagacagcttggatcaatggtggaaattgcaaaacaactccaggccgtgaaacgcaaaattagagacgagtctctatgtcctcagcaccatgaggctctgagtttgttctgctatgaggatcaggaggccgtttgcttgatttgtgccataagccatacgcacagagcccacactgtcgtcccactggatgatgctacccaagaatacaaggaaaaactccagaaatgtttggagcctttagagcagaaattgcaggaaattacacggtgcaaaagcagtgaagagaaaaaaccaggcgagctgaagagacttgttgagtcaagacgtcaacagattttacgcgaattcgaggagctacataggcgccttgatgaagaacagcaagtcctgttaagcaggctggaggaggaggaacaagacatccttcagagactacgtgaaaatgcagctcacctaggggataagagacgtgatcttgcacatctggccgcagaggtggagggcaagtgcctgcagtcaggctttgagatgctgaaggtgtag

SEQ ID NO: 209720 - DNA, 225 bp, Artificial Sequence
  Description of Artificial Sequence: Synthetic coding sequence
atggccgagaccagcctgctggaggccggcgccagcgccgccagcaccgccgcggccctggaaaatttacaagtggaggcgtcttgcagtgtgtgtctggagtacttgaaggaaccagtgataatcgagtgtggacataatttttgtaaggcttgcattacaaggtggtgggaggacctcgagagagactttccatgtcccgtgtgccggaagactagtcgctag

SEQ ID NO: 209721 - DNA, 1236 bp, Artificial Sequence
  Description of Artificial Sequence: Synthetic coding sequence
atggccgagaccagcctgctggaggccggcgccagcgccgccagcactgccgccgccctggagaacctgcaggtagaggcctcttgtagtgtgtgccttgaatatctgaaagaaccagttataatagaatgcgggcataatttctgcaaagcctgcataacacgctggtgggaggatctggaacgagatttcccttgcccagtatgcaggaaaacttctcggtatagatctctgagaccaaaccgccaactagggtcaatggttgaaatagccaagcagctccaagccgttaaaagaaaaataagagacgaatcgctatgcccgcagcatcatgaagcactgtccctattctgttacgaagatcaggaggcagtgtgtttaatctgtgctatcagccacacacaccgtgcccacacagtagtaccactggacgatgccacccaggaatataaggaaaagctgcagaaatgtttggaacctctggaacaaaagctgcaggagatcaccagatgcaagtcttctgaagaaaagaagccaggggaactcaaaaggctggtggaaagcaggaggcagcagattctcagagaatttgaggaactccataggcgtttagacgaggaacagcaagttcttcttagtaggctagaagaggaggaacaagatattttacagaggctgagagagaacgctgcgcacctgggtgataagagacgggatctggctcaccttgcagccgaagtcgaaggaaagtgtttacagtctggctttgaaatgctcaagcccgtcctatctgcacgcgaggaatgcgagaaagtgaagactatggaggtgacttctgtatccatcgaactcgagaagaattttagcaactttccgaggcagtacttcgccctccgaaaaatcctcaaacaactcatagcggatgtgacgctagatccagagaccgctcacccaaatttggttctttcggaggaccggaaatctgtgaagtttgtcgagacccgtctacgcgacttgccagacacgcctcggagattcactttctacccctgtgtcctggcaacagagggcttcacttcaggccggcactactgggaggttgaagtcggggacaagactcactgggctgtgggcgtgtgtcgggactccgtgagcaggaaggggggctgtggatatggcatgggcacaaatatgcagcctccccctcacttattgccgctgtgtacatctcggtag

SEQ ID NO: 209722 - DNA, 1467 bp, Artificial Sequence
  Description of Artificial Sequence: Synthetic coding sequence
atggccgagaccagcctgctggaggccggcgccagcgccgccagcacagcagcagcgctcgaaaatctacaagtagaggcatcctgcagcgtgtgcttagaatatcttaaagagccggtgatcatcgaatgcgggcataacttttgcaaagcttgtatcactcgatggtgggaggatttggaaagagacttcccttgccccgtgtgccgtaaaacgtcacgatacaggtccctcagaccaaacaggcaactgggctcaatggtcgaaatcgccaagcaattacaggctgtgaagaggaaaatccgcgacgagagcttgtgtcctcaacatcacgaggctctgtcactgttctgttacgaggatcaggaagccgtatgtctaatatgcgccatctcacatacacatagggcccacaccgtggtgcctctggatgatgcaacacaagaatacaaggagaagctgcaaaaatgcctggaacctctggagcagaaactgcaagaaattacccgatgcaagagctctgaggaaaaaaagcccggggagctgaaacgcctggtggagtcacgtaggcagcagatcctgagagagttcgaagaacttcaccgccggctagacgaagagcaacaggtactgctgagccgactggaggaggaggagcaggacattctccagagactacgagagaatgccgctcatctcggagataaacgacgagacctggctcacctagccgcagaagtggagggaaagtgtctacagtcaggcttcgagatgttaaaagacgttaagtctactctggagaaatgcgaaaaagtgaaaactatggaggtcacctccgtgagtatcgagctagaaaaaaacttctctaacttcccacggcagtacttcgccctccggaagatactgaaacaactgattgctgacgtgacactcgaccctgagactgcgcatccaaacctggtgttgagcgaggacaggaaatctgtcaaatttgtagagacacgcttacgcgacctcccagatacaccgaggagatttaccttctatccctgcgtcttggctacggagggctttacttccggccgccattattgggaggtggaggttggggataagacacattgggcagtgggcgtttgtagagattccgtgtctaggaagggtgaattaacacctctccctgagactgggtactggcgcgtcaggctttggaatggcgacaagtacgccgccaccaccaccccatttacccccctgcacatcaaagtcaagcccaagcgggtgggcatctttctggattacgaagccggcacattatcattttacaatgtgaccgaccggagccacatttatacatttactgacaccttcacagagaagctgtggcctctgttctatcctgggattcgcgccggtagaaaaaatgcggccccccttacaatcagaccccctactgattgggagtag

SEQ ID NO: 209723 - DNA, 786 bp, Artificial Sequence
  Description of Artificial Sequence: Synthetic coding sequence
atggccgagaccagcctgctggaggccggcgccagcgccgccagcacggcagccgctctggagaatttgcaggtggaggcatcttgttctgtgtgcttggagtacctaaaggagccggttatcatagaatgtgggcacaacttctgtaaggcatgtataactcgttggtgggaagacctagagcgcgacttcccatgcccggtctgtaggaagaccagtcggtatcgctctctccgccctaatcggcaattaggcagcatggtggaaatcgctaagcagcttcaggctgtgaaaagaaagattcgggatgagagcctctgtccacaacatcacgaggctctttcactattttgctatgaggaccaagaggcagtatgcctgatctgtgccatcagccatacgcaccgcgcccatacggtcgttccactcgatgacgccacgcaggaatacaaggagaagctacagaagtgtctggagcctcttgaacagaaactgcaggaaattacgagatgcaaatcttctgaagaaaaaaagcctggggaattgaaaagactagttgagagccggaggcagcaaattctgagagagtttgaagagctgcaccggcgtttggatgaggaacaacaagtgctgctaagcaggctcgaggaagaggaacaggatattctgcagcggctacgggagaatgctgcgcatctcggcgacaagcggagagaccttgcccatctagcggcagaagtagagggaaaatgcctacagagcggttttgaaatgcttaaggtgtag

SEQ ID NO: 209724 - DNA, 147 bp, Artificial Sequence
  Description of Artificial Sequence: Synthetic coding sequence
atggccgagaccagcctgctggaggccggcgccagcgccgccagcacggccgctgcactggaaaacctgcaggtggaggcttcatgcagcgtgtgcctggaatatctgaaagagccagttatcatagaatgtggacataacttttag

SEQ ID NO: 209725 - DNA, 786 bp, Artificial Sequence
  Description of Artificial Sequence: Synthetic coding sequence
atggccgagaccagcctgctggaggccggcgccagcgccgccagcacagccgcagcactggagaacttgcaggttgaagcatcttgctctgtttgcctggagtacttgaaagagcccgtgatcattgagtgcggccataatttttgcaaggcctgtatcacccggtggtgggaagacctggagagggacttcccatgtcccgtgtgtagaaagacctcgagatatcggtcactcaggccaaatcgccaactggggtctatggtggaaatcgcgaaacagctgcaggctgttaagcgcaagatcagagacgaatcactctgcccccagcaccacgaggccttgagcctgttctgttacgaggatcaggaggctgtgtgtttaatctgcgcaatctctcatacgcatagggcccacactgttgtgccactggacgatgccacacaggaatataaagagaaactccaaaagtgtttggagccgctcgagcagaagctgcaggagatcacccgatgtaagtcaagcgaagagaaaaagcccggcgagctgaagcgcttggtagagagtcggcggcagcaaatactccgggaatttgaagaattgcatagaaggctagacgaggaacaacaggtgctgctgagcaggcttgaggaggaggagcaggatatccttcagaggttgagagagaacgccgcccatctcggcgacaaacgaagagatctggcccaccttgctgccgaggtcgagggaaaatgcctgcagtcagggtttgaaatgttgaaggtatag

SEQ ID NO: 209726 - DNA, 1467 bp, Artificial Sequence
  Description of Artificial Sequence: Synthetic coding sequence
atggccgagaccagcctgctggaggccggcgccagcgccgccagcactgctgccgccctggagaacctgcaggtggaggccagttgttccgtatgtttggaatacttgaaagagcccgtcataattgagtgtggtcataatttctgcaaggcatgcatcacccgctggtgggaggatctggaacgcgattttccctgccccgtttgccggaagacaagccgctatcggtcgcttagacctaacaggcaactgggaagcatggtggaaatcgctaagcagttacaagccgtaaagagaaagattcgagatgagagcctgtgtcctcagcatcatgaggcccttagcctgttttgctatgaggatcaggaggccgtgtgcctcatctgtgcaatatctcacacacaccgcgcccataccgttgtccctctcgatgatgccacacaggaatataaggagaaactccagaaatgcctggaaccactggaacaaaagctgcaggaaataactaggtgcaaatcctccgaagagaagaaacctggggagctgaagcgtttggttgagtcacggcgtcagcaaatcctgcgcgaatttgaagagctccacaggcggctcgatgaggagcagcaagtgctgctctcacgactggaagaggaggagcaggatattctgcaacgcctgagggaaaatgcagcccatctgggtgataagcgtcgagatttggcacacctggccgctgaggttgagggcaagtgcctgcagtctggattcgaaatgctcaaggatgtaaaaagtactttggaaaaatgtgagaaggtgaagaccatggaggtgacaagtgtgagtatcgagttggagaagaacttcagcaacttcccacgccagtactttgcgctgagaaagatcctgaagcaactcatagccgatgtgacgttggaccccgaaaccgcccatccaaatctagtgctttcagaagatagaaagtccgtgaagttcgtggaaactcggctgagggatctgccagacaccccacgcagattcacgttctatccatgcgtgctcgcgactgagggtttcacgtccgggcgacactactgggaagttgaagtcggcgacaaaacacattgggctgtgggtgtgtgcagggactccgtttctcgcaagggtgaactgacccctctgccagagaccgggtattggagggtacggctgtggaatggtgacaaatatgccgctaccaccactccgttcacacctctacacattaaggttaagccaaagcgtgtgggtattttcctagattacgaggctgggactctgtctttttataatgtgaccgatagatcacatatttacacgttcactgacacatttaccgagaagctatggcctctgttttaccctggaatcagggccgggcgcaagaatgctgccccactgacaatcagacctccaaccgactgggaatag

SEQ ID NO: 209727 - DNA, 225 bp, Artificial Sequence
  Description of Artificial Sequence: Synthetic coding sequence
atggccgagaccagcctgctggaggccggcgccagcgccgccagcaccgctgcagcactcgagaatctccaggttgaggccagctgcagtgtttgcctcgaatacctcaaagagcccgtaatcatagagtgcggacacaacttctgtaaggcttgcatcactcgctggtgggaagacctagaacgagatttcccttgtccagtctgcagaaagacaagcaggtag

SEQ ID NO: 209728 - DNA, 1467 bp, Artificial Sequence
  Description of Artificial Sequence: Synthetic coding sequence
atggccgagaccagcctgctggaggccggcgccagcgccgccagcacagcggcggcacttgagaaccttcaagtagaggcaagctgttccgtttgcttagagtacctcaaggaacccgtgattatcgagtgtggacacaacttctgtaaagcttgtattacgagatggtgggaagacttggaaagagactttccttgcccagtctgcaggaagacctctcgctaccgcagtttgcgccccaataggcagctgggcagtatggtcgagattgcgaaacaactgcaggcagtgaagagaaagattcgcgacgagtcattatgcccacagcatcatgaagccttgtcccttttttgctatgaggatcaggaagcggtatgtctgatttgcgccatttctcatactcacagggctcataccgtggtccctcttgacgacgccacccaagagtataaggagaagctccagaagtgtctggaaccactggagcagaaacttcaggagataacacggtgtaagagtagtgaagagaagaagcccggtgaactgaaacgtctggtagagtctcgcagacagcagatcctgagggaattcgaggagcttcatcgccggctggacgaggagcagcaagtactccttagccgcctggaggaggaagaacaggatatcttacagcgcctgcgagaaaatgcagctcacctcggcgataaacgccgcgatttggcacacctcgcggcagaagtagagggcaagtgtttgcagagtggcttcgaaatgctcaaagatgtgaagtccactctcgagaagtgcgagaaagtgaagacaatggaagtgacatcagtcagcattgagttggaaaagaacttttcaaatttccctaggcagtactttgcccttcggaagattctgaaacaacttattgccgacgttactttagacccagaaaccgcccaccccaacctcgtcctgtctgaagatagaaagagcgtaaagtttgtggagactagactccgagacctgcctgataccccccgccgcttcaccttttacccctgtgtacttgccaccgagggttttacaagcggccgacattactgggaggtggaggtcggcgataaaacgcattgggctgtgggggtgtgccgggattctgtctctcgaaagggagagctaactcccctgcccgagacaggttactggagggtgaggctttggaatggagacaagtatgccgcaaccaccaccccgtttactcccctgcatataaaggtgaaacctaaaagggttgggatctttcttgactatgaggccggcacactgtctttctacaacgtcacagaccggtcccatatctataccttcactgacactttcacagagaagctttggcctttgttctatcctggcatccgggccggaaggaaaaacgccgcccccctgacaatccggcctccaactgactgggaatag

SEQ ID NO: 209729 - DNA, 1557 bp, Artificial Sequence
  Description of Artificial Sequence: Synthetic coding sequence
atggccgagaccagcctgctggaggccggcgccagcgccgccagcaccgctgccgccctcgagaacctgcaggtggaggccagctgctcagtgtgcctggagtacctgaaagagcccgtgatcattgagtgcggacataatttttgtaaggcatgtattaccagatggtgggaagacctggagagagattttccttgtccggtgtgtcgcaagacaagcagatatcgaagcttgagacctaataggcagctcgggagcatggtggagatcgctaaacagcttcaagccgtgaaacgcaaaattagggatgagagtctctgcccgcagcatcacgaagctctgagcctcttttgctacgaggaccaggaggcggtgtgtttaatctgcgctatctcacatacacaccgggctcacacagtcgtgccactagatgacgccacgcaggaatacaaggagaaattacagaagtgtttggagccactcgagcagaagctgcaagaaatcactagatgtaagtccagcgaggagaagaaaccaggtgagttgaaaaggttagtggaaagccggagacaacagatcctcagagagttcgaggagctgcacagacgccttgacgaggaacagcaagtccttttgagtcgcttggaggaggaggaacaggacatcctgcagagactgagagagaacgccgcccatcttggcgataaacgccgtgatctcgcacacctagctgcggaagttgagggcaagtgcctgcagtctgggtttgagatgctgaaggatgtcaagtccactctcgagaaaaacattccacgaaaattcggcggctcgctttctaccatctgcccaagggaccataaagccctgcttggtctggtcaaagagatcaaccgctgcgagaaagtaaaaacaatggaagttacaagcgtcagtatagagttagagaagaatttctcaaacttccctaggcagtacttcgctttaagaaagatcctgaaacagttgatcgccgatgtaactctggatccggaaactgcccaccctaacctcgtcctgtcagaggatcggaaatcggtcaagtttgtcgagacccgcctcagggacctgcctgacacacctaggaggttcaccttttacccgtgtgtgctggcgacagagggatttacaagtggccgtcactattgggaggtagaagtcggagataagacacactgggctgtgggtgtttgccgggattccgtgtctcggaagggcgagcttacaccactgcccgagacagggtattggagggtgcgcctgtggaatggggacaagtacgccgcgactaccacccccttcacacctctgcacattaaagtgaagcccaagagagtgggcatcttcttggactatgaggcaggaacgctaagcttctacaatgtgaccgaccggtctcacatttacacgtttactgatacattcactgaaaagctctggcctctgttctacccagggatccgggcgggtaggaagaatgcagccccactcacaatccggccgcctacagactgggagtag

SEQ ID NO: 209730 - DNA, 1467 bp, Artificial Sequence
  Description of Artificial Sequence: Synthetic coding sequence
atggccgagaccagcctgctggaggccggcgccagcgccgccagcacagccgcagcccttgagaaccttcaggtcgaggcaagctgctcagtgtgcctcgagtaccttaaagaaccagtgattatcgaatgtggccataatttttgtaaggcctgtattacaagatggtgggaagacctagagagagacttcccgtgccctgtgtgcaggaaaacctctagataccgctcacttaggccaaatcgccagttaggttctatggtggagatagcaaagcagctgcaggctgtgaagcgtaaaatcagggacgagtccctctgtccccagcaccacgaggctttgtccctcttctgctacgaggaccaggaagcagtttgtctgatctgcgccatctcccacacacatcgggcccatactgtagtgccactcgatgacgccactcaggagtacaaggagaaactgcagaagtgccttgagccgttagaacagaaattgcaggaaatcacacgctgtaagagttctgaggagaagaagccgggtgagctcaaaaggttagtcgagtcccgacgccaacagatcctgagagagttcgaggagttacaccggagactagatgaggagcaacaggtgctgctgtcccgtctcgaggaggaagagcaggacatcttgcaaaggttgagggagaacgccgcgcacctgggggacaaaagacgtgatcttgcgcacttggctgccgaggtggagggcaagtgcttgcagtcgggcttcgaaatgcttaaggacgtgaagtctactttggagaaatgcgagaaggttaaaactatggaagtgacgagcgtaagcattgaattagagaagaacttttcaaacttcccccgccaatattttgcactgcgcaagattctcaaacagcttatcgctgacgtcactctggacccggaaacagctcatccgaacttggtgctgagcgaagaccgcaaatccgtcaagttcgtggaaaccagactgcgggaccttcccgacacaccgaggagattcaccttttatccctgtgttctggctaccgaaggatttacttctggacggcactattgggaggtcgaagttggagataaaactcattgggctgtaggggtgtgcagagatagtgtcagccggaagggtgagctgaccccactcccagagactggatactggagagtgcggctgtggaatggcgacaaatatgcggcaacaaccaccccattcacacccctgcacattaaggtgaaacccaaacgcgtgggcattttcctggattatgaagccggcacactctccttttacaatgtcaccgacagaagtcacatttacaccttcacggacacttttacggagaaattatggccactcttctaccctggcattcgcgctggcagaaaaaacgctgctcccttgacaatcagaccacctaccgactgggagtag

SEQ ID NO: 209731 - DNA, 435 bp, Artificial Sequence
  Description of Artificial Sequence: Synthetic coding sequence
atggccgagaccagcctgctggaggccggcgccagcgccgccagcacagcggcagcgctggaaaacctacaggtcgaggcctcctgttccgtgtgcctggaataccttaaagaacccgtaatcattgagtgcgggcacaatttctgtaaggcgtgcatcactcggtggtgggaggacttggaacgggacttcccgtgccctgtgtgtagaaagacttcgcggtaccggagcctgagaccaaatagacagcttggctctatggtagaaatcgcgaagcaacttcaagccgtgaaacgcaagatacgcgacgaaagtttatgccctcagcatcacgaagccctgtcgctgttttgctacgaagatcaggaggccgtgtgtctcatttgtgcaatctctcatacacaccgtgcacacaccgtggtgcctctcgattag

SEQ ID NO: 209732 - DNA, 435 bp, Artificial Sequence
  Description of Artificial Sequence: Synthetic coding sequence
atggccgagaccagcctgctggaggccggcgccagcgccgccagcactgccgcagccctcgaaaacctgcaggttgaggccagctgcagcgtgtgcctggagtacctaaaagagccagtaatcatcgaatgcggccataatttttgcaaagcctgcattacgcggtggtgggaggatctagagcgggacttcccctgccccgtgtgtaggaagacgtcacggtataggagtctaagacctaacagacaactggggtctatggtggaaatcgccaaacagctgcaagccgtgaaaagaaaaattcgcgacgagagcctctgccctcaacaccacgaggccctgagccttttctgctatgaagatcaggaagctgtatgtctgatttgtgcaatcagtcatacccaccgggctcacacggtcgtcccactggactag

SEQ ID NO: 209733 - DNA, 684 bp, Artificial Sequence
  Description of Artificial Sequence: Synthetic coding sequence
tgaaccagccggtaccggagcctgcggcccaaccggcagctgggcagcatggtggaaatagctaaacagcttcaggccgtgaagcgcaagatcagggatgagtcactgtgcccacagcatcacgaagctctgagcctgttttgttacgaggatcaggaagcagtttgcctgatttgcgctatttcacatacacacagggctcatactgtggtgccacttgatgatgctacacaagaatacaaagagaagctacagaagtgcctagagcccctggagcagaagctccaggaaataacacgctgcaaatctagcgaagagaagaagccaggggagctcaagagactagtcgagagccgccgccagcaaattcttcgcgagtttgaagaactgcatagacgcctggatgaggagcagcaggtcctgttatcgcggctcgaagaggaagaacaggacattctgcagagacttcgcgagaatgcagctcacttgggggacaaacgtcgggatctggctcacctcgcagcagaagtggagggtaaatgtctccagtcagggttcgagatgctcaaagacgtgaagtccacactcgagaagtgcgagaaagtcaagaccatggaagtgacatctactaccccttgcacatctctgcattctgaaattaatgataatgtccgtggacggtag

SEQ ID NO: 209734 - DNA, 147 bp, Artificial Sequence
  Description of Artificial Sequence: Synthetic coding sequence
atggccgagaccagcctgctggaggccggcgccagcgccgccagcacggcggctgcactcgagaatctgcaggttgaagcctcttgttccgtgtgcttggaatatttgaaagagcctgtgattatcgagtgcggccacaacttctag

SEQ ID NO: 209735 - DNA, 435 bp, Artificial Sequence
  Description of Artificial Sequence: Synthetic coding sequence
atggccgagaccagcctgctggaggccggcgccagcgccgccagcacagccgccgcactggaaaacttacaggtcgaagcttcttgttctgtttgtctcgaatacctgaaagagcccgtgattatcgagtgtggacacaacttttgtaaagcatgcatcacaagatggtgggaagaccttgagcgggacttcccctgccctgtttgtcggaaaacctccagataccgatcactgaggcccaacagacagctgggatccatggtcgagatcgccaagcagttacaggcagtcaagaggaaaatccgggacgagagcctctgcccgcagcatcacgaggctcttagcttgttctgttatgaagatcaggaggccgtctgcttgatctgcgccattagccacactcaccgtgcacatactgttgtgccactcgactag

SEQ ID NO: 209736 - DNA, 1467 bp, Artificial Sequence
  Description of Artificial Sequence: Synthetic coding sequence
atggccgagaccagcctgctggaggccggcgccagcgccgccagcactgctgctgctctggaaaacctgcaggttgaagcttcgtgttctgtctgcctcgagtacctgaaagaacctgtgatcatcgagtgcggccataatttctgtaaagcttgtattacaaggtggtgggaggacctcgaacgcgattttccgtgccctgtgtgtaggaagacctccagatataggtccctccggccaaatagacagcttggctcgatggtcgaaattgccaagcaactccaggctgtcaaacgcaaaataagagatgagtctctgtgtccacaacaccacgaggcactgagtctcttctgttatgaagatcaggaggccgtctgcctgatctgcgctatttcacatactcatcgggcacacacagtagtccccctagacgacgccacccaggagtacaaggagaaattgcagaaatgcctcgagcctcttgaacaaaagcttcaggaaataacacggtgcaaatcatccgaagaaaagaagccaggtgagttaaagcgtctggtcgaatcgcgtcgacagcagatactccgagagtttgaagaactgcatagaagactggacgaagagcaacaggtgctgctgagtagactggaagaagaagagcaggacattctgcagcgcctgagagaaaatgctgctcacttaggcgataagcgccgcgacctagcgcacttggcagccgaggtggaggggaagtgcctgcaatctggctttgagatgctgaaggatgtgaaatccacccttgaaaagtgcgaaaaggtgaagactatggaagttacatcagtgagtattgaacttgagaaaaacttttccaacttcccccgacagtactttgctctgagaaaaattctcaagcagttaattgcagacgttacacttgatccggaaactgcccaccctaacctcgtgctgagtgaggatcgaaagtccgtcaagttcgtggagacccgactgcgggacctgcccgacacaccaaggaggttcacattttatccctgtgttctagccacggaaggtttcactagcgggcgccattattgggaggtcgaggtgggggacaaaacacattgggcggttggcgtgtgccgtgattccgtcagccgcaaaggcgagttaactccattgccagagaccgggtactggcgtgttagattatggaacggtgacaagtatgccgcaactactaccccttttacaccactgcacatcaaagtgaagcccaagagggtagggatcttcctcgattatgaagcagggacactgagcttctacaatgtgaccgacagaagtcacatatacacatttactgacaccttcaccgagaagttgtggcccctgttttacccgggtatccgggctgggcgaaagaacgcagctcctctgaccatccgccccccaacagactgggagtag

SEQ ID NO: 209737 - DNA, 1467 bp, Artificial Sequence
  Description of Artificial Sequence: Synthetic coding sequence
atggccgagaccagcctgctggaggccggcgccagcgccgccagcaccgccgctgctttagaaaatcttcaagttgaggcctcatgctccgtgtgtctggagtatctgaaggaaccggtgatcattgagtgtggccataatttttgtaaggcatgtatcacccgctggtgggaggacctcgaaagggacttcccttgccctgtgtgcaggaagacatctaggtatcggtccttgcgaccaaaccgacagctcggatctatggtggaaatagccaagcagctgcaagcagtgaagaggaagataagggacgagtcgctgtgtccccagcatcacgaggcactgtcactcttctgctacgaggatcaagaggcggtgtgcctgatatgtgctatctcccacacccatcgtgctcatactgtggtgcctctggatgacgctacgcaggagtataaagagaagcttcaaaagtgcttggaacctctggaacagaaactgcaagaaatcaccagatgtaaatcaagcgaagaaaaaaaacctggggagctgaagagactggtggagtctaggagacagcagatcctgcgggagttcgaagaacttcataggcgcctggacgaagagcagcaggttcttctgagccggctcgaggaggaagagcaagacattcttcagcgtttgcgggaaaatgctgcccacctgggagataagcggcgggatctggcacacttggccgccgaggtcgagggaaaatgtcttcaaagtgggtttgaaatgttgaagccagtgttgtctgcacgcgaggagtgtgagaaggtcaaaactatggaagtgacctcagtctctattgagctcgagaagaacttcagcaactttccgagacagtacttcgctctgcgcaagatcttaaagcagctgatcgctgacgtgaccctcgatccagaaacagcccatcctaatttagtattgtctgaggaccgcaaatcagtcaaatttgtggagactagacttcgggacttaccagatacccctcggaggttcacgttttacccctgtgtgttagccacagaggggtttacatctgggagacactactgggaagtggaggtgggcgacaaaactcactgggccgtaggcgtttgccgggacagtgtgtccagaaaaggagagctcacacccctgcctgaaacaggatactggagagttagattgtggaacggcgataagtatgccgccactacaactcctttcacccccctgcacataaaggttaagcccaaacgggtcggaatatttttggattacgaagccggaacactcagtttctataacgtgacggaccgttctcacatctatacttttacagatacctttactgagaagctttggcctttattctaccctgggatccgtgctggccgtaagaacgccgctccactaaccatcaggcccccaacagattgggagtag

SEQ ID NO: 209738 - DNA, 1557 bp, Artificial Sequence
  Description of Artificial Sequence: Synthetic coding sequence
atggccgagaccagcctgctggaggccggcgccagcgccgccagcacggcggccgctctggaaaacctgcaggtggaagcttcctgcagtgtttgcctggagtatttgaaggagccagtgatcatcgagtgcggccataacttttgcaaggcctgcattactcgttggtgggaagatttggaacgcgactttccttgccctgtgtgtagaaaaactagccgctacagaagtcttaggccgaatcgccagctgggatctatggtagagatagccaaacaactgcaggctgtgaaaaggaagattagggacgagtccctgtgcccccagcatcatgaagccctgtcgctgttctgctatgaggaccaagaagcagtgtgcctgatatgtgctattagccacacacaccgcgctcacacagtggtaccattagacgatgccacacaggagtacaaggagaagttgcagaagtgcttagagcctctcgagcaaaagctgcaggaaatcaccagatgtaagtctagcgaagaaaagaaaccgggcgagcttaaacgattggtcgaaagccggcggcagcaaattcttcgggaatttgaagagctccatcggaggctggatgaagagcaacaggtccttttaagccgcctcgaagaggaggagcaagacatcctccagcgactcagagagaacgctgcacacctgggcgacaaacggcgagatttggcccatttggctgctgaagtggagggtaagtgcttacagtccgggtttgagatgctgaaacccgtgctcagcgcacgagagaagaatatcccccgcaagttcggcggaagcctgtctacaatttgcccccgcgaccacaaggcactgttgggtctggtaaaggaaatcaatcggtgcgagaaggtaaaaacaatggaagtgacttcagtgtccattgagctcgaaaaaaacttttcgaattttccgaggcagtacttcgccctgcggaagatactcaagcaactgatagctgacgttaccttagatccggagaccgcccacccaaatttggttttgagcgaagatcggaagtctgtgaagtttgttgaaacccgactgcgcgacttgcctgatacaccccgacgatttaccttctacccatgcgtactggccactgaaggcttcactagcgggaggcactactgggaggtggaagtgggtgacaagactcattgggccgtgggggtctgccgcgattccgtatcccgcaagggagaactgactccattgcccgagacagggtactggcgagtccggctttggaacggtgacaagtatgctgcaactaccacgccctttacccccctgcacatcaaagtgaaacccaagcgcgttggtatcttcctcgactacgaagcagggaccctctccttttataatgtgaccgataggtcacacatttacaccttcaccgacaccttcacagagaaactctggccgctgttctacccaggaatcagagccgggaggaaaaatgcggcccccctcaccattcgaccaccgacagactgggaatag

SEQ ID NO: 209739 - DNA, 1236 bp, Artificial Sequence
  Description of Artificial Sequence: Synthetic coding sequence
atggccgagaccagcctgctggaggccggcgccagcgccgccagcacagcagccgccttagagaacctgcaggtagaggccagttgctccgtatgcctggagtacttgaaagagccagtgataatcgagtgtggtcataacttttgcaaagcttgtattacccggtggtgggaggatcttgagcgcgattttccgtgccccgtctgccggaagacatcaaggtatcgttcactacgtcctaatcgacagctgggatccatggtggaaatcgccaagcagttgcaggcagtgaagagaaaaatccgagatgagagcctgtgtccccagcaccatgaagctctgtctctgttctgttatgaggaccaggaagcagtttgtctgatttgcgccatcagccatacacatagagcccacactgtcgtccccctggacgacgctacccaggagtataaagaaaagctgcagaagtgcttggagcctttggagcagaagcttcaggaaatcacaagatgcaagagctcagaagagaaaaaacctggggagctaaaacgcctcgttgagtctcgcaggcagcaaatcttaagagagttcgaggaactgcataggagattagatgaagaacaacaggttctactgtcccgccttgaagaagaggagcaggacattctgcagcggcttcgggagaacgcagcgcacctgggagataagaggcgggatcttgcacacctcgctgccgaagtggagggaaagtgcctacagagcggatttgagatgctgaaaccagtcctctctgcccgggaggagtgcgaaaaggtcaagaccatggaagtgacatccgtatccattgaactggaaaaaaatttctctaacttccctcgtcagtattttgctctcaggaaaatcctaaaacagctcattgctgacgtgacactcgatccggagacggctcatccgaacctggtactttcagaggatcgaaagagcgtgaaatttgtcgagacaaggttacgcgatctccctgacaccccaaggcgattcaccttctatccttgtgtgctggccacagagggatttacgagtggaagacactattgggaagttgaggttggggataaaactcactgggccgtaggtgtgtgcagggactcggtctcacggaaggggggttgcggctacggtatgggaacgaacatgcagcccccccctcatttattgccactgtgcacctcaaggtag

SEQ ID NO: 209740 - DNA, 1557 bp, Artificial Sequence
  Description of Artificial Sequence: Synthetic coding sequence
atggccgagaccagcctgctggaggccggcgccagcgccgccagcactgccgccgctctggaaaacctccaagttgaagcatcttgctcagtatgcctcgagtacttaaaagaacccgtgattatcgaatgcggacacaatttctgtaaggcctgtattacccgctggtgggaagatttggagcgagacttcccatgccctgtgtgccgaaagacttccaggtaccgttctctaaggcccaacagacagctcggctccatggtcgagattgccaaacagctgcaagccgtaaagaggaagatccgagatgagtcactgtgcccccaacaccatgaggcattgtcactcttttgttacgaggaccaggaggcagtttgcttgatttgcgctattagccatactcatcgagcccacacagtggtgcccctcgatgatgctacccaggaatataaagagaaactccaaaaatgtctggagcctttggagcaaaaactccaggagattacacgctgcaaatccagtgaggagaagaagcccggcgaactgaaaagactggtggagagtaggcgtcagcagatcctccgtgagttcgaagagttacaccgaaggctggatgaggagcagcaagtgctgctgagccgactcgaggaagaagaacaggacattctccagcgactgcgggagaacgctgcgcacctaggtgataaacgcagagatctggcccacctagccgccgaagttgagggcaaatgtctgcagtccggatttgagatgttgaagccagtgctctcagccagagagaaaaatatcccacgaaaattcggaggttccctgtccactatttgtccgagagatcataaagctctgctcgggctggtcaaagaaataaatcggtgtgagaaagttaagactatggaggtaacctccgtcagcattgaactggagaagaacttcagcaacttccccagacagtattttgctctcaggaaaattctcaaacagttgattgctgacgttaccctcgacccagagaccgctcatcctaatctggtcttaagcgaggatcgaaagtctgtaaagttcgttgagacccgcctcagggatttgcctgatactcccagacggttcactttttacccctgcgtactggccacagaggggttcacgagtggtagacactattgggaggtagaggtgggcgacaagactcactgggcggtcggagtgtgtcgcgactccgtcagtaggaagggcgagctgacgcctctacctgaaacaggctattggagagtgagactgtggaacggcgataaatatgcggccactacaacaccattcacacccttacatataaaggtgaagccaaagagagtcggcatctttctcgactacgaggcaggcacgttgtcattctacaatgttaccgatcgctcacatatttacactttcactgatacattcaccgaaaaactttggcctcttttctacccagggattcgggcggggcgcaagaatgccgctcctttaaccataaggcctcccactgactgggagtag

SEQ ID NO: 209741 - DNA, 1467 bp, Artificial Sequence
  Description of Artificial Sequence: Synthetic coding sequence
atggccgagaccagcctgctggaggccggcgccagcgccgccagcaccgcggccgcccttgagaatctacaggtggaagcctcgtgcagtgtttgcctcgaataccttaaggaacctgtcattatcgaatgtggacacaacttctgtaaggcttgcattacccgatggtgggaggacctggagcgggatttcccttgccccgtgtgtcggaagaccagcagatacaggtcccttaggccgaataggcagctaggttctatggttgaaattgcaaagcagctccaagcggttaaaaggaagattcgagacgaatctttgtgtcctcagcaccacgaggcgctgagtctgttttgctacgaagaccaggaggctgtgtgtctgatttgcgctatcagccatactcatagggcgcacaccgtagtgccactggacgacgcaactcaggaatacaaagagaaactgcagaagtgtctggagcctttggagcaaaagttacaggagatcactcgctgtaaaagtagcgaagaaaaaaagcctggcgagctaaagagactggtggagagcaggagacagcagatcctgagggaattcgaagagctccaccggaggctggatgaagagcagcaggtgctgttatccagactcgaggaggaggagcaagacattctgcagcggcttagggagaacgcagcacacctcggagacaagcgaagagatctggcccacctcgcggccgaggtagaaggaaagtgcctgcagtcaggattcgaaatgctgaagcccgtgttaagcgcccgagaagagtgtgaaaaagtcaagacaatggaggtcactagtgtctccatcgagttagagaaaaatttctccaattttccccggcagtattttgctctgcgcaagatcctgaagcagctgatagcggacgttacactcgacccagaaacggcgcaccccaaccttgtcctcagtgaggatcgcaagagcgtgaaatttgtggaaactaggcttcgagacttgcctgacacccctcggcggtttacattctatccgtgcgtactggcaacagagggctttacgtccggaagacactattgggaggtggaggtcggtgacaaaacacactgggctgtcggggtctgccgggatagcgtgtcacgcaaaggagagcttaccccgctccccgaaacggggtactggcgcgtcaggctgtggaacggggataagtacgcggctactacaactccatttactcctctgcatataaaggtcaagcccaagagagtcggcattttcctagattatgaggccggcacactaagtttttacaacgtgaccgacaggagtcatatctacacatttaccgataccttcactgaaaagctttggcccctgttttatcctggcattagagccgggaggaaaaacgccgcaccactgaccattcgcccacccacagactgggaatag

SEQ ID NO: 209742 - DNA, 1557 bp, Artificial Sequence
  Description of Artificial Sequence: Synthetic coding sequence
atggccgagaccagcctgctggaggccggcgccagcgccgccagcacagcagctgctctggagaatctccaagtcgaagctagttgtagcgtctgcctggaataccttaaagaacctgtgatcattgagtgcggtcacaatttttgtaaggcatgcatcacgcgatggtgggaggatcttgaaagggacttcccctgtcctgtgtgcaggaaaacctcccgatacagatcacttagacccaatcgtcaactcgggtccatggttgaaatcgccaaacagctgcaggcagtaaagcgtaaaatccgggatgagagcctgtgcccacagcaccacgaggcactgtcactcttttgttatgaggaccaggaagctgtatgtctgatctgcgctatcagccacacacaccgagcgcacaccgtggtgccactggacgatgctacccaggaatataaagaaaaacttcagaagtgcctggaaccacttgagcagaagttacaggaaattacgaggtgcaagtctagcgaggagaagaaaccaggggagctcaagcggctcgtggagtcaagaagacaacagattctccgtgagtttgaggagctccataggagactggacgaggaacagcaggtgcttctctcacggcttgaggaagaagagcaggacatcttacaacggcttcgggaaaacgccgcccacctgggggataaacgtcgggatctcgcccacttggccgccgaagtcgaagggaaatgccttcagagtggattcgagatgctgaaagacgtgaagagtaccctggaaaagaatatacctcgcaaattcggcgggagcctctcaactatctgtcctcgcgatcacaaggccttgctgggcctggtgaaagagatcaatcgatgcgaaaaggtcaagacgatggaagtgacttccgtctctattgagttagagaaaaacttttcgaactttcccagacagtatttcgcattgaggaagattctgaaacagctgatcgcagatgttaccctcgacccggagactgcccaccccaatctcgtgctgagcgaagaccggaaatccgtgaaattcgtggagactcgcctgagagatttacccgatacaccccgtcgctttacattctacccctgcgtgctggccaccgagggttttacctctggaagacattattgggaggtcgaggtaggggacaaaacccactgggccgtcggagtctgtcgtgatagcgtcagcaggaagggggagctgacacctctgcccgagacagggtactggcgtgtcagactttggaacggagataagtatgccgctactaccacacctttcaccccgctccacatcaaagtaaaacctaagagagtgggcattttcctggactacgaagctgggacacttagcttctataacgtgaccgaccggtctcatatctatacgtttacagacacatttaccgagaagctctggccccttttctacccaggaatccgagccggaagaaagaacgcggcgcccttgactatccgaccaccaaccgactgggagtag

SEQ ID NO: 209743 - DNA, 1467 bp, Artificial Sequence
  Description of Artificial Sequence: Synthetic coding sequence
atggccgagaccagcctgctggaggccggcgccagcgccgccagcactgctgcggcactggaaaaccttcaagtcgaagctagttgctcagtgtgtttagaataccttaaggagcccgtcataattgaatgtggacataatttttgcaaagcatgcatcacaagatggtgggaggacctcgaaagggactttccgtgcccggtctgtcgtaagacctctcgctaccgatcacttaggcctaataggcagctgggctctatggtggagatcgcaaagcagctgcaggccgtgaaaaggaaaattcgtgacgagtctctgtgtccacagcatcacgaggctctctcgctcttttgctatgaggatcaggaagcagtatgcctcatatgcgcgatctcacacactcaccgcgcgcataccgtggttcctcttgatgacgccacacaggaatataaagagaagctccaaaagtgtttagagcctcttgagcagaagctccaggagataaccagatgcaaatccagcgaggaaaaaaagccaggagaactaaagagactggtggagagtcgaaggcagcaaatactcagagagtttgaggaacttcaccgcaggctcgacgaggagcagcaggtactcctctcacggcttgaagaagaagagcaagatatcctgcaaagactgagggaaaatgccgcacacctgggcgacaagcgtagagacttagcacacctggctgctgaggtggaaggaaaatgcctgcagagcggatttgaaatgttaaagccagtcctgtcggcccgcgaggaatgtgaaaaggtgaaaactatggaggtgactagtgtcagcattgaactcgaaaagaacttttcaaacttcccccgtcagtattttgctttgcggaaaatccttaaacaattgattgcggacgtgactctcgatcctgagacagctcacccaaatctggtactctccgaggaccgaaagtcagtcaaattcgttgagacccggttgcgggatctgccggatacacccagacgttttactttctatccatgcgtactcgcgacagaggggtttaccagtggacgtcactactgggaggtcgaggtcggggataaaactcattgggcagtgggggtctgtcgagattctgtgagccgaaagggagagttaaccccgctgcctgagacaggatactggcgggtccgcctttggaatggcgacaaatacgccgccactacgactccttttaccccactgcacatcaaggtgaagcctaagcgggttggaatcttcttggactacgaggcaggcacgctctcattctacaatgtgactgaccggtcccacatctacaccttcacagatactttcactgaaaagctctggcccctcttctatcccggaattcgtgccgggaggaagaatgcagcccctctgactatcagacctcctaccgattgggaatag

SEQ ID NO: 209744 - DNA, 1467 bp, Artificial Sequence
  Description of Artificial Sequence: Synthetic coding sequence
atggccgagaccagcctgctggaggccggcgccagcgccgccagcaccgcagccgcactggagaacctccaggtcgaggccagttgttcagtgtgcttggaatatctgaaggagccagtcatcattgagtgtggccacaacttttgcaaggcctgcataacacggtggtgggaggatctggaacgtgacttcccctgccctgtgtgccggaaaacatcgcgctatcggagtttgcgcccaaacaggcagctggggtcaatggtcgaaatcgcaaagcagctgcaggcagtgaagaggaaaattcgagatgagagcttgtgcccccaacaccacgaagctctgagcctgttctgttatgaggaccaggaagccgtgtgcctaatttgtgccatcagccacacacaccgggcacacacagtggtacccctggatgacgccacacaggagtacaaggagaagctccagaaatgcctggaacctcttgaacagaaactgcaggagatcacccggtgtaaaagctcagaggagaagaagccgggggaactgaaacggctcgtggaatctaggcgccaacaaattttacgtgaatttgaggaactgcaccgcagactggatgaagaacaacaggttcttctctctaggctggaagaagaggagcaggatattctgcagagattgcgcgaaaacgcggcacatctgggcgataagaggcgagacctggctcacctcgctgccgaggtcgaaggcaaatgtctgcagagcgggttcgagatgctcaaacctgtgctgtccgctcgagaagagtgtgaaaaagtgaagaccatggaggtgacatccgtgtccattgaactcgagaaaaacttctccaacttccctcgacagtatttcgctctccgtaagattctgaagcagcttattgcagacgtgactttggacccagaaaccgcccaccccaacctcgttttgtcagaggatagaaaaagtgtcaagttcgtggagacccggttgagggatctgcctgacacaccacgccggtttaccttttatccttgcgtgctcgcgactgaaggctttacaagcgggcgccactattgggaggttgaagtcggagataagacacactgggctgtcggtgtttgtagggacagtgtgagcagaaaaggcgagttaacaccccttccagagacggggtattggagggtcaggctctggaacggagacaaatacgctgccaccaccacacctttcacccccctgcacattaaggtgaagcctaagagggtcggtattttccttgactatgaggctggaacactgagcttctataacgtgaccgaccgcagccacatctatacttttacagacacgttcacggaaaagctgtggccactattctatcctggcatccgggcgggccgaaaaaacgctgcccccctcaccattcgcccacctactgattgggagtag

SEQ ID NO: 209745 - DNA, 1467 bp, Artificial Sequence
  Description of Artificial Sequence: Synthetic coding sequence
atggccgagaccagcctgctggaggccggcgccagcgccgccagcactgctgccgcgttagaaaatttgcaggtcgaagcatcttgttcagtgtgtttagagtatctcaaagaacccgtgatcatcgagtgcgggcataatttctgcaaagcatgcattaccagatggtgggaggatctcgagagagattttccttgtcctgtctgccgaaagaccagtagataccgcagcttgcgacctaaccggcaacttggctctatggtggagatcgccaagcagcttcaggccgttaagaggaaaatcagggacgaatccttgtgcccccaacaccacgaagccctgtccctgttttgttatgaggatcaggaggctgtctgcctgatctgtgcgatatcacatactcatagagcgcacaccgttgttcccctagacgatgctacacaggagtacaaggagaagctgcagaagtgccttgagcccctggaacagaaattacaggagattacgagatgcaagtcttctgaagagaaaaaaccaggcgaactcaagcgactggtggagtcccggcgccagcaaatactgcgggagtttgaggagttgcataggaggcttgatgaggagcagcaggtcctgctgtctcgccttgaagaagaggagcaagacattctgcagcgattgcgagagaatgccgcgcacctcggagataaacgcagagacttagcgcacttggcggcagaagtcgaggggaagtgcttgcagtctggttttgaaatgcttaaaccagtgttgtcagctcgggaagagtgcgaaaaagttaaaacaatggaggtcacgtctgtgagcatcgaactggaaaagaacttttctaatttccctaggcagtacttcgcgctcaggaaaatcctgaagcaactcattgccgatgtcaccctggatcccgagacggcccatcctaatcttgtgctgtcagaagacagaaaatccgtgaagttcgtggagactcggctgagagacttgcctgatacaccacgccggttcaccttctacccctgtgtcctggccacagaaggctttacttcaggcagacattactgggaggtcgaggtcggtgataagactcattgggcagtgggggtgtgtcgggattccgtaagcaggaagggagagctcacacctctccccgaaacgggttactggcgagtgcggctgtggaacggggacaagtacgccgctaccaccacaccatttaccccacttcacataaaggtcaagccaaagagggtcggtatatttctcgactacgaagcaggtacgctttccttctataacgtgaccgacagatcccacatttacacattcacagatacttttacggagaagctttggccattgttctaccccggcattcgcgctggccggaagaacgctgccccgctcacaatcaggcctcccaccgactgggagtag

SEQ ID NO: 209746 - DNA, 1557 bp, Artificial Sequence
  Description of Artificial Sequence: Synthetic coding sequence
atggccgagaccagcctgctggaggccggcgccagcgccgccagcacagccgcggccttggaaaacctgcaggtagaggcgtcctgcagtgtatgcctagagtatcttaaagaacccgtgattatcgaatgcggccacaacttctgtaaggcctgcataacacgctggtgggaagacctcgagagggacttcccctgccctgtctgtaggaaaacaagcaggtaccgatcactgcgccccaaccggcagctgggcagtatggtcgagattgctaagcagctgcaggccgttaaacggaagatcagagatgagtccttgtgtcctcagcaccatgaggcactctcccttttttgctatgaagaccaggaggccgtatgtcttatatgtgccattagccatactcacagagctcacacagtcgtgcccctagatgacgctacacaggagtacaaggagaagttacagaagtgcctggaaccccttgaacagaaactgcaggagattacaaggtgcaaatccagtgaagaaaagaagccgggtgaattgaaacggctggtggaatctagaagacagcagattctgcgggaatttgaagagctgcatcgcagacttgacgaggagcagcaggtgctgctgagcaggctcgaagaggaagagcaggacattctacagaggctgagggagaatgccgcacatctgggagacaaacggcgcgacctcgcccatttggctgctgaggttgaggggaaatgcttgcagagcggatttgagatgctgaaggacgtgaagtccacccttgagaaaaacatacctagaaaatttggcggctcactgagcaccatctgtccacgggaccacaaggcccttctcgggctcgtgaaggaaataaaccgatgcgaaaaggtcaagaccatggaggtcacgagtgtaagcattgagcttgagaagaattttagcaacttccccagacagtactttgccttgcggaaaatactgaaacagctcattgctgacgtgaccctggatccagaaactgcccatccaaatctggtgttgagcgaggatagaaaatctgtcaaattcgtagaaacacggctgagagatctgcccgacacgccgagacgctttactttctacccatgcgtgttggctacagagggttttacctcaggaaggcactactgggaggtggaggtgggcgataagactcattgggctgtgggggtctgcagggatagtgtgtccaggaagggcgagcttacaccactgccggagactggatattggagagttcggctgtggaacggtgataaatatgcagctaccaccacccccttcactccactacatataaaggtgaaacctaagcgggtaggaatattcctcgattatgaggctggtaccctgagcttctacaacgttacagaccggtcccacatctataccttcacagatactttcacggaaaaattgtggcctcttttctaccccggcatcagggctggccggaaaaacgccgccccgctgacaattcggccgcccacagactgggagtag

SEQ ID NO: 209747 - DNA, 1236 bp, Artificial Sequence
  Description of Artificial Sequence: Synthetic coding sequence
atggccgagaccagcctgctggaggccggcgccagcgccgccagcacagctgccgccctggagaacctccaggttgaggccagttgctccgtctgtctcgaatacttgaaggagccggtgattatagaatgtggccacaatttttgcaaggcttgtatcacccgctggtgggaggacctggaacgcgactttccttgccctgtatgtagaaagacgtccaggtaccgatccctccggccgaatcgacagcttggatccatggtagaaattgccaagcagttacaggctgtcaagagaaagatccgcgatgagtctttgtgtccccaacatcatgaagccctgtctctcttttgctacgaagatcaagaagccgtgtgtctgatatgtgcaatctcacacacgcatagggctcatactgttgtgccactcgatgatgccacgcaggagtataaggagaagctgcaaaaatgtcttgagcccctggagcagaaactgcaggagataacgcgatgtaagtcaagtgaagaaaaaaaaccaggggaactgaagcgcctggtcgaaagcagacgccagcagattcttcgggagttcgaagagctgcaccggcgcctggatgaggagcagcaggtactgctgtctaggctcgaggaagaggagcaggatatactgcaaaggctgcgggaaaatgcagctcacctcggagataaacgtcgcgaccttgcccacctcgctgcagaagtcgaaggcaagtgtctccagtctggattcgagatgctgaagccagtcctgtccgcccgcgaggaatgtgagaaggtgaaaactatggaggtcacaagcgtctctattgagctggagaagaactttagcaacttccctagacagtacttcgcactcaggaagatcctgaagcagttaatcgcggacgtaaccctcgatccggagacggctcatccaaatcttgtgctaagtgaggatcgcaagtctgtcaaattcgtagagacacgccttagggacctacctgataccccacgcagatttaccttctacccctgcgttctcgcaacagaaggcttcacgtcaggccgccactattgggaggtcgaggtgggcgataagacacactgggctgtgggagtctgcagagattccgtcagccgtaagggagggtgtgggtatgggatgggcactaacatgcagccccctccacacctcctccctctatgtacctctcggtag

SEQ ID NO: 209748 - DNA, 1557 bp, Artificial Sequence
  Description of Artificial Sequence: Synthetic coding sequence
atggccgagaccagcctgctggaggccggcgccagcgccgccagcacggccgctgcactggagaacttgcaagtggaagccagttgttctgtttgtttagagtatctgaaagagcccgtaattatcgagtgtggccataacttttgcaaagcctgcatcactcgctggtgggaagatctcgagcgggactttccatgccccgtgtgtaggaaaacaagtcggtaccgaagtctaagacccaatagacagctcggttccatggtcgaaattgctaaacaactacaggctgtgaagcggaagatccgtgacgagagtctttgcccccagcatcacgaggcgttatccttgttctgctatgaggatcaggaggcagtgtgtcttatttgcgctatttcacatactcaccgagcccatactgtggtgcccctggatgacgcaacccaggaatataaggaaaaactccagaagtgtctggagcccctggagcagaagctgcaagagatcacacgctgtaagagctctgaggaaaagaaacccggagagcttaagaggttggtcgaatcccggcggcagcagatattgagggaatttgaggagctgcatcgtcgtttggatgaagaacagcaggtattactgagccgccttgaagaagaggaacaggacatcctccagcgtttgcgcgaaaatgcagctcatctgggggataaacgccgtgacctggcacacctcgcagccgaggttgagggaaaatgtctccaaagcggctttgagatgctcaagccggtacttagcgcaagggaaaaaaatatccccagaaagttcgggggatctttgtccaccatctgtcctcgggaccataaggccctattagggcttgtgaaagagataaatcggtgcgagaaggtgaaaactatggaggtgacatctgtctcaatcgagctggaaaagaatttttcaaacttcccgcggcagtatttcgccctgaggaagattctgaaacagctgatcgccgacgttacactcgacccagaaaccgctcacccgaatcttgttctcagtgaggaccggaagtcagtgaaatttgtggagacacgactgagagatctgccagacacacctcggcggtttacgttttacccttgtgttttggcaaccgaaggattcaccagcgggaggcattattgggaagttgaagtcggtgacaagacacactgggcggtgggcgtgtgtcgcgatagcgtcagccgcaagggcgagctcacacctcttccagagacaggctactggcgtgttaggctttggaacggggataaatatgccgccaccacaactcctttcacccccttgcacatcaaggtgaagcctaagcgcgtgggaatctttctagactacgaagctggcaccctctccttctacaatgtgacagatcggagccatatttacaccttcactgataccttcaccgagaaactgtggcccctgttctaccctggcatcagggccggaaggaaaaatgcagctccactgaccatacgcccacccacagattgggaatag

SEQ ID NO: 209749 - DNA, 1236 bp, Artificial Sequence
  Description of Artificial Sequence: Synthetic coding sequence
atggccgagaccagcctgctggaggccggcgccagcgccgccagcacagccgccgctctggaaaatcttcaggtggaagcctcatgcagcgtttgtcttgagtacctgaaggagccagtgatcattgaatgtggtcacaacttctgcaaggcttgtatcacccgatggtgggaggacctcgagagagacttcccctgccccgtctgcagaaagacctcccgatatcggagcctgaggccaaacagacagctgggtagtatggtagaaatcgcaaagcagctccaggccgtcaaacgcaaaattagagacgagtcactttgccctcaacaccatgaggcattaagcctgttttgctacgaggatcaagaggctgtctgcctgatctgcgccatctcgcacacacaccgggcacacaccgttgtgcctctggatgacgcgacgcaggagtacaaggaaaagctgcaaaagtgcctggagcccttggaacagaaactccaggagatcacacggtgtaaatcgagtgaggagaagaagcccggagaattgaagaggttggtcgaaagtagaaggcaacagatactcagagagttcgaggaactccatcggaggctggatgaggagcagcaggttttgctgtccagacttgaagaggaggagcaagatatcctgcagcgcctgagggagaacgctgctcatctaggtgataagcggcgggatctcgcacacctggccgccgaggtcgaaggcaaatgcctgcagtccggttttgagatgctcaaaccagtgctaagcgcgcgagaagaatgcgagaaagtaaaaacaatggaagtgacatctgtaagcattgaacttgagaaaaactttagtaactttcctcgccagtacttcgcccttcgaaagatactgaaacagctcattgcagatgtgaccctagatcctgagaccgctcaccctaatctggtcttatccgaggatcggaagtcagttaagtttgttgaaacccgtctgcgagaccttccggacacgccacgccgattcacattttacccttgcgtgctggcgaccgaggggttcacatcagggcggcattattgggaggtggaggtaggagataaaacccactgggcagtcggagtttgtcgggactctgtgagcaggaaaggcggatgtggctacggcatggggaccaacatgcagccaccgccgcatctgctgcctttgtgcaccagcaggtag

SEQ ID NO: 209750 - DNA, 1236 bp, Artificial Sequence
  Description of Artificial Sequence: Synthetic coding sequence
atggccgagaccagcctgctggaggccggcgccagcgccgccagcacagcagcagccctcgagaatcttcaggtggaggcttcatgctctgtgtgcttggagtatcttaaggagccagtgatcatagagtgcggtcacaacttctgtaaggcttgcatcacacgttggtgggaggatcttgaacgcgatttcccttgcccggtgtgccgcaagacttcacggtataggtccctccggccaaaccgccagctgggttcaatggtggaaattgcaaagcaacttcaggctgttaagcgcaaaattcgcgatgaatccttatgccctcagcatcacgaggctctgtcactgttctgctacgaagaccaggaggcggtctgtttgatttgcgccatttcacacactcaccgggctcacaccgtcgtcccattagatgatgctactcaagagtacaaggagaaactacagaaatgtctggagcctctcgagcagaagctgcaggaaatcactcgatgtaagtcttccgaggaaaaaaaaccaggagagctgaaaaggctggtggagagcagacgccagcagatattgcgagagttcgaagagctgcacagacgactcgacgaggagcaacaagtactactgtcaaggttggaagaggaagagcaagatatacttcaacggctcagagaaaacgcggcccatttgggagataagcggagagatttagcccatctggctgcagaggttgaggggaaatgtttgcagagcggcttcgagatgctcaagcctgtgctgtcagccagagaagaatgtgaaaaggttaagactatggaggtgaccagcgtgagcattgaactggagaagaattttagcaatttcccaagacaatattttgccttgaggaaaatcttgaagcagctgattgctgatgtgacacttgaccctgaaaccgcccacccaaacctcgtcctgtctgaggatcgcaaatccgtgaagtttgtggaaacgaggctgcgcgaccttccagacacacccaggcgttttacattctacccttgtgtcctcgccaccgagggttttactagcgggcgacactactgggaggtggaggtaggggataaaacccactgggccgtgggcgtgtgccgagacagcgtgagccgaaagggaggttgtggctacggaatgggtaccaacatgcaaccacccccccatctccttccactgtgcacctcgagatag

SEQ ID NO: 209751 - DNA, 1557 bp, Artificial Sequence
  Description of Artificial Sequence: Synthetic coding sequence
atggccgagaccagcctgctggaggccggcgccagcgccgccagcactgccgcggcattggagaatctgcaggtggaagcctcctgctccgtgtgtctggaatacctcaaagagcccgtgattatcgagtgcgggcacaacttctgtaaggcctgcatcacacggtggtgggaagatttagagcgcgatttcccatgccccgtgtgtcggaagacttcacgatatagaagtctgagaccaaatcgtcaattgggctccatggtggaaatagctaagcaactccaggcagtgaagcggaagattcgggatgaaagcctgtgtccacaacaccatgaggctctctctctgttctgttacgaggatcaagaagctgtatgcctaatctgcgctattagccacacccacagagcccatactgtggtcccccttgacgatgcaacccaagagtacaaagagaagctacaaaaatgccttgagcccctggagcaaaagctgcaggaaattacaagatgcaagtccagcgaggagaagaagccaggagagctgaaacgcctggtggagagccgtcggcagcaaatactgcgcgaatttgaagagctgcaccgccgcttagacgaagagcagcaggtgctcctctctcgactggaggaggaagagcaggacattctccagcgtctccgtgaaaatgccgcccatctcggagataaacgccgggacctggcccacttagctgctgaggttgaaggcaagtgtcttcagtcgggatttgaaatgctcaaagatgttaaaagcaccctcgagaaaaacatccccaggaagtttggcgggtctctgagcacgatttgtccacgtgaccacaaagctctactaggactcgttaaagagattaatcgatgtgaaaaggtgaaaacaatggaggtcacttccgtcagcatcgagttggagaaaaatttctccaactttccgcggcagtatttcgcccttcgtaaaatcttgaaacagctgatcgctgatgtcaccctcgacccggaaaccgctcaccctaacctggtactgagcgaggaccgtaaatccgtcaagtttgtagagactcgcttgcgcgatctgccagatactccacgccggtttacattctacccttgtgtattagctactgaaggcttcacctccggtcggcactactgggaggtggaagtcggcgacaagacccactgggccgttggagtctgtcgcgattctgtgagtcgtaagggggagctgactccactgccagaaacaggatactggcgagtccggctatggaacggagacaaatacgcagccaccacaacaccatttacgccgttgcacattaaagtcaagcctaagcgagtggggatattcctggactatgaggcaggcaccctatcattttacaacgttaccgacaggtcacatatctatacattcactgacacttttaccgagaagttgtggcccctattctatccaggaatccgagcggggcgcaaaaatgccgcaccactgactatccggcctccgacggattgggagtag

SEQ ID NO: 209752 - DNA, 1557 bp, Artificial Sequence
  Description of Artificial Sequence: Synthetic coding sequence
atggccgagaccagcctgctggaggccggcgccagcgccgccagcactgctgccgctctggagaatttgcaggttgaagccagctgttccgtctgcctggaatacctgaaggaacccgtcattatagagtgcgggcataacttttgcaaggcttgtattactcgctggtgggaggacctggaaagagattttccctgcccagtctgccggaagactagccgctatcggagcctgaggccaaaccggcaattggggtccatggtggaaatagccaaacagttgcaagctgttaagcggaagatacgcgacgaatctttgtgcccacagcaccatgaggccttatctctgttttgttatgaggatcaagaggccgtttgcctaatctgcgcgatctcgcacacccatcgcgctcatactgtggtgccccttgatgacgctacccaggagtacaaagaaaagttgcaaaaatgtctggagcctcttgaacagaagttacaggaaattacccgatgcaagtcttccgaagaaaaaaaaccgggcgagctgaagaggctagtggagagtagacggcagcagatcctgagggagtttgaagagctgcaccgccgattagacgaagagcagcaagtgctgctctcccgattagaggaagaggaacaggacatactgcagaggctgcgggaaaatgctgcccacttgggagataaacgtcgggacctcgctcatctggccgcagaggtggaaggtaagtgtctccagtctggctttgagatgctgaaacctgtgttgtcggctcgggagaagaacatcccccgaaaattcggaggtagcctaagtacgatttgtccacgcgaccacaaagcacttctgggcttagtgaaggagatcaacaggtgcgaaaaggtgaagactatggaggtgactagcgtctctattgagctggaaaagaacttctctaactttccacgtcagtacttcgcccttagaaaaatattgaagcagctgatcgcagacgtgacattggaccctgaaaccgcacacccaaacctggtgctgtctgaggacagaaaaagcgtgaaattcgtagaaacccgtctgcgtgatttacccgataccccccgacggtttaccttttacccttgtgtgctcgcaactgaagggttcaccagtggacgacactattgggaggttgaagtgggagataagactcactgggccgtgggagtatgtcgggattccgtctcacgcaagggtgagctgacgccactgcccgaaacaggatactggcgggtgcgtctgtggaatggagataagtacgccgctactaccacacccttcacacccttgcatattaaagtgaagccaaagcgtgtaggtatcttccttgactatgaggctggtactctgagcttctacaacgtgaccgacagatcccacatatacacttttaccgataccttcaccgagaagctgtggcccctgttttatcctggaattcgcgccggacgaaagaatgcagctccattgacaatcagacctccaacggattgggagtag

SEQ ID NO: 209753 - DNA, 1557 bp, Artificial Sequence
  Description of Artificial Sequence: Synthetic coding sequence
atggccgagaccagcctgctggaggccggcgccagcgccgccagcacggccgctgctttggagaatctgcaggtcgaggccagctgctccgtgtgcctcgaatacttgaaggagcccgttatcattgaatgtggccacaacttttgcaaagcttgcatcacgagatggtgggaggacctggagagggattttccatgtcctgtgtgccggaaaacgtctcgatacagaagcttgcgacccaacaggcagctgggctccatggtggagattgccaagcagctgcaggcggtaaagcgaaaaattcgcgacgaaagcctgtgccctcagcaccatgaggcgcttagccttttttgctacgaagatcaggaagcagtgtgcctgatctgcgcaatttctcacacacatcgggcccacacggttgtccccctggacgatgcaacccaggaatataaggaaaaactgcagaagtgccttgagcccctcgagcagaagctgcaagaaatcacccgatgcaagagctccgaagaaaaaaagccaggggagcttaaacggctcgttgagagtagaaggcaacagattctccgcgagttcgaagagctccatcgaagattagacgaggagcaacaagttctgttgagtagactggaagaggaggagcaagatatacttcagcggctacgggagaacgccgcccatctgggcgacaagcggagggacctcgcgcatttggcagcagaagtcgagggaaagtgcttgcagtctggttttgagatgttgaagccggtcctgtcagcacgcgagaaaaacattcctagaaaattcggtggctcccttagcacgatttgcccacgcgaccataaggccctgctgggcttggtgaaagaaattaatcgatgtgagaaagtgaaaactatggaagttacatctgtgtcaattgagctcgagaaaaatttttccaattttcctcgacagtattttgctctccgaaaaatcctgaaacagctgatcgctgacgtcacacttgacccagagactgcacacccaaatctggtcctctctgaggaccggaaaagtgttaaatttgtggaaacccgtctgagggatctacctgacacgccccggcggtttaccttctatccctgcgttcttgcaactgaaggttttacgagtgggcgtcattattgggaagtggaggtaggtgacaagacccattgggccgtgggagtttgccgcgacagcgtttcccggaagggggaactgacccctctgcccgaaaccgggtattggcgagttcgcttgtggaacggcgacaaatatgcggcaaccactacccctttcactcccctgcacattaaggtgaaacccaagcgcgtggggattttcttggattacgaggctggcactctgtccttttacaatgtgacagatcgaagtcacatctacacattcactgatactttcactgagaagctgtggccattgttttaccctggaatacgggctggccggaagaacgccgcacctctcaccatcagaccacctaccgactgggaatag

SEQ ID NO: 209754 - DNA, 1557 bp, Artificial Sequence
  Description of Artificial Sequence: Synthetic coding sequence
atggccgagaccagcctgctggaggccggcgccagcgccgccagcactgctgctgccctggaaaatttacaagtggaggcctcatgttctgtctgtttggaatatctgaaggaacccgtaataattgaatgcggacacaacttttgcaaagcctgcataactagatggtgggaggacctcgaacgagattttccatgccccgtctgccggaaaacaagtcgataccgcagcctgcggcctaatcgccagctgggctccatggtcgagatagccaagcagttacaagctgtcaagaggaaaatcagagacgaaagcctgtgcccccagcaccatgaggcgctgtctttattctgctacgaagaccaagaggcggtgtgcctgatctgtgccatctcccacacccacagagcccataccgtcgtacccctggacgacgctactcaggagtacaaggagaaacttcagaagtgccttgagcctctcgaacagaagttgcaagagataacaagatgtaagtcctccgaggaaaagaaacccggagagctgaaaagactagtcgaaagccgtagacagcagatcttgcgcgagtttgaagaattgcacaggagactcgacgaggagcaacaggtccttctctcccggttggaagaggaggaacaggatatcctgcagcggttgcgcgaaaacgcagcccacctgggcgacaaaaggcgcgaccttgcccacctggccgccgaagtggaaggaaagtgtcttcagtcgggattcgagatgttaaaagacgtcaaaagcactctggagaagaacattcccaggaaattcggcggcagtctgtcaaccatctgcccgcgcgatcacaaggccttattagggctggttaaggagatcaacagatgcgaaaaagtgaaaaccatggaggtgacctcagtgtcaatcgaactggagaagaattttagcaattttccacgtcagtatttcgccttacggaaaattttgaagcagcttattgccgacgtgactctggatcctgagacggcccatccaaacttagtgctcagcgaggataggaaatctgtaaagtttgttgagacccggctacgggatttgcccgacacaccgcgtcggttcaccttttatccatgcgtgcttgcgacagagggcttcacatcaggcagacactattgggaggtggaagttggcgacaagacccattgggccgtcggcgtctgtcgtgatagtgtctcccggaagggcgaattgacccctctccccgaaacggggtactggagagtgcgactctggaatggagataagtacgctgccaccacaacgcctttcaccccactccacatcaaggtgaagcccaaaagagtcggcatcttcctcgactatgaggccggaactttgagcttctataatgtcaccgaccgctctcatatctatactttcaccgacacatttaccgaaaagctttggcccctgttctatcctggaattcgcgctggccgaaagaatgctgcacccctgaccattagacctccaacagattgggagtag

SEQ ID NO: 209755 - DNA, 1557 bp, Artificial Sequence
  Description of Artificial Sequence: Synthetic coding sequence
atggccgagaccagcctgctggaggccggcgccagcgccgccagcacagcagcggcgctcgagaatttgcaggtggaggcttcttgcagcgtgtgcctagaatatttaaaggaacctgtgatcatcgagtgcggtcataacttctgtaaggcctgtatcaccaggtggtgggaggatctggaacgggactttccgtgtccagtgtgccgcaagacgagtcgctataggagcttgcgacctaatagacaacttggtagcatggttgagatagccaaacaattgcaagccgtgaagcgtaagatcagagacgagtctttatgcccccagcaccacgaggccctcagcctattctgctacgaggatcaggaagcagtgtgcttgatttgcgccatctcccacacacaccgtgcacacacagtggtgccgcttgatgacgctacccaggaatacaaggagaagttgcaaaaatgcctggagcccctggaacaaaaactgcaagagattacccggtgtaagagcagcgaggagaagaaaccaggagaactgaagagattagttgagagtcggcgccaacaaattctgcgagagttcgaagagttgcaccgcagattggacgaggagcaacaggtgttactgtctcggctggaagaggaggagcaggacatcctgcagcggctgcgggaaaacgcagcccacttgggggacaagagacgcgatctggcacatctggctgcagaagtcgaagggaaatgtctgcaatcaggcttcgaaatgttgaagcccgtgctgtcggccagggagaaaaacattcctcgcaaatttgggggctccctttcaaccatctgccccagggaccacaaggcccttcttggtttggtgaaagagattaataggtgcgaaaaagtcaagactatggaggtgacctccgtttcgattgagttggaaaagaatttttcaaacttccctaggcagtactttgctctacgcaagatcctgaagcagctgatcgccgacgtcaccttggaccctgaaacagcgcatcctaatctcgtgctgagtgaggacaggaaaagcgtcaagttcgtcgagacaaggcttagggacctgcctgacacccctagaaggtttactttttacccatgcgtgttagccaccgaaggcttcaccagtggaaggcactattgggaggtggaagtcggagacaagacacattgggcagttggggtgtgccgcgactccgtctcccgaaaaggcgagctcactcctctgcctgagacaggatactggcgcgttcgcctctggaatggcgataagtatgctgccaccacaacacctttcacccctctccacattaaggttaagcccaagagagtgggtatcttcctggactacgaggccggaacactgtccttttataacgtgaccgatcggtcccacatctatacatttacggacacatttaccgaaaagctctggcccctattttacccaggcattagagcaggtagaaagaatgccgcacctctcactatccggccgccgacagactgggagtag

SEQ ID NO: 209756 - DNA, 1254 bp, Artificial Sequence
  Description of Artificial Sequence: Synthetic coding sequence
atggtggagatcgccaagcagctgcaggccgtgaagcggaagatccgagacgagtccttatgcccgcagcaccatgaggccctaagcctgttctgttatgaggaccaagaagcagtgtgcctgatctgcgctatctctcacacgcacagagctcatacggtggtgccacttgatgatgctacccaggagtacaaggagaaactacagaaatgcctagaacccctggagcagaagctgcaggaaataacgagatgcaagtcctctgaggaaaagaaacctggagaactgaaaaggctcgtcgagtctagacgccagcagatcctgagagagtttgaagaattgcatcggcgtctcgacgaggagcagcaggttcttctgtctcgcctggaagaggaggaacaggacatcttgcagaggctgcgcgaaaacgctgcccacctaggcgataagagacgagacctggcccacctggcagcagaagtggagggcaagtgtttacagagcgggtttgagatgctaaaaccagtgctctctgctcgggaagagtgcgaaaaggtcaagacaatggaagtgacgtctgtttccattgagctcgagaaaaattttagtaatttcccgcgtcaatattttgccctgagaaagattttaaagcagctgatcgctgacgtgaccctcgaccctgagactgctcacccaaacctggttttgtctgaagatagaaagtccgtaaaattcgtcgagaccagactacgggacctgcctgacactcctaggcgatttacattctatccatgcgtcctcgccaccgagggctttacctctggaaggcactattgggaagttgaggctgctcactgtgtcttagcgcaggatcctgaaaatcaagccctcgctcggttctattgttacaccgagcgtactattgccaagcggctcgtcctccgaagggacccctccgtcaagaggactttgtgtaggggatgttcatctctgctggtacccggccttacctgcactcatagacagcggcggtgtcggggtcagaggtggactgtacagacatgtttgacctgccagaggtctcaacggtttctgaacgatcccggtcatctcctgtggggcgacagacccgaagcacagttaggaagccaggctgattccaaacctttgcagcctcttccgaatacggcacacagtattagcgatagacttcctgaagagaaaatgcaaacacaaggttcctctaaccagtag

SEQ ID NO: 209757 - DNA, 1254 bp, Artificial Sequence
  Description of Artificial Sequence: Synthetic coding sequence
atggtggagatcgccaagcagctgcaggccgtgaagcggaagatcagagatgaatccctgtgtcctcagcatcatgaggccctaagcctcttctgttatgaggaccaggaagctgtgtgtcttatttgcgcgatttcacacacccacagagcccacaccgtcgtgccccttgacgacgccacccaggagtataaggaaaagctgcagaagtgtcttgagcccctcgagcagaaactgcaagagatcacacgctgcaagtcatcagaggagaagaaaccgggagagctaaagagactggtggaaagtagacggcagcagatcctcagggaatttgaggagctacacagaaggctggatgaggagcagcaggtgctactgagtcgacttgaagaagaggaacaggatattcttcagagattgagggaaaacgctgcacacctgggtgataaacgacgcgacctggcacacctagctgccgaggtggaaggaaagtgtctccaatcaggttttgagatgctgaaaccggtattaagcgcccgagaagaatgcgagaaggtcaaaacaatggaagtcacaagcgtttccatcgagttggagaaaaatttcagcaacttcccacgacagtatttcgccctccggaagatacttaagcagctgatcgccgacgtcaccctcgaccctgaaactgcacaccccaatctggttctctccgaggaccgcaagagcgttaaatttgtagaaaccagactgcgagatctccccgatacacccaggaggttcacattctacccttgcgtcttagcaacggaaggctttacctctggaaggcattactgggaggtggaggccgcccactgcgtgctcgcgcaggaccccgaaaaccaggccctcgctagattttattgctacaccgagcgaactatagccaaaagactagtacttaggagggacccctcagtgaagcgcactttatgccggggatgcagtagtcttctggtcccagggctcacgtgtactcacaggcagcgcagatgtcgcgggcagcggtggacagtgcagacctgtctcacctgtcagcgctcgcagcgtttccttaatgaccctggtcatctactgtggggggacaggccagaggcccagctggggtctcaggccgacagtaagcctctgcagcctctgcctaataccgcgcattccattagtgatagactcccagaggagaaaatgcaaacccaggggtccagtaatcagtag

SEQ ID NO: 209758 - DNA, 1236 bp, Artificial Sequence
  Description of Artificial Sequence: Synthetic coding sequence
atggccgagaccagcctgctggaggccggcgccagcgccgccagcactgctgctgcgctggaaaacctgcaagtcgaggcctcatgttcagtttgtttggaatatctgaaagaaccagtgatcattgagtgcggccataacttctgtaaggcatgcatcacgcggtggtgggaggatctcgaacgtgattttccatgccccgtctgcagaaagacttctcgctatcgctcgcttagacccaatcggcagcttgggtctatggtagaaatcgcaaaacagctgcaggccgtgaaacgtaagatcagggatgagtctttatgtcctcagcaccacgaggccctgagtcttttctgttacgaggaccaggaggccgtctgtctcatctgcgcgatctcccatacccacagagctcacactgtagtgccgctagatgacgcaacccaagaatacaaggaaaaattgcagaagtgcctggagcctctagagcaaaagcttcaggaaataacccgctgtaagtcctctgaggaaaagaagcccggggagctcaaacgacttgtggagagcaggcggcaacaaattttacgcgagtttgaggaactgcatagacgccttgatgaggagcagcaggtcctgctgagtaggctggaggaggaggaacaggacatactccaacgcctgagggagaacgccgcccacctgggagataaaaggcgcgacctggcccatttggccgctgaggtagaaggaaaatgcctacagtccggttttgagatgttgaaacccgtgctgtccgcacgcgaggagtgtgaaaaggttaagaccatggaagtgacgagcgtgtctattgagttagagaagaacttttccaatttcccaaggcagtacttcgccctgagaaagatccttaagcagctcatcgcagacgtcacactggatcctgagacagctcaccccaacctcgttctcagtgaggataggaagtctgtaaagttcgtggagacacgcttgcgcgatcttcctgatactccccgacggtttacattctatccttgcgtgctggcaactgagggcttcactagtggcagacactactgggaagtggaagttggggataaaacgcattgggccgtgggagtgtgcagagatagcgtgtccagaaaggggggttgtggctacggaatgggaacgaacatgcagccccctccacacctgttgcctctgtgcacatctcgctag

SEQ ID NO: 209759 - DNA, 1254 bp, Artificial Sequence
  Description of Artificial Sequence: Synthetic coding sequence
atggtggagatcgccaagcagctgcaggccgtgaagcggaagatccgcgacgagtccctgtgtccacaacaccacgaagccctgtcgctgttctgttacgaggatcaggaagctgtctgtctaatatgcgccatcagccacactcaccgagcccatacagtggttccactggacgatgcaacgcaggaatacaaggaaaaactgcagaaatgtcttgaaccactggagcagaaacttcaggagattacaagatgcaagagcagtgaggaaaaaaagccaggggaactgaagcgtctcgtggagagcaggcgtcagcagatactaagagaatttgaagagttgcaccggagattagatgaagaacagcaggtgctgttgagccggcttgaggaggaagaacaggacattctccaaagactgcgggaaaacgctgcacacctgggagacaaacgacgtgacttagcccacctggccgctgaagtcgagggcaagtgtcttcaatcgggatttgaaatgctcaaacctgtcctatcggcaagggaagaatgcgagaaagtgaaaacaatggaggtcaccagtgtgagtatcgaattggagaagaacttctcaaacttcccaaggcagtacttcgcattgaggaaaatacttaagcagctcattgctgatgtcactttggatccagaaaccgctcacccaaacctggtactttctgaagaccgaaagtcagttaaatttgtagagactcgcttgcgagatctgccagataccccccggagattcaccttctatccctgcgttcttgccacagagggctttacaagtggccggcactactgggaagtcgaagcagctcattgtgttctggctcaggatcctgagaaccaggcattagctagattctactgctacacagagagaaccattgccaagaggctggtcctgcgcagggacccgtctgtcaagaggaccctctgccggggctgctcctctctgttggtacccggactcacctgtacacatcgacagaggagatgcaggggccagagatggacggtgcagacctgtctgacctgtcagcggtctcagaggttcctgaatgacccagggcatcttctatggggcgaccggcctgaggcccagttagggtcgcaggccgactccaaaccattacagccattacccaacactgcccattccatcagcgaccgtttaccagaagagaagatgcagactcagggttcctcaaatcaatag

SEQ ID NO: 209760 - DNA, 1557 bp, Artificial Sequence
  Description of Artificial Sequence: Synthetic coding sequence
atggccgagaccagcctgctggaggccggcgccagcgccgccagcacagcggcagccctggaaaacctgcaggtggaggcgagttgctctgtttgtctggagtatctaaaagaaccagtcattattgaatgtggacacaatttctgcaaagcatgtattacaaggtggtgggaagatcttgaacgcgattttccatgccccgtgtgccgaaagacttcacggtacagaagtctgcggccgaatcggcagctgggctcgatggttgaaatcgccaagcagctgcaagctgtcaagcggaaaatccgggacgaatctctatgtccccagcaccacgaggcgctttcattattctgttacgaggaccaagaagccgtttgcctcatttgtgctatttcccacacccatagggcccatacagtagttcccctggacgatgccacccaggaatataaggaaaaactgcaaaaatgcctggaacccctggagcaaaagctgcaggagattacaaggtgcaaaagttctgaagaaaaaaagccaggcgagctgaagcgactggtagagagcagacgtcagcagatcctgagggaatttgaggagctgcatcggaggctcgatgaggaacagcaggtgctcttgtcaagacttgaggaggaagagcaggatatcctgcagaggctgagagagaacgctgcccatctgggagacaaacgaagagatctggcacatctggccgcagaggtagaagggaagtgcctccagtctggcttcgagatgttaaaacccgtgctgtccgcccgagaaaaaaacatcccccggaaattcggaggaagccttagtactatttgtccgcgcgatcataaggcacttctgggcctggtgaaggaaattaaccgctgcgaaaaggtgaaaaccatggaagtgacgagtgtctcgatagaactagaaaaaaacttctctaacttcccccggcagtatttcgctcttcgaaaaattctgaagcagcttatcgctgatgtgacgctggacccagagactgcccatccaaatctggtcctgagtgaagaccgcaaatcggtaaaattcgttgaaacacgacttagagatcttcccgacactcctagacgctttaccttctacccctgcgttctggcaacagaaggctttacttctgggcggcactattgggaggtggaagtgggcgataagactcattgggccgtgggcgtatgccgcgattccgtctcccggaagggagagctgacacccctacccgagactggatattggcgggtccgattatggaacggcgacaagtatgctgctaccacaaccccgtttacccccttgcacattaaagtcaagccaaagagggtgggtattttcctcgactacgaggcggggactctatcattttacaatgtgacagatcgaagtcatatatatacgtttactgacacattcaccgagaagttgtggccacttttctaccctggaattcgtgccggccgcaaaaatgcagctcccctgaccatccggccaccaaccgattgggagtag

SEQ ID NO: 209761 - DNA, 1254 bp, Artificial Sequence
  Description of Artificial Sequence: Synthetic coding sequence
atggtggagatcgccaagcagctgcaggccgtgaagcggaagatccgagatgaatccttgtgcccacagcatcacgaggcactctctctcttctgttacgaggaccaggaagccgtgtgtctgatctgtgccatcagccacacacacagagcacacacggtggtgcctctggatgacgcgactcaggagtataaagagaaactgcaaaagtgtctagagccactggagcagaagttgcaagaaatcacaaggtgtaagtcatctgaggagaagaagcccggcgagctcaagcgccttgtggagagcagacggcagcagatcctcagagagttcgaggagctgcaccgacggttagacgaagagcagcaggtgttgttgtcccgcctggaggaggaagaacaggacatattacagcggctgcgtgaaaacgctgcacacctgggcgataagcggagagacctggctcacttggctgctgaagtggagggcaagtgtctacaatccggtttcgagatgctcaaaccggtattgtcagctagagaggaatgcgaaaaagtgaagactatggaggtgacaagcgtgtccatagagcttgaaaagaatttttcaaatttcccgagacaatacttcgccctgagaaaaatcctgaagcaactcatcgccgatgtaacattggatccggagacagcccatcctaacctggtgctgagtgaggatcgtaagtctgtgaaattcgtcgagacacggctcagggatctgcctgacacccctcgccgattcactttttatccctgtgtcctggccaccgagggctttacctccgggcgccactactgggaagtcgaggctgctcactgtgttcttgctcaagaccctgagaatcaggcattagcacgcttctactgctatactgaaaggactattgcaaagcgactggtacttaggcgggaccctagcgttaaacgcacactgtgccgagggtgtagcagcctcctcgtacccggtcttacatgcacccagaggcagagacgctgccgcggtcaacggtggaccgtgcagacctgccttacttgccaaagatcccagaggttcctcaacgacccgggccacctgctgtggggagatcgccccgaggcacaactggggtcccaagccgactcaaagcctcttcaacctctgccaaacacggcccacagtatctctgaccggctgcccgaggaaaaaatgcagactaaggggagttctaatcaatag

SEQ ID NO: 209762 - DNA, 1236 bp, Artificial Sequence
  Description of Artificial Sequence: Synthetic coding sequence
atggccgagaccagcctgctggaggccggcgccagcgccgccagcacagctgctgcactggaaaatttgcaggtggaggcgagttgctcggtttgcctagagtatctcaaagagcccgtcataatagagtgcggacacaacttttgcaaggcatgcatcaccaggtggtgggaggatctcgaacgggactttccatgccccgtctgccgtaaaactagtcgatatagaagtctacgacccaacagacagcttggttcaatggtggaaattgccaaacagctgcaggccgtgaaaaggaaaatccgtgatgagtccctgtgtccacagcatcatgaagctctgtccttgttttgttacgaagatcaggaggccgtttgcctcatttgtgccatcagccacacccacagggcgcataccgtggtcccactagatgacgcgacacaggaatacaaagagaagctgcaaaaatgcctcgagcccctggaacagaagctgcaggagataaccagatgtaagtctagtgaggagaaaaaacccggagagcttaagaggctggtcgagtcacggcggcagcagattctgcgagagttcgaggagctccacaggcgcctggacgaagaacagcaggtgctgctctccagactggaagaggaggagcaggatatccttcaaagacttcgggagaacgctgcacatctgggggataagcgccgggaccttgctcatctggctgctgaagttgaagggaagtgtctgcagtccggtttcgagatgttgaagcctgtgctgtccgccagggaggagtgcgaaaaggtgaaaactatggaggttacttctgtttccattgaattggagaaaaatttttctaactttccaaggcagtactttgcattgagaaaaattctgaagcaattgattgccgatgttactctcgatcctgaaactgcccatcccaacctcgtgctgagtgaagaccgcaaaagcgtaaaattcgtggagaccaggttgcgcgatctacccgacacaccacggagattcaccttctacccctgcgtcctagctacggaggggtttactagcggcaggcattactgggaggtcgaagtaggtgacaaaactcattgggcagtcggagtgtgtagagacagcgtgtcacgaaaaggcggatgcggctacggaatgggcacaaacatgcagccacccccacacctgcttccgctgtgtacatctaggtag

SEQ ID NO: 209763 - DNA, 1254 bp, Artificial Sequence
  Description of Artificial Sequence: Synthetic coding sequence
atggtggagatcgccaagcagctgcaggccgtgaagcggaagatcagggacgagagcctctgcccgcagcatcacgaagcccttagcttattctgttacgaggaccaagaagcagtgtgcctcatctgcgccatctcgcacactcaccgggctcatacggtggtgcccctcgatgatgctactcaggaatataaagagaagttgcagaagtgcctagaacccctggagcagaagctccaggaaatcacacgatgtaagagctccgaggaaaaaaaaccaggcgagctgaagagactcgtcgaatctaggagacaacaaatactacgtgagttcgaggagctgcaccgcagattagacgaagaacagcaggtgctgctcagtaggctcgaagaggaagagcaagatatactgcagaggcttagagagaacgccgctcatcttggtgacaagaggagggacctcgcacatttagcagctgaagttgaagggaaatgtttgcagtccggctttgagatgctgaaacctgtgctgtcagcccgcgaggagtgcgagaaagtgaaaaccatggaagtaactagcgtatctatagaactggaaaagaatttcagtaactttccgcgacagtactttgccctgagaaagatcctgaaacagctgatcgcagacgtgacacttgacccagagacggcacatcctaatctggtgctgagtgaggacagaaaatccgtgaagtttgtggaaacacggctaagggacctgccagacacacctcgcagatttactttttatccttgtgtcctagcgaccgaagggtttacttccgggaggcactactgggaggtggaggcggcccactgcgtcttagcacaggatcctgagaatcaggccctggctcgattttactgttatacagagcggacaatcgccaaaaggctggttctgaggcgggacccttccgtcaagcgcaccctatgcaggggatgcagcagcctcctcgttccaggcctcacttgcacccaacggcagcgacgctgccgcggtcaacgctggacagttcagacctgtttaacgtgccagagaagccagcgatttttaaatgacccgggccacctgctgtggggtgaccggcctgaggcacagctcggctcacaggctgactccaaacctttgcaaccactgcccaacaccgcacatagcatctcggacaggctccccgaagagaaaatgcaaacccagggaagcagcaaccagtag

SEQ ID NO: 209764 - DNA, 1557 bp, Artificial Sequence
  Description of Artificial Sequence: Synthetic coding sequence
atggccgagaccagcctgctggaggccggcgccagcgccgccagcaccgcagctgcactggagaatttgcaggtcgaagcttcctgtagtgtatgtctcgaatacttgaaggagcctgtgatcattgaatgtggccacaatttttgtaaggcgtgtattacacggtggtgggaggatttggaaagagacttcccatgccccgtgtgtagaaagacatcaaggtatcgcagtttgcgtccgaatcgccagctgggaagtatggttgagatcgcgaagcagctgcaggcagttaaacggaaaattagggatgagtctttgtgcccacagcaccatgaagcactatcactgttctgttatgaagaccaagaggcggtgtgcttgatttgtgccatatcacacacccacagggcccacacagtggtacccttagatgatgctacgcaagagtataaggaaaaattgcagaagtgtctggagcctctggaacagaagctccaagaaattacaaggtgtaaaagttctgaggagaaaaaacccggtgagctgaaacgcttagtggaatcacgaagacaacaaatcctgcgggaatttgaggagctgcaccgtcgcttggacgaggagcagcaggtgctcttaagcaggctggaggaggaggaacaggatatcctccagaggctgcgagagaacgccgctcacctgggtgataaaaggagggacttagcccaccttgcggccgaggtggagggaaagtgccttcaaagcggcttcgaaatgctgaaggacgtgaagtcaaccctggaaaaaaatatcccacggaagtttggtgggtccttatccaccatctgtcctagagaccacaaggctttacttggcctggtcaaggagatcaaccgatgcgagaaagtgaagacaatggaggtgaccagcgttagcatcgaactcgaaaaaaacttcagcaattttccacgccagtattttgcccttcgaaagatcctcaagcagcttattgctgacgttactctggatcctgaaactgcccacccaaacctcgtcctctccgaagataggaaatctgttaagttcgtggaaacacggctccgggatctacctgatacacctaggcgtttcacattctatccatgcgtcttggccacagaaggtttcacatctggccggcactactgggaagtcgaagtcggtgataaaacccactgggctgtgggcgtctgtcgcgactcagtgagtagaaaaggtgaactgacacctttgcctgagacagggtattggcgagtccggctctggaatggggataagtacgctgctacaacgacgccattcaccccacttcacatcaaggttaaacctaagcgagttggcatttttctggattacgaggctggaaccttatcattctacaacgttacagatagatctcacatctacactttcacggacacattcaccgagaaattgtggccactcttttatcccggcattagagccgggagaaagaacgcggccccactgaccatccgaccacccacagactgggagtag

SEQ ID NO: 209765 - DNA, 1557 bp, Artificial Sequence
  Description of Artificial Sequence: Synthetic coding sequence
atggccgagaccagcctgctggaggccggcgccagcgccgccagcaccgccgcggccttggaaaatctgcaggtggaggcttcatgttcggtgtgcctagagtacctcaaagaacccgtgatcattgaatgtggccacaatttctgcaaagcgtgcatcacacgctggtgggaagatttagagcgagattttccatgtcctgtctgccggaaaaccagtcgttacagaagcctacggccgaaccggcagctcgggtctatggtggaaattgccaagcagctgcaagccgtgaaaaggaagattagagatgaaagcctgtgccctcaacatcatgaagcattgagcttattttgttacgaagatcaagaggcggtgtgccttatctgcgctataagtcacacacaccgggcacacaccgtggtcccacttgacgacgccactcaggaatacaaagagaaactccagaaatgtctagagccgttggagcaaaagctacaggagattacacgctgcaaatcttcagaagagaaaaagccgggggagctcaagcggctggtggagtctcgcaggcagcagattctcagagagtttgaggagctgcaccggaggttggacgaggaacagcaggtgcttctgtcacgattagaagaagaggaacaggacattctgcagcgtctgcgagagaatgccgcccatctcggggacaaacggcgcgatttagcacaccttgctgctgaagtagaagggaagtgtcttcagtctggcttcgagatgctgaaggatgttaagtctaccctggagaagaacattccccgcaaattcgggggttccctctctacaatctgcccacgggaccataaagctctattagggcttgtgaaggagataaatcggtgcgagaaggtgaaaaccatggaggtgactagtgttagcatagaactcgagaagaacttttcgaactttccaagacagtactttgctctgaggaaaatactcaagcaactgattgccgacgttacccttgaccctgagactgctcacccaaacctggtgctgtctgaagaccgcaaatcagtgaagttcgtcgagacacgcctgcgcgatctgcctgatacacctcggaggttcacattttacccttgcgtcctcgcaacggaaggttttacttccggtcggcattactgggaggtggaggtaggtgataagacgcactgggccgtaggcgtgtgtagggacagtgtttccaggaagggcgaactgaccccgctgcctgaaactgggtactggcgcgttaggctttggaatggcgataaatacgcagcaactaccaccccattcacacccctccatataaaagttaagcccaaaagggtcggaattttcttggattatgaggccggtacgttgtccttttataatgtgaccgataggtcccacatttacaccttcacagacaccttcacagagaaactttggccattgttctacccaggaatccgcgccggacgcaaaaacgcagctccactgacaatccgcccacctaccgactgggaatag

SEQ ID NO: 209766 - DNA, 1467 bp, Artificial Sequence
  Description of Artificial Sequence: Synthetic coding sequence
atggccgagaccagcctgctggaggccggcgccagcgccgccagcactgccgcagctctggagaacttacaggttgaagccagctgctccgtctgcctggagtatctcaaagaacccgttattattgaatgtgggcacaacttttgtaaggcctgtattactaggtggtgggaagatctggaaagggacttcccctgtccagtgtgtcgaaagacaagcagataccgctccctccgacctaatagacagttgggctccatggtcgagattgctaaacagttgcaagctgtcaagaggaaaataagagacgaatctctctgccctcagcaccacgaggccttgtcgcttttctgctacgaagatcaggaggccgtgtgcctaatttgtgccattagccatacacatcgggcccatacggtcgtgcctcttgacgacgccacccaggagtataaggaaaaactgcagaagtgcctggagcctttggagcagaaactgcaggaaatcacaagatgtaaaagctcagaggagaaaaagccaggcgagcttaaacggctagttgagtctagaaggcagcagatcctgagagaatttgaagagctccatcgccgtctcgacgaggaacaacaggtgctcctgtctcggctggaggaagaagaacaggacattctccagagactgagagagaatgctgctcacttgggtgacaagcgcagggacctcgcccatcttgcagctgaggtggaaggaaaatgtctgcaatccggctttgagatgttgaaaccggtcctctccgcccgcgaggagtgcgagaaggtgaaaaccatggaggtgactagtgtgtcaatagagctggaaaagaacttcagcaactttccccgccaatatttcgccctgcgcaagatcttaaaacaactcattgccgacgtgacgcttgacccagagacggcgcaccctaatctggttctgtcagaagatcggaaatcagttaagttcgtggagaccaggctgagagacctgcctgataccccgcggagattcacattctatccgtgcgtcttggctacagaggggtttacctcaggacgacactattgggaggtggaggtgggggacaagacacactgggctgtcggtgtgtgtagagattctgtgtcaaggaagggagaactcacacccctaccggagactgggtattggagagtccgtctatggaatggcgataagtatgctgccaccacaaccccttttacaccgctgcacatcaaagttaagccaaagagagtagggatcttcctagactatgaggccgggacattgagtttttacaacgtgactgacagatcacatatatatacattcaccgacacattcacagaaaaactgtggcctcttttttaccctggtatccgagctgggcgaaaaaacgctgctccactgacgattaggcctccaaccgattgggagtag

SEQ ID NO: 209767 - DNA, 1467 bp, Artificial Sequence
  Description of Artificial Sequence: Synthetic coding sequence
atggccgagaccagcctgctggaggccggcgccagcgccgccagcacggctgccgctctggaaaacctacaggtcgaagcaagctgtagtgtttgcctggagtacttaaaagagcccgtcatcattgaatgcgggcacaacttctgtaaagcttgcataacccggtggtgggaggacctggaacgggattttccttgtcccgtgtgccgcaagacctcccggtaccgctcgttgcgccctaacagacagctgggttctatggtggaaatcgctaaacaattgcaggccgttaagcgaaagatccgcgacgaaagtctctgtccccagcaccacgaggccctgtccctcttttgttatgaggaccaggaagctgtctgcctgatctgcgcaatttcacacactcatagagctcataccgtagtgccactggatgatgccacgcaggaatataaggagaagctgcaaaaatgtctggagcctcttgagcagaagctccaagagattacccgatgtaagtcctcagaggagaaaaagccaggtgagctgaagcgcctagttgagagccgccgtcaacagattttaagagagttcgaggaactgcataggaggctggatgaagaacagcaagtgctcctctcccggctggaggaagaggagcaagatatcctccaacggctgcgagagaatgccgcgcacttgggtgataagaggcgagatctggcccatttggccgctgaagttgaaggcaaatgtctccaatcgggctttgaaatgctgaagcctgtgctgtcggcaagggaggaatgtgagaaagtgaaaacgatggaagttaccagcgtgtcgatcgagttggagaagaatttctctaactttccacgccagtattttgcattacgcaaaattctcaaacagctgattgctgacgtgaccctggatcctgaaacggcacatccaaatcttgttctcagcgaagaccggaaatcagtaaagtttgttgagacgcggctcagggatctgcccgacacaccgaggcgtttcactttctatccgtgcgtgttggccacagaaggatttacctcaggtagacactattgggaagtggaggtaggggacaagactcactgggccgtgggggtgtgcagggattccgtctcgcgaaagggggagctgacacctctgccagaaacgggctattggcgggtgaggctttggaatggggataagtacgccgctacgactaccccattcacccccctgcacatcaaagttaagccgaagagagttggcattttccttgactacgaggctgggacgcttagtttttacaatgtgaccgacaggtctcacatttatacattcacagatacattcacagaaaagctgtggcccctgttctaccctgggattagagccggtcgtaagaacgcagcccctctgacgatccgtccaccaacagactgggagtag

SEQ ID NO: 209768 - DNA, 1254 bp, Artificial Sequence
  Description of Artificial Sequence: Synthetic coding sequence
atggtggagatcgccaagcagctgcaggccgtgaagcggaagatccgggacgagagtctgtgcccccagcaccatgaagcactctctctgttttgttatgaggatcaagaggccgtgtgcctgatatgtgctatttcccacacgcaccgagcacataccgtcgtgccattggatgacgcaactcaagaatacaaagagaagttgcaaaagtgtcttgaacccttggagcagaagctgcaagagattacacgctgcaagtccagcgaggagaaaaagcctggggagctgaaaaggctggttgagagtagacggcagcagattctgcgggagtttgaggagctgcatcgacgcctcgatgaggagcagcaggtgttgctgagcagacttgaggaagaagaacaagatattctgcagcggctgagagagaacgccgctcacctgggagacaagcggcgcgatctagcccatctggccgccgaagtggaaggaaagtgtctgcaaagtggcttcgaaatgctgaaacctgtgctcagtgctagagaggaatgcgaaaaggtaaagaccatggaggtgacctctgtgtctatcgagctggagaaaaacttctctaattttcccaggcagtactttgcactgaggaaaatcctcaagcagctgattgcggatgtgaccctcgacccggaaacggcccacccaaatctagttttgtcagaggaccggaaatccgtaaaattcgtggaaacccggctccgggacctgcccgacaccccccgtagatttacattttacccctgcgtgttagcgactgaaggctttacatctggccggcactactgggaggtggaagctgcacactgcgtgctcgctcaggaccctgaaaaccaggcccttgccaggttctactgctatacagaaagaaccattgctaagcgactcgtcctgcgaagggatcccagcgtgaaaagaacactctgtcgtggttgttcctctctgctggtacctggcctgacctgcacgcagagacagagacggtgcaggggacagcgttggaccgtacagacttgcctcacttgccagagatcccagcggttcctgaatgaccccggccacctgctgtggggtgaccgccctgaagcacagctgggcagccaggcagacagcaaacccctgcagccactcccgaatactgcacactccatcagtgatcgtctccctgaagagaagatgcaaacgcagggcagcagtaaccagtag

SEQ ID NO: 209769 - DNA, 1893 bp, Artificial Sequence
  Description of Artificial Sequence: Synthetic coding sequence
atggccgccgtggccatgacccccaaccccgtgcagaccctgcaggaggaagcagtctgcgctatttgcttggactacttcactgaccctgtgagcatcgggtgtgggcataacttttgccgggtgtgtgttacacaattgtggggtggagaggatgaagaggacagagacgagctcgatcgcgaagaagaggaggaggacggcgaggaggaggaggtcgaggcggtgggggccggagctggatgggatactcctatgcgggacgaagattacgagggtgacatggaagaagaggtggaggaggaagaggagggggtgttttggacctcgggcatgagtaggtcgtcttgggataacatggattacgtgtgggaggaagaagatgaggaagaggatctggactactacctgggcgacatggaggaggaggacctgagaggagaggatgaagaggacgaagaagaggtcctggaggaagtggaagaggaagacctggaccccgtgacacctttgccacctcctccagctccgagacgctgctttacttgtccacagtgtcgcaagtcttttccgcggaggtccttccgcccaaacctccaactggcgaatatggtgcaagttattaggcagatgcatccgacccccgggcgcgggtcaagagtgacagaccaaggcatttgcccgaagcatcaggaagctcttaagcttttctgtgaggtcgacgaagaagctatctgcgtcgtgtgcagagaaagtaggtcgcacaaacagcactccgtggtgcccctggaagaagtcgttcaggagtacaaagccaagctgcagggtcacgttgaacccctcaggaagcaccttgaggctgttcagaaaatgaaagccaaggaggaaaggcgggttaccgaactcaaatcccagatgaagtccgaacttgccgctgttgcatctgaatttggtaggctgacaaggtttctcgcggaagaacaggcagggcttgaaagacggctgagagaaatgcacgaagctcaactgggcagggctggcgccgcagcttcgagattagccgaacaagccgctcagttaagcagactgctcgccgaggcccaggaacgctcgcagcaggggggactccggctgttacaggacatcaaagaaaccttcaatagatgtgaggaagtgcagcttcagccccccgaggtttggagcccagacccttgtcagcctcacagtcatgactttttgactgacgctatagtccggaaaatgagtcggatgttttgccaggcggccagggtagatctgactctggaccctgatactgctcaccctgccctgatgctttccccagaccggcgaggagttaggttagccgagcgaaggcaggaggtcgcggaccatccaaaacgcttctccgcagattgttgtgtgctgggggcccagggcttcaggtccggccgtcattactgggaagtcgaagttggtggacgacgagggtgggccgtcggcgctgccagagaatctactcatcacaaagagaaggtgggaccaggcggtagttccgtgggcagcggagacgccagctcttcacggcaccatcaccgccgccggcgtctccacctgccgcagcagcccttactacagcgggaagtgtggtgtgtaggcaccaacggaaagagataccaggctcaatcctcaacagagcagacgctgctctcccccagtgagaagccgaggaggttcggtgtttatctggactacgaggctgggcggcttggcttctacaatgcggaaaccctggctcacgtgcatacattctctgctgcctttctcggcgagcgcgtgtttcctttcttcagagtcttgagcaaggggacacgcatcaagctgtgcccctag

SEQ ID NO: 209770 - DNA, 1557 bp, Artificial Sequence
  Description of Artificial Sequence: Synthetic coding sequence
atggccgccgtggccatgacccccaaccccgtgcagaccctgcaggaggaggcagtctgtgctatttgcctggattatttcactgacccggtttcaattgggtgcgggcataatttctgtcgagtgtgcgtcacccaactttggggaggagaagacgaggaggatcgcgatgaactggacagggaagaagaagaggaggacggggaggaggaagaagtggaagctgtcggcgccggcgcgggatgggacacacccatgcgcgacgaagactatgaaggcgatatggaggaggaagtcgaggaggaggaggagggagtgttttggacatcgggcatgagccgaagttcatgggacaacatggattatgtatgggaggaggaagatgaggaagaagacctggactactatcttggagacatggaggaggaggacctgaggggcgaagacgaggaagacgaggaagaggtccttgaggaggtggaggaggaggacctggatccagtgacccccctgcctccccctccggccccacgcaggtgtttcacatgtccacagtgtagaaagtcctttcctagaaggagctttcggccaaacctccagcttgctaacatggtccaagtgatccgccaaatgcatcccacgcccggccgagggtcgcgggtcacggaccaaggtatctgccccaaacatcaggaagcactcaagctgttttgcgaagttgatgaggaggcaatctgtgtcgtgtgcagagagtcacggagccataagcagcacagcgtggtacccctggaggaggtggtccaggagtataaagctaagttgcagggtcacgtcgaacctcttcgcaaacacctcgaagctgtgcagaagatgaaagcaaaagaagagcgccgtgtcacagagctgaaatcccagatgaagagcgaattagccgccgtcgcaagtgagtttggacgactcacccgcttcctggccgaggaacaagcgggactggagcgtcggctgagagaaatgcacgaagctcagcttggcagggctggtgccgccgcgtccagattagccgaacaggccgctcaactctcacgtctgcttgctgaggcccaagaacgaagccagcaagggggcctccgactattacaggacattaaagagacattcaacagatgcgaggaagtccagctccagcccccagaagtctggtctccagatccatgccagcctcacagccacgatttcttgacagacgcaattgtgagaaaaatgtctaggatgttttgccaagcagctcgggtcgacttgaccctcgatcccgacaccgctcatcctgctttaatgctcagtcccgaccgaagaggagtaaggcttgccgaacgccggcaggaagtggcggatcaccccaagcggttttcagcggattgttgtgtactgggcgctcagggattccgctccggccgccactactgggaggaacctaaggaaccgtcctggcctccggcccagcccagtctaacctattacgtgtgtccaaccgatagacccgagttctccttcacttag

SEQ ID NO: 209771 - DNA, 453 bp, Artificial Sequence
  Description of Artificial Sequence: Synthetic coding sequence
ctgcaggaggaggccgtgtgcgccatctgcctggactacttcaccgacccagtgtctataggatgcggccacaatttctgccgagtatgtgtaacacagttgtgggggaggcgcggaggtggctctggaggctacccagttacgcctctccccccgccaccagccccccggcgctgctttacatgccctcaatgtcggaagagctttccacgtcgatcttttcggcccaacctccaactcgccaatatggtgcaggttatccgccaaatgcacccaacgcctggcaggggctcccgggttacggatcaagggatttgccctaaacaccaggaagcgctcaagctgttttgcgaggtcgacgaagaagccatttgtgtggtgtgccgtgagtcacgctcacacaaacaacattccgtagttccgctggaggaagtggtccaagaatataaatag

SEQ ID NO: 209772 - DNA, 948 bp, Artificial Sequence
  Description of Artificial Sequence: Synthetic coding sequence
atgaaggccaaggaggagcggcgggtgaccgagctgaagagccagatgaagtccgagctggctgcagtggccagtgaattcgggcgcttaaccaggtttctggccgaggagcaggcgggcctcgagcggagacttagagagatgcacgaggctcagcttggtcgggccggcgcagccgcgagtagactggcggaacaagcggctcagctcagtaggttgctggcagaggcccaggaaaggagtcagcagggaggcttaagactgctgcagcaggacattaaagagacctttaaccgttacgctatagttcgaaaaatgtctcggatgttttgccaggccgcccgcgtggatcttaccctcgatcccgacacggcacacccagcacttatgctttctcccgatcggcggggggtgcgcctcgccgagaggagacaggaggtggccgaccaccctaagcgcttttctgctgattgctgtgtactgggtgcgcagggcttcagatctggccgccattactgggaggttgaggtgggcggtcgcagaggctgggctgtaggcgctgcgagagaaagcactcaccacaaagaaaaggtcggccctggcggatcctctgtggggtctggcgatgcgagctcgtcaaggcatcatcacagaagaaggcgcctccaccttccccaacaacccctgctccagagagaggtgtggtgcgtcgggaccaatgggaaacggtatcaggcccaaagttcaactgaacagaccttactgagcccttccgagaagcctcgaaggtttggagtgtatctggattacgaggccgggagattaggcttctacaatgctgaaacgttggctcacgtgcacaccttttccgccgcatttctgggagagagggtttttccattctttcgcgtgctctcaaaagggacccgaatcaagttatgtccttag

SEQ ID NO: 209773 - DNA, 1035 bp, Artificial Sequence
  Description of Artificial Sequence: Synthetic coding sequence
atggccagcggcgtgggcgccgccttcgaggagctgccccacgacgggacatgtgacgaatgtgagccagatgaagcaccaggtgccgaggaagtttgccgagagtgtgggttctgctactgtaggcggcacgctgaggctcatagacagaagtttctaagccaccatctcgcagagtatgtacacgggagccaagcgtggacaccccctgcggacggagagggcgccgggaaagaagaagcagaggtgaaggtggaacaggagcgggagattgaaagcgaggccggagaggagtccgaatcagaggaagagtccgagtctgaagaagaatctgaaacagaggaagagagcgaagatgagagtgatgaagaaagcgaggaggattctgaagaggaaatggaggatgagcaagagagtgaagctgaagaggataatcaggaagagggagaatctgaggccgagggtgagacagaggcagaaagtgagttcgacccggagatcgagatggaggccgaacgagttgccaaaaggaagtgtcctgatcacggtctggatcttagtacttactgtcaggaagaccggcaactgatatgcgtgctctgtcccgtgattggcgcacatcagggacaccaactctctaccctggatgaagctttcgaagagttgcgatccaaggactcgggcggactcaaggccgctatgattgaactcgtcgagcggttaaaatttaagtccagcgatccgaaggtcacacgagaccaaatgaagatgtttatccagcaagagtttaagaaagtacaaaaagtgattgccgacgaagaacagaaggccctccatctcgtcgacattcaggaggcaatggcaactgctcacgttaccgaaatcctcgccgacatccagagtcacatggatagactgatgacacagatggcccaagctaaagagcaactagacactagcaatgagtccgcagagccaaaggcagaaggggacgaggaaggcccctctggcgcctccgaagaggaggacacgtag

SEQ ID NO: 209774 - DNA, 1743 bp, Artificial Sequence
  Description of Artificial Sequence: Synthetic coding sequence
atgagcgagaaccggaagcccctgctgggcttcgtgagcaagctgacttcaggcactgctcttggtaattctggcaagacacactgccccctctgtttaggattatttaaggctcctaggctgctcccatgcttacacacggtgtgtaccacctgcctcgaacaattggagccattctcggtggtcgatatccgggggggggatagcgatacatcttccgagggcagcatatttcaggagctcaaaccccggagcctacagtcacagattggaatcttatgtccagtgtgcgacgcgcaggtcgatctgcccatggggggcgtgaaggccttgaccatcgaccaccttgcagtcaacgacgtcatgctcgaaagcttaaggggtgagggacaaggactcgtttgtgatctgtgtaacgatcgcgaggtagagaagcggtgccaaacttgcaaggctaatctgtgccatttctgttgtcaggctcacagacgccagaaaaagacgacctaccatacaatggtcgacctgaaggaccttaaaggatactcccgtatcggtaagcccatcctgtgtccagtgcaccctgccgaagagcttaggctcttttgtgaattttgcgatcgaccagtatgtcaagactgtgtggttggcgaacacagagagcacccttgcgacttcaccagtaatgttatccataagcacggtgactcagtttgggagctgctgaagggcacccagccacatgtggaggccctggaggaagctttggcccagatccacataatcaattctgccttgcagaaacgcgtggaagccgtagcagccgacgtccgcactttttcagagggatatatcaaagccatcgaggaacaccgcgataaactgttgaaacagctggaggacattcgcgctcagaaggaaaatagcctccagttgcagaaggcccagctagagcagctgctggccgatatgcggacaggagtggaattcaccgaacacctgctcactagcggtagcgatctggagattttaatcacaaagcgcgtcgtggtcgaaaggctacggaagctaaacaaggtccagtacagcacacggcccggtgtgaacgacaaaatccgcttctgcccacaggagaaagccggacagtgtcgcggctatgaaatctacggaacaataaacaccaaggaggtggacccggccaagtgtgtcctacagggcgaggacctccatagggcccgtgaaaaacaaacggcatcctttaccctcctttgcaaggacgcagcgggtgaaataatgggccgcggaggtgacaatgtgcaggtcgccgtggtgcccaaggataagaaggacagtcccgtacgcaccatggttcaggacaacaaagatgggacctactacatatcctacacgccaaaagagcccggtgtgtataccgtgtgggtctgtatcaaggagcaacacgtgcagggaagcccttttaccgtgatggtgcggaggaagcataggccacactccggcgtgtttcactgctgcaccttttgctcctcaggtggtcaaaaaacagctcgctgtgcttgcgggggcacaatgccaggtggataccttggatgcggccacggtcacaaaggccacccggggcatcctcactggagttgttgtggcaaattcaacgaaaagagcgagtgcacgtggaccggagggcagtccgccccccgatctctgctgagaaccgtggcattatag

SEQ ID NO: 209775 - DNA, 1572 bp, Artificial Sequence
  Description of Artificial Sequence: Synthetic coding sequence
atgctgagcggcgtgaccctggagggcggcggcgcccggagcggcgagggcagaagatctcggaccgagttgaaaccccgctccctgcaaagtcagataggcatcctgtgcccagtctgtgacgcccaggtggacctgccaatgggtggtgtgaaggctctgactattgatcatctcgccgtgaatgacgtgatgcttgagtcgctcaggggcgaaggtcagggccttgtctgcgacctttgcaatgacagagaggttgagaaacgctgccaaacatgcaaagccaacttgtgtcatttctgttgtcaagctcacaggcgccagaaaaaaactacctaccacactatggtggacctcaaggatctcaaaggatatagtcggataggcaagcctattctctgcccagtgcatcctgcggaagaactccggctgttttgtgagttctgtgacagaccagtgtgccaggactgtgtggtgggcgaacatcgtgagcatccctgcgacttcacgtccaatgtcatccacaagcacggggactctgtgtgggaactgttgaaagggacacagcctcatgtggaggccctggaggaggcgctggcccagattcatatcatcaattcagctcttcaaaagagggtggaagctgtcgcagctgatgtgcggacattcagcgagggttacatcaaagctatagaggagcaccgcgacaagctactgaagcaattggaggatattagagcccagaaagagaacagtttgcagttacagaaggcacaactcgagcagctgctagccgatatgaggaccggagtcgaattcacagaacacctgttgaccagcgggagtgaccttgagatcttaattaccaagagagtcgtggtcgaaagacttaggaagctgaataaggttcaatactcaacgcgcccaggcgttaatgacaagataagattttgcccccaggagaaagctgggcaatgccgcggctatgagatttacggaactatcaataccaaggaggtggatccagccaagtgcgtgttacagggagaagacctgcatcgggcacgcgaaaagcagacagccagtttcacgctattgtgcaaagatgctgctggggaaatcatgggaagaggtggtgacaacgtccaggtggccgtcgtccccaaggataagaaggattcccccgtgaggactatggtgcaggataataaagatgggacctattatataagctatacaccgaaagagcctggtgtgtacactgtgtgggtgtgtattaaggagcagcacgtacaggggtctcctttcactgtgatggttagaagaaaacaccgcccacatagtggggtattccattgttgcacattttgttctagcggcggacagaagaccgctaggtgtgcttgcggggggacaatgcctggaggatatctggggtgcggacacgggcacaagggacaccctgggcatccacactggagttgctgtggcaaatttaacgaaaaatccgagtgcacatggacgggaggacagtctgcaccgagatccctcctgcggaccgtggccctgtag

SEQ ID NO: 209776 - DNA, 1689 bp, Artificial Sequence
  Description of Artificial Sequence: Synthetic coding sequence
atgagcgagaaccggaagcccctgctgggcttcgtgagcaagctgacttccggaaccgccttaggtaactccggtaagacccattgtcccctctgtctcggactgtttaaggcaccgagacttcttccatgcctgcacacagtgtgtaccacttgcctggagcagctcgagccattctcagtcgtggatatccggggaggagatagcgacacatcgtcagaggggagcatctttcaagagcttaagccacgttccctgcagtcccaaataggcatattgtgccccgtgtgtgatgcacaggtagacctcccaatgggcggcgtgaaagccctgactatagaccatctcgcagttaatgacgtaatgcttgagtccttgcgaggtgaaggccaggggctggtttgtgacctttgtaatgacagggaggtggagaagcgatgccagacatgcaaagcaaatttgtgtcatttttgctgtcaagctcaccggaggcaaaaaaaaaccacataccacaccatggtcgatctcaaggatctaaaaggttactcaagaatcgggaagccaattctttgccccgtccacccggcggaggagctgcgcttattctgcgagttctgtgaccggcccgtttgccaagattgcgtggtaggagaacaccgggaacacccctgcgattttacaagcaacgtcattcacaagcacggcgattctgtgtgggaactgctaaaagggacccagccccacgttgaggcattggaagaggccttggcccagattcacataattaacagtgcgctgcaaaaacgggttgaggctgttgccgccgacgtgcgcaccttttccgaagggtatattaaggcgatcgaagagcatcgcgacaaactgctcaaacagcttgaggatataagagcacagaaggagaacagcttacagcttcaaaaggcacaattggagcagttgctggctgacatgcgtactggcgtggaatttactgaacacttactgacaagtggatcagacctcgaaatccttattacaaagcgagtggtagtagagcggctgcgaaagctgaataaagtccagtactccactcgtccaggagtgaatgataaaatccgtttttgtcctcaggagaaggctggccagtgtagaggctatgagatctatgacttgcaccgcgcaagggaaaagcaaactgcttcgttcaccctcctgtgcaaggacgcggccggagagattatgggtcgcgggggggacaacgttcaggtcgcagtggtccctaaggataagaaggactctcccgtgcgcactatggtgcaggacaacaaagatgggacctactatattagctacaccccgaaggagcccggtgtctacacagtctgggtgtgtatcaaggaacagcacgtgcagggctccccattcactgtaatggtgcgcaggaaacaccggccgcactctggggtgttccactgctgcaccttttgctcctccggcggacaaaagactgccagatgtgcctgtggtggcaccatgcctgggggctaccttggctgcgggcatggccacaagggccatccaggtcatccccactggagttgctgcggcaaattcaacgaaaaaagtgagtgcacttggacaggaggtcagtcggccccacggagcctgttgaggaccgtagctctgtag

SEQ ID NO: 209777 - DNA, 1917 bp, Artificial Sequence
  Description of Artificial Sequence: Synthetic coding sequence
atggacggcagcggccccttcagctgccccatctgcctggagcccctgagggagcccgtaacacttccctgcggtcataatttctgcctcgcatgtctgggagcactttggccccatcgaggtgcctccggggcaggcggtcccgggggcgccgcaagatgcccactgtgccaggaaccttttccggacggcctgcagctccggaagaaccataccttgagcgagttgttgcagttgcgacagggctccggtcctgggagcggaccaggacccgcgccagctctggcaccggagccttcggcccctagtgccctccccagcgtaccggagccttctgccccatgcgctccagaaccctggccagcaggagaggaacctgttcgctgtgatgcttgtcctgagggcgcggcactcccagctgcactatcctgtttatcttgcctggccagtttttgtccagcgcacctgggccctcatgagcggtcacccgccttacggggtcaccgcctggtgccccctttgcggcggttggaagaaagtctgtgtcctagacaccttaggccccttgagcggtattgcagagccgagagagtttgtctctgcgaggcttgcgcagctcaggagcacagaggacacgaacttgtccctcttgagcaggagagggcccttcaggaggcggaacagagcaaggtgctgagtgctgttgaggacaggatggatgagctaggggctgggattgcccagtctcgaaggaccgtcgcccttattaagtccgcggcagtcgcagagcgcgaaagggtctctcgactcttcgccgatgctgctgccgctctacagggcttccagacccaggttctgggcttcattgaggaaggagaagccgcaatgttgggacgaagccagggcgacctaagaagacaggaggagcagaggagccgcttgtctcgtgccaggcaaaacctcagtcaggtccctgaggccgatagcgtgagctttctgcaggagctgcttgcacttcggctggccctagaggacggatgtggacctggccctggtcctcctcgcgaactgtcatttactaagagctcgcaggctgtaagggctgtgcgcgatatgctggcagtcgcatgcgtcaaccagtgggagcagctcagaggtcccggagggaacgaagatggcccccagaagctggactcagaagccgatgctgagcctcaggatctggaaagcacaaacctcttggagagcgaagccccacgggattatttcttaaaattcgcctatatcgttgatctggattccgataccgctgacaaatttctccagctgttcggcacaaagggcgtgaagcgggttctgtgccccattaattatccactctcacccactcgctttacacactgtgagcaagtactcggcgagggcgctctcgaccgagggacctattactgggaggtggagatcatagaagggtgggtgagcatgggagttatggcggaagatttttcaccacaagagccttatgatcgtggccggctgggacgaaacgctcattcttgctgcctccagtggaatggcaggtccttctctgtgtggttccatggcctagaagcgcctctccctcaccccttcagtccaacagtgggagtttgcctagaatacgccgacagggccctggctttctatgcagtgagggacggcaagatgtccctcctcagaaggctcaaagccagtagaccccgccgagggggtattcctgcttcccccattgaccccttccagtctaggctcgactcacactttgcaggtttatttacccacaggctgaaacctgcctttttcttagagtcagtggatgcccacctccagattgggcctctaaagaaatcttgcatctcggtgctgaaacggcgttag

SEQ ID NO: 209778 - DNA, 1482 bp, Artificial Sequence
  Description of Artificial Sequence: Synthetic coding sequence
atggccagcggcatcctggtgaacgtgaaggaggaggtgacctgccctatctgcctcgaactgctgacgcagcctttgagcctagactgcggccactccttctgccaggcgtgtctgactgccaatcataaaaaaagcatgctcgacaaaggcgagtcatcctgccccgtttgtcgcatttcctaccaaccggagaatatacgccccaatagacatgtggcgaacatcgtcgaaaagctcagggaggtgaagctgtctcctgaaggacagaaggtcgaccactgcgctaggcacggggagaagctcttgctcttctgtcaggaggacggtaaggtgatttgctggctatgcgagagatcacaagaacaccgcggccatcacaccttcctgacagaggaagttgctcgcgaataccaagttaagttacaggccgctttggagatgttgagacagaaacagcaggaagccgaagaattggaggcagacattcgcgaagagaaggcctcctggaagacacagatccagtacgataagactaatgtcctggctgattttgaacagttgagagacatcctcgactgggaggagtcgaatgaattacaaaacctggagaaggaggaagaggacatactcaagagtctgacaaatagtgagaccgagatggtccagcagacccaatcgcttcgggaactgatttcagatctcgagcatagactccagggatctgtcatggagctgctccagaaggtatccggcaaaatcctccggactgagaatgttactctaaagaaaccagaaacttttccgaaaaaccaacgcagagtcttccgagcccccgacctgaaagggatgcttgaggtcttccgtgagctgacagatgtcaggcgttactgggttgacgttacggtcgccccgaataacatcagctgtgcggtgattagtgaagacaagcggcaagtgtcatctcctaaacctcaaattatatacggcgcccgaggcacccgttaccagacatttgtaaactttaattattgcacaggcattctcggaagccagagtatcactagcggcaagcactattgggaggtggatgtaagcaaaaaaaccgcctggattctgggcgtttgcgccggtttccagcccgacgctatgtgtaacattgaaaagaacgaaaactaccagcctaaatacggctactgggttattggacttgaagaaggagttaagtgctccgcattccaagactcaagcttccacaccccctcagtcccctttattgtccccctatccgtaattatatgtcccgatcgagtcggcgtgttcctggattacgaggcctgcactgtgtcattttttaacatcacgaaccatggctttcttatttacaaattctcccactgtagtttctctcagcccgtattcccgtatcttaatccacgcaaatgcggtgtacctatgactttatgtagcccaagctcttag

SEQ ID NO: 209779 - DNA, 981 bp, Artificial Sequence
  Description of Artificial Sequence: Synthetic coding sequence
atggccagcggcatcctggtgaacgtgaaggaggaggtgacctgcccgatttgtctcgaactattgacacagcctttgtcactagattgtgggcactccttctgccaagcgtgcctgactgctaaccataaaaagagcatgctggacaagggcgagagttcctgccccgtatgtagaatttcttaccagccagagaacattcgaccgaaccgtcacgtggctaatatcgtggagaagctccgggaggtgaaactttctccagagggccaaaaagtggaccattgtgcacgccacggagagaagctcctgcttttctgtcaagaagatggtaaggtcatttgttggctttgcgaacgtagtcaagaacaccgcggccatcatacgttccttactgaggaggtggccagagagtatcaggttaaacttcaagccgctctcgagatgctgcgacaaaaacagcaggaggctgaggaactggaagctgacatcagggaagaaaaggcctcctggaagactcagatccaatacgacaaaacgaacgttctcgccgatttcgagcaacttcgggacatcttagattgggaagagagtaacgagctacaaaatctcgagaaggaggaagaggacattctaaaatctctgacaaactccgaaaccgagatggtgcaacagacacagagcttaagagaactgatcagtgacctggaacatcggctccaaggaagcgttatggagttgctgcagggagtggacggcgtgatcaagcgcacagaaaacgttacactcaaaaaacccgaaacctttccaaagaaccagagacgggttttccgggcccccgatttgaaagggatgctggaagtgttccgagaattgacagatgtgcgacgctattggggttggtcagctatggccagatccaggttcactgcaacctcaacaagtcagattcaggccattctgctcccacagccacctaagtag

SEQ ID NO: 209780 - DNA, 1482 bp, Artificial Sequence
  Description of Artificial Sequence: Synthetic coding sequence
atggccagcggcatcctggtgaacgtgaaggaggaggtgacctgccccatttgtctcgaactattgacacaacctctttctctagactgcggacacagtttttgccaagcctgcttaactgcaaatcacaagaaatccatgttggataagggcgaatcctcttgtcccgtgtgtagaatttcttatcaaccagagaacattaggcccaatcggcatgttgccaacatcgtggagaagctgagggaggttaagctgtctcccgagggccagaaagtcgaccactgtgctcgtcacggcgagaaactgctcctgttttgccaagaggatggcaaggtgatttgttggctgtgcgagaggtcccaagagcaccgagggcatcatacattcctgaccgaggaagttgccagggagtatcaagttaaactgcaggccgcgttggaaatgcttaggcagaaacagcaggaagctgaggaactggaggccgatatccgagaggagaaggcttcatggaaaacccaaattcagtatgacaagactaacgtgctggccgattttgagcagttaagggacatcctcgactgggaggagagtaatgaattgcaaaacctggaaaaagaagaagaggatatattgaaatctctgactaactctgaaaccgaaatggttcagcagacacagtcactcagggagcttattagtgatttggagcaccgactccaggggtccgttatggagctgttacagggcgtggatggcgtcattaaaaggacggaaaacgtgactctgaaaaagcccgagacgtttcccaaaaaccagagaagggtattccgcgccccagatcttaaaggcatgctggaggtttttagggaactgacagacgttagaagatattgggtggacgttacggtggctcccaataatatctcctgtgcagttatcagtgaagataagagacaggtcagcagcccgaagccgcagattatctatggcgcaagaggcactagatatcaaacctttgttaattttaattattgtaccgggattttaggatcacagagcatcacaagtggtaagcattactgggaagtggatgtgtcgaagaagaccgcgtggatcctgggcgtctgcgcggggtttcagcctgacgccatgtgcaacatcgagaaaaatgagaattatcagcctaagtacgggtactgggtgatcggcttggaagaaggagttaagtgctccgccttccaggattcatcttttcatacccccagcgtcccattcattgtacctctgagcgtgattatttgtcccgacagggtcggtgttttcttagactacgaagcgtgtaccgtctctttctttaacatcaccaaccatgggttccttatatacaagttctcacactgcagtttttcccagcccgtgtttccatacctcaacccccgaaaatgtggagtcccaatgaccctgtgctccccctcctcatag

SEQ ID NO: 209781 - DNA, 1044 bp, Artificial Sequence
  Description of Artificial Sequence: Synthetic coding sequence
atggccagcggcatcctggtgaacgtgaaggaggaggtgacctgccctatctgtctcgagctgctgactcagccattgagcctggactgtggacattccttttgtcaagcctgcctcacagctaaccataaaaagtcaatgctggataaaggcgagtcatcctgtcccgtgtgtcggatttcttatcaacccgagaatatccgccccaatcgacacgtggctaacatcgtggaaaaactgcgggaggttaagttgagccctgagggacaaaaggtggaccactgcgccagacacggtgagaaactgttgctcttctgtcaagaagacggcaaggtgatctgctggctttgcgagcgctctcaggagcatcgggggcaccatacctttttgaccgaggaggtggcaagagaatatcaggtaaaattacaggctgctctcgagatgctgagacagaagcaacaggaggctgaagagttggaggcagacatccgggaagagaaggcatcttggaagacccagatccagtacgataagacaaatgtgctcgcagacttcgaacagctgagggatattctcgattgggaagaaagcaacgagctgcagaacctggaaaaggaggaggaagatattctgaaaagtttaactaatagtgagacagagatggtacaacagacccagagcctgagagagcttatctctgatctcgagcaccggctacagggaagcgtgatggaactacttcagggagtggatggcgtgatcaaacgcacggaaaatgtgacactgaagaaacccgaaactttccccaaaaaccagcggagagtgttcagggcgcccgacctgaaagggatgcttgaagttttcagggaactgactgatgtgaggcggtattgggggaaagagaagagtcactaccataaacctccctgcggcctcagtctgctgctcagtctatcatttaggatcctctgttctctgttggggtcttgtttcaagatctacgatagccccagcaagacccacattacttatccttccctgtag

SEQ ID NO: 209782 - DNA, 984 bp, Artificial Sequence
  Description of Artificial Sequence: Synthetic coding sequence
atggccagcggcatcctggtgaacgtgaaggaggaggtgacctgcccaatctgtttggaactgctcactcagcctcttagcttagattgcggccatagtttttgtcaggcatgcttgacggcaaatcacaagaaatctatgctggataaaggtgagtcttcctgccctgtgtgccgcatcagctaccagccggagaacattagacctaaccgccacgtggccaatatagtggagaagctgagggaagttaaactgagccctgagggacagaaggtagaccattgtgcccggcatggcgagaagctgctgctgttctgtcaggaggacggtaaggttatatgctggctctgcgagcgctcccaggagcaccgtgggcaccatacattcctcactgaagaagtagcccgagaataccaggtgaagctccaagcagccctggagatgttacggcagaagcagcaggaggctgaagaactggaagccgatatcagggaagaaaaggcttcctggaaaacccagatccagtacgataagacaaacgtgctcgccgattttgagcagttgagggacatactcgattgggaagagagcaatgaactgcaaaacctggagaaggaggaagaggacattctgaagtccttgacaaactccgaaaccgaaatggtccaacaaactcagagcctccgggagctgatttctgacctggagcaccgcctgcagggctccgtcatggagctcctgcaagccggcgtgcagtgtctgatcttacggacggagaacgtgacactcaagaaacccgaaactttcccgaagaatcagaggcgcgttttccgagcgcctgacttgaaaggaatgctcgaggtattccgagaactcacggacgtgcgtcgctattggggttggtctgctatggccagatctcggtttacagctacgtcaacatcccagatccaggccattctgttgccacagccacctaagtag

SEQ ID NO: 209783 - DNA, 981 bp, Artificial Sequence
  Description of Artificial Sequence: Synthetic coding sequence
atggccagcggcatcctggtgaacgtgaaggaggaggtgacctgcccgatctgtctggaactcctaacacagcctctgagtctggattgcgggcacagtttctgtcaagcctgcttgaccgcgaaccacaaaaagagtatgctcgacaaaggcgagtccagctgtcctgtgtgcagaatttcttatcagcctgagaacattaggccaaaccgacacgtcgctaatattgtagaaaaacttagagaggtgaagttgtctcctgagggtcagaaagtggatcactgtgcaagacacggggaaaaattgctcctgttttgccaggaagatggcaaggtcatttgctggctctgtgaaaggagccaagaacacagaggccatcatacgtttctgacggaggaagtggccagggagtaccaagtgaaactccaagctgccctggaaatgctacgccaaaagcaacaagaagcagaagaactggaagccgatatacgcgaagagaaggctagctggaagacgcagattcagtacgacaagaccaatgttttggccgatttcgagcagttgcgcgatattcttgactgggaggagtcaaatgagcttcagaatttggaaaaggaagaggaagatatattaaaaagtctgacaaactcagaaaccgagatggtgcagcagactcaatcactgcgtgaattaatctcagacctggaacatagattacagggatcagtcatggagttactgcagggggtcgatggcgttatcaaacgcactgagaacgtcactctcaagaagcccgaaacctttccaaagaaccagcgaagagtgttccgggcgcccgacctgaagggaatgctcgaagtgttcagagagcttactgacgttcgccgatattggggctggtcagccatggctcggagcaggttcacagctactagcaccagtcagatccaagccattctactgcctcaaccccccaaatag

SEQ ID NO: 209784 - DNA, 630 bp, Artificial Sequence
  Description of Artificial Sequence: Synthetic coding sequence
atggccagcggcatcctggtgaacgtgaaggaggaggtgacctgcccaatatgcctcgaactgttgacgcaacccctgagcctcgattgcgggcattctttctgccaggcctgcctaaccgccaaccataagaagagcatgttggacaagggcgagagcagctgccccgtatgcaggatttcgtatcagccagaaaatattagacccaacaggcatgtcgcgaacatcgttgagaaattgagggaggtgaagctatctcccgagggccaaaaggtggaccattgcgcaaggcatggggagaagctactgctattttgtcaggaagatggcaaggtaatttgctggttgtgtgagagaagtcaggagcatcgggggcaccataccttccttaccgaggaagtcgctcgggaatatcaggttaagctccaggccgccttagaaatgctccgccagaagcagcaggaagctgaggagctggaggccgacattagagaagaaaaggcatcctggaaaacccagattcagtacgacaagaccaacgtcctggccgactttgaacaacttagggacattttggattgggaagaatcgaacgagcttcagaacctagagaaggaagaagaggactag

SEQ ID NO: 209785 - DNA, 219 bp, Artificial Sequence
  Description of Artificial Sequence: Synthetic coding sequence
atggccagcggcatcctggtgaacgtgaaggaggaggtgacctgccccatctgtcttgagctgttaacccagccacttagccttgattgtggccatagcttttgccaggcctgcctgaccgccaaccacaaaaagtcaatgctcgacaagggagagtcgtcttgtcctgtgtgcagaatatcctaccagccagagaacattagacctaaccgacactag

SEQ ID NO: 209786 - DNA, 816 bp, Artificial Sequence
  Description of Artificial Sequence: Synthetic coding sequence
atggccagcggcatcctggtgaacgtgaaggaggaggtgacctgccctatctgtctcgaactactgacacagcccctctccttagattgcgggcactcattctgtcaggcatgtctcacagctaaccataagaaatctatgctggacaagggggaatcatcttgtccagtctgtcgcatcagttaccaacctgagaatattcgtccgaaccgacatgtagccaacattgtcgaaaaacttagagaagttaaactctcccctgaagggcagaaagtagatcattgtgcgagacacggtgagaaactgctcctcttttgccaggaagatggcaaagtgatttgctggctgtgcgaaaggtcccaggagcatcgaggccaccatacgtttctgacggaagaggttgcccgtgagtaccaggttaagctgcaggccgccctggagatgttgcgacagaagcagcaggaagcagaggaacttgaagcagacatccgagaagagaaagcatcttggaaaacgcagatacagtacgataagacaaatgttctggctgactttgagcaactgagagacatcctagactgggaggagtccaatgagctgcaaaacctggagaaagaggaagaggacattctgaagtccctcaccaactctgagactgagatggtgcagcaaacacagagcttacgtgagttgatctctgacctggagcaccggctgcaggggagcgtcatggagcttctgcaggatggggagcgagatctggaagaagctaggaactttagcaaaaagtctaaggaatccgtcagtagctcatag

SEQ ID NO: 209787 - DNA, 1464 bp, Artificial Sequence
  Description of Artificial Sequence: Synthetic coding sequence
atggcctggcaggtgagcctgctggagctggaggactggctgcagtgtccaatttgcttagaagttttcaaagaacctctgatgcttcaatgcggccattcatactgcaagggctgcctcgtttctctgagttgtcacctcgatgcagagctccgctgtcctgtgtgtcgccaggccgtggacgggtctagctcactcccaaatgtttcattggctagagtgatcgaagccttgcgactcccaggagaccccgagccgaaggtttgtgtccaccaccggaacccactgtctctgttctgcgaaaaggaccaggaactgatttgcggactttgtggattactcgggagccatcagcaccatcccgtgaccccggtgtcaactgtgtattcgcgtatgaaggaggagcttgccgcgctcatctctgagctaaagcaggagcagaagaaagtcgacgagctgattgcgaagctggtgaataacaggacccgaattgtcaacgagagcgatgtattctcttgggtgatacgacgggaattccaggagttgcaccatctcgtggatgaggagaaagcccggtgcttggaggggattggaggacacactcgtgggctggtggcaagcttggacatgcagctcgaacaggcgcagggaactcgcgagcgtctggcgcaggcggagtgcgtgctggaacagttcggcaacgaggaccaccacaagttcatcagaaagtttcatagcatggcctcccgcgcagagatgccgcaggccaggcctctcgaaggcgccttttcgcctatcagttttaagcccgggctgcatcaggcagacatcaaactcactgtttggaagaggctgttccggaaggtccttccagctcctgagccattaaaacttgacccagccaccgctcaccccctcttggaactgagcaagggaaacaccgttgtgcagtgcggtctcctggcccagagacgggccagccagcctgaaaggtttgattatagcacttgcgtcttagcctctcgcggcttctcttgtggccggcattattgggaagtagttgtggggtcaaaatctgattggaggctcggcgtaattaagggtactgcatccagaaaagggaagcttaaccggtctcccgagcacggcgtgtggctcatcggcctcaaggaaggcagagtctacgaggcatttgcctgtccacgcgttcctctccccgtggcaggccatccacatcgaatcggactctacttacactatgaacagggtgagcttactttcttcgacgccgatagaccagacgacctccgcccattatacacctttcaagcagacttccaggggaagttgtatcctatactcgacacatgttggcatgagagaggaagtaactcattgcctatggtcctcccacccccatccggtcccggacctttgtccccagagcagcctacgaagctgtag

SEQ ID NO: 209788 - DNA, 1464 bp, Artificial Sequence
  Description of Artificial Sequence: Synthetic coding sequence
atggcctggcaggtgagcctgctggagctggaggactggctgcagtgccctatctgcctggaggtcttcaaggagcccctgatgcttcagtgtggccattcttattgcaagggttgtctggttagcctttcttgtcacctggacgcagagctgcgctgccctgtctgtcggcaagctgtggacggatcgagcagtctgcccaatgtctcactggctcgggtgattgaagctctgcggcttcccggggatcctgagcctaaagtctgtgtccaccaccgcaacccactctctctgttctgtgagaaagatcaggagctgatttgcggactttgtggactattggggagccaccagcaccaccctgtgaccccggtctccaccgtctactcccggatgaaagaggaactcgccgctcttatctctgaacttaaacaagagcagaagaaagtcgacgaactgattgcaaaactcgtgaataaccgcactcgcatcgtgaacgagtctgacgtcttctcttgggtcatccgccgcgaatttcaggagctccaccatttggtcgacgaagagaaggcccggtgcttggaaggtattgggggccatacaaggggacttgtagccagcctagacatgcagctggagcaagcacaggggactcgtgagaggttggctcaggccgagtgtgttctggagcagttcggaaatgaggaccatcacaaattcataagaaagtttcacagcatggcctctcgggcagagatgccgcaggcccgcccattggaaggcgcatttagcccaatatcatttaagcccggcttgcatcaagcggacattaagctgacagtgtggaagagattattccgcaaggtccttccagcacctgagcctctcaagctggatccagcaaccgcgcaccctctactggagctgtccaagggaaataccgtggtccagtgtgggctcttagctcagaggcgcgcatcccagcccgagagattcgattatagcacttgtgtcttggcatcccgcggctttagctgtgggcggcactactgggaggtagttgtgggcagcaaatctgactggaggctgggcgtgattaaaggcactgcctcccggaaagggaagttgaacagaagtcccgaacacggggtctggctgattgggctgaaggaaggacgcgtttacgaggcatttgcttgccctcgggttcccctaccagtcgccgggcatccacatagaattggattatacctgcattacgagcagggagagttaacatttttcgacgccgatcggccggacgacctgcgccctctttacactttccaagccgacttccagggtaaactctatcctatcctggacacttgttggcatgagagaggtagtaatagccttcccatggtcctcccacccccaagtggccccggccccctgtcgccagaacagccgaccaaactttag

SEQ ID NO: 209789 - DNA, 1467 bp, Artificial Sequence
  Description of Artificial Sequence: Synthetic coding sequence
atgaccagccccgtgctggtggacatccgggaggaggtgacctgcccaatctgcctagaactgctgacggagcccctttcaattgactgtggccatagcttctgtcaggcatgtatcaccccgaacgggcgggaatccgtaataggccaggaaggagagagaagctgcccggtctgccagacgtcctaccagccagggaatttacggccaaatcgccatctggctaacatagtgcggcgcttgcgcgaggtggtgctcggaccaggaaaacagctgaaagcagtgttgtgcgcggatcatggcgagaaattgcagcttttttgtcaagaagacgggaaagtcatctgttggctgtgcgagcgctcgcaggaacaccggggccatcacacctttcttgtagaagaagtcgcccaggagtaccaagagaaatttcaagagtcattaaagaaattgaagaacgaagaacaggaggcggagaaacttactgcatttattcgtgaaaaaaaaactagctggaaaaaccagatggagccagagagatgccggattcaaactgagttcaatcagttacgcaacatactcgatcgagtggagcagagggagcttaaaaaactggagcaggaggagaaaaagggcctgcggatcatcgaggaggccgagaacgatctcgtgcatcagacacagtccctgcgcgagctaatcagcgacctggagagacgatgtcagggcagtacaatggagctcctccaggacgtgagcgacgtaactgagaggtctgaattttggaccctacggaagcccgaagccctaccaaccaaactgcgatcaatgttccgcgcgccagacctgaagcgcatgctcagagtctgccgcgaattaaccgatgtccagtcctattgggtcgacgtgactctgaatccacacacagctaaccttaatctggtcctggctaagaaccgcaggcaggtccgttttgtgggagccaaggtttcaggaccctcttgtcttgaaaaacattatgactgctcggtcctcgggagccagcacttctccagtgggaagcattattgggaagtggatgtggccaagaagacagcctggattttaggagtgtgctccaacagtctggggccaactttctcattcaaccatttcgcgcagaaccactcagcttattccagataccaaccgcaatcaggctactgggtaattgggctgcagcataatcatgaatacagggcatacgaagactcgtcacccagcctcctactgagcatgacggttccccccaggcgcgttggagtcttcctggattacgaggccgggaccgtatcattttacaatgtcacaaatcacgggtttccaatctatactttctcaaagtactacttccccaccactctgtgtccatatttcaacccatgcaattgcgtgatccccatgactctgcgaaggccctctagctag

SEQ ID NO: 209790 - DNA, 1551 bp, Artificial Sequence
  Description of Artificial Sequence: Synthetic coding sequence
atgtgcggcagcgagcggatcctgcaggccggcaacatcctggagattagggttggccaggccggcgctcgccgcgtggctaccatgaccagccctgttctagtggacatcagagaagaggttacatgccccatctgcctggaactgctgaccgaacccctgagtatcgactgtggccactccttttgtcaggcctgcattaccccaaatgggcgcgagagcgtgatcgggcaggaaggggagaggtcttgccctgtttgccaaacctcttatcaaccaggaaatctgagaccgaacagacacctagctaatatcgtgcggagattaagagaagtggtattaggacctggaaaacagctcaaagcggtgctgtgtgccgatcacggtgagaagttacagttgttttgccaggaagatggtaaggtgatttgctggttgtgcgagagaagtcaggagcacagaggccaccatactttccttgtcgaggaggtggctcaagagtaccaggagaagtttcaggagtcattgaaaaaactgaagaatgaggaacaggaagcagagaaactgacagctttcattagggagaaaaaaacctcatggaaaaatcagatggaacccgagcggtgtcgaatccagacagaatttaaccagctgcgcaacatcctcgatcgggtggaacaacgtgagttgaagaagctggagcaagaagagaagaaaggactccggatcattgaggaggccgaaaacgatcttgtgcaccagacacagtccctccgagaactcataagcgacctggaacggcggtgccagggcagcacgatggagttactgcaagatgtaagtgatgtcaccgagaggtccgaattttggactctaaggaaacccgaagcactacccacaaaactcagatccatgtttcgggcccccgatcttaaacgcatgctacgcgtatgccgggagttgacagacgtgcaatcttactgggtcgatgtaacgcttaacccccacactgcaaacctgaatttagtgcttgcgaaaaatcggagacaggttagattcgtgggagccaaagtgagcggcccgtcctgcctagaaaaacattacgattgctccgtccttggcagccagcactttagtagtggtaaacattattgggaggtagatgtggccaagaaaacagcgtggatactgggggtctgttctaattctctgggacctacattctcatttaaccacttcgcgcagaatcacagcgcatactcgagatatcagcctcagagcggctactgggtgattgggttgcaacacaatcacgaatatagggcttacgaggatagctccccgtccctcctgttaagcatgacggtgcctccacggagggtgggtgtgttccttgattacgaagccggtaccgtgtctttctacaacgtgacgaatcacggttttccgatttataccttctccaagtattactttcctaccacactctgtccttactttaacccttgcaattgcgttattcccatgactttgagacggcctagcagctag

SEQ ID NO: 209791 - DNA, 1389 bp, Artificial Sequence
  Description of Artificial Sequence: Synthetic coding sequence
atgaccagccccgtgctggtggacatccgggaggaggtgacctgccctatttgccttgagctgcttacagaaccactgagcatcgactgtgggcactctttctgtcaggcgtgtatcacccccaacggcagggagtctgtgataggacaagaaggcgaaagatcctgcccagtctgccagacatcttatcagccaggcaacctaaggcctaacaggcaccttgcaaatatcgttcgcagactccgtgaagaggacggcaaggtaatttgttggctgtgtgagagatctcaggagcaccgtggacaccatacttttttagttgaggaggtggcccaagagtatcaggagaagttccaggaatcgcttaagaagctgaaaaatgaggaacaagaggcggaaaagttgaccgccttcattcgtgaaaagaaaaccagttggaagaaccagatggaacccgagcgctgcaggattcaaaccgagtttaaccaactgcggaacatcctggatcgagtcgaacaacgcgagctgaagaaattggagcaggaagaaaagaaagggctcagaatcatagaagaggcagagaacgacctagtgcatcaaactcagtccttgcgagagttgattagcgatctcgaacgcagatgtcaagggtcaaccatggagctgcttcaggatgtttctgacgtaacggagcgcagcgaattctggacactgaggaaaccagaggctttgccaaccaagcttagatccatgtttagagccccagacttgaaacggatgttacgggtgtgccgggagctaacagacgtccagagctactgggttgacgttaccctcaatcctcacacagctaacctaaacttggtgctcgcaaagaatcgaagacaggtcagattcgtcggggccaaggtttcaggcccaagttgtctggagaagcattatgactgtagtgtgctaggaagccagcatttctcctctgggaaacactactgggaggttgacgtagcaaaaaaaacagcatggatactcggggtctgctctaatagtttgggacccacgttcagcttcaaccacttcgctcagaaccactcagcatattcccggtatcaacctcagtctggttactgggtgataggcctgcagcataaccatgaatatcgcgcctatgaggactcaagcccaagcctcttactctctatgactgtacctccaagaagggtcggcgtgtttctggactatgaagcaggaaccgtcagcttttacaacgttactaatcatggattccctatatacacattttctaagtactactttcctaccactctgtgtccatattttaatccttgtaattgtgtcatccctatgactctgcgacggccaagtagctag

SEQ ID NO: 209792 - DNA, 1188 bp, Artificial Sequence
  Description of Artificial Sequence: Synthetic coding sequence
atgtgcggcagcgagcggccctggcggaagaccgccgccctgctgtccgggggctgggagggacatctcttggcatgtgagcggtcacaggagcaccgaggacatcacacatttctggttgaagaggtggcgcaggaataccaggagaagttccaggagagcttgaaaaagctgaagaatgaggagcaggaggctgaaaagctgactgcatttatacgcgagaagaagacgtcctggaagaaccagatggaaccagaacgctgcagaatacaaactgaatttaatcagctcagaaatatcctggatagggtagagcagagggaactgaaaaaacttgagcaagaagagaagaagggcctcagaatcattgaagaggcagagaatgatttggtgcatcagacccaatcactgcgcgagctgatatcagacctggaaaggcggtgtcaaggttctactatggagttgctgcaggacgtgagcgatgttaccgagcgatcagaattttggacactgcggaaaccggaagcgctgcccaccaagcttagaagcatgtttcgagctcctgatctaaagcgcatgttgcgcgtgtgcagagaactcacagacgtccagtcttactgggtggatgtaaccctaaatccccacaccgccaacctgaacttagttctggcaaagaacagacggcaagtcaggttcgttggagccaaagttagcgggccctcttgcttagagaaacactatgattgttcagtactaggctcacagcactttagctccggcaagcactactgggaggttgatgtggcgaaaaagactgcatggattttaggagtgtgttccaacagcctcggccccactttttccttcaaccatttcgcccagaaccactcagcctacagccgctatcagcctcagtccggctactgggtcatcggcctgcagcataaccacgagtaccgggcatatgaggattcctctccctccctccttctgtccatgaccgtgcccccacgccgagtcggcgtgtttctcgactacgaggcgggcaccgttagtttttacaatgtcaccaaccatggcttccccatttacaccttttctaagtactacttccctacaaccctttgcccttacttcaacccttgtaattgcgtcatcccgatgacattgcggaggccatcgagctag

SEQ ID NO: 209793 - DNA, 942 bp, Artificial Sequence
  Description of Artificial Sequence: Synthetic coding sequence
atggagcccgagcggtgccggatccagaccgagttcaaccagctgaggaacattctggaccgtgttgagcagcgagagctgaagaagctggaacaggaagaaaagaagggcctgaggattattgaagaggctgaaaatgatctcgtgcatcagacccagtccctgagagaattgataagtgacttagaacgcagatgtcaaggctctactatggaactactgcaagacgtgagcgatgtcacagagcgctccgagttttggactctgcggaagccagaagctcttccaaccaaattgaggtccatgtttcgggcacccgacctgaaaaggatgctgcgcgtttgtagagagctcacggatgtgcagtcttattgggtggatgtcacccttaacccacacactgccaatctgaacctagtgctggccaagaataggagacaagttagatttgttggcgccaaagttagtggcccctcttgtctcgagaagcactacgattgtagcgtgctgggatcacaacacttttcttccggcaagcactactgggaggttgacgtggccaaaaaaaccgcctggattctgggagtgtgctccaattctcttggacccactttcagtttcaaccactttgctcagaaccacagtgcctactcacgttaccagccccagagtgggtactgggtcattggacttcagcacaaccacgagtatagagcttacgaggattcttccccatcattgctcctatctatgaccgttccacctcgtagagttggcgtctttctagactacgaggcagggactgtgtccttttataatgtcactaaccacggattcccgatctataccttttccaagtactactttcctaccactctctgtccttactttaacccttgcaattgcgtgatcccgatgacattgagacgacctagttcatag

SEQ ID NO: 209794 - DNA, 942 bp, Artificial Sequence
  Description of Artificial Sequence: Synthetic coding sequence
atggagcccgagcggtgccggatccagaccgagttcaaccagctgcggaatatcctcgaccgcgtcgaacagcgggagctgaagaaactcgaacaggaggaaaagaagggcctgaggatcatagaagaggccgaaaatgatctggttcatcaaacacagtccttaagggaactcatatcagatctggagaggagatgtcagggctcgacgatggaactgctgcaggacgtgagcgatgttaccgagcggtctgagttttggaccctgagaaagccagaagctctaccaacgaaacttcgaagtatgttccgagcacctgacctgaagcggatgctgagagtctgcagagagttgacggacgtccagagctactgggtggatgttacattgaaccctcacacagcaaatttaaacctcgtcctcgctaaaaaccgacggcaggtccgcttcgtgggagcaaaggtgtcaggacctagttgccttgagaagcattacgattgctctgttttgggttctcagcatttttcttcagggaaacattactgggaagttgatgtcgctaagaagaccgcctggatcttgggagtctgctcaaattcattgggtcccacattctcattcaaccactttgcccagaaccatagtgcctactctcgatatcagccacaatccggttattgggtgattgggctgcagcataatcacgagtaccgagcatatgaagattctagcccgagtttactgctgtctatgacagtgccccctaggcgcgttggtgtgttcttggattacgaggctggtactgtgtctttttacaacgtaacgaaccacggatttcccatatacaccttcagcaagtactatttcccgactacactctgtccgtacttcaacccatgtaattgcgtcatcccgatgaccctgcggcggccatcgagctag

SEQ ID NO: 209795 - DNA, 942 bp, Artificial Sequence
  Description of Artificial Sequence: Synthetic coding sequence
atggagcccgagcggtgccggatccagaccgagttcaaccagctgaggaacatcctagatcgcgtcgagcagcgcgagctgaaaaaactcgagcaagaggaaaagaaaggacttaggatcattgaggaggcagagaatgatctggtgcatcagactcaaagtctccgggaactgatttccgaccttgaaaggcggtgccaggggtctacgatggaactcttacaagacgtctctgatgttacggagcgttccgaattttggacgcttagaaagcccgaggcgctgcccacaaagctgcgatccatgttcagagcccccgacctgaagcgaatgctgagggtctgcagagaacttaccgacgtccagtcttattgggtcgatgttacccttaacccgcataccgcaaatctcaacctggtgctcgccaagaaccggagacaggtgcggttcgtcggggccaaagtgtccggcccatcatgtttggagaaacattatgattgttcggtgctggggagccagcatttctctagcggaaaacactactgggaggtggatgtggccaagaagacagcctggattctaggcgtgtgcagtaactctcttggaccgaccttttcattcaatcacttcgcacaaaatcattcagcctacagccggtaccagccacagagcggctattgggtgattggcctgcaacacaaccacgagtatcgcgcatatgaggactcttcaccatctctgttgctcagtatgactgtaccacccaggcgcgtaggcgtcttcctggactacgaagcggggaccgttagtttctataacgttaccaatcatgggttccccatttacaccttcagcaagtactattttcccaccacgctctgcccatacttcaatccctgcaactgtgtgatacctatgaccctccggcggccaagctcttag

SEQ ID NO: 209796 - DNA, 942 bp, Artificial Sequence
  Description of Artificial Sequence: Synthetic coding sequence
atggagcccgagcggtgccggatccagaccgagttcaaccagctgcgaaatatcctcgaccgtgtcgaacagcgagaattaaagaagttggagcaggaggaaaaaaaaggccttcgaatcatcgaggaggcagagaacgatcttgtgcaccagacacagtccttacgggaactgatctctgacctggagcggcgttgtcagggttctactatggagctcttgcaggacgtgtccgacgtgactgagcgaagcgagttttggacactgcgtaaacccgaagcactgcccactaaactcaggtccatgtttcgtgcccccgatctaaagcgcatgttacgcgtctgtagggaactaactgatgtccagtcttactgggtcgatgtaactctgaacccccacaccgccaatctgaatcttgtcttggctaagaaccgccgccaggtaaggttcgtgggagccaaagtcagcgggccaagttgccttgagaagcactacgattgctctgtgctcggaagtcaacatttcagcagcggaaaacattactgggaggtagatgtggccaaaaaaacagcatggattctgggcgtgtgcagcaattcactcgggcctaccttctccttcaaccatttcgcccagaaccactctgcttactcccgttatcagccgcagagcgggtactgggtgataggcctgcagcataaccacgagtacagagcgtacgaagacagctcaccgtccttgctgctgtctatgacagtgccccctaggagagtcggagttttcctcgattacgaggcgggaacagtgagcttctataatgtaactaaccatggctttccaatctatacattttcgaagtattacttccccaccacattgtgcccttactttaacccctgcaattgtgtgattccgatgaccctgcgcagaccgagtagctag

SEQ ID NO: 209797 - DNA, 3651 bp, Artificial Sequence
  Description of Artificial Sequence: Synthetic coding sequence
atggcccggaactgcagcgagtgcaaggagaagcgggccgcccacattctatgcacctattgcaacaggtggctatgctcttcatgcactgaagagcatcgccattctcctgtacctggaggacccttttttcctcgggcacagaaagggtcccctggggtcaacgggggtcctggtgatttcacgctgtactgtcccctgcacactcaggaagtcctcaaacttttttgcgaaacttgcgacatgctgacatgccattcttgtctggtcgtggaacataaggagcacagatgtagacacgtggaggaggttctacagaatcaaagaatgttgttagaaggagtcaccacccaagtggcacacaagaagagctcactccaaacctctgcaaagcagatcgaggaccgcatctttgaagtgaaacatcagcacagaaaggtggaaaaccagattaagatggcgaagatggtgttaatgaacgagttgaacaagcaagccaacggtttgattgaagagctggaggggattaccaatgagcgtaaaaggaagctcgaacaacagttgcaatctatcatggtccttaacagacagttcgaacacgttcagaactttattaactgggcagtgtgctctaagacgtctgtgccatttcttttcagcaaggagttaatcgtgtttcagatgcagcggctgctcgagacttcctgcaatacggaccctggctctccctggtcaatccgatttacgtgggaacctaatttctggaccaaacagctcgccagcctgggttgtatcacgaccgaaggaggccaaatgtctcgcgccgacgcacccgcctacggcggacttcaggggagtagccctttctaccaatcacatcagtctcccgtcgcacaacaagaggccctgtcccaccccagccacaaattccagagccccgcagtgtgtagttcgagcgtgtgctgcagtcattgtagcccagtgagcccctccttgaagggccaggtcccacccccttctatacatccagctcatagcttcagacagccacccgagatggtacctcagcaactcgggtcactgcagtgttccgccctcctaccccgggaaaaagaactggcttgtagtccacatccaccaaaactgctgcaaccttggcttgaaactcagccacctgtggaacaggaaagtaccagccagaggctcgggcaacaactcaccagccagccagtatgtatcgtgccccctcaggacgttcagcaaggcgcgcacgctcaacctaccctccagaccccttctatacaggtgcagtttgggcaccaccagaaacttaagctgtcacatttccagcagcaaccgcagcagcagttaccacctccccctccgcctctgccccatcctccaccaccactgccaccccctccccagcagccgcatccaccgttaccacccagtcagcatttggcttcgtcacagcatgaaagcccccctggacccgcctgcagccaaaatatggacataatgcatcataaattcgagctggaggaaatgcagaaagacctcgagctgctcctccaggcacaacagcccagtctccagctttcccagacgaaatctccccaacacctgcaacagactatcgttggacagattaactatattgtccggcagcctgctcccgtccagagccagagtcaagaggaaaccctgcaggctaccgatgagcccccagcgagccagggctctaaaccagcgttgcctttagacaaaaatacagcggccgccctgccccaagcttctggagaggagacccccctttcagtgcctcctgtggacagtactattcagcacagcagcccaaatgtcgtgcggaaacacagcacttctctgtccataatgggattttcaaacaccctagaaatggaactgagcagtacgaggcttgaacggcccctagaaccgcagatacaatcggtgtccaacttgactgctggggccccacaggcggtcccatcgctgctcagcgcacccccaaaaatggtgagctcacttacaagcgtacaaaatcaggcgatgcccagcctgactactagtcacctccagacggtgccgtccctcgtgcatagcacattccagtcaatgcccaatctcatatctgacagccctcaggctatggcttctcttgcaagtgaccacccccaggccggtccctcacttatgtcgggacacactcaagcagttccatcactagccacatgtccactgcagagtattcctccggtcagcgatatgcagcccgagactggaagcagctctagctccgggagaacttctggcagcctgtgtcccagggacggagcggacccatcccttgagaacgctctgtgcaaggttaaactggaggaacctatcaacttgtctgtgaagaagcctccactggctcctgtcgtaagcacttcaacagccttacagcagtaccaaaatcctaaggagtgtgaaaattttgaacagggtgccctcgagctggacgccaaagaaaaccagtccatcagagcattcaactcagaacacaagataccttacgtgagactggagagactgaaaatatgcgctgcctcttcaggagagatgccagtgtttaagttgaaaccccagaagaatgaccaggacgggtcttttctgctgatcattgaatgcggaactgagagcagcagcatgtccattaaagtgagccaggaccgcctctccgaggcaacccaggctcctggcctggagggtaggaaggtgactgtgacatccctcgctggccagaggccgcctgaagttgaaggaacatcacccgaagagcatcgcctgattcctagaacccctggagctaaaaagggccctcccgccccgattgagaatgaggacttttgcgctgtatgtctgaatggtggagaactgttatgctgcgacaggtgtccaaaggtattccatctgagttgccacgttccagccctgctgagcttccctgggggagagtgggtctgtactctgtgtcggagtcttactcagcctgaaatggagtacgactgcgagaacgcctgctacaatcagcccggcatgcgtgccagccctgggctctccatgtacgaccagaaaaaatgtgaaaagcttgttctctccttgtgttgtaataatttgtccctgcctttccacgagccggtgagtccccttgctcggcattactaccagatcattaaacggccaatggacttaagcatcattaggcgaaaacttcagaagaaggatcccgcacactacaccacaccggaggaagtggttagcgacgtgaggctcatgttctggaactgtgcgaagttcaactacccagatagtgaagtggcagaggctggccggtgtctggaagtgttttttgagggatggctgaaggaaatctaccctgagaaaaggtttgcccagcctcgacaggaggactcagattccgaagaggtgtctagcgagtctggctgcagcactccccagggatttccatggcctccttacatgcaggagggcatacagcctaaacggcgcaggaggcacatggagaacgaacgcgcaaaaaggatgagcttccgcttggctaatagcatttcccaggtgtag

SEQ ID NO: 209798 - DNA, 1458 bp, Artificial Sequence
  Description of Artificial Sequence: Synthetic coding sequence
atggaccccaccgccctggtggaggccatcgtggaggaggtggcctgcccgatctgtatgacgtttctcagggagccaatgtccatcgattgcgggcacagcttctgtcatagttgtctgtccgggttgtgggagattcccggggaaagccagaattggggttatacatgcccactctgccgagcacctgtgcagccccggaatctacgccccaattggcagcttgctaatgttgtggagaaggtgcgacttctgagacttcaccccggtatggggctgaagggcgacctgtgtgaacgccacggcgaaaaattgaaaatgttctgcaaagaagatgtccttatcatgtgcgaagcttgctctcagtcacctgagcacgaggcacactcagtcgtacccatggaggatgtcgcctgggagtataagtgggagctgcatgaagccctggagcatctgaagaaggaacaggaggaggcctggaagctagaggtcggggaacgtaagcggacggccacttggaagatacaggtggagacgcgcaagcagtccatcgtttgggagtttgagaagtatcagagattgctggagaagaagcaaccaccccatcgtcagctcggcgcggaagtcgccgccgcacttgcgtcactgcaaagagaagcagccgagacgatgcagaagctcgagctcaatcattccgagttgatccagcagtctcaggttttgtggcgtatgatcgccgaattgaaagagagatctcagcggcccgtacgctggatgctgcaggacatccaggaggtgctaaaccggagcaaaagctggtctctgcagcaaccagagccgatttctctggagctgaaaactgactgccgggttctgggccttcgagagatcctcaagacttatgcggccgacgtgcggctggacccggacacagcttatagccgattgatagtcagcgaggaccgtaaacgcgtgcattacggtgataccaaccaaaagttacctgacaaccccgaacggttttaccgctacaacattgtactgggatctcagtgcatctcaagtggccgccactactgggaggtcgaggtgggagataggtcagaatggggcctgggcgtttgcaaacaaaacgttgacagaaaagaggttgtctatttaagtcctcactatggattctgggtcattaggttgcgcaagggcaatgaataccgcgccggtaccgacgaatatccaatcttatccttacccgtgcctcccagacgcgttggcatattcgttgactacgaagcacatgatatttcattctacaacgtcacagactgtggcagtcacatcttcacattccctcgctatccgttccctgggaggttgctgccctatttttctccctgctatagtatcggcactaataatacagccccattagccatttgctctctggatggagaggactag

SEQ ID NO: 209799 - DNA, 621 bp, Artificial Sequence
  Description of Artificial Sequence: Synthetic coding sequence
atgcagaagctggagctgaagaccgactgccgggtgctgggcctgcgcgagatcctgaagacatatgctgcagatgtgagactggatcccgataccgcctacagccgtcttattgtttccgaagacaggaagagggtgcattacggggataccaaccagaaacttcccgacaaccctgagagattctaccgatataacattgttctgggctcgcagtgcataagttctggtagacattattgggaggttgaggttggcgaccggtcagagtggggactgggcgtctgtaagcaaaacgtggacagaaaggaagtagtttatcttagcccacactatggcttttgggttatccgcctccgtaaaggaaacgagtaccgcgctggtacggatgagtatccgatcctcagtctcccagttcccccccggagagtgggcatctttgtcgattacgaagctcacgatatttccttctacaatgtgacggactgtggcagtcacatcttcacgtttccgagatatccgttccccggtagactgctcccttatttctccccttgttacagtatcggaacgaacaatacagctccactcgccatttgtagcctggatggcgaggattag

SEQ ID NO: 209800 - DNA, 1536 bp, Artificial Sequence
  Description of Artificial Sequence: Synthetic coding sequence
atggccgccgtgggcccccggaccggccccggcaccggcgccgaggccttagcactcgccgccgaactacagggagaggcaacttgcagcatctgtctagagctatttcgagaaccagtctcggttgagtgcgggcattctttttgcagagcatgcattgggagatgctgggaacgtcctggagccgggagcgtcggagccgccacaagggccccccctttcccattaccttgcccgcaatgcagagagccagccaggcccagccagctgcggccaaacagacagcttgctgccgttgccacactactgaggcgtttttccctgcctgcagccgcgcccggggagcacggtagccaggccgccgcagcccgtgccgccgcagcgaggtgtggccaacacggggaacccttcaaactatattgtcaggacgacggacgcgccatatgcgtggtttgtgaccgtgcccgggaacaccgagagcatgccgtcctcccgctggacgaggctgttcaggaggcgaaggagttactagagtcccgactgagagtgttgaagaaggaactcgaagactgcgaagtcttcagatcaacagagaaaaaagagtctaaagaactgctgaagcaaatggccgcagaacaggaaaaggttggcgcggagttccaggcgctgcgtgctttcctggtggaacaggagggccggttactcggcaggttagaggagctgagcagggaagttgctcagaagcagaacgagaacttggcccagctaggagtggagattactcaactgtccaaactgagctctcaaatccaggagaccgcacagaaacccgatctggattttctacaagaatttaagagtactttgtccagatgtagcaacgtgcctggtcctaagccaaccacagtctcatctgaaatgaagaataaggtgtggaatgtcagcttgaagactttcgtactgaagggtatgctgaagaagttcaaagaggatctccggggcgagctggaaaaggaggaaaaagtggaactgacactggacccagataccgccaatcccaggctcatcttatctttggatctaaagggagttagactgggcgagcgggcacaagatctgcctaatcacccctgccgctttgacacaaacacgagagtgctggcctcatgtggtttttcttcaggacgacaccactgggaggtggaggtcggctctaaggatggctgggcattcggggtggccagggaatctgtgagaaggaaaggcctgacgccttttacaccggaggagggggtctgggccttgcagctgaatggcggacagtactgggctgtcacatcacctgagcggtcccctttgtcctgcggccatttaagccgagtcagggttgctctggatctggaggtcggcgctgtgtccttctacgccgtggaggacatgaggcacctctatacctttagagtcaacttccaagaacgtgtcttcccattgttctctgtgtgcagtactggtacctaccttcgaatttggccatag

SEQ ID NO: 209801 - DNA, 666 bp, Artificial Sequence
  Description of Artificial Sequence: Synthetic coding sequence
atggccgccgtgggcccccggaccggccccggcaccggcgccgaggctctcgcattggcagccgagctacaaggcgaggctacttgctctatttgccttgaattatttagggaacccgtctctgtcgaatgtggccactcattctgcagagcatgtatcgggaggtgttgggaacgtcccggcgctgggtctgtgggggcagctacacgcgccccaccatttccgctgccctgccctcagtgtcgtgaacccgcgagaccttcgcagctgcggccgaataggcagctcgctgctgtggcaacgctattgagacggttttcccttcccgctgccgcccccggggagcatggctcccaggccgccgcagctagggccgctgcggccagatgcggtcagcatggcgagccattcaagctgtactgtcaagatgatgggagagccatttgcgttgtgtgtgatcgggctagggagcacagggaacatgcagtgcttcccctcgacgaggcagttcaagaagcgaaggaattacttgaatctaggctgcgcgttctgaagaaggaattagaggattgtgaagtgttcaggtccactgaaaagaaggagtctaaagagctactagtgagccaggcccccgctggaccaccttgggacatcactgaggcttag

SEQ ID NO: 209802 - DNA, 912 bp, Artificial Sequence
  Description of Artificial Sequence: Synthetic coding sequence
atggccgccgagcaggagaaggtgggcgccgagttccaggccctgagagcatttctggtcgaacaagagggccgacttttgggcaggcttgaagagctgagtcgtgaagtagcccagaaacagaatgagaaccttgcacaactcggtgtggagatcacgcagttgtcaaaactctcttcccagatccaagaaaccgcccaaaagcctgatttagacttcttgcaggaattcaaaagtaccttatcgcgctgctccaacgtgcctggacccaaacctacgaccgttagctctgaaatgaaaaataaagtctggaacgtgagccttaagactttcgtgctgaaaggcatgctaaaaaagtttaaagaagatctccggggagagttggaaaaggaagagaaggttgagctgaccctagaccccgacactgccaatccacggctgattctttcactcgacctgaaaggagttcgtctcggagagcgagcacaggaccttccaaatcatccctgccgttttgatacgaacaccagggtgctggcctcctgtggcttctcttctgggcgccaccattgggaggtagaagtcggctcaaaggatgggtgggctttcggagttgcacgggagtcagtgcgtcggaaggggctgacgcccttcaccccagaggagggggtgtgggctctgcagctgaacgggggacaatactgggcagtgacttctcccgagcgctctcctctgagttgtggccacctctctcgggtccgggtggcccttgatttggaggtgggggcggtcagtttttatgctgtggaggatatgcggcatctctataccttcagagtcaactttcaagagcgtgtcttccctttgtttagcgtatgcagcacagggacttacctgaggatttggccctag

SEQ ID NO: 209803 - DNA, 912 bp, Artificial Sequence
  Description of Artificial Sequence: Synthetic coding sequence
atggccgccgagcaggagaaggtgggcgccgagttccaggccctgagggctttcctggtagagcaagagggacgactactggggcgcctggaggagctcagcagagaagtcgcacagaaacagaacgagaacctggcacagttgggagtggagatcacccagctctccaagctgagtagccagatccaggagaccgctcaaaaacctgacctggattttctgcaggaatttaagtcgactttgtccagatgttccaacgtgccagggcctaagcccacaactgtctctagcgagatgaagaataaggtgtggaacgtgtcactaaaaacttttgttctcaaaggtatgttaaaaaaattcaaagaggacctcaggggggagttggagaaggaagaaaaggtcgaactgaccctggaccccgataccgccaatccacggctcatcttaagccttgatctgaaaggggtccggttgggggaaagggcccaagatctccctaatcacccatgtagatttgatacaaacactagggtgttagccagctgcgggttctctagcggacgacaccattgggaagttgaagtggggagtaaagatggctgggcattcggcgtcgcccgcgaatcggtccgcagaaaagggcttacccctttcacacctgaagaaggcgtctgggctcttcaactcaatggggggcagtattgggccgttacatcgccagaaagatctccgcttagctgcggccatttaagccgtgttcgggtcgccctggatctcgaggtaggcgcagtgagcttctacgccgtcgaggacatgaggcatctttacactttccgcgttaactttcaggaacgcgtgtttccacttttcagcgtatgctctactgggacctacctaagaatttggccttag

SEQ ID NO: 209804 - DNA, 990 bp, Artificial Sequence
  Description of Artificial Sequence: Synthetic coding sequence
atgacccaggccaccggccagatgctgtgcctgcacgtgcaggtgccacttcagcttcttctcttagggcaaaagcagatggccgcggagcaagaaaaagtcggagctgaatttcaagcactacgcgccttcctggtggagcaggagggcagactcctgggaagattggaggagcttagcagggaggttgcgcagaaacagaatgaaaacctggcccaactcggcgttgaaatcacacagctgtcgaaactctcgtctcagattcaggagacggcccagaaacctgatttagattttctacaggaatttaaatctacccttagccgatgctctaacgtaccaggtccgaaacccacaactgtgtcatccgagatgaagaataaggtgtggaacgttagccttaagacttttgtgctgaagggcatgttgaagaagtttaaggaggatctccgaggcgaactggaaaaggaggagaaagtggagctcactctggatcccgatactgccaaccccagactgattctgtctctggatctgaagggggttcgacttggagaacgggcacaggacctcccaaatcatccatgtcgatttgatactaacaccagggtcctcgcgagttgtggattctcatccgggcggcaccactgggaggtcgaagtggggtcaaaggatggatgggccttcggggtggcccgggaatccgtaagacggaagggactcacccccttcacaccagaagagggggtttgggcacttcaactgaatggcggccagtactgggcagtgactagccctgaacgtagccctctgagctgcggtcatctgagtagggtgagagtggcactcgacttggaggtcggcgccgtttctttttacgcagtcgaggacatgcgccatctttatacattccgagtgaatttccaagagcgagtgtttcccctgtttagtgtttgtagcacaggaacctatcttaggatatggccatag

SEQ ID NO: 209805 - DNA, 912 bp, Artificial Sequence
  Description of Artificial Sequence: Synthetic coding sequence
atggccgccgagcaggagaaggtgggcgccgagttccaggccctgagagccttcctggtggagcaagaaggccggctgcttggacggctggaagagcttagtcgagaagttgcccagaagcagaacgagaaccttgcacaactcggcgttgaaatcacacagctgtctaagctgtcttctcagatccaggaaacagcgcagaaaccagatctcgacttcctacaggagtttaagtcaaccctgtcccgatgtagcaacgtccccggtccgaaaccgactactgtttcatccgaaatgaagaacaaggtgtggaatgtgagtcttaagaccttcgtgcttaagggtatgttaaaaaagttcaaggaggatctgagaggcgagcttgaaaaagaggaaaaggttgaactcaccttggatccagacaccgctaatccgaggctgatactgagcttagacctaaaaggggtaaggttaggagagcgggcccaagacctgccgaaccacccctgtcgatttgacaccaacactcgggtcctggcgagttgcggtttcagctcaggtagacaccactgggaggtggaggtgggctctaaagatggatgggcattcggcgtggccagagagtccgtgaggcggaaaggattgacccccttcaccccagaggagggagtctgggccctgcagctgaacggtgggcaatattgggctgtgaccagtcctgaacgttcacctctttcttgtggccaccttagtagagtgcgtgttgcgcttgacctggaagttggcgcagtgtccttttacgccgtagaggatatgcgtcacctctatacgtttcgcgtcaactttcaggagcgggtgttccccctgttttccgtgtgcagcactggtacatacttgagaatctggccttag

SEQ ID NO: 209806 - DNA, 1434 bp, Artificial Sequence
  Description of Artificial Sequence: Synthetic coding sequence
atgagcgccgcccccggcctgctgcaccaggagctgagctgccccctctgtctgcaacttttcgatgcgccagttactgctgaatgcggccacagtttctgtcgtgcatgcctcggaagagtggcaggtgaacccgccgccgacggaaccgtgctgtgcccgtgctgtcaggccccaacacgacctcaggctctctcaaccaatcttcagctcgcgcgcctggtcgaagggctcgcacaggtgccgcaagggcactgtgaagaacacctcgaccctctctcaatctactgtgagcaggatagagcgttagtctgcggagtgtgcgcctcgctggggagtcatcgggggcaccggttgcttcctgccgccgaagcgcatgcacgtctgaagacccagctgccgcagcagaaactccagttacaagaagcctgcatgcggaaggaaaaatcagtggcagtcctagaacaccagctggtggaggtggaggagactgtgcgacagttcaggggtgccgtgggggagcaactcgggaagatgcgcgtgttcctcgccgccctggaggggtcattagacagagaagcagaaagggtaagaggcgaagcaggggttgcgctgagacgggagcttggttcattgaatagttatctcgagcagcttaggcagatggagaaggtcctggaggaggtagccgataaaccccagacagagttcctgatgaagtactgtctggttacctctcggttgcagaagatcttggctgaaagtccccctccagctcgcctcgacatccagctcccaattatctcagacgatttcaagtttcaggtgtggcgtaagatgtttagagccttgatgcccgccctcgaggaattaacttttgaccctagctcagcacaccccagtctggtggtgtcctcgtctggaaggagggttgagtgctccgagcagaaagcaccaccagctggagaggacccgaggcagtttgataaggccgtagctgtagtcgcccatcagcaactctccgaaggtgaacactattgggaagttgacgttggcgataagcctagatgggctttaggcgtgatagctgcagaggcgccacggcgcgggcgcttacatgctgttccctcccaaggcctgtggctgctaggtctgagggagggtaaaattctcgaagctcacgtcgaagctaaagaacctcgcgccctccgctctcctgagcggagacctactcggattggtctttatctgtcctttggcgatggagtgctgtccttttacgacgcatccgatgccgacgcgctcgtgccactcttcgctttccacgagaggttaccgaggccggtgtacccgttttttgacgtgtgttggcacgacaaagggaaaaatgcccagccacttctgctggtcggccctgagggtgccgaggcctag

SEQ ID NO: 209807 - DNA, 753 bp, Artificial Sequence
  Description of Artificial Sequence: Synthetic coding sequence
atggcctggcaggtgagcctgctggagctggaggaccggctgcagtgcccaatttgcttggaagtcttcaaggagtctctaatgctgcagtgcggacactcctactgtaagggatgcctcgtcagcctcagctatcatttagacacaaaggtgagatgtccaatgtgctggcaggttgtcgatggcagcagctcccttcccaatgtgagcctcgcctgggtgattgaagcactaagactgcccggagatcccgaaccaaaggtatgtgtccatcacaggaatccattgagcctattttgcgaaaaggaccaagagttgatatgtggtctgtgtggcttgttaggctctcatcagcaccatcctgttaccccggtgtctaccgtgtgctcacgcatgaaggaagagcttgcagcgctgttctctgaactcaagcaggaacagaaaaaggtggacgagctgatcgccaaactcgtgaaaaaccgcacccgcattgtcaacgagtccgatgtgttttcctgggtgatcaggagggagtttcaggagctgcggcatcccgttgacgaagaaaaggcaaggtgcctcgaaggcattgggggccataccagggggttggtggcctctctggatatgcagctggaacaggcccaagggaccagagagcgcttggctcaggctgagtgcgtgttggaacaattcggaaacgaggaccatcatgaatttatctggaagtttcattctatggcctcccgctag

SEQ ID NO: 209808 - DNA, 849 bp, Artificial Sequence
  Description of Artificial Sequence: Synthetic coding sequence
atggcctggcaggtgagcctgctggagctggaggaccggctgcagtgcccaatctgcctcgaggtttttaaagaatccctcatgcttcaatgcgggcacagctactgcaaaggctgcctagtgtccctctcctaccacctggataccaaagtgagatgcccaatgtgctggcaggtcgtggatggctcctcctcactaccaaacgtgtccctggcctgggtgattgaggcactgaggttgcccggcgatcctgaacccaaggtttgtgtgcaccataggaacccattgagcctgttttgtgagaaagaccaggagctgatctgcggactatgtgggctgcttggatcacaccaacatcaccccgtcacgccggtgtctaccgtctgctcccgcatgaaggaggagctagctgccctgttcagcgagctgaaacaagagcagaagaaagtggatgagctaatcgccaagcttgttaagaacaggactcgcattgttaatgaaagcgatgtcttcagctgggtcataaggagggaattccaagaacttcgacacccagtggacgaagaaaaggccagatgcttggaagggatcggcggtcacacaagaggtctcgtggcttcactggatatgcagctggagcaggcacaaggaactagagagaggctggcccaggctgagtgtgtgctcgagcagttcgggaacgaggaccaccacgaatttatttggaaatttcatagtatggcgtctaggctgactaagactgaggagcttgagaaaaagtggagaaatggattggccgcttctcactctctgcctcagcaggtgcgccctcaaagaagaaccccttag

SEQ ID NO: 209809 - DNA, 753 bp, Artificial Sequence
  Description of Artificial Sequence: Synthetic coding sequence
atggcctggcaggtgagcctgctggagctggaggaccggctgcagtgccctatttgcctagaagtgttcaaagaatccctgatgctccagtgtggccactcgtactgcaagggctgtctcgtgtctctctcctaccatctggatacaaaggtcagatgtccaatgtgttggcaagtagtggatggatcatccagcctccctaatgtgagtctggcgtgggtgattgaagctttgcggctccctggtgatcccgagcccaaagtatgtgtgcaccatagaaatcccttgtcactgttttgtgaaaaggatcaggagctgatttgtgggttgtgcggcctgttgggcagccatcaacatcatcctgttacgcccgtgagtaccgtttgctctaggatgaaagaagaactggctgcacttttctcagagctcaaacaggagcagaagaaagttgatgaactcatagccaaattggtgaaaaaccgaacacgcatagtgaatgagagtgacgtattctcctgggttatccgccgtgagttccaggagctgcgtcatcccgtcgatgaggagaaggctagatgcctggagggaatcggcggacatacacgcggcctcgttgcttccctggatatgcagttagagcaagctcagggcactagggagcgattagctcaggccgaatgtgtcctagagcagttcggcaatgaggaccaccatgaattcatatggaaattccactccatggcttctagatag

SEQ ID NO: 209810 - DNA, 750 bp, Artificial Sequence
  Description of Artificial Sequence: Synthetic coding sequence
atggcctggcaggtgagcctgctggagctggaggaccggctgcagtgtccaatatgccttgaggtgtttaaggaaagcctcatgctgcagtgcggacatagctattgcaaaggctgcctagtgtcgctctcgtatcacttggacacgaaagtgcggtgtcctatgtgctggcaggtagtagacggctcctcaagtctgcctaatgtctcgttagcttgggtaatcgaagctttgcgcctacccggcgacccagaaccaaaagtctgcgtgcaccataggaatcctctgtctcttttttgcgaaaaggatcaagagctgatctgtggcttgtgtgggctcctgggctcccatcagcatcaccccgtgacccccgtatcaactgtgtgttcgcgcatgaaagaagaactggctgccctgtttagtgaattgaagcaggaacagaaaaaggtcgacgaacttatagccaagctggtcaaaaacaggacacgcattgtgaatgaatccgacgttttctcctgggtgataaggcgcgagttccaggagctaagacatcctgtggacgaagaaaaggcccggtgcctcgaaggtatcggtgggcatacgagaggcctggtcgcatccctggacatgcagctggagcaagcacaaggcacccgagagcgcctggcccaagctgagtgtgtgctcgagcaatttgggaatgaggatcaccatgagttcatctggtttcactccatggccagcagatag

SEQ ID NO: 209811 - DNA, 753 bp, Artificial Sequence
  Description of Artificial Sequence: Synthetic coding sequence
atggcctggcaggtgagcctgctggagctggaggactggctgcagtgtcccatctgtctggaggtgttcaaggagtctttgatgctccagtgcggtcacagctactgtaagggctgcctcgtgagtctgtcttatcacctggacaccaaagtgcggtgcccaatgtgctggcaggtggttgacggctcttccagtctccccaatgtgagtctcgcgtgggtcattgaggcgctgagacttcccggggatccagagcctaaagtgtgcgtccaccatagaaaccctctaagcctcttctgtgagaaggatcaggagttgatttgcggcctttgcggcctattgggatcacaccaacaccacccagtcacccccgtgagcacagtctgtagccggatgaaggaggagctggcagcgctctttagtgaactgaagcaggagcaaaaaaaggtcgacgagctgatcgcaaaacttgtgaaaaatcgcactaggattgtcaacgagtcagatgtttttagttgggtgattaggagggagttccaggagctccgacacccagtagacgaggagaaggcacgttgcctcgaaggtataggaggacatactaggggacttgtggcaagcttggatatgcagttagaacaggcccagggaactagggagcgactcgcacaggccgagtgtgtcctcgaacagtttggtaacgaggatcatcacgagttcatctggaagtttcactccatggccagtagatag

SEQ ID NO: 209812 - DNA, 750 bp, Artificial Sequence
  Description of Artificial Sequence: Synthetic coding sequence
atggcctggcaggtgagcctgctggagctggaggactggctgcagtgtcctatctgcctagaggtcttcaaagagtcccttatgcttcagtgtgggcactcctactgtaaaggatgtctcgtttcgctgagctaccatctagacacaaaagtcaggtgtcccatgtgctggcaggttgttgacggatcatcaagccttcctaatgtgagtctggcttgggtgatagaggccttaaggctacccggcgaccctgagcccaaggtttgtgtacatcatagaaaccctctgtccctattctgtgagaaggaccaggagttgatttgtgggctatgcgggttgcttgggtctcaccagcaccaccctgttacacccgtgtctacagtttgtagccgaatgaaggaggaactggccgctttatttagtgaacttaaacaagaacagaagaaggtggacgaactgatcgcaaaacttgtgaagaacaggacacggatagtcaatgaaagtgacgtattctcatgggtgatccgacgggagtttcaggaacttcgtcacccggtggatgaagaaaaggctaggtgtttagaagggattggtggccatactagagggctggtcgcctccctggacatgcaactcgagcaggcgcaagggacgagggagcgcttagctcaggctgagtgcgtgctcgagcaattcggcaacgaggatcatcatgagtttatttggtttcattccatggcctctcgatag

SEQ ID NO: 209813 - DNA, 1656 bp, Artificial Sequence
  Description of Artificial Sequence: Synthetic coding sequence
atggccgagaactggaagaactgcttcgaggaggagctgatctgccccatttgtttacacgtttttgtcgagcccgtgcagcttccctgtaaacacaatttttgtcgaggctgtataggagaagcctgggccaaggacagtggcctggtaagatgcccagaatgtaatcaagcatataatcagaagcccggcctggagaagaatctgaaactgaccaacatcgtggaaaaatttaatgcactgcacgtagagaaacctccagccgccctccactgtgtgttctgccgacgtggaccaccgttgcccgcacagaaggtgtgtttgagatgcgaagccccttgttgtcagtcacacgttcagacacacctgcagcagccaagtacagccaggggccaccttctggttgaggccgatgatgtgcgcgcatggagttgcccgcagcataacgcctacagactgtatcactgcgaggcggagcaggtggcagtgtgtcaatactgctgttattatagcggggctcaccaggggcacagcgtctgcgacgtcgagatcagacggaatgagattcgcaagatgttaatgaagcaacaggaccgattagaagagagggagcaggacatcgaagaccagctgtacaagctggaatctgataagaggctagttgaggagaaggtgaaccaactgaaggaagaggttcggctccaatacgaaaaactgcatcagctgctggatgaggacttacggcagaccgtcgaggtgttggacaaggcccaagccaagttttgctcggaaaatgctgctcaggcgctccaccttggtgagcggatgcaggaggcaaagaaactgctgggctctttacagttgcttttcgacaagacggaggacgtgagctttatgaaaaacacaaagagcgtgaagatcctgatggaccggacacagacgtgtactagctcttccctctcgcccacgaagatcggacatctgaattcaaaactctttcttaacgaagtggcaaagaaagaaaagcaactgcgcaagatgctggaaggtccattctctacgcctgtgcctttcctacagtccgtcccactgtatccttgcggtgtttcctcaagcggggccgagaagcgcaagcatagcactgccttcccagaagctagtttcctggagacctcctccggacctgtgggcgggcagtacggtgccgctggcactgccagcggcgaggggcagtcaggccagccattggggccatgttccagtacccagcacctcgtagccttacccggaggcgcccaacctgtccattcctcacccgtctttcctccgtcacagtatcccaatgggtccgcggcacagcaacccatgctcccccagtacggtggaagaaagatcctggtatgctcagtggacaactgttactgctcctccgtggccaatcacggcggccaccaaccatacccccgttccgggcacttcccttggactgttccatcacaggaatactcacatcctctgccccctactccatctgtaccccagagcctaccttctctggctgttcgtgactggctcgacgccagccagcagcccgggcaccaggacttttaccgggtttacgggcagccctccactaaacactacgtgacatcttag

SEQ ID NO: 209814 - DNA, 1653 bp, Artificial Sequence
  Description of Artificial Sequence: Synthetic coding sequence
atggccgagaactggaagaactgcttcgaggaggagctgatctgccctatatgcttacatgtttttgtcgaacctgtgcagctcccctgcaagcacaatttctgtaggggctgcataggagaagcgtgggctaaggattcagggctcgtgcggtgtccagagtgtaatcaggcatataaccaaaaaccaggcttagagaaaaacctcaagctgaccaatatagttgaaaagttcaacgcgctacatgtggaaaaacctccagccgcactccattgtgtcttttgccgtagggggcctccgcttcctgctcagaaggtctgccttaggtgtgaagcgccatgttgccaaagtcacgtgcaaacccatcttcagcagccttcaacggcccgcggacatctcctcgtggaagctgacgacgttagagcctggagttgtccccagcacaacgcatatagactgtatcactgtgaagcagaacaggtcgctgtgtgtcagtattgctgttactactcgggagctcaccaggggcatagtgtgtgtgatgttgaaatccggaggaatgagatcagaatgttgatgaagcagcaggatagactggaagagagggaacaagatatcgaagatcagttatacaaactcgaatcagacaaaagacttgtggaggagaaggtgaaccagctaaaagaggaggtccggctgcagtatgaaaagctacaccagttattggacgaggatttgcggcaaacggtggaggtgctcgacaaagcccaggccaaattctgttcagaaaacgcagcacaagctctgcacctaggagagaggatgcaagaggcaaaaaagctcctaggcagcctgcaattgctgtttgataaaaccgaggacgtgtcctttatgaaaaatacaaagtcggtgaagattttgatggaccgcactcaaacatgtaccagttcctctctgtccccaacgaaaatcgggcatttaaacagcaaactgtttctcaatgaggtggcgaagaaagagaagcagctgcggaaaatgctcgagggaccattttcgaccccggtgccatttttgcagtccgtgcccctgtatccgtgtggcgtttcctccagtggagccgagaagcgcaagcactccaccgcgtttcctgaagcgtccttcttagagacctcctcgggcccggttggaggccaatatggagccgccggcactgcttctggcgaggggcagtcaggacagccactgggcccatgcagcagcactcagcacctggtggcacttcccggtggggcccagcctgttcacagcagcccagtattccctccctcccagtatcccaacggctccgccgcgcaacaaccaatgttaccccagtatggtggacgcaagatcctggtatgcagtgtggataattgctactgtagtagcgtggcaaatcacggcgggcatcaaccctatcctaggtcaggccattttccatggactgtgcctagccaggaatacagtcaccctctgcctcctacaccgtcggtcccgcagagcctcccctccctcgccgtgagggactggcttgatgcttctcagcaacccggacatcaggatttttaccgtgtgtacggtcagcctagcaccaagcattacgtgactagttag

SEQ ID NO: 209815 - DNA, 2133 bp, Artificial Sequence
  Description of Artificial Sequence: Synthetic coding sequence
atggaggagatggaggaggagctgaagtgccccgtgtgcggcagcttctatcgggagccaattatactcccatgctctcataatctgtgtcaggcctgcgcaaggaacatcttggttcagactccggaatctgagtcaccgcagtcccaccgggccgccggatccggcgtctctgattatgactatctggatctggacaaaatgagcctgtattcagaggcggactcgggctatggttcctatggtggctttgcgagcgcgccaacaactccctgccagaagtccccaaacggagtgcgtgtgtttccgccagctatgccgccacccgcaacccacctgtcgcccgcccttgcgccagtgcccagaaatagctgtattacctgtcctcaatgccacagaagcctgatactggacgacagggggctccggggattccccaagaatcgggtgctggagggggtgatcgataggtatcagcagtccaaagccgcagccctgaaatgtcagctctgcgagaaagcaccaaaagaagccactgtaatgtgcgagcagtgcgatgtgttttattgcgatccttgtagacttaggtgtcatcctccacgggggcctctggccaagcatcggctggtgccgccagcccagggcagggtatcgcgacgtcttagtcccagaaaggtgagcacgtgcactgaccacgagcttgaaaatcacagtatgtattgcgtccagtgcaaaatgcctgtgtgttaccagtgtttggaggaaggtaaacactccagccacgaggttaaggcacttggcgctatgtggaagctgcataagagtcagctgagccaggcccttaacggcctgtcagatagagcgaaggaagctaaggagttcttagtccagctgcgaaacatggtacagcaaattcaggaaaactcggtcgagttcgaagcttgcttagtcgcacaatgcgacgctctgatcgatgccctcaatagaaggaaggctcagctgttggcgagggtcaataaggagcatgagcataaacttaaggtggttcgggaccaaatttcccactgtaccgtaaagctccgccagacaaccggccttatggaatactgcttggaggtcatcaaggaaaacgatccttcgggattcctacagatatccgacgccctaatccggcgtgtgcacctgacggaggaccagtggggaaaaggaacactgacgccgcgaatgactactgattttgacctgtcgctagataactctcccctactccaatctatacatcagctagattttgtccaggttaaagcttcaagccccgttcctgcgacacccatcctacaactcgaggagtgctgcactcataacaatagcgccacactgtcctggaaacagccaccactaagtaccgttcctgcagacggctacatcctggagctggatgatggcaatggaggtcaattcagagaagtgtatgtcggcaaagagacaatgtgcactgttgacggcctacactttaactcaacttacaatgcccgggtgaaagcgttcaataagactggtgtaagcccatattccaagaccctggtgctccagacttccgaagtggcttggtttgccttcgaccctggatccgctcattccgacatcatcctgagcaacgacaatttgaccgttacgtgctcgtcttatgatgatcgagtggtcctcggaaagaccggctttagtaaaggaattcactactgggagttgactgtcgatcggtacgacaaccaccctgaccccgcattcggcgttgcgagaatggacgtaatgaaggacgtgatgctcggcaaggatgataaagcctgggctatgtatgtggacaacaatcggtcctggtttatgcataataattcgcatactaacagaaccgagggaggtatcaccaagggcgccactatcggcgttctattggatttgaacaggaagaaccttactttctttatcaatgatgagcaacagggtcccatcgcttttgataacgtggagggtctgttttttcccgcagtgtcactcaatcgcaatgtccaggttaccctccatacaggattgccggttccggacttttattccagtagggccagcatcgcatag

SEQ ID NO: 209816 - DNA, 2409 bp, Artificial Sequence
  Description of Artificial Sequence: Synthetic coding sequence
atggaggagatggaggaggagctgaagtgccccgtgtgcggcagcttttacagggagcccatcattttgccatgcagtcacaatctgtgccaggcatgcgcgcggaatatactcgtgcaaactcctgaatccgaatctccacagtctcacagggcggcggggagtggtgtctccgattacgactatttggaccttgacaagatgagtctatactccgaggcagactcaggctacggaagctacggaggatttgcatcagcccccactaccccatgtcagaaaagtcccaacggcgtcagagttttccctcctgccatgcctcccccagccacacatttgtctccagctctcgcccctgtacccagaaacagttgcattacctgccctcagtgtcacagaagcttaatccttgacgataggggccttcggggctttcctaaaaaccgggtgctggaaggtgtgatcgatcgctaccagcagagtaaagccgctgcccttaaatgtcagttgtgtgaaaaggccccaaaggaggcaacagtgatgtgtgaacagtgcgatgtcttttattgcgacccttgccgcctaaggtgtcacccaccacgaggcccactcgctaaacacagactggtgcctcccgcccaaggaagggttagcagacggctctcaccaagaaaagtgtccacgtgcaccgaccatgagctcgagaatcattcaatgtattgcgtccagtgcaagatgcccgtgtgctaccagtgcttggaagaggggaaacattcttctcatgaggtcaaggcccttggcgccatgtggaagctacacaagtcccagttatcccaagcgctaaatggactgtcagacagagcaaaagaggccaaagaatttctcgtgcaactccgcaatatggtgcagcagatccaagaaaactcagtggagtttgaggcctgcctggttgctcagtgtgacgcacttatcgatgccctgaacagaagaaaagcccagctcctggcacgggtcaataaggagcacgagcataaactgaaagtggtcagggaccagatcagtcactgcaccgtaaaattacggcagaccacgggcttgatggaatactgcctcgaggtgataaaagagaacgacccctcagggttcttgcagatatctgatgcactcatccggcgggtgcacttgaccgaagatcaatggggcaaaggcacgttgacacctcgaatgactacagactttgacctttctctcgacaacagtccattgcttcagagtatacaccagctggacttcgtgcaggtgaaggtgcctgccactcccatcctgcaactggaagaatgttgtacccataataattccgccacactgtcctggaagcaaccacccttgtccaccgtccctgccgatggttatatcctggagctcgacgatggtaacggtggccagtttcgagaagtgtacgtcgggaaggagactatgtgtaccgtcgacggactccacttcaatagcacgtataacgcccgcgtaaaggccttcaacaagaccggggttagcccctactccaagacacttgtcctccagacttcagaggataccgatagcgaggaacagaccctccccttcccagtcccatcagaacggctgccgttaaggagaatgtctcccttctcctccacacttaacctacagccttcatttccaggaagaagttattttgactttcgtagttcccctcatcagctttctctgcactcaagtttgcagtctctgaacgcacccggatgtaactttgaaacccagagcgctccttactctcagctcgttgatatcaaaaaattgctggctgttgcttggttcgcttttgacccagggtcagctcactcagatattatcctgtcgaacgacaacctgactgtaacttgcagttcttacgacgatagggtcgtcctgggaaagacggggttctccaagggtatccactactgggaattaaccgttgaccggtatgacaaccatcccgaccctgcgttcggcgttgcacgtatggacgtcatgaaagatgtcatgctggggaaggacgataaagcctgggctatgtacgtggataacaatcgcagttggttcatgcacaacaacagtcatacaaatcgcacagaggggggcattaccaagggggcaactatcggtgtgctcctcgatctgaaccgaaaaaacctgacattctttattaacgacgaacagcaaggaccaatcgcctttgataacgtggaaggtctttttttccccgccgtgtccctgaatcgaaatgtgcaagtgtctacacttccattgcggctcaattcatgttgttggttaccggtgcaacgtctgccacgcgcagtgcagtctaacagaagggaaggatcttag

SEQ ID NO: 209817 - DNA, 1653 bp, Artificial Sequence
  Description of Artificial Sequence: Synthetic coding sequence
atggaggagatggaggaggagctgaagtgccccgtgtgcggcagcttttatagagagcccataattctgccctgtagccataacctttgccaggcatgcgctagaaatatcttggtccaaactccagagtccgagagcccgcagtctcatcgcgcagcaggatccggcgtctcagactacgactacctggatcttgacaagatgtccctttacagcgaggctgattccgggtacggatcttacggtggcttcgccagtgccccgacaactccttgccaaaaatctcccaacggtgtaagggtgttcccacctgcaatgcctcctcctgctactcacctatcgcctgctctggcccccgtccccaggaactcatgtatcacctgcccgcagtgccaccgttcattgatattggatgatcgcggcttgagggggtttccaaaaaatagggtgttggagggcgtgattgatagatatcagcagtccaaggctgccgcccttaagtgccagttgtgcgaaaaggctccgaaggaggcaacggtgatgtgcgaacagtgtgatgtgttttactgcgacccctgccggctgagatgccacccaccaagggggccgctcgctaagcatcgcctcgttccgccagctcaggggagagtcagtaggaggctctccccaaggaaagtgtccacttgtaccgaccacgaactggagaatcactccatgtactgcgtccagtgcaaaatgccagtatgttaccagtgtctcgaagagggtaaacacagtagccacgaggtgaaggctctgggggctatgtggaaactccataagtcccagctcagccaggctctgaacggcctttctgatagagccaaagaagcaaaagagtttttagtgcagctcagaaacatggttcagcaaattcaggaaaatagcgtagagtttgaagcgtgtctggttgcgcagtgcgacgcactcatcgatgccttgaacaggcgtaaagcacaactcctcgcgagggtcaacaaggaacacgaacacaagttgaaggtggtgcgtgatcaaatttctcattgcaccgtcaaactcaggcaaaccaccggccttatggagtattgtctcgaggttatcaaggaaaatgatccttctgggtttttacaaatttccgacgccttgatccgccgcgtacacctcaccgaggaccagtggggaaagggaactctgacgccgagaatgaccacggactttgatctgtcgctggacaattcgccactgttgcagagcattcaccagctggatttcgtacaggtgaaggcgagtagtcctgtacccgccacccccatactacagcttgaagagtgctgtactcacaataactccgccacactcagctggaaacaaccaccactctctaccgtgcccgcagacgggtatattctggagctcgatgacggcaacggggggcagtttcgggaggtgtacgtggggaaagaaaccatgtgcaccgtggatggacttcactttaacagtacgtataatgctcgggttaaagcattcaacaaaactggagtgtcaccatattcgaaaaccttggtattgcaaacaagtgaaggaaaggccctccagcagtacccatccgagagagaactgcggggcatatag

SEQ ID NO: 209818 - DNA, 3750 bp, Artificial Sequence
  Description of Artificial Sequence: Synthetic coding sequence
atggccaccgccgccaccgaggagcccttccccttccacggcctgctgcccaaaaaagagacaggtgcagcctcctttctgtgtagatacccggaatacgacggtagaggcgtattaatcgccgttctggacacaggcgtcgaccccggggctccgggcatgcaggtcaccacggatgggaagccaaagatcgtcgatatcatcgatactacgggctccggcgacgtgaacaccgccactgaggtggagcccaaggatggcgagattgtgggcctctcgggacgcgttttgaagattcctgcctcatggaccaatcccagtggaaaataccacatcgggatcaaaaatggttatgacttctaccctaaagcactgaaggaacgtattcagaaggagaggaaggagaaaatttgggaccccgttcaccgggtggctttggctgaggcctgccgaaagcaggaggaatttgatgttgcaaacaacggatcatcgcaggccaataaattgattaaagaggagctccagtcccaggtggagctgctgaacagctttgagaaaaaatatagtgatccaggccccgtgtacgattgtctggtgtggcatgatggggaagtctggagagcctgcatagactcgaatgaggacggggatctcagcaagagcaccgtccttaggaactacaaggaagcccaggagtacggctccttcggcacagccgagatgctcaattactccgttaacatttacgatgacggcaatctgctgtccatcgtgacatcaggtggagcgcatggcacccatgtagcctctatagccgccggtcacttccccgaggaacccgagcggaacggagtggccccgggggctcagattctgagcatcaagattggagatacacgattatctactatggaaaccggaactggactgattcgtgccatgattgaagtgatcaaccacaagtgcgacctcgtaaactactcctatggcgaggcaactcactggcccaatagcggtaggatctgcgaagttattaatgaggctgtctggaaacacaatatcatctatgtatcttctgcaggaaataacggcccatgcctgagcactgtcggctgccccggcggtacgacctcctccgtaataggtgttggggcctacgttagccctgatatgatggtggctgaatacagtctgcgggagaagctgccagccaaccagtatacctggtcctcgcggggcccgtccgccgacggagcattgggggtgtctatttcagccccaggcggagccattgctagtgtgccaaactggacactgaggggcacacagctgatgaacgggacgtcaatgtcttccccaaacgcatgtggaggcatcgccctgatcttgtcaggcctgaaagccaataatatcgattacacggtgcactcggtcaggcgcgccctagaaaacaccgccgtcaaagccgacaatattgaagtgtttgctcagggccatgggattatacaggtcgataaagcttatgattacttagtgcagaatacatccttcgccaataagctgggtttcaccgtgactgtgggaaacaacagaggcatctacctcagagatccagtccaggtggccgctcccagcgaccacggggtgggaattgaacccgtttttcctgaaaacacagaaaatagcgaaaagataagcttacagttgcaccttgcactcacatccaatagcagctgggtgcagtgtccctctcaccttgagctcatgaaccaatgtcgccatatcaacattagagtagaccctaggggtctacgcgagggcctccactacaccgaagtgtgtggatacgatattgctagtccaaatgccggacctctgttcagggttccaataaccgctgttatcgcagcgaaagtgaatgagagcagtcactacgacctcgccttcaccgacgtccacttcaagcccggacagattagacgccactttattgaggtgcctgaaggggccacctgggccgaggtcacggtttgttcttgctcctccgaagtctccgctaaattcgtcctacacgcggtgcagctggtcaagcagcgcgcgtataggtcacacgagttctacaagttttgtagtctccccgagaagggtactcttaccgaagccttccccgttctaggcggaaaagccatagagttctgtattgccagatggtgggcttcactgagtgatgtgaacatcgattatacaatcagtttccacggaatcgtgtgcaccgccccacagctgaatattcacgcatccgaagggatcaaccgttttgatgtgcaaagctctcttaagtacgaggatttggctccatgcatcacacttaagaattgggttcagacccttaggcccgtcagcgccaagacaaagccacttgggtccagagacgtgctgcctaataaccgccaattatatgagatggtactcacctacaactttcaccagccaaagagtggagaggttacgcccagctgccctctcctgtgcgagctcctgtacgagtccgagtttgattcgcagctgtggatcatctttgatcagaacaaacgacagatggggagcggagatgcctacccacatcaatattcgctgaagctggaaaagggtgactacaccattagactgcagatccggcacgagcagatatctgacctggaacgtctcaaggatctaccctttattgtgtctcatcgcctgagcaacaccttgtccctggatatccatgagaatcatagcttcgccctgctgggcaaaaagaaatcgtcgaacctgaccctcccaccgaaatacaaccaaccattctttgtaacatctctccccgacgataaaatacctaaaggagccggcccagggtgctatctggcagggtcactgaccctttctaagacagagctcggcaagaaagcggacgtgatccctgttcattattatttgattcctcctcctactaaaaccaagaacgggagcaaggacaaagaaaaagattcagagaaagaaaaggacctgaaagaggagtttaccgaagccctgcgtgacctgaagattcagtggatgactaaattggactcctctgacatttataacgagttgaaggagacctaccctaactacttgccactctacgttgctaggttacaccagctggacgccgagaaagagcggatgaagagactgaatgaaatcgtcgacgcggctaacgcggtaatatcacacattgaccagactgctctggcggtgtacattgctatgaagacagacccccgtccagacgccgccaccatcaaaaacgatatggacaagcaaaaaagcacattagtggacgcactttgccggaaaggttgtgccctcgccgatcaccttttacacacacaggcacaagatggcgcaatctccacagacgccgaggggaaagaggaggaaggagaatcacccctggacagcctcgcagaaactttttgggaaactacaaaatggactgacctgttcgacaacaaggtactcactttcgcttacaagcatgctctcgttaataagatgtacggccgtggtctgaaattcgctaccaaactggtagaggagaagccgaccaaagagaactggaaaaactgtattcagctgatgaaactacttggttggacccattgtgccagcttcaccgagaactggctgcctattatgtaccctcccgattactgcgtgttctag

SEQ ID NO: 209819 - DNA, 1791 bp, Artificial Sequence
  Description of Artificial Sequence: Synthetic coding sequence
atgctgcccagccaggcccagggcctgctgtggtgggtgttccccctctttcccgccagttccctcagttacccacctgtgtcgtacagagcagatgggcttgcccggaacacctttctgaaagcctgttcagaaagcagctcatcctccaacatttccacaatgctggttacacatgactacacagctgtaaaagaggatgaaatcaacgtctaccagggcgaggtggtgcagatcttagcttcgaatcagcaaaatatgtttctggtgtttagggcggctacggaccagtgccctgctgcagagggctggatccccggctttgtgctgggccacacaagcgccgtaattgtcgagaatcctgatgggaccttaaagaaaagcacaagctggcacaccgcactcaggttgcgcaaaaagagtgaaaagaaagacaaagacggcaagcgcgaaggcaaacttgaaaacgggtaccgaaagtcacgtgaggggctgagcaataaggtgagcgtgaaacttctgaatcctaactacatctatgacgtgcctccggagttcgtgattcccctgtccgaagttacttgtgaaaccggtgaaactgtagtgctccggtgtcgcgtgtgtggtaggccaaaagccagtataacctggaagggtccagagcacaatactctcaacaacgacgggcattactctatttcgtacagtgatcttggggaagctaccttgaagatcgtcggagtgactacggaagacgacggcatttacacatgcattgctgtaaatgatatgggttccgctagctcttccgcgtcgctccgcgtgctaggccctggaatggatgggattatggtcacatggaaagataacttcgacagtttttactcagaggttgctgagcttggccggggcaggttttccgtggtgaagaaatgcgatcagaagggtacaaagcgcgcagtggcgacaaagtttgtgaataaaaaactaatgaagagagaccaggtgactcatgagctgggcatcctgcaatccctccagcaccccttacttgtgggcttgctggacaccttcgagacaccaactagttacattctggtattagaaatggccgatcaggggaggcttcttgattgtgttgtcagatggggctccttgactgagggtaaaattcgggctcaccttggagaggtactggaggccgtccggtacctgcacaactgccgaatcgcacacctagaccttaagcctgagaatattttggtcgacgagagcttggctaagcctactatcaaattggcggacttcggcgacgctgtccagctgaacacaacctattatattcatcagctgctggggaatcctgaattcgcggcacctgaaatcatccttggaaatccagtatcgctgacttcagacacgtggagcgtcggggtcttgacctatgttctcctctctggtgtttccccctttctggacgattcagtcgaagaaacgtgccttaacatttgtcggcttgatttctctttcccggacgattactttaaaggagtctcccagaaagccaaggagtttgtatgtttcctattgcaagaagatcccgcaaaaaggccgtccgccgccttggcactacaggagcagtggctgcaggccggcaatggccgatccactggcgtgcttgatacatcaaggctgacatcattcatcgaacggaggaagcatcagaacgacgtgcggccgatacgcagcatcaagaacttcctccaatctcgcttactgcctcgcgtatag

SEQ ID NO: 209820 - DNA, 9294 bp, Artificial Sequence
  Description of Artificial Sequence: Synthetic coding sequence
atgagcggcagcagcggcggcgccgccgcccccgccgccagcagcggccccgccgcagctgcttctgctgccgggtcaggatgtggtggcggcgccggggaaggcgctgaggaggctgcaaaagacctagccgatatagccgccttctttcggtctgggttcaggaaaaatgacgagatgaaagcgatggatgtactccccatcctcaaagagaaagtagcctacctgagtggtggccgagataagagagggggacccatacttacgttccccgcgcggtctaaccacgaccgcatccgtcaggaggaccttcggcgcttaatcagctacctggcctgcattcctagtgaggaagtgtgcaagcggggtttcaccgtgattgtggatatgcggggcagtaagtgggactctataaagccgctcctgaagatattacaggaatctttcccatgctgtatccatgtagctctcatcatcaagcctgacaacttctggcagaaacaaaggaccaactttggtagttctaaattcgagtttgaaacaaacatggtaagcctggaaggactgactaaggtggtcgacccttctcagctgacccctgaatttgatggctgtctcgagtacaaccatgaggagtggatcgaaatcagggttgcatttgaggactacattagtaatgctactcatatgctttctaggctggaggaactacaggatatactcgccaagaaagaactgccacaggacttggagggggcccggaacatgattgaggaacattcacaactgaagaagaaggtgataaaagcacctattgaggatctggacctcgaaggacaaaagctgttgcagcgaatccaatctagcgaatcattcccaaaaaagaactccggaagcgggaacgccgatctccagaatctattgccaaaggtgagcacgatgttggacaggcttcactctacacgacagcacctacaccagatgtggcacgtgcgcaaattgaagttagaccaatgcttccagctgaggctcttcgaacaagatgctgaaaaaatgtttgattggattactcacaataaagggttgttcctcaattcttacactgagattggaacaagccatcctcacgcaatggaacttcaaacccaacataaccacttcgcaatgaactgtatgaatgtctacgtcaatattaaccggattatgtctgtcgccaaccgcttagtggagagcggacactatgcaagccagcagattaggcagatcgcatctcaattggaacaggagtggaaagctttcgcagccgcgctggatgaaaggagcaccctccttgacatgtctagcatcttccatcagaaagcagagaagtatatgagcaatgtggatagctggtgtaaggcatgcggcgaggttgatctgcctagcgagctacaggatctggaggacgccattcatcatcatcagggtatctacgagcacataacactcgcctacagtgaggttagccaagacggcaaaagtctgttggacaagctgcagcgccctttgacacctggctcctctgattctctgactgctagcgcaaattattcaaaggccgttcaccatgtgttggatgtgattcacgaagtactgcaccaccagaggcagctggaaaatatttggcagcaccggaaagttcgactgcatcagagattacagttgtgcgttttccagcaagatgtgcaacaagtgctggactggatcgagaaccatggtgaagctttccttagcaagcacactggcgtggggaagagcttacacagagccagagccctgcagaaaagacatgaagacttcgaagaggtagcccagaatacctacactaatgcagacaaactgctggaggcagctgagcagctagctcagacaggcgaatgcgaccctgaagagatataccaggccgcccatcagctagaggatcgcatccaggacttcgtacgcagagtcgaacagcgcaaaatcttactggatatgtcagtgtccttccacactcacgtgaaggagctctggacttggctggaggagctgcagaaagaactgctggatgacgtgtacgccgagagcgtagaggcagtacaggacctcatcaaacgattcggacagcaacagcagactactctccaggtgacagtcaacgtgatcaaagagggcgaagatctaatccagcagctgcgagattcagcgatatctagcaataagacacctcacaactccagcatcaatcatattgaaaccgtactgcaacaactagacgaggcccagtcgcagatggaagagctctttcaagagcgaaagatcaaattagaactgtttttacagctgcggatctttgagcgtgatgctatagatattatttcagatctggagtcatggaatgacgagctaagccagcagatgaacgacttcgacaccgaggatctcaccattgccgaacagcgcctacaacatcatgctgacaaagctttgaccatgaacaacctgacattcgacgtcatccatcaggggcaagaccttttacagtacgtgaacgaagtacaagccagtggtgtggaactcctgtgtgatcgagatgtcgacatggctacccgggtgcaggacctactcgagttccttcatgaaaagcagcaggagctcgaccttgccgcggagcagcacaggaaacatctggaacagtgtgtgcagcttcggcatttacaggctgaggttaaacaggtcctaggctggatcaggaacggcgagtctatgctcaacgccggtttaattactgcctcatcgctgcaggaggcagagcagctgcagagagagcatgaacaattccagcacgccatagaaaagactcatcagtcagcattgcaggtgcagcagaaggccgaggccatgcttcaggctaatcattacgatatggacatgataagggactgcgccgagaaagtcgcttcacattggcagcagctgatgttaaagatggaagatcgcctcaaacttgtgaatgcctctgtggccttctacaaaacctccgagcaagtgtgttcagtgttggaaagcctagagcaggaatacaaacgagaggaggactggtgcggcggcgcagacaaacttggacctaactcagagactgatcacgtcacaccaatgataagcaaacacttagaacagaaagaggctttcctgaaagcttgcacactggcccgcagaaatgcagatgtttttttgaaatatttacacaggaattccgtcaacatgccagggatggtcactcacattaaggcccccgagcagcaggtgaaaaatatacttaatgaactctttcagagggaaaatagagtactccattactggaccatgagaaaacggcgactagaccaatgccagcagtatgtggtgttcgagcgctctgccaagcaggccctcgaatggattcacgacaacggggagttttatctgtccacccacacgagtacagggtcatccatccagcatacccaagagctcctgaaggaacatgaggaattccaaataaccgcaaagcaaactaaagaacgtgtcaagcttctgatacaactcgcggatggcttctgcgaaaaaggccacgcacacgctgccgagattaaaaagtgtgtcacggccgtggacaagcgataccgcgactttagcctgagaatggaaaagtaccgcaccagccttgaaaaagctcttggcatttcatcggactctaataagtcctctaagtccttacagttggacattatcccagcatcgattccaggtagtgaggtgaaattaagggacgccgcccatgagctgaacgaagagaagagaaagtccgctcgcaggaaggagttcatcatggctgagctgatccagaccgagaaggcctacgtgcgggatctcagggagtgtatggacacctacctctgggagatgactagtggggtcgaggaaatacccccaggcatcgtgaataaggagttgattattttcggaaatatgcaggaaatttatgagtttcacaataacatctttctaaaagagctggagaaatacgaacagttacccgaagatgtgggccactgttttgtcacatgggccgataagtttcaaatgtacgtcacctactgtaagaacaaacccgacagcacccagcttattttggaacatgcaggcagctactttgacgaaatccaacagcggcacggtcttgcgaatagcataagcagctacctcatcaaaccagtccagcggattacaaagtaccaattactgttgaaggaactgttgacctgctgcgaagagggaaagggcgaaattaaggacgggttagaggtgatgttatctgtgccaaaacgcgcaaatgacgccatgcacctgtctatgctcgaaggcttcgatgagaacattgagtctcaaggagaacttatactccaagaaagctttcaggtgtgggatccaaagaccctgatcaggaaaggtagggagcgccacttgtttctgttcgagatgtcactcgttttctccaaggaggttaaagattcctccggccgcagtaagtatctgtacaaaagtaagttgtttacatctgagctgggggtgaccgagcacgtcgaaggcgacccttgtaaattcgccctttgggtgggccgaactccgacctccgataacaagattgtgctgaaggccagcagcatcgaaaataaacaggactggattaagcatatccgagaggtcatccaggaaaggacgatccatctcaagggtgccttgaaggagccaatccatatccccaagaccgctccagctacccggcagaaaggccgacgcgatggtgaagacttggacagtcagggcgatggttcaagtcagcccgacaccatcagcatagcttctaggacctcacagaatacactcgactccgataaactttctggagggtgcgagctgactgttgtgattcacgactttaccgcttgtaacagcaatgagctcacaatacgccgaggccagacggtggaggtgctggagcggccacatgataagcccgactggtgtttggtgcgcactactgatcgcagccctgctgccgagggtctggtcccctgtggatctctgtgcatcgcccatagcagatctagtatggaaatggaaggcatcttcaatcacaaagatagtttatcagtaagttccaacgatgctagcccaccagctagtgtggcctcactacagcctcatatgattggcgctcagtcctcacccggtccaaaacgacctggaaataccctacgcaagtggctgacctcccctgtgaggcgcctgtcctctggaaaagcggatggtcatgtgaagaagttagctcacaagcataagaaatccagggaggtcagaaagtctgcggatgccggcagccagaaggatagtgacgatagcgcagcgacaccccaagacgaaaccgtggaggagcgggggcgcaacgaggggctgtcgtctggtacgctaagtaaatccagctccagcggcatgcaatcatgcggcgaagaggaaggagaggagggcgccgacgcggtacctctgccccctcccatggctatccagcagcactctctcttacagcctgattctcaggacgataaggcatcgagccgcttgctggtgcgtcctacgtcgagcgagaccccatctgccgccgagttagtaagcgccatcgaagagctggtgaaaagcaagatggcactcgaagatcgcccttcctcccttctggtggaccagggggactcaagcagtcccagttttaatccttctgacaactctttgctcagtagcagctccccaattgacgagatggaagaacgaaagagttcaagcttaaagcggcggcactatgtacttcaggagctcgtcgagactgagagagattacgttagagacctgggttacgtagtcgagggatatatggcccttatgaaggaggacggtgttcctgacgatatgaaggggaaagacaagatcgtgttcggcaatatacatcagatatatgattggcatagagactttttcctgggggaattggaaaaatgtctcgaagaccccgagaaactcggcagccttttcgtgaaacatgagagaagactccacatgtacattgcctactgccaaaacaaacccaaatccgaacatatagtctcagagtatattgacacattcttcgaggatctgaagcaaagactcggccaccgcctccaactaaccgacttactgatcaagcctgtacagcggataatgaagtatcaactcttgctaaaggatttcctgaaatactccaaaaaagcctcgctggacacatcagagctggagcgggctgtggaggtcatgtgcatagtgccccggcgctgtaatgacatgatgaatgtcggacgtcttcagggcttcgacggaaaaatagtggctcaggggaaactgctccttcaggacacatttctggtcacggaccaggacgcaggactcctgccccgctgcagggagcgtagaatcttcctgttcgagcagatcgtgatattctccgagccactggacaagaaaaaagggttctcaatgcctggtttcctgttcaagaattctataaaggtgtcctgcttatgtcttgaggagaatgtggaaaatgacccctgtaagtttgcgctcacaagtagaaccggggacgtggtcgagacctttatcctccacagttcatcaccttctgtcagacaaacatggattcacgaaatcaatcagatattggagaatcagcgcaattttctgaatgcattgacaagccccattgagtatcagcgcaatcattctgggggcggaggcggcggcggctccggtggctcaggaggcggaggcgggagcggtggaggaggcgctccgtccggtggctctggacactcaggagggccctcaagttgcggcggagccccctcaacttccagaagtcggccaagcagaataccacaacctgtccgccaccatccaccggtcttggtcagtagtgcagcttcatcacaagcagaggctgataagatgtcgggaacgtccacccctggaccgagtctaccccctcccggcgccgctcctgaagccggacccagcgccccatccaggcggcctcctggcgctgatgcggaaggatcagagagagaggcagagcctatccctaaaatgaaggtgctggagagccctagaaagggagcagccaacgcaagcgggagttcccctgacgcacctgcgaaagatgcccgagcttccctcggcaccttaccccttgggaagccccgcgccggggccgccagcccccttaacagccctctgtcaagcgcggtcccgtctttggggaaagaaccctttcctccttcatcccctctgcagaagggtggatcattctggtcgtctattcctgccagccccgccagtcgccccgggagcttcacattccccggcgacagcgactcccttcagcgacaaacacccaggcacgccgcccctggtaaagataccgaccgcatgtctacctgctcatctgcatctgaacagagcgtgcaatctacgcagtccaatggatcggaatcctcttcttcaagcaatatctccacgatgctcgtcactcacgactacaccgcggttaaagaggacgagatcaacgtctatcagggggaagtagtgcaaatccttgccagtaaccagcaaaatatgtttctggtgttcagagcagcgaccgatcaatgcccagctgctgagggatggatcccaggttttgtcctgggccatacaagtgctgtgattgtggagaatcctgatgggacattaaaaaagtccacaagctggcataccgctttacgactgcggaaaaaaagcgaaaagaaggacaaggatgggaagagagaggggaagctggagaacggttaccggaagtccagggaaggcctcagtaacaaagtatccgttaaattactgaatcctaattacatttatgacgtaccacctgaattcgtcatcccgctgtctgaggtgacgtgtgaaaccggagaaactgtggtgcttagatgccgcgtctgtggccggcctaaggcatccatcacctggaagggaccagagcataatacactcaataacgatggccattattccatcagttatagtgacctaggtgaggccactctgaagatcgtgggggtcactactgaggatgatggaatttacacctgcattgcagttaacgacatgggctcagccagttcttccgcatctctccgggtgttgggacctggaatggacggcatcatggtgacgtggaaggataacttcgactctttttattctgaagttgctgaacttggcagaggccgattttccgtggttaagaagtgtgatcaaaaaggaaccaagcgggccgttgccacaaaattcgtgaacaaaaaactcatgaagagggaccaagtcacccatgagctcggaatactgcaaagtctccagcaccctttacttgtcggtctgctcgatacgttcgagactcctacatcatacatccttgtcctggagatggctgaccagggacgcctgctggattgcgtggtcaggtggggttctcttaccgagggtaaaattcgcgcacatctgggagaagtccttgaggcagtgaggtacctccacaactgccggatagcacatctggacctcaagcccgagaacatcttagtcgacgagtcattggcaaaacccacaatcaaattggcagactttggcgacgccgtccagttgaatactacatactacattcaccagttgttaggcaatcctgagtttgctgctcccgagattatccttgggaatcccgtaagcctgacctcggacacatggagtgtgggcgtcctcacttatgtgctgctgtccggcgtctctccttttctggatgatagcgtggaagaaacctgtctcaatatttgcagactggacttctctttccccgatgactacttcaagggggtgtcacagaaagcaaaagaattcgtgtgcttcctactacaggaggacccggctaaaagacctagcgctgccctagccttgcaggagcagtggttgcaggctggcaatggccgatccacaggggttcttgacaccagtcgcttgaccagtttcatcgagcggagaaagcaccagaacgatgtgagacccattcggtctatcaaaaacttcctacaatccagattgcttccccgagtttag

SEQ ID NO: 209821 - DNA, 7503 bp, Artificial Sequence
  Description of Artificial Sequence: Synthetic coding sequence
atgctggaccggctgcacagcacccggcagcacctgcaccagatgtggcatgtccgaaaattaaagctagatcaatgttttcaactgaggctgtttgaacaggatgccgagaagatgttcgactggattacccataataaaggtctgttcctaaatagctatacagagatcggaacttcccacccacacgccatggaactgcagactcagcacaatcatttcgccatgaattgtatgaatgtctatgtgaatattaacagaattatgtccgtggccaacaggctggtcgagagtggacactatgcctctcagcagattcggcagattgcctcccaattagagcaggagtggaaggccttcgccgccgccctggatgaacgcagtacattgctagatatgtctagtattttccatcagaaagccgaaaaatatatgtcaaatgttgacagctggtgcaaggcctgtggcgaggtggacttgccctccgagcttcaagaccttgaggacgctattcaccatcaccaggggatctatgaacatatcacactggcatactctgaagtctcacaggacgggaaatcccttctcgacaagctccaacggcccctcacccccggttcttccgattcactgacagcttccgccaattattcaaaagcggtccatcacgtcttggatgtgatccacgaggtccttcaccatcaaagacaacttgagaacatttggcagcaccgaaaggtccgcttgcaccagcggctccagctgtgcgtctttcagcaagatgtccaacaggttctggattggattgaaaaccacggcgaagccttcctctccaaacatactggcgttggaaagagccttcatcgggcgagggcgttacaaaagagacacgaagacttcgaggaggtggcgcagaacacatatactaacgcagacaagctgctggaggcagctgaacagttggcccagaccggggaatgtgatcctgaggaaatctaccaagccgcgcaccagcttgaggacagaattcaggatttcgtccgtagagtggaacagaggaaaatactcctggatatgagtgtctcctttcatacccacgtgaaggaactgtggacttggctggaggaactgcaaaaagagctgctcgatgacgtttatgctgaaagcgtggaagccgtgcaggacctcatcaagaggtttggacagcagcagcagactacactccaggtcacagtcaacgtcataaaggagggtgaagacctgatccaacaacttcgcgactcagcaatctcttctaataagacgccccacaacagctcgattaatcacattgagaccgtgctacagcaactggatgaagcacagtctcagatggaggagttgtttcaggaaaggaagattaagctggaactgtttcttcaactccgcatctttgaaagagatgcaatcgacatcatatcggacctggagagctggaatgacgagctcagccagcagatgaacgattttgacacagaggacctgacaatagccgagcagagactccagcaccacgccgacaaagccttaacaatgaacaacctgaccttcgacgtcattcatcaaggacaggacctgctgcaatatgttaacgaagtgcaggcctccggcgtggaactgttatgtgatagagatgtggatatggccacgagagttcaggatctactggagtttctccatgagaagcagcaggagttggacctggcagccgagcagcacaggaagcacctagaacaatgtgtgcagctccgccatctgcaagccgaagtgaagcaggtgctgggctggatccggaatggtgaatcaatgcttaacgcggggctgattacagccagttccctccaggaagccgaacagctgcaacgggagcacgaacaattccagcacgcaattgagaaaacccaccaatctgcgctgcaagtgcaacagaaggcagaggcgatgctgcaggccaaccattacgacatggacatgattcgggactgtgcggagaaggtggcgagtcattggcagcagctgatgctcaagatggaggatcggctaaaattggtgaatgctagcgtggccttctataagaccagtgagcaagtgtgttctgttctcgagtctctggaacaggagtataaacgggaagaggactggtgtggtggagccgacaagctgggacccaacagtgagactgaccatgttactcctatgatatccaaacatcttgaacagaaggaggcatttctgaaggcatgtaccctcgctcgacgcaatgccgatgtcttccttaagtaccttcaccgcaattccgtgaacatgcctggcatggtaactcacataaaggccccagagcaacaagtgaagaatatcctgaatgaattattccaaagagagaacagggtgctgcactactggacaatgcgtaaacgtagacttgatcagtgccaacagtacgttgtcttcgaacgctccgctaaacaagccctggagtggatccatgacaacggcgaattttatctgtcaacgcacaccagcaccggcagctcaatccagcatacccaagaactgctgaaggaacacgaagagtttcagatcaccgccaagcagacaaaagagagagtcaaactgctgattcaactcgcagacggcttctgcgagaaggggcacgcccacgcagcggaaatcaagaagtgcgtgaccgccgttgacaagcgataccgggatttttccctcaggatggagaagtaccgcacgagcctcgagaaagcacttggtattagcagcgattctaacaagagctcaaagagcttgcagttggacattattccggcgagtattccaggcagcgaggtgaaactccgggatgccgcacacgagttaaatgaggaaaagcgaaaatcggcacgaagaaaagaattcatcatggcggaactcattcaaactgagaaggcttacgtgagggatttgcgggaatgcatggatacttacctctgggaaatgacctcaggcgtggaggagattcccccagggatagtgaacaaggagttaataatcttcggtaatatgcaggaaatatatgaattccacaataatattttcctgaaggaactagaaaagtacgagcagctacccgaggatgttggtcattgcttcgtgacttgggcagacaaatttcagatgtacgtcacttattgtaaaaacaagcctgacagcactcagctgatactagaacacgccggtagctattttgatgagatccagcagcgacatggcctcgctaactcaataagcagttatctaattaaacctgttcagcggatcacaaaataccagttactgctgaaagaattgttaacttgttgtgaggagggcaagggtgagatcaaagatggccttgaagttatgctgagcgttccgaaacgcgccaatgacgccatgcaccttagcatgctggaagggtttgatgagaacatagagtcccagggcgagctcattcttcaggaaagctttcaggtttgggaccccaaaacactgatccgtaagggcagggagaggcacctttttctattcgagatgagtttagtgttcagcaaagaggtcaaagatagttccgggcggagcaagtacttatacaaaagcaaactgtttaccagcgagctgggcgtgaccgaacacgtggagggggacccctgcaagttcgcgctatgggtcggacgaaccccaaccagcgataataagatcgtgttgaaggctagtagcatagaaaacaaacaggactggattaagcatatccgcgaggtaatccaggagaggactatacatctgaagggcgcgctaaaagaaccaatccatatcccgaagacagctccagcgacgcggcagaagggcagaagggacggagaagatttagacagccagggggacgggtcttcccagcccgatacaatcagtatcgcctcacgcacctctcagaacaccctcgacagtgataaactttctggaggctgtgaacttactgtagttattcacgacttcacagcctgcaactctaacgaacttaccatccggcgaggccagacagtggaagtgcttgaaagaccacatgacaagccggactggtgcctcgtgcgcactacagatcgatcccccgcagctgaggggctggtcccttgtggctctttgtgcatagcccatagtcgtagttcaatggagatggagggtatttttaaccataaggactcccttagtgtgtcatcaaatgacgccagtcctcctgcttcagtcgcatcactgcagccccatatgattggggcccagtcctcacccggaccaaagagaccgggcaatacccttcgaaagtggttaacatcccccgttcggcggctatcctcaggaaaggcagatggccatgtgaaaaaactggcacacaagcataaaaaaagcagggaggtacgcaagtccgcagacgccgggagtcagaaggactcagatgatagtgctgctacaccacaggatgagacagtcgaagagagggggaggaacgagggcctctcaagcgggactctgtccaagagttcctccagcggcatgcagtcttgtggagaagaagagggggaagaaggcgccgatgccgtccccctccccccccccatggccatccagcagcactccctgctccaacccgattcacaagatgacaaggcttcctcccggctcctggtgaggcctaccagcagcgagacccccagcgctgctgagctcgtatcagcaatcgaagaattggtgaagtctaagatggctctggaagatcggccttcgtccctcctcgtcgaccagggagatagctcgagccccagcttcaaccccagcgataactcactcttgagctcttcttccccgatcgacgagatggaggagagaaaatccagttccctcaaaaggaggcattacgtcctccaggaactggtggagaccgaacgggactacgttcgtgatctcggttacgtggtggaaggctacatggccttaatgaaggaagatggagttccagacgacatgaagggcaaggataaaatcgtcttcggtaatatccaccagatctacgactggcatcgggactttttcctaggcgagcttgaaaaatgccttgaggacccagagaaactgggctcactatttgtcaaacacgagcgccgcctgcatatgtacatcgcctactgtcagaataaacccaaaagtgagcacatagtatcagaatatattgacacattctttgaagatctgaagcagagacttggtcaccgactgcagctgacggacctgcttatcaagcccgtgcagcgaatcatgaaataccagctcctgctaaaagactttctcaaatactcaaagaaggctagtttggatactagtgagctcgagcgcgccgtagaggtcatgtgcattgtcccccgccgctgcaatgacatgatgaacgtgggcagactgcagggttttgacggtaaaatcgtcgcacagggaaaactgttattgcaagacaccttcctggtgactgatcaggatgctgggttgctacctcgctgcagagagaggcgaatttttctgttcgaacaaattgtcatctttagcgaaccccttgacaagaagaaagggttctctatgcctggtttcctgttcaagaattctatcaaggtgtcctgcctctgcctggaggagaacgtggaaaatgatccttgcaaattcgccctgacctcgcggactggagatgtcgtcgagacattcattctgcacagcagttcaccttccgtgcgccagacatggattcacgagatcaaccagatactggaaaatcagcgcaactttctcaatgccctcactagcccaattgagtaccagcgaaatcactccgggggcggaggggggggcggaagtggcggtagtggaggcggcggaggttccggcggcggaggagccccatccgggggcagcggccattcaggggggccttcatcatgcgggggcgccccatccacgtcacggagtagaccttcacgtatcccacaaccagttcgtcaccacccccccgtacttgtatcaagcgcagccagttcccaggccgaggcagacaagatgtctggcacctctaccccaggcccttcgttaccaccccctggggctgcgcccgaggcagggcccagcgcaccaagcaggcggcccccaggagcagacgctgagggctcagaaagagaagccgagccaattccaaagatgaaagtacttgagtcaccccgcaagggtgccgctaacgccagtgggtctagccccgatgcgccggctaaagatgccagggctagcctgggaactttgccgttgggaaagccacgggctggagctgcctctccactcaactctccactcagctcagctgtcccgtccctgggcaaagagccattcccgccttcatctcctctgcaaaagggtggcagcttctggtcgtcaattcccgcttctccggctagtagacccggcagctttacgtttcctggcgattctgacagtttacagaggcagacaccaagacacgccgccccaggaaaagataccgataggatgtccacctgtagctccgcctctgaacaaagtgttcagtcaacccagtctaacggttcggaaagttcatcatcctccaacatctctaccatgctcgttacacacgattatactgctgtgaaagaggacgaaatcaatgtttatcaaggcgaagtggtgcagatactggccagcaaccagcagaatatgttcctcgtctttcgcgccgccacggatcaatgtccggctgccgaggggtggattcccgggtttgtactgggccacactagtgcagtgatcgttgagaacccagatgggacactgaaaaaatccacatcctggcacacagctctccggctccggaagaaatccgaaaagaaagacaaggacgggaaaagagaaggcaagctggagaacggttataggaaatcaagggaaggactctcaaataaggtttccgttaaactcctaaaccctaattacatctatgatgtgccaccagagttcgtcattcccttgtcagaggtaacttgcgagaccggggaaacagttgtcttgagatgtagagtctgcggccggcctaaggcttccataacctggaaaggcccagaacacaataccttgaacaacgacggacactactcgatcagctactccgatcttggggaggctaccctaaaaatagtaggtgttaccacggaagacgatggaatctatacctgcatcgccgttaacgacatggggtcggccagttcaagtgcatccctacgagtactgggccctgggatggacggcattatggtcacgtggaaggataattttgacagtttttattctgaggtcgcagagttggggcgtgctaactggaacaactggtctccatattag

SEQ ID NO: 209822 - DNA, 8766 bp, Artificial Sequence
  Description of Artificial Sequence: Synthetic coding sequence
atgagcggcagcagcggcggcgccgccgcccccgccgccagcagcggacctgctgccgccgcgtctgctgcagggtccgggtgcggtggtggcgcgggtgaaggtgctgaagaggccgccaaggatctggccgacatcgccgccttttttcgctcgggattccgtaaaaatgacgagatgaaggcaatggatgtactcccgattctaaaggagaaggtggcttacctgagtggcgggcgggataagcggggcggacctatcttaacttttcctgctagaagtaatcatgacagaataagacaggaagacctgcgaaggctgatctcatatctcgcatgtattcctagcgaagaggtctgcaaaagggggtttaccgtcatcgttgacatgaggggctccaagtgggatagtatcaagccattactcaaaatattacaggaaagtttcccctgttgcatacatgtcgctctgatcattaagcccgacaacttttggcagaagcagagaacaaactttggttcttccaagtttgaattcgagacaaacatggtaagcctcgaagggctcaccaaagtcgttgacccctcccaactcacccccgagttcgatggttgcctggaatacaaccatgaggagtggatcgagatccgagtggcattcgaagattacatctcgaacgccacgcacatgctgtcccgcctggaggaactgcaggacatactcgctaagaaggagttgccccaggatttagaaggcgcccggaatatgattgaggagcactcacagctgaaaaagaaggtgatcaaagccccgatagaggatcttgacctggagggacagaagctcctgcagagaatccagtcatccgagtccttccccaagaaaaacagtggtagcggtaacgctgatctgcagaacctgttaccaaaagtgtccactatgctggaccgcctccatagcacccgtcagcatttacaccagatgtggcacgtaagaaaattaaagttggatcaatgtttccagttgcgtctctttgaacaggacgccgaaaaaatgttcgactggataactcataacaaagggttattccttaactcctataccgaaataggaacctcacaccctcatgcgatggagctgcagactcagcacaatcactttgcaatgaactgcatgaacgtgtacgttaatataaacaggattatgtccgttgcaaatagactggtggaatccggacactacgcctctcagcagatccgtcagattgcctcacaattggaacaggagtggaaggccttcgccgcagctctagatgagcgatctacactgttggacatgagctccatcttccaccaaaaagccgagaagtatatgtctaatgtggacagctggtgtaaggcatgtggcgaggtagacctaccctcagagctgcaggacctggaagatgctatccaccaccatcaggggatctatgagcacatcacgctggcttactcagaagtctctcaggacgggaagagtctgctggataagctacagcggccgctcacgcctggttcatctgactccttgactgcttccgccaattacagtaaggccgtccatcacgtactggacgtcatccatgaggtgcttcaccatcaaagacagcttgaaaatatatggcaacaccgcaaggtgcggctccaccagcgcctgcagctgtgtgtgtttcagcaggacgtgcagcaagtcctggactggatcgaaaatcacggggaggctttcctgtcaaaacacactggcgtaggaaagtcgttgcatcgcgcaagagctctccaaaagaggcacgaggacttcgaagaggtggcacaaaatacgtacactaatgctgacaagttacttgaggctgctgaacagctcgcccagacgggcgaatgcgatccagaagaaatctatcaagcagcccaccagctggaagatcgaatacaggatttcgttcgcagggtggagcagcggaaaattctacttgacatgagtgtgagttttcacacccatgtgaaggagctctggacgtggctcgaagaattgcagaaagaactgttagacgatgtgtacgcagaatccgtggaagccgtccaggacttgatcaaacggtttggccagcagcagcagaccaccctgcaggtgaccgtgaatgtcataaaagaaggagaagacctcatccagcaactacgcgacagcgccatttctagcaacaaaacgccccacaacagttccatcaaccacatagaaactgtgttgcaacagctcgatgaggcacaatcacagatggaggagctgttccaagagaggaagattaagcttgagctatttcttcaactccgcatcttcgagcgagatgccattgacattataagtgatcttgaatcttggaatgatgagctctcacagcagatgaatgatttcgacactgaggacctgactatagccgagcaacggttgcagcatcacgccgataaggctctcactatgaacaatctgacttttgacgtcatccaccaggggcaagacctgcttcagtacgtgaatgaagtccaggctagcggagtggaactgctctgcgacagggatgtggacatggccacccgtgtgcaggacctgctggaatttttgcatgaaaaacagcaggaactggatctggccgcagaacagcacagaaagcaccttgaacagtgtgtccaactaaggcatcttcaggcagaagtcaagcaggtcctaggttggattagaaacggggaatcaatgctaaacgcaggactgatcacagctagtagcctgcaagaagccgagcagttgcagcgagaacatgaacagtttcaacatgcgatagagaaaacgcaccaatcagcactccaggtccaacagaaggcggaagccatgctccaagccaaccactatgatatggacatgattcgggactgtgcagagaaggttgcaagccattggcaacagttgatgctcaaaatggaagatcggttaaagctggtgaatgcgtccgtggccttctataagacgagtgagcaggtgtgcagcgtgctggagtcattagagcaggagtacaaaagagaagaagattggtgtgggggagctgataaactagggcccaactcagagaccgaccatgtgaccccaatgatatccaagcacctagagcagaaagaggcatttctaaaagcttgtaccctcgctcgacgcaacgcagacgtgttcctcaaatatcttcatcgtaactctgttaatatgcctggcatggtgactcacatcaaagcacccgaacaacaggtgaagaacatccttaacgaactgttccagcgggaaaaccgcgtgctccactactggaccatgaggaaacggagactagaccagtgtcagcagtacgtggtgttcgaaagaagtgccaagcaggccctggagtggatccacgacaatggtgaattctacctctctacgcacacatctacagggagttctattcagcatacccaggagctcctgaaggagcacgaagaattccagatcacagcaaagcaaactaaagaacgcgttaaattgttgattcagctggctgatggcttttgcgagaagggccacgcccacgcggccgagatcaaaaaatgtgtaaccgctgtcgacaagcgttatcgagatttctcactccgtatggaaaagtacaggacatccctcgagaaggccctaggtattagttctgactctaacaaatccagtaagtccttacagttggacatcatccccgccagtattcctggttcggaggtgaagttaagggatgcggcacatgagctgaacgaagagaagcggaagagcgcgagaaggaaagaattcataatggccgagctaattcagaccgaaaaagcctatgtccgtgatttaagggaatgcatggatacttacctgtgggagatgacatcaggtgtggaagaaatcccccctggcatcgttaacaaggagctgatcatatttggaaatatgcaggagatttacgagtttcacaacaacatcttcctgaaagaattagagaaatacgagcagctcccggaggacgttggacattgcttcgtaacttgggcagataaattccagatgtatgtaacatactgtaaaaacaaacctgacagcacccagttaattctggagcatgcaggaagctactttgacgaaattcagcagcgccatggcctggcgaattccatttcaagttacctcatcaaacccgtccagagaatcacaaagtaccaacttctgctgaaagagctcctgacgtgctgcgaagagggaaagggagaaattaaggacggtcttgaagtgatgctaagcgtgccaaaacgcgccaatgatgctatgcacctttccatgcttgaggggttcgatgaaaacatagagagtcaaggcgagctcatcctacaagagagcttccaagtatgggatcccaagacactaattagaaaaggacgggagcgccatctgttcctcttcgaaatgtcactggttttcagcaaggaagtcaaagatagctcggggagaagtaaatacctttataagagtaaattgtttacctctgagctaggcgttaccgaacacgtggaaggagatccctgcaaattcgctctgtgggtcggcagaacccctacctctgacaacaaaatagtcctgaaggcgtcatcgattgaaaataaacaagactggatcaagcacattagggaggtgattcaggaaaggacaatccatctcaaaggagccctcaaggaacccatccacattcccaaaactgcaccagcaacccgccagaagggtcgtagggacggggaggacctggacagccaaggtgacggatcgtctcagcctgataccatctctatcgcctctcgaacttcccagaacactcttgactccgacaaactgtcaggtgggtgcgaactgacagtcgtcatacacgacttcaccgcctgtaactcaaacgagctgaccatacgtcgtggccaaaccgttgaagtgctagaacgcccacacgacaaaccagactggtgtctggtgagaacgaccgatagatcccctgctgcagagggcctggtgccatgcgggagcctctgcattgcccactcgcggtcctcgatggaaatggagggaatcttcaaccataaagatagccttagtgtgagctctaatgatgcttcaccacccgctagcgtggctagcctccaaccccatatgataggcgcccaaagcagcccaggcccaaaacgccccggcaatacgcttcgaaaatggctaacgtctcctgtgaggcgcttgtcgtccggaaaggccgacggccatgtgaaaaaactagctcacaagcacaaaaaaagtcgagaggtcagaaagagcgccgatgctggaagccaaaaggattctgacgatagcgcggcaacgcctcaggatgagaccgtcgaggagagagggcgcaatgaagggctctcttctggcacgctgagtaaaagttcttcatcaggaatgcagtcctgcggggaggaggaaggtgaggaaggagccgatgctgtgccgctcccgcctcccatggctattcagcagcacagtttgcttcagcctgactcacaggatgacaaagcatccagccggttgttggtgagaccaacaagctccgagacccccagcgccgctgaattagtgtccgccatagaggaattggtgaaatccaagatggcgctcgaagaccgtccctcaagcctgttggtcgatcaaggggacagctcatccccgtctttcaatcccagcgacaatagcctcctgtcttctagctctcccatcgatgaaatggaggaacggaagtcgtccagtttaaagaggcgacactatgtgctccaggagctagtggaaaccgagagggattatgtgcgcgatctgggctacgtggtcgaaggttacatggctctcatgaaagaagatggagtgcctgacgacatgaaagggaaggacaagatcgtgtttggaaacattcaccagatctacgactggcacagagatttctttctgggcgaactggaaaagtgtctcgaggatcctgaaaagctcggctctctattcgtgaagcacgaacgtcgactccatatgtacattgcttactgccagaataaacccaaaagcgaacacatcgtttctgagtacattgacaccttttttgaggacctgaaacagcgcctcggtcaccggttgcagctcaccgacttattgatcaagcccgtgcagaggatcatgaagtatcagctattgctaaaagacttcctcaagtatagcaaaaaggccagcctggacacatccgaacttgaaagggcagtggaggtcatgtgcattgtgccaagaagatgcaacgacatgatgaatgtaggcagactccaaggattcgacggtaagatagtcgcccagggtaaactgcttctccaagatacatttctggtgaccgaccaagacgcggggctgctgccccgctgtagagagaggcgcatttttctgtttgagcagatcgtgattttcagcgaacccttagataaaaaaaaaggattctctatgccagggttcttgtttaagaacagtattaaggtttcttgcctttgcctggaagaaaacgtcgaaaacgatccgtgtaagtttgcgctgactagtcgcacaggagacgtcgtagagacttttatattgcacagctccagccccagtgtgaggcagacttggatccatgaaatcaatcagattctcgaaaaccagcggaatttcctcaacgcactcaccagcccaatagagtatcagcggaaccactctggaggaggtggcggaggaggatctggtggctccggtggcgggggcggaagcggcgggggaggagcaccatcaggggggtcggggcattctggtggcccctcctcctgcggtggagcgcccagtaccagtcggtctagaccctctcgcattccccagcccgttagacatcaccccccagtgctcgtctcttccgccgcctctagtcaagccgaggcggacaagatgtcggaatcagagagttcttccagtagcaacattagcacaatgctggttacccacgattatacagcagtcaaagaggatgagattaatgtctatcaaggtgaagtggttcagatcctggccagtaaccaacagaacatgtttttggtgtttcgagcggcaaccgaccagtgtccagccgctgagggttggattcccggctttgtgctgggtcatactagtgccgtcattgtcgagaatccagatggtacgctaaagaagtccactagttggcatacggctctaagactccgtaagaagtccgagaaaaaggacaaagatggcaagagagaggggaagctggagaatggttacagaaagtcaagagaggggttaagtaataaggtaagcgtgaagctcctgaatccaaattacatctacgatgtccctcccgagttcgttataccactttccgaggtgacatgtgagacaggcgaaaccgttgtcctgcggtgccgggtgtgcggacgccctaaagccagtatcacctggaagggccctgaacacaatactctgaataacgatgggcattacagcatttcttattccgaccttggagaggcaaccctgaagatcgtgggtgtgaccacagaggacgacggcatctatacatgcatcgcagttaatgatatgggctccgccagctcttccgcatctcttcgcgtcctgggtccggggatggacgggataatggtaacctggaaggataactttgatagcttttactctgaagttgcggaactcggcagggggcgcttctcggtggtcaagaagtgcgaccagaagggtaccaaacgggctgtggcaaccaagtttgtgaataaaaaattaatgaagcgcgaccaggttacacacgaactcggcattttacagagccttcagcatccgttgctcgtgggacttctagatactttcgaaaccccaacctcctatatcctcgttctggaaatggcggaccagggccgattgttggattgtgtagtccgatggggatctctgactgaagggaagatccgggcccacctaggcgaggtcctcgaagccgtacgctatctgcacaattgtcggattgctcatctggacttgaagccggaaaatattctggttgacgaatcattggctaagcccaccataaaactggctgactttggtgacgcagttcagcttaatacgacatattacatccatcagctgctaggtaaccccgaatttgcggcccccgagatcatcctgggtaatccagttagcctgaccagcgatacatggagcgtaggtgtgctgacctacgtccttctgtctggcgtgtcaccgttccttgacgacagtgtcgaggagacatgtctaaacatttgtcgactagacttttcgttccccgacgactacttcaagggcgtgtctcagaaagcaaaggaattcgtttgctttctgctgcaggaggacccagctaaacgcccaagcgctgctttggcactgcaggagcagtggctacaggcgggaaatggtcggtcgaccggcgtgctcgatacctccaggctcactagcttcattgagcggcgcaaacaccaaaatgacgtgcgtccaatccgttccataaagaacttcctgcagagcaggttactcccaagagtctag

SEQ ID NO: 209823 - DNA, 768 bp, Artificial Sequence
  Description of Artificial Sequence: Synthetic coding sequence
atggccctggaggaccggcccagcagcctgctggtggaccagggcgatagtagttctccttcttttaacccgagcgataacagcttactttcttccagcagtccaatagacgaaatggaggagcgcaaatcaagctctttgaaaaggcgacattacgtgctccaggaactagtggagaccgaaagggattacgtgcgggacctgggctatgtggttgaggggtacatggctttgatgaaggaggatggcgtgcctgacgatatgaagggtaaggacaaaattgtgtttggcaacattcaccagatatacgattggcacagggatttttttcttggggaattggaaaagtgtctggaagatcccgagaagcttgggtcactgtttgttaagcacgagagaaggctgcatatgtacattgcatattgccagaataagcccaagagcgaacacatagtgagcgaatatattgacacattttttgaggaccttaaacagagactaggccacaggttgcagctgaccgacctgctcatcaagcctgtgcagcgcatcatgaagtatcagctgctgttgaaggacttcttgaaatacagtaagaaagcgtccctcgatacgtctgagctggaacgtgctgtagaagtaatgtgcatcgtcccgcgccgctgcaatgacatgatgaatgtgggccggctgcagggattcgacgggagggtagtggcgctgtgccaccgatttaaggaaactttccgcgaaatatgctggttttag

SEQ ID NO: 209824 - DNA, 1203 bp, Artificial Sequence
  Description of Artificial Sequence: Synthetic coding sequence
atgaacggccagctggacctgagcggcaagctgatcatcaaggcccagctcggcgaagacatacgcagaattccaattcataatgaggacattacatatgatgagctggtgctgatgatgcaaagggtgtttcggggcaagctgctgtccaatgacgaggttaccatcaaatacaaggacgaggacggggaccttatcacgatcttcgactcgtcggatttatccttcgcaatccaatgttcccggattctgaaactcacactcttcgtgaatggccagccaagaccacttgaatcttctcaagtgaaatatttgcggcgtgaattaattgagctgcggaataaggtcaacagacttctcgactctctcgaaccacctggcgagccggggccttcaaccaatatacccgaaaatgatactgtggatggccgagaggagaaaagtgccagcgactctagcggaaagcagtctacccaagttatggccgcatctatgagcgctttcgacccccttaaaaaccaagatgaaattaacaaaaatgtcatgtccgcatttgggctgactgacgaccaggtgtcggggccaccaagcgccccagctgaagataggagcggaacccccgacagcattgcatcatcatcaagtgccgctcatcccccgggagtgcagcctcaacagcccccatacacgggcgctcagacccaggccggtcagattgaaggtcagatgtaccagcaatatcagcaacaggcaggttatggggcacagcagccccaggcaccaccacaacagcctcagcagtatgggatacagtacagcgcatcctactcacagcagaccggaccacagcagccccagcagttccaggggtatgggcagcagccaacttctcaggccccagcccccgccttctcgggacaaccacagcagctaccggcacaacctccacaacagtaccaggcctccaactatcccgcgcagacttatacagcccagacaagtcagcctactaactacacagtcgccccagccagccaacccggtatggccccatcccagcccggggcataccagccgcggccagggtttacatccctcccagggagtactatgactcctccaccttccggccctaatccctacgcccggaacagacctcctttcggtcagggctacacccagccaggcccgggatacaggtag

SEQ ID NO: 209825 - DNA, 1101 bp, Artificial Sequence
  Description of Artificial Sequence: Synthetic coding sequence
atgaacggccagctggacctgagcggcaagctgatcatcaaggcccaattaggcgaagacataagaagaatcccaatccacaatgaagatatcacctatgatgagctcgtgctgatgatgcagcgcgtgtttcggggaaagctgctgtcgaacgatgaggtgaccatcaaatataaagacgaagatggagatttaatcacgatttttgacagtagcgatttgtcatttgccatccagtgctcgaggatcctgaaactaaccctctttgtaaacggtcagccgaggccactcgaaagcagccaggtgaaatatctaagacgagaattaattgagttgaggaataaagtgaacagattactggactctttggagccccccggggaacccggaccctctacgaatattcctgagaacgacacagtggatggccgtgaagaaaagagcgcatctgattcctctggaaagcagagcacccaggttatggccgcgagtatgagtgcatttgatccacttaaaaatcaggatgaaatcaacaaaaatgttatgtcagccttcggcctgaccgacgatcaggtctccggaccgccgtctgcacccgcggaagacagatctggcaccccagactctatcgcttcctcttccagcgccgcccatccccctggggtccagccccagcaacctccttacaccggtgctcaaacacaggctggacagatgtatcagcagtattcaaacaggcccgcgatggtgcattcatcacgtcgccttcacctcagcagcttaaacagcatggttttttctatacagcaggcaattgtttcaagattagacctcaacaatctgtcctccagccgcgatatggcatcgaaccagttgccacggcatcagctgctcccatttctcgtatcactaaataattgcctgctatcccggcactcctcaacaaggcgtgcgataattctccacaaattgactctgcctaaacttctcagcttattaatcatcctgtggctgctgccccttaatttggagtggttacaggcaaacttaggcccgataaaccaggaccaagtcttgttgcattttctcgaggtgccttag

SEQ ID NO: 209826 - DNA, 474 bp, Artificial Sequence
  Description of Artificial Sequence: Synthetic coding sequence
atgaacggccagctggacctgagcggcaagctgatcatcaaggcccagctcggcgaggatatcagaaggattccgattcataatgaagacattacatatgatgagttagtgctgatgatgcagagggtgtttagagggaaactgttgtcaaacgatgaagtgaccatcaaatacaaggatgaggatggtgatctgataaccatattcgacagttctgacctatctttcgccatccaatgttctaggatcttaaagttgaccctctttgtcaatggacagccacgacctttagagtcttctcaggtgaagtacttaagacgggagctaatcgaattgagaaacaaggtcaacaggctgctggattcgctggagcccccgggcgagcctggcccatctactaatatacccgagaatgacactgttgacggaagggaggaaaagtcagcttcggattccagcggtaagcagagctag

SEQ ID NO: 209827 - DNA, 387 bp, Artificial Sequence
  Description of Artificial Sequence: Synthetic coding sequence
atgaacggccagctggacctgagcggcaagctgatcatcaaggcccagcttggggaggatatccgccggatcccaatccataatgaagacatcacatatgacgaattggttctgatgatgcagcgtgtatttagagggaaactactgtccaacgatgaggtgaccataaagtataaagacgaggatggggacctgataacaatcttcgacagctctgatttgtcatttgccattcagtgctctaggatcctgaagttaactctattcgtaaatggacaacccagacccctggaatcatcacaggtgaagtatctacgtagggagctgattgagctgagaaataaggtaaatcgcttattggatagcctggaaccccctggtgaatag

SEQ ID NO: 209828 - DNA, 546 bp, Artificial Sequence
  Description of Artificial Sequence: Synthetic coding sequence
atgaacggccagctggacctgagcggcaagctgatcatcaaggcccaactgggcgaggacattcgcaggattccaattcataacgaggacataacttacgatgagctggttctaatgatgcaacgcgtctttagaggaaaacttctgtccaacgacgaggtgaccatcaaatacaaggacgaagatggagacctcattaccatcttcgacagcagtgatctcagttttgccatccagtgctcccgaatcttaaagctgaccctcttcgtgaacggccagcccagaccattggagtcttctcaagtgaaatacttacggcgcgagctgatcgaactgagaaataaagtgaatagacttcttgacagtctggaacctccaggggaacctggaccctcaaccaacatccctgagaacgacacagtggatggcagggaagagaagtcagccagtgactcttctgggaaacagtctactcaggtcatggccgcaagcatgtctgcatttgacccactgaagaatcaggatgaaatcaataaaaacgtgtag

SEQ ID NO: 209829 - DNA, 1203 bp, Artificial Sequence
  Description of Artificial Sequence: Synthetic coding sequence
atgaacggccagctggacctgagcggcaagctgatcatcaaggcccagttgggcgaagacatcaggcgcattcctatccataacgaagatatcacctacgacgagctcgttcttatgatgcaaagggtctttcgcgggaaactcttatctaatgacgaggtcacgataaaatacaaggatgaggatggcgatctaattaccatttttgattcatcagatctctcattcgctatccaatgcagtcgcattttgaagttaacacttttcgtgaatggccagcctcgcccacttgaatcctcccaggtgaagtaccttcggcgggagcttattgagctgcggaacaaagtgaaccgcctcttagattccttagagccgccaggagagccaggaccctccaccaatattcccgagaatgacactgtagatggtcgcgaggagaaatcagccagcgatagctctgggaagcagagcactcaggtgatggccgccagcatgtccgcgttcgacccgctaaagaatcaggacgaaatcaataaaaacgtcatgtcagcctttggcctgacggatgaccaggtgtccgggccccccagtgcccctgctgaagataggtccggaacaccggacagtattgcctcatcttcctcagccgctcaccccccaggtgtgcagccccagcaacccccgtataccggggctcagacacaggccggccagatcgagggtcagatgtatcaacagtatcagcagcaggcaggatacggcgcccagcaaccacaggcacctccccagcagcctcagcaatatggaatccaatattcggcttcatattcccagcagacggggccccagcaaccacagcaatttcaaggatatggtcaacagcctacctcccaggcccctgcccctgcgttctcaggccagccccaacagctcccggcgcagccccctcagcagtatcaggcctcgaactacccagcccagacctatacagcgcagacttctcagcccactaactacacagtagcccctgcctcacaacctgggatggccccgtcccagccaggcgcctaccaaccacgccccggttttacttctcttcccggctctaccatgacccctccaccctcgggccccaatccatacgctcgcaatcggccaccttttggacagggatacacacagccgggccctgggtaccgttag

SEQ ID NO: 209830 - DNA, 1191 bp, Artificial Sequence
  Description of Artificial Sequence: Synthetic coding sequence
atgaacggccagctggacctgagcggcaagctgatcatcaaggcccagctgggcgaggatatcagacggattcccatccacaatgaggatattacatacgatgagttagttctcatgatgcagcgagtcttcaggggaaagcttctaagtaatgacgaggttaccattaaatacaaggacgaagacggagatttaatcacaatttttgactcctctgacctctcctttgccatacagtgttcccgaattctgaaattgacactgtttgtcaatggccagccccgccccctggagtctagtcaggtcaagtatctgcggagggagctgatcgagttgcgaaacaaggttaacagactccttgacagcttagagccaccaggggaacccggaccttccacaaatattccagaaaatgatactgtggatggacgcgaggagaagtccgcctccgattccagtggcaagcagagcacccaggtgatggctgcatccatgagcgcattcgatccgctcaaaaatcaagatgaaatcaacaaaaatgtgatgtcggccttcggactgacagacgatcaggtgagtggcccgccgtcagcccctgccgaggacagatcaggcacacccgatagtatagcatcaagctcttctgccgcccacccacccggggttcagccacaacagccaccttacaccggggcccagactcaggctgggcagatgtatcagcagtatcaacaacaggcaggctacggcgcccagcaaccgcaggcccctccacagcagccccagcagtatggtatccagtactccgccagctactcccaacagactggaccgcagcagccccagcagtttcagggttatggccagcagcctacatctcaagcgcctgctcctgccttttctggccaacctcaacagctgcccgcccagccacctcagcaatatcaggcttcaaattaccctgcacagacctataccgcgcagactagccaacccaccaattacacggttgcccccgcatcacagccgggtatggcacccagccagccaggtgcctatcagccgcgtccgggcttcactagtctccccggatcaacgatgaccccccctccgagcggccctaacccctatgcacgcaatcgtcccccgtttggtcagggctacacccagcctggaccgggttatagatag

SEQ ID NO: 209831 - DNA, 729 bp, Artificial Sequence
  Description of Artificial Sequence: Synthetic coding sequence
atgggcgaggccagcccccccgcccccgcccggcggcacctgctggtgctcttgctcctcctctcaacgcttgtgatccccagtgcagccgcccctatccatgatgccgatgcacaggaaagctccctaggacttactggtctgcagagcctccttcaaggattctcccggttgtttcttaagggtaatttgctgcggggaatagacagcctgttttctgcacccatggattttagaggcctacctggaaattaccacaaagaagaaaaccaagaacatcaattgggtaacaatacactgagctcccacctccagatcgacaagatgacagataacaagacaggggaagtgctaattagcgaaaacgtcgtagccagcatccagccagctgagggtagctttgagggtgatctaaaagtcccgcgcatggaggagaaggaagccctggtgccgatccagaaggcaaccgattcgttccacaccgagctccacccacgcgtggctttctggatcatcaaactgcctcggcgcaggtctcaccaggacgcactggaaggggggcactggctgtccgaaaagcgtcatcggctccaggcaatcagagatgggttacgtaaggggacccacaaggatgtcctggaagagggcaccgaatcatctagccattcccgcttgtctccgagaaaaacccatttactgtacatcctgagaccatcgcgccagctgtag

SEQ ID NO: 209832 - DNA, 1980 bp, Artificial Sequence
  Description of Artificial Sequence: Synthetic coding sequence
atgcagggcagcagcctgtggctgagcctgaccttccggagcgcccgggttctctcgagagcccgcttcttcgaatggcagagtcctgggcttcccaacacagccgccatggagaacggtaccggaccttacggggaggaacgccctcgcgaggtccaggaaaccacagtgacagagggagccgccaaaattgcattcccttcagcaaacgaagtcttctacaaccccgtgcaggagtttaacagggatctgacatgcgccgtcatcaccgagtttgcacggattcagctgggcgcaaagggtattcagattaaggtgccaggcgagaaggatacacagaaggtcgtggtagacctctccgaacaggaagaagaaaaagttgaactgaaagaaagtgagaacttagccagtggcgatcaacctcgtaccgcggcagtcggggaaatatgcgaggaaggactgcacgtccttgagggcctggcagcctccggcctgagatccatccgattcgcgctcgaagtgccagggttgcgatccgtagtcgcaaacgacgcgtccaccagagccgtcgatttgattcgccgcaatgtccagctcaacgatgttgcccaccttgttcagccatcacaagctgacgccagaatgctgatgtaccagcatcagagagtaagcgaacgcttcgacgtcattgacctggatccctatggttcgcccgcaacctttctggacgctgccgtgcaggcggtgtccgaaggaggattactatgtgttacctgtacagacatggccgttctcgccggcaatagcggagaaacatgctactcaaagtacggcgcgatggctctgaaaagccgtgcatgccatgaaatggctctgcgcatcgtgttacattcacttgacctgagggctaattgttatcagcggtttgtggtcccactgcttagcattagtgcggacttctatgtacgagtgttcgtgagggtatttactggacaagcgaaggtgaaagcatccgccagcaaacaggccctcgtgttccaatgtgtgggttgcggcgctttccatctacaacgactgggtaaagcgtccggggtgccgagcggtcgggccaagtttagtgccgcttgcgggccccccgtgacccctgagtgcgagcattgtggccagagacaccagctcggtgggcccatgtgggctgaacccatccacgacctggacttcgtaggacgggtgctggaggccgtgtctgctaatcctggccggtttcataccagcgagcggattcgcggggtacttagcgtgattaccgaggaactgcctgatgtacccttgtactatactttggatcagctgtcaagtacgatccattgcaacactccgagcttgctgcagctaagaagtgctctcctacatgccgatttccgcgtgtcactcagtcacgcctgtaagaacgcggtgaagactgacgctcccgccagtgcgctgtgggacataatgcggtgctgggagaaggaatgtccagtcaagagagagcgactcagcgaaacctccccagccttccggatcctctcagtggagccccgcctgcaggccaattttacaattcgagaggacgccaacccttcatccaggcagaggggtctgaagcgtttccaagctaatcccgaggctaactggggacctcgtccacgcgcccgccctggtggcaaagcagcagacgaagcgatggaggagaggaggaggctcctccaaaacaagcgtaaggaaccacccgaggacgtggcccagcgggctgcacggctaaaaacctttccctgcaaacgcttcaaagagggcacttgccagaggggcgaccaatgctgctactcgcactctcctcccactccacgggtgtctgcagatgctgcccccgactgccccgagactagcaaccagacaccacctggtccgggtgccgctgctggccctggaattgattag

SEQ ID NO: 209833 - DNA, 1980 bp, Artificial Sequence
  Description of Artificial Sequence: Synthetic coding sequence
atgcagggcagcagcctgtggctgagcctgaccttccggagcgcccgcgtactctcccgtgccagattcttcgaatggcaatcaccaggtctccctaatacagccgcgatggagaatggcacaggaccatatggggaggaacgccctcgggaggtgcaggagacaacggttacagagggggctgcaaaaatcgcatttccttctgccaacgaagtcttctacaatccagtgcaggaattcaatcgcgacctcacctgcgctgtaattaccgagttcgccaggatacagttaggcgcaaagggcattcagataaaagtgcccggtgagaaggatacccagaaagtggtagttgacctgagtgaacaagaggaggagaaggtggagcttaaggaatccgagaacctcgctagtggggatcagccacgaacagccgccgtgggcgagatttgcgaggaagggctgcacgtactggaggggctggccgcctcgggactccggtctatcaggtttgcgctggaggtccccggactacgatcagttgttgcaaacgacgccagtacccgcgccgttgatctgatccgtagaaacgtccagttgaacgatgttgctcacctcgttcagcctagccaagcggatgcccgcatgctgatgtaccaacaccagagagtgtccgaacgcttcgacgttatagatctggatccatacggctctccagcaactttccttgatgctgctgtgcaggctgtcagcgaggggggactcctgtgcgtcacatgtacagatatggctgtgcttgcaggtaacagcggcgaaacttgctactccaagtatggcgccatggctctcaaatcacgtgcttgccatgagatggcactccggattgtgcttcacagcttggacctgcgggctaattgctaccaaaggttcgtggttccacttctcagcatttcagctgatttttatgtgcgagtatttgtgagggtgtttaccggccaggccaaggtgaaggcgagcgccagtaagcaggctttagtctttcagtgcgtcggctgtggtgcgtttcacctgcagcggcttggaaaggcctccggagtcccctccggcagagccaagttttccgccgcctgcggacccccagtgacacccgaatgtgagcactgtggacagcgtcaccaactgggtggtcccatgtgggctgaacctatacacgatctggattttgtggggcgcgtgcttgaagcagtgtcggcgaacccgggccgcttccacacaagcgagcgcattcggggggttctctctgttataactgaggagctgccagatgtccccctgtactataccctcgaccaactcagctctaccatccactgcaatacgccatcactgctgcagctccgctcggcgctcctacatgctgacttcagggtttcgttaagccatgcatgcaagaatgcagtgaaaaccgatgcccccgccagcgccttgtgggacatcatgcgctgttgggagaaggagtgtcccgttaaaagagagcggctctctgagactagccctgccttccgtattctgtccgtcgaacctagactccaggccaacttcactattagggaggacgcaaatcccagttcgagacagcgggggttaaaaaggtttcaggccaatccagaagccaactggggccccaggccccgagcgcggcccggaggaaaggccgctgacgaagcaatggaggagcgacggagactcctacagaacaaacggaaagagcctcccgaagacgtggcacagcgcgccgcacgcctgaagacttttccatgcaagaggttcaaggaggggacttgccaaaggggagatcagtgctgttacagtcacagcccccctacgccacgggtgagtgcagacgccgccccagactgcccagaaacaagcaatcagacacctcctgggcccggggctgcagctggaccggggatagactag

SEQ ID NO: 209834 - DNA, 1878 bp, Artificial Sequence
  Description of Artificial Sequence: Synthetic coding sequence
atgagcgagaacctggacaacgagggccccaagcccatggagagctgcggccaggagagttcaagcgccttgagctgcccaaccgtgtcagtccctccagccgctccagcggctctggaagaagtagaaaaggagggagcaggagcggcaacaggaccgggtcctcagcccggcctttattcctacattagggacgacctctttaccagcgaaatctttaagctggaactgcagaacgtgcctcggcacgcctcgttttcagatgttcgacggtttcttggaaggttcggactgcagcctcataagaccaaactgtttggccaaccaccatgtgccttcgtgacctttcgatcagccgccgagagagataaggccctgagagtcttgcacggagccctctggaagggccggcccctgtccgtacgcctcgcacgcccaaaggctgacccaatggcccggagacgtagacaggagggcgaatcagagcccccagtgacaagagtcgccgacgttgtgacacctctctggaccgtgccttatgctgagcaattggagcgaaaacaattggaatgcgaacaggtcctacagaagctcgccaaggaaattggtagcaccaatcgggcgctcctgccttggctgctggaacagcgccacaaacacaacaaagcatgctgtccgctagagggcgtgcggcccagcccccagcagaccgagtatagaaataagtgcgagtttttggtaggtgtcggagtcgatggggaggataatactgtgggctgccgtctcggcaagtataaaggtgggacctgtgccgtcgccgctccttttgacaccgtacatattccagaagcaaccaagcaggtcgttaaggccttccaagaattcataagatcaacaccttactccgcatatgaccctgagacgtataccgggcattggaaacagctgactgtaagaactagccgtagacaccaagcaatggcaatcgcttactttcatccacagaagctatctccggaagagttagccgagctcaaaacaagcttggctcagcatttcaccgccggtcccggaagagccagcggggtcacctgtctgtattttgttgaagaaggacaaaggaaaaccccaagtcaggagggccttccacttgaacatgtggcaggtgataggtgcatacatgaagaccttttggggctgacctttcggattagcccacatgccttttttcaggtgaatacccctgctgcagaggtgctgtatacagtcatacaagattgggcccaactcgacgccggttctatggtgctggatgtctgctgcggcacgggaacaatcggcctggctctcgcccggaaggtaaagcgcgttattggtgtggaactgtgccctgaggccgtcgaagatgctcgcgtaaatgctcaagataacgagttatccaacgtggaattccactgtggcagggccgaagacctagtgcccaccctggttagccggctggcaagccagcatctggtggcaatactggaccccccacgcgcaggcttacactcaaaagtgatcttggcaatcagacgggctaagaacctaaggcggttactgtatgtgtcatgcaacccgcgcgccgccatgggcaatttcgtggatctgtgccgcgcaccctccaaccgagttaaaggaattcccttccgacccgtgaaggctgtggcagtcgacttgtttccgcagaccccacattgcgagatgctcattctcttcgaaagagttgaacaccctaatggaacaggcgtcttgggcccccacagtcctccagcgcagccaacacctggacctcctgataacacattacaggagacagggacgtttccctcgagctag

SEQ ID NO: 209835 - DNA, 1878 bp, Artificial Sequence
  Description of Artificial Sequence: Synthetic coding sequence
atgagcgagaacctggacaacgagggccccaagcccatggagagctgtggtcaagagtcaagctcggccctctcttgccctaccgttagcgtgccgcctgcggccccggcagccctcgaggaggtcgagaaagagggggctggagccgcaactggtcctggaccccagcccggtctatactcctacattagagacgaccttttcacctcagagattttcaagctagaacttcagaacgtgccgcggcatgcctcttttagcgatgttagaagatttctcggccggttcggactccaaccgcataaaacaaagctattcggacagcctccttgtgcgtttgtgacattccgctcagccgccgagagggataaagcattgcgcgtgctgcacggagccttgtggaagggacgtccattatctgtacgcttggctagacccaaagcagacccaatggcgcgccgaaggcgtcaggagggggagtctgagcctccagtcacacgcgttgctgacgtagtgacgcctctgtggactgtcccatatgctgagcagctggagaggaaacagttggaatgcgaacaggtcctgcaaaagctggcaaaggaaattggttctaccaaccgggcattgttaccatggttattggagcaaaggcataagcacaataaggcttgttgcccactggaaggtgtgagaccctcaccacaacagaccgaatataggaacaaatgtgagttcttggtcggagttggtgtggacggggaggataacaccgtgggttgccgcctcggcaagtacaagggcggcacgtgcgctgtggccgccccctttgacacagtccatatcccagaggcaacgaagcaggtagtgaaggctttccaagagttcatcaggtctacaccgtactccgcctacgatccagaaacatataccggtcactggaaacagctgactgttcgaaccagccgaagacaccaagcgatggccatcgcttacttccatccacagaagttgagccccgaagaactggcggaacttaagacatcactggctcagcattttacagccggccctggcagggcatcaggggtcacctgcctttactttgtagaggagggccagaggaaaacaccctctcaagaaggtctcccacttgaacatgtagccggagatcgttgcatacacgaggacttgctagggctgacatttaggatttccccccatgccttctttcaggtgaacacaccagccgctgaggtgctttacacagtcatccaggactgggcccagcttgacgcaggcagcatggtgctggatgtatgttgtggcaccgggacgatcggtctggctttagcaaggaaggttaaaagggtcatcggcgtggaattatgccccgaagctgtagaggatgctcgcgtgaatgcccaggataacgaattgtctaacgttgagttccattgcggcagggcggaagatttagtgcctactttagtgtccaggttagcaagccaacatctggtggcaatactggatccccctcgagcaggtctgcacagtaaggtgattctggccattaggagggcgaagaatctgcgcaggcttttgtatgtttcctgtaatccaagggcagccatggggaactttgttgatctgtgtagggcgccctcaaacagagtgaaagggataccatttcggcctgttaaggccgtggccgtcgacctttttcctcaaaccccccactgtgagatgctgatcttgtttgagcgggtggagcatcccaacgggactggcgtgctaggcccccactccccacctgctcaacctacacccggacccccagacaacacgctgcaggagaccggcactttcccttcaagctag

SEQ ID NO: 209836 - DNA, 1689 bp, Artificial Sequence
  Description of Artificial Sequence: Synthetic coding sequence
atgagcgagaacctggacaacgagggccccaagcccatggagagctgcgggcaagagtcatcgtcagcattgagttgcccaactgtctctgtgccacctgctgcaccagcggcccttgaggaggttgagaaagagggggctggcgcggccactggccctggaccccagcctgggctttacagctacattagagatgacctgttcaccagcgaaatatttaagcttgagctacagaacgtgcctcgtcacgcctccttctccgatgtgcggaggttcctgggacggtttgggctgcaaccccacaagactaaactgtttggacagcctccctgcgctttcgttacctttcgctcagccgcggagagagacaaagcactgcgagtgctgcatggggctctgtggaaggggagacctctgtccgtgcgtctggccaggccaaaggcagatcctatggccaggcgacggaggcaagagggtgaatccgagccccccgtcacgcgggtggctgacgtggtgacgccattgtggaccgttccatacgccgagcagctcgagcgtaaacagctcgaatgtgagcaagttcttcagaaacttgctaaagagatcggaagtactaaccgggcgctgctgccttggctactggaacaacggcacaagcacaacaaggcatgttgcccacttgaaggtgttagaccctcgccacagcagacagagtacaggaacaaatgcgagttcctggtgggcgtgggggtggatggcgaagacaatacagtggggtgtaggttggggaagtacaagggtggcacatgcgccgtggctgcaccctttgacaccgtgcacatcccagaggcgaccaagcaagtcgtcaaggcttttcaggaattcatcaggtccactccgtacagcgcttatgaccctgagacctatacagggcactggaagcagttgaccgtgcggacgtcacgccgccatcaggccatggccattgcgtatttccacccgcagaagctctcgcccgaggaactggccgagctaaaaacgagccttgcgcagcactttacggccggccctgggcgagccagcggggtcacctgcttgtacttcgtggaggagggtcagcgcaagactccttcacaggaaggactccccttagaacacgtcgctggcgatcggtgtatccacgaggatctgctaggcttaacatttcggatctcaccccacgccttcttccaggtgaatactccggctgcagaggtcctgtacaccgtgatccaggattgggcccaactcgatgcaggcagcatggtcctcgacgtttgctgtggcaccgggaccataggcctggccctggcccgaaaggttaaaagggtgatcggagtggagctctgtccggaagccgtggaagatgctcgagtgaatgctcaagataacgaattatcaaacgtcgaatttcactgcggcagggccgaggatctggtgcctactctggtgtccaggcttgccagtcagcatctggtggctattttagacccgcctagggcaggactgcattccaaggtgatcttagctatccggcgagcaaaaaatctgcggcgcctgttgtatgtgagctgtaaccctagagctgcgatgggcaatttcgttgacgcacctttgtttccaccacaaccgttgcagtccccaatctag

SEQ ID NO: 209837 - DNA, 1530 bp, Artificial Sequence
  Description of Artificial Sequence: Synthetic coding sequence
atggtgctgtggatcctgtggcggcccttcggcttcagcggccggttcctcaagctcgaatcacactcaataaccgagagtaagtcactaattcctgtggcctggacatcattaactcagatgctcctcgaagcgccaggtatctttctgcttggacagaggaagcgtttctcgacaatgccggaaaccgaaacccacgaaagagagaccgagctcttttcgcctccgtccgatgtgagaggcatgaccaagttggaccggactgccttcaaaaagaccgtcaacattccggtgcttaaggtgagaaaggaaatcgtgtcgaagctcatgagaagccttaaaagggcagccctacagcgccccggaattcgtcgggtgatcgaggaccccgaggacaaggaaagtcgactaattatgctcgacccatacaaaattttcacacatgacagctttgaaaaagctgaattgtcggtgctggagcagttaaatgtatctccgcagatatctaagtacaatttagagctgacgtacgaacatttcaaatcagaggaaattctaagggctgtgttgccggaaggtcaggacgtgacttctgggttcagccgaatcggccacattgctcatttaaatttaagggatcaccaactttctttcaagcacctcatcgggcaagtaatgatagacaagaatcctggcatcacatcagctgttaataaaattaataacatcgacaatatgtaccgaaatttccagatggaggtgctctccggggagcagaatatgatgacgaaggtccgggagaacaactacacctacgagttcgacttttccaaggtgtattggaacccgcgcttgtcaactgaacatagtcgaatcactgagctcctcaagcctggggacgtgctctttgatgtttttgctggggtggggccttttgctattcccgtagctaaaaagaactgcactgtgtttgccaatgaccttaaccctgaatcccacaagtggctcctgtataactgtaaactcaacaaggtggatcagaaagttaaggtgttcaacctggacgggaaggattttttgcagggcccagttaaagaagaactcatgcagcttctgggcctgtcaaaagaacgaaaaccctctgtacatgtcgtaatgaatttgcccgctaaagcaatcgaatttctgtctgcttttaagtggctgcttgacggccagccatgctcgagtgagttccttccgatcgtccactgctactccttcagtaaagatgctaaccctgctgaggatgtcaggcagcgtgctggagccgtattgggaatcagtcttgaagcctgttcgtctgtccatctcgtccggaatgtcgctcctaacaaggagatgttgtgcatcacatttcagattcctgctagcgtgctgtacaagaatcagactcgtaatcccgagaatcatgaggacccgccactgaaaagacagagaacagccgaagctttctctgacgagaagactcagatcgtcagtaatacctag

SEQ ID NO: 209838 - DNA, 1266 bp, Artificial Sequence
  Description of Artificial Sequence: Synthetic coding sequence
atgcaggccctgcggcacgtggtgtgcgccctgagcggcggcgtggattccgccgttgcagcccttttactgcgtcgtcgcggctatcaggtcaccggggtctttatgaaaaactgggactccctagacgagcatggagtttgtaccgccgacaaggattgcgaggatgcatatagagtctgtcagatattggatatcccttttcatcaggtgagttatgtgaaggagtactggaacgacgtattttcggactttcttaatgaatacgagaaaggacgcacgcctaacccggacatcgtttgtaacaaacatatcaagttctcttgtttctttcactatgcagttgacaatctgggagcagacgccatcgccacgggacactacgcgagaacctctctggaagacgaggaggttttcgagcaaaagcatgtgaaaaagccggaaggcctttttagaaatcgcttcgaggtccggaatgccgtgaagttactgcaggctgcggactcatttaaggaccagaccttttttctctctcaagtttctcaggatgctctgcgtaggaccatattccccctgggcggccttactaaagagttcgttaagaagattgcagccgagaataggctacaccacgtccttcagaagaaagagagcatgggtatgtgttttatcggcaagcgtaattttgaacattttctgctgcaatatctgcagccgagaccaggacactttatctcaattgaggataacaaggtcctcgggacgcacaagggctggttcctctacacactgggacagcgggccaacattggcgggcttagagaaccctggtacgtggtcgaaaaggattcagtgaaaggagacgtatttgttgccccacgcactgaccatcccgcactgtacagggatctgttgcgcacctcccgagtgcactggattgctgaggaaccaccagcagctctggtccgcgataagatgatggaatgccacttccgtttccgacaccagatggccctggtgccttgtgttctaacacttaatcaggatggaacagtctgggtgaccgcagtacaggccgttagggctcttgcgacaggtcaattcgccgtcttttataaaggtgacgagtgcctggggtctgggaaaattttaagattgggtccatctgcatataccctgcaaaaggggcagcggagggcaggcatggctacagaatctccctccgactcgcctgaagatggcccaggcttgtccccgcttctgtag

SEQ ID NO: 209839 - DNA, 300 bp, Artificial Sequence
  Description of Artificial Sequence: Synthetic coding sequence
atgcaggccctgcggcacgtggtgtgcgccctgagcggcggcgtggatagcgctgtcgccgccttgctcctgcggaggcgtgggtaccaagtgaccggcgttttcatgaaaaattgggacagcctggacgagcacggcgtgtgcacagcagataaagactgcgaggacgcttatcgagtgtgtcagattctggacatcccatttcatcaagtgtcctatgtcaaggagtattggaacgatgtcttccggggccgttgtcactgccataggagcctctgcaaaaacttccctggcaggtag

SEQ ID NO: 209840 - DNA, 396 bp, Artificial Sequence
  Description of Artificial Sequence: Synthetic coding sequence
atgaagaactgggacagcctggacgagcacggcgtgtgcaccgccgataaggactgtgaggatgcatatcgcgtttgccaaattctggatatcccatttcaccaggtgtcctatgtcaaggaatattggaacgacgttttctcagactttctgaacgaatatgaaaagggtcgaaccccaaacccagacatcgtctgcaataaacacataaagttttcttgtttctttcactacgctgtcgataacctaggagctgacgccatagctactggacattacgccaggacttctctggaagatgaagaagtgttcgaacagaagcacgttaagaaacctgaggggctgttcagaaatagatttgaagtgaggaacgctcggtttccccgaatgccatag

SEQ ID NO: 209841 - DNA, 300 bp, Artificial Sequence
  Description of Artificial Sequence: Synthetic coding sequence
atgcaggccctgcggcacgtggtgtgcgccctgagcggcggcgtggacagcgcagtggctgctctcctgctaaggaggagagggtaccaggtgactggcgtatttatgaaaaattgggattccttagatgaacatggtgtgtgcaccgccgataaggattgtgaggacgcctatagagtctgtcagatcttagacattccgtttcaccaggtttcctatgttaaggaatattggaacgacgtatttcgaggcagatgccattgtcaccgctctctgtgtaaaaatttccccgggcgctag

SEQ ID NO: 209842 - DNA, 300 bp, Artificial Sequence
  Description of Artificial Sequence: Synthetic coding sequence
atgcaggccctgcggcacgtggtgtgcgccctgagcggcggcgtggatagtgcggtcgctgctctgctgctgaggcgtcgcggctaccaagtgaccggtgttttcatgaagaactgggatagcctcgacgaacacggcgtgtgcacagccgacaaagactgcgaggacgcttatagagtctgtcaaatcctggatataccattccaccaggtaagttacgtgaaggagtactggaatgacgtttttcgcggaaggtgtcattgtcacaggagtctgtgtaaaaatttccccgggcgctag

SEQ ID NO: 209843 - DNA, 300 bp, Artificial Sequence
  Description of Artificial Sequence: Synthetic coding sequence
atgcaggccctgcggcacgtggtgtgcgccctgagcggcggcgtggactctgcggtcgccgccctcttgctgcggaggcgaggttaccaggtgacaggggtctttatgaaaaattgggacagccttgatgaacatggggtgtgtaccgccgacaaggattgtgaggatgcctatcgagtttgtcagatcctcgatattccatttcaccaagtgagctacgtgaaggaatattggaatgatgtgttccgtgggcggtgtcattgtcaccgcagcctatgtaaaaacttccctgggcgctag

SEQ ID NO: 209844 - DNA, 501 bp, Artificial Sequence
  Description of Artificial Sequence: Synthetic coding sequence
atgcaggccctgcggcacgtggtgtgcgccctgagcggcggcgtggattcagcagtggccgcacttctgctccggaggcgaggataccaggttaccggagtcttcatgaaaaattgggattccctggacgagcatggtgtttgtactgctgacaaggattgtgaggacgcttatcgagtctgccagattctagacatcccctttcaccaagtgagctatgtcaaggagtactggaacgacgtgttcagcgatttccttaacgagtatgaaaaggggcggaccccaaaccctgacatagtctgtaataaacacattaagttcagttgcttcttccattatgccgtggataatctcggcgccgacgcgattgccaccggtcattatgcaaggacatcactggaagatgaggaagtgtttgaacagaaacatgtgaaaaaacccgaggggttatttagaaaccgctttgaggtgaggaacgcccggtttcctagaatgccatag

SEQ ID NO: 209845 - DNA, 1038 bp, Artificial Sequence
  Description of Artificial Sequence: Synthetic coding sequence
atggagcccctgcgggtgctggagctgtacagcggcgtgggcggcatgcaccatgcattgagggaaagctgtatccccgctcaggtggtggcagcaatagatgtgaataccgtggctaacgaggtttataagtacaattttccccacactcaattgctggccaaaaccatagagggcatcacgctggaagagtttgatagactttcctttgacatgatcctgatgtcacctccctgtcaaccttttacacgtgaccttcttatacaaactattgaaaattgcggctttcagtatcaagagttcctcctcagccctacaagtctagggatcccaaatagcaggctgcggtacttcctgatagcaaaactccagtcggagcccctgccttttcaagcacctggccaagttctcatggaattccccaaaatcgaatcggtccatcctcagaagtacgcaatggatgtggaaaataagattcaagaaaagaatgtggagccaaacatcagcttcgacgggtccatacagtgttcggggaaagacgcaattctgttcaaactcgagacagcggaggagattcacaggaagaaccagcaggatagtgacctcagcgttaaaatgttgaaggactttctcgaagatgatactgacgtcaatcagtatcttctgccacccaagtccttgctccgctatgccctccttctcgacatcgtgcagccgacttgcagacgctctgtttgctttaccaaaggttacggctcatacatcgaaggaacagggagtgttctccaaaccgccgaggacgtgcaggtcgagaacatctacaagagcctgacaaacttgagccaggaggaacagatcaccaaactgctgatcctcaagctgcgttatttcacccctaaggagatcgccaacttgctgggattcccaccagagttcggcttccctgagaaaatcactgttaaacagaggtatagactgctcggcaactctctgaacgtgcatgttgttgccaagcttatcaagatcctatacgagtag

SEQ ID NO: 209846 - DNA, 216 bp, Artificial Sequence
  Description of Artificial Sequence: Synthetic coding sequence
atggagcccctgcgggtgctggagctgtacagcggcgtgggcggcatgcatcacgccttacgtgagtcttgcatccccgcacaagtcgttgctgcaattgacgtgaatactgtcgccaatgaagtctacaagtacaattttccacacactcagcttcttgccaagaccatagaaataacaaaaatcaccaaagtgtacagcttcgggaaatgctag

SEQ ID NO: 209847 - DNA, 354 bp, Artificial Sequence
  Description of Artificial Sequence: Synthetic coding sequence
atggagcccctgcgggtgctggagctgtacagcggcgtgggcggcatgcatcatgccctcagggagtcctgcatcccagcccaggtcgtggcagccatcgatgtgaatactgtagcaaatgaagtgtataagtataattttccgcacacccagctcttagctaagacaattgagaggccactagatacgaacaatcgaaagctgtggctttctgtccccagggtaagtatcatatcgaatttgtcctggcacagcaaatttaaggcgaccatatttagttactgcaaggcctcggtgcgggcaatcacccttagcagcccgtggtctgggaccgatggtgtgcctcaaaactag

SEQ ID NO: 209848 - DNA, 1176 bp, Artificial Sequence
  Description of Artificial Sequence: Synthetic coding sequence
atggagcccctgcgggtgctggagctgtacagcggcgtgggcggcatgcatcacgctctcagagagagttgtatccccgctcaggtggtagctgccatagacgtaaataccgtggcgaatgaagtgtacaagtataactttccccatacacagctcctcgctaagactatagaggggatcactcttgaggagtttgaccggctctcttttgacatgatcctgatgtcccccccctgtcaaccattcactagaataggtcggcaaggtgacatgaccgactcccgcacgaacagcttcctacacatacttgatatcctgccccgcctccagaaactaccaaagtacattcttctagagaacgtgaaagggttcgaagtatcgtctactcgtgatttgctgattcaaaccatcgaaaactgcggttttcagtatcaggagttcctgttgtcgccaacttcgttgggaattcccaatagccgccttcggtattttttgatcgctaaactgcagtcagagccactcccctttcaagcacccgggcaggtgctgatggagttccctaagattgaatccgttcaccctcagaagtacgcaatggacgtggagaacaaaattcaggagaagaacgtcgagccaaacattagttttgatggatccattcagtgtagcggtaaagatgcgatactctttaaactggaaactgccgaggagatccatcgtaagaaccagcaggacagcgacttgtcagtgaagatgctgaaggacttcctggaggacgacactgacgtcaaccaatacttgttgcctcccaaatctttgcttcgctacgctttgttactggacatcgttcagcccacttgccgacgctctgtttgctttacaaaggggtacggatcatacattgagggcaccggcagtgtgctgcaaactgctgaagatgtgcaggtcgaaaatatttacaagtctctgaccaatctgtcacaggaggaacagatcactaagctgctgattttaaaactcaggtatttcacccctaaggagattgccaatctgctggggttcccaccagaattcggatttccagagaagataacagtgaagcagcggtatagactgctgggtaatagtttaaatgtgcacgtggtcgccaaattaatcaaaattctctacgaatag

SEQ ID NO: 209849 - DNA, 1104 bp, Artificial Sequence
  Description of Artificial Sequence: Synthetic coding sequence
atggagcccctgcgggtgctggagctgtacagcggcgtgggcggcatgcatcatgcacttcgagagtcctgtattcctgctcaggtcgttgctgctatcgatgtgaacaccgtggctaatgaagtctataaatataacttcccacacacccagctcttggcgaaaacaatcgagggaatcacactggaagagttcgaccgcttgtccttcgacatgatactaatgtcccccccatgccagccttttacacggctgcaaaagttgcccaagtacatcctcctcgagaatgtgaaaggcttcgaagtttcgtcaacgcgcgaccttctcattcagacgattgagaactgtggattccagtaccaggaattcctgctaagtccgacctctctaggcattcctaacagcagattgcgctacttcctcattgccaagttacaatctgaacccctgccgttccaagcaccagggcaggtgcttatggagtttccaaagatcgaatcagtgcacccacaaaagtacgccatggacgttgagaataagattcaggagaaaaatgtggaacccaatattagctttgacggttcaatccagtgctctggaaaggatgcgattctattcaagttagagactgcggaggagatacacagaaagaatcagcaggactcggatttaagcgtcaagatgctaaaagatttcttggaggatgataccgacgtaaaccaatacctgctcccgccaaagtctctgctgagatacgcgctacttttagacattgtgcaacccacatgcaggcggtcggtgtgttttactaagggttacgggtcttatatcgaagggactggaagcgtgctacagaccgcagaagatgtgcaggtggaaaacatctacaagtcacttaccaacctgagccaagaggagcagatcaccaagctgctgattttgaaactgcggtacttcactccgaaggagatcgcaaatctcctcggtttcccaccggagttcggcttccccgagaagatcacggtgaagcaacgatataggctgttgggcaatagcctcaatgttcatgtggtagcaaagttgattaagattctctacgagtag

SEQ ID NO: 209850 - DNA, 933 bp, Artificial Sequence
  Description of Artificial Sequence: Synthetic coding sequence
atgagcaccctgagcctgatgaagtacaccagcatcatcttcctgacgcactcctatttacccagaagactcaagatagggcgccaaggagatatgactgactcaagaaccaacagcttccttcacattctggacattctgccgcgagaccttctaattcaaaccatagagaactgcggctttcagtatcaggaatttttgctctcaccaaccagcctgggtatccctaattccagactgagatactttctcatcgccaaattacagagcgagccattgccattccaagcgccgggacaggtcctgatggagtttcctaagatcgaaagtgtacaccctcagaagtatgcaatggacgtggaaaataaaatccaggagaagaacgtggaaccaaatattagcttcgatggaagcattcaatgttcaggcaaagacgccatcctgttcaagctggagacagcagaagagatccacagaaaaaaccagcaggattcggacctcagtgtgaaaatgctcaaagacttcctggaagacgataccgatgtgaatcagtacctgctgcctcccaagagcttactgcgctatgccttgctcttggacatcgtccagcctacctgtaggcggagcgtttgttttaccaaggggtatgggtcatatattgaaggaacgggttcggtcctgcagacggccgaagatgtgcaggtggagaatatatacaaatcactgaccaacctgagccaggaagagcagattacaaagctgctgatcctcaaattacgttatttcactccaaaggaaatcgctaatctgttggggtttccacccgaatttggatttccggagaagatcactgtcaagcagaggtaccggcttcttggaaattcactcaatgtgcacgtagtcgcaaagcttattaagattttgtacgagtag

SEQ ID NO: 209851 - DNA, 1305 bp, Artificial Sequence
  Description of Artificial Sequence: Synthetic coding sequence
atgctgcggtgcctgtaccactggcaccggcccgtgctgaaccggcgctggtcacggctgtgtctccccaaacagtacctgtttactatgaaactgcaaagccccgaatttcaaagcctttttacggaggggctgaaatcactgactgaactttttgtcaaagaaaaccatgagttgaggatagcaggtggggccgtgagagatcttctgaatggcgtcaaaccacaggatatcgacttcgcaaccaccgccactcctactcagatgaaggagatgttccagtccgcagggatccgcatgatcaacaatcgcggcgagaagcatggtaccatcaccgccaggctccacgaggagaactttgaaatcactaccttgagaattgatgtgaccacggatgggaggcatgccgaagtggagttcacaactgactggcagaaagatgcggaacgaagggatctgactattaattccatgttcctcggctttgatggcactttattcgactactttaacggctatgaagacctcaagaataagaaggtgcggttcgtgggacacgccaaacaaagaatacaagaagattatctcagaatcctccgctattttcgattttacggaaggatcgtcgacaagcccggtgaccatgatcctgaaaccttagaggctatagccgaaaatgctaaaggcctcgccgggatcagcggggagaggatctgggttgaactgaagaaaatcttagttggcaatcatgtcaaccatctgatccacctcatctacgaccttgatgtggcaccatatatcggactccccgcaaatgcctctctggaggagttcgacaaggtgtcaaagaatgttgacggtttctcacctaaaccagtcacgttgctcgcttccctgtttaaagttcaagatgatgtaacgaagttggatttgcgcctgaagatcgccaaggaagaaaagaatttgggactgttcattgtgaagaaccggaaggacttgataaaggccacggactcgtctgaccccttaaagccttaccaagacttcatcattgacagcagggaaccggacgcaaccacgagggtgtgcgagctgttgaaatatcagggcgaacattgtctactaaaagagatgcaacagtggagcattccaccttttcctgtgtcaggtcacgacatcaggaaggtgggaattagttctgggaaggaaattggagcactgctgcaacagttgcgggagcagtggaaaaagagtggataccaaatggaaaaagacgaactattatcatacattaaaaaaacttag

SEQ ID NO: 209852 - DNA, 1245 bp, Artificial Sequence
  Description of Artificial Sequence: Synthetic coding sequence
atgctgcggtgcctgtaccactggcaccggcccgtgctgaaccggaggtggagcagactgtgcctgccaaagcagtatctgttcaccatgaaacttcagtctccggagttccagtccttattcacggagggactgaaatccctaacagagctatttgtcaaggagaatcacgagctgcgcatagccgggggagctgtgcgtgacctcctgaacggggtgaagccccaggatattgatttcgccaccactgctaccccaacccagatgaaggagatgttccagagcgcaggtattagaatgattaacaaccgaggcgagaaacatggaaccattactgccaggctgcacgaggaaaacttcgagatcactaccttgcgcattgatgtgacaacagacggccgtcatgcagaggtggagttcacaaccgattggcagaaagatgcggaaagacgcgatctaactatcaattcaatgttcctaggcttcgatggcaccctttttgactactttaacggatacgaagacctgaagaataagaaggtccggttcgtgggacacgccaaacagcgcatacaagaggactatttgcgcatcttgaggtacttccggttctatggaagaattgtggataagcccggagatcacgatccagagactcttgaagcaattgctgaaaacgccaaaggactggcaggaatctcaggtgaaaggatttgggttgaactcaaaaagatcctggtgggacttccagccaatgcttcgttggaggagttcgataaggtgtctaagaacgtggatgggttcagcccaaaacctgttacgctgctcgcttccctttttaaggtccaagacgatgttacaaagctcgatcttcgtctcaagatcgccaaagaagaaaagaacctgggtttgtttatcgtcaagaatcgcaaagacctgatcaaggcaactgattccagtgatcctttaaagccgtaccaggacttcataatagatagccgggagcccgacgcaactacccgggtctgcgaactgctcaaatatcaaggagagcattgtctcctgaaggaaatgcagcagtggtcaatcccgcccttccctgtcagtggtcatgatattcggaaagtgggtatctccagcggaaaagaaatcggcgctctcctccaacagttgcgtgaacagtggaagaagagtggttatcaaatggaaaaagatgagcttttgagttacatcaaaaagacctag

SEQ ID NO: 209853 - DNA, 174 bp, Artificial Sequence
  Description of Artificial Sequence: Synthetic coding sequence
atgctgcggtgcctgtaccactggcaccggcccgtgctgaaccggcgatggtcccgtctttgcctgcctaagcaatacctgtttacaatgaagcttcagtcccccgagttccagtccctgtttaccgaaggcctgaagagcctcaccgggattaatgctttccatgaaaattag

SEQ ID NO: 209854 - DNA, 174 bp, Artificial Sequence
  Description of Artificial Sequence: Synthetic coding sequence
atgctgcggtgcctgtaccactggcaccggcccgtgctgaaccggcgctggtcccgcctctgccttccaaaacagtatctattcaccatgaagctgcagtccccagagttccaaagtctgttcaccgaaggccttaagtcactcactggcattaatgcttttcatgagaactag

SEQ ID NO: 209855 - DNA, 189 bp, Artificial Sequence
  Description of Artificial Sequence: Synthetic coding sequence
atgctgcggtgcctgtaccactggcaccggcccgtgctgaaccggcgttggtcgcgcctctgcttgcccaagcaatacttgttcaccatgaaattgcaaagccccgaatttcagagcctgtttacagagggtttaaagagcctgacagaacttttcgtgaaggagaaccatgaactgaggattgcctag

SEQ ID NO: 209856 - DNA, 174 bp, Artificial Sequence
  Description of Artificial Sequence: Synthetic coding sequence
atgctgcggtgcctgtaccactggcaccggcccgtgctgaaccggcgttggagtcgcctgtgcctccctaagcagtacctctttaccatgaaactgcaaagccccgaatttcagtcgctgttcactgagggactgaagagcttaaccgggataaatgctttccacgaaaactag

SEQ ID NO: 209857 - DNA, 1305 bp, Artificial Sequence
  Description of Artificial Sequence: Synthetic coding sequence
atgctgcggtgcctgtaccactggcaccggcccgtgctgaaccggagatggagccggctctgtctgccaaaacagtacctattcacaatgaaactacagtctccagagtttcagtctctgtttacagagggactcaagagcctgacagagttgttcgtcaaggaaaaccatgaattgcgcatcgctggtggagcagtgcgagatttgctgaacggcgtcaaacctcaggatatagatttcgccaccactgcaacccctacgcagatgaaggaaatgttccagtccgcgggcattcgcatgattaacaatcggggggaaaaacatgggaccattactgcccgacttcatgaggagaatttcgaaatcaccaccctaagaattgacgtgacaaccgatggacgacacgccgaggtagaattcaccacggactggcagaaggatgctgaaagaagagacctgactatcaatagtatgtttttagggttcgatgggacgttgttcgattactttaatggatacgaagatctaaagaacaagaaagtgcggtttgttggacacgcgaagcagcgtatccaagaggactacctgaggatcctccggtacttccgattctatggcaggattgtggacaaacccggggatcacgaccccgaaaccttagaagcaatagctgagaatgccaagggactggctgggatcagcggggagcggatttgggtggagctgaagaaaatccttgtgggtaaccacgtaaatcatttgatccatttgatctatgatcttgatgtcgccccctacattggcctgccggcaaatgcctcactggaggaatttgataaggtgtccaagaatgtcgatgggttctcccctaagcctgtgacactgctcgcgtctctgtttaaagtgcaggacgacgtgaccaagctagacctgagactgaaaatcgccaaggaggaaaaaaatctcggtcttttcatcgttaaaaatcgcaaggatttaattaaggcaaccgacagttcagaccccctgaagccttaccaggactttatcatcgattcacgcgaacctgatgctacaactcgtgtttgcgaactgcttaaatatcagggagagcattgtcttctgaaagagatgcagcaatggtctattcctccattccctgtgtctggacacgacattcggaaagtggggatctcttccgggaaggaaatcggcgcacttttgcagcagctcagagagcagtggaagaaatcaggctatcagatggagaaagatgagttactgtcgtatattaaaaagacctag

SEQ ID NO: 209858 - DNA, 762 bp, Artificial Sequence
  Description of Artificial Sequence: Synthetic coding sequence
atgaacttcagcggcggcggccggcaggaggccgccggcagccggggaagacgggccccccgtcctcgcgaacaggatagggatgtgcagctctctaaagccctttcctatgcactgcgacatggggcccttaagcttgggcttccaatgggcgctgacggtttcgtgccactgggtaccctcctgcaactgcctcagttcagaggattctccgctgaggacgtgcaacgggtagttgacactaaccggaaacagagattcgcactgcagctgggcgacccctcaacggggctcctaatccgagcgaaccaaggacattccttgcaggtgccaaagctggagttgatgcctttggaaactccgcaagcactgcctccaatgctcgtccacggcacattttggaaacattggccttctatcctgcttaagggtctgagctgccagggaagaacccatatccacctggcacctggccttccgggagatcccggtattatctccgggatgcgaagccattgtgagatcgctgtgtttattgatgggcccctggctctggcggatgggattcctttcttccgctccgctaacggtgtgattctgaccccaggaaatacagatggttttcttttgcccaagtattttaaagaagctttacagctgcgtcccactcgcaagccacttagtctcgctggggacgaagagactgagtgccaatccagcccgaaacactccagtcgggagagacgtagaatccagcaatag

SEQ ID NO: 209859 - DNA, 768 bp, Artificial Sequence
  Description of Artificial Sequence: Synthetic coding sequence
atgaacttcagcggcggcggccggcaggaggccgccggcagccggggccggcgggcaccgagacctagggagcaggaccgagatgtccagctctctaaggcgctgtcttacgccctcaggcacggtgccctcaagctcgggctccctatgggggcagatggctttgtccccctcggcacactgctacagctgccacagttccggggtttcagtgctgaggatgtgcagagggtggtggacactaataggaagcagcgcttcgccctgcaactgggcgatccatctactggactcctgatccgggcaaaccagggccattcgctccaagtgggggttcccaagctggagttaatgcccttagagacgcctcaagccttaccccccatgctcgtccacggaactttctggaagcactggccgtcgatccttcttaagggcctgagttgtcagggtcggacacacatccatctggcacccggtctgcctggagatcccggaattatctcagggatgcggtcccactgtgagatcgctgtatttattgacggtccactggcgctcgcggacgggatacccttttttcgttctgctaatggggtgatccttactcccggaaacactgacggcttccttttgccaaaatattttaaagaggcgctgcaactcaggcccaccaggaaaccactgagcctcgcgggggacgaagaaacagaatgtcaaagcagccccaaacatagtagtagagaacgccggcgaatccaacaatag

SEQ ID NO: 209860 - DNA, 615 bp, Artificial Sequence
  Description of Artificial Sequence: Synthetic coding sequence
atgggcgccgacggcttcgtgcccctgggcaccctgctgcagctgccacaatttcgcggatttagcgcagaagatgtccagcgcgtagtggatacaaatcggaagcaaagattcgcactgcagctgggagatccctccactggactcctgatcagggccaaccaggggcattcacttcaagtccctaaacttgaactcatgccactggaaaccccgcaagccttgcctccaatgttggtgcacgggaccttttggaagcactggcccagcatcctgctgaagggcctctcttgtcagggccgtacgcacattcacctggcgcccgggctgccgggggatcctggtattatctctgggatgcgcagccattgcgaaattgcagtgtttatcgacggccctctggccctggcggacggaattcccttcttccgctctgccaatggggtgattcttacccctggaaacaccgacggatttttactacctaagtatttcaaagaggccttacagctgcgtcccacacgtaagccattgtcactggctggagatgaggaaaccgagtgtcagtcttctcccaagcatagctctcgggagaggcgtcgcatccaacagtag

SEQ ID NO: 209861 - DNA, 651 bp, Artificial Sequence
  Description of Artificial Sequence: Synthetic coding sequence
atgaacttcagcggcggcggccggcaggaggccgccggcagccgggggcggcgcgcccctagacctcgagagcaagatagggacgtacagctctctaaggcccttagctacgccctgagacatggtgctctaaagctgggcctgccaatgggggccgatggcttcgttccgttgggaaccctgcttcagttgccccagtttagaggctttagcgcagaagatgtacagcgtgtggtggacaccaacaggaagcagcgctttgccctgcaactcggcgatccatccactggactcctcatccgggctaatcagggtcactccctccaggtaccgaagctggaactcatgcccctggaaaccccccaggcactccctcccatgctcgttcatggaaccttttggaagcactggcctagcatcctgttaaagggcctgtcttgccaggggcggactcacatccacttggcgcctgggttacctggggatcctggaataattagtggcatgaggtcccattgcgagatagccgtcttcatcgatggaccgctggccctggcaggcaagcccctcagcctggcaggtgatgaggagacagaatgtcagtcatcccccaagcactcatccagagaacgcaggcggattcagcagtag

SEQ ID NO: 209862 - DNA, 504 bp, Artificial Sequence
  Description of Artificial Sequence: Synthetic coding sequence
atgggcgccgacggcttcgtgcccctgggcaccctgctgcagctgccacaattccggggtttctcagccgaggacgtgcagcgagtagtggacactaacagaaaacagcgatttgcgctccagctcggggacccctccaccggcttgctgatcagggccaaccaaggccatagcctgcaggtaccaaagcttgagttgatgcccctggagacaccccaggccctacccccgatgctggtccacggaaccttctggaagcactggcctagcatcctgttgaaagggctgagttgccagggacgaactcacatccacctggcaccaggattaccgggcgatcccggtattatctccggaatgcgctcccactgcgagatcgccgtgtttatcgatggccccctcgctctggctggcaaacccctgagccttgcaggtgatgaggagacagagtgccagtccagtcctaaacattccagccgagagcgcagaaggatacagcagtag

SEQ ID NO: 209863 - DNA, 516 bp, Artificial Sequence
  Description of Artificial Sequence: Synthetic coding sequence
atggaggagcggggcgacagcgagcccacccccggctgcagcggcctaggaccgggcggcgtgcgaggatttggggatggcggaggagctccttcctgggcacccgaagatgcatggatggggactcaccctaaatacctggaaatgatggagttggatatcggagatgccacccaggtctacgttgctttccttgtgtatttggacctaatggaaagcaagtcatggcacgaggtaaactgtgtgggcctgcccgagctccagctcatttgcctggttggaaccgagattgaaggggaaggactgcagacagtagttcctacccccataactgcctcgctgagccacaatcggattagggaaattctgaaagcatctagaaagctgcagggagaccctgatctgcctatgtctttcacattagccattgtggaatcagactcgaccatcgtctattacaagctgacagatgggttcatgctgcccgacccacagaatatcagcctgaggcggtag

SEQ ID NO: 209864 - DNA, 390 bp, Artificial Sequence
  Description of Artificial Sequence: Synthetic coding sequence
atggaggagcggggcgacagcgagcccacccccggctgcagcggcctcgggcctggcggcgtgcgaggcttcggtgacggcggaggcgcacccagctgggccccggaggacgcctggatggggacccaccctaaatatctggaaatgatggaattagacattggggatgccacccaagtttatgtcgcgttccttgtttatctggacctaatggagagcaagtcctggcacgaagtgaattgtgtgggccttcccgaactgcagctgatttgtctggtcggcacagagatcgaaggagaaggcctccagaccgtggttccaacgccgattaccgcgtcgctctcacataatcgaattttcctgcttgaggacgatatccatgtcagctag

SEQ ID NO: 209865 - DNA, 1398 bp, Artificial Sequence
  Description of Artificial Sequence: Synthetic coding sequence
atggccgaggccgtgttccacgcccccaagcggaagcggcgggtgtacgagacatacgagtcccccctgccaatccccttcggacaggaccacggaccattgaaggagtttaaaattttccgagccgaaatgataaataacaatgttatagtgcgtaacgccgaagacattgagcagctgtacggaaaggggtattttggcaaagggatcctcagccggtcaaggccctcattcacaattagcgatcctaagctcgttgctaaatggaaggatatgaagacaaatatgccaatcattacatctaaacgctaccagcactcagttgagtgggctgcagaattgatgcgtagacaggggcaagatgaaagcaccgtgcggagaatcctgaaggactataccaaaccattggaacatccacccgtgaagcgtaacgaagaagcccaagtacatgataagctcaatagcggcatggtcagtaacatggagggtacagccggaggggaaagaccctctgtggtgaacggggactctggaaaaagcgggggcgtcggagacccacgggagcctctgggttgcctgcaagaaggctccggctgtcacccaactaccgagagtttcgagaaaagcgtgcgggaagacgcgagcccccttcctcacgtttgttgctgcaaacaggacgctctgatcctgcagcgcgggctccatcatgaggacggatctcagcacatcggcctgctgcatccaggagaccgcgggcctgatcacgaatacgtgttagtggaagaggcggagtgcgctatgagtgagagagaggcagcacctaatgaggaactggtgcagcgcaataggcttatttgtagacgcaacccatatagaatctttgagtacctgcagctcagcctagaggaggcgttcttcctggtgtatgccctggggtgcctatccatctattatgaaaaggagccactcaccattgtgaaactctggaaggcattcacagtggtgcagccaactttccggactacctacatggcatatcactacttccggagcaagggatgggtcccgaaagtaggtctaaagtatggaacggacctcctcctctatcgcaaagggccccctttttaccatgctagctattctgtgatcatcgagctggtcgacgaccactttgagggctccctgcgacgcccgctcagttggaagtcgctcgctgcactgagccgggttagcgtgaacgtgagcaaggaactgatgttgtgttacctgattaagccatctaccatgactgacaaagagatggaatcgccagagtgtatgaagcgaatcaaggtgcaggaagtcatcctcagccgatgggtctccagcagagagagaagcgaccaggacgatttgtag

SEQ ID NO: 209866 - DNA, 1320 bp, Artificial Sequence
  Description of Artificial Sequence: Synthetic coding sequence
atggccgaggccgtgttccacgcccccaagcggaagcggcgggtgtatgaaacctatgagtccccgctgcctatcccgttcgggcaggaccacggtccattaaaggaatttaagatttttagagccgagatgataaacaacaatgtgatcgttagaaacgcagaagacatcgagcagctgtatggcaaggggtatttcggcaaggggatcctatcaagatcgcggcccagtttcactattagcgaccccaagttagtggctaaatggaaagatatgaagaccaatatgcctataatcacctctaagcggtatcagcatagcgtcgagtgggcagcagagctgatgagacggcagggacaggatgaatccacggtccgccgcatcctaaaggactacaccaagcctctggagcaccctccagttaaaagaaatgaggaggctcaggttcacgacaaactgaattccggtatggtcagtaacatggaaggaacagccggaggagaacggccgtcggtcgtgaatggagatagtggaaagtccggtggagtcggagatccaagggaacctttggggtgtcttcaggagggttctggatgccacccaaccaccgaatccttcgaaaagagtgtgagagaggatgccagcccattaccacacgtctgttgttgcaagcaggacgcgttaatcctccagcgcggccttcatcacgaagatgggtcccagcacattggacttttacatcccggtgaccgcggcccagaccacgagtacgtacttgtggaggaggcagagtgcgctatgtctgagcgggaagctgcccccaatgaggaagcgtttttcttggtgtatgccctcgggtgcctatctatttattacgagaaggagccactgactatcgtgaagttatggaaggcctttacagtggtgcagccaactttccggaccacatacatggcatatcactattttagatcaaaggggtgggtgccaaaggtggggctcaagtacgggactgaccttttactgtacaggaagggccccccgttttaccacgcctcatacagcgtcatcatcgaactggtggatgatcactttgagggtagcctgcgcagaccactgtcttggaaatcactcgcagctctctctcgagtgtctgtgaacgtctctaaggagctgatgttatgttatctcattaagccatcaaccatgactgacaaagagatggagtctcctgagtgtatgaaacgtataaaagtgcaggaagtgattctatcaaggtgggtctcctccagagaacggagtgaccaagatgacctgtag

SEQ ID NO: 209867 - DNA, 1347 bp, Artificial Sequence
  Description of Artificial Sequence: Synthetic coding sequence
atggccgaggccgtgttccacgcccccaagcggaagcggcgggtgtatgaaacgtatgagtccccgctcccgatcccattcggtcaagaccatggcccgcttaaagagttcaagatatttagggctgaaatgatcaacaacaatgtgattgttcgcaacgcagaggatatagaacagctgtacggtaaggggtacttcgggaagggcattctgtctcgctcccggccttctttcaccatttcagatcctaagcttgtcgcaaagtggaaggacatgaaaactaatatgcctatcatcacaagcaaaagataccagcattctgtggaatgggcagcggagctgatgcgcaggcagggtcaggatgagtcgactgtccgaaggattcttaaagattacacaaagcctctggagcacccgcccgtcaagcgcaacgaagaagcacaggtccacgataagctgaacagcggcatggtttctaacatggaaggcaccgcggggggcgagaggccctccgttgtcaatggtgattctggcaagagcggcggggtcggggatccccgtgaacctctgggttgtcttcaagaagggagtggctgtcacccaaccacagagagttttgaaaaatcagttagagaagacgccagtcccctgcctcacgtgtgctgctgtaaacaggatgccctgatcttacagaggggtctgcatcacgaggatgggagccaacatataggcctgttgcatccaggggatagaggcccagatcatgaatacgtcctggttgaagaggctgaatgcgcaatgagtgaacgcgaggccgcgccaaacgaggaactagtgcagcgaaacagattgatttgtaggagaaacccatatagaatatttgaatacttgcagctgagtctcgaagaagagcccctgaccatcgtaaagctttggaaagcattcacagtggtgcaacccactttccgcacaacatatatggcttaccactacttccgctctaaagggtgggtccccaaagtgggacttaagtacggtacagatctgttgctgtaccgtaaaggcccacctttttaccacgccagttattctgtcatcattgagctggtggatgaccactttgaggggtctcttcgccgacctcttagttggaaatcacttgccgccttgtcgcgggtaagcgtcaacgtttctaaagagctgatgctatgttacctcattaagccatcaaccatgactgacaaagaaatggagtcccctgaatgcatgaagagaattaaagtccaggaggtgattctgagccgctgggtttcctcccgggagcgatccgatcaggatgacttgtag

SEQ ID NO: 209868 - DNA, 1398 bp, Artificial Sequence
  Description of Artificial Sequence: Synthetic coding sequence
atggccgaggccgtgttccacgcccccaagcggaagcggcgggtgtacgagacctacgaaagtcccctgccaatcccctttgggcaggatcacggacccctgaaggagttcaagattttccgtgcagagatgatcaataacaacgtcatagtgcggaacgccgaggacatcgaacagctctatggcaaaggctacttcggcaagggaattctgagccggagcaggccttccttcactatttcggaccccaaattagtcgccaagtggaaggacatgaaaacaaacatgcccatcattacctcaaaacggtatcaacatagcgttgagtgggccgctgagttgatgcgccggcaggggcaggatgaaagcacggtcagaaggatcctcaaggattacacgaaacctctcgaacacccgcccgtcaagcgtaacgaggaagcacaggtacacgacaagctgaattccggtatggtatctaatatggaaggtacggctggcggagagagaccaagtgttgtgaatggcgactcagggaaatccgggggtgtcggcgacccccgcgagcccttgggctgccttcaggaaggcagcggctgtcacccgacaacagaaagctttgagaagtcggttcgtgaagatgcgtcgccgctgccccatgtctgctgttgcaagcaagacgccctcattctgcagaggggtttgcaccacgaagatggctcccagcacattggcctcctgcatcccggagatcgtggccccgaccatgagtacgtgctggtcgaggaggccgagtgcgccatgtccgagagggaagccgccccaaacgaggaactggttcagcgtaatcgcctgatctgccgacgaaatccgtatcgcatatttgagtacctccagttatccctggaagaggctttctttctcgtgtatgcgcttggttgcctgagcatctattatgaaaaagagccactgacaattgtgaaactttggaaggctttcacagtggtacagcctaccttccggacaacttatatggcctaccactacttccggtccaaaggctgggtccccaaagtgggactgaagtatggaactgatctgctgctctaccggaagggtccccctttctatcatgcttcgtatagtgtcattatcgagttagtggatgatcacttcgaggggagtctgcgaaggccactatcatggaaatctcttgccgctctcagccgtgtcagcgtgaatgtctcgaaagaattgatgctctgttaccttattaaaccctccacaatgaccgataaagagatggaatcccctgaatgtatgaagcgcatcaaggtccaggaggtaatcttgtctagatgggtgtccagtcgggagaggagcgaccaggatgatttatag

SEQ ID NO: 209869 - DNA, 1320 bp, Artificial Sequence
  Description of Artificial Sequence: Synthetic coding sequence
atggccgaggccgtgttccacgcccccaagcggaagcggcgggtgtacgagacatatgaatctcctctgcctattcctttcggtcaggatcacggaccattaaaggagtttaagatctttcgcgcagagatgataaataataacgtaattgtaaggaacgcggaggatattgaacaactgtacgggaagggctattttggtaaaggcattcttagccgatcgcgacccagttttactatttcagaccccaaattggtggccaagtggaaggatatgaaaaccaatatgcccatcatcacctctaagaggtaccagcatagtgtggaatgggccgcagagcttatgcgcagacaaggtcaggatgagtcgaccgttagaagaatcttaaaggattatacaaagccactcgagcaccctcccgttaaaagaaatgaggaggcacaggtccacgacaaactcaatagtggaatggtctctaacatggaaggtacagccgggggcgaacggccatccgttgtgaacggcgactccggaaagagtggcggcgtcggcgaccccagggagccactcggctgtctgcaggaaggatctgggtgccatccaacgacggagtcttttgagaaatcagttcgtgaggacgcttcccctctgccgcacgtctgttgttgcaaacaggatgctctgatattgcaaagaggcctacaccacgaggatggcagccagcatattggcctgctccatcccggggacagaggaccagaccatgaatacgtgctcgtggaggaggctgaatgcgcaatgagtgagcgggaagccgcccccaacgaagaggccttcttcctagtgtatgccttgggttgcctgagcatctactacgaaaaagaacctctgaccattgtgaagttgtggaaagcatttactgtcgtgcaacctacttttcgcactacctatatggcctatcattattttcggtctaaagggtgggtcccaaaagtggggttgaaatacggtacagatctgctcttgtatcgcaagggtcctcctttttaccacgcatcttacagcgttattatcgaattggtggatgatcacttcgagggatcactcagacgacccttatcatggaagagtctggccgctctttcacgcgttagcgtgaatgtgtccaaagagcttatgctgtgctaccttataaagccaagtaccatgacggacaaagaaatggaatctcccgaatgcatgaaaagaattaaggttcaggaagtgattttatcaagatgggtcagcagtagggaaaggagcgaccaggacgacctttag

SEQ ID NO: 209870 - DNA, 1209 bp, Artificial Sequence
  Description of Artificial Sequence: Synthetic coding sequence
atggccgaggccgtgttccacgcccccaagcggaagcggcgggtgtacgagacctatgaatccccactgccaatacccttcggacaggaccatggtcccctgaaagagtttaagatattcagggcagaaatgatcaacaacaacgtaatcgtccgcaatgccgaggacattgaacaattatatgggaaggggtattttggtaaggggattctgagccgatcccggccttcatttaccatcagcgatccaaaacttgttgcgaagtggaaagatatgaagaccaacatgcccataattaccagcaagcgttaccagcattctgtagagtgggccgcagagctgatgagacggcagggacaagatgagtcaacggtgcggcgcatactgaaagactacaccaagcccctcgaacacccacccgtgaaaaggaacgaggaagcccaggtgcacgataagttgaatagcggcatggtgtcaaatatggaggggactgcaggtggagaacgaccctcagtcgttaatggggacagtggcaagtccggcggggttggggacccgcgcgaacctctgggttgcctccaggagggatccggctgccaccctactaccgagtcctttgaaaagagtgtgagggaggacgcatccccactgccccacgtatgctgttgtaaacaagacgccctgatacttcagagaggactgcatcacgaggatggctcacagcacattgggctgctgcatccaggcgataggggccccgaccatgagtacgttctggttgaagaggcggagtgcgcaatgtctgaaagggaggccgctccaaacgaggaagcattcttcctggtgtacgcgttaggatgtctgtcgatctactatgagaaggagccactgaccatcgtgaaactgtggaaggcatttactgtggtacagcctacgttccgaacaacatatatggcctaccactatttccgaagtaagggctgggtgcctaaagtgggactgaagtacggaactgacctgctgctgtacaggaagggacccccgttttaccacgcttcttacagtgttattattgagctcgtggacgaccactttgaagggtctttgcggcggcccctgagttggaaatcgcttgctgccctgtccagagtgtctgtcaacgtaagtaaagttacacagcaccaactctgtcactggagtgtcacctag

SEQ ID NO: 209871 - DNA, 1137 bp, Artificial Sequence
  Description of Artificial Sequence: Synthetic coding sequence
atggccgaggccgtgttccacgcccccaagcggaagcggcgggtgtatgaaacgtatgagagcccccttcctatcccattcggacaggaccacggcccactcaaggagtttaagatcttccgggcggagatgataaataataacgtgatcgtgagaaatgccgaggacattgaacagctgtatgggaaaggctactttggcaaggggattctcagcagatcacgaccttcattcaccattagcgatccaaaactcgtagctaaatggaaggacatgaagaccaacatgcccataattacgtctaaaaggtatcagcactcggtggaatgggcagctgaactcatgcggagacaaggtcaggacgagagcacagtgcgcagaatcttgaaggattataccaaacccctggagcatccgcccgtgaagcgcaatgaagaggcccaggtccatgacaaactcaatagtggcatggtgagcaatatggaagggaccgccggcggcgaacgtccctctgtggtcaatggcgactcaggcaagagcggcggcgtgggagatccaagagagcctctgggatgcctccaagagggtagcggctgtcatcccacaaccgagtcgttcgaaaagtctgtgagagaggacgctagtcccttgccccatgtgtgctgttgcaagcaggatgctctgatactacagcgggggctacaccatgaggatggcagccagcacattggcctgttacatcctggggataggggtcctgatcatgagtacgtgctcgtggaggaagccgagtgcgccatgtccgagagagaagccgcacccaacgaagaacttgtgcaacgcaaccgtctgatttgtaggcggaacccctatcgtatctttgaatatttgcaattgtccctggaagaagcgttcttcctggtgtatgccctgggttgtctgtctatatattacgaaaaggagcccctcaccatcgtgaaattgtggaaagcttttacagtcgtacagcctacatttcgcactacctacatggcttatcattactttcgcagcaaaggctgggtgcctaaagtcggtctgaagtacggtaccgatctgctgctgtatagaaaggggccccccttctatcacgcctag

SEQ ID NO: 209872 - DNA, 1317 bp, Artificial Sequence
  Description of Artificial Sequence: Synthetic coding sequence
atggccgaggccgtgttccacgcccccaagcggaagcggcgggtgtatgaaacctatgaatcccctttgcccatcccattcggccaggaccacggtcccctcaaggaattcaagatcttcagggccgaaatgatcaacaacaacgtgattgtccgtaacgcagaggatatagaacaactgtatggcaaggacatgaaaactaatatgccaattatcacgagcaagaggtatcagcatagtgtcgaatgggcggccgaactcatgcgccggcaggggcaggacgagtccaccgtgcgccgcatcctgaaagattacaccaagccactggagcacccacctgtcaaacgcaacgaggaagcgcaggtccatgataagcttaactcgggaatggtgtccaacatggagggcacggcaggcggcgagaggccttctgtggttaatggggacagtggcaaaagcggaggggttggtgatccccgcgaaccactgggatgtctgcaagagggtagtggctgtcaccctacaaccgagtctttcgagaagtcagtccgggaagatgctagtcctcttccgcacgtgtgctgctgcaagcaggatgcactcattctccaaaggggacttcatcacgaggatggtagccagcacattggcctgctacacccaggcgaccgagggcccgatcacgaatatgtgcttgtggaagaggctgagtgcgccatgagcgagagagaggctgctcctaacgaggaattggtccagaggaacagactcatatgccgccgcaatccatataggatttttgagtatttgcagctttcccttgaagaagccttcttcctggtgtatgcactgggctgtctatccatatactatgagaaagagcctttgacaattgtcaaactgtggaaggcattcaccgtggtgcagcctacctttcgaaccacatacatggcctaccactacttccggtccaaagggtgggtgccaaaagtgggactgaaatatggcacagacctccttctgtacaggaaggggccgccattttatcatgccagctactcagtgatcattgagttggtggacgaccattttgagggctccctgcgccgccctctctcctggaaaagcctggccgccttaagccgggtgagtgtgaacgtctctaaggagctcatgctctgctatctcattaaaccgagtaccatgactgacaaggaaatggagagcccagaatgcatgaaaaggattaaggtgcaggaggtgattttgagcaggtgggtgagctctagagagcgatctgaccaagacgacctgtag

SEQ ID NO: 209873 - DNA, 1221 bp, Artificial Sequence
  Description of Artificial Sequence: Synthetic coding sequence
atggccgaggccgtgttccacgcccccaagcggaagcggcgggtgtacgaaacgtacgagagcccgctccctatccctttcgggcaggaccatggcccgctaaaagaatttaagatcttccgagccgagatgatcaataacaacgtgattgtccgcaatgccgaggatatagagcagttgtacgggaaggggtatttcggtaagggcatcctaagcaggtcaagaccgagctttaccataagcgaccccaaattagtggccaaatggaaggacatgaaaaccaacatgcctatcatcacttcaaagcgctaccagcacagtgtggagtgggcggctgaattaatgcgccggcagggtcaggacgagtccaccgtaaggaggattctgaaggactacaccaagcccctggagcaccccccagtgaagcgcaacgaggaagctcaagtgcacgacaaactgaactctgggatggttagtaatatggagggcactgcgggaggagaaagacctagcgtgcggggcctacatcatgaggatggatctcagcacatcggcctgctacaccccggggaccgaggccctgaccatgagtatgtactagtcgaggaggccgagtgcgcaatgagcgaacgggaagccgcacctaatgaggaattggtgcagcgcaaccggttaatctgccgacggaacccataccgaatttttgaatacctgcagttgagcctcgaagaggcttttttcctagtgtatgccctgggctgcctttctatatattatgagaaggagcctctcacaatcgtaaaactctggaaagcctttaccgtggtccagcctacctttcgcactacttatatggcataccactacttcagaagcaaaggctgggtgccgaaggttggtctcaaatatggtaccgatctgctcctgtatagaaaagggcctccattctaccacgcctcttattccgtgatcatcgagttagtggatgatcattttgagggatctctccggagacccctgagctggaagtccctggctgctttgtcccgcgtctctgtcaatgtttcaaaggagctcatgttgtgttacctgatcaagcctagcactatgacagacaaggagatggagagccctgagtgtatgaagcggatcaaggtccaggaggtgatactgtcgagatgggtgagctccagagagagatccgaccaggacgatctctag

SEQ ID NO: 209874 - DNA, 933 bp, Artificial Sequence
  Description of Artificial Sequence: Synthetic coding sequence
atgctggtggtggaggtggccaacggccggagcctggtgtggggcgcagaggcggtgcaagccctgcgtgaacgtttgggagtcggtggtagaaccgtgggggccctgccgaggggacccaggcaaaattccagactaggattgccactgctactgatgcccgaggaggccagattgctggccgaaattggcgcggtcacattagtctccgcccctcggcctgattctcgccatcatagtttggctctgaccagcttcaaacgtcaacaggaagaaagcttccaggaacaaagtgcactggccgctgaagcacgcgaaacccgccgccaggagttgctggagaaaatcaccgaagggcaggctgcaaagaagcagaaactcgagcaagcttctggtgcctcatctagccaggaggcggggtcctctcaagccgctaaagaagatgagacgtctgatgggcaggcttctggtgaacaggaagaggctggaccatcgtctagccaggctggaccatctaatggggtcgccccgctgccgcgctctgcactacttgtgcagttagctacggcacggccgagacccgtcaaggcccggccgttagactggcgggtgcagagtaaggactggccccacgccgggagacccgcacatgagctcaggtacagtatataccgcgacctgtgggagcgggggttctttctgtcagccgcaggtaagttcggaggagactttctggtgtaccctggagacccactgcgtttccacgcccactatatcgctcaatgttgggccccagaagacacgattcctctccaggacctggtcgccgctgggcggctcggcacctccgtcaggaaaaccttgttgctgtgtagcccccagcccgacgggaaagtggtttacacaagcttgcagtgggccagtctgcagtag

SEQ ID NO: 209875 - DNA, 933 bp, Artificial Sequence
  Description of Artificial Sequence: Synthetic coding sequence
atgctggtggtggaggtggccaacggccggagcctggtgtggggcgccgaagctgttcaggcactgcgcgagcgattgggggtgggaggacgcaccgtaggagctcttccacgcggtccgcggcaaaacagtagactcgggttgcccctcttgttaatgcctgaggaggctcggttactggcggagattggtgcagttactctggtgtccgcccctcgaccagatagcagacaccacagtctagccctgacctctttcaaacggcagcaggaggagagctttcaggagcagtcagctctcgcagcagaggcccgcgagactagacggcaggaactgctggagaagatcaccgaggggcaggccgcaaagaagcagaagctggaacaggcatccggtgcaagttctagtcaggaagcgggctctagccaggccgcaaaagaggacgaaacatctgatggccaggcctcaggggagcaagaggaggcgggaccttctagttcccaggccggaccctccaatggtgtagcccctctcccccgatcagctctcctggtgcagctcgcaacggcgcggcctcgccctgttaaggctcgtcccctggattggcgggttcagtccaaagattggccgcatgcaggaaggcccgctcatgagctgaggtacagcatatatcgcgacctgtgggagcgggggttttttttatctgccgcagggaaatttgggggggatttccttgtgtatcccggggatcccctacgattccacgcccactacatcgcacagtgctgggccccagaagatactattccccttcaagacctggttgccgccggccgcctaggcacctctgtgaggaagactctgctcctgtgcagtcctcagcccgatggcaaagtggtatatacctccctacagtgggccagccttcagtag

SEQ ID NO: 209876 - DNA, 933 bp, Artificial Sequence
  Description of Artificial Sequence: Synthetic coding sequence
atgctggtggtggaggtggccaacggccggagcctggtgtggggcgcagaggctgtgcaggcgctgcgagagcgtctgggggtcggtgggaggaccgttggcgcattacctcgcggcccaagacagaacagtcggctggggttgcccctactgcttatgcccgaggaggctaggcttctggccgaaattggagcagtcactttagtttcagcaccaaggcctgacagtcgccaccacagtcttgctctgacctccttcaaaaggcagcaagaggaatcttttcaggagcaatcagcactggcagcagaagccagagaaacgagaagacaagaactgctagagaagatcacggaaggccaggccgcgaagaagcagaagttagagcaggctagtggtgcttctagtagccaggaggctggttccagtcaggcagctaaggaagacgagacaagtgacggccaggcatcgggagaacaggaggaggcggggccaagcagttctcaagccggcccgtcaaacggcgtcgcgcctcttccacgttccgcccttctcgtgcaacttgccactgccagaccaagaccagtgaaggcccggcctctggactggagggtgcaatccaaagactggccccacgccgggagaccagcacacgagcttcggtattcaatctatagggatctctgggaaagggggttcttcctcagtgccgctggcaagtttggcggagactttctggtatacccaggcgatccattgcgctttcatgcacactacatcgctcagtgttgggcccctgaggacaccatacccctgcaggatttggtggctgctgggcggttgggaacgtctgttcggaagaccctgctactgtgttccccacagccagacggaaaggtggtgtataccagcttgcagtgggcctccctgcaatag

SEQ ID NO: 209877 - DNA, 939 bp, Artificial Sequence
  Description of Artificial Sequence: Synthetic coding sequence
atgctggtggtggaggtggccaacggccggagcctggtgtggggcgccgaggccgtgcaggccctccgggaaaggctgggtgttggcggtagaaccgtgggtgctctgccccggggtccaagacagaacagtaggctcgggctgcctctgctcctcatgcctgaagaggcgaggctgctggctgaaataggcgctgtgaccctggtatcagcccccaggccagactctcgtcatcattccttggcactcacttctttcaaaaggcaacaggaagagagtttccaagagcaatcagcactcgccgccgaagccagagagactagacggcaagagcttcttgaaaagattaccgagggccaggccgccaagaagcaaaaactggagcaggcttccggcgcctcgtccagccaggaggctggttccagccaggctgccaaagaggacgagacctctgacggacaggcatctggcgaacaggaggaggctggcccatcatcctctcaggccggcccttccaacggggtggcgccgctccctcgctcagcgctgctcgttcagctggcaactgctcggccgcgtccagttaaagccaggccactggactggcgcgtgcagagtaaggattggccacacgccgggcgtcccgcccatgagcttcggtactccatctacagagatctgtgggagcgcggctttttcctctccgccgccggtaagttcgggggggacttcctggtttatccaggcgaccctctgcgattccacgcgcactacattgctcagtgttgggccccagaggacaccattcctctgcaggacctggtcgctgctggaaggttgggaacgtctgtccgcaaaacgctcctattgtgtagcccacagccagacggatttaaaagccaagaggtgagtattaatctggtctataagtgcagttag

SEQ ID NO: 209878 - DNA, 729 bp, Artificial Sequence
  Description of Artificial Sequence: Synthetic coding sequence
atgctggtggtggaggtggccaacggccggagcctggtgtggggcgccgaagctgtacaggctttgcgggagcggctaggcgtgggtggacgaactgttggggctcttcctcggggaccccgacagaattcaagacttggcctcccccttcttctgatgcctgaggaggccagactccttgcagaaattggggccgttactttggtgtcagcaccacggccagatagccggcaccactcccttgcactgacatcctttaagcgccagcaggaggagagcttccaggaacagtccgcacttgccgctgaggcccgtgaaactaggcgccaggagttgttggagaaaattacagagggacaggctgctaagaagcaaaagctagagcaggcttcaggcgctagctccagccaggaggccgggtctagccaggctgccaaggaggacgagacctctgatggtcaggcgagtggggagcaagaggaggccggccctagcagctcccaggccggaccctcaaacggcgtggcaccattgccgagatctgcgcttttagtgcagcttgccactgcacgacccagacccgtgaaggctcgccctctggattggcgagtacagagtaaggattggccccacgcaggccggcccgcgcatgagttgcgctactccatttatcgggatttatgggagagggggttctttctgtccgccgccggcaagttcggcgggtag

SEQ ID NO: 209879 - DNA, 1581 bp, Artificial Sequence
  Description of Artificial Sequence: Synthetic coding sequence
atggagcccgagcccgagcccgccgccgtggaggtgcccgccggccgcgttttgagcgcgcgtgaactgttcgcagctcgctcaaggagccagaagctgccgcaacgctcccatggtcccaaggattttctgccagacgggtctgccgctcaggccgagaggctgaggcgatgtagagaagagctttggcagctccttgccgagcagcgagttgagagactcggctctttagttgcagccgagtggagaccggaggagggttttgtggagctgaaatctcccgctggaaagttttggcagaccatgggctttagcgaacagggaagacaaaggctgcatcctgaagaggcactgtatctcctggaatgcggatctatacacctgttccaccaggatctcccgctgagcatccaggaggcttaccaacttctgctgactgatcatactgttacgttcttgcagtatcaggttttttctcatttaaagcggctgggctacgtagtccgtcgtttccagcctagctccgtgctatcgccctacgaaagacagctcaacttagacgcaagtgtacagcatcttgaagatggggatggcaaacggaaacgctcttccagctcaccccgaagtatcaacaaaaaggctaaggcgctggacaattctctgcagcccaaaagtctcgctgcaagcagccctcccccgtgctcacagcccagccaatgccctgaggagaaaccccaggaatccagccccatgaagggcccagggggcccatttcagctgcttggtagtttggggccatcgcccggcccagccagagagggggtcgggtgcagctgggaatcaggcagggccgaaaatggcgtgactggggctggcaagcggagatggaattttgagcagatcagcttccctaatatggcctccgactctcgacacacactgctgcgggctcccgcccctgagctcctccctgctaacgttgctggaagggagactgatgcagaatcttggtgccaaaagctgaatcaacgcaaggagaaactatccaggagagagagagaacaccacgcggaagccgcccagttccaggaggatgtaaatgccgatccagaagtgcagaggtgttcgagctggcgcgagtacaaagagctgctacagcgccgacaggttcagaggtcccagcgccgggcgccccatctgtggggccagccagtcacccctctactgtctccgggccaggcatcttcccccgccgtcgtccttcagcacatctccgtgctccagaccacccatctgcccgacggtggcgcacgcctcctggaaaaatccggcgggttggaaatcatttttgatgtgtatcaggctgatgccgtggccaccttcaggaagaacaaccccgggaagccctacgcaaggatgtgcatttccgggtttgatgagccagtgcctgacctgtgtagcttaaagcgtctgagctaccaaagtggtgacgttcctctcatcttcgccctggtggaccacggggacatctcgttctacagttttcgcgatttcaccctgcctcaagacgtgggccattag

SEQ ID NO: 209880 - DNA, 594 bp, Artificial Sequence
  Description of Artificial Sequence: Synthetic coding sequence
atgggcttcagcgagcagggccggcagcggctgcaccccgaggaggcactgtatctcctggagtgcggcagcatacatctttttcatcaggacctgccactgtccatccaggaagcttaccagctgttactgacggaccacaccgtgacttttctgcagtaccaggtcttctcccacctaaaacgactgggttacgtggtgcggcgcttccagccttcctctgtcctgtccccttatgaaaggcagctcaacctcgatgcttctgttcagcacctcgaagacggagatgggaagcggaagcggtccagcagcagccctagaagcataaacaagaaggccaaggcgctcgataactctctacagccaaagtctctcgctgcctcaagcccccccagcggaacatccaggtgtccaaggatgtgggggacagaccttacagctctgcagcggatggagctcgcccccggcgaccgtgactgccttttttctggaaccatctccgccgcatcgtgcacccagacattgacctgctccttccgcgggcagagcggaccatggccgtgggtgtctgacacacacagagtgaagctgtag

SEQ ID NO: 209881 - DNA, 534 bp, Artificial Sequence
  Description of Artificial Sequence: Synthetic coding sequence
atggagcccgagcccgagcccgccgccgtggaggtgcccgccggccgggtgctaagcgcaagggaacttttcgctgcgaggtctaggagtcaaaagctgccccagagatctcacggacctaaggactttttgcccgacggttctgcagcacaagccgagaggctgcgacggtgtcgcgaggaactttggcagctgctcgccgaacaacgggtggagagactgggcagccttgtagcagccgagtggcgccctgaagagggctttgttgagctgaagtctcctgccggaaaattttggcagacaatgggcttcagcgaacagggtaggcagcgcctgcacccagaggaagcactgtacctgctagagtgcggatctattcacctcttccaccaggacttacccctgagtatccaagaggcctaccagctgttgctgacagatcataccgtaacttttctgcagtaccagccaccagaggaggtgggcttgtgcggatctaccatccctacgaaattgtgcccggttcccgtgtag

SEQ ID NO: 209882 - DNA, 4296 bp, Artificial Sequence
  Description of Artificial Sequence: Synthetic coding sequence
atggaccggcggaacgactacggctaccgggtgcccctgttccagggacccctgccgccaccagggtccttgggactgcctttcccccctgacatacagacagagaccactgaggaagatagcgtactgttgatgcatactttactagccgccactaaagacagcctcgccatggatccaccggtcgtaaatcgacctaagaagtcgaagaccaagaaggctccaatcaagaccataaccaaggctgctcccgcagcacctcccgtcccagccgccaacgagatagcaacgaacaagccaaagattacttggcaggctctgaatctgcctgtgattacacaaatcagccaggccttacctaccactgaggttacgaacacgcaggcttcttccgtcaccgcccaaccaaagaaagccaacaaaatgaaacgcgtaaccgccaaagctgcacagggctcacagtcccctactggacacgaaggtggcactattcagctcaaaagcccactgcaggtgctgaagcttccagtgattagtcagaacattcacgcaccaattgccaatgaatctgcttcatcccaagccctcatcacgagtattaaaccaaaaaaggccagcaaggctaagaaagcagccaacaaagcaattgcgtcagccaccgaggttagccttgccgcaaccgccactcacaccgccacaactcagggacagatcaccaacgagaccgcctctatccacaccacagcagcatcaatccggaccaaaaaggccagcaaagctcggaagaccattgctaaggtgattaataccgataccgagcacatcgaagcattgaacgtgactgacgcagcaacgcgtcaaatagaggctagcgtggtggccatccgccctaaaaagtcaaaaggaaagaaggctgctagcagaggcccaaacagcgtgagcgaaatatctgaagccccactggccacccaaattgttacgaatcaggccctcgcggcaacactcagggtaaaacgggggtcaagggcacgcaaagccgctacaaaagctcgggcaacagagtcccagacccctaacgcagaccaaggggcgcaggctaagattgccagcgcgcagactaacgtttcagccttggagacccaggtagcagccgctgtgcaggccctagccgacgattaccttgcccagctgtctctcgagccgactacccggacccgaggcaagcgcaaccgcaaaagcaagcatttaaacggagatgagcgttcagggagcaattatcgtcgcattccctgggggcggcgccctgcccccccaagagatgtggcaatactccaggagagggctaacaagctcgtaaaatatctactggtcaaagaccagaccaagattcctataaagcgctccgatatgctccgtgacgttattcaagagtacgatgaatactttccagaaataattgaacgagcatcctacaccctggagaaaatgttccgggttaacctcaaggaaattgacaagcagagtagcctgtatattctgatatcaacacaggagtccagcgccggcatcctcggaacgaccaaggatactccgaaactgggcctgctgatggttattctgtctgttattttcatgaacggtaataaggcatccgaagccgtgatttgggaggttctgagaaaacttgggttgcgacccggggtgcggcactccctgtttggcgaggtgagaaaattaataacagatgagttcgtaaaacagaagtatctcgagtataagagagtgcctaattcccgcccaccagagtatgagtttttctggggtctgcggtcgtatcatgagacgtctaaaatgaaggttttgaagttcgcctgtcgcgtacagaagaaagatccaaaagactgggcagtccaataccgagaggcagtcgagatggaggttcaagccgctgcagtcgctgtcgctgaggccgaggcacgggccgaggccagggcccagatgggcatcggagaagaggcagtcgcaggaccatggaactgggatgatatggacatcgactgcctgacccgggaggagctgggggatgatgcgcaggcatggtctagattctctttcgagatcgaggcgagggctcaggaaaatgccgatgcatcaacgaacgtgaatttttccagaggcgccagcaccagagccggcttttccgacggcgcttccatctcctttaacggagccccttcctcaagcgggggtttttccggaggtcccggaattacgttcggggtggcaccctcaacttcagcctccttcagcaacacggcatctatttccttcggggggaccttgtcaacgtcatcaagcttcagctctgccgccagcatcagtttcgggtgcgcgcattctacatcaacatccttcagttctgaagctagtatatcctttggtggtatgccctgtacctccgcatctttttcgggaggagtttcatcaagtttctctggacccttgtcaacctccgcaaccttctccggtggcgcctcatctggattcggaggaaccctgagcacaacagcaggattctctggggtgttgtccacatctacatcctttggttcagcccccactacaagcaccgttttttcgagcgcattgtccacttccacgggatttgggggcatcctcagtacatctgtctgtttcggtggttcgcctagtagctccggttcattcggcggtaccctgtctacatcaatttgcttcggcggctccccctgtactagcacgggcttcggcggcaccctgtctaccagcgtcagcttcgggggctcctcctccacgtcagctaactttggtgggaccctgtccacatcgatttgtttcgatggctcccctagcaccggcgcaggcttcgggggggccttaaatacatctgcttctttcggcagtgtattgaatacgtctacaggcttcggtggcgctatgagtacttctgcagactttggaggaaccctctctacttccgtgtgctttgggggatctccggggacatctgtttcatttgggagcgcgctcaatactaacgctggctatggtggcgcggtaagtaccaataccgacttcgggggcacgctttctacaagcgtctgctttggcggttccccgtctacaagcgcagggttcggcggggccttaaacacgaacgctagcttcggctgtgcagtttccacgagtgcctctttcagcggcgccgtttccacatccgcctgtttctcgggggcccctattactaacccaggctttgggggagcattctccacatctgccggctttggaggggctctgagcaccgctgcagacttcggcggaacgccttcgaactcaattgggttcggcgcagccccgtcaacctccgtgagttttggaggggcccacggaacctctctttgcttcggcggcgctccctctacgtccctctgtttcggcagtgcatctaataccaacttgtgtttcgggggccctcccagcactagtgcgtgcttttcaggagcgacatctccgtcattttgcgacggcccgtctacatccacgggcttcagtttcgggaatggcctgtccacgaacgccggcttcggcggtggcctcaacacatctgccgggtttggaggcgggctcggtaccagcgccgggtttagtggaggcttgagcacaagctccggattcgatggcggtcttggcaccagtgcgggctttggtggaggacctggtacttctacggggtttggcggcggactaggtacaagcgcagggttctccgggggcctgggtacatcggccggcttcgggggaggactcgtgacttccgacggatttgggggtggtttgggaaccaatgcttcctttggatccacgctgggcacaagtgcgggattttccggtggtcttagcacctccgatggatttggtagcaggcccaatgcgtccttcgacagaggcctgtcaacgattatcggctttggtagtggctctaacaccagtaccggctttaccggggagccaagtacctccacaggtttttcttccggtcccagctcaatcgtcggcttctccggaggcccatctacaggggtggggttctgtagtggtccctctacttctgggttttctggcgggccaagtacaggggctggcttcggagggggccctaacacaggcgccggattcggcggagggccctctacctcagctggttttggtagtggagccgcatcattaggagcttgcggtttttcctatggctag

SEQ ID NO: 209883 - DNA, 2121 bp, Artificial Sequence
  Description of Artificial Sequence: Synthetic coding sequence
atggaccggcggaacgactacggctaccgggtgcccctgttccagggcccgcttccaccaccagggagcttggggctgccgttcccacctgacatccagaccgaaacgaccgaagaggattctgttctgttaatgcatacacttttggcggccacgaaagattccctcgctatggacccgccggtggtgaatagacccaagaagtccaaaaccaaaaaagctccgatcaagacaataacaaaagcagccccagctgcaccccccgtgcctgcagcgaacgagattgctaccaataagccgaagataacctggcaagccctgaatcttccagttattacccagatctcccaggccctcccaaccaccgaggtcaccaatactcaggccagcagcgtcacagctcagcccaagaaggcgaataaaatgaaaagggtgacagcaaaggctgcccaaggcagccagtccccgactggtcacgagggaggaactattcaactaaaaagccccctgcaggtgctaaaactccctgttatatcacagaatatacacgctcccattgcgaacgaatccgctagtagccaggccctcatcacttctattaagccaaaaaaagcctcaaaagcgaaaaaggccgccaacaaggctatcgccagtgcaaccgaggtgtcccttgcagcaacagcaacacacaccgctactacacaggggcagatcactaacgaaaccgccagcatccacacaacggccgcatcgatcagaacgaagaaggccagcaaagccaggaagaccatcgcaaaagtcattaacacagacacggaacatatcgaggcgctgaacgtcactgatgccgcgaccagacaaatcgaagctagcgtagtcgccatcaggcctaaaaaatccaaaggcaagaaggcggcgtctcgcggtccaaactcagtgtctgagatcagtgaagcccctctggccactcaaatcgtgactaaccaagccctagccgccacactgagagtgaaaagggggagccgtgctagaaaagcggcaaccaaagcgcgcgctacagagtcccaaacgcctaacgccgatcagggtgcgcaagcaaaaattgctagtgcccagacaaatgtctctgcgctggaaactcaggtcgctgccgccgtgcaggctctggcggacgactatctggcacagttgagtctggagccaacaactcgcacgcgtggaaagaggaatagaaaatccaagcatctgaacggtgacgagcggtccgggtcaaattataggcgaatcccttggggccggcgccccgctcccccaagggatgtggccattttacaggaacgtgcaaataagctggtgaaatacctattggtgaaagatcagaccaaaatcccgatcaaacgcagcgatatgctccgggacgttatacaggagtacgatgaatactttcctgaaattatcgaacgagcgagttatacattagagaaaatgtttcgagttaacctgaaggagattgacaaacagtcttcactgtatattctcatttccacccaagagagctccgccggcatcttgggcactaccaaggacactcctaagcttggcctgctgatggtgatcctgtcagtcatctttatgaacggtaacaaggcttctgaggccgtcatatgggaagtactgcggaaattaggccttcgacctggcgtgcgacatagcctgtttggcgaagtgcgtaaacttatcactgacgaattcgtgaagcagaagtatctggagtacaaacgggtgcccaattcaagacctcctgaatacgaatttttctggggccttcgcagttaccacgaaacctccaaaatgaaagtcttgaaatttgcttgccgcgtgcagaagaaagaccctaaagattgggcggtgcagtacagagaagccgtggaaatggaggtccaggccgccgctgtggctgtggccgaagctgaggcaagggccgaaatatactctccttgcctgcagatacccctaatcaattgctcttctccaagccatggggccaaagtacatccctggaatctgtgtcctcattcttctcaggggtcgtatggccagtcagcggaaggcgtaatgtag

SEQ ID NO: 209884 - DNA, 1074 bp, Artificial Sequence
  Description of Artificial Sequence: Synthetic coding sequence
atggaccggcggaacgactacggctaccgggtgcccctgttccagtcaaagcatctgaatggtgatgagaggagcggctcaaactaccggcgcataccttggggacgaagacccgctcctccacgcgacgtggccatactgcaggaacgggctaataagttggtgaaatacctgctcgtcaaggatcagaccaagattcctattaaaagaagcgatatgcttcgggatgtgattcaggagtatgacgagtacttccctgagatcattgaacgggcatcctacaccctggagaagatgtttagagttaatctaaaagagattgataaacaatccagcttatatattctgatctccacccaggagagctctgccggcatcctcgggacaactaaggatacccccaaactgggtctgcttatggtgatcctgagcgtgatatttatgaacgggaacaaggcctccgaggccgttatttgggaggtcctgaggaagctcggcttacgccctggcgttagacacagcctctttggtgaggttagaaagctcatcacggacgaattcgttaagcaaaagtacctggagtacaagagagtcccgaactctcgacctcctgaatacgaatttttctggggactccgctcctaccatgagacctctaagatgaaagtgttaaaattcgcctgtcgtgtccagaaaaaagatccaaaagattgggccgtgcaataccgagaggccgttgagatggaggtgcagctgcagctgtggctgtggttacggctgaaaccaggactgagtgggagtaatacctccacagggtttaccggcgagccttctacctcaaccggttttagctcaggaccaagcagcatcgtgggcttttccggcggccctagcaccggcgtcggattttgcagcggcccttccacatctggtttttccggggggccgtctactggggcgggattcggcgggggacccaacaccggggctggcttcggaggcggcccttccacctcagctggctttggcagcggagcagctagtctcggggcgtgcgggttttcctacgggtag

SEQ ID NO: 209885 - DNA, 2121 bp, Artificial Sequence
  Description of Artificial Sequence: Synthetic coding sequence
atggaccggcggaacgactacggctaccgggtgcccctgttccagggccctctgccacccccaggctcgctaggcttgcccttcccacccgacatccagaccgagactaccgaggaggacagtgtcttgctaatgcatactctgctggccgcaaccaaagactcccttgcaatggatccccccgtggttaacaggccgaagaaaagcaaaaccaaaaaagctccgattaagactataactaaagctgccccagcagcaccacccgttcccgccgcaaacgaaattgccacaaataagcccaaaattacctggcaggcccttaatctgccagtgattacgcaaatatcccaggctttacccaccacagaggtcaccaacacccaggcatccagtgtgactgctcagccaaaaaaggctaacaagatgaagagggtcacagccaaggccgcccaaggaagccaatcacccaccggccacgagggtggcacaatccagctgaaatctccactgcaggtcctgaaactgccagtaatcagtcagaacattcacgctcctatagctaacgagtccgcctcttctcaggcgcttatcaccagcattaagcctaagaaagccagcaaagctaagaaggcagccaataaggccatcgcctctgccaccgaggtatcgctggccgcaacggccacgcacaccgccactacacagggccaaatcactaatgagacggcaagcatccatacaaccgccgctagcattcgtaccaaaaaagctagtaaggctcgtaaaactattgcaaaggtcatcaacacggatactgagcatattgaggcactgaacgtcactgatgccgcaaccaggcagatagaggcctcagtggtagctattcggcctaagaagtcaaaagggaaaaaggctgcttctcggggcccaaacagtgtgagcgagatctcagaagctccattggctactcagatcgtaactaatcaagctctcgcagccaccctgagagtcaagagaggttcaagagctcgaaaagctgccaccaaggctcgagccactgaatcacagacacctaacgcagatcaaggtgcacaggccaaaattgcaagtgctcagacaaatgtgagtgctctggaaacccaggtggccgcagcagtacaggccttggctgatgattacctcgcacagctttccctcgagcctacaactaggactaggggcaaacggaataggaagagcaagcatctcaacggtgatgagagaagtggctctaattataggcgtattccgtggggcagacggccggctcctccccgagacgtggccatactccaggagagggccaataaactggtgaagtacttgcttgtaaaggaccaaaccaagatacctattaagagaagcgatatgctgagggatgttatccaggaatatgatgaatatttcccagaaatcattgaacgcgctagttacacattggagaaaatgtttcgggtgaatctgaaggagatcgacaagcagtcaagcttgtacatcctgatcagcacgcaggagtcctctgctggaatactaggcacaaccaaggacacccccaagctggggctgctgatggtcatcctttcggttattttcatgaatgggaataaggcatcagaggctgtcatatgggaggtattgcggaagctcggattacggcccggcgtccgtcattccttgtttggggaggtgcgaaagttgatcactgatgaatttgtgaagcagaagtaccttgagtacaagcgggtgccgaacagcagacctccagaatacgagtttttctggggcctcagatcataccacgagacttctaagatgaaggtgcttaaatttgcttgccgcgtccagaagaaagaccctaaggactgggccgttcagtaccgcgaggctgtagaaatggaagttcaggcggccgccgtcgccgtagccgaggcggaagcccgagccgagatctactccccatgtctgcaaatcccattgattaactgtagttcgccaagtcacggggcaaaggtacatccctggaacttgtgcccacacagtagccaaggctcctatggacaatcagctgaaggcgtgatgtag

SEQ ID NO: 209886 - DNA, 3105 bp, Artificial Sequence
  Description of Artificial Sequence: Synthetic coding sequence
atggaccggcggaacgactacggctaccgggtgcccctgttccagtccaaacaccttaacggagacgaacgctctgggtctaactaccggcgaatcccttgggggaggcgccccgctccaccccgcgatgtagctattctgcaggaacgcgctaataagcttgttaaatatctgttggtgaaggatcagacaaaaattccaatcaaaaggagcgacatgcttagagatgtcatccaggagtatgacgagtacttccctgaaattatagagcgcgcgtcttataccctggaaaagatgttccgcgtaaacctgaaggaaatcgataaacagagctccctgtatatcctcatttccacccaggagtcatctgctgggattttgggaaccacgaaagacacacccaagctgggcctgctaatggtgatcctgtctgtgatttttatgaacggaaataaagcttctgaagccgtgatatgggaggtattacgaaagttggggctgcggccaggcgtgagacacagcttgttcggggaggtaaggaagctgatcactgatgagttcgttaagcagaaatatttggaatataagagagtgcctaactcaagaccacccgaatatgaattcttttggggactgaggtcttatcatgagaccagtaagatgaaggttttaaaatttgcctgccgggttcagaagaaagatcctaaggattgggcagtgcaataccgggaagccgttgaaatggaggttcaggccgccgccgtggcagtcgcagaggctgaggctagggccgaggctcgtgctcagatgggaatcggagaggaggccgtggctggcccatggaattgggacgacatggacatcgactgcctgactagggaggaactcggtgacgatgcccaagcctggtctagatttagttttgaaattgaggcccgggctcaggaaaacgctgatgcctctacaaacgtgaacttttctcggggcgccagtacccgcgcggggttctccgacggggcatccataagcttcaacggcgccccctcatcatcaggaggcttcagcggcggtcccggtatcacattcggggttgcgccatccacttccgcctccttttctaacactgcttcgatcagcttcggaggcactttatctacaagctcttccttcagtagtgctgcatccatctcattcggctgcgcacattcgacatcaacgtcgttctcttctgaggcgagtatttcattcggaggaatgccttgcaccagcgcctcattttccggcggagtgagcagctccttctccggaccgctctccactagcgccacgttttccggaggggcttcatcagggtttggcggcacgctgtctaccaccgccgggttttctggcgtcctgtccactagcactagctttggctcggctccaactacctcgacggtattttctagtgcgctgtccactagtacaggttttgggggcattctgtcaaccagtgtgtgtttcggaggcagtcctagctcttccggctccttcggtggaaccctgagtactagcatctgcttcggggggagcccctgtacaagcaccggcttcggcggaacactgtcaactagcgtgagtttcggaggctcttcatccaccagcgccaacttcgggggcactctgtcaactagcatctgcttcgatgggtctccttctaccggagctggctttgggggcgcacttaacactagtgcgtccttcggttctgtcctgaatacaagtaccggctttggtggtgctatgagtacatcagccgacttcgggggtaccctgtccacctccgtctgttttggcgggtccccagggaccagtgtgtctttcggatcagccttgaataccaatgctggctatggcggtgctgtgtctacaaatactgacttcggcggcacactgagtacctctgtgtgcttcggaggaagtccaagcacaagcgctggattcggaggtgctttaaacacaaacgctagtttcgggtgtgccgtatcaacctccgcatccttctctggcgctgtgtctacatctgcctgctttagcggtgctccaattacaaaccctgggtttgggggcgccttctccacaagtgcgggatttggcggggcgctgtctaccgctgccgatttcggagggacaccaagtaactcaataggttttggcgctgcgcccagcactagcgtttccttcgggggagctcacggcacttctctgtgttttggaggcgcacctagtacctctttgtgttttggctccgcctccaacactaacctgtgctttgggggcccgccttcaacttcagcatgcttctccggcgctactagtccttccttttgtgatggcccttctaccagtaccggattcagttttgggaatggtctgtcaacaaatgcaggttttggaggaggtctcaatacttctgcggggtttggaggcggcctcggcacctcagcaggcttctcgggagggcttagcacctcctctggctttgacggtggcctagggacaagcgccgggtttggcggcggtccaggtacgagtaccggatttggaggagggctgggcactagcgctggatttagtggtggtctgggtacatctgccggcttcggcggcggcttagtgacctcagacggattcggcggcggcctcgggaccaatgcatcattcggctcaaccttgggtacaagcgctggattttcggggggcctgtctacctccgacgggttcggaagccgcccgaacgccagtttcgatcgcgggctcagcacaatcatcggatttggctccggttccaatacttccacaggcttcaccggcgagcccagcacatctacgggcttctccagcgggccgtcatccatagtgggtttctccggcggtcccagcaccggcgtcggcttctgttctggtccttcaaccagtgggttttcaggcgggccctcgacaggggccggtttcggcggcggccctaacacgggcgccggcttcggcggggggccttcaacctctgcaggatttggcagcggggcggcaagcctgggtgcctgcgggttctcctatggttag

SEQ ID NO: 209887 - DNA, 693 bp, Artificial Sequence
  Description of Artificial Sequence: Synthetic coding sequence
atgcacaccctgctggccgccaccaaggacagcctggccatggaccccccagtcgtcaacaggcccaagaaaagcaagaccaagaaggcccctatcaagacaatcacgaaagctgccccggccgcccctccagttcctgcagctaacgagatcgccactaacaagcccaaaatcacgtggcaggcgctcaacctacccgtgatcacgcagatctcccaagctctgcccaccaccgaggttaccaatacacaggcgtcgtcagtgaccgcccagcctaagaaggcgaacaagatgaagcgtgtgacagcgaaggcagctcaggggtcccagtctcccacgggccacgaaggagggacgatccaactgaagtcacccctccaggttctgaaactgcctgttatctctcagaatatacatgctccaattgcaaatgaaagcgccagttcccaggccttaatcacatccatcaagcctaaaaaggcctctaaagccaagaaggctgccaataaggccatcgccagcgctacggaagtgtcgttggcagctaccgctactcacacagccacaacccaggggcaaatcaccaatgagacagccagtatccataccaccgctgcctctattagaacaaagaaagcatccaaagcgcgtaaaacgatcgcaaaagtcattaacacagataccgagcactag

SEQ ID NO: 209888 - DNA, 510 bp, Artificial Sequence
  Description of Artificial Sequence: Synthetic coding sequence
atggaccggcggaacgactacggctaccgggtgcccctgttccagggacccttgccccccccaggtagcctcggcttgcccttcccacccgatattcagacagaaacaacagaggaagatagcgttctgctcatgcataccctgttggcggcaacgaaagatagcctcgcaatggatccacctgtcgtgaatcgccctaagaagagtaaaacaaagaaagcccctatcaaaacaattacaaaggctgctcctgccgcccctccggtgcccgccgccaatgaaatcgcgaccaacaaaccaaagatcacttggcaggccctgaatctccctgtgataacacagataagtcaggccttacccaccaccgaggttacaaacactcaagctagttccgttactgcacagcccaagaaggcgaataagatgaaaagggttacagcgaaggcagcccagggctctcagagccccaccggacatgagggtggtactatccagctgaagtccccttag

SEQ ID NO: 209889 - DNA, 2889 bp, Artificial Sequence
  Description of Artificial Sequence: Synthetic coding sequence
atgctgcgggacgtgatccaggagtacgacgagtacttccccgagataatcgagagggcatcttacaccttagagaagatgttccgcgtaaatctgaaggaaatcgacaagcagtcaagcttgtatatcctgattagcacccaagagagcagcgctggcatcctcgggacgacaaaggatactcccaaactgggcctgctcatggtgatcctttccgtcatctttatgaacggaaacaaggcttcagaagcagtgatatgggaggtgttgagaaagctcgggctccggcccggggtgaggcacagcctattcggagaggtgagaaaactgatcaccgacgaattcgtaaagcagaagtatcttgagtataaaagggttcccaacagcaggccaccagaatatgagttcttttggggtctcagatcctatcacgagacttcaaagatgaaagttctgaagttcgcatgccgggtacagaaaaaagacccaaaagattgggccgtccagtatcgtgaagcggttgagatggaagtgcaagcagcagcagttgccgtagccgaagcggaggccagggcagaggcccgggcgcagatggggattggagaggaagccgtggcgggtccgtggaactgggacgatatggatatcgattgcctgacccgcgaggaactcggagatgacgcgcaggcctggtctcgcttcagcttcgaaatcgaggcccgtgcccaagaaaacgcagacgccagtacgaacgtcaatttcagtcggggggcttctacaagagcaggattctcagacggtgcaagcataagctttaacggggctccaagctcaagcgggggcttcagcggaggaccaggcattacattcggagtcgctccgagcacttcagcctctttttcaaataccgccagtatcagttttggtgggaccctgtctacaagcagttcattctctagcgccgcttccatttccttcggctgcgcccacagtaccagtaccagcttcagcagtgaagcatcaatatccttcggcggtatgccctgcacctcagccagcttttcaggcggcgtgtcttcttcttttagcggacccctcagcacctccgcaaccttctctggtggcgccagctctggatttggcggcaccctttccacaacagctggcttttccggcgtgctcagcacgtctacttcttttggatccgcacccaccactagcacagtgttttcatccgcattgtccacgtccaccggcttcggcggcatcctctcaacgtctgtctgttttgggggtagtccgagcagttccggttcttttggggggacactgagcacctccatatgctttggcggcagtccgtgcacaagcacgggatttgggggcactctttcgacgagcgtcagttttggcggcagcagctccacatcagcaaatttcggaggcacactatccacctcaatctgtttcgacggctccccatctacaggcgccggatttggaggcgcactgaacacctccgcctcttttggaagcgtactgaacacgagtactggtttcggtggcgccatgtcgactagcgccgatttcggcggaacgcttagcacctcagtttgttttggcggctcccctgggacatcagtgtcatttggctccgccttaaacactaacgctgggtacgggggcgccgtcagcacgaacacagacttcggaggtactctcagcacctccgtctgctttggcggctccccctctaccagcgcaggttttggcggggccctgaatacaaatgctagctttgggtgtgccgttagcacctctgcatcattttcaggcgcagtctcaaccagcgcttgcttttctggggctccaatcaccaaccccgggttcggcggcgcattctccacgtctgcaggctttgggggcgctctatcaactgccgctgatttcggtggtacgccgtccaacagtatcggttttggggctgcccctagtacgtctgtgagctttgggggagcccatggtacttcactgtgtttcgggggtgccccgtcaacatccctgtgctttggatctgcatcaaataccaacttatgtttcggtgggcccccaagtacctcagcatgtttttctggcgctactagtcctagcttctgcgacgggccttcgacctccaccggatttagcttcggcaacggattgagtaccaatgccggatttgggggtggcctcaatactagcgctggttttggaggaggactggggacaagtgccggcttttcgggcggactgtcaacgtccagcggcttcgatgggggtctgggcacaagtgccggtttcggcggaggacccgggactagcacaggctttgggggcggcttaggaacctccgccggattttctggcggcctgggcacctctgctggcttcggcggcggcctagtgacgagcgacgggtttggaggcggcttggggacaaacgcctcctttggctctactctggggactagcgccgggttttccggaggattatcaacgtccgatggcttcggctctcgacccaacgcctcttttgaccggggtctaagtacaatcatcggcttcggttctggttccaatacatcgaccggcttcactggggaaccaagcacatccaccgggttcagctcaggacctagctccattgtggggttctcaggcgggccctcaacaggggtgggattttgttctggcccatctacttcgggattttcgggcggcccgtctacaggcgctggctttgggggaggtcctaatacgggagcagggtttggaggagggccatcaacatctgctggttttgggtcaggcgccgcgtccttaggggcctgtggcttcagctatggttag

SEQ ID NO: 209890 - DNA, 366 bp, Artificial Sequence
  Description of Artificial Sequence: Synthetic coding sequence
atgcacaccctgctggccgccaccaaggacagcctggccatggacccgccagtcgtcaatcgccccaaaaaatccaaaaccaagaaagcccccatcaagactatcacaaaagccgctcctgcagcaccacccgtgcctgccgcaaacgaaattgcaacaaacaagcccaagattacatggcaggcacttaatctgcccgttataacacagatctctcaagccctccctaccaccgaggtgaccaatacacaggcatccagtgttacggctcaacccaaaaaggctaataagatgaaacgagtgaccgcaaaggcggctcagggctctcagagcccaactggacacgaaggcggaacaatccagtag

SEQ ID NO: 209891 - DNA, 579 bp, Artificial Sequence
  Description of Artificial Sequence: Synthetic coding sequence
atgcacaccctgctggccgccaccaaggacagcctggccatggaccctcccgtcgtgaacaggcctaaaaagagcaagaccaagaaggcacctatcaaaacgattaccaaagcagctcccgccgctcctccagtgccggcagccaacgagattgcaaccaataagccgaagattacttggcaggctctgaatctcccggttatcacacagattagccaagccctcccgaccacagaagtgactaatacacaggcatcctcagtgaccgctcagccgaaaaaagccaacaaaatgaagcgtgtcacagctaaggcagcccaaggaagccaaagccctaccggccacgagggaggaacaatacaattgaagtccccccttcaggtgctcaaactgcccgtcataagccaaaatatccacgcacctatcgccaacgaatcagccagcagccaagctttgatcacatcgattaagcccaaaaaagccagcaaagccaagaaggctgccaacaaagcaattgcatccgcaaccgaggtgtccttggccgcaaccgctacacacaccgccaccactcaaggatag

SEQ ID NO: 209892 - DNA, 531 bp, Artificial Sequence
  Description of Artificial Sequence: Synthetic coding sequence
atggaccggcggaacgactacggctaccgggtgcccctgttccagggcccacttcctccacctgggtcactgggactgccatttccaccggacatccagactgagacaactgaggaggacagtgtacttttgatgcataccctgttggcagcaacaaaagattcactcgctatggaccctccggtggtaaacagaccgaagaagtctaagacaaagaaggcacctattaagaccattaccaaggccgcacccgcggctccccctgttccagctgctaacgagatagcaacaaataagccgaagatcacatggcaggcactcaacctcccagtaattacacagatcagccaggccctgcctaccacggaagtgacaaatacacaggcaagctctgtgactgcccagccgaagaaggccaacaaaatgaagagggttaccgcaaaagctgcccagggatcacagtctcccacgggccatgaggggggtactatccagttgaagtcgcctcttcaggtgcttaaactaccttag

SEQ ID NO: 209893 - DNA, 507 bp, Artificial Sequence
  Description of Artificial Sequence: Synthetic coding sequence
atggaccggcggaacgactacggctaccgggtgcccctgttccagggacctctaccgcctccagggtccctcggactgcccttcccgcccgacattcagactgaaaccacagaggaggattccgtcctactgatgcacactctgctcgccgctactaaggatagcctggccatggatcctcccgttgttaatcggcccaagaagtcaaaaactaagaaagctcctattaagactatcaccaaggcagccccggctgccccgccagtccccgcggccaacgagatagccactaataaaccaaagattacatggcaagctctgaatctgcccgtaatcactcagatctcccaggccctccccaccaccgaagtgaccaatacccaggcgagctcagtcacagcccagcctaaaaaggccaataaaatgaaaagggtgaccgcaaaggcagctcagggttcccagtctcccacgggtcacgagggcggaacaatccagcttaagtcttag

SEQ ID NO: 209894 - DNA, 2046 bp, Artificial Sequence
  Description of Artificial Sequence: Synthetic coding sequence
atggaccggcggaacgactacggctaccgggtgcccctgttccagggtcctctccccccacccgggtctctggggttgccattccctcctgacatccaaactgagacgacagaggaggacagcgtgcttctgatgcacactctgctcgccgctaccaaggactcactggcgatggaccctcccgtggtcaataggcccaagaaatccaagaccaagaaagcacccataaagaccattacaaaagccgccccggccgcccccccggttcccgccgccaacgaaattgcgacaaataaacctaagataacctggcaggcgttgaaccttcccgtcataacccagatctcccaggcgctgccaacaaccgaggttacaaatactcaggcctcatcagtgacagcgcagcccaaaaaggccaataagatgaagcgcgtgaccgccaaagcggcacagggctcccagtcccccacaggccatgaaggtggcaccatccaactcaagtcccccctgcaggtgctgaagctccccgttatctcccagaacattcatgccccaatcgcaaacgagagtgcaagctcccaggccttgatcacgtccatcaagccaaaaaaagcctctaaagccaaaaaagctgcaaacaaagcgatcgcgagcgccaccgaagtgtctttggcagccactgccactcacaccgccacaacacagggacagatcactaatgagaccgctagcatccatactactgcggccagtatacggactaagaaggcctcaaaagcaaggaaaaccatagccaaggtgataaatactgatactgaacacatagaagctctgaatgttacagacgccgccacccgccagatcgaggcgtccgtcgtcgccatacgccccaagaagtctaagggaaagaaggcggcttcccgtgggccaaactctgtttctgaaatctcagaggctcctctcgctacccagatagttaccaaccaggccctggcagccacgttaagagtcaaacggggctcacgggcccggaaggccgccacaaaagccagggccacagaaagtcaaacaccaaatgcagatcagggtgcgcaggccaagattgcttccgctcaaacgaatgtgagtgccctagagacccaggtcgcagcagccgttcaagcactggccgacgattacctggcccagctctcacttgagcccaccacccgcaccagggggaagcggaaccgaaagtctaagcatctcaacggcgatgagagaagcgggtccaactatagaaggatcccgtggggaaggcgaccagctccgccccgggatgtggcaattctgcaggagcgtgccaacaaactggtaaaatatctattggtaaaagaccagacgaagatcccaatcaagcggtcagatatgctacgagatgtgattcaagaatatgatgaatatttccccgaaataatcgaacgcgcctcctacacgctggagaagatgtttcgtgtaaacttgaaggagatcgataagcagtcttccctctacattctcatcagtactcaggagagttcagccggtatcttaggaaccacaaaggatactcctaagctgggtttactaatggtcattttgagtgtcattttcatgaatggcaataaggcttcggaagctgttatctgggaggtattacgaaagctgggcttgcggccaggggttcgacacagcctctttggagaggttcgcaaactgatcacagatgagttcgtaaagcagaagtacctcgagtataagcgagtaccaaacagccgacctcccgagtatgaatttttttgggggctccgttcttaccatgagacatctaaaatgaaggtgttgaagttcgcgtgtcgggttcaaaagaaggatcctaaggactgggccgtacagtatcgggaggccgttgagatggaggtccaagccgcagcggtggccgtggccgaggccgaagctagagcggaatggttccaacatcagcattggctgtattggcggacccagcatcaacatgggctccagtag

SEQ ID NO: 209895 - DNA, 372 bp, Artificial Sequence
  Description of Artificial Sequence: Synthetic coding sequence
atgcacaccctgctggccgccaccaaggacagcctggccatggacccccccgttgtgaataggcccaaaaaatcaaagacaaaaaaggcacccattaagacaataaccaaggccgctccagccgctccccctgtgccggctgcaaacgaaattgctaccaacaaacctaagataacctggcaagctctcaacttaccagtcattacacagatctctcaagccttaccaaccaccgaagtcacgaatactcaggcatcttccgttacagcacagccaaagaaggctaataagatgaaacgcgtgacggctaaggctgcccaagggagccagtcccctacggggcacgagggagggacaattcaattgaaatag

SEQ ID NO: 209896 - DNA, 216 bp, Artificial Sequence
  Description of Artificial Sequence: Synthetic coding sequence
atgcacaccctgctggccgccaccaaggacagcctggccatggacccgcccgtggttaatcggccaaaaaaaagtaagacaaagaaagctccgattaagacgatcaccaaggctgcgccagctgcccctcccgtgccggcggccaacgagattgcaacgaacaagccaaagatcacctggcaagcattaaatctgccagtaataacacaaatttag

SEQ ID NO: 209897 - DNA, 195 bp, Artificial Sequence
  Description of Artificial Sequence: Synthetic coding sequence
atgcacaccctgctggccgccaccaaggacagcctggccatggacccccccgtcgttaatagaccaaaaaaaagcaagactaaaaaagctcccatcaaaaccattaccaaagccgctcccgctgcaccgcccgtgcccgccgcaaacgagattgccaccaataagcctaaaattacttggcaggcactcaattag

SEQ ID NO: 209898 - DNA, 930 bp, Artificial Sequence
  Description of Artificial Sequence: Synthetic coding sequence
atggaccggcggaacgactacggctaccgggtgcccctgttccagtcaaaacacctaaatggggacgagcgctccggaagtaattaccgtcgcatcccgtggggacgccggcccgcccccccaagagacgtagccatcctgcaggaaagggccaacaagctggtgaaatacctactggtaaaggaccagactaagataccaattaaacgaagcgacatgctgcgggacgtgatccaagaatacgacgagtacttccctgaaatcatcgagcgcgcaagttacactctagagaaaatgttccgggtcaaccttaaggaaattgataagcagagcagcctctacatactgatcagtacccaggaaagtagcgcaggcatattaggcaccacaaaagacactccaaagcttggcctgctgatggtgattctcagtgtgatcttcatgaacggcaacaaggcttcagaagctgttatttgggaggtgttgcggaagttaggtctacggccaggtgtgcggcacagtctgttcggggaggtgagaaaactcatcaccgacgagtttgttaaacaaaaatacctcgaatacaaaagagtaccgaactcccgtccaccagaatacgaattcttctggggacttaggtcataccacgagacaagcaagatgaaagtgttgaagtttgcatgtcgcgttcagaagaaagaccctaaagactgggcagttcagtatcgggaagctgtcgaaatggaggtccaggcggcagccgtcgctgttgctgaggccgaagcccgagcagagatctacagcccctgcctccaaatccctctgattaattgttcctcaccttcacatggagctaaagtccatccctggaacctttgtccccactcatcacagggctcatacggacaaagcgccgagggagtaatgtag

SEQ ID NO: 209899 - DNA, 1263 bp, Artificial Sequence
  Description of Artificial Sequence: Synthetic coding sequence
atgcccggcggctgcagccggggccccgccgccggcgacggccggctccgccttgcccgcctggcccttgttttgttgggatgggtgagcagcagcagccccacaagctctgcatctagtttctccagctcggctccgttcctggctagcgcagtaagtgcccaaccccctcttcctgaccagtgtcccgcactatgcgaatgttcagaggctgcaagaacagtcaaatgtgtgaacaggaatttaaccgaggttcctacggacctgccggcctatgtcagaaatctcttcctgacaggcaatcagttggccgtgcttcctgcgggagcctttgcccgcaggccacccctggcggagttggccgctctcaatctgtctggatctcggctggacgaggtcagggcgggcgccttcgagcacttaccatcccttcgacagttggacttgtctcataatcccctggccgacctctccccgtttgcattcagcggctccaatgcttctgtgagcgcgccgagccctcttgtggagctgattttgaaccacattgtccccccagaggatgaacggcagaatcggtctttcgaggggatggtagtggccgccctcctggctggccgggcccttcagggactgaggaggctggaactggcctccaatcacttcctatatttacctcgtgatgtgctggcccagcttcccagtctgcgtcatttggatctctccaacaacagcttagtgagcttgacctatgttagtttccgtaatcttacacaccttgaatctctgcatcttgaggataatgctctcaaagtccttcacaatggcacgcttgcagaactgcagggtctgcctcacattcgtgttttcctcgataacaatccgtgggtgtgtgactgccacatggctgacatggtcacgtggcttaaggagacagaggtagtgcaggggaaggaccgcttgacttgcgcctatcccgagaagatgcggaacagagtgttacttgaactgaattcagccgacctggattgtgaccccatacttcccccctcattacagacctcttacgtatttctaggaattgtcttggctctcataggagcgatattcctgttagtgttgtatctcaatcggaaaggcatcaaaaagtggatgcataacattagggatgcttgccgcgaccacatggagggctatcattataggtatgaaatcaacgcagatcctcgtctgaccaacttgtcgtcaaactctgacgtctag

SEQ ID NO: 209900 - DNA, 1263 bp, Artificial Sequence
  Description of Artificial Sequence: Synthetic coding sequence
atgcccggcggctgcagccggggccccgccgccggcgacggccggctcagactggccagattggcactggtgctgttgggttgggtatcttcgagtagtcccacatcttcggcctccagcttcagctcatcagcgccgtttctcgcctctgctgtgtccgctcagcctccacttccagatcagtgcccagccctgtgtgaatgttctgaggccgcccgtactgtgaaatgtgtgaatcgtaacctaacagaggtgcccaccgatttgcccgcctatgttagaaacctatttcttacaggcaaccagcttgcagtcctccctgctggggccttcgcgaggcgcccccctctggcagaattggcggcccttaatctaagtgggtccaggctcgatgaggttagggctggcgccttcgaacacctgccttcgctgcgacagctggacttatctcacaacccactcgctgatctgagtcccttcgctttttctggctctaatgcatccgtcagtgcaccttcacctcttgtagaactgatactgaatcacattgtacctccagaggatgagcggcaaaaccgctctttcgagggtatggtcgtagcagcccttttagcaggcagagcactgcaaggtttaaggaggctggagttggcttccaatcatttcctttatctgccccgggatgtcctcgcacagctgcccagtctccgccacctggatctctctaacaattccctggttagtctgacctacgtctcttttaggaatctgacacatctagagagtttacacctggaggataacgcactaaaagttttgcacaatggcaccttagcagaactgcaggggctaccacatattagagtattcctggacaacaatccctgggtttgtgactgtcacatggcggacatggtgacatggctcaaagagactgaagtcgtccagggcaaggataggctcacatgtgcttatcctgagaaaatgcgaaatcgggtactgctggaactgaactcagcagacctggactgcgaccccatcctgcccccttcactccagaccagctatgtctttctgggaattgttttagccctcatcggagcaatcttcctcctggtcttatacctaaataggaaaggtattaaaaaatggatgcacaacatacgtgacgcatgcagggaccacatggaaggctaccactatcggtatgagatcaatgctgatcctaggctaaccaatttatcctccaatagtgacgtctag

SEQ ID NO: 209901 - DNA, 1263 bp, Artificial Sequence
  Description of Artificial Sequence: Synthetic coding sequence
atgcccggcggctgcagccggggccccgccgccggcgacggccggctgaggttagctaggttggcattggtcctgttggggtgggtgagtagcagctcgcctactagctctgcttctagcttttcctcctctgctcctttcctggcctccgcagttagtgctcagcctcccctgcccgatcagtgccccgccctgtgcgaatgttccgaggccgcaagaaccgttaaatgcgttaacaggaatctgaccgaggtgcccactgatcttcccgcatacgtcagaaacctgtttttaactggcaatcagctggcggtcctgccagccggcgcatttgctaggagacccccactagcagaattagcagccttaaacctttctggtagtaggctggacgaagttagagccggcgccttcgagcacttgccaagtttaagacagcttgatttaagccataacccgctggcggacctgtcacctttcgccttctctggtagtaatgccagtgtgtcagccccgagcccgcttgtggagcttattctcaaccatatcgttccaccggaggacgaaaggcagaaccgtagttttgagggcatggtggtcgccgccctgctggcgggcagggctttgcagggacttcgcagactggagttggcatcaaaccatttcctgtatttaccgcgcgatgtcctcgcacagctgccctctcttagacatctggacctgagcaacaattcactggtttccctgacatatgtgtctttccgaaacctaacgcacctcgagtccttgcatctggaggataatgcactcaaggtcttgcataacggaaccctcgccgagttgcaaggactgccacatattcgggtgttcctcgataacaatccttgggtgtgcgattgccacatggccgatatggtcacatggctgaaggagactgaggtggtacagggtaaggaccgcctgacctgtgcctacccggaaaaaatgaggaaccgtgtgctcttggagcttaattccgccgacctcgactgcgaccccatcttacccccctccctgcagaccagttacgtgtttctggggattgtgctggcgctaatcggcgcgatattcctgcttgtcctgtatctgaacaggaaaggaattaagaagtggatgcacaatatccgggacgcctgcagggatcacatggagggttaccactatagatatgagatcaacgccgacccgcgcctgacgaacctttcgagcaattccgatgtttag

SEQ ID NO: 209902 - DNA, 1056 bp, Artificial Sequence
  Description of Artificial Sequence: Synthetic coding sequence
atggccctgcccttccagaaggagctggagaagtacaagaacatcgatgaagacgaactactagggaagctgtccgaagaagaattgaagcagttagagaacgtccttgatgacctcgatcctgaatccgccatgttacctgcagggttccggcaaaaggaccaaacccagaaggctgcaaccgggccattcgacagagagcacctcctgatgtacttggagaaagaggcacttgagcagaaggacagggaggatttcgtcccatttactggagagaaaaagggtcgggtgtttatcccaaaggaaaaacctattgagactagaaaggaggaaaaagtgacgctggatccagagctggaggaggcactagcttctgcttccgacacagaactatacgacctagccgccgtgctcggagtgcacaatctactgaataatccaaaattcgatgaagagactgcaaacaataaggggggaaaggggcctgtccggaacgtagtgaagggggaaaaagttaagccggtatttgaagagccacccaacccaaccaacgtggagattagtctgcaacagatgaaagccaacgatcctagcctccaggaagtaaacttaaataatattaagaatattccgattcccacgttgcgcgaatttgcgaaagctctggaaaccaacacgcacgtcaagaagttcagcttggccgcaacccgctcgaacgatcccgtagccatagcgtttgccgacatgctgaaggtgaacaagacactgacctcattgaatattgaatctaatttcattactggcacgggtattcttgccctggtggaagctctaaaagagaatgacacactgactgagattaagatcgacaaccaacgccaacagcttggtaccgcagtggaaatggagatagcccaaatgctggaagagaattctcgtatcctcaaattcgggtaccagtttactaagcaggggccccgcacacgagtggccgccgcgattaccaaaaataacgatctcgtgcgcaaaaaaagagttgaggctgatcggcggtag

SEQ ID NO: 209903 - DNA, 948 bp, Artificial Sequence
  Description of Artificial Sequence: Synthetic coding sequence
atggccctgcccttccagaaggagctggagaagtacaagaacatcgacgaggatgagcttcttggaaaactctcagaagaagaacttaagcaactggagaacgtactggatgatttagatccagaaagcgccatgctccccgccgggttcagacaaaaggatcagacacaaaaggcagccaccggtccatttgatcgcgagcacctcctcatgtatctggagaaggaagctcttgagcaaaaagatcgggaggattttgtgccgttcacaggcgaaaagaaaggcagggtgtttatccccaaggagaaacctattgagactcggaaagaggagaaggtaacactggaccctgaattggaagaggctttggcttccgcatctgatacagaactatacgatctggctgccgtgctgggcgttcacaacctcctgaacaatcccaagttcgacgaggaaaccgcaaataacaaaggcggcaaaggccctgtacggaacgttgttaagggggagaaggttaaacccgtgttcgaggaacccccaaacccaaccaatgttgaaatctctctgcagcagatgaaggccaatgacccaagcctgcaggaggtaaacctcaacaacataaaagcattcgcagatatgttgaaggtgaataagacgctaaccagcctgaatatcgagtccaactttattacaggcactggtatcttagccctcgtagaagcgcttaaggagaacgatacactaacagagatcaagatcgacaaccagagacagcaactgggaacagcagtcgagatggagatcgcgcagatgctggaggaaaacagccgaatcctgaagtttgggtaccaatttaccaagcaggggcccagaacacgagtcgcagctgccatcacaaagaacaacgacctggtcaggaagaaacgagttgaggctgaccggcgctag

SEQ ID NO: 209904 - DNA, 1059 bp, Artificial Sequence
  Description of Artificial Sequence: Synthetic coding sequence
atggccctgcccttccggaaggacctggagaagtacaaggacctggacgaggacgaattgctgggaaacctatccgagacagagctcaaacagctggagactgttctagatgatctggatcccgagaacgcactcctgccggcggggtttcggcaaaaaaatcagacatccaagtctacaactgggcccttcgaccgagaacacttactgtcttacctggaaaaggaggctcttgagcacaaggaccgcgaggattacgtgccctacaccggcgagaagaagggcaaaatctttatcccgaagcagaagcccgtacagaccttcactgaggaaaaggtgagtcttgacccggaactcgaggaggccctgacttccgcctcggataccgaactgtgcgatctggctgccattttaggcatgcataacctgattaccaatacaaagttctgcaatatcatgggatctagcaatggagtggatcaggagcacttcagtaatgttgtcaaaggcgagaaaattctgccagtttttgacgagccaccaaacccaacaaacgtggaggagagcctgaaacgcaccaaggagaacgacgcccaccttgtggaagtcaacctcaacaacatcaagaatatacccatccctacactaaaggatttcgctaaagcactggaaacgaacacacacgtgaagtgtttcagcctcgcagccaccagaagtaacgaccctgtggcaacagcttttgcagaaatgttgaaggtgaacaagaccttaaagtcactgaacgttgaatccaacttcattactggcgttggaattctggcgctgatcgacgctctgagagataacgagacattagccgaactgaaaatcgacaatcaacgccaacagcttggaacggccgttgaactggagatggctaaaatgttggaagaaaacacaaacatcctgaaatttgggtaccaattcacccagcagggtcctaggacccgcgctgccaatgccattacaaagaacaacgatctggttagaaaaaggcgggtggagggggaccaccagtag

SEQ ID NO: 209905 - DNA, 1059 bp, Artificial Sequence
  Description of Artificial Sequence: Synthetic coding sequence
atggccctgcccttccggaaggacctggagaagtacaaggacctggatgaggatgagctcctgggaaacttatctgaaactgagctcaaacagctcgagaccgtgctggacgatctggatcctgaaaacgcacttctccccgccggctttcgtcagaaaaaccagacctcaaaatcaacaaccggcccttttgatagagaacatctgttgtcctatctggaaaaggaggctctcgagcacaaggaccgtgaagattacgtgccgtatacaggtgaaaagaaaggaaaaatctttattcctaagcagaagccagtacagacattcactgaggaaaaagtgtccctagacccggagctggaagaagccttgacgtctgccagcgacacggagctgtgcgatctggcggctatactgggcatgcacaatctgatcacaaacactaaattctgcaatatcatggggtcttcaaacggcgttgaccaagaacacttcagcaacgtagtgaagggcgagaaaattctacctgtgttcgatgagccccctaacccaacaaacgtagaggagagcttaaaaagaacaaaggaaaacgacgcccacctagtagaggtgaacctgaataacatcaaaaatattcccatacctaccttaaaggatttcgccaaggcactggagaccaacacccatgttaaatgcttcagtttggccgccactcgaagtaatgaccccgtggctactgcattcgcagaaatgctgaaagtcaacaaaactctgaagtctctgaatgtggagagtaacttcattacaggggttggtatcctcgctttaattgatgctctgagggataacgagacactggccgagctgaaaatcgacaatcagcggcagcagctaggaactgccgtggaactggaaatggctaagatgttggaggaaaacaccaacatcttgaagttcggataccaatttactcagcagggaccacgcacacgtgcagctaacgccatcacaaaaaacaatgatttggtcaggaaacgcagagtggaaggcgatcaccaatag

SEQ ID NO: 209906 - DNA, 102 bp, Artificial Sequence
  Description of Artificial Sequence: Synthetic coding sequence
atggccctgcccttccggaaggacctggagaagtacaaggacctggacgaagacgaactgctaggtaatctgtctgaaactgaactcaagcagctggagtag

SEQ ID NO: 209907 - DNA, 1038 bp, Artificial Sequence
  Description of Artificial Sequence: Synthetic coding sequence
atgagcagctaccagaaggagctggagaagtaccgggacatcgacgaggacgagatcctgcggactctgtcaccagaagaactggagcaactagattgcgagctgcaagaaatggatcctgaaaacatgttgctgcccgccggcttacggcagcgcgatcagacaaagaaaagtcccactgggcccctggaccgagaggctttgctgcaatatcttgagcagcaggcactcgaggttaaggaaagagacgacctggtcccgtttaccggcgagaaaaaggggaaaccctacatccagccaaagcgcgagataccagccgaggagcaaattaccctggaacctgagttggaagaagctttggctcatgctaccgatgccgaaatgtgcgacattgccgccattctcgatatgtataccttaatgtctaacaagcagtattacgacgccctctgtagtggtgaaatttgtaacacagagggtatctccagcgtcgtgcagcctgacaagtataaacccgtgcccgacgagcccccgaatccaacaaacattgaagaaatactaaaacgggtaaggagtaacgataaggaattagaagaggtgaacctgaacaatatccaggacatccctattcccatgctgtccgagttgtgcgaggcaatgaaggccaatacatatgtaagatctttctctcttgtcgcgacccgctctggcgatcctatcgccaatgccgtcgcggacatgctgcgggagaatcgtagtttgcagagtttgaacatagagtcaaatttcatcagctctactggactcatggccgtgctgaaggccgtcagggaaaacgcaacactgactgagctgcgggttgacaaccagagacaatggcccggagacgccgtggaaatggaaatggcgaccgtgctggagcagtgccccagcatcgtgcgctttgggtaccacttcacccagcaaggaccccgcgcccgagctgctcaggccatgacgcggaataacgagctgaggaggcagcagaagaagcgatag

SEQ ID NO: 209908 - DNA, 831 bp, Artificial Sequence
  Description of Artificial Sequence: Synthetic coding sequence
atgagcagctaccagaaggagctggagaagtaccgggacatcgacgaggacgagatcctgagaactctgtctccagaagaactcgagcagttggattgcgaactgcaggagatggatcccgagaatatgctgctaccggccggactgcggcagcgtgatcagaccaaaaagtcgcccactggccccctggaccgcgaggctctcctgcaatacctggaacaacaagctctcgaggttaaagaacgtgacgatcttgtacctttcacaggagagaaaaaaggggtggtgcaacctgacaagtataaacctgtgccggacgaacccccaaatcctacaaatatcgaggaaattttaaaaagggtgaggtctaatgataaagaactcgaggaagttaatcttaataacatacaagacatccctattcctatgttgtctgagttgtgtgaagctatgaaggccaatacatatgttagaagctttagcctcgtggccaccaggtcaggcgacccaatcgccaacgctgtcgctgatatgctccgcgaaaacaggagcctccagtcccttaatatcgagtcaaactttatcagcagcaccgggctgatggcggtgttgaaagcagtgagggagaacgccactttgaccgagcttagagtggataaccagcggcagtggccaggagacgcagttgagatggaaatggccactgtcctggagcagtgtccaagcattgtgagatttggctaccactttacccagcagggccctagggccagagccgcccaggccatgactcgaaacaatgagttacgacggcagcagaagaagcgatag

SEQ ID NO: 209909 - DNA, 429 bp, Artificial Sequence
  Description of Artificial Sequence: Synthetic coding sequence
atgagcagctaccagaaggagctggagaagtaccgggacatcgacgaagacgagatcctccgaaccctgtctccggaagagctggagcagcttgattgcgaactgcaggaaatggaccccgagaatatgcttctgccggccggtctgcgccagcgcgatcagactaagaagagccctaccggaccgcttgacagggaggctctgctgcagtacctggaacaacaggctctggaagtgaaggaaagagacgatcttgtgccttttacaggagagaaaaaagggaagccctacattcagcccaaaagagagatccctgcagaggaacaaattacactagaacccgagctggaggaagccctggcccatgctaccgacgctgagatgtgtgacattgcggctattctagacatgtacaccctgatgagctag

SEQ ID NO: 209910 - DNA, 855 bp, Artificial Sequence
  Description of Artificial Sequence: Synthetic coding sequence
atggacgccatcaagaagaagatgcagatgctgaagctggacaaggaaaacgcccttgatagggctgagcaggcagaagccgataagaaagctgcggaggacagaagtaagcagctcgaggaggacattgctgctaaggagaagctgctccgcgtgagtgaagacgagcgggacagggtgctcgaggaactgcacaaggccgaagattcactgttagctgctgaagaggcagctgccaaggccgaagctgacgtcgcatccttgaatagaagaatccagctggttgaggaagagctggaccgcgcccaggaacggctggcaacggcacttcagaaactagaggaggccgagaaagcagcggacgaatccgagcgcggaatgaaggttatcgagtcccgagcgcaaaaggacgaagagaaaatggagatccaagagatccagctaaaggaagcgaaacacattgccgaggacgccgatcgaaagtacgaggaggtcgctcgaaagctcgtaatcattgaatctgatcttgagcgcgcagaggaaagagctgagctgagcgaaggcaagtgcgctgagttagaggaggagctgaagacagttacaaacaatctgaagtccctggaggcccaggccgaaaagtactcacagaaggaagatcgctatgaagaggaaatcaaagttttgtctgataagctcaaggaggccgagaccagggcagaatttgcagagcggagtgtgacgaagctcgagaagtccatagacgaccttgaagaaaaggtggcgcatgcgaaagaagagaacctctccatgcatcaaatgctggaccagactctgctcgaactcaacaacatgtag

SEQ ID NO: 209911 - DNA, 855 bp, Artificial Sequence
  Description of Artificial Sequence: Synthetic coding sequence
atggacgccatcaagaagaagatgcagatgctgaagctggacaaggagaacgcgctggaccgggccgagcaggccgaagccgacaaaaaagccgcggaggaccggtctaaacaactggaagacgaactggtgtccctccagaaaaagctgaaaggcacagaggatgagttggataaatactcagaggcattgaaggatgcacaggagaagctcgagctcgctgaaaagaaagccaccgacgctgaggccgatgtggcaagtctgaacagacgtattcaactggtggaggaagagttggaccgggctcaggaacgactggctaccgcacttcaaaaacttgaagaggccgagaaagccgcagatgaatcggaaaggggcatgaaggtgatcgagtctcgtgcccagaaagacgaggaaaaaatggagattcaggagatccagcttaaagaggcaaaacacatcgccgaagacgccgacaggaagtacgaagaggtggcacggaagctggtcataatcgagagtgacctggaacgtgcagaggaaagggccgaattgagcgaggggcaagtgaggcagctggaagagcagctgagaattatggaccaaaccctgaaggccctcatggctgcagaggataaatattctcaaaaggaagaccgctacgaggaggaaatcaaggtcctgagcgataagctcaaggaagctgagacacgcgccgaattcgcggagagaagcgtgaccaagcttgaaaagtctatcgatgacctggaagacgaactttacgctcaaaaactaaaatacaaagctatatccgaagagctggaccacgccctgaacgatatgaccagcatgtag

SEQ ID NO: 209912 - DNA, 738 bp, Artificial Sequence
  Description of Artificial Sequence: Synthetic coding sequence
atggccggcagcagcagcctggaggccgtgcggcggaagatccggagtctgcaggaacaggcagatgctgctgaggagcgtgccggcactcttcagagagagttggaccacgagaggaaactccgcgagacagctgaggctgacgtcgctagcctgaatcgacgaattcagctcgttgaggaggagttggatagagcacaggagcgactcgcgactgcattacaaaaactggaagaggccgagaaggctgctgatgagagcgaacgcggcatgaaagtgattgagagccgcgctcagaaagacgaggagaagatggagatccaagagatacagctgaaagaagccaagcacatcgcagaggatgcggaccgaaaatatgaggaggtggccagaaagctggtgattatcgaatctgatctggagcgcgccgaggaacgcgctgaactaagcgagggtaaatgcgctgaacttgaagaagaactaaaaaccgtaaccaacaacctgaaatctctggaagcgcaagccgagaaatacagccaaaaagaagatcgatatgaggaggagattaaagtgctctctgacaaactgaaggaggccgagaccagggcggagttcgcagaacggtctgtaacgaaactagaaaaatctattgacgacctggaagatcagctgtaccagcaactcgagcaaaaccggcgactcacgaatgaactgaaactggctctgaatgaggattag

SEQ ID NO: 209913 - DNA, 981 bp, Artificial Sequence
  Description of Artificial Sequence: Synthetic coding sequence
atggacgccatcaagaagaagatgcagatgctgaagctggacaaggaaaacgctctcgatagggcggaacaggcagaggcggacaaaaaggccgccgaggaccggtcaaagcagctagaagaggacatcgccgcaaaggagaaacttctgagggtatccgaagatgaaagggatcgtgtcctggaggaactccataaagcggaagacagtcttctcgcggcagaggaagccgccgcaaagctcgaagatgaacttgtgtctcttcagaagaagctgaaaggaactgaagatgaacttgataaatacagtgaagctctcaaggatgctcaagagaaattggagctggcggaaaagaaggctaccgatgccgaggccgacgtggcatccctgaacaggcggattcagctggtggaggaggagctggacagagcgcaagagagactcgccactgcccttcagaagctcgaggaagcagagaaagctgcagatgaatcagagagagggatgaaggtgattgaatcaagagcccaaaaagacgaagagaaaatggagattcaggagatacagctaaaggaagccaaacacatcgctgaggacgctgatagaaagtatgaggaagtggcacggaaactggtgattattgagtcagacctggagagggccgaggaacgagccgaactcagcgagggcaagtgcgccgagctggaagaggaattgaagacggtgaccaacaatcttaagtccctggaagctcaggcagaaaagtacagccagaaagaggataggtacgaagaggaaattaaggttctgtctgataagctcaaggaggccgagaccagggcagagttcgccgagagaagcgtcaccaaattagagaagtccatagatgatctggaggagaaagtggctcacgctaaggaggaaaatctgagtatgcaccagatgctggaccagacccttctggagcttaataacatgtag

SEQ ID NO: 209914 - DNA, 855 bp, Artificial Sequence
  Description of Artificial Sequence: Synthetic coding sequence
atggacgccatcaagaagaagatgcagatgctgaagctggacaaggagaatgctctcgatcgagcagagcaggccgaggccgataagaaggccgcagaggatagatctaagcagctggaggatgagcttgtgagtctccagaagaaattaaagggaaccgaggatgaactcgataagtactcagaagcgcttaaagatgcccaggaaaagttagagctggcagaaaagaaagcaacggatgccgaagcagatgtggcatccctcaaccgaagaatacagctcgttgaggaggaactggatcgtgcacaagagagactggccacagcgctgcaaaagctcgaagaggccgagaaagccgccgacgagagtgaacgaggcatgaaagtgattgagtctcgggctcagaaagacgaagagaagatggagatccaggaaatccaactcaaagaggctaaacacatcgcagaggacgccgatcgtaaatatgaggaggtcgctaggaaactggtcatcatcgaatcagacctggaacgcgcagaggagagagcggaactttccgaaggtcaagttcggcagttagaagagcagctcaggatcatggaccagaccctcaaggcgctgatggcggcagaggacaaatactcccagaaggaggatagatacgaagaggaaatcaaggtcctttccgacaagttaaaggaggccgagacccgcgccgaatttgctgaaaggtccgttacaaagttggagaagtccattgacgacctggaggagaaggtcgcccatgcaaaggaggaaaacttgagtatgcaccaaatgctggatcagaccttactggaattaaacaacatgtag

SEQ ID NO: 209915 - DNA, 855 bp, Artificial Sequence
  Description of Artificial Sequence: Synthetic coding sequence
atggacgccatcaagaagaagatgcagatgctgaagctggacaaggagaacgccctcgatcgggcggagcaggctgaggctgataagaaggcagccgaggatcgaagcaaacagctggaggacgaactggtctcacttcagaagaaactgaagggcacagaggatgagcttgacaagtacagtgaggcgctgaaggacgctcaggagaagcttgaactcgccgaaaaaaaggcgactgacgctgaggccgatgttgctagcctgaatcggaggattcagcttgtcgaagaagaactcgaccgcgcccaggagcgtttagctacagcacttcaaaagttggaagaagccgaaaaagctgcggatgaatccgaacgcggtatgaaggtgatcgagagccgggcgcaaaaggacgaggaaaaaatggagatccaggagatccaactcaaggaggctaaacacattgctgaagatgccgatcggaagtacgaagaagtggctcgcaaactcgtgatcatcgagtctgacctggagcgcgcggaagagcgggccgagctcagcgaaggaaaatgcgccgaactggaggaagagttgaagaccgtcaccaataacctgaagtccctcgaggctcaggcggaaaagtatagtcagaaagaagacaggtacgaggaggagattaaggtccttagcgataagttgaaggaggccgagacacgcgcggaattcgccgagcggagcgtaactaaattggagaaatctatcgacgacttagaagacgaactgtatgcccagaaacttaagtataaggcgatcagcgaggaactcgaccatgcgctgaatgacatgacctctatttag

SEQ ID NO: 209916 - DNA, 855 bp, Artificial Sequence
  Description of Artificial Sequence: Synthetic coding sequence
atggacgccatcaagaagaagatgcagatgctgaagctggacaaggagaacgccttagacagggccgaacaggccgaggcggataaaaaagccgccgaggataggagtaagcagcttgaggaagacatcgcagccaaagaaaaactcctccgcgtgtctgaggatgagcgtgacagggtcctggaagagttgcacaaggccgaagacagcctgctggcagcagaagaggcagctgccaaagccgaggccgatgttgcttctcttaaccgcagaattcaactggtagaggaagagctggaccgcgctcaagaaaggttggctaccgctcttcagaaactggaagaagctgaaaaggctgctgacgagagcgaacggggcatgaaagtgatagagagccgggcccagaaggacgaggaaaagatggagatccaagaaatccagcttaaagaggcaaaacacattgctgaagatgcagatcggaaatatgaggaagtagccagaaaattagtgatcatcgaaagtgatctggaaagggcagaagagcgtgccgaactgtctgaaggtcaggtgcgtcagctagaagaacagctgagaatcatggaccagacactcaaggcactgatggcagccgaggataaatactctcagaaggaggacaggtacgaagaggagatcaaggtgctgtctgacaaactgaaagaagccgagactagagcggaattcgccgagaggagtgtcaccaaactggaaaaatcaatagacgacctcgaggaaaaggtcgcacatgccaaagaggagaatttgtcgatgcaccagatgttggaccagactttactggaactgaacaatatgtag

SEQ ID NO: 209917 - DNA, 855 bp, Artificial Sequence
  Description of Artificial Sequence: Synthetic coding sequence
atggacgccatcaagaagaagatgcagatgctgaagctggacaaggaaaacgccttagaccgcgccgagcaagccgaggccgataaaaaagctgccgaagatcggtcaaagcagctggaagatgaacttgtcagtttacagaaaaagctaaagggaactgaggatgagctcgacaaatattcggaggccctaaaggatgctcaggaaaaactcgagcttgccgagaagaaagcgaccgacgctgaggccgacgtggcctctctgaacaggaggattcaattggtcgaagaagagctggatcgggctcaggagaggctggcaacggctcttcagaaattggaagaagccgaaaaagctgctgatgagtcggaaagagggatgaaggtcattgagtcaagggcccagaaagatgaagagaagatggagatccaggaaatccagctgaaggaggctaagcatatcgccgaagacgcggaccggaagtatgaagaggtggctcgtaaactggtgatcattgagagcgatctggaaagagctgaggaacgcgcagagctctccgagggcaaatgcgcggaactcgaagaggagctgaaaactgtaaccaacaatctaaagtctctggaagcccaggctgaaaaatatagtcagaaagaagacaggtacgaagaggagattaaggtgctgtcagacaagttgaaggaggcagaaacgagggccgagttcgctgagaggagtgtgacgaaactggagaagagtatcgatgatttggaggaaaaggttgcccacgccaaggaagagaacttaagtatgcatcagatgttggatcagaccctgcttgagcttaataacatgtag

SEQ ID NO: 209918 - DNA, 798 bp, Artificial Sequence
  Description of Artificial Sequence: Synthetic coding sequence
tgacgggccgagcaggccgaggccgacaagaaggccgccgaggaccggagcaagcagctggaggatgagctggtttccctgcagaaaaagctcaaagggactgaggatgagctggacaagtattctgaggccctcaaagacgcacaggaaaagctcgaactggcagaaaagaaagctacagacgctgaggcggatgtggcgagtctgaaccggcgtatccagctcgtggaagaagagttagatagggcccaggagcgcctggcaacagcactgcaaaaactcgaagaagcagaaaaggccgcggacgaaagcgagaggggaatgaaggtgatcgaatcacgagcccagaaagacgaggaaaagatggaaatccaggagatccaactcaaagaggcaaagcacatagcagaagacgccgacaggaaatatgaagaggttgctagaaagcttgtcattatcgagtcggaccttgagcgtgccgaagagcgagcagagctgtccgaaggtaagtgtgctgaactggaggaagagctcaagaccgttacaaacaatcttaagtcattggaagcacaggccgaaaaatattctcagaaggaagacaggtatgaggaagagataaaggtgttatcggataaattgaaggaggctgagacgcgggcagagtttgctgagagatctgtgaccaaactagagaagagtatagatgatctggaagatgagctgtacgcacaaaaactgaagtacaaggcgataagcgaagaactagaccatgctttaaatgacatgacgtccatgtag

SEQ ID NO: 209919 - DNA, 855 bp, Artificial Sequence
  Description of Artificial Sequence: Synthetic coding sequence
atggacgccatcaagaagaagatgcagatgctgaagctggacaaggagaacgcaattgatcgcgccgaacaggccgaggcagacaagaagcaggccgaagataggtgtaagcaattagaagaagaacagcaagcactgcagaagaagctcaagggtacagaggatgaggtggagaaatattcagagtccgttaaggaagcccaagaaaagctggagcaggccgagaaaaaggcaacagatgcggaagcagatgtagcatcgctgaaccgccgcattcagcttgtcgaagaggagctcgatcgcgcacaggaaaggctggcaaccgcgctacagaaactggaagaagccgaaaaggccgcagacgagtcagaacgggggatgaaggtcatcgaaaatagagccatgaaagacgaggaaaagatggaactgcaagagatgcagctgaaagaagctaaacatatagcagaggactcagacaggaagtatgaggaagtggccagaaagctggttatcttggagggagagttagagcgtagtgaggaaagggccgaagtcgcagagtccaagtgcggcgacctggaggaggaactgaagattgtgaccaataacctgaagtcattagaagcacaggccgacaagtattccaccaaggaggataagtatgaggaggagatcaaactgctggaggaaaagctcaaggaggccgagactcgggccgagtttgccgaaaggagcgtcgctaaactggagaagactattgatgatttggaagagaccttagcttctgccaaagaagagaatgtcgagatccaccagacgctcgaccagaccctgctggaactgaacaacctctag

SEQ ID NO: 209920 - DNA, 855 bp, Artificial Sequence
  Description of Artificial Sequence: Synthetic coding sequence
atggacgccatcaagaagaagatgcagatgctgaagctggacaaggaaaacgcaattgaccgggccgagcaggccgaagctgataaaaagcaggcagaagataggtgcaagcagctagaggaagagcagcaggcgcttcaaaagaaactcaaaggaacggaggatgaggtcgagaagtatagcgagtccgtgaaagaagcacaagaaaaactcgaacaggcagagaagaaagcaaccgacgctgaggccgacgttgcgagcttgaatagacggatccagttagtagaggaggaactggaccgggcccaagagcgactggcaacagctctgcaaaagttagaggaggcggaaaaggccgctgacgagagcgaacgtggaatgaaagtgattgaaaaccgggctatgaaggacgaggagaaaatggagctgcaggagatgcagttgaaggaggcaaagcacattgccgaagatagtgatcggaaatatgaggaagtggcaagaaagctcgtgatacttgaaggagaactggagagatctgaggaacgcgccgaagtggcagaaagcaagtgcggcgacctagaggaggaattgaagattgtaaccaataatctcaaatccctcgaggctcaggccgacaagtacagcaccaaagaggacaaatatgaggaggagataaagctcctcgaggagaagctgaaagaagctgagacacgcgccgagtttgcagagcgaagtgttgcaaagcttgagaaaaccatcgatgacctggaggacgaggtgtatgcccagaagatgaagtataaagccatttcagaagagctcgacaatgccctaaacgacattactagtctctag

SEQ ID NO: 209921 - DNA, 855 bp, Artificial Sequence
  Description of Artificial Sequence: Synthetic coding sequence
atggacgccatcaagaagaagatgcagatgctgaagctggacaaggaaaatgcaattgacagagctgagcaggcagaggctgacaagaaacaggccgaagaccggtgcaaacagctcgaagaagagcagcaggcgctgcagaagaagcttaagggaactgaggatgaggttgagaaatattctgagagtgttaaggaggcccaggagaagcttgagcaggctgagaagaaagctacggacgccgaagctgacgtggccagtttgaacagacgtatccagctagtcgaagaggaacttgatcgagcccaggagagactggccaccgctttacaaaaactcgaagaggccgaaaaagctgcagacgaatcagagcgtggtatgaaggtgatagaaaatagggcgatgaaggacgaagagaagatggaattacaggagatgcaattgaaagaggccaaacatatagcagaagacagcgataggaagtacgaggaggtcgctagaaagcttgtgatactggaaggggaactagaacggagcgaggagcgagcagaagtggccgagtccagagcgcgacagcttgaagaagaattgaggactatggaccaagctctgaagtcccttatggccagtgaggaggaatattcaaccaaggaggacaaatacgaggaggagataaaactgctggaagaaaagctgaaggaggcagaaacccgggcggagtttgcagaaaggtctgtggcaaaactcgagaagacaatcgacgacctggaggagacactggctagtgctaaggaggagaacgtcgagatccaccaaacactggaccaaactttactggagctgaataatttatag

SEQ ID NO: 209922 - DNA, 969 bp, Artificial Sequence
  Description of Artificial Sequence: Synthetic coding sequence
atggacgccatcaagaagaagatgcagatgctgaagctggacaaggagaacgccatagaccgtgctgagcaggctgaggccgataaaaagcaggccgaggaccgatgcaaacaacttgaggaggaacagcaagctctccagaaaaaactcaaaggaaccgaggatgaagtggaaaaatattcagaatctgtgaaggaggcgcaggaaaagcttgagcaggcggagaaaaaagccacagacgcggaggcggacgtggcctcccttaaccggagaattcagttggtcgaagaggaattggatagggcccaggagcggctcgctacagccctgcagaaattggaggaagcagagaaagccgccgatgagtctgagagaggtatgaaggtcatcgagaatcgagctatgaaggatgaggagaagatggagctgcaggaaatgcaactgaaagaggctaagcatattgccgaagactcagaccggaaatacgaagaggtagctaggaagctggtcatcctggaaggtgagttggagcgctctgaagagcgggccgaggtggcagagagcaagtgtggagacctggaggaagagttgaagatcgttacgaacaatctgaagtccctcgaagctcaggcagataaatatagcacaaaggaagataagtacgaggaggaaatcaagctgctggaggaaaagctgaaggaagccgaaactagagccgagttcgccgagcggtccgttgccaaactggagaaaacgatcgacgacctagaggagagtacatctatagcaacaacagaacattggttcacgcccgacacgctagcattgaccgatacacccagtccatgtacagagcccacacacaaaaccccatggcccactctgaagccattgtgtaccgggacaccttggctgtccctatcggattctcctttgcacgtcggcacctgtggtccaataaagccttag

SEQ ID NO: 209923 - DNA, 858 bp, Artificial Sequence
  Description of Artificial Sequence: Synthetic coding sequence
atgatggaggccatcaagaagaagatgcagatgctgaagctggacaaagagaatgctctagatcgggccgagcaggccgaggccgaacagaagcaggccgaggagagatccaagcagctggaagacgagctggccgcaatgcaaaaaaagctcaagggaaccgaagacgagttggacaagtattccgaggcacttaaggatgcccaggaaaaactggagctagccgagaaaaaagccgcagacgctgaggccgaagtggcctcactaaatagacgtattcagctggtagaagaggaattggaccgagcacaagaacgtctagcaacagccctgcagaagttggaagaggcagagaaggcggccgatgagagcgagcgcggaatgaaggtcattgaaaatcgcgccctgaaagacgaagagaaaatggagcttcaggaaatccaacttaaagaggccaaacacattgctgaggaggccgatcggaagtacgaagaggttgcaaggaagctggtgatcattgagggagacctggaacgcaccgaagagagagctgagcttgcagagagccggtgccgcgagatggatgagcagattcggttgatggatcagaacctgaagtgcctcagcgccgctgaagaaaagtacagccagaaggaggacaaatatgaggaagagatcaaaattctcacagacaagcttaaggaggcagagaccagggcagagttcgcagagcgaagcgtcgctaagttagaaaagactatcgacgatttggaggataaacttaagtgtacaaaggaggagcacttatgcacccaacggatgcttgaccaaacactgctcgatttgaatgagatgtag

SEQ ID NO: 209924 - DNA, 744 bp, Artificial Sequence
  Description of Artificial Sequence: Synthetic coding sequence
atggccggcatcaccaccatcgaggccgtgaagcggaagatccaggtcctgcaacagcaagccgacgatgctgaggagcgcgcagagaggctacaaagagaagttgaaggggagcgaagggccagggagcaggccgaggcagaggtggccagtttgaacagacggattcagttagtggaggaagaactcgatcgcgctcaggagaggctggctacagctctgcaaaagctcgaagaggcggagaaggctgctgacgagagtgagagaggcatgaaagtgatagagaacagggcgctaaaggacgaggagaaaatggaattacaggagatacagcttaaggaagccaagcatatcgctgaggaggcggaccgcaagtacgaggaggtggcccggaagttagtgatcattgagggcgacctcgaacgcaccgaagaacgagctgagctggcagaatccaagtgtagcgaactggaggaggagttaaagaacgtcactaacaacctgaaatctcttgaggcccaagcagagaagtacagccaaaaggaagataagtacgaagaagaaattaaaattctgacagacaagcttaaggaagctgagactcgcgccgaatttgctgaaaggtccgtggcaaaactggagaagactatcgacgatctcgaagaacgcttatattcgcagctcgagaggaatcgtttgttgagcaacgagctgaagctgaccttgcacgatctctgcgattag

SEQ ID NO: 209925 - DNA, 747 bp, Artificial Sequence
  Description of Artificial Sequence: Synthetic coding sequence
atggccggcatcaccaccatcgaggccgtgaagcggaagatccaggtcttgcagcagcaggcagatgacgccgaggagcgggccgagcgcctccagagggaggttgagggggaacgtagggcaagggaacaagccgaagccgaggtggccagccttaaccgccgtatccagctggtggaggaggaactggacagagcccaggagcggctcgccacagccctgcagaagctggaagaagccgaaaaggccgctgatgaatcagaacgcgggatgaaggtgatagagaatagagcactgaaggacgaggaaaagatggaactccaggaaatccagctgaaggaggcaaagcatattgctgaggaagctgaccgtaagtacgaggaggtggcccgaaaactggtcattatcgagggagatctggaacgcaccgaagagagagctgagttggctgaatcccgttgtagagagatggatgagcagattcgattgatggaccagaacctgaaatgcctctctgccgctgaggagaaatactcccagaaggaagataaatatgaggaggaaatcaagattttgaccgacaagctgaaagaggccgagaccagagcggagtttgccgagagaagcgtggccaaactggaaaagaccatagatgatctggaggacgaactttacgcccagaaactaaagtataaggccatatctgaggagctcgaccacgcactaaacgatatgaccagcatctag

SEQ ID NO: 209926 - DNA, 747 bp, Artificial Sequence
  Description of Artificial Sequence: Synthetic coding sequence
atggccggcatcaccaccatcgaggccgtgaagcggaagatccaggttcttcagcagcaggcagacgatgctgaggagagagcggagcggcttcagcgcgaggtagagggggagcgtcgcgcccgagaacaggccgaagctgaggtggctagtttaaatagacggatacaattggtcgaggaagagttggatcgggcacaggagcggttggcgacagctctccagaaactcgaggaggcagaaaaggccgctgatgaaagcgaacgcggtatgaaagtcatcgagaacagggccctgaaggacgaagagaagatggagttgcaggagattcagctgaaggaagctaagcatatcgccgaggaggcagatcgtaagtatgaggaagtggccagaaagctcgtaataatcgagggggacctagagcggactgaggaacgcgccgaactggccgaatcgaagtgctctgagctggaggaggagctgaaaaacgtgactaacaatctgaagagcctcgaagcccaggcggaaaaatactctcagaaagaagacaaatatgaggaagagattaagattctcaccgacaagttgaaggaggctgaaacaagggccgagttcgcggagcgttctgtggctaagttagagaagactattgatgacctggaagacaagctcaagtgtacgaaagaggagcacctatgcacccagcggatgctggatcagacgctgttagatttgaatgaaatgtag

SEQ ID NO: 209927 - DNA, 675 bp, Artificial Sequence
  Description of Artificial Sequence: Synthetic coding sequence
atggccggcatcaccaccatcgaggccgtgaagcggaagatccaggtgctgcagcagcaggccgacgacgcagaggaaagggccgagaggctgcagcgcgaagtagaaggcgagcgcagggccagagaacagagactggccacggcgttgcagaaactcgaagaggccgagaaggcggcggatgagtccgaaaggggcatgaaggtgatcgaaaaccgtgccctcaaggacgaagagaaaatggaactccaggagatccagttgaaagaggccaagcatatagccgaggaagccgatcgcaagtatgaggaagtggccaggaagttagtgatcatcgagggggacctggaacgaactgaggaaagagcggaattggctgaaagccgctgtagagaaatggacgagcagattagactcatggatcagaacctcaagtgccttagcgccgctgaggaaaagtactcacagaaggaggataaatacgaggaagaaatcaagatactgactgacaagctcaaggaggccgagactagggccgagtttgcggagaggtctgtggcaaagctggaaaagacaatcgatgacctagaggataagctgaaatgtacgaaagaggagcacctttgcacacagcgcatgttagaccagacgctgctagatctcaatgaaatgtag

SEQ ID NO: 209928 - DNA, 858 bp, Artificial Sequence
  Description of Artificial Sequence: Synthetic coding sequence
atgatggaggccatcaagaagaagatgcagatgctgaagctggacaaggagaatgctctggatcgtgcagagcaggcggaggccgagcaaaagcaggctgaggagcgatcaaagcagcttgaggacgaactggcagccatgcagaaaaagctcaaaggcactgaagatgagctcgataaatattcagaagccttgaaggacgcccaagagaagctggaattggctgaaaagaaagccgccgacgcagaggctgaggtcgcctcactgaataggagaattcaactagtcgaggaagaattagaccgggcgcaggagcgactggcgacagcactacagaagttggaggaagccgaaaaggctgcagacgagtccgagagaggtatgaaggtgatcgagaaccgggctctcaaggatgaagagaagatggaacttcaggaaattcagcttaaagaggcaaaacatattgcagaagaagctgaccgcaagtacgaggaggttgccagaaagttagtgatcatcgagggagatctggagaggactgaggagcgagccgagctcgctgagtctaagtgcagtgagctggaggaggaactgaaaaacgtgacgaataacctcaagagcctggaggctcaggcagaaaaatactcccagaaagaagataaatacgaggaggaaatcaagatacttaccgataagctgaaagaggccgaaacgcgagctgagtttgcagagagaagcgtggctaagttggagaaaacaatcgatgatctggaagacgaactctatgcccaaaaattgaagtataaggccatttccgaggagctcgaccacgcactcaacgatatgacatccatttag

SEQ ID NO: 209929 - DNA, 744 bp, Artificial Sequence
  Description of Artificial Sequence: Synthetic coding sequence
atggccggcatcaccaccatcgaggccgtgaagcggaagatccaggttctccagcagcaggcggatgatgccgaagagcgagccgagcgcctgcagcgagaggtcgaaggcgaaaggagagccagagaacaggctgaggccgaagtcgcaagtctgaacagaagaatccaactcgtagaggaggaactcgaccgggcccaggaaagattggcgaccgctcttcagaagttggaggaagccgagaaggctgcagatgagtctgaaagaggcatgaaggttatcgagaatcgtgcactaaaggacgaggaaaaaatggagctgcaagagatacagctgaaggaagccaagcacattgctgaagaagcagacagaaaatatgaggaggttgcacggaaattggtcatcattgagggagacctcgaacgaaccgaggaaagagccgaactcgcggagtcacgatgtagggaaatggacgaacagattagactcatggaccaaaacctgaagtgtctgtccgcggcagaagaaaagtattctcagaaagaagataagtatgaggaagagattaaaatccttaccgataagctgaaagaggcagagaccagagcggaattcgccgagcggtccgtcgctaaattggaaaagaccatcgacgacctggaggagcggctgtacagtcagttggagaggaatcgattgctttccaacgagctaaagctcactctgcacgatctctgtgactag

SEQ ID NO: 209930 - DNA, 747 bp, Artificial Sequence
  Description of Artificial Sequence: Synthetic coding sequence
atggccggcatcaccaccatcgaggccgtgaagcggaagatccaggttctgcagcagcaggccgacgatgctgaggagcgggctgaaagactgcagagagaggtcgagggagaacgcagggcaagggagcaggctgaggccgaagtcgccagcttgaatcggcggatacaattggtggaggaggagctcgatagggcgcaggagaggctcgccaccgcactccagaagctggaggaggccgaaaaagccgccgacgaaagcgagcgagggatgaaggtcatagaaaaccgcgcactgaaagacgaggagaaaatggaattacaggagatccagttgaaagaggctaagcacatcgccgaagaggctgacaggaagtatgaggaagtagcacgcaagctcgtaatcatcgaaggcgatctggaaaggacagaagagcgagcagagttggcagagtcccggtgccgagaaatggatgaacagattcggctgatggatcaaaatctgaagtgcctcagcgcagctgaggaaaagtattcccaaaaggaggacaagtatgaagaggaaatcaagatattaactgacaagctgaaagaggctgagaccagggctgagtttgcagaacgctcggtggctaaactggagaaaacgatagatgacctcgaagataagctaaaatgcacaaaggaagagcacttgtgcactcagcgtatgctggaccagacattgctggaccttaatgagatgtag

SEQ ID NO: 209931 - DNA, 228 bp, Artificial Sequence
  Description of Artificial Sequence: Synthetic coding sequence
atgatggaggccatcaagaagaagatgcagatgctgaagctggacaaggagaatgcccttgaccgcgccgaacaagccgaagctgagcagaaacaggcagaggaaagaagcaagcagcttgaagatgagttagccgctatgcagaagaagctgaaaggcaccgaggacgagctggacaagtacagcgaggccttaaaagatgcccaggaaaagttagaactggcctag

SEQ ID NO: 209932 - DNA, 747 bp, Artificial Sequence
  Description of Artificial Sequence: Synthetic coding sequence
atggccggcctgaacagcctggaggccgtgaagcggaagatccaggctctccaacaacaagctgacgaagcagaggatcgggcccagggcctacagcgggagctcgacggtgagcgggaaaggagagaaaaggccgagggtgatgtggccgctctgaatcgcagaattcagttagtggaagaggagctggaccgggcccaggaaagactggccacagcacttcaaaaactggaagaggctgagaaggccgctgatgaaagtgaaagggggatgaaggtcattgagaacagggcgatgaaggatgaagagaagatggaaattcaggagatgcagctcaaagaagccaaacacattgccgaggaagcggatcgaaagtatgaagaggtcgctagaaagctggtgattttagaaggagagctagagcgggccgaggagcgcgcagaggtaagcgaactgaaatgcggcgacttggaagaagagctcaaaaacgtcaccaataatctgaaatctctggaagccgcctccgagaagtactctgaaaaggaagataaatacgaggaggaaataaagctcctgtccgataaactcaaggaagccgaaacaagggcagagttcgcagaaagaaccgtggcaaaactggaaaaaaccattgatgaccttgaagagaagttggcccaggcaaaggaggagaatgtcggactccatcaaacactggaccagacacttaacgagttaaactgcatctag

SEQ ID NO: 209933 - DNA, 855 bp, Artificial Sequence
  Description of Artificial Sequence: Synthetic coding sequence
atggaggccatcaagaagaagatgcagatgctgaagctggacaaggagaatgccatagatcgagccgaacaggccgaggctgataagaaggctgctgaggacaagtgtaaacaggtggaggaagaactaactcatctccaaaagaagttgaaagggacagaagacgagctggacaagtacagcgaggatctgaaggatgcccaggaaaagctggaactgacagagaagaaggcctctgacgctgaaggggatgtcgcagccctcaacagaagaattcaattagtggaagaggaactcgacagagcgcaggagaggcttgctacagctcttcagaagttggaggaggctgagaaagcggcagatgaatcagaaagagggatgaaagtaattgagaatcgtgcgatgaaagatgaggaaaaaatggagattcaggaaatgcagctgaaagaagctaaacacatcgccgaagaagctgatcgaaaatacgaagaggtggcacgcaagctggtcattcttgaaggggagttggaacgggctgaggaaagagctgaggtgtcagaactgaagtgcggggacttggaggaggagcttaaaaacgtgactaataatctgaagtccctcgaggccgctagtgagaaatatagcgaaaaggaagataagtacgaagaggagatcaaactgcttagcgacaagctaaaggaagccgagaccagggctgaattcgcagaacgtaccgtggctaaattggagaagacaatcgatgacctcgaagagaaattggcccaggcgaaggaagaaaatgtaggccttcatcagacattagatcagaccctaaacgagctgaactgcatctag

SEQ ID NO: 209934 - DNA, 855 bp, Artificial Sequence
  Description of Artificial Sequence: Synthetic coding sequence
atggaggccatcaagaagaagatgcagatgctgaagctggacaaggagaacgccatagatagggccgagcaggcggaggccgataaaaaggccgctgaggataaatgtaagcaggtggaggaggagcttactcacctgcagaagaagctcaagggcacagaagatgaactcgataaatatagtgaggacctgaaggacgcacaggagaagctcgaactgaccgagaaaaaagcctctgacgctgaaggagacgtcgcggcacttaaccgccggattcagctggtggaggaggaactcgaccgagctcaggaacggcttgccaccgcactgcagaaactggaggaggctgaaaaggctgctgatgagtctgagagaggaatgaaagtaatcgaaaatcgtgcaatgaaggacgaagaaaagatggagatccaagagatgcagctcaaagaagccaaacacatagccgaagaggcagatcgcaaatatgaggaggtagcccgtaaactcgtcatcctcgagggcgagcttgagagagctgaggaacgcgccgaggttagcgaattaaaatgcggcgatttagaggaggaactgaagaatgtcactaataacttaaaatccttggaagcagcctctgagaaatatagtgagaaagaagacaagtacgaggaggaaatcaagctgctgtctgacaaactgaaggaggctgaaacgagggccgaattcgctgaacgcacagtagcaaaattagagaagactatcgatgaccttgaagagaagttggcccaggcaaaggaagaaaacgttggtctgcaccagacccttgaccagactctgaatgaattgaattgcatttag

SEQ ID NO: 209935 - DNA, 2244 bp, Artificial Sequence
  Description of Artificial Sequence: Synthetic coding sequence
atgggccggctgaacgagcagcggctgttccagcccgacctgtgcgatgtggacttggtcctcgtcccgcagagaagcgtgtttcccgctcataagggcgtgctggctgcttattctcagttctttcattctctctttacccaaaataagcagctacagcgagtggaactgagcctggaagccctcgcaccaggagggctgcagcagattctgaatttcatctatacatctaagcttctggtgaacgccgctaatgtgcatgaagtgttgtccgccgcctccctgctccagatggcagacattgctgcctcttgtcaggagctactcgacgccagatcgttggggccaccagggcctggtacagtggcacttgcacagcccgcggcctcatgtacccctgcagcacctccttactactgcgatatcaaacaggaagctgatactccaggcctaccaaaaatctatgctcgtgaaggcccagacccatactctgtacgagtcgaagatggagctggcacagccggcgggacagtgcccgctaccatcgggcccgcccagccattctttaaagaggaaaaagagggaggggttgaagaagcaggcggccctcctgcttcgctctgtaaactggaaggtggagaagagctggaggaggagctaggcgggtccggcacatacagtcgccgcgaacagtctcagattatagtggaagttaatctcaacaatcaaacccttcacgtttccacagggcctgagggcaaaccaggcgcgggaccatcacctgccactgtcgttctgggtcgggaggatggactccaacgacactctgatgaagaggaggaggatgacgaagaggaagaggaggaggaagaggaggaggagggtggaggctccggcagggaagaggaggaggaagaagagggcgggtcccagggtgaagaggaggaggaagaagaggacgggcacagcgaacaagaggaggaagaagaggaggaagaagaagaaggtccatctgaacaggaccaggagtccagtgaagaggaggagggcgaagaaggagaagccgggggaaagcagggacctcgggggagcaggagttcaagagccgacccgccaccgcacagccacatggctactcgttctcgagaaaatgctcggagaagaggcacacctgagcccgaagaagccgggcgcagggggggcaagcggcctaagcctcctccgggcgtcgctagtgcctccgctcgtggcccacctgcaaccgacggacttggggcaaaggtgaaactggaagaaaaacaacatcacccatgccaaaagtgtccaagagtgttcaacaataggtggtatctcgagaagcatatgaacgtgacgcatagtaggatgcagatttgcgaccagtgtggcaaacgtttcttactcgagtccgagcttctgcttcatcgccaaactgactgtgagagaaatattcagtgtgttacatgtggtaaagcttttaagaaactgtggtccttacatgaacacaataagatcgtgcatggctacgcagaaaagaaatttagctgcgaaatctgtgaaaaaaagttctatactatggctcacgtgaggaaacatatggtggctcatacaaaagatatgccttttacctgcgagacatgcggtaagtcgttcaaacgtagcatgagcctaaaagtgcattcactccagcactcgggggagaaacccttccggtgcgagaattgcaacgagaggtttcagtataaataccaattgaggtctcatatgagcatccacatcggccataaacagtttatgtgccagtggtgcggaaaagacttcaacatgaagcaatactttgatgagcacatgaaaacccatactggagaaaaaccctacatatgcgagatctgtggcaaatctttcacatctcgacccaatatgaagcggcaccgccggactcacacaggcgagaaaccctatccgtgcgacgtttgtggacagcgcttccgttttagtaatatgttaaaggcccataaagaaaagtgttttcgcgtgtctcataccctggctggggacggcgtccccgctgcaccgggtttgccccctacgcaacctcaggcacacgctcttcctctgttaccagggcttccacagactttgcctccacctcctcacctgcccccaccccctccgctgttccctacaaccgccagcccaggaggtcggatgaacgctaacaactag

SEQ ID NO: 209936 - DNA, 483 bp, Artificial Sequence
  Description of Artificial Sequence: Synthetic coding sequence
atgaccgaccagcaggccgaggcccggagctacctgagcgaggagatgattgcagagttcaaagcggctttcgacatgttcgatgctgatgggggaggggacatttctgtgaaggagctggggacagtgatgaggatgcttggacagaccccaactaaggaagagctagatgcaattattgaggaggtggacgaggacggatctggcaccatcgatttcgaagaatttctggttatgatggtacgacagatgaaagaagatgctaaggggaagtccgaggaagagctggcggagtgtttccgaatttttgacaggaatgccgacggctacatcgatcccgaagaactggctgagatcttccgtgctagtggagagcacgtgaccgatgaagaaattgaatccttgatgaaggatggtgacaagaacaatgatggacgtatcgacttcgatgagtttctcaaaatgatggaaggggtgcagtag

SEQ ID NO: 209937 - DNA, 438 bp, Artificial Sequence
  Description of Artificial Sequence: Synthetic coding sequence
atgatcgccgagttcaaggccgccttcgacatgttcgacgccgacggaggcggtgatatctctgttaaagagcttggtaccgtcatgcggatgctgggccagactcctacaaaggaggagctggatgccataatcgaggaggttgacgaggacggaagtggaaccattgactttgaagagttcctcgtcatgatggtaaggcaaatgaaagaagatgccaaggggaaaagcgaagaagaattggccgagtgcttcagaatatttgacaggaatgccgatgggtatatcgaccctgaggaattggccgagatcttcagggccagtggggagcacgtcacagatgaagagatcgaaagccttatgaaagatggggataagaacaatgacggcaggattgacttcgatgagttcctaaaaatgatggaaggcgtacagtag

SEQ ID NO: 209938 - DNA, 564 bp, Artificial Sequence
  Description of Artificial Sequence: Synthetic coding sequence
atgcccgaggtggagcggaagcccaagatcaccgccagccggaagctccttctgaagtcactgatgttggccaaagctaaagaatgctgggagcaggagcacgaggagcgtgaggctgaaaaagttaggtatctagccgaacgcattccaacactccagacccgcggtctgagcctttctgctctccaggatttgtgtcgggagcttcacgcgaaagtcgaggttgtggatgaggaaagatatgacatagaggctaagtgcctgcacaatacgcgggagattaaggacttgaagttgaaggttatggacctgagaggaaaattcaaacggccacctctgcgtcgggtgagagtgtcagccgatgcgatgctcagagccctacttggttcgaaacataaggtcagcatggaccttagggcgaacctgaagagtgtcaagaaggaagacacagagaaagagagacccgtcgaagtgggcgactggcgaaagaacgtcgaggctatgagtggaatggaaggccgcaagaagatgtttgatgccgccaaatctcctactagccagtag

SEQ ID NO: 209939 - DNA, 564 bp, Artificial Sequence
  Description of Artificial Sequence: Synthetic coding sequence
atgcccgaggtgcagcggaagcccaagatcaccgccagccggaagcttcttctgaaatcgctgatgcttgccaaggcgaaggagtgctgggagcaggagcatgaggaaagagaggctgaaaaggtgaggtacctagccgagcggatccctaccctgcagacacggggacttagcctgagtgcccttcaggacctctgtcgggaactgcacgcaaaggtggaggtggtggacgaagaacgatacgacatcgaggctaaatgcctgcacaatacacgcgaaataaaagacctgaaactgaaggtcatggacttgagaggcaagtttaagcgaccaccactgagaagagtgagggtttcagccgacgccatgctccgggctttgttaggaagcaaacataaggtgagcatggatttaagggccaacctcaaatcagtgaagaaagaggacaccgagaaggagcggcctgttgaggtgggagattggcgcaagaatgtggaggccatgagtggcatggaaggacggaaaaaaatgttcgatgctgcaaaaagccccacgagccagtag

SEQ ID NO: 209940 - DNA, 564 bp, Artificial Sequence
  Description of Artificial Sequence: Synthetic coding sequence
atgcccgaggtggagcggaagcccaagatcaccgccagccggaagctgcttttgaagtccctgatgttggccaaagccaaggagtgctgggaacaagaacatgaggagagagaagccgagaaagtaaggtacttggctgagcggattccaactttacagactcgcggcctatctctctctgcccttcaggacctctgccgggaactgcacgctaaagtggaggtggtggatgaggagaggtacgatatagaggctaagtgtctgcataatactagggaaatcaaggacctgaagttgaaggttatggacctccgcgggaagttcaaaagaccacctctgaggcgtgtccgtgtaagcgctgacgcaatgctcagggcacttctcggttccaagcataaagtttctatggacctgagagctaatctcaaaagtgtgaaaaaggaggataccgagaaagagcgtccagtggaggtgggcgattggagaaagaatgtggaggccatgtcagggatggaggggcgcaagaagatgttcgatgcggctaaatccccaacttcacagtag

SEQ ID NO: 209941 - DNA, 564 bp, Artificial Sequence
  Description of Artificial Sequence: Synthetic coding sequence
atgcccgaggtggagcggaagcccaagatcaccgccagccggaagctcctgttaaagtctctgatgcttgctaaggcaaaagagtgttgggaacaagaacacgaggagcgggaggctgaaaaggttcggtatctggctgagaggatccctaccttgcaaacaaggggattaagcttaagcgccctgcaagatttgtgccgggaactgcatgccaaggtggaagtggttgacgaagagagatacgacattgaagccaaatgtctgcacaatacccgtgagattaaggatttgaaactgaaagttatggatctgcgcgggaaatttaagcggccccccctgaggagggtaagggttagcgcggacgcgatgttgagggcactgctcggatccaagcacaaggtcagcatggacctccgggcaaacctcaaatccgtgaagaaggaggataccgaaaaggagcgtcctgttgaagtgggtgattggcgtaagaacgtagaggcaatgtccggtatggagggtcgcaagaagatgtttgatgctgccaaatccccaacttcccaatag

SEQ ID NO: 209942 - DNA, 564 bp, Artificial Sequence
  Description of Artificial Sequence: Synthetic coding sequence
atgcccgaggtgcagcggaagcccaagatcaccgccagccggaagttgctgttgaaatccctcatgttggctaaggctaaggagtgctgggaacaagaacacgaggagagggaggctgaaaaagtgcgctacctggccgaacgcatcccgactcttcagacccgcggtctgtcactgtctgctttgcaggacctgtgtcgggagctgcatgccaaggtggaggttgtcgacgaagagcgatacgatatcgaagcgaagtgtttacacaacacgcgggagattaaagatttgaaacttaaagttatggatctgagagggaagttcaaaagaccgcctctgcgtagagttcgtgtgtccgccgatgctatgctacgcgctttactcgggagcaagcacaaggtatccatggatctgcgggccaacttgaagtccgtgaagaaggaagacacagagaaggagagaccggttgaagtcggcgactggcgaaagaatgtcgaggccatgtctgggatggaaggtcgaaagaagatgttcgatgcggcgaaatcgcctacatctcaatag

SEQ ID NO: 209943 - DNA, 414 bp, Artificial Sequence
  Description of Artificial Sequence: Synthetic coding sequence
atgcccgaggtggagcggaagcccaagatcaccgccagccggaagctgttgctaaagagtctgatgctcgctaaggcgaaggaatgttgggagcaggagcacgaggagcgggaggccgaaaaggtgaggtacttggcagaaaggattcccactctgcagaccagaggcttgtctctctctgcgctccaggacttatgccgggagctgcatgccaaagttgaggtggtagacgaggaaaggtatgatattgaggctaaatgcctccacaacacaagagagattaaggatcttaagttgaaggtcatggatctcaggggaaaatttaaacggccgcccttgcgccgagttagagtgagcgctgacgcaatgcttagggcgctgcttggctctaagcacaaggtgtccatggactag

SEQ ID NO: 209944 - DNA, 549 bp, Artificial Sequence
  Description of Artificial Sequence: Synthetic coding sequence
atgagccagtgcaagaagcggaaccgggccatcaccgcccggcggcaacatcttaaaagtgtaatgttacagatcgcagccaccgagctcgagaaggaggagagcaggcgggaggccgagaaacaaaattatcttgccgaacactgtcccccgctccacatccctggcagcatgtccgaggtgcaagaactgtgcaaacagctgcatgcaaagatcgatgccgcggaagaagagaaatacgacatggaggttcgcgttcagaagacgagtaaagagctagaagacatgaaccagaagctttttgacttgcgggggaagtttaagagaccaccgctgcggagggtccgaatgtcagcggacgctatgcttaaagcgctgttgggatctaagcacaaagtttgcatggacctgagggccaatctaaaacaagtcaagaaggaggataccgaaaaagaaagggacctcagggacgtcggagattggagaaaaaatattgaggagaagtctggtatggagggccgtaaaaaaatgtttgaatcagagtcctag

SEQ ID NO: 209945 - DNA, 549 bp, Artificial Sequence
  Description of Artificial Sequence: Synthetic coding sequence
atgggcgacgaggagaagcggaaccgggccatcaccgcccggcggcagcatcttaagtcagtgatgctccagattgctgccactgagttggaaaaagaggaaagcagacgggaggcggaaaaacaaaattacctggcagagcattgtccacctttgcacatcccgggaagtatgagcgaagtccaagagctctgtaagcagctgcacgccaaaatcgacgctgccgaagaagagaagtacgacatggaggttcgagttcagaagacctcgaaagagttggaagatatgaatcaaaagttgttcgatttgaggggtaagttcaagaggccccctctacggagagttcgaatgtctgctgatgcaatgttaaaagcgctcttggggtctaagcataaagtatgtatggatttgcgggcaaacctaaagcaggtcaagaaagaggacaccgagaaggagagggatctgcgggacgtcggcgattggagaaaaaatatagaagaaaagagcggtatggaagggagaaaaaaaatgttcgagtccgagtcatag

SEQ ID NO: 209946 - DNA, 549 bp, Artificial Sequence
  Description of Artificial Sequence: Synthetic coding sequence
atgggcgacgaggagaagcggaaccgggccatcaccgcccggcggcagcatttaaaatcggtcatgctccagatcgctgctaccgagctcgaaaaggaggaaagtcgcagggaggcagagaagcaaaattacctggccgaacactgtcccccactccatattccagggagtatgtccgaggtgcaagagttgtgcaagcagttacacgctaaaatagacgctgccgaggaggagaagtatgatatggaggttcgcgttcagaagaccagcaaagaactggaagacatgaaccagaagctcttcgacctcagaggcaaattcaaaaggccccccctgaggcgggttcgtatgtctgctgacgcgatgttaaaagcactcttgggcagtaagcataaagtgtgtatggatttgagggctaatctgaaacaggtcaagaaggaggatacagagaaggaaagagacctccgtgacgtcggcgattggcggaagaatatcgaggaaaagagtggcatggagggtaggaaaaagatgtttgagagtgagtcctag

SEQ ID NO: 209947 - DNA, 549 bp, Artificial Sequence
  Description of Artificial Sequence: Synthetic coding sequence
atgggcgacgaggagaagcggaaccgggccatcaccgcccggcggcagcacttaaagtcagtcatgcttcagattgcggcaacagaacttgaaaaagaggaatcccggagggaagccgagaaacagaattacctcgctgagcattgtccgccgctgcacattccaggcagtatgtcagaggtgcaagaactatgcaagcagctgcatgcaaaaatcgatgccgccgaggaggaaaaatatgacatggaggtgcgggtgcagaagacctctaaagaactagaggatatgaatcagaagttgtttgatctccggggaaagttcaaacggcctcccctgaggcgggtgagaatgagcgccgacgcgatgttgaaggctttgctgggctccaaacataaggtttgtatggacctgcgggcgaatttgaagcaggtgaaaaaagaagataccgagaaagaacgtgacctcagggacgtcggggattggcgcaaaaatatcgaagaaaaatccggcatggaaggaagaaagaagatgttcgagagcgaatcctag

SEQ ID NO: 209948 - DNA, 633 bp, Artificial Sequence
  Description of Artificial Sequence: Synthetic coding sequence
atggccgacggcagcagcgacgccgcccgggagccccggcccgcccccgcccccatcagacggaggagtagcaattaccgagcttacgctaccgagccacacgctaaaaagaagagtaagatctctgcctctaggaagcttcagctcaaaactctgttgctacaaatcgctaagcaggagctggagcgagaggccgaagagcgtcggggtgagaaggggcgagcactctctacaagatgccagccactcgagctagcaggacttggatttgccgagcttcaggacctgtgcagacagcttcatgccagagtggataaagttgacgaggaacgatatgacattgaggctaaggtgacgaaaaatattactgaaatcgcagacttgactcaaaagattttcgatcttcggggaaagttcaagcgtccaacattgcgtcgagttaggatttccgccgatgcaatgatgcaggctttactgggggcaagggcaaaagaaagtctggatttgagggctcacctaaagcaggtgaaaaaggaggacacagaaaaggaaaaccgggaggtgggcgattggaggaaaaatattgacgcattatctggcatggaaggccgcaaaaaaaaatttgaatcttag

SEQ ID NO: 209949 - DNA, 837 bp, Artificial Sequence
  Description of Artificial Sequence: Synthetic coding sequence
atgagcgacaccgaggagcaggagtacgaggaggagcagcccgaggaagaggctgccgaggaggaagaggaagcccctgaggagccagaaccagttgctgaacctgaggaagagcggccaaaaccctcccgcccagtcgtgccgccacttatccctcccaagattcccgagggagaacgagtagattttgacgatattcacagaaaacgaatggagaaggatctgttagagttgcaaaccctcatcgacgttcacttcgagcagcgtaaaaaggaagaggaggagctggtggctctcaaagagaggatcgaacgtcgaaggagcgagcgcgcagagcagcagaggttccgcacggaaaaggagcgcgaacggcaggcgaagttagctgaagaaaagatgcgcaaagaagaggaggaggccaagaagcgggctgaggatgacgctaaaaagaagaaagtactctctaacatgggagcgcatttcggaggatacctggttaaagctgaacagaagcggggaaagcggcagaccggccgtgagatgaaggtaagaatcttgagtgagaggaagaaacctctcgacattgattacatgggtgaggagcaactgagagccagatctgcctggctacctccatctcagccatcctgccctgcccgggagaaggcccaggagctgtccgattggattcatcaattggagtctgagaaattcgacttgatggcaaagttgaaacagcagaagtacgagataaacgtcctgtacaacaggatatcgcacgcacagaaatttaggaagggggctggcaaaggacgggtgggggggcggtggaaatag

SEQ ID NO: 209950 - DNA, 837 bp, Artificial Sequence
  Description of Artificial Sequence: Synthetic coding sequence
atgagcgacaccgaggagcaggagtacgaggaggagcagcccgaggaagaggccgccgaggaggaggaggaggccccagaggaacccgagcccgtggccgagcccgaagaggaacggcctaaaccctcacgacccgtagtgccgcctcttattcctcctaaaatcccagaaggggaaagagtggactttgatgatatccacagaaagcgaatggaaaaagatctgttggaattacagactctgatcgacgtgcacttcgagcagcgtaagaaagaagaggaagaactggtagcccttaaagagcggatagaaagaagacgctccgaaagagccgaacaacagcggttcaggacagaaaaggagagagaacgccaagctaagttggctgaggagaaaatgcgtaaagaagaagaggaggccaagaagagggccgaggacgacgccaagaaaaagaaagtcttaagtaatatgggcgctcacttcggcggatatctggtgaaagccgagcagaaaaggggcaagcgacagactgggagggaaatgaaagtgcggattctcagcgaacgtaaaaaaccactggacattgactatatgggcgaggaacagctccgtgcacgttctgcctggctcccaccctcgcagcccagttgccccgctcgagaaaaagcacaagagctctcggactggatacatcagctggagtccgagaagtttgatctcatggcaaaactcaaacagcagaaatacgagatcaacgtgttgtacaaccgcatctcccacgcgcagaagtttcgtaagggggctggtaaaggaagggtcggggggcgctggaagtag

SEQ ID NO: 209951 - DNA, 756 bp, Artificial Sequence
  Description of Artificial Sequence: Synthetic coding sequence
atgagcgacaccgaggagcaggagtacgaggaggagcagcccgaggaggaggcagcagaggaggaagaagaggaggaggagagacctaaaccctcgcgcccagtggtccctcctctcatcccgcccaagatcccagagggagaacgcgtcgacttcgacgatatccacagaaaaaggatggaaaaggatctgctggagctgcaaactctgatagacgtgcacttcgagcaaagaaaaaaggaagaagaggaactggtcgcattaaaggagcggatcgagagaaggcgttcggaacgcgcagagcaacagcggtttcgtaccgagaaggaacgcgagagacaagctaagttggccgaagaaaagatgcgcaaggaagaagaggaggcaaaaaaacgggctgaggatgacgccaagaagaagaaggtcctgtctaacatgggagcacacttcgggggatacctggtgaaggcagagcagaaacgcggcaaaagacagactggtagggaaatgaaggtgcggatcctgagtgaaaggaaaaagcccctcgatatagactacatgggggaggaacagctgagggagaaagcccaagagctgagtgactggatccaccagctagagtctgagaagtttgatctgatggccaaactcaagcagcagaagtacgagatcaatgtgctgtacaacagaataagtcacgcccagaaatttcgaaagggcgctggcaagggccgagttggagggcgatggaagtag

SEQ ID NO: 209952 - DNA, 522 bp, Artificial Sequence
  Description of Artificial Sequence: Synthetic coding sequence
agcaaggcccagccccaggacagccagcacctgcggcacagcctggggcggacgaggatgtcggacacagaagagcaggaatatgaagaggagcagcctgaggaagaagccgccgaagaagaggaggaaggggaggtgcctgatagcgcggaagaggagcgacctaaaccctcgcgacctgtcgtgcctcccctcatcccccccaaaatcccagagggtgagagagtcgattttgacgacatccatcggaagaggatggaaaaggaccttcttgagcttcagaccctgatcgacgttcattttgagcagagaaagaaggaagaagaagagctggtggccctaaaggaaagaatcgaacggaggcgcagtgaaagagctgagcagcagaggttccgcacagagaaggagcgagaacggcaggccaagctcgcagaagagaagatgcgaaaggaggaggaggaggccaagaagagagccgaggacgatgcaaagaaaaagaaaaaaaaaaaaaaaaaaaagtag

SEQ ID NO: 209953 - DNA, 756 bp, Artificial Sequence
  Description of Artificial Sequence: Synthetic coding sequence
atgagcgacaccgaggagcaggagtacgaggaggagcagcccgaggaggaagcggccgaggaagaggaggaagctcccgaagagcccgaacccgtgagaccagtggtgcctcccttgattccgcctaaaatccctgagggggagcgcgtggactttgacgacatccacagaaagagaatggagaaggatctactagagctacagacactaatagatgtccattttgaacaacgcaaaaaagaggaggaagaactggtggctttaaaggaaagaattgagagaaggcgatctgagagagcagagcagcagcggttccgcaccgagaaggaacgcgagcggcaggctaagcttgcggaggaaaaaatgcggaaggaggaggaagaggctaaaaagagggctgaggatgacgctaaaaaaaagaaggtgctaagcaatatgggagctcatttcgggggttatctggttaaagctgaacagaaaagggggaagcgccagactgggagagagatgaaggtgagaattctctcagaaaggaaaaaaccactggatatcgactatatgggagaggaacagctccgggagaaggcccaggaactctctgactggattcaccagctggaatcggaaaagttcgatctgatggcaaagcttaaacagcaaaaatatgaaattaatgttctgtacaatcgaatcagccatgctcagaagttccgcaagggtgctggcaagggccgagtcggagggcggtggaaatag

SEQ ID NO: 209954 - DNA, 579 bp, Artificial Sequence
  Description of Artificial Sequence: Synthetic coding sequence
atggagaaggacctgctggagctgcagaccctgatcgacgtgcactttgagcaaaggaagaaggaggaagaggaactcgtggctctcaaagagcggatcgagaggagacggtctgagcgggctgagcagcagaggtttcgcacggagaaggagagagaacgccaggctaaactggctgaggaaaagatgaggaaagaggaggaagaggccaaaaaaagggccgaggacgacgccaagaagaagaaggtgctgtcaaatatgggagcacactttgggggttatctggttaaagccgagcagaaaaggggcaaacggcaaacggggcgcgagatgaaagtgagaatcttaagtgaacgcaagaaaccgttagacattgactacatgggtgaggagcagctccgggaaaaagcacaggagctatcagattggattcatcagctggaatcggaaaaatttgacctgatggccaagctgaagcagcagaaatacgagataaacgttttgtacaaccgcatcagtcacgcccaaaagttccgcaagggagcaggtaaagggcgcgtaggcggacgctggaagtag

SEQ ID NO: 209955 - DNA, 882 bp, Artificial Sequence
  Description of Artificial Sequence: Synthetic coding sequence
atgagcgacatcgaggaggtggtggaggagtacgaggaggagcaccctgaggaggaagaagattggcgagaagacgaggatgaacaagaagaggccgccgaagaagacgccgaagccgaggcggagaccgaagagacacgggctgaagaggacgaagaggaggaagaagcgaaggaagccgaggacgggccaatggaagaatccaaacccaaaccgcgtagctttatgccgaacctggtgccgccaaagattccggatggggagagggtggactttgacgatatccatcgcaagaggatggagaaggacttaaacgaactgcaggcgttaattgaagctcacttcgagaaccggaagaaggaggaagaggaactcgtgagcctgaaggaccgcatagagcggcgacgcgctgaacgagccgaacagcaaaggattagaaacgagagggaaaaggagagacagaatcgactggccgaagagagggcccgtcgagaagaggaagagaatcggcgcaaagctgaggatgaagcccgcaaaaagaaagcactcagtaacatgatgcattttgggggctatatccaaaagcaagcccagaccgagaggaagtccggaaaacggcaaactgaacgtgaaaaaaagaagaagatattggcggagcgtagaaaggtgcttgcgatcgatcatttaaatgaagaccagctgcgggagaaggcaaaggagctctggcagtcaatctacaacctggaagcagagaagttcgatctccaggagaagttcaaacagcaaaaatacgaaattaatgtgttgcgcaaccgaatcaacgataatcagaaggtcagcaagacacgtggcaaagccaaggtcacggggcggtggaaatag

SEQ ID NO: 209956 - DNA, 600 bp, Artificial Sequence
  Description of Artificial Sequence: Synthetic coding sequence
atgagcgacatcgaggaggtggtggaggagtacgaggaggagatggctgccccacagcatcaggaggaggcagccgaggaggatgcggaagcagaggccgagactgaagagacacgagcagaggacgaagaagaggaagaagccaaagaagcagaggacgggccgatggaagagtccaagcccaaacctaggtcatttatgccaaacttagttccccctaaaatacctgacggggaaagagtcgacttcgacgacattcatcggaagcggatggaaaaggatctgaacgaactgcaggcgctgatcgaggctcactttgagaatagaaagaaagaggaagaggagctggtgagcctaaaggaccggattgagaggcgcagggcagagcgcgccgaacagcagcggatccggaatgagcgcgaaaaggaaagacagaaccgtctggcggaggaacgcgctagacgtgaggaggaggaaaatagaagaaaagccgaggatgaagccaggaagaaaaaagccttgtcaaatatgatgcactttggagggtatattcaaaagcatcctcccgacagagccgagaaatgggaggaagccgactag

SEQ ID NO: 209957 - DNA, 852 bp, Artificial Sequence
  Description of Artificial Sequence: Synthetic coding sequence
atgagcgacatcgaggaggtggtggaggagtacgaggaggaggccaagctggagcaagaggaggccgccgaggaggatgcagaggctgaggccgaaacagaagaaacccgggcagaagaggacgaggaggaagaagaggctaaagaggccgaggacgggccaatggaagagtctaaacctaaaccacgcagcttcatgccgaacttagtacctcctaagatacctgatggagaacgggttgatttcgatgacatccaccgcaagagaatggagaaggaccttaacgagctgcaggctctgatcgaagctcacttcgaaaatcgaaagaaggaggaagaggagttagtgtcactgaaagataggattgaacggcggcgggcagaacgagctgaacagcagcggataaggaacgaacgcgagaaagaacggcagaacaggcttgcagaggaacgggcgaggcgagaggaagaggagaaccgaaggaaggccgaagacgaagccaggaaaaaaaaagccctctcaaacatgatgcattttggcggatatatccagaagcaggcacagactgagaggaagagcggtaagcggcagaccgagagggagaagaagaaaaagatcctggcagagcgaagaaaagtgctggcaatcgaccacctgaacgaggatcagctgagggagaaagcaaaagagctgtggcagtccatctataacctcgaagcagaaaagttcgacctgcaggagaaatttaaacaacagaagtacgagatcaacgtccttcggaatcgaataaacgacaaccagaaagtgtccaaaacaaggggcaaagctaaagttactgggcgctggaaatag

SEQ ID NO: 209958 - DNA, 858 bp, Artificial Sequence
  Description of Artificial Sequence: Synthetic coding sequence
atgagcgacatcgaggaggtggtggaggagtacgaggaggaggagcaggaggaagcagccgtcgaagagcaggaagaggctgctgaagaagatgccgaagctgaagccgaaaccgaggagacacgagcagaggaggatgaggaagaggaggaagccaaggaggcagaagatggcccaatggaggaaagtaaacccaagccccgtagcttcatgccaaatctggtgcccccaaagatcccagatggggagcgcgtcgacttcgacgacatacaccgaaagcgcatggaaaaggacctcaacgaactgcaagcactaattgaagcgcattttgagaaccgcaaaaaggaggaagaagagctggtcagtcttaaggacagaatcgaacggagacgagccgagcgcgccgagcagcaacgtatcaggaatgagcgcgaaaaagagagacaaaaccggcttgccgaagaacgcgctagaagagaggaggaggaaaatcgccgcaaagccgaagatgaagcacgcaagaagaaggcactcagcaacatgatgcattttggcggctacattcagaaaaccgagcggaagtccggcaaaagacagaccgagagggagaagaaaaaaaagatcttggccgagcgtaggaaggtgctggcaatcgatcacctgaatgaggatcagctccgagaaaaggccaaagaactatggcagagtatttacaatctcgaggcagagaagtttgacctgcaggaaaagttcaagcagcagaaatacgagatcaatgtgctgagaaatcggatcaacgataaccagaaagttagcaaaaccagggggaaagccaaggtgacggggcggtggaagtag

SEQ ID NO: 209959 - DNA, 867 bp, Artificial Sequence
  Description of Artificial Sequence: Synthetic coding sequence
atgagcgacatcgaggaggtggtggaggagtacgaggaggaggagcaggaagaggcagccgtggaggaacaggaggaggccgctgaagaggacgcggaggccgaagcagaaactgaagagacccgcgccgaagaagacgaggaagaagaggaggcaaaggaggcggaggacggcccaatggaggaatccaagcccaaacccagatcatttatgcccaacctggtccctccaaagatccccgacggagaaagggtcgatttcgacgatatccaccgcaagagaatggaaaaggacttaaacgaattgcaggccctgattgaggcccactttgaaaacagaaagaaggaagaagaggaactcgtgtcgttgaaagatcgaatcgagaggcggcgggctgagagagcagagcagcaaaggattcggaacgaaagagaaaaggagagacaaaaccgccttgccgaggaaagggcccggagagaggaggaagagaaccgcagaaaagcagaggacgaggctaggaaaaagaaggccctctcgaatatgatgcattttggaggctatattcagaagcaagcacagaccgagagaaagtctggaaagagacagactgaaagagagaagaaaaaaaagatactagctgaacggcgtaaagtgctggccatagaccacttaaacgaggatcagttacgggaaaaggccaaggaattgtggcagtcgatttacaacctggaagcagaaaagttcgacttgcaggagaaattcaaacagcagaagtacgaaattaatgtgctgagaaatcgcattaacgacaaccagaaggtgtccaagactaggggaaaggctaaagtcaccggaaggtggaaatag

SEQ ID NO: 209960 - DNA, 867 bp, Artificial Sequence
  Description of Artificial Sequence: Synthetic coding sequence
atgagcgacatcgaggaggtggtggaggagtacgaggaggaggagcaggaggaagcggccgtagaagaacaggaagaagcagccgaagaagacgccgaggccgaggctgaaaccgaggaaacgcgtgccgaggaggacgaggaagaagaagaagccaaggaggccgaggacggccccatggaagaaagtaaacccaaaccacgatcattcatgcccaaccttgtgccgccaaaaattcctgacggtgagcgtgtcgatttcgacgatatccaccgaaaaaggatggagaaggatctcaacgaactccaggccttgattgaagcgcacttcgagaaccgtaaaaaagaagaggaggaactggtctcactcaaagacagaattgaaaggcggcgggcagagcgcgccgaacagcagagaatcagaaatgagagagaaaaggagaggcagaacaggttagctgaggagagagccagacgagaggaagaagagaataggcgcaaggccgaggacgaagctcggaagaaaaaggcgctgtcaaatatgatgcacttcggagggtatatccagaagcaggcccagactgagcgaaagagcggtaagagacagacggagagagagaagaagaagaagatcctagcagagaggcgcaaggtgctcgccatcgaccacttgaacgaagaccaactgcgagagaaagcaaaagagttgtggcagtccatctataatctcgaagcggagaaatttgacctccaagaaaaatttaaacagcaaaagtacgagatcaatgttctccggaatcggatcaatgataaccagaaggtgtccaaaacacgcggtaaggcaaaggtgactgggagatggaagtag

SEQ ID NO: 209961 - DNA, 681 bp, Artificial Sequence
  Description of Artificial Sequence: Synthetic coding sequence
atggaggagagcaagcccaagccccggagcttcatgcccaacctggtccctccaaagatcccggatggcgaacgggttgattttgatgacatccaccggaagaggatggaaaaagacctgaatgagctgcaggctctgattgaagcccactttgaaaataggaagaaggaagaagaggagctggttagcctaaaagatcgaatcgaaaggagacgagcagagcgcgctgagcaacaacgcattaggaatgaacgcgagaaagagcgccagaaccgcctggccgaagaacgggcgagacgtgaagaggaggagaatcggaggaaagccgaggatgaggccagaaagaaaaaggcactctccaacatgatgcactttggtggctacattcagaaaacagagcggaagagtggaaagcggcaaacagagcgggagaagaagaagaagatcttggccgagcgacgcaaggtgctggcgatcgaccatcttaatgaggatcaacttcgcgagaaagctaaagagttatggcagagtatctacaaccttgaagcagaaaagttcgacctacaggagaaattcaaacagcaaaaatacgagatcaacgtgctgcggaatcgcattaatgataaccaaaaagtgtcaaaaaccaggggcaaagcaaaagtgacagggcggtggaaatag

SEQ ID NO: 209962 - DNA, 858 bp, Artificial Sequence
  Description of Artificial Sequence: Synthetic coding sequence
atgagcgacatcgaggaggtggtggaggagtacgaggaggaggagcaagaagaagctgcagtcgaagagcaggaagaggccgccgaggaagacgccgaggccgaggccgaaacagaggaaaccagggctgaggaggacgaggaggaagaggaagcaaaggaggcggaagatggaccgatggaggaatcaaagccgaaacctcggtcttttatgcccaacctcgtgcctccaaagatccccgatggagaaagagtggacttcgacgatatccaccgcaagagaatggagaaggatctcaacgagctgcaggcgttgattgaagcccacttcgaaaaccggaaaaaggaggaagaggagctggtgtccttgaaagaccgcatagagaggagaagggcagaacgagctgaacaacaacgcatacgcaatgagcgtgaaaaagaacgccaaaaccggctggcggaggagcgcgcccgacgagaagaagaggagaatagaagaaaagccgaagacgaagcccgcaagaaaaaggctctgagtaacatgatgcatttcgggggctatatccagaagaccgagaggaagagtggtaaacggcaaaccgaaagagaaaagaagaagaaaatactagcggagagaagaaaagttctggctatcgaccacttgaatgaggaccagctcagagagaaggcaaaggaactttggcagagtatatacaaccttgaggcagagaaattcgacctgcaggaaaaattcaagcagcagaaatatgaaattaacgtgcttcggaatcgcataaacgacaatcagaaagtctccaaaacacggggcaaagccaaggtgactgggcggtggaaatag

SEQ ID NO: 209963 - DNA, 876 bp, Artificial Sequence
  Description of Artificial Sequence: Synthetic coding sequence
atgagcgacatcgaggaggtggtggaggagtacgaggaggagtacttagagcacgctgaagccgccgtcgaagagcaggaggaggctgcagaagaagacgctgaggcagaggcagaaactgaggagacaagggccgaagaagacgaggaagaagaggaggctaaggaagccgaagatgggcccatggaagagtcaaaacccaaaccccgctccttcatgccgaatttggtaccgccaaagatccctgatggagagcgggtggactttgatgatatccatagaaaaagaatggagaaagaccttaatgagcttcaggccctgattgaagcccattttgagaatcgaaaaaaagaagaggaagagctggtgtctctcaaagatcgcatcgaacggcggcgggcagaacgcgccgagcagcaaaggataagaaacgaacgcgagaaggagaggcaaaatcgactggccgaggagcgggcccgtcgggaggaggaggagaacagaaggaaagctgaggacgaggcacgtaaaaaaaaagcactgtcaaacatgatgcatttcggtggttacatccagaagcacaccctgcaaacagaaagaaaaagtggtaagcgccagaccgaaagagagaagaaaaagaagatcctggcagagagaagaaaagttctggctattgatcatctgaatgaagaccagcttcgagagaaagccaaggaactatggcaatcaatctacaacttggaggctgagaaattcgatcttcaagagaaatttaagcagcaaaaatatgagatcaacgttctcaggaacaggattaatgacaatcagaaggttagtaaaaccagggggaaagctaaggtgaccggcaggtggaaatag

SEQ ID NO: 209964 - DNA, 894 bp, Artificial Sequence
  Description of Artificial Sequence: Synthetic coding sequence
atgagcgacatcgaggaggtggtggaggagtacgaggaggagtacttggagcatgccgaagctgccgttgaagaggaggaagactggcgcgaggacgaggatgagcaggaggaggctgccgaggaagacgcagaggctgaggcggagacagaggaaaccagagccgaggaggatgaggaggaggaagaagccaaggaggcagaggacggccctatggaagaaagtaagcctaaacccagatcttttatgccaaatctcgtaccccccaagattccagatggggagagggttgacttcgacgacattcacaggaagcgcatggagaaagatcttaacgaattacaggcattgatagaggcgcatttcgagaatagaaagaaggaagaggaggaacttgtgagcctgaaggatcggatcgagcggcggagggccgaacgtgcggagcagcagcgcatccgaaatgagagggagaaggagcgccagaaccgcctggcagaagaaagggcaagaagagaggaggaggagaatcgacggaaagctgaagatgaggcacggaaaaaaaaggcactgagtaacatgatgcatttcggcggctacatccagaaaactgagcggaagagcggaaaaagacagaccgaacgagagaagaaaaagaaaattctggcggagaggagaaaagtgctggccattgaccatttgaatgaagatcagctcagagaaaaagcaaaagaattatggcagtcgatatataacctcgaggcagagaagttcgacttacaggagaaatttaagcagcagaaatacgagattaatgtgctgcggaacagaataaacgacaatcaaaaagtgtcaaaaactcgaggtaaggccaaggtaactggacgctggaaatag

SEQ ID NO: 209965 - DNA, 867 bp, Artificial Sequence
  Description of Artificial Sequence: Synthetic coding sequence
atgagcgacatcgaggaggtggtggaggagtacgaggaggaggagcaggaggaagcggcagtggaggagcaagaagaggctgctgaagaggacgccgaagctgaggccgagacagaggagaccagagcagaggaagacgaggaagaagaagaggcgaaagaagccgaagatggccccatggaagaaagcaagcccaaacctaggtctttcatgccaaacttggtcccacccaagatccccgacggtgaacgtgtcgacttcgacgatattcaccggaaaaggatggagaaggacttaaacgagctacaagcattgatcgaggcacacttcgagaacaggaagaaagaggaggaggagctggtgtcattgaaggataggattgaaagacggagagccgagcgggcagagcagcagcggatcagaaatgaacgggagaaggagcgccaaaaccggctagctgaggaacgggccagaagagaagaggaagaaaacagacgtaaggccgaggatgaggcgcggaagaagaaggccctgagcaatatgatgcactttggtggatatatccagaaacaggcgcaaacagaacggaagtccggtaaaaggcagacggagcgcgaaaagaagaagaagattctcgccgaaagacgcaaagtcctggcgatcgaccacctgaacgaggatcaactccgcgagaaggccaaagagctttggcaatccatctacaatctggaagcagaaaagttcgacctgcaggaaaaatttaaacaacagaagtacgagatcaacgtcttaaggaaccggattaatgataaccagaaggtctcaaaaacccggggcaaggccaaggtaacgggcaggtggaagtag

SEQ ID NO: 209966 - DNA, 771 bp, Artificial Sequence
  Description of Artificial Sequence: Synthetic coding sequence
atgagcgacgaggaggtggagcaggtggaggagcagtacgaggaggaggaggaggcgcaggaagaagctgccgaggttcatgaggaggttcacgaacccgaagaaaagccacgccccaaattgaccgcgcccaagatccccgaaggagaaaaggtggatttcgacgatatccagaagaaaaggcaaaataaggacctcatggaactccaagctctgattgattcccacttcgaagcacgcaagaaggaggaggaggagcttgtggctctcaaggaaaggatagaaaaacgacgagctgaaagggccgaacagcagcgcatccgcgcagaaaaggaacgtgagagacagaatagacttgccgaagagaaggccaggagagaagaggaggatgctaaacggagagccgaggatgatcttaaaaagaaaaaggctctgagtagtatgggtgccaattacagctcttatttagcgaaagctgaccagaagagaggaaaaaagcagactgcgcgtgaaatgaagaaaaagattttagccgagaggaggaagcccttgaatattgaccacctcggcgaagacaaacttcgtgacaaggcaaaagagctctgggagaccctgcatcagctggaaatagataagtttgagtttggcgagaaacttaagcgacagaagtatgacattactaccctcaggagcaggattgaccaagcacagaagcactccaagaaagctggcacgccggccaaaggcaaagtcggcggccggtggaagtag

SEQ ID NO: 209967 - DNA, 777 bp, Artificial Sequence
  Description of Artificial Sequence: Synthetic coding sequence
atgagcgacgaggaggtggagcaggtggaggagcagtacgaggaggaagaggaggcccaggaagaagaggaggtgcaggaagataccgccgaggaggatgcagaagaggaaaaaccgagaccaaagcttactgcacccaaaatccccgagggggagaaggtcgacttcgacgatatccagaaaaagcggcagaataaggatctgatggagcttcaggcactgatagatagccacttcgaggcgcgaaagaaggaggaggaggagctggtcgccctaaaagagagaattgagaagagaagggctgagagggctgagcaacagagaatcagagccgagaaagaaagagagagacagaaccgactcgcagaagaaaaggcccggagggaggaagaggatgctaagcgaagagcagaagatgaccttaaaaaaaagaaggctttgtccagcatgggagcgaattattcatcctatctcgccaaggccgatcaaaagagggggaaaaaacagaccgctagggaaatgaaaaagaagattctcgccgaaaggcgtaagccattaaacattgatcatctgggcgaagacaagctcagggataaggcgaaggaactgtgggaaactcttcaccagctggagatagataagttcgagttcggtgaaaaactcaaaaggcagaaatacgatatcactacccttcggagtagaatagaccaagcccaaaaacatagtaagaaagcaggaacccctgctaagggaaaagtgggcggccgctggaagtag

SEQ ID NO: 209968 - DNA, 738 bp, Artificial Sequence
  Description of Artificial Sequence: Synthetic coding sequence
atgagcgacgaggaggtggagcaggtggaggagcagtacgaggaggaggaagaagcccaggaagaggaagagaagcccagacccaagctcaccgcacctaagatcccggagggagagaaagttgacttcgatgacattcagaaaaagcgccaaaataaagatctgatggagctccaagcattgatcgactcgcacttcgaagccagaaagaaggaggaggaggagcttgtggctctgaaggagagaattgagaaacgacgtgccgagagagcagagcagcaacggattcgggcagagaaagagagagagcgccagaaccggttagccgaggaaaaagcgagaagggaagaggaagacgctaagcgccgggctgaagacgatttgaagaagaaaaaggccctttccagcatgggagcaaattattcatcatacctggcaaaggctgaccagaagaggggcaaaaagcagacagcgagagagatgaagaagaagatcctggccgagagacggaagcctctgaacattgaccacctcggcgaggataagctccgagataaggctaaagagctctgggaaacactccatcaactggaaatcgacaagttcgagtttggggaaaaattgaagcgccagaagtatgacatcactacactgcgtagccggattgaccaggctcagaaacactcaaagaaagcgggcacacccgccaaaggaaaagtaggcggcagatggaaatag

SEQ ID NO: 209969 - DNA, 759 bp, Artificial Sequence
  Description of Artificial Sequence: Synthetic coding sequence
atgagcgacgaggaggtggagcaggtggaggagcagtacgaggaggaagaggaagcccaggaagaggctgctgaagtgcacgaagaagaggaaaagccacgccctaagctaactgcacccaaaatcccagaaggtgagaaggttgacttcgacgatatccagaagaaaaggcagaacaaggacctgatggaattgcaagcgttgatcgattctcacttcgaagctcgaaagaaggaggaagaagagctagtcgcactcaaagaacgcattgaaaagaggcgggccgaaagagcggagcaacagcgcatcagggctgaaaaggaacgcgaacgacagaacagactcgcggaggagaaagcacgcagggaggaggaggatgcaaagagaagagcagaggacgacttaaagaagaaaaaggctctgagcagcatgggagccaattattccagctatctggccaaggccgaccagaaaagaggcaagaagcagaccgctagggagatgaagaagaagatcttggcagagcggcgcaaaccactgaatatcgatcatctcggggaggataagttacgggacaaggcaaaagaactgtgggaaaccctgcaccagctggaaatcgacaagttcgaattcggcgagaagctaaaacgccagaagtacgatatcatgaacgttcgcgccagggtgcaaatgctcgcgaagttcagtaagaaggccgggacacccgccaagggaaaggtggggggcaggtggaaatag

SEQ ID NO: 209970 - DNA, 783 bp, Artificial Sequence
  Description of Artificial Sequence: Synthetic coding sequence
atgagcgacgaggaggtggagcaggtggaggagcagtacgaggaggaagaggaagcgcaggaggaggccgctgaggtccatgaggaggacaccgcagaagaggatgctgaagaggagaaaccccggccgaagctgaccgctcctaagatacctgaaggtgagaaggtggattttgacgacattcaaaaaaagaggcagaacaaagatctcatggagcttcaggctctgatagactcccatttcgaggcccggaagaaggaggaagaggagttggtggccctcaaggagagaatagagaagaggcgggccgaacgggccgaacaacaaagaatccgcgcggaaaaggagagagaaagacagaatcggctggcggaggagaaggcaagacgggaagaggaggatgccaaaagacgtgctgaagatgacttaaaaaagaaaaaggcattgtcaagcatgggcgccaactactctagttatctggcaaaggccgaccaaaaaagaggaaagaaacaaacagcacgcgagatgaagaaaaaaatattggcggagcgccgaaaacccctcaacattgaccatctgggagaagataagctcagagacaaggccaaagagctctgggaaaccttgcaccaactggagattgataaatttgagttcggtgagaaattgaaaaggcagaagtacgacatcactaccctgagatctcgcatcgaccaggctcagaagcactccaaaaaagcaggcacccctgccaaaggaaaagtgggggggcgctggaaatag

SEQ ID NO: 209971 - DNA, 753 bp, Artificial Sequence
  Description of Artificial Sequence: Synthetic coding sequence
atgagcgacgaggaggtggagcaggtggaggagcagtacgaggaggaggaggaggcacaggaagaggaggaggttcaggaggaggagaagcccaggccgaagctgactgcccccaaaattcctgagggagagaaggttgatttcgatgatatacagaaaaagagacagaacaaagacctgatggagctccaggctcttatcgattcccattttgaggcaagaaaaaaggaggaagaagagctggtcgccctaaaggagcgtatcgagaagagaagagctgagcgcgccgagcagcaacggattcgcgccgagaaggaacgcgaacgccagaacaggctggccgaagaaaaggcgcggagggaagaggaagacgctaaaaggagggctgaggacgatctgaagaaaaaaaaggccttaagctcaatgggagcgaattatagctcttacttagcaaaagctgaccaaaagcgggggaaaaagcaaaccgcgagggagatgaagaagaagattctggcagaacgcagaaagcccctgaatattgaccacttgggcgaggacaaactgcgggataaagcaaaagagctgtgggaaacacttcaccagctcgaaatcgataaatttgagttcggggagaagctaaagcgccagaagtatgatatcacaactctgagatccaggatcgaccaggctcagaaacacagtaaaaaggccggcacgccggcgaaaggcaaggtgggcggacgctggaaatag

SEQ ID NO: 209972 - DNA, 786 bp, Artificial Sequence
  Description of Artificial Sequence: Synthetic coding sequence
atgagcgacgaggaggtggagcaggtggaggagcagtacgaggaggaagaggaggctcaagaggaagcagcggaagtccatgaagaggggatgcgaacacaggatttcttccatgaggagaaaccacgcccgaaactcactgcaccaaaaatccccgaaggtgagaaagtggacttcgacgatatacagaagaaaaggcagaacaaagacctgatggagttgcaggcgctcatcgacagtcatttcgaggctcgtaaaaaagaggaggaagagttggtagcactgaaggaaagaattgaaaagcggagggccgagcgtgccgagcagcagcgcatcagggccgagaaggagcgggaaagacagaacagactcgcggaggaaaaggccagaagggaggaggaagatgccaagcgcagagctgaagatgaccttaaaaagaagaaagctttgtcaagcatgggagctaactactcatcctacctcgctaaggctgatcagaagagaggaaagaagcagaccgccagagagatgaaaaagaagattctggccgaacgcaggaagcccctgaacatcgaccacctgggggaggacaagctgagagataaggccaaagagctttgggaaactctccaccagcttgagatcgataaatttgaattcggggaaaagttgaagcgacaaaagtatgacattactacgcttcgcagtaggatagatcaagctcagaagcactccaaaaaggccgggacccccgccaaggggaaggtcgggggccggtggaagtag

SEQ ID NO: 209973 - DNA, 786 bp, Artificial Sequence
  Description of Artificial Sequence: Synthetic coding sequence
atgagcgacgaggaggtggagcaggtggaggagcagtacgaggaggaggaggaggcacaggaagaagccgccgaagttcacgaggaggtccacgaaccagaggaggtgcaagaagaggagaagcctaggcctaagctcaccgcccctaagattccggaaggagagaaagtcgatttcgatgacattcagaagaaacgccagaacaaagatctgatggagctccaggcgctcattgactctcactttgaggccagaaaaaaagaagaggaggaactggtggccctgaaggagcgtattgaaaaaaggcgagccgaacgggcagagcaacaaaggatcagagccgagaaagaacgagagcgacagaatcgccttgcagaggaaaaagcacgtagggaggaggaagacgcgaagcgccgcgcggaggacgatcttaaaaaaaagaaggccctgagcagcatgggagcaaactattcctcttacctggcaaaggcagatcagaagcggggaaaaaagcagacagcccgcgagatgaagaagaagatcctggctgaaaggcggaaaccactcaacattgaccacctcggggaggacaaactgagggacaaagccaaggagttgtgggagaccttgcaccagctcgagatcgataagtttgaatttggagaaaaacttaagaggcagaaatacgacattaccaccctcaggtcccgaattgaccaggcccagaaacactccaaaaaggccgggacacccgccaagggcaaggttggtggacggtggaaatag

SEQ ID NO: 209974 - DNA, 753 bp, Artificial Sequence
  Description of Artificial Sequence: Synthetic coding sequence
atgagcgacgaggaggtggagcaggtggaggagcagtacgaggaggaagaggaggctcaggaagaagaggaagtgcaggaggaggaaaaaccgagaccaaaactcacagcccctaagatcccagaaggagagaaagttgacttcgatgacatccaaaaaaaacggcagaataaggacctcatggaactccaggctctgattgattcgcactttgaagccagaaagaaggaagaagaggagctcgtggcattgaaagaacgaatagaaaaacggcgagcagagcgagccgagcagcaaagaatccgggcggagaaagagagagaaagacagaaccggctggctgaggagaaagccagaagggaggaggaggatgctaagaggagagctgaggatgatctgaagaaaaagaaggccttatcctctatgggagcaaactactcgtcatacctagctaaagcagatcagaagcgcggcaagaaacagactgctcgagaaatgaagaaaaagatcctggccgaacggagaaagccactgaacatagaccaccttggagaagataagctccgggataaggccaaagaactttgggaaaccttacaccagctagagattgacaaattcgaatttggcgaaaagcttaagagacaaaaatacgatattatgaatgttcgggcaagagtccagatgctggcaaaattcagcaagaaagcagggacgccggccaaaggtaaagtgggtggaagatggaaatag

SEQ ID NO: 209975 - DNA, 810 bp, Artificial Sequence
  Description of Artificial Sequence: Synthetic coding sequence
atgagcgacgaggaggtggagcaggtggaggagcagtacgaggaggaggaagaagcccaggaggaggccgcagaggtgcacgaagaggtacacgagcctgaggaggttcaggaagataccgcggaagaggacgcagaggaggaaaaacctcgtcccaaactgaccgctcctaaaatccctgaaggcgagaaggtagatttcgatgatatccaaaaaaagagacaaaacaaggatcttatggagttgcaggctctgatagactcacactttgaggctagaaagaaggaggaggaggaactggtggccttaaaggagaggatcgagaaacgaagagccgagagagcggaacagcaaagaatacgggcagagaaagaacgggagcgtcagaacaggctggcagaagaaaaggcacgccgcgaggaggaagatgctaagcgccgagccgaggacgatttgaagaagaagaaagcgctgtcctccatgggcgctaactactcctcatacctggctaaggccgaccaaaagcggggcaagaagcaaactgccagggaaatgaagaaaaagattctcgccgaaagacggaaacccctgaacatcgaccacctgggcgaagataaattgcgcgacaaggcaaaggagctctgggagactctgcatcagttagaaatcgacaaattcgagttcggagagaaactcaaacgccagaagtatgacatcactaccctcaggtcccgcatcgatcaggctcagaagcactctaagaaggccggtactcccgctaagggcaaagtgggcggccggtggaaatag

SEQ ID NO: 209976 - DNA, 813 bp, Artificial Sequence
  Description of Artificial Sequence: Synthetic coding sequence
atgagcgacgaggaggtggagcaggtggaggagcagtacgaggaggaagaagaggcccaggaagaagccgctgaagtccacgaagaggctcaccccggcgaggagagcgtgcgcgaagacactgccgaagaggatgccgaagaggagaaaccccgtcccaaattgactgccccaaaaatcccagaaggtgagaaagtcgattttgatgacattcagaaaaaacgccagaacaaagatctgatggagctgcaggcgctgatcgattcccactttgaggcgcggaagaaagaagaagaagagttagttgcgctgaaagagcgcatagagaagcgccgcgccgagcgcgcagagcagcagcgcatccgagcggaaaaggaaagggagagacagaatagacttgccgaggaaaaggcccgccgagaggaagaggacgccaagcgcagagcagaggacgacttgaagaaaaagaaagctctgagttccatgggggctaattatagctcgtatttggcaaaggccgatcaaaagaggggcaagaaacagaccgctagagaaatgaagaaaaaaatactggccgaaagaaggaaacctttgaatattgaccatctcggcgaagataagctgcgagacaaggctaaagagctttgggagactttacaccaactggaaatcgataagtttgagtttggggagaagcttaagagacagaagtatgatatcacaacactcaggtctaggattgaccaggcacagaaacacagcaagaaggccgggactccggccaagggcaaagtgggaggccgctggaaatag

SEQ ID NO: 209977 - DNA, 435 bp, Artificial Sequence
  Description of Artificial Sequence: Synthetic coding sequence
atgagcgacgaggaggtggagcaggtggaggagcagtacgaggaggaggaagaggcacaggaggaggctgccgaggtgcacgaagaggaacgtagagctgaggatgatctgaagaagaagaaggccctcagctctatgggcgccaattatagctcctatcttgctaaggcggaccagaaaagaggtaaaaaacaaactgccagagaaatgaaaaagaagatcctggctgagagaagaaagccactcaatatcgatcacctgggtgaagacaagctgagagacaaggccaaagagctttgggagcccccccagtcctgccaggggctgcctgacagtcctgggggaggagaggctataccaggccgccctcctcggctgtgcccatgctgcctgcacccattgggtccggttaataaggccgccgagccaccctag

SEQ ID NO: 209978 - DNA, 1617 bp, Artificial Sequence
  Description of Artificial Sequence: Synthetic coding sequence
atggaggagagcgtgaaccagatgcagcccctgaacgagaagcagatcgccaatagccaggatggctacgtgtggcaggttaccgacatgaatcggctccacagattcttatgtttcggatccgagggtggtacttactatatcaaggagcaaaagctcggcctagagaatgcagaggcgctgattagacttatcgaggacgggcgtggttgcgaagtgatccaggagattaagtctttcagccaggagggtcggacgacaaaacaggaacccatgctcttcgcgctggccatctgctcccagtgctcagatattagcacaaagcaagctgcttttaaggccgtgtccgaagtgtgcagaatccccactcacctgtttaccttcatccagtttaagaaggacttaaaggaaagtatgaagtgtggcatgtgggggcgcgcactgagaaaggccatcgcagattggtataacgagaagggcggaatggcactggcactggctgtaaccaagtacaaacaacggaacggatggagccataaagacctcttgaggctgtctcatttgaagccaagctccgagggactggccattgtcaccaaatacattaccaaagggtggaaagaggtccatgaactctacaaggagaaggcattgagcgtagaaacggaaaaattgttaaaatacctggaagctgttgagaaggtgaagcgcacccgcgacgagcttgaggtcattcacctgatcgaggagcatagacttgttagagagcacctgctcactaatcatttaaagagtaaagaagtatggaaagcactactgcaggaaatgccactgactgccctgctacgcaatttgggcaaaatgacagcaaacagcgttctggagcctgggaactcagaggtttcgctcgtgtgtgagaagctgtgcaacgagaaactgcttaagaaggcgaggattcacccatttcatatcctcatagccctggagacttataagactggacacggactccgaggaaagctcaaatggcgaccagacgaggagatcctgaaggctttggatgccgccttttacaagaccttcaaaaccgtggaacctacgggaaagcggttcttacttgccgtggacgtgtcagcttctatgaaccagcgagtattgggcagcattctaaacgcctctactgttgcggccgccatgtgtatggtggtcacacgcaccgaaaaggatagctacgtggtggccttcagtgacgagatggtgccatgccccgtcacaactgatatgaccctgcagcaggtgcttatggcgatgagtcaaatcccagcaggaggcactgattgtagtctccctatgatttgggcccagaagaccaacacaccagccgacgtgtttatcgtttttacggacaacgagacctttgcagggggagtacatcccgccatcgccctgcgcgagtataggaagaaaatggatatccccgctaaattgatcgtgtgcgggatgacgagtaacgggttcactatcgccgaccctgacgaccggggaatgttagacatgtgcggattcgatacaggggcgctggacgttattagaaacttcacacttgacatgatatag

SEQ ID NO: 209979 - DNA, 1557 bp, Artificial Sequence
  Description of Artificial Sequence: Synthetic coding sequence
atggaggagagcgtgaaccagatgcagcccctgaacgagaagcagatcgcaaacagccaagatggatatgtgtggcaggtgacagacatgaaccggctacaccgatttctttgtttcggctcagagggtggaacgtattatatcaaggaacaaaagcttgggctcgagaacgccgaagcgttgattagacttatagaagatgggagaggctgcgaggtaattcaggaaattaaaagtttttctcaggaaggacgcacaaccaaacaggaacctatgctcttcgcgctggcaatctgttcacagtgttccgatattagcaccaaacaggctgcattcaaggctgtgagcgaagtgtgccgcattcctacacatctttttacattcatacagtttaagaaggatctaaaagaatctatgaaatgcggcatgtggggccgtgccctgcgaaaagcgatcgccgattggtacaatgaaaaaggaggaatggctcttgccctggccgtgacaaagtacaaacagaggaacggctggtcacacaaagacctgctgaggttgagccacctgaagcccagctcagagggcctggcgatcgtaacaaaatacattactaaaggatggaaagaggttcacgagctttataaggaaaaggccttgtccgtcgaaacggagaagctcctgaaatatttagaggccgtcgaaaaagtgaaaagaacacgtgacgaactggaagtcattcatctgattgaagagcaccggctcgtgagggaacatttgttgacaaatcacctgaaaagtaaggaggtgtggaaagccctcctgcaggaaatgcctctgacggccctgctgcgtaatctgggcaagatgactgctaattccgtgctggagcccggtaactcagaggtctcactggtttgtgaaaaactatgcaatgaaaagctgcttaagaaagcacgaattcatccattccacattctcattgctctggagacttataagacaggtcatggcctgcgtggaaaactcaaatggcggcctgacgaggagatcctcaaagccctcgatgctgctttttataaaaccttcaaaacggtcgagcccactggcaaacgcttcctcttggccgtggacgtctctgctagcatgaatcaacgcgtgctgggaagcatcctcaacgcttctacagtggctgctgccatgtgtatggtggtgacaagaaccgagaaagactcgtacgtcgttgcattttcggacgagatggttccctgccccgtgacaacagatatgaccctgcagcaggtcttgatggccatgtcgcagattccagctggcggcaccgactgcagcctccccatgatctgggcgcagaagaccaataccccagccgacgtcttcattgtgtttaccgacaatgagaccttcgcaggcggcgtacatcccgccatagcactacgagaatataggaaaaagatggacatacccgcaaaacttattgtgtgtggtatgacttcaaacggattcacaattgccgatcctgatgaccgggacacagtcaaatag

SEQ ID NO: 209980 - DNA, 1578 bp, Artificial Sequence
  Description of Artificial Sequence: Synthetic coding sequence
atggaggagagcgtgaaccagatgcagcccctgaacgagaagcagatcgccaactcccaagatggatacgtttggcaggttactgacatgaaccgactccaccggtttctttgtttcgggtccgagggtgggacctactatatcaaggagcagaagctgggcctggagaacgccgaggcgctgattcgattgattgaggatgggcgcggatgcgaggttatacaggaaattaagagctttagccaggagggacgcactaccaagcaggaaccgatgctatttgcgctggctatctgcagccagtgtagcgatatttctacaaagcaagccgcttttaaggccgtgagtgaggtttgtagaatacctacccacctgttcaccttcatccagtttaaaaaggatctcaaggaaagtatgaagtgcggaatgtggggccgcgccctaaggaaggcgattgccgattggtacaacgagaaaggaggcatggctctcgccctcgcagttactaaatacaaacagcggaacggctggtcccacaaagatcttttgcgactgtcacacttaaaaccctcctcagagggacttgccatcgtgaccaaatacatcaccaaaggctggaaggaggtccacgagctttataaggaaaaagcgctatccgttgaaaccgaaaaactcctgaaatatcttgaagccgtggagaaagtcaagcgcacccgcgacgagttggaagtgattcacctgattgaagagcatagactcgttagggaacacctgctgactaatcacctgaaaagtaaagaggtgtggaaggccctgttacaggagatgcctttgaccgccttgctgcggaatctgggcaagatgacagctaactccgttttggaaccaggaaactcagaggtttcactggtgtgcgagaagctttgtaacgagaagctcctgaaaaaagccagaatccacccattccatatccttatcgctctcgaaacctacaaaacaggacatggcctgcgcggtaaacttaaatggcggcccgatgaggaaattctgaaggccctggatgcggccttttataagaccttcaagactgtcgagcccacaggaaagcggtttctcttggctgtggatgtatcagcctcgatgaatcagagggtgctaggctctatcctcaatgctagcactgtcgctgccgccatgtgcatggtggttacccggacagaaaaagactcttatgtggtcgcgttctcagacgaaatggtgccttgccccgtgacgacggatatgaccctgcagcaggtacttatggctatgtctcagattcccgccggtgggactgactgtagcctcccgatgatctgggcccagaaaacaaatacccctgcagacgttttcattgtattcacggacaacgagacgtttgctggaggcgtgcaccctgctatcgcattgcgagagtatcgtaaaaagatggatattcccgccaagcttatcgtgtgcgggatgacatcaaatggattcactatcgctgaccctgacgatagagccctgcagaacaccttgcttaacaagagtttctag

SEQ ID NO: 209981 - DNA, 1605 bp, Artificial Sequence
  Description of Artificial Sequence: Synthetic coding sequence
atggaggagagcgtgaaccagatgcagcccctgaacgagaagcagatcgcgaacagtcaggacggttatgtctggcaggtgacagacatgaaccggctgcatcgctttctgtgctttgggtcagaaggagggacatactacatcaaggagcagaagcttggcctggagaacgcagaggccctgatccgtttgatcgaggatggcaggggatgtgaggtgattcaggaaattaagtctttttctcaggaagggagaaccactaagcaggaacctatgcttttcgctctggcaatttgcagccaatgcagcgacatctctactaaacaggccgctttcaaggcagttagcgaggtttgtagaattcccacacacctattcacctttatacaattcaaaaaggacctgaaggaaagcatgaaatgcggaatgtggggaagagctttgagaaaggccatagcggactggtataatgagaaaggcggaatggcccttgcacttgccgtcactaagtacaagcaacggaacgggtggtcacacaaggatctgctgcggctgtcacacctcaaaccatcctccgagggcctggctatcgtcactaaatatattacgaagggctggaaggaggtgcatgagctgtacaaagaaaaagctttgtcagtcgagactgaaaaacttctgaagtacctcgaagcagtcgagaaggtcaagcgcactcgagacgagctggaggtgatccaccttatagaggagcacagactcgtgcgagaacatctcttgacaaaccatcttaagagcaaggaggtttggaaggccctgctacaggagatgcccctgacagccctgctaagaaacctgggaaagatgacggccaactccgtcctcgagccgggaaacagtgaggtgagtctcgtctgcgagaagctgtgcaacgaaaagctacttaaaaaagcacgcatacaccccttccatatcctcatagctctcgaaacgtataagacaggccatggtctcagaggcaaacttaaatggcgaccagatgaggagatactcaaggcccttgacgctgcattttacaaaaccttcaaaacggtggagccaaccggaaagaggtttctcctcgccgtggatgtctcagcttctatgaatcagagagtgttggggagcattctgaatgcctctacggttgccgccgctatgtgtatggttgtcacgcgaacagagaaggactcttatgtcgtcgccttcagcgacgaaatggtgccgtgtcctgtgacaacagacatgaccctgcaacaagtcttgatggccatgagccagatacccgccggagggacggactgctctctccctatgatttgggctcagaaaactaatacacctgctgacgtgttcatagtatttacggacaatgaaacattcgctggcggtgtacacccggccatcgccctccgggagtaccgaaaaaagatggatatccctgcgaaactgatcgtctgtggaatgacgtctaacggttttacaatcgctgaccctgatgatagaggtatgctcgacatgtgcggttttgacactggagcccttgacccctgcaaaatcccttactag

SEQ ID NO: 209982 - DNA, 1617 bp, Artificial Sequence
  Description of Artificial Sequence: Synthetic coding sequence
atggaggagagcgtgaaccagatgcagcccctgaacgagaagcagattgccaactcacaagatggatatgtttggcaggttactgacatgaatagactgcaccgattcctttgtttcggcagcgagggaggcacgtattacattaaggaacagaagcttggcctggaaaacgccgaagcccttataagactgatcgaagacgggcggggatgcgaagtgattcaggaaataaagtctttttctcaggagggccgcaccacgaagcaggaacccatgctctttgcacttgccatctgctcccagtgcagtgatatttctactaagcaagctgcattcaaagctgtgtccgaagtgtgccgcatccctacccacctatttactttcatccagttcaagaaagatttaaaggaaagcatgaaatgtgggatgtggggtagagccctgcgtaaagccatcgcagactggtataatgagaagggtgggatggcgttggccctggccgtaaccaaatataagcagaggaacggttggagccacaaggatctgctccggctgtcgcacctgaagccttctagtgagggtctggcgatcgtgacaaagtatataactaaaggctggaaagaagttcatgagctctacaaagaaaaggcactctccgtggaaaccgagaaattgctgaaatacctggaggccgttgagaaagtgaaacgcacccgcgatgagctggaggtgattcatctcattgaagagcataggctagtaagggaacacttgctgaccaatcatcttaagtccaaggaggtgtggaaggccctcctgcaggagatgccactgaccgccttgctgcgcaacctgggaaagatgactgctaattcagttttagaaccaggcaacagcgaagtttctctcgtgtgtgagaaattgtgcaacgaaaaattgctgaaaaaggcgcggattcatccttttcacatactgatcgctttggaaacctacaaaaccggacacggcctgcgaggaaagctgaagtggcgcccggatgaggagatcctgaaagccctcgatgcagccttttacaagacttttaaaacggtggagccaacggggaagagatttctactcgcagtggacgtgagcgcctccatgaaccaaagagttctcggatccattttgaacgcttccacagtcgccgcggccatgtgtatggtggtaaccagaactgagaaggattcctacgtggtggcctttagtgatgagatggttccgtgcccagtgacaaccgacatgacgctacagcaggttctgatggctatgagccagatcccagctggcggtacagactgtagcctgcctatgatttgggcccagaagaccaacacccccgccgacgtattcatagtcttcactgacaacgaaaccttcgctggaggggtgcaccctgcgatcgccctgcgagagtaccgcaaaaagatggatatccccgctaagctgatcgtttgtggcatgacgagcaatggattcaccatcgccgaccccgatgacagggggatgctagacatgtgtggcttcgacaccggagcactggatgtaatccgcaatttcactttggacatgatttag

SEQ ID NO: 209983 - DNA, 1617 bp, Artificial Sequence
  Description of Artificial Sequence: Synthetic coding sequence
atggaggagagcgtgaaccagatgcagcccctgaacgagaagcagatcgcgaacagtcaagacggttacgtgtggcaggtgaccgatatgaatcgcctgcatagatttctgtgcttcggctccgaaggagggacgtactacatcaaggagcagaagctgggtctcgaaaacgctgaggcattgattcggcttatagaggacgggcggggatgtgaggtgattcaggaaatcaaatcctttagtcaggaaggccgcaccaccaagcaggagcccatgctatttgccctggccatttgcagccagtgctcagacatcagcaccaaacaggctgcgttcaaggccgtgtctgaagtatgcagaattcccacacaccttttcacattcattcaatttaaaaaagatttgaaagagagcatgaagtgtggtatgtggggccgagcactccgcaaggcaattgccgattggtacaacgagaagggtggtatggccctggccctcgccgttactaagtataaacaacgaaacggatggagccataaagatcttttaaggctgtcgcatctgaaacctagctctgagggcctcgcaattgtgactaagtacatcactaagggttggaaagaggtgcacgaattatacaaggagaaggccctgagcgtggaaaccgaaaagctgctgaagtacctggaagccgtggaaaaagtcaaaaggacacgcgatgaacttgaagtaattcacttaatcgaggagcaccggcttgtgcgtgagcatctgctgacaaaccatctcaagtccaaagaagtgtggaaggccctgctgcaggaaatgcctctgacggcacttctacggaatttaggcaagatgactgcaaattctgtgctagaacctgggaacagcgaggtgagcctggtctgtgaaaagctctgcaatgaaaaactcttaaagaaagccagaatccatcccttccacatcctgattgccctagagacctacaaaacagggcatgggcttcgcggcaagctgaagtggagaccagacgaggagatactgaaggctcttgatgctgctttttacaagactttcaagactgtcgagcctactgggaagcgctttctcctagctgtggacgtatccgccagtatgaatcaacgcgtgctaggttccatcctcaacgcctctactgtcgctgccgccatgtgcatggtggtcacccgcaccgagaaggactcatacgttgttgcattttcggacgagatggtcccctgcccggtgaccaccgatatgaccctccagcaagttctcatggccatgagccagattccagcgggcggtacggactgcagcttacctatgatttgggctcagaagacaaatactcccgcagacgtttttattgtgtttactgataatgagacattcgcaggcggggttcatcccgcaatcgccttgcgggaatatcgcaaaaaaatggacatacccgcgaaactcattgtgtgcggaatgacaagcaatggattcaccatcgcggaccccgacgaccgggggatgttggacatgtgcggattcgacacaggagctcttgacgtgatcaggaactttaccctggacatgatatag

SEQ ID NO: 209984 - DNA, 792 bp, Artificial Sequence
  Description of Artificial Sequence: Synthetic coding sequence
atgcccctgaccgccctgctgcggaacctgggcaagatgaccgccaactcggtgctggagcctggaaacagcgaggtgagcctggtttgcgaaaagctgtgcaacgagaaactgctgaagaaggcgcgcattcaccctttccacatcctaattgccctcgaaacatataaaacgggacacgggctgagaggaaaacttaagtggcggccagacgaggagattctgaaggccttagacgcagcattttacaaaactttcaagaccgtggagcctactggaaagcgattcttattggccgtcgatgtgagtgcgagcatgaatcagcgagtattggggtccattttaaacgcttcgactgtcgcagcggccatgtgtatggtggtgacaagaactgaaaaggacagctacgtggtcgccttttctgacgagatggtcccttgtccagtgacgaccgacatgacgctgcagcaggtcttgatggcgatgtctcaaatccctgcaggaggaaccgattgctccctccctatgatttgggctcagaagacaaacacacctgctgatgtgttcattgtattcaccgacaatgaaaccttcgctgggggagtgcaccctgcgatcgccctcagagagtatagaaaaaaaatggatatcccagccaagcttatagtgtgcggcatgacttctaatggcttcacgatagctgatccggatgaccgaggtatgttggatatgtgcggcttcgacaccggagcattggacgtcatcaggaactttacccttgacatgatttag

SEQ ID NO: 209985 - DNA, 126 bp, Artificial Sequence
  Description of Artificial Sequence: Synthetic coding sequence
atggaggagagcgtgaaccagatgcagcccctgaacgagaagcagatagcgaattcccaagatgggtatgtgtggcaagtaaccgacatgaatcggcttcatcgatttttgtgtttcggctcatag

SEQ ID NO: 209986 - DNA, 1050 bp, Artificial Sequence
  Description of Artificial Sequence: Synthetic coding sequence
atggccgccagcgaggccgccgtggtgagcagccccagcctgaagaccgatacttctccagttttggagaccgctggaacagtggcggccatggctgccacacctagcgcgagagcggcagcagcagtggtggccgctgccgcgcgcaccggcagcgaggcgagagtcagcaaagccgcccttgccaccaagctgttatctctgagcggggtttttgctgtgcacaagcctaaaggtcccacatccgccgaactcttgaataggctgaaggagaagctgcttgcagaggctggaatgccttccccagagtggaccaaacggaaaaagcagacgctgaaaattggtcatggcgggactctggatagcgctgcacggggcgtgttggttgttgggattggctcaggaacgaagatgctcacatccatgctctccggatcgaagcgctacacagctatcggggagctgggtaaggccacagatacactggactctacgggacgggttaccgaggagaagccatacgataagattacgcaagaagatatcgagggtatcctgcagaagtttaccggcaatattatgcaagtcccaccgctctactccgctctgaaaaaagacggccagagactgtctaccctgatgaagagaggcgaggtcgtggaagccaagccggcccgcccagtgacagtatactccatctccttacagaagtttcagcctcccttctttacccttgacgtggaatgtggggggggcttttatatcagaagtctggtgtccgacattggcaaggaactgagcagctgcgccaatgtactggagctaactcgcaccaaacagggaccattcacactagaagaacacgcactgccagaagataaatggaccattgacgacatcgctcagtcactcgaacattgttcctcgctgttccctgctgaactcgctcttaagaaaagcaaaccagaaagcaacgagcaagtgctgagctgtgagtatataaccctgaacgagcccaagagggaggatgatgttatcaagacttgttag

SEQ ID NO: 209987 - DNA, 996 bp, Artificial Sequence
  Description of Artificial Sequence: Synthetic coding sequence
atgggcagcgccggcctgagccggctgcacggcctgttcgccgtgtataagccgccaggcttaaagtggaagcacttgcgagatacagtagaattacaactgctaaagggcctgaatgcacgaaagcccccggcccctaaacagcgcgtccgctttttacttggacctatggagggctcagaggagaaggagcttacgctgaccgctacctcggttcctagtttcatcaatcacccactagtttgtggacctgccttcgcccatctcaaagtgggagtgggccatcggctagacgctcaagcgagcggtgttctagtgctgggtgtgggccacgggtgccgcctgctgaccgatatgtataatgctcatcttactaaggactacacagtacgcgggctcctcggcaaggccactgacgattttagggaggatggcaggctcgtggagaaaacaacgtatgaccatgtaacccgagagaagctggaccggatcctggcagtcatacagggcagccatcaaaaggctctcgttatgtactccaatctcgacctgaagacccaggaggcatacgaaatggcggtgcgaggactgatccgcccaatgaacaagtcccccatgctcataacagggatccggtgcctttacttcgcaccacccgagtttttgttggaggtgcaatgtatgcacgaaacacaaaaggaactcaggaagctggtgcacgagattggcctggagctcaagacgaccgccgtgtgtactcaagtgagacggacccgggatggcttctttactctcgattcagcgctcttgagaacacagtgggacttgaccaatatacaagatgccattcgggctgccacaccccaagtggccgccgagctggagaagtccttgtcaccgggacttgatacaaaacagctcccgagtcctggatggagctgggactctcaggggccgtcttccaccctcgggttggaacgcggcgccggccagtag

SEQ ID NO: 209988 - DNA, 828 bp, Artificial Sequence
  Description of Artificial Sequence: Synthetic coding sequence
atggagggcagcgaggagaaggagctgaccctgaccgccaccagcgtcccctcatttattaatcaccccctggtctgcggaccagcattcgcccacttgaaagttggtgttggccataggcttgatgcacaggctagtggagtgctggtcctcggggtgggccatggatgcagactgcttaccgacatgtacaacgcacatctcaccaaagactacacagtcaggggactgctcgggaaagcgacagacgacttccgcgaggacggccgactcgtggagaagacaacctacgaccatgtcacacgcgagaagctcgaccggattctggctgttatccaaggcagccaccaaaaggcgctggtcatgtattcgaatctggacctcaaaactcaggaggcatacgagatggcagtgcgggggcttattaggcccatgaacaagagtcctatgttgattacggggattagatgcctgtacttcgcccctccagagttcctccttgaggtccagtgcatgcatgagacacagaaggaactacgaaaattggtccacgagattggacttgagttgaaaactaccgccgtgtgcacccaggtgcgccggactagggacgggttctttacactggattccgccctcctgagaactcaatgggatctcacgaacattcaggatgcgattagagctgcaaccccacaagtggccgccgagcttgagaaaagcctttcccccggacttgatactaagcaattacctagccccgggtggtcttgggatagccaaggtccaagcagcaccctggggctggaacgcggagccggccagtag

SEQ ID NO: 209989 - DNA, 1701 bp, Artificial Sequence
  Description of Artificial Sequence: Synthetic coding sequence
atgcggcggcagtggggcagcgccatgcgggccgccgagcaggccggctgcatggtgagtgccagccgcgcgggtcagccggaagctgggccttggtcttgtagtggggtgattctgagccgctcacccggacttgtgctctgtcatgggggtatcttcgtcccgtttctgcgtgcgggcagtgaagttctgacagccgctggcgccgtgttcttgccgggggattcatgcagagatgacctgaggctgcatgtgcaatgggcccctacagccgcaggtcctggcgggggtgctgagaggggcagaccaggactgtgtacaccacagtgcgcgtcccttgaaccaggacctcccgccccatccagaggccggcctctgcagcctagactacctgctgagttattgttgctcctgtcctgcccagctttctgggcacacttcgctcggctctttggcgatgaggctgcagaacagtggagattctccagcgcggcccgagacgacgaggtgtcggaagacgaggaggctgatcagctgcgtgccttaggttggtttgcgttgctgggagtgcggctcggccaggaggaggttgaagaggaacgtggtcccgccatggccgttagtccactgggcgccgttccaaagggtgccccactgctcgtttgtggcagtccatttggtgccttttgcccagatattttcctcaacactctgtcttgcggcgtgttgtccaatgttgccggtcctctgctgctgactgacgccaggtgtctgcctggaactgagggcggcggcgtgtttacggccaggcccgctggcgctttagtggccctcgtcgtggcccctctatgctggaaggcaggcgagtgggtgggttttactcttttatgtgccgcagccccactgttcagggcggctagagatgctttacatcggctcccgcattccaccgctgccctcgctgccctactccctccagaggtgggggtcccctggggcctaccgctgcgggactccggtccattgtgggccgctgctgccgtattggtggagtgcggaacagtttggggatccggtgtggcggtcgcccctcgcttggtggtcacctgtcgtcatgttagtccgcgcgaggcagccagagtgctcgtcaggagtactacacccaagagcgtggccatatggggccgagtggtgttcgccactcaagaaacttgcccttatgacatcgctgtcgtatcactcgaagaagatctggatgacgttcctatacctgtgcccgcagaacacttccatgagggggaggccgtctctgtggttgggtttggcgtgtttggacagtcttgcggcccctccgtaacttcaggcatcctttccgccgtggttcaggtgaacggcacccccgttatgctccagaccacatgcgccgttcattcaggaagcagcggcggcccgctgtttagtaatcactccggaaatcttctcggcattattacaagcaacactcgtgataacaatactggcgctacatatccccatctgaatttttctatccctattacggtgctgcagcctgcattacagcagtatagtcagacccaggatttggggggccttcgcgagttagatcgggcggctgaaccagtcagagtggtgtggcgcctgcagcgacctctggcggaggcccctagatctaagctgtag

SEQ ID NO: 209990 - DNA, 1197 bp, Artificial Sequence
  Description of Artificial Sequence: Synthetic coding sequence
atgcggcggcagtggggcagcgccatgcgggccgccgagcaggccggttgcatggttagcgcatctcgcgctggccaacctgaggcaggaccctggtcttgctccggcgtcattctgagtcggtctcccggtctcgttctgtgtcacggcggtatttttgtgccttttctgcgggctggaagcgaggtcctgacagccgccggcgcggtgtttctgcccggcgacagctgccgggatgacctgcgcctgcacgtccagtgggctcccaccgctgcaggtcccggcggtggggccgagaggggaaggcccggcttgtgtacccctcagtgtgcctccctcgaacccggtcccccggctccaagtcggggccggcccctccagccgcgtttaccagctgagctgcttctcttgctctcttgccccgctttctgggctcacttcgccaggttgtttggcgatgaagccgctgaacagtggagattcagcagcgccgccagagatgatgaggtttccgaggacgaggaggccgatcaattgcgagctctgggttggtttgcactcctgggagtccggctgggccaagaggaagtggaagaagagcgaggacctgctatggccgtgtccccgcttggggcagttcccaagggcgctcccctgctcgtttgcggtagcccttttggcgccttttgtcccgatatcttcctcaacaccctgagttgcggggttctgtcaaatgttgcagggccgctcctgttaaccgacgccaggtgccttcctggcacagaaggcggcggtgtgtttaccgctcggccagcgggcgctcttgtggccctcgtggtagcgcccctctgctggaaagcaggagaatgggtgggattcactctgttgtgcgccgcagccccgctgtttcgggctgcgagagacgctcttcatcggttaccacactctactgccgccctggcggccctgctgccccctgaagttggagtgccatggggactccctttgagagattcgggcccgttgtgggcggcggccgccgtcctggtagaatgtgggacagtgtggggctccggggttgcagtagcaccaaggcttgtggttacttgccgccacgtctcacctcgggaggcagcccgcgtgttggtgcgaagcacaactcctaagcacaatcaccagcagcaccctggtcagtag

SEQ ID NO: 209991 - DNA, 828 bp, Artificial Sequence
  Description of Artificial Sequence: Synthetic coding sequence
atgctgaacctgctgctgctggccctgcccgtgctggccagccgggcttatgccgcgccagcaccaggacaagcgctccagagagtcggaattgtcggtggccaggaagcaccaagaagcaaatggccttggcaggtctccctcagagtgcacgggccatattggatgcatttttgtggtggtagcctgattcatccgcagtgggtgctcaccgccgcgcactgcgtgggacctgacgtgaaggatctcgcagccctccgagtacaactgcgcgagcagcacctatactatcaggaccagctgctgcccgtgtctagaataatcgtgcacccccaattttatacagcccagatcggcgccgatatcgccttgttagagcttgaggaacccgttaatgtaagctcacacgttcatacagtgacactgccccctgcgagtgagactttcccaccagggatgccatgctgggtgactgggtggggagatgtggacaatgacgaacgcctgcctcctccttttcctcttaagcaggtcaaggttcctatcatggagaatcatatctgtgatgctaaataccatctgggcgcttacactggcgacgacgtcaggatcgtccgagatgacatgctttgtgccgggaacacaagacgcgattcatgccagggagactcggggggacctctcgtatgtaaggtaaacggaacttggcttcaggccggcgtcgtgtcctggggtgagggctgtgcacagccaaacagaccaggaatatatacaagggtcacctactatctggattggatacaccattatgtgcctaagaaaccctag

SEQ ID NO: 209992 - DNA, 849 bp, Artificial Sequence
  Description of Artificial Sequence: Synthetic coding sequence
atgctgctgctggccccccagatgctgaacctgctgctgctggccttgcccgtgctggcctctcgcgcatacgccgctccagcacccggccaagctctgcagagggtaggcattgtcgggggccaagaggccccacggagcaaatggccatggcaagtttctttgagagtgcatggaccatactggatgcatttctgtggtgggtcattgattcacccccagtgggtcctaacagccgcacactgcgtgggcccggacgtgaaagacctcgccgctctgagggtgcagctgcgcgagcagcacttgtattaccaggatcagttgctgccagtgtctcggatcattgtgcacccacagttctatactgctcagatcggagctgacattgctctcttggagttggaagagccggtgaacgtctcgtctcatgtccatacggtaaccctgcccccggcatcagaaacttttcctccagggatgccctgctgggtcacaggatggggagacgtggataatgatgaacgccttccaccgccctttccattgaaacaggtaaaggtacccataatggagaaccatatctgcgatgcaaagtaccacctgggcgcatacaccggtgacgatgtaaggattgtgcgggacgacatgttatgcgctgggaacacacgaagagactcatgtcagggggatagtgggggtcccctggtgtgtaaggtgaacgggacatggctgcaggccggagttgtatcttggggagaaggatgcgcacaaccaaatcgcccagggatctacaccagagtaacctattatctcgattggattcatcattatgtgcccaaaaagccctag

SEQ ID NO: 209993 - DNA, 2532 bp, Artificial Sequence
  Description of Artificial Sequence: Synthetic coding sequence
atgtggggccggctgtggcccctgctgctgagcatcctgaccgccaccgcagtcccagggccctccctgcggaggccaagtcgcgagctggacgccactcctagaatgaccatcccctacgaagaactctctggcacacggcacttcaagggacaggcccagaactattctacactgctgctcgaagaggcttccgctcggctgttagtgggagcaagaggagcactgttcagcttaagtgccaacgatatcggcgacggcgcccacaaggaaatccactgggaagcaagtccagagatgcagtctaaatgccaccaaaagggtaaaaataatcagacagagtgctttaaccacgtccgcttcttacagcgcctcaactctacccatctatatgcctgcggtacacatgcatttcagccactatgtgccgctatcgatgccgaggcgtttacgctgcccacatcgtttgaggaaggcaaagaaaaatgcccgtacgaccccgccagaggatttactggccttattattgatggcgggttgtatactgccacacggtatgaatttagatccattcccgatatcaggagaagcaggcatccccatagtctgaggaccgaagagacacccatgcattggctgaacgatgcagaatttgtattctctgttctcgtgcgcgagagtaaagcctctgctgtcggtgacgacgacaaggtttattacttcttcactgagagggcgaccgaagaaggctcgggtagttttacccagagcagaagctcccaccgagtggccagggtcgcccgggtgtgtaagggagatctgggtggcaagaaaattcttcagaagaaatggacttcctttctaaaagcacgcctgatttgtcatattccactgtacgagaccttgagaggcgtgtgcagccttgacgccgagacgagctcacggacccatttctacgctgcctttaccctctcaacgcagtggaaaaccctggaggcctcggccatatgtagatacgacttagctgagatccaagcagtgttcgctggaccctacatggagtaccaggacggctcccgcagatggggaaggtatgagggtggggtccccgagcccagacccgggtcttgtatcacagatagtcttcgcagtcaaggatataactctagccaggacctgccgtcactggtcctggactttgttaagctacatcccctgatggcgcgacccgtggtacccacgcgcgggcgcccgctgttactcaaaaggaatatcaggtacacacacctcaccgggacccctgtgacgacccccgctggaccaacttacgatctgctctttctcggcacagccgacgggtggattcataaggccgtggtgctgggaagcggcatgcatatcatcgaagagacccaggtgttcagagagtcccagagtgttgaaaatttagtgatttctctgctccagcacagcctctatgtgggagctccctcaggtgtaatccagttgccactgtctagttgttctcgctaccgctcctgctatgattgcattctggcccgggacccctattgtggatgggacccagggacacatgcatgcgccgcagctactacaattgctaatcgctctcaagggagtcggacagccctgattcaggacatcgagagaggtaataggggctgtgagagtagtcgcgacacaggtcctcctccaccactgaaaacccggtctgtgctgcgaggtgatgacgtgcttctgccctgtgaccaacctagcaaccttgcacgggccctttggctgctaaacggttccatgggtttgagtgatggtcagggaggttacagggttggtgtggacgggctcctcgtgactgacgcacagccagagcactccggtaactacggctgttacgccgaagagaatgggctgcggactctgctcgcttcatacagccttacagtgcggccggcgactcctgcaccagcgccaaaggcccccgcaactcctggtgcccagctggctcccgacgtgcggctgttatatgtcctggccatcgctgccctgggaggcctgtgcctgattctggccagcagcttgttgtatgtggcctgtctcagggagggcaggaggggaaggagacggaagtatagcctcggtcgggccagtcgcgctggcggtagcgcggtgcaactccagacagtgagtggacaatgcccaggagaagaggatgaaggggacgacgaaggggccgggggactggaaggctcttgcttgcagattatccctggcgagggagctcccgcaccccccccacctccacccccccccccaccagctgaacttactaacggattggtggctctcccttcccgccttcgacgcatgaacggtaactcgtacgtcctgctgcgccagagtaataatggcgtccccgccggaccttgctcttttgccgaagaactctcccgtattcttgagaaacgtaagcatacccagcttgtggagcaactggacgaatcatccgtgtag

SEQ ID NO: 209994 - DNA, 708 bp, Artificial Sequence
  Description of Artificial Sequence: Synthetic coding sequence
atgctgagcctgctgctgctggccctgcccgtgctggccagccccgcctacgtggcacctgccccaggccaggcgctgcagcaaaccggtatagtgggcgggcaggaggcccccagatccaaatggccttggcaggtgtccctcagagtgcgcggtccctactggatgcatttttgtggaggcagcctgattcacccacagtgggtgctgacagcagctcattgcgtcgagccggacattaaggaccttgctgcactgcgcgtacagcttcgggaacagcatctgtactaccaagatcagttattgcccgtctccaggatcatagtccatccccagttctacataatccagacaggtgccgacattgccctcttagaactggaagagcccgtgaatatttcctctcatatccatacggtaacccttcctccagcctctgaaacgttcccccccggaatgccttgttgggtcaccggatggggggatgtggataataacgtgcatttacctccgccataccctctgaaggaggttgaggttccggtcgtggaaaaccacctctgtaatgctgaataccacactggcctccacacaggtcattctttccagatcgtacgcgacgacatgctgtgcgcaggaagcgagaaccacgactcctgccagggagactctgggggccctttggtgtgcaaggtgaatggaacctag

SEQ ID NO: 209995 - DNA, 4281 bp, Artificial Sequence
  Description of Artificial Sequence: Synthetic coding sequence
atgcacagcagcaaccccaaggtgcggagcagccccagcggcaacactcagagctccccaaaatccaagcaggaagttatggtgcggccgcccacagtgatgtcccccagcggaaatccacagctcgactccaagttctcgaaccagggtaaacaggggggctcagcctcccagtcacagccgtccccgtgcgacagtaaatccgggggacatacacctaaggcccttccaggccccggcggctctatggggttgaaaaatggtgcagggaatggcgctaaaggcaagggaaaacgggagagaagtatctccgctgactcttttgaccagcgagaccctgggactcccaacgatgattcagatataaaggaatgtaactctgccgaccatatcaaaagccaggacagccaacacaccccccacagcatgacccccagcaacgccacagcgccgaggtcctcaacgccaagtcatggccagaccaccgccactgaacctacacctgctcaaaagactccagctaaggtggtttatgtgttctccaccgaaatggccaacaaggccgcagaggcagtcctgaagggccaagttgagaccattgtgagtttccacatacagaacatttctaacaacaagacagagagatctactgcaccactcaatacccagatctccgccttgaggaatgacccaaagcccttgccccagcagccacccgcccctgctaaccaggatcagaacagttcccagaacacgcggttgcaacccacgccgcctatcccagccccagctccaaaacccgctgccccgcccagacctctcgatagggagtcccccggagtggagaataaactgatcccatcagtcgggagtcctgcttcctctacacccttgcccccagatgggactggccccaacagcacccccaataacagggccgttacgcccgtatcccagggctctaactcctcaagcgccgatcctaaggctccgccccctcctccagtctctagtggcgagccccctactcttggcgaaaatcccgacgggcttagccaagagcagctagagcaccgcgaacgaagtttacagactttgcgggatattcagcggatgctcttcccagatgagaaagaattcacaggtgcacagagcggtggacctcaacagaaccctggagtcctcgatggtccacaaaaaaaacctgagggtccaattcaggcaatgatggcccagtctcagagcctcggcaagggacctgggcccagaactgatgtcggggctcccttcggcccacagggacaccgagatgtgccgttctcacctgatgagatggtgcctccctctatgaacagtcagtctgggactattggacccgatcatttggaccacatgacaccagagcaaatagcttggctcaaattgcagcaggaattctacgaggagaagaggcgaaaacaggaacaggtagtcgtccaacagtgcagcctccaggatatgatggtccaccagcacgggcctcgtggggtagtgaggggaccacctcctccttatcagatgactccatcggagggctgggcgcccggtggaacagagcccttctctgacggcatcaacatgccacattccttgcctcctcgggggatggccccacacccaaacatgcctggaagccagatgcgtctgcccggattcgctggaatgattaactctgagatggagggacccaacgtgcccaatccagcctcaagacccggtctgtctggcgtcagctggcctgacgatgtaccaaaaattcccgacggacggaactttccgccaggccagggcatctttagcggccctggccggggtgagaggttcccaaatcctcagggcctgtccgaggaaatgtttcagcagcagctggccgagaagcagctgggcttgccgccgggaatggccatggagggtatacgtccaagcatggagatgaacagaatgatcccaggcagccagagacacatggagcccggcaacaacccgatctttcctagaatccctgtggagggtcccctctccccaagcagaggggactttcctaagggcatccccccccaaatgggccccggccgtgaattagagtttgggatggtcccgagcggcatgaagggagacgtgaatttgaacgtcaacatgggcagcaatagccagatgattccccagaaaatgagggaggccggcgccggccccgaggagatgctgaaactgcggcccgggggctctgatatgctgcccgcccaacagaagatggtacccctcccattcggagagcacccacaacaggagtatggaatgggacctaggccttttctccctatgtcacagggaccagggtctaactcaggcctccgcaatcttagagagcccatcggacccgaccagagaaccaactcgaggctctctcatatgccacccctgcccctgaatccctcgtccaacccaacatcattgaataccgctccccccgtgcagagagggcttgggagaaagccccttgacataagcgtggctggtagtcaggtgcatagccccggcatcaatcccttgaaatcacctaccatgcaccaggtccagtcaccgatgctcggttcgccttcaggtaatttgaaaagcccccagaccccaagccagctggccggtatgctcgcaggaccggccgcagcagcttcaatcaaaagcccccctgtgcttggttccgcagccgcctctccagttcatctgaaatcgcctagcctgcccgccccctcccccgggtggacatcctcgccgaagccccctctgcagtcccctggaatcccaccgaatcataaggcccctctcaccatggcctcaccggccatgctgggtaatgtagaaagtggtggaccgccacctccgactgccagccagcccgcttccgtcaacattcccggatcgctcccaagttccaccccctacaccatgccaccagaaccaacactgtcccaaaatcccctgagcatcatgatgagcaggatgagtaaattcgctatgccctcttccacacccttataccacgatgctatcaagaccgtagcttcatctgacgacgatagtccaccggcaagatctcccaatctgccatctatgaacaatatgcctgggatgggcataaacacccagaaccctagaatctccgggccgaatccagtggtgccaatgccaactctcagccctatgggcatgacccagccactgtcccattcaaatcagatgccgtcgcccaatgcagtcggccctaatattcctcctcacggcgtccccatgggtcccggccttatgtcacacaatcctatcatgggtcacggctctcaggagccacctatggttccgcagggacgtatgggattcccacaaggcttcccgccagtgcagagtccacctcaacaggtgccttttccccacaatgggccctccggcggccaaggctcattccctggagggatgggcttccccggggaaggccctctgggcaggccatcaaacctgccacagtcttccgccgacgcagcactgtgcaaaccaggtgggccaggcgggcccgacagctttaccgtactgggtaactccatgccatccgtgtttacggatccagacctgcaggaagtgattaggcctggcgctacagggataccggaattcgatttgagccgcataatccccagcgagaagccttcccagacactacagtacttccctagaggcgaagtaccaggacgcaagcagccacagggcccaggccctggtttctcacatatgcaggggatgatgggagaacaggccccacgtatgggtcttgccttaccaggcatgggcggaccaggtcctgttggtacacctgatattcctttggggaccgccccgagcatgccagggcacaatcccatgcgacctcctgcatttttgcagcaaggaatgatgggcccacaccataggatgatgagccccgctcaatccacgatgcctggacagccaaccctaatgagtaaccccgctgcagccgtgggaatgatccctgggaaagatagaggtcctgccggactgtacacacacccagggcctgtgggaagccctggaatgatgatgtctatgcagggcatgatgggaccgcaacagaacatcatgatacccccgcagatgcggccccgcggcatggctgcagatgtggggatgggcggcttctcccagggccctggaaatccagggaatatgatgttttag

SEQ ID NO: 209996 - DNA, 1221 bp, Artificial Sequence
  Description of Artificial Sequence: Synthetic coding sequence
atgagcggctgccccttcctgggcaacaacttcggctacaccttcaagaagctccccgttgagggaagcgaggaggacaagtcccagactggcgtaaaccgcgctagtaaaggcgggctcatctatggtaattacctgcacctcgagaaggtccttaacgcacaagagttgcaaagcgaaactaagggcaataagatccatgatgaacacttgtttatcatcacacatcaggcgtatgagttatggttcaaacagattctgtgggagctggactctgtgcgagagatctttcagaatgggcatgtccgggacgagaggaacatgttgaaagtggtgtcccgaatgcacagggtgagcgtcatactcaaattgctggtgcagcagtttagtatacttgaaacaatgacagcgctggatttcaacgactttcgggagtacctatctcccgccagtggcttccagtctcttcagttccggctccttgagaacaaaatcggcgttctccaaaatatgcgagtcccatataacaggcgacattacagagacaattttaaaggagaggaaaacgaactcctactcaagtcggagcaagaaaagacactcctggagcttgttgaggcctggctggagagaaccccagggctcgaaccacatggattcaacttctgggggaagctggagaagaatattactagaggcctcgaggaagaatttattaggattcaggccaaggaggagagtgaggaaaaagaagagcaggtggcagaatttcagaagcagaaggaagtcttgttaagcctgtttgacgagaaaagacatgaacatctcctcagcaagggcgagcggcgactgagctatcgagcgctccagggcgcactcatgatatatttctaccgcgaagagccgcggtttcaggttccattccagctgctgaccagcttaatggacatcgattccctcatgaccaaatggaggtacaaccacgtctgtatggtacatcgaatgctgggctccaaagccggaaccgggggcagcagcggctaccattatctccgttccacagtgtctgacaggtacaaagtgttcgtggacctatttaatctaagcacatatctgatccctcggcactggatcccaaaaatgaatcccacgatacacaagttcctgtacacagccgagtattgtgattcttcctacttctcctctgacgagtccgattag

SEQ ID NO: 209997 - DNA, 1335 bp, Artificial Sequence
  Description of Artificial Sequence: Synthetic coding sequence
atgatcgaggacaacaaggagaacaaggaccacagcctggagcgggggcgggcctccttaatattttcgctgaagaacgaagtaggtgggctgatcaaggctctcaagatcttccaggagaagcacgtcaacctcttacacatcgaatcgcggaagtctaaaaggagaaatagcgagtttgaaatttttgtcgactgtgacattaatagggaacagctcaatgatatattccatcttctcaagagccatacaaatgtcctctcggtaaacttgcccgataactttactctgaaagaagacgggatggagaccgttccctggttccctaagaagatcagtgacttagaccattgcgccaaccgcgtgctcatgtatggtagcgagctggacgccgaccaccctgggtttaaagacaacgtgtatcgcaaacgtcgaaaatactttgcagacctagcaatgaactataaacatggtgacccaatcccaaaggtggagttcaccgaagaagaaattaagacttgggggacggtattccaagagctcaacaaactgtacccaacccacgcatgccgggagtacctcaaaaaccttccccttctttcgaagtactgtgggtatcgggaagacaacatcccccagctcgaggacgtaagtaacttcctcaaggagcggactgggttctctatccgtcctgtcgccggctacctgagtcccagggacttcctgtctgggctcgccttccgagtttttcactgcacccagtacgttcgacattcatctgatcccttctacaccccagagcccgacacttgccatgaactactggggcatgtgcccctcctcgcggaaccgtccttcgcacaattttcccaggaaatcggcctcgcaagtcttggagccagcgaggaagccgtccagaagttagccacatgttacttctttacagtggagttcggcttatgcaaacaagatggccaattgagggtgttcggggccggcttactgtcttccatatctgaactcaaacatgctctttccgggcatgccaaggttaaacctttcgaccctaagattacgtgtaagcaggaatgcctcattacaacattccaggacgtgtatttcgtctccgagagcttcgaagatgctaaggagaagatgagggagtttacaaagacgataaagagaccttttggtgtgaaatataatccttacactagaagcatccagatcctgaaagacactaagtcaattacttctgccatgaacgaactgcagcacgacttggatgtggtgtcagatgcacttgccaaggtgagtcgcaagccttccatttag

SEQ ID NO: 209998 - DNA, 1401 bp, Artificial Sequence
  Description of Artificial Sequence: Synthetic coding sequence
atgatcgaggacaacaaggagaacaaggaccacagcctggagcgggggcgggcctccctcatcttctccctgaaaaacgaggtgggtgggttgatcaaggcactcaaaatcttccaggagaaacatgtgaatcttctccatatcgaatcaagaaagtctaaaagaaggaatagcgaattcgaaatatttgtggattgcgatataaatcgagagcagctgaacgacatcttccacctccttaagtcccacacaaatgttttgagtgtcaatttgcccgacaacttcactctgaaggaggacggcatggaaacagtcccctggtttccgaagaagatatccgacctggaccactgtgccaatcgggtgctgatgtatgggagtgagctcgatgccgaccatcccgggtttaaggataacgtctaccgaaagagaagaaagtactttgccgatcttgctatgaattacaaacatggtgaccctattccgaaagttgagttcaccgaagaggagattaaaacatggggcactgtcttccaagaactgaataagctctaccccacccacgcatgtcgcgaatacctgaagaacctgcctctgcttagcaagtattgtggctacagggaagataatatcccacagctggaagacgtgagtaattttctcaaggagcgcaccggcttttctatccggcccgtagccggttatctgagcccacgggacttcctatccggactagcgtttagggtgttccactgcacccaatatgtccgacactcctcggaccctttctacaccccagagcctgacacttgccacgagctgctcgggcatgtaccccttttagcagaaccctccttcgcccagttctctcaggagatcggcctggccagccttggagcatctgaggaggccgttcagaaactggccacctgttacttcttcacagtcgaattcggtctgtgcaagcaagacggccagttgagggtgttcggagctggcttgctgtcttcaatctctgagctcaaacacgctttgagtggtcacgccaaggtcaagccctttgatcccaaaatcacgtgcaaacaggagtgtctcatcacaacatttcaggacgtgtacttcgtctccgaatcctttgaggacgccaaagagaaaatgcgtgagtttacaaagactataaaacgtccttttggagtgaagtacaacccttacactagaagtatacagatactcaaggataccaaaagcatcacaagtgccatgaacgagctccaacatgatctggacgttgtctctgacgcattggccaagtccttgaatgaggatgtactccaggtgtcagtatttgctctgctgttatttctgcctagcctccacggagagtgtcaccctgacacttag

SEQ ID NO: 209999 - DNA, 753 bp, Artificial Sequence
  Description of Artificial Sequence: Synthetic coding sequence
atgcagcccgccatgatgatgttcagcagcaagtactgggcccggagaggcttcagcctagattctgccgtgccggaagagcatcaactcctgggtagcagcacacttaataagcctaattccggaaagaacgacgacaaaggcaataaagggtcgtctaagagagaagctgcaacagaaagcggtaagacagctgtcgtcttctccctcaagaacgaggtggggggattggtgaaggcgttaaggctcttccaggagaaacgagtcaacatggtacacatcgaatccaggaaatcccgtcgacgctctagcgaagtagaaatcttcgttgattgcgagtgcggaaaaactgaatttaacgaacttattcagctgttaaagtttcagacaacaattgtaaccctcaatccccctgagaacatctggacggaagaggaggaactggaagatgtgccctggtttccccgcaagatttccgaactggataagtgttctcatagagtcctgatgtatgggtccgagctggatgccgatcaccctggatttaaggacaacgtgtaccgccaacgccgcaagtacttcgtagatgtggccatgggctacaaatacggccctaggcttctcgccgcaattggtgactgggagttccagctgttttccgtaagctcatccctgtctagtagcagtttgtgcatgctgagcgtgcacatccttatggacgtgcggtcaatcgtcgtggctgtggacatctag

SEQ ID NO: 210000 - DNA, 1473 bp, Artificial Sequence
  Description of Artificial Sequence: Synthetic coding sequence
atgcagcccgccatgatgatgttcagcagcaagtactgggcccggaggggcttctccctagactcagcagttcccgaggagcaccagcttctcggctccagtacactgaataagccgaactctggaaagaatgatgacaaggggaacaaggggtccagtaagcgagaggcagcaaccgaaagtggaaagacagcagtggtgttctcactgaaaaacgaggttggcggactcgtgaaagctctcagactgttccaggagaagcgggtgaacatggtgcatattgaaagccgcaagtcccgccggaggagttcggaggtggagattttcgtggactgtgaatgtggaaagactgagtttaacgaacttatccagctgctgaagtttcagactaccattgtgacactgaatccacccgagaacatctggaccgaggaggaggaactcgaggatgtaccttggtttccgagaaagatctcagaacttgacaaatgctcacatcgcgtactgatgtacggttcagaattggacgccgaccaccctggattcaaagataacgtgtaccggcagaggagaaagtattttgtggatgtagccatgggatataagtatggccagcccattcctcgggtggaatataccgaggaagagacaaagacttggggcgtcgtgtttcgcgagctgtctaaattgtatcctacacatgcttgtcgtgagtatctgaagaacttcccacttctcacaaagtattgcggatatcgtgaggataacgtaccgcagctcgaggatgtatccatgttcctaaaggaacgcagcgggttcactgtgcggcctgtagccgggtatttaagtcctagggactttttagcgggtttggcttacagagtcttccactgcactcagtatatccgccacggttccgaccccctatataccccagagcctgacacatgccacgagctgctgggccatgttccgcttcttgccgatcccaagttcgcacaattcagccaggagataggtctagcaagcctcggtgcctcggatgaggacgtgcagaagctggctacctgttacttctttacaatcgaattcggattatgtaagcaggagggccagctccgcgcatacggcgccggactgttgtcatctattggcgaactgaagcatgctcttagtgataaggcttgtgttaaggcatttgacccaaagacaacttgtctgcaggaatgccttatcacgacttttcaagaagcctattttgtctcggagtcttttgaagaggccaaggagaagatgcgcgattttgccaagtctatcacccggccattctcagtgtacttcaatccctatactcaatctattgagattttaaaggatacaaggtcaatagaaaacgtggtgcaggatctaagatctgacctcaatactgtgtgtgacgctttaaacaaaatgaatcaatacctgggaatctag

SEQ ID NO: 210001 - DNA, 525 bp, Artificial Sequence
  Description of Artificial Sequence: Synthetic coding sequence
atgagcagcgccgccgccgaccactgggcctggctgctggtgctgagctttgtgtttggctgtaatgtgttacgcattctattgccgtcattttctagctttatgagccgcgtgctccagaaggatgctgagcaggaatcacaaatgcgggcagagatccaggacatgaagcaggaactgtctacggtcaatatgatggacgaatttgctcggtacgctaggctcgaacggaaaatcaacaagatgaccgacaagctgaagacccacgttaaggccaggacagcccaactagccaaaattaagtgggtaatcagcgtggctttttatgtcctgcaggccgctctgatgattagcctgatttggaagtattattctgtgccagtagcggttgtcccatccaagtggatcactccattagatagattagtggcattcccaacccgagtggccgggggtgtgggcattacctgttggatcctggtctgtaacaaagtcgtggccattgtccttcaccccttttcctag

SEQ ID NO: 210002 - DNA, 423 bp, Artificial Sequence
  Description of Artificial Sequence: Synthetic coding sequence
atgagccgggtgctgcagaaggacgccgagcaggagagccagatgcgtgcagagatccaggacatgaagcaggagttgtctacagtaaatatgatggatgaattcgcacgttatgcaagactagaaagaaaaatcaacaagatgaccgataaactgaagactcacgtcaaagctcggacagcacagttagctaaaatcaaatgggtgatttccgtggccttctatgtgttacaggctgccttgatgatctctcttatctggaagtattactcagtgcccgttgcagttgtccctagcaaatggatcaccccactggatagactcgtagccttccctacgcgggtggccggcggcgtgggtatcacatgttggatactcgtttgtaacaaagtggtagccatcgtgctgcatcccttcagttag

SEQ ID NO: 210003 - DNA, 423 bp, Artificial Sequence
  Description of Artificial Sequence: Synthetic coding sequence
atgagccgggtgctgcagaaggacgccgagcaggagagccagatgcgggccgagatccaggacatgaagcaggagttaagtactgttaacatgatggacgagttcgctcggtacgctcggctggagagaaagatcaataagatgaccgacaaactgaaaacccatgtcaaggcccgcactgcacaattggctaagataaaatgggtgataagtgtggcattttacgtacttcaggctgcactcatgattagcctcatctggaagtactatagcgtccctgtggccgtcgtgcctagcaaatggatcacgcctttggacagactcgtagcatttcccacccgggtggcaggcggagtaggtatcacgtgttggattctggtttgcaataaggtagtagctatagtgctgcatcctttttcctag

SEQ ID NO: 210004 - DNA, 519 bp, Artificial Sequence
  Description of Artificial Sequence: Synthetic coding sequence
atgagcagcgccgccgccgaccactgggcctggctgctggtgctgagtttcgtgtttgggtgtaacgtgctcaggattctgctgccttcattcagcagtttcatgtccagagtattacaaaaggatgccgagcaggaatctcagatgagagccgaaatccaggatatgaaacaggagctgagtaccgtgaacatgatggacgagtttgctagatacgcgagactcgagaggaagataaataagatgaccgacaagctgaagacccacgtgaaggctcgcactgcccaactggcaaagatcaagtgggtgatatccgtcgcgttttatgtgctccaggccgctctcatgatatccctgatatggaaatattacagcgtgccagttgccgtcgtgccctcaaagtggattactcccttggatcgccttgtcgctttcccaacgcgtgtggctgttttctcatcaagtatatggaccagcaaatgttttagtagtccggacaaatcaattctcgagaagtag

SEQ ID NO: 210005 - DNA, 1083 bp, Artificial Sequence
  Description of Artificial Sequence: Synthetic coding sequence
atggccctgcacagcatgcggaaggcccgggagcggtggagcttcatcagagccctccataagggtagtgccgccgcaccggcccttcaaaaggactctaagaaaagagttttctcaggaatccagcccactggcattctccatctagggaactacctgggagccattgaatcatgggtgcgcctccaggacgagtacgatagcgtgctgtatagcatagtggacctccactccattaccgtgccacaggatccggctgtactgcgacagagtattctggacatgacagcagtcctccttgcatgtggcatcaatccagaaaagtccatcctgtttcagcagtcacaagtcagcgagcacacccagctttcatggattctcagttgcatggttaggctgcccaggttgcagcacctgcaccagtggaaagccaagaccactaaacaaaagcacgatggcacagtcgggttactaacataccccgtgctgcaggctgcggacattcttctgtataagtcaacccatgtgccagtcggcgaggaccaagtacaacatatggagttagtgcaagacctggcgcagggttttaacaaaaagtacggcgaattcttcccagtgcccgagtcaatcctcacatcgatgaagaaggtgaaaagcctgagggatcccagtgccaagatgtccaagtcagacccagataagctggctactgtgaggatcaccgattcgcctgaggaaatcgttcaaaaatttaggaaagccgtgacagatttcacgagcgaagtcacctacgatccagccgggagggccggagtttcaaacatcgtggcggtgcacgccgcagtgacaggactctcagttgaggaggtcgttaggcgaagcgctggtatgaataccgcccgatacaagctcgccgtagctgacgccgttatcgagaagtttgcccccatcaaacgggagatcgagaagttgaagctggataaagatcacctggagaaggtgctacagattggcagcgcaaaagccaaggagcttgcctataccgtctgccaggaggtcaagaaactggtcggtttcctgtag

SEQ ID NO: 210006 - DNA, 663 bp, Artificial Sequence
  Description of Artificial Sequence: Synthetic coding sequence
atggccctgcacagcatgcggaaggcccgggagcggtggagcttcatccgagcactccataaaggctcagccgccgcccccgccctccaaaaagactcaaaaaagcgagtatttagtggaatccagcccacaggtattctacatctaggcaattacttgggcgctatcgagtcctgggtgaggctgcaggatgaatatgacagcgtgctgtattccatcgtggatctccactccattaccgtgcctcaagatcctgcagtgttgaggcagtcgattctcgacatgactgctgtgctactcgcttgcggcatcaatcccgagaagtccatcctatttcagcagtctcaggtgagtgaacacactcagttgtcgtggattctgtcttgcatggtccgactacccagacttcagcacctccatcaatggaaggcaaagaccaccaaacagaaacatgatggaaccgtgggacttttgacttatccagtactccaagccgctgatatattgctgtataagtccacccatgtcccagtcggcgaggatcaagtacagcatatggagctggttcaggacctggcacagggcttcaacaagaagtatggggagtttttcccagttcccgaaagcatccttagcatgtgtgtcctagtattcttgacatag

SEQ ID NO: 210007 - DNA, 801 bp, Artificial Sequence
  Description of Artificial Sequence: Synthetic coding sequence
atgaccgccgtgctgctggcctgcggcatcaaccccgagaagagcatcctgtttcaacaaagccaagtgtcagagcatacccagctatcctggattctatcttgtatggtcaggctgccacgcctgcagcatcttcatcaatggaaggcaaaaacgacgaaacagaagcatgacggcacagtgggactgctgacctacccggtgctgcaggcggccgacattttgctgtataaatctactcacgtacctgtgggcgaagatcaagttcagcacatggaactggtgcaggacttggctcaagggttcaataagaagtacggcgagttctttcccgtccctgagtctatcttgacatccatgaagaaggtgaagagtcttcgggatcctagtgccaaaatgagcaagtcggaccccgataagctcgccactgtgcgtatcaccgatagccctgaagaaatagtccagaagtttaggaaagctgtgactgactttacaagcgaggtgacttatgaccctgctggcagggcaggagtttcaaacattgttgcagttcacgcagccgtcacagggctctcagtggaagaagtggtacggagaagcgccggcatgaacacagcgagatataagctcgcagtggccgacgctgtgatagaaaaattcgcacctataaagagagaaatcgagaaattaaagcttgacaaagatcaccttgagaaagtgcttcagattggaagcgctaaggccaaggaattggcttacaccgtgtgccaggaggtgaagaagttggtgggattcctctag

SEQ ID NO: 210008 - DNA, 1293 bp, Artificial Sequence
  Description of Artificial Sequence: Synthetic coding sequence
atgctggtgagcctgaagatgagctacaaggccgccgccggcgaggactataaagctgactgtcctccgggcaacccagcacccacatctaatcatgggccggacgcaaccgaagctgaggaggactttgtggatccttggaccgtgcagacctcatccgctaaaggaattgactacgacaaactgatcgtcagattcggctcttctaaaatagacaaagagctgataaaccggatcgaacgggcgacaggccaacgtccccatcatttcctccggagagggatcttcttttcacaccgcgatatgaaccaggtccttgacgcttatgagaacaaaaaacctttttacttgtacactggccggggaccgtcatccgaagccatgcacgtgggtcacctgatcccctttattttcaccaagtggctgcaggacgtctttaacgtgcccctggttatccaaatgaccgacgatgagaagtatttgtggaaggacctgaccctggatcaggcttattcttatgcagtggaaaacgcaaaggacattatcgcatgcggtttcgatataaacaaaactttcatctttagcgatctagattacatgggcatgtcttctggattctacaagaatgttgtcaaaatacagaagcacgtgacttttaatcaggtgaaaggtatattcgggtttaccgacagcgactgcatcgggaaaatctcattcccagccatccaggctgcaccctcgttttcaaattcatttccccaaatctttcgggatcgcaccgacatccagtgccttatcccatgcgcaatcgatcaagatccctacttccggatgacacgggacgtggccccacgaattggttaccctaagccagcattgcttcatagcacctttttccccgcccttcaaggggcccaaacaaagatgtccgcttcagatcccaacagttccatctttctgacggacaccgcaaagcagatcaagacgaaggtgaacaaacatgccttcagcgggggacgcgacacaatcgaggaacatcgacagtttggaggcaactgcgatgtggacgtgtcttttatgtatctgacttttttcctggaagatgatgataaactcgagcagatcagaaaggactacaccagcggcgccatgctgacaggggaacttaagaaggctctgatcgaggtgctgcagccactcatcgctgaacaccaggcgcggagaaaagaggtaacagacgagatcgtgaaggagttcatgaccccccgaaagctctcgtttgattttcagtag

SEQ ID NO: 210009 - DNA, 1416 bp, Artificial Sequence
  Description of Artificial Sequence: Synthetic coding sequence
atgcccaacagcgagcccgccagcctgctggagctgttcaacagcatagccactcagggagagttggtaagaagtctcaaggctggcaatgccagcaaggacgagattgactccgcggtaaagatgctggtgtctttgaagatgagttataaggcagcagccggagaggactacaaggcagattgtcccccaggcaacccggctcctacgtccaaccacggtccagacgctactgaggcagaagaggactttgtggacccctggactgtacagacctcctccgctaagggtattgattacgacaaactcattgtacgctttgggtcttcaaaaatcgataaggagctgattaacagaattgaacgtgccactggacaacgaccacaccactttttgcgaagggggatcttcttctctcacagggacatgaaccaggtgttagatgcatacgagaataaaaagccattctacctgtatactgggagaggtcccagctccgaagcaatgcacgtgggacacctgattcctttcatctttacaaaatggcttcaggatgtgtttaatgttccacttgtgatacagatgacggacgacgagaagtatctatggaaggatctgactctcgatcaggcttattcctacgcggtggagaatgccaaggatatcatagcctgcggctttgacatcaacaagacattcatctttagtgacctcgattacatggggatgtcctcaggtttctataagaacgttgtaaaaatccagaaacacgtcacgttcaatcaggttaaaggtatatttggctttacggattcagattgcattgggaaaatctctttcccagccattcaggcggctcccagcttctctaacagctttccacagattttcagagacaggaccgacatccaatgtctgataccctgcgcaatcgatcaagacccatactttcgaatgaccagagacgtcgctccccgcataggctatccaaagcccgccctactgcactccacctttttcccggccttacaaggcgctcagacgaaaatgagtgcttctgacccaaatagctccattttcctcaccgatacagcaaagcagattaagacaaaggtgaataagcatgctttctccggcgggagagacacaattgaagaacatagacagttcggaggtaactgcgacgtcgacgtgagcttcatgtatttgacttttttcctcgaagacgatgacaagctggaacagattcgaaaggattacactagtggtgcgatgctgacaggagagctaaagaaggcactcatagaagttctccagcccctaatcgccgagcaccaagctagacggaaggaagtgacagatgagattgtgaaggagtttatgacaccgcgcaaactatcctttgacttccagtag

SEQ ID NO: 210010 - DNA, 1293 bp, Artificial Sequence
  Description of Artificial Sequence: Synthetic coding sequence
atgctggtgagcctgaagatgagctacaaggccgccgccggcgaggactacaaggctgactgtccccctggaaatcccgctccaacttctaatcacggccctgatgcaacggaggccgaagaggactttgttgacccttggactgtgcagacatccagtgcgaaggggatcgattacgataaactgatagtccggtttgggagttccaagatcgataaagaactcatcaatcggattgagcgtgccactggacagaggcctcatcacttcctgagacggggaatcttttttagccaccgggatatgaatcaggtgcttgacgcatatgagaataagaagcccttttacctgtacaccgggcggggcccttcatccgaggccatgcacgtgggccatcttattcctttcatctttacaaagtggctgcaggacgtcttcaacgtgccactggtgattcagatgactgacgacgaaaagtacctatggaaggatttgactttagaccaggcctattcatacgctgttgaaaacgctaaggacattattgcatgtggattcgatatcaataaaacgtttatcttcagcgacctggactacatgggcatgtcgtcaggtttttataaaaacgtggttaaaattcagaagcacgtcaccttcaaccaggtgaagggcatcttcgggtttactgatagcgattgcattggtaagatatcttttccagcaatccaggccgctccttccttcagcaattctttcccacagatctttagagatcggaccgatattcagtgcctcatcccctgtgccatcgaccaggacccatacttcagaatgacccgggacgttgcgccccgcatcggatatcccaagcccgctctgctgcactccaccttctttccagccctccagggagcacagaccaaaatgtccgcaagtgatcccaactcttctatattcctgaccgacacagctaaacagataaaaacaaaggtgaacaagcacgccttcagcgggggccgggatacaatcgaagagcatagacagttcggcggtaattgcgacgtggacgtaagcttcatgtatctcactttcttcctggaagatgacgacaagctggagcaaattcgtaaggattacacttctggggccatgttgacaggtgagcttaaaaaggcactcatcgaagtcctgcagcccctgatcgctgagcaccaggcccgacggaaggaggtgaccgacgagatcgtgaaggaattcatgacaccccggaaattgtcatttgactttcaatag

SEQ ID NO: 210011 - DNA, 1416 bp, Artificial Sequence
  Description of Artificial Sequence: Synthetic coding sequence
atgcccaacagcgagcccgccagcctgctggagctgttcaacagcattgctacacagggggagctggttagaagcctgaaagctgggaacgccagtaaggatgagatagacagtgccgtcaagatgctagtttccctcaaaatgtcctataaagctgccgcgggcgaggactataaagcggattgccctcccggaaatcctgccccaacaagcaaccacggcccagacgctactgaggccgaggaagacttcgttgacccttggacggtacagactagttcggctaagggaatcgattacgacaaactcatcgtgcggtttgggagcagcaagattgacaaggaactcatcaatcggatcgagcgagccactggccagcgaccgcaccatttcctgcggcgaggcatcttcttctctcacagggacatgaatcaagtcttggacgcttatgagaacaaaaaacctttctatctgtacacaggccgcggaccgagctccgaggctatgcatgtgggccaccttatacccttcatcttcactaagtggctgcaggatgtcttcaacgtgcccctcgtcattcaaatgactgatgatgagaagtacctctggaaggatctgacacttgaccaagcctattcttatgcagtggaaaatgccaaagatatcatagcatgtggcttcgatataaacaagacttttattttcagtgacctggattatatgggcatgtcatccggcttttataagaacgtcgtgaaaatacagaagcacgtgacctttaaccaggtgaaggggatatttggctttaccgattccgattgcattggcaagatttcattcccagctattcaggctgctccttccttttccaacagtttccctcagatcttccgagaccggactgacatccagtgtctgattccttgcgctattgatcaggacccatattttagaatgacaagggatgttgcccctcgaataggttatccgaagcccgcgcttctgcactctacgtttttccctgccctgcagggagctcagaccaagatgagtgcgtccgatcccaattcttcgatcttcttgacggatacagctaagcaaatcaaaactaaggtcaacaagcacgccttttccgggggccgcgacacaatcgaggagcatagacaatttggaggcaactgtgacgtggacgtatcgtttatgtacctgacattttttcttgaggatgacgacaagctggagcagatccggaaagattacacaagcggagcaatgctgactggcgaattaaagaaggccctgattgaggttctccaacctttgatagctgagcaccaagctagaaggaaggaggtcaccgacgagatcgttaaggagtttatgacgcctagaaaactttcattcgatttccaatag

SEQ ID NO: 210012 - DNA, 684 bp, Artificial Sequence
  Description of Artificial Sequence: Synthetic coding sequence
atgctggtgagcctgaagatgagctacaaggccgccgccggcgaggactacaaggctgactgccctcctggtaatcccgcccctacatccaaccacgggcctgacgctaccgaggcagaggaggatttcgtggacccatggacagtgcagacttcatcagccaagggtatcgactacgataaactgattgtcagatttggctctagcaagatcgacaaggagcttatcaatagaatagagagagccaccggccagagacctcatcatttccttaggagggggattttttttagccatagagatatgaaccaagtgcttgacgcgtatgagaacaagaagccgttttacctatatactggtagggggccttcatcagaagccatgcatgttggtcaccttattccgtttatttttaccaagtggcttcaagatgtgttcaacgttcccctagtcatccagatgaccgatgacgagaagtatctgtggaaagacttgaccctggaccaggcatactcatatgccgtcgaaaacgctaaggatattattgcctgcggcttcgatatcaataagacattcatcttcagcgacctggactatatgggcatgagcagcgggttctacaaaaatgtcgttaaaattcagaaacacgtaacgtttaatcaagtcaagggcattttcggatag

SEQ ID NO: 210013 - DNA, 324 bp, Artificial Sequence
  Description of Artificial Sequence: Synthetic coding sequence
atgcccaacagcgagcccgccagcctgctggagctgttcaacagcattgccacacaaggcgagctagtgcgatcactgaaggcgggaaatgcatcaaaagacgagattgactcagctgttaagatgctggtgtcgcttaagatgtcatataaggccgcggcaggcgaagactataaggccgactgcccacctggaaatcccgccccaacatctaatcatggtcctgacgcaacggaagctgaagaggactttgtcgacccatggaccgtgcaaactagctctgccaagggcatcgattacgataagctgatagttaggttttag

SEQ ID NO: 210014 - DNA, 453 bp, Artificial Sequence
  Description of Artificial Sequence: Synthetic coding sequence
atgcccaacagcgagcccgccagcctgctggagctgttcaacagcattgccactcagggggaactggttcgctcactgaaggcgggcaatgccagtaaggacgaaatagatagcgcggtcaagatgttggtgtccctcaagatgagttacaaggctgccgctggcgaggattacaaggccgactgcccccctggcaacccagcgcccacttcgaaccatggccccgatgccactgaagctgaagaagactttgttgacccatggacggtgcaaaccagtagtgccaaggggatcgactatgacaagctgattgtccgctttggaagttccaaaattgacaaggaactcattaaccgtatcgagcgcgctactgggcagaggccacaccattttctccggagaggaattttttttagccatcgcgatatgaatcaggtgctggacgcctactag

SEQ ID NO: 210015 - DNA, 294 bp, Artificial Sequence
  Description of Artificial Sequence: Synthetic coding sequence
atgcccaacagcgagcccgccagcctgctggagctgttcaacagcatcgcaacacagggtgaattggttaggagcctcaaagcagggaacgcttccaaagatgagatcgattccgccgtaaaaatgctcgtcagcctcaagatgagctacaaggctgcagccggagaagattacaaggctgattgccctccaggtaaccccgccccgacctccaatcacggaccagacgccaccgaggcagaggaggacttcgtcgacccatggacagtacagacatcctctgctaagggctag

SEQ ID NO: 210016 - DNA, 81 bp, Artificial Sequence
  Description of Artificial Sequence: Synthetic coding sequence
atgcccaacagcgagcccgccagcctgctggagctgttcaacagcattgccacccaaggtgagctcgtgcgctccctctag

SEQ ID NO: 210017 - DNA, 318 bp, Artificial Sequence
  Description of Artificial Sequence: Synthetic coding sequence
atgcccaacagcgagcccgccagcctgctggagctgttcaacagcatcgcgactcagggtgaactcgtacgctccttaaaagcagggaacgcatcaaaggacgaaattgattccgctgtcaaaatgttggtgagcctaaaaatgtcgtataaggcagccgccggagaggactataaagctgattgcccccctggcaaccccgcgccaacctccaatcacggccctgacgccacagaggctgaagaagacttcgtcgatccatggaccgtccagacgtcctccgccaaggggatcgactatgataaactcattgtctag

SEQ ID NO: 210018 - DNA, 102 bp, Artificial Sequence
  Description of Artificial Sequence: Synthetic coding sequence
atgcccaacagcgagcccgccagcctgctggagctgttcaacagcatcgcaacccagggggagctggtgaggagcctgaaggctggaaacgcgagtaagtag

SEQ ID NO: 210019 - DNA, 207 bp, Artificial Sequence
  Description of Artificial Sequence: Synthetic coding sequence
atgcccaacagcgagcccgccagcctgctggagctgttcaacagcattgccacccagggggaactcgtgcgatccctgaaggcgggcaatgcatccaaggatgagattgattcagcggttaagatgctggtgagcctgaagatgtcatacaaggctgctgcaggtgaggattacaaagccgactgcccgcctggaaaccccgcatag

SEQ ID NO: 210020 - DNA, 375 bp, Artificial Sequence
  Description of Artificial Sequence: Synthetic coding sequence
atgcccaacagcgagcccgccagcctgctggagctgttcaacagcatcgcgactcaaggcgagttggtgaggtcactgaaagccggcaatgcctccaaggatgaaatcgattccgctgtcaaaatgctggtaagtcttaaaatgtcttataaagcagcggccggtgaagactataaggcagattgccccccaggcaatccggccccaacctctaaccatggtcccgatgcaacggaagcggaagaggactttgttgatccgtggacagtccaaacgtccagcgctaagggaatcgattatgataagttgattgtaagattcggttccagcaagatagacaaagagctaatcaaccggatcgagagagccacatag

SEQ ID NO: 210021 - DNA, 261 bp, Artificial Sequence
  Description of Artificial Sequence: Synthetic coding sequence
atgcccaacagcgagcccgccagcctgctggagctgttcaacagcatcgccacgcagggagagctagtgcgcagtctcaaggccggcaacgcgagcaaggacgagatcgatagcgcggtgaaaatgctggtttctctcaagatgagttataaggccgccgccggggaggactataaagcagactgtccccccgggaatccggcccccacctctaatcacggcccagatgctacggaggccgaggaggacttcgtggattag

SEQ ID NO: 210022 - DNA, 168 bp, Artificial Sequence
  Description of Artificial Sequence: Synthetic coding sequence
atgcccaacagcgagcccgccagcctgctggagctgttcaacagcattgctacccagggggagctggtgcgatccctcaaggccggcaatgctagcaaggatgaaatagatagcgccgtgaaaatgctggtgtcgctaaaaatgtcctataaggccgccgcaggctag

SEQ ID NO: 210023 - DNA, 192 bp, Artificial Sequence
  Description of Artificial Sequence: Synthetic coding sequence
atgcccaacagcgagcccgccagcctgctggagctgttcaacagcattgccacccagggcgagttagtgcgatccctgaaagcgggtaacgcaagcaaggacgagattgatagtgccgtaaagatgctagtttcgctaaagatgagctacaaagctgcagccggagaagactacaaggcggactgtccctag

SEQ ID NO: 210024 - DNA, 213 bp, Artificial Sequence
  Description of Artificial Sequence: Synthetic coding sequence
atgcccaacagcgagcccgccagcctgctggagctgttcaacagcatcgccacacagggggaactggtcagaagcctgaaggctggaaatgccagcaaggatgagattgactcagcagtgaaaatgttggtaagcctgaagatgtcctataaagccgccgccggagaagattacaaggctgactgtccacctggaaatcctgcacctacgtag

SEQ ID NO: 210025 - DNA, 177 bp, Artificial Sequence
  Description of Artificial Sequence: Synthetic coding sequence
atgcccaacagcgagcccgccagcctgctggagctgttcaacagcatcgctacccagggagagctggtgcggtcactgaaggctggaaacgcctctaaggacgaaattgacagcgccgtgaagatgcttgtctctctgaagatgagctataaggcagccgctggggaggattactag

SEQ ID NO: 210026 - DNA, 423 bp, Artificial Sequence
  Description of Artificial Sequence: Synthetic coding sequence
atgctggtgagcctgaagatgagctacaaggccgccgccggcgaggattataaggctgactgtccccccggaaatcccgcccccactagcaatcacgggcctgatgctaccgaagctgaggaggactttgtggacccttggacagttcagaccagcagcgccaaaggaatcgactacgacaaactcatagttcggttcggaagttctaaaatcgacaaagagctgataaaccgaatcgaaagagccaccggacagcgcccacatcactttctgcggcgtggaatatttttctcacacagagatatgaaccaggtgctcgacgcctacgaaaacaagaaacccttttatctgtacactggtcgcggaccatcaagtgaagccatgcacgtggggcatctcatacctttcatctttaccaagtag

SEQ ID NO: 210027 - DNA, 462 bp, Artificial Sequence
  Description of Artificial Sequence: Synthetic coding sequence
atgctggtgagcctgaagatgagctacaaggccgccgccggcgaggactataaggctgattgccctcccggcaatcccgctccaaccagcaaccatggtccggacgctaccgaagctgaagaagatttcgtcgatccttggaccgtgcagacatcttccgccaaggggatcgattacgacaaactgatagttaggttcggttcctcaaagattgataaggagctcatcaacaggatcgagcgcgcgaccggccagcgacctcaccattttctgaggcgcggaatttttttctctcatagggatatgaaccaggtactggacgcctatgaaaacaagaaacctttttatttgtatactggccgtggcccatcatccgaagcaatgcatgtgggccatctgatcccattcatcttcactaagtggctgcaagatgtgttcaatgtcccactagttatccagtag

SEQ ID NO: 210028 - DNA, 675 bp, Artificial Sequence
  Description of Artificial Sequence: Synthetic coding sequence
atgctggtgagcctgaagatgagctacaaggccgccgccggcgaggattataaggccgattgtccacccggcaacccagcgcctacatctaaccatggccccgatgccaccgaagctgaagaggattttgtagatccctggacggtgcagaccagttccgccaagggcatcgattacgataaactaattgtgaggttcggctcctctaaaattgacaaagagctgataaatcgcattgagagggccaccgggcaacgcccacaccacttccttaggcgaggcatctttttctcccacagggacatgaaccaggtcttagacgcctacgagaataaaaagcccttctatctctatacaggacgaggcccttccagcgaagccatgcacgtggggcatctgattccatttattttcactaagtggctgcaggatgtgttcaatgtgcctctcgttatccagatgaccgacgatgaaaagtatctgtggaaagacctgacccttgatcaagcctacagctacgcagtcgagaatgcgaaagacatcatcgcctgcggctttgacataaataaaacattcatcttctccgaccttgattatatgggaatgtctagcggcttctacaaaaacgtggtgaaaatccaaaagcatgtcacattcaatcaggtgaaaggatag

SEQ ID NO: 210029 - DNA, 1293 bp, Artificial Sequence
  Description of Artificial Sequence: Synthetic coding sequence
atgctggtgagcctgaagatgagctacaaggccgccgccggcgaggactacaaagctgactgcccacccggtaaccccgccccaacaagtaatcatggacccgatgccaccgaagccgaagaggatttcgtcgatccctggactgtacagaccagttctgcaaagggtattgattatgacaaactgattgttcgttttggttcttctaaaattgataaggagcttatcaaccgtatagagagagctaccggtcagaggccacaccactttctccggcgcggtattttctttagtcatcgggatatgaatcaggttttggatgcctatgaaaataagaagcccttctacctatatactggcagggggccatcttctgaagcgatgcatgttggccacctaattccctttatttttactaaatggctgcaggacgtttttaatgtgccgctggtcatacaaatgactgatgacgaaaagtatctctggaaagatctgacattggatcaggcttactcttacgcagttgaaaacgccaaagatattatcgcatgcggattcgacatcaacaaaacatttatttttagtgatttggactacatgggtatgtcaagtgggttttacaagaatgttgtgaaaatccagaaacacgtgacctttaatcaggtgaaaggaatctttggctttactgactcggactgtatcggaaaaatctcctttcctgccattcaggccgcaccttcttttagcaacagctttccacagattttcagagatcggaccgacatccaatgtttaattccatgcgccattgatcaggacccttacttccgtatgactcgggacgttgctccgaggatcggatatcccaagcccgccctgcttcactctactttcttccccgctttgcagggcgcacaaacaaagatgtctgcctcagaccccaattctagcatttttttaacagacaccgcgaaacagatcaaaactaaggtgaataagcacgccttctccggtgggagggatacaattgaggaacatagacagtttggcggtaactgcgatgtcgacgtgagcttcatgtatctcacatttttcctggaagatgatgacaaattagagcagatccggaaggactacaccagcggagccatgttaacaggggagctcaaaaaggcactgattgaggtgctgcaacccttgattgctgaacaccaagcccgtagaaaggaggtcaccgacgaaattgtgaaagagttcatgacccctaggaaactgagtttcgactttcagtag

SEQ ID NO: 210030 - DNA, 345 bp, Artificial Sequence
  Description of Artificial Sequence: Synthetic coding sequence
atgcccaacagcgagcccgccagcctgctggagctgttcaacagcattgccacacaaggagagctggttcggtcactcaaagccggaaatgcatctaaagacgaaattgattccgcggttaaaatgttggtgtctttgaagatgagctataaagccgcagcaggcgaggattataaagctgattgccccccgggcaaccctgctcctacgtctaatcacgggcccgacgccacggaggcggaggaggactttgtggatccatggaccgtccaaaccagcagtgctaagggcatcgactacgacaagctgatcgtgcgctttggctcctccaagattgacaagtag

SEQ ID NO: 210031 - DNA, 177 bp, Artificial Sequence
  Description of Artificial Sequence: Synthetic coding sequence
atgcccaacagcgagcccgccagcctgctggagctgttcaacagcatcgcaacccagggagagttagtaagatcccttaaagcagggaacgctagcaaggacgaaatagattccgcagtgaagatgttagtgtcactaaaaatgtcttataaggccgccgctggcgaagattactag

SEQ ID NO: 210032 - DNA, 459 bp, Artificial Sequence
  Description of Artificial Sequence: Synthetic coding sequence
atgcccaacagcgagcccgccagcctgctggagctgttcaacagcatagcgactcaaggtgaactagttagatccctgaaggctggtaatgcatccaaagacgaaatcgactctgccgtaaagatgcttgtgtcactgaagatgagttacaaagccgccgcaggtgaagactacaaggcggattgtccaccggggaatcctgctcccacttccaatcacgggcctgatgctacagaagcagaggaggacttcgtggacccatggaccgtacagacctcttcagcaaaggggatcgactacgataagttgattgtccggtttggttccagcaagattgacaaggagctgattaatagaattgagcgcgccacagggcagagaccccatcatttccttcgtcgggggatctttttctctcatcgggatatgaatcaggtcttggatgcttacgaaaattag

SEQ ID NO: 210033 - DNA, 1416 bp, Artificial Sequence
  Description of Artificial Sequence: Synthetic coding sequence
atgcccaacagcgagcccgccagcctgctggagctgttcaacagcatcgccacccaaggggagcttgtcaggagcctcaaagcaggaaacgcaagcaaagacgaaattgactccgccgtaaaaatgctggtgtccctcaagatgtcatacaaggccgctgccggcgaagactataaggctgactgccctcccggtaaccccgccccaacttccaatcacggcccggacgccactgaggccgaggaggattttgttgacccttggaccgttcagacctcgagcgctaaaggaatcgattacgataaactaatagtgcgctttggttcatcaaaaattgacaaggaactgattaatcgaatagaaagggccacaggacagaggccacatcactttctgcgtagaggaatctttttttctcatcgggatatgaaccaggtgctcgacgcatatgaaaataagaagcccttttatctctacacaggccgcgggccgtctagcgaggctatgcatgtgggccacttgatccctttcatctttaccaagtggcttcaagacgtctttaatgtccctcttgtgattcagatgaccgatgacgaaaagtatctttggaaggatctgaccctggatcaggcctatagttatgcagtcgagaacgcaaaggatatcattgcttgcggctttgacataaacaagacttttatcttcagcgatctcgactacatgggcatgagctctggattttacaaaaatgtagttaagatccaaaaacacgtgaccttcaatcaggtaaagggtattttcgggttcacagactcagattgtatcggtaagatcagcttcccagccattcaggccgcgcctagcttctctaactcctttccacagatattcagagatagaaccgatattcagtgcctgatcccatgcgccatcgatcaagacccttatttcaggatgacccgggatgtggcccccagaatcggttacccaaagccagctctgctgcacagcacattttttccggctctgcagggggcacaaactaaaatgagcgctagcgaccctaattcatcgatcttccttactgatacagctaagcaaattaaaactaaggtaaacaaacatgctttctccggtggtcgagacacaattgaagagcatcgtcagtttggaggaaattgcgatgtggatgtttctttcatgtacctcaccttctttctggaggacgatgataaactggagcagatcagaaaggattacacctctggagcaatgttgacaggcgaactgaagaaagctcttatcgaggtgctccagccacttatcgcagagcatcaagccaggcggaaagaggtgacagacgagatcgtgaaagagttcatgacaccccgaaagctatccttcgattttcagtag

SEQ ID NO: 210034 - DNA, 465 bp, Artificial Sequence
  Description of Artificial Sequence: Synthetic coding sequence
atgctggtgagcctgaagatgagctacaaggccgccgccggcgaggattacaaagcagactgcccccctggaaatccagcacctactagcaaccatggtcctgatgccaccgaagccgaagaggactttgtcgacccctggacggtccagacctcctcggctaaaggcatcgattacgacaaactaatcgtccggttcgggtcctctaagatagataaggaactgatcaaccggatcgagagagcaacgggacagcgccctcatcatttcctcaggaggggcatcttcttttcccaccgcgacatgaatcaggtcctggatgcctatgaaaataagaagcctttctatctgtatacaggaagagggcctagcagcgaagcaatgcacgtcggccatttgattccattcatattcacaaaatggctacaagatgtgtttaacgtgcccctggtcattcagatgtag

SEQ ID NO: 210035 - DNA, 639 bp, Artificial Sequence
  Description of Artificial Sequence: Synthetic coding sequence
atgcccaacagcgagcccgccagcctgctggagctgttcaacagcatcgccacccagggcgaactggtgagaagtttgaaggccggaaatgcatcgaaggatgagatcgactcagctgttaagatgctggttagtctcaagatgagctacaaggccgcagcaggggaggactacaaggcggactgccccccgggaaatccggctccaacgagtaaccacggccccgatgccactgaggctgaggaggactttgtcgatccttggacagtgcaaacctcgagcgccaagggaatcgattatgacaagctgatcgtccggttcggatcatcgaagatcgataaagaactgataaatcgaattgagcgcgccactgggcagagaccccatcattttttaagaagggggatattcttttctcatagggacatgaaccaagtcttggacgcatacgaaaacaaaaaaccgttttacctgtatacagggcgcgggcccagttccgaggccatgcatgttggacatctgatccccttcatctttaccaagtggttgcaggacgtgttcaatgtacctcttgtgatacagatgactgatgacgaaaaatatctttggaaggacctgacactggaccaggcctattag

SEQ ID NO: 210036 - DNA, 1041 bp, Artificial Sequence
  Description of Artificial Sequence: Synthetic coding sequence
atgagcctgctgcggagcctgcgggtgttcctggtggcccggaccggaagctaccccgccgggagtctcctccggcagagcccacaaccaagacatacattctatgctggcccacgcctgagcgcgtctgcctcttcaaaggagttgctgatgaagctacgtcgaaagactggttactccttcgtgaattgcaagaaagccttggaaacatgtggcggcgaccttaagcaggcagagatttggctgcacaaagaagcccagaaggagggatggagtaaggccgcaaagctgcaggggcgtaagacaaaagaggggttgattggactgctgcaggagggtaataccacagtgctcgtggaggtgaactgtgaaaccgattttgtttccagaaatctgaagtttcagttgctggtgcagcaggtggctttgggcacgatgatgcattgtcagaccctgaaggatcagccctctgcctactcaaaagttcagtggctgacacctgttaatttggcactgtgggaggccgaagccggaggctctttagaaggatttctaaatagcagcgagctgagcgggctccccgcagggccagaccgggaaggtagcctcaaggaccaacttgcactagcgatcggcaaattgggggaaaacatgattctgaagagagctgcatgggtgaaagtccctagtggtttctacgtgggtagctacgtgcacggggccatgcagtccccatctctacacaaactggtcctcggcaagtatggggcgttggtcatttgcgaaacgtctgagcaaaagacaaatctggaagatgtcgggagacggttgggccagcatgtggtgggtatggccccgctaagtgtagggagcctggatgacgagccagggggcgaggccgaaactaagatgttgtcacagccctacttactggacccgtctattactctgggacagtacgtccaacctcagggggtgtccgttgtcgactttgtgaggtttgagtgcggtgagggagaagaggccgccgaaaccgagtag

SEQ ID NO: 210037 - DNA, 858 bp, Artificial Sequence
  Description of Artificial Sequence: Synthetic coding sequence
atggtgtactgcaccaccacctgggccatctggaactgccagctgctcttgggctataaaccattgcagaatgtgactggcctgaacactgtcggatcctgcaataccgttgccgagatttggttacacaaagaagcccagaaggagggttggtccaaggcggccaaactgcagggtcgcaagacgaaggagggcctgatcggattactgcaggaggggaacactaccgtgctggttgaagtgaactgcgagacagattttgtgtctagaaatctgaaattccagctcttagtgcagcaggttgctctcgggaccatgatgcattgtcagactctgaaggaccaaccttcggcctatagtaaggggttcctgaatagttccgaactgagcggactgcccgctggtccggatagagaagggagcttgaaggatcaactggcactcgccatcgggaaacttggagagaatatgattttaaagagagccgcatgggttaaagttccttcaggcttctacgtaggctcttatgtccatggcgctatgcagtccccttcactgcataaactggtcctgggcaaatacggtgccctggttatctgtgagacctcagagcagaagacaaaccttgaggacgtcggccgcaggttaggccagcacgtagttggaatggctcctctgtccgtgggttcattggacgacgagccaggcggagaagctgagaccaaaatgctctctcaaccctatttactcgacccatctatcaccctcggacagtatgttcaaccccagggagtgagtgtagtggatttcgttcgctttgaatgcggagagggcgaggaagccgccgagacagaatag

SEQ ID NO: 210038 - DNA, 978 bp, Artificial Sequence
  Description of Artificial Sequence: Synthetic coding sequence
atgagcctgctgcggagcctgcgggtgttcctggtggcccggaccggatcttacccagccggctcattgttacgccagtccccccagccccggcatacgttttacgctggtccgagactgtcggctagtgccagctccaaggagctgctcatgaaactgagaagaaaaaccgggtattcatttgtgaactgcaagaaagctttagaaacttgcggtggcgacctgaagcaggcagagatttggcttcataaggaagctcagaaagaggggtggagcaaagcagcaaaactccaaggtagaaagacaaaagaaggtctgatcggtctgctccaagaggggaacacgactgtcctggtggaagttaattgcgaaaccgacttcgtaagcagaaacctgaaattccaactgctggtgcagcaggttgctctgggaacaatgatgcactgccagaccttgaaggatcagccgagcgcgtattctaaaggcttcctgaacagttctgaactcagcgggctccctgctgggcccgaccgggagggctccctgaaagaccagttggctctggccattggtaagctcggcgagaacatgatactcaaaagggccgcatgggtgaaagtcccaagtgggttttatgtcggatcttatgtgcatggcgcgatgcagtccccttcacttcacaagctggttctcggcaagtacggagcactcgtgatatgcgagacttctgagcagaagacaaacctcgaagacgttgggagaagactcgggcagcatgtggtgggaatggctccactcagcgtgggatcactggacgacgagcccgggggcgaggctgaaactaagatgctatctcagccttacctgttagaccctagcatcacccttggtcaatacgtgcagccacaaggtgtgtccgtcgtcgacttcgtcaggtttgagtgtggcgagggggaggaggccgctgagaccgaatag

SEQ ID NO: 210039 - DNA, 504 bp, Artificial Sequence
  Description of Artificial Sequence: Synthetic coding sequence
atgagcctgctgcggagcctgcgggtgttcctggtggcccggaccggctcctaccccgccggaagtctgttgcggcagtctccacaaccaagacatacattttatgcaggccctcggctgtccgcatcagcatcttcaaaagagctgcttatgaagctcaggagaaagaccgggtacagcttcgtgaattgcaagaaggccttagaaacgtgcgggggagacttaaaacaggcggagatttggttgcacaaggaggctcagaaagagggctggtctaaagccgcaaagctgcagggacgcaagacaaaagagggacttataggattgctccaggagggtaacacaactgtgttggtggaagtcaattgcgaaactgatttcgtgtcgagaaacctcaagttccagttattagttcagcaggtcgccctggggaccatgatgcattgtcaaacactgaaggaccagcctagtgcttattcgaaggagaactgggagaaaacctag

SEQ ID NO: 210040 - DNA, 648 bp, Artificial Sequence
  Description of Artificial Sequence: Synthetic coding sequence
atgagcctgctgcggagcctgcgggtgttcctggtggcccggaccggtagttatcccgcaggtagcttgcttcgacagtcaccgcaacccaggcatacattttacgctggtcctagactgtccgcctccgcttcaagtaaggagctgttgatgaagctcaggagaaagacagggtattctttcgttaactgcaagaaggctctggagacttgcgggggcgacttgaaacaggctgagatttggctgcataaggaagcacagaaggagggatggagcaaagccgccaagttacaagggaggaagactaaggagggcctcattggcctgctgcaggaaggcaataccactgtcttggttgaggtcaattgtgagaccgattttgtgagtcgaaatctgaagttccagctgctggtgcagcaggtggccctggggacaatgatgcattgtcagactttgaaagaccagccatcggcctattccaagggctttctcaattcctccgagctttctggcttgcctgctgggcctgatagagaagggtccctgaaggaccagctggcactggcaatcggtttaccatttcagatcggggccgtgagtgaactgcagttgcctgagtccaactttctgcagaacacctccagctag

SEQ ID NO: 210041 - DNA, 435 bp, Artificial Sequence
  Description of Artificial Sequence: Synthetic coding sequence
atgaagagccagtggtgccggcccgtggccatggacctgggcgtgtaccaactcagacattttagtatttctttcttatcatctcttctaggcacggaaaacgcatcagttaggttagacaatagcagcagtggcgcctcggttgttgcgattgacaataaaatcgaacaggctatggatttggttaagtctcatctgatgtacgccgtgagggaggaggtagaggtccttaaagagcaaataaaggagctaatcgaaaaaaactcccagctggagcaggagaataatttgcttaaaacgcttgctagcccagaacagcttgcccagttccaggctcaactccaaactggttctccacccgccacgacgcagccccagggaacgacgcagccgcccgctcaacctgcatcccagggatccgggcctaccgcttag

SEQ ID NO: 210042 - DNA, 3222 bp, Artificial Sequence
  Description of Artificial Sequence: Synthetic coding sequence
atgcaccagccccccgagagcaccgccgccgccgccgccgccgccgatatctctgcccgcaagatggcacaccctgccatgttcccacgccgcggcagcggtagcggatccgccagcgcactgaacgcagctggcaccggcgtcggctcaaatgcgacctcatctgaggacttcccccccccaagccttctgcagcctccaccccccgcagcctcatccacgagtgggccacagcccccacctccccagagcctaaacctcctatcacaggcacagttgcaggcccagcctctcgcccccgggggaacacaaatgaagaagaagtccggatttcaaattacttcagtgactcctgcccagatatctgcttccattagctccaataattcaattgccgaagacacagagtcatatgatgacttggacgagagccacactgaggatctttctagtagtgagattctggacgtgtcgctgagccgggctactgacctcggggaaccagagcggtctagttcagaagagacacttaataatttccaggaggcagaaaccccaggagccgtttcacccaatcaacctcatttaccgcagccgcatctaccccacctgccccagcagaacgtggtgatcaacggaaatgcccacccacatcacttacatcaccaccatcagatccaccacggacaccacctgcagcacgggcaccaccacccctctcacgtggcagtcgcatcagcctccataaccgggggacctccttcctcccctgtaagccgaaaactgagcaccacaggcagttccgacagcattaccccagtcgcgcctaccagcgcggtgtctagctctggctctcccgctagtgtgatgacaaacatgcgagccccatccactacaggcggaataggtattaactcagtgaccggtacttctaccgtgaacaatgttaatataacagcagtgggatccttcaatcccaatgttacctctagtatgcttgggaatgttaatatatccacgtccaacatcccaagtgctgcaggtgtctcagtgggaccaggcgtgacgtctggagtaaatgtcaatatcctttccgggatgggcaacggaaccattagcagctctgctgccgtgtcctcagtccccaatgctgccgctggaatgaccggaggttccgtatcctctcagcagcagcagccaacagtgaacaccagtcggttcagagtggtgaagctagattcctcaagcgagccttttaaaaaagggagatggacgtgcactgaattttacgagaaggaaaacgccgtacccgctactgagggtgtactgataaacaaagtggtggagaccgttaagcagaacccgatcgaggttacttccgaacgcgaatccacatctggctcaagtgtttcgagctctgtctcaaccctgtcccactacacagaaagcgtagggtccggcgagatgggcgcacccactgtggtggtccagcagcaacagcagcagcagcagcaacaacagcaacagccggccctgcagggggtgacattacaacagatggattttggctcgacaggcccacagagcatccccgctgtgtctatccctcaatcaattagccagtcacagatttcccaggtacagttacagtcccaggagctgagttaccaacaaaagcagggattgcagccagtgcctctacaggccaccatgagcgccgccactgggatccagccaagtcccgttaatgtcgttggggtgacctcagcactcgggcaacagccatctatttcttctctcgcacagccgcagctgccatacagccaggcagccccccccgtgcagacacctttgcccggcgcacctccaccacagcagctacaatacgggcaacagcagccaatggtcagcacccagatggcgcctgggcatgtgaaatccgttactcagaatcccgccagcgaatacgttcagcagcaaccgattcttcagactgcaatgtctagtggtcagccatctagcgccggcgtgggggctggaaccacggtgatcccagtcgcacagccccagggcatccagttgcctgtgcagcctacggctgtgcccgctcagccggcaggggcttctgtacagcctgtgggtcaggcacccgcagccgtaagtgcagtgcctaccggcagccagatcgccaacataggccaacaggctaacattccgacagcagtgcagcagccgtcaacccaggttccacctagtgttattcagcagggagcccccccgagttcccaggtcgtgccacctgcccagactgggattatccatcagggtgtgcagacaagcgcccctagcctgcctcagcagctggtgattgcttctcagtcgtctttactgacagtcccacctcagccccagggagtcgaacccgtagcccagggcatagtcagccaacagttaccagcagtctcaagtctgccaagcgccagctccattagcgtgacatctcaggtcagcagtaccggaccctccggaatgccttccgcccccaccaacctcgtgcctcctcaaaacatcgcgcagactccagctacgcaaaacggaaaccttgtgcagagtgtgagccagccccctctgattgccacaaacaccaaccttcctcttgcccaacagataccactaagttccacccaattctctgctcaatctttggcccaggctatcggcagccaaattgaagatgcccggagggcagcagagccgagtttggtcggactgcctcagaccatcagcggagactccggaggcatgtcagcagttagcgacggctccagcagctctctggccgctagcgccagtttatttcctctaaaagtcctgcctctgacaacacccttggtggatggcgaggacgagtcaagttctggggctagcgtcgtagcaattgataataaaattgagcaagccatggatcttgtgaaaagtcatctgatgtacgcagtgcgcgaggaggtggaagtcctgaaggagcagataaaagaactgattgagaagaactctcagctggagcaggagaacaacctcctcaagacactagctagccctgagcaattagcgcagttccaggcacaactccagaccggatctcctccagcaacgacacaaccccaggggacaacgcagccaccagcccagcccgcttcccaggggtctggcccaactgcctag

SEQ ID NO: 210043 - DNA, 126 bp, Artificial Sequence
  Description of Artificial Sequence: Synthetic coding sequence
atgaagagccagtggtgccggcccgtggccatggacctgggcgtgtaccagctccgccacttctccatatcattcctgtcatcgctgctcggcaccgagaacgcgtctgtacgcctggacaactag

SEQ ID NO: 210044 - DNA, 429 bp, Artificial Sequence
  Description of Artificial Sequence: Synthetic coding sequence
atgcaccagccccccgagagcaccgccgccgccgccgccgccgccgacattagtgcacgaaagatggcacaccctgctatgtttcctaggcgagggagcggcagcggtagtgcctcggctctcaatgccgccgggactggcgtggggagcaacgcaacgtcttccgaggacttcccaccaccgtcccttctccaaccacccccccctgccgcctcatccacctctggacctcagcctcccccaccacagtcacttaacctactctcacaagctcagttacaggcccagccactcgcccccgggggcactcagatgaagaaaaagtccgggtttcaaatcacctcagtaacacctgcacagatatccgcctccatttcatcaaataacagtatcgccgaagataccgaaagctatgatgacctggactag

SEQ ID NO: 210045 - DNA, 1713 bp, Artificial Sequence
  Description of Artificial Sequence: Synthetic coding sequence
atgcaccagccccccgagagcaccgccgccgccgccgccgccgccgatattagtgctagaaagatggcccacccagccatgttccctagacgaggctccggatccgggagtgccagcgctctgaacgcggcaggtacaggagtgggctctaacgccaccagctccgaagacttcccgcctcccagcctactgcagcctcccccgcccgcggcaagttcgacttcagggccacagccacccccacctcagtcactgaacttgctttctcaggcccaactacaggcgcaacccctcgctcctggcgggacccagatgaaaaagaagtccggcttccagattacctcagtgactcccgctcagatatcagcctctatctcgagtaataacagcatcgcagaggatactgagtcatatgacgacctcgatgagagtcacactgaggatctgtcttcatccgagattctcgacgtgagcctcagtagggcaaccgacctaggcgaaccagaacggagcagcagcgaagagacgctcaataactttcaagaggccgagacacctggcgccgtgagtccgaaccagcctcatctcccacagccccacctcccccacctgccacagcagaatgttgtgattaacggaaatgcccaccctcatcacttgcaccaccatcatcagattcatcatggccaccacctgcagcacggtcatcaccacccttctcacgtcgctgtggccagtgccagtataactggtggacctccgagtagtccagtgtcgaggaaactgtctactactgggagcagtgattcaattacacccgtggccccaacaagcgccgtctcatcatccgggagtcctgcttccgtcatgaccaacatgagagcccctagcacgaccgggggtataggcattaactcggtgaccggaaccagtacagtgaacaatgtcaatataacggcagtgggcagtttcaatcccaatgtgacttctagtatgttggggaatgttaatatcagtacatcaaatattccctccgcagctggggtgtctgttggcccaggggtgactagcggggtaaacgtcaacattttatcggggatgggcaatgggaccatcagctctagcgcagctgtaagctcagtacctaatgcagccgccggaatgaccggcggctccgtgtcttcacaacagcagcagcccacggtcaatacctcccgttttagggtcgtcaagttggactctagctccgaaccattcaagaaggggcgctggacttgcacagaattttacgaaaaagagaacgcggtgcccgccaccgaaggggtgcttattaataaggtggtggaaaccgtgaagcagaaccccattgaggttacgagtgagcgtgaatccaccagtggatctagcgtgtcatccagcgtgtccacactgtcacattacaccgagtccgtgggatctggtgagatgggagctcctacagtagtcgttcagcagcagcagcagcagcagcagcaacagcaacaacagcctgccttacagggggtgactttacagcagatggactttggcagtacaggaccacaatcaatcccggccgtgtctatccctcaaagcatcagccagagccagatctcacaggtccagcttcagtcccaggaactgagctatctgaccatgaaggtggtcctactcattgtgtacctgtgtatgtag

SEQ ID NO: 210046 - DNA, 603 bp, Artificial Sequence
  Description of Artificial Sequence: Synthetic coding sequence
atggcccagagcaagctggactgccggagccccgtgggcctggactgctgcaactgttgcctggacctggcccatcgatccggtctacaacgcgggagttccggcgaaaataataatcctggctcccccaccgtttcaaatttccggcagttgcaggagaagcttgtgttcgagaaccttaacaccgacaaactgaattcgatcatgaggcaggactccctggaacccgtcctgcgcgatccatgctacctgataaacgaggggatatgtaatcggaatattgaccagactatgctgtctattctgctttttttccattccgcctccggagcttctgtggttgcaattgacaataaaatcgagcaggcaatggatttggttaagaatcacttgatgtatgcggtaagggaagaggtcgaaattctcaaagaacagatccgagaactcgtggagaaaaattctcaactggagagagagaacacacttctaaaaactctggcctctccagagcagctcgaaaaattccagtcttgtctgtccccagaggaaccggcccctgaatccccccaagtgccagaagctcctggcgggtccgccgtgtag

SEQ ID NO: 210047 - DNA, 333 bp, Artificial Sequence
  Description of Artificial Sequence: Synthetic coding sequence
atggccttccagcccccctacagcagcagcctgttccggaagcgggataatgcatctggcgcctccgtggtcgcaatagacaacaaaatcgaacaggcaatggacctggtgaagaaccatttgatgtatgccgtacgggaggaagtcgagatattaaaagagcaaattagagagttagttgagaaaaatagtcagttggaaagagagaatacgttgctcaaaactttagcctcacctgagcaactagagaagttccagagctgcctaagcccagaagagcctgccccggagtctccgcaagtgcccgaggccccaggcgggagtgccgtctag

SEQ ID NO: 210048 - DNA, 603 bp, Artificial Sequence
  Description of Artificial Sequence: Synthetic coding sequence
atggcccagagcaagctggactgccggagccccgtgggcctggactgctgcaactgttgcttggacctggcacaccggagcggactccagcgaggctcctccggggagaacaataatccaggctcacccaccgtttcgaattttcgccagcttcaggagaagctggtttttgaaaatttaaacactgataagctgaatagtatcatgaggcaggactctctggagccagtgctgcgtgacccttgctatcttattaatgaggggatatgcaaccgtaacatagatcagacaatgttgagcatactgctctttttccacagtgcctccggagcctcagtggtagcgatcgataataagattgaacaagctatggacctcgttaagaaccatttaatgtatgccgtccgggaggaagtcgagatcctgaaggaacagattagggagctggtcgaaaagaattcacagctggaaagggaaaacacgttactgaagactttggcctccccagagcagttggaaaaattccagtcctgtctgagcccggaagagcccgctccagaatcaccacaggttccagaggctccaggcggctcagcagtttag

SEQ ID NO: 210049 - DNA, 603 bp, Artificial Sequence
  Description of Artificial Sequence: Synthetic coding sequence
atggcccagagcaagctggactgccggagccccgtgggcctggactgctgcaactgttgcttggatcttgcacacaggtccggacttcagcgaggcagtagtggcgaaaataacaacccaggttcacctacagtctccaactttaggcagcttcaggaaaaactcgtgttcgagaacctgaacaccgacaagctgaactccattatgagacaggattcactggagcctgttttgcgcgacccttgctatttgatcaatgagggcatctgtaatagaaatatcgaccagactatgttaagtattctgttattctttcacagcgccagtggcgccagcgttgtggctattgacaacaaaattgagcaggctatggacctggtgaagaatcacctcatgtatgccgtgcgtgaagaagtcgagatcctgaaagagcagatacgggaactcgtggagaaaaattcacagttggagcgcgagaacaccctactgaagactttagctagcccagaacaactggagaagttccagtcttgcctgagcccggaggagcccgccccggagtctccgcaggtgcctgaggctcctgggggatctgctgtttag

SEQ ID NO: 210050 - DNA, 234 bp, Artificial Sequence
  Description of Artificial Sequence: Synthetic coding sequence
atggacctggtgaagaaccacctgatgtacgccgtgcgggaggaggtggaaatcctaaaagagcagattagggaactggttgaaaaaaatagtcagctggaacgggagaatacgctcttgaagaccctagcatcccccgagcagctagaaaaattccagtcctgcctaagccccgaagagcctgcgcctgagtctccgcaggttccggaagcacctggcggcagcgctgtctag

SEQ ID NO: 210051 - DNA, 405 bp, Artificial Sequence
  Description of Artificial Sequence: Synthetic coding sequence
atgaacaccgagatgtaccagacccccatggaggtggccgtgtaccaactgcataacttctcgattagtttcttctcatccctgctgggaggtgacgtcgtcagtgtcaaactggataattccgccagtggggcctccgtagtggccatcgacaacaaaattgaacaggcgatggacttagtgaaaaaccatctgatgtacgctgtcagggaggaggtcgaaattttgaaggagcagattcgggaacttgtcgagaagaactcccaactggaacgtgagaacacactgctgaagaccctggccagtcccgaacagctggagaagttccagtcgtgtctgagtcccgaggaacccgccccagaatctccgcaagttcccgaagcccccggcggatcagcggtctag

SEQ ID NO: 210052 - DNA, 540 bp, Artificial Sequence
  Description of Artificial Sequence: Synthetic coding sequence
atggcccagagcaagctggactgccggagccccgtgggcctggactgttgcaactgctgcctagatctggcgcaccgcagtggcctgcagagaggatccagcggagagaacaataatccaggttcacccacggtctccaacttcaggcaggactccctggaaccggtactccgcgacccatgctacctgatcaacgagggaatttgcaacaggaatattgaccagaccatgctaagcatcttgttattcttccacagcgcatcaggggcgagcgtggttgcaatcgacaataaaatagagcaggcgatggaccttgtgaagaaccatttaatgtatgctgtgagagaggaagtggaaattcttaaggaacagatccgagagctggtcgagaagaattcgcagctcgagagagaaaataccttgctgaaaactctggcgtcccccgagcaactagaaaagttccagtcctgtcttagccccgaggagccagctcccgaatcaccacaagtccctgaggcgcctggcggatcagctgtgtag

SEQ ID NO: 210053 - DNA, 372 bp, Artificial Sequence
  Description of Artificial Sequence: Synthetic coding sequence
atggcccagagcaagctggactgccggagccccgtgggcctggactgctgcaactgttgcctggacctggctcacaggtcaggtctgcagagaggctcatccggggaaaataacaatcccggcagtccaactgtctctaactttcgccagttgcaggagaagcttgtttttgagaacctgaacaccgataagctcaactcaatcatgagacaggactccctcgaacctgtcttgcgggacccttgttatctgataaatgagggcatctgcaacaggaacattgaccagaccatgctgagtatcttgctgttcttccactctgcctctggagcctccgtggtggctattgataacaaaatcgagcaggcttag

SEQ ID NO: 210054 - DNA, 78 bp, Artificial Sequence
  Description of Artificial Sequence: Synthetic coding sequence
atggacctggtgaagaaccacctgatgtacgccgtgcgggaggaggtggagatactcaaagagcagatacgggaatag

SEQ ID NO: 210055 - DNA, 351 bp, Artificial Sequence
  Description of Artificial Sequence: Synthetic coding sequence
atggcccagagcaagctggactgccggagccccgtgggcctggactgctgcaactgctgcctggacttggcgcaccgctccgggttgcaacggggaagtagtggggagaacaataatcccggatcccccacggtatctaattttaggcagctgcaggagaaactggtgtttgaaaacctcaatacagataaactgaacagtatcatgcggcaagattctcttgagcctgttctcagggatccctgttacttgatcaacgaaggcatatgtaatcgcaatatagaccaaacgatgctttcaatacttctgttcttccattcagccagtggcgcatcagtggtcgcaatctag

SEQ ID NO: 210056 - DNA, 177 bp, Artificial Sequence
  Description of Artificial Sequence: Synthetic coding sequence
atggcccagagcaagctggactgccggagccccgtgggcctggactgttgtaactgctgcttggacctcgctcatcgatccgggctgcagcggggtagtagcggagagaacaataaccctggaagcccgactgtctccaactttcgacagctacaggagaagctcgtttttgagtag

SEQ ID NO: 210057 - DNA, 255 bp, Artificial Sequence
  Description of Artificial Sequence: Synthetic coding sequence
atggcccagagcaagctggactgccggagccccgtgggcctggactgttgtaattgctgcttggatttagctcaccgttctggactgcagcgaggctcctccggagagaataacaatcccggaagccccactgttagcaactttcggcagctgcaagaaaaactagtatttgaaaacctgaataccgacaagttaaacagtataatgagacaagactcattagagcctgtgttgagagacccttgttacctatag

SEQ ID NO: 210058 - DNA, 603 bp, Artificial Sequence
  Description of Artificial Sequence: Synthetic coding sequence
atggcccagagcaagctggactgccggagccccgtgggcctggactgctgcaattgctgcctggatctggcacacagatcggggctgcagcgcggatcatctggggaaaacaacaatcctggctcaccaacagtatcgaattttcgccaactccaagaaaagctcgtgttcgagaatctgaacactgataagttgaacagtataatgaggcaggactctctggagcccgttctcagggatccctgctatctcattaatgaaggcatttgtaatcgaaatatcgaccagaccatgctatccatcctgctgttttttcacagcgcgtccggagcctctgttgtggccatagacaataagatcgaacaggccatggatttggtaaagaaccatctcatgtatgcagtgcgggaagaggtagagattctgaaagagcagatccgggagctcgttgagaagaacagtcagttagagagggaaaacacccttttgaagacacttgcttcacctgaacagttagaaaaattccaatcttgtttatctccagaggaacctgcccccgagtcgcctcaggtgccagaagcacctggtggatcagctgtgtag

SEQ ID NO: 210059 - DNA, 303 bp, Artificial Sequence
  Description of Artificial Sequence: Synthetic coding sequence
atggcccagagcaagctggactgccggagccccgtgggcctggactgctgtaactgttgcctggacctcgcccatcggtctggccttcaacgtggctctagcggcgagaataataaccccgggtccccaactgtatccaacttccgccagctgcaggagaagctggtctttgaaaacttgaacactgacaaacttaacagcattatgcgtcaggattcactggagcccgtgcttagggacccctgctacctgattaacgaaggcatctgcaataggaacatcgatcagacaatgcttagctag

SEQ ID NO: 210060 - DNA, 360 bp, Artificial Sequence
  Description of Artificial Sequence: Synthetic coding sequence
atggcccagagcaagctggactgccggagccccgtgggcctggactgctgtaactgctgccttgatttggcccatcggagcggactgcagcggggatcatccggggagaacaataatcccgggtctcctactgttagcaacttcagacagcttcaggaaaagctggtgttcgaaaatctgaatacagataagctcaattcgatcatgcgccaggacagccttgaacctgtgctccgagacccgtgctaccttataaacgaaggtatctgcaacaggaatatcgaccagaccatgctaagcattctgttattctttcatagcgccagcggggcctccgttgttgctattgataacaagtag

SEQ ID NO: 210061 - DNA, 399 bp, Artificial Sequence
  Description of Artificial Sequence: Synthetic coding sequence
atgcggcaggacagcctggagcccgtgctgcgggacccctgctacctcatcaacgaaggtatttgcaacaggaatattgatcagactatgctgtctatcctgcttttcttccatagtgcctccggggcctcagtggtggctatcgacaacaaaatcgaacaagcgatggacctcgttaagaatcacctgatgtacgccgtacgtgaagaagtcgaaatccttaaggaacaaatacgggagctggtcgagaaaaatagccagctcgagcgggaaaacacgctgctgaagaccctggcttccccagagcagctcgaaaagtttcagtcatgtctctcgcccgaagagcctgcgcctgaaagcccacaggttccagaagcacccggaggctctgccgtgtag

SEQ ID NO: 210062 - DNA, 375 bp, Artificial Sequence
  Description of Artificial Sequence: Synthetic coding sequence
atggcccagagcaagctggactgccggagccccgtgggcctggactgctgtaattgttgccttgacctagcccaccggagcggactgcagcggggatccagcggggagaacaacaaccctgggagtcctactgtgtctaattttcgacaactgcaggaaaagctggtctttgagaacctgaatacagataagcttaacagtattatgcggcaggacagtctggaacctgtgctaagagacccgtgctacttgatcaacgaaggtatttgcaacaggaatatcgaccagaccatgttgagtatactgctgtttttccactccgcgagcggcgcctcggtcgtagccattgacaataagattgagcaggcaatgtag

SEQ ID NO: 210063 - DNA, 1188 bp, Artificial Sequence
  Description of Artificial Sequence: Synthetic coding sequence
atgagcggcggcaagaagaagagcagcttccagatcaccagcgtgacaacagattatgagggcccaggatcgcccggggccagtgacccccctacgcctcagcccccgaccggaccccctcctagactccctaatggtgagcccagtccagacccagggggaaagggcaccccgaggaatggatctccacctcccggtgcgcctagttcccggttccgggtagtgaagcttcctcatgggctaggtgagccttatagaaggggcagatggacatgcgtggacgtctacgagagagacctggagcctcacagcttcggcggacttctggaggggataagaggcgcctccgggggagccggcgggcgttcactcgacagccgcttggagttggcttccctgggactaggggccccaacccccccctctggcctgtcacaggggcccacgtcctggttgcgacctccccccacctcccccggaccccaggcccggagctttactggaggactggggcagctcgtcgtcccgtctaaggccaaagccgagaaacctccgctctcagcgtcctctccccagcagcgcccacctgagcctgaaactggtgagtctgctggtactagcagagctgctacacctctcccaagcctgcgggtggaggccgaagcaggaggctccggcgcccgtactcctccgctctctcgtcggaaggccgttgatatgaggctgagaatggagttaggagctcccgaggagatgggtcaggtccctccacttgatagccggccctcctcccctgccctgtatttcacgcatgacgcctccctggttcacaagtcgccggacccctttggcgccgtggcagcgcagaagttctctttggcacattcgatgctggccatcagcgggcaccttgacagcgatgatgatagtgggagtgggtcattggtcggaatcgataacaagatcgaacaggctatggatctggtcaaatcccacttgatgtttgctgtgagggaggaggtggaagtccttaaggagcagatccgggagctggcagagaggaacgcagccctggagcaggaaaacggactgcttagggcgttggctagtcctgagcagttagcccaactccccagctccggagtgccacgcctcgggccccccgccccaaacggtccatccgtgtag

SEQ ID NO: 210064 - DNA, 1314 bp, Artificial Sequence
  Description of Artificial Sequence: Synthetic coding sequence
atgagcggcctggacggcgtgaagcggaccacccccctgcagacccattccattatcatcagcgatcaagtgccctctgatcaagacgctcaccaatatctgcgactgcgagatcagagcgaagctacccaagtgatggctgaacccggggagggtggtagcgaaacagtcgctctcccaccccctccacctagcgaagaaggaggcgtacctcaagatgcggccggtcgaggagggacccctcaaatccgtgtggtcggcggacgtgggcacgtggctatcaaggcaggccaggaggaaggccaacccccggctgagggcttggcagctgcgagcgtggtcatggctgccgatcggagcctgaagaaaggagtacaagggggggaaaaagcccttgagatttgcggggcccagcgctccgcctccgagctgactgcaggagccgaggcagaagccgaggaggtcaagactggtaagtgcgccactgtgtccgccgccgttgccgagcgcgagtccgctgaggtagttaaggagggattggcagagaaagaagttatggaagaacagatggaggtggaggagcagccaccggagggagaggagattgaagtcgcagaagaagatcgtttggaggaggaagcccgcgaggaggaggggccctggccattgcacgaggctttgcgcatggatccgctggaagccatccaactggagctggatactgtgaacgcccaagccgacagagcattccagcagctcgagcacaaattcggcagaatgcggagacactatctggaaagacgtaactacattattcagaatattcctggcttttggatgaccgcgttccgcaaccacccgcagttgtctgcgatgatacgtggacaggacgcggagatgctgcggtatataacaaacctggaagtgaaagagctgcgccatccaagaactggctgcaaattcaagtttttctttaggcggaacccctatttcaggaataagttgatcgtcaaagagtacgaggttcgctcctctgggagggtcgtgagtctgtcaactcccattatttggaggaggggtcacgaaccccagtctttcatcagaaggaaccaggatcttatttgctcattttttacttggttctcagatcacagcctgccagaaagtgataagattgcagagataatcaaggaggacctgtggcccaaccctttacagtattatctgctgcgcgagggggtgaggagggccaggaggcggcctttgcgagaacctgttgagataccgagaccgttcggatttcagtctggctag

SEQ ID NO: 210065 - DNA, 522 bp, Artificial Sequence
  Description of Artificial Sequence: Synthetic coding sequence
atgagcggcctggacggcgtgaagcggaccacccccctgcagacccatagtattataattagcgatcaggttcccagtgatcaggacgctcatcaatatttgcgcctccgggaccaatccgaggcgacacaggtaatggctgaacccggagaaggagggtctgagaccgtcgcactgcctccacctcccccgagcgaggaaggaggagtgccacaggatgctgcaggccgaggaggcactccccagattcgtgtggtggggggaaggggacatgtcgcaatcaaggctggccaggaagagggtcaaccacccgccgaggggctggccgcagcttctgtcgttatggccgccgacaggtcccttaaaaaaggggtgcagggaggcgaaaaagccttagaaatctgcggagctcaaaggagcgccagcgagctgacagctggcgccgaggctgaagctgaggaagtcaaaaccggcaaatgcgccaccgtgtccgccgcggtggcaaaaatgcagaggtgttag

SEQ ID NO: 210066 - DNA, 2082 bp, Artificial Sequence
  Description of Artificial Sequence: Synthetic coding sequence
atggaccggcccgacgagggcccccccgccaagacccggcggctgtcttcgagcgagtcaccacagagggaccctccgccgccaccgccacccccgcccctgctgcgactgcccctgccacctccacagcagcgccctcgtcttcaggaagagaccgaagcagcacaggtcctggcagacatgcgaggggtgggactcggtccggctctgcccccccctcctccttacgttatcctggaggagggagggatacgcgcttactttacactcggcgcagagtgccctggttgggactctacaatcgagtcaggctacggagaggctccgccaccgactgaatcactggaagccctcccaacaccagaggcgtccggggggtcccttgaaattgatttccaagtggtgcagagtagcagctttggcggtgagggtgccctagagacatgttccgcggtcggatgggcaccccagaggctcgtggatcctaagagcaaagaagaggccatcatcattgttgaggacgaggatgaggacgagcgggaatccatgcgatcatctcgccggcgccgccgcaggaggcgcagaaagcagaggaaagttaagcgcgagtccagagagcgcaatgcagaaaggatggagagcattctgcaggctctcgaagatatacagctggacctggaagccgtcaacatcaaggccggaaaagcgttcctcagactcaaacggaagtttattcagatgagacggcccttccttgaacggagagacttgataattcagcacatccccgggttctgggttaaggctttcctcaaccatcctagaatttccatattgataaaccggagggacgaagacatatttcggtatctgacaaatttgcaggttcaggacttgagacatatctctatgggctataagatgaaactttactttcagactaacccatacttcacaaacatggtgatcgttaaggagtttcagcgcaacagatcaggaagactggtgagccattcaacccctatccgttggcaccgagggcaagaacctcaagctcgcagacacggcaatcaggacgcaagtcactctttctttagctggttcagcaaccacagtctgcccgaggctgatcgaattgctgaaataattaagaacgatctgtgggtgaaccccctgaggtactacctgcgggaacgaggaagccgcattaaaagaaaaaaacaagagatgaagaaacgcaaaactcgaggcagatgcgaagtggtcatcatggaggacgctcctgactattacgccgttgaggacattttcagcgaaataagtgacatcgatgagacaatacacgacattaagatcagcgacttcatggaaacaactgactactttgaaacaacagataatgaaattaccgacattaacgagaatatttgcgattctgagaaccctgaccacaacgaggttcccaataacgagaccacagacaataacgaaagcgccgacgaccatgaaaccactgacaataacgagtctgccgacgacaacaacgaaaatccagaggacaataataagaacacggacgacaatgaagagaaccccaataataatgagaacacctatggaaataacttcttcaagggcggcttctggggctcccatggcaacaatcaggactcatcagactcggacaacgaagcagacgaagctagcgacgatgaagataacgatggtaacgagggcgataatgaaggaagcgatgatgatggaaacgagggtgataatgaagggtcagacgacgatgaccgcgacatcgagtattacgaaaaagtaatagaggacttcgacaaagatcaggcagactacgaggacgtgatcgaaattatcagtgatgagagtgtggaggaagagggcatcgaggagggcatacagcaggatgaggatatttatgaagaagggaattacgaagaggagggctccgaagatgtctgggaggagggagaggatagcgacgattccgatcttgaggatgtgctgcaggtccctaacgggtgggctaacccagggaagagaggcaaaaccggatag

SEQ ID NO: 210067 - DNA, 1062 bp, Artificial Sequence
  Description of Artificial Sequence: Synthetic coding sequence
atgccctggcccctgctgctgctgctggccgtgagcggcgcccagaccacacgcccctgttttcccgggtgccaatgcgaagtcgagaccttcggtctattcgactcttttagcctgacgcgagtggactgctctggcctgggacctcacattatgcctgtgcccatccctctcgacacagcgcacttagacctatcttcaaaccgactcgaaatggtgaacgaatccgtgctggctgggccaggctataccacgctggccggactcgacctgtcccacaatcttcttacctctatttcccctaccgcattcagcaggcttcggtaccttgagagtctggacctcagccacaacgggcttactgccctgcctgcagagtctttcacctcatcccccttatccgatgtcaatctgtcccataatcagcttcgggaggtgtccgtgagcgcttttacaacccacagccaggggagggcgcttcatgtagatctgtctcacaatctcattcaccgactggtaccacatcccactcgagcaggactgccggcaccaactatacagtccttaaatctggcatggaacagactccacgcagtccctaacctccgcgatctgcctctccgatacctttcccttgatggaaacccattggctgtgatcggccctggcgcctttgcagggctgggggggctcacgcacctatcacttgcttctctacagagactacccgaactagcaccatctggattcagagagctgccaggcctccaggtactggatctctctggcaatcctaagctgaactgggctggagctgaggtcttctctggactctcctctctccaagagcttgatctgagcggaacaaacctggtgcctttgcccgaggcactcctgctacaccttccggcactccagtccgtgtccgtcggtcaagatgtccggtgtagaagacttgtgagggaaggcacctatccacggagacccggatcatctccaaaagtggcactccattgcgtagatacacgggacagtgccgctaggggaccaacaattctgtag

SEQ ID NO: 210068 - DNA, 966 bp, Artificial Sequence
  Description of Artificial Sequence: Synthetic coding sequence
atgccctggcccctgctgctgctgctggccgtgagcggcgcccagacaacgaggccctgttttcccggctgtcaatgtgaagtagagactttcgggctgtttgattcattcagtctcacacgtgtcgactgttctgggcttggcccgcatattatgcctgtccctatacctctggacactgcccacctagatctatcctccaacaggctggaaatggtaaacgagtctgtcctcgcagggcctggttacaccactctggccggtctcgacctttcacataatttattgacaagctcacctcttagtgacgtgaacttgtctcataatcagctcagagaggtttccgtcagtgcgttcactacccatagccaaggccgggcacttcatgtcgatttgtcccacaacctaatccataggcttgttccccaccccactcgtgcaggcttaccggcacctacaatccagtctttaaacctagcctggaacaggcttcatgcagtacccaatctaagggatctcccgttgcggtatctgtccctcgacgggaatcctcttgcagtgattggtccaggggcatttgcgggattaggtgggctgactcacctgtctctggccagcctgcagcgactgcctgaactcgccccctctggctttagggaactgccgggattgcaggtgctggatctgtccggaaaccccaagttgaactgggccggagccgaggtttttagcgggttgtccagcctgcaggagctggatctctctggaacgaatcttgtgcctctgcccgaagcactgctgcttcacctgccagctctgcagtcagtgtccgtgggccaggatgtgcggtgtaggcggttggttcgcgagggtacctaccccagaagacccggcagcagtcctaaggttgctttgcactgcgtcgacactagggactcagccgcaagaggccccaccatactgtag

SEQ ID NO: 210069 - DNA, 318 bp, Artificial Sequence
  Description of Artificial Sequence: Synthetic coding sequence
atgccctggcccctgctgctgctgctggccgtgagcggcgcccagacaaccaggccttgcttcccagggtgtcaatgcgaagttgaaacttttggtttgttcgacagctttagcctgactcgcgtggactgctccgggctgggcccacacatcatgcctgttcccattcccctggataccgcccaccttgacctgagctcaaaccgtctggaaatggtcaacgaaagtgtactggctggaccaggctatacaactctggccgggctcgacctatctcacaatcttttgacatccatctcccctaccgccttctcctag

SEQ ID NO: 210070 - DNA, 1062 bp, Artificial Sequence
  Description of Artificial Sequence: Synthetic coding sequence
atgccctggcccctgctgctgctgctggccgtgagcggcgcccagactacccgcccttgtttccccgggtgccagtgcgaggtcgaaactttcggcctgttcgattctttttcgctgaccagggtagactgcagtggcttaggtccgcacataatgccagtgcccatcccgctcgataccgcccatttagatttgtcgagcaaccgtctggaaatggtcaatgaaagcgtgctcgcggggcctggctataccacactagcaggtcttgatttgtctcacaatctactgacgagcattagccctactgctttctccagactgagatatctcgaatctttagatctgtcccacaacgggttaacagccctgcccgctgaatccttcacctctagtcccctatccgatgtgaacctgagccacaaccagcttagggaagtgagcgtgtcagcatttactactcattcccaggggcgtgccctgcatgtggatctgtcccacaatctgatccacaggctagtgccgcatccaacccgggctgggctgcccgccccaaccattcagtccctgaatctcgcctggaatcgtcttcatgctgttcccaatctgcgggatctgcccctcaggtatttgagtttagatggaaatcctctggccgtgataggccccggtgcgttcgccgggctgggaggactgactcacctgagccttgccagccttcagagactacctgagctggccccgagcggtttccgcgaactgccaggcctccaagttttggatttgagtggtaatccgaagctgaattgggcaggcgcagaggtgttcagtgggctgagttccctgcaggagctagacttgtctgggaccaacctcgtgcccctccccgaggctttattgctgcatttacctgctctgcaaagcgtgtctgttggccaggacgttcggtgcagacggctggtcagggagggaacatacccaagaaggcctggaagtagtcctaaagttgcactgcactgcgtggacactagagactcagccgcgaggggtccaaccatcctctag

SEQ ID NO: 210071 - DNA, 453 bp, Artificial Sequence
  Description of Artificial Sequence: Synthetic coding sequence
atgccctggcccctgctgctgctgctggccgtgagcggcgcccagacgacccgaccatgctttcctggatgtcagtgtgaagtagaaaccttcggcttgttcgactcctttagccttacgcgtgtggactgcagtggacttggtccccacatcatgccggttcccattcccctggacaccgcacatctggacctgagtagcaacaggctggagatggtgaacgagtcagtgctggctggcccagggtatacaactttagccgggctggacctatcgcacaacctgctaacatcgatttcccctactgcatttagcagacttcgctacctcgaatcattggacctgagccataacggtctgactgcacttccagcagaatcttttaccagtagccccttatcagacgtaaacctgtcccataatcagcttcgcgaggtcagtgttagcgcatag

SEQ ID NO: 210072 - DNA, 2574 bp, Artificial Sequence
  Description of Artificial Sequence: Synthetic coding sequence
atggagagcgaggacctgagcggccgggagctgaccatcgacagcataatgaacaaggtgcgagacatcaagaataaatttaagaatgaggatcttacagacgaactgagtctgaataaaatttctgcagataccactgacaattcaggcacggtgaaccagatcatgatgatggctaacaaccctgaggattggcttagtctgctcttgaaactcgagaagaatagcgtaccactgtcagacgcgctgctgaataaactgattggacggtactctcaggccatcgaggctttgccccccgacaagtacggccagaacgaaagcttcgcccgcattcaagtgcggttcgctgagctgaaagctatacaagaaccggacgacgccagggattatttccagatggcccgggctaattgtaagaaattcgcatttgtgcatatcagttttgctcagttcgaactgtcccagggcaatgttaagaagagcaagcagctgctgcagaaggccgtggagcggggcgccgtccctctcgagatgctcgagattgcacttcgtaatctcaacttacaaaagaagcaactgctgtctgaggaagaaaaaaagaacttgtcagccagcactgtattgacagcccaggaaagctttagtggaagcctcgggcatctgcaaaaccggaacaatagctgtgattctcgcggacagacaacaaaggctcggtttttgtatggagaaaatatgccaccccaagatgcagagattgggtaccgcaattcactgcgtcagacaaataaaactaagcaatcttgcccctttgggcgcgtaccagtgaacctgttaaatagtccagactgtgatgtcaaaacggatgattctgtggtgccctgctttatgaagaggcagacctctaggagcgaatgcagggatttggtcgtcccgggatcaaagccgtcaggaaatgactcatgtgaacttcgcaatctgaaatccgtgcagaatagccacttcaaagaacccctggtctccgatgagaagtcctctgaactgataattactgactccatcactctgaaaaataaaactgaatcttcccttctggctaaattagaagaaaccaaagagtaccaggagcccgaagtgcctgaaagcaaccagaagcaatggcagtcaaaacgcaagtcagagtgtatcaatcaaaacccagccgctagcagtaaccattggcagattccagaacttgcaaggaaagtgaacacagagcagaagcacactacattcgagcagcctgtgttttccgtctccaaacagtcccctcccatatctacctccaagtggttcgatcctaagagtatctgcaagaccccgtcatccaacacactggatgactatatgagttgcttcaggactcccgtggtgaagaacgacttcccgcctgcctgtcagctgtccactccttacggccaaccagcatgctttcagcagcagcagcaccagattctggccacccctttgcaaaatctgcaggtgcttgccagctcttcggccaacgaatgtattagcgtgaagggccggatttattcaatcctgaaacaaataggttctggcggtagcagcaaggtgtttcaggtattgaacgagaagaagcaaatctacgccatcaaatacgtgaacttggaggaagctgataatcagaccctggactcgtatcgaaacgaaatcgcatatctgaataagctccagcaacatagtgataaaataattaggctgtatgactacgaaattaccgatcagtacatctacatggttatggaatgtggcaacattgatctgaatagctggctgaaaaaaaaaaagtctattgatccgtgggagcgaaagagttattggaaaaatatgctcgaagctgttcacactatccatcaacatggcattgtccactctgacttgaaacccgcaaactttctaatcgttgacggaatgcttaaacttattgacttcggcatcgccaatcaaatgcagccagatacaacgagtgttgtaaaggactcacaagtgggtactgtgaactatatgcctccagaagcgattaaagacatgtcctcatccagggaaaatggcaagtctaaaagcaaaatctctcctaaatcagatgtgtggagcctgggttgcatcttgtactatatgacgtatggcaagaccccattccagcagatcatcaatcaaatctccaaactgcacgctatcatcgaccccaaccacgagatcgagttcccagacatccccgagaaagatctccaagacgttctgaagtgctgccttaagcgtgatcctaaacagcgaatttctatcccagagttactggctcacccttatgtgcagatccagacccacccggtgaatcagatggccaaagggacaacagaagagatgaagtacgtgctcgggcagcttgtgggcctcaactcccccaatagcattctcaaggcagccaagacactttacgagcactattcaggtggggaaagccataatagttcttcctcgaaaaccttcgagaaaaagcgaggtaagaaatag

SEQ ID NO: 210073 - DNA, 420 bp, Artificial Sequence
  Description of Artificial Sequence: Synthetic coding sequence
atggagagcgaggacctgagcggccgggagctgaccatcgacagcatcatgaacaaagtccgcgatattaaaaacaagttcaagaacgaagatctgacagacgagctttcactgaacaaaattagcgccgataccaccgataactctggtactgtcaaccagattatgatgatggcaaataatccagaagattggctctctctgctgctcaagctggaaaagaacagcgtccccctttcagacgcattactgaacaaactgatcggccgttatagtcaagcgatcgaagcactgcctcccgacaaatatggccagaatgaatccttcgccaggatccaggtcagatttgccgaactgaaagcaatccaggagccagatgatgcccgggattatttccagatggctcgcgccaattgttag

SEQ ID NO: 210074 - DNA, 531 bp, Artificial Sequence
  Description of Artificial Sequence: Synthetic coding sequence
atggagagcgaggacctgagcggccgggagctgaccatcgacagcataatgaacaaggtgcgggacatcaagaacaagtttaagaatgaggacctgacagatgagctgagcttaaataagatcagtgctgacactacagataattccggaaccgtgaatcaaattatgatgatggctaacaatccagaggattggctgtctctcctgctgaaactggaaaaaaattcagttccactctcggatgctctgttaaataagctcatcgggaggtactcccaggccattgaagccctaccgcccgataaatatggccagaatgagagttttgccagaatccaggtgcgttttgctgagctgaaggctattcaggaacccgacgatgccagggattactttcagatggcacgcgccaattgtaagaaattcgcctttgtccacatctcctttgctcaatttgagctcagccagggaaacgtaaagaagtctaagcagctgctccaaaaggccgtggaacggggcgccgtgccgtag

SEQ ID NO: 210075 - DNA, 453 bp, Artificial Sequence
  Description of Artificial Sequence: Synthetic coding sequence
atggagagcgaggacctgagcggccgggagctgaccatcgacagcatcatgaacaaggtgagagacatcaagaataagttcaagaacgaggacctcacagatgagttgagtttgaacaaaatcagtgctgacacgacagacaattccggcaccgtgaaccagattatgatgatggctaataatccagaggactggctgtcactgctgctgaaactcgagaagaactccgtgccgcttagtgacgcgctgctcaataaactgattggcaggtactctcaagcgatagaggcactcccacctgacaaatatggccagaatgagagttttgcaaggatccaggtgcgattcgccgagctcaaagccatccaagaaccagacgacgcacgtgactacttccaaatggcacgtgccaactgtaagaagtttgccttcgttcacatctcattcgcatag

SEQ ID NO: 210076 - DNA, 492 bp, Artificial Sequence
  Description of Artificial Sequence: Synthetic coding sequence
atggccgagggcggcggccagaaccaccacgaggtggtgaagttcatggacgtttatcagcggtcatactgccatccgattgagactttagtcgatatttttcaggagtatcctgatgagatagagtatattttcaaaccatcatgcgtccccctgatgcgatgcggtggctgttgtaacgacgagggcctcgagtgtgtacctactgaagagtcgaacattactatgcagatcatgcgaatcaaaccacaccagggtcagcatatcggcgaaatgtcatttttgcagcacaacaaatgcgagtgccgtcctaagaaggacagagcccggcaggaaaatccttgcgggccatgctctgagaggcgcaaacatttgtttgtgcaggatccccagacatgtaaatgctcctgcaagaacactgactctaggtgcaaggcacgccagttagagcttaatgaacgtacatgcagatgtgacaagccaagacgctag

SEQ ID NO: 210077 - DNA, 1368 bp, Artificial Sequence
  Description of Artificial Sequence: Synthetic coding sequence
atgaccaccatggccgccgccaccctgctgcgggccaccccccacttctcgggacttgccgccggaagaacctttctcctgcagggcctgttacgcctactcaaggcccccgccctcccgctcctttgccgcggccttgcggtggaggccaagaagacatatgtgagagataagccccatgttaatgtcggaacaattgggcacgtggatcatggtaaaactacattgacggcagccatcactaagatcctggctgaggggggtggggccaagttcaagaaatacgaggagatcgacaacgcgcctgaggaacgtgcacggggaatcacgatcaacgctgcgcacgtggaatacagtacggccgctcggcactacgcgcatactgactgtccggggcatgccgactatgttaaaaacatgataacgggcaccgcccccttagacggttgcatcctggtcgtggccgctaatgatggcccaatgcctcaaactcgcgaacatctgcttttagccagacaaatcggagtcgagcacgtggtggtttacgttaacaaggccgatgctgtgcaggattccgagatggtcgagctcgtggagttagaaatccgggagctgttgaccgaattcggttataagggagaggagacacctgtgatagtgggctcagctctgtgtgcgcttgaggggagggaccctgaactagggctgaaatctgtccagaaattgcttgatgctgtcgatacctatatccctgtacccgcaagagacctagagaagccatttctgctgcccgttgaagctgtatattcagtgcccggcagaggcaccgtggttaccggaactctcgagcgcggtattctgaaaaagggtgatgagtgtgaactactggggcactcaaaaaacattcggacagttgtgaccgggatcgaaatgttccacaaatctctggaacgagctgaggccggcgataatttaggcgccttagtgagagggctgaagcgagaagacctcagacgcgggcttgttatggtgaagcccgggtccataaaacctcatcagaaggttgaggctcaggtctacatcctctccaaagaggaggggggaagacacaaaccatttgtgtctcattttatgccggtgatgttttctctaacttgggatatggcctgtcgcatcatcttaccacctgaaaaagagctggccatgcccggggaagacttgaaattcaacctgattctgcgccaaccaatgattctcgaaaaggggcagaggttcaccctgcgcgatggcaataggacaatcggtactgggctggtgacaaacaccctcgccatgaccgaagaggaaaagaacatcaagtggggatag

SEQ ID NO: 210078 - DNA, 1611 bp, Artificial Sequence
  Description of Artificial Sequence: Synthetic coding sequence
atggccacccccgacgccggcctgcccggcgccgagggcgtggagcccgctccttgggcccagctcgaagcccccgctcgcctgctactgcaggctttacaggctggccctgagggggcgcgtcgggggttaggggtacttcgcgctctgggttcccgcgggtgggaaccgttcgactggggaagactgctggaagcactatgtagggaggaaccagtcgtgcagggaccagatggcagactcgagcttaaaccacttctgttaagactgcctagaatatgtcaaaggaaccttatgagcctgctcatggcggtgcgtcccagtttacccgagtccggcttgttgagcgtgcttcagatagcgcagcaggatctcgccccggatcccgatgcctggttacgggctttgggcgagctgctgcgtcgtgatctcggggtgggaactagtatggaaggtgcctctccactatccgagaggtgccaacgacaattgcagagcctttgccgcggcctcggtttaggtgggcgccggctgaagtccccacaggcgccagaccctgaggaagaggagaaccgggactcacagcagcctggaaagcgcagaaaagactcggaggaagaggctgcctctcctgaaggtaagagggttcctaagcggctgcgttgctgggaggaggaggaagaccatgagaaggagaggcctgaacataaatcactagaatcactggcagacggtggctccgcgagtcccattaaggatcagcctgtgatggcagtcaaaaccggagaagacggctcaaatctggacgatgccaagggactcgcagagtccctggaactcccgaaagccattcaggaccagctgcccagattgcagcagctcctgaaaactcttgaggaggggctagagggactggaggacgcaccacctgtggaattacagttacttcatgaatgcagcccaagccagatggacctcctatgcgcccagttgcagctgccccaactgtccgacttgggcttactccgcctgtgtacctggctactagccctttctcctgatctcagcctgagcaatgcgaccgtactgacccggagcctgtttctcggacgcattctaagcttgacctcttcagctagccggctgctgaccaccgcactgaccagtttctgtgcaaaatacacctatcctgtttgttcagccctcctcgatcccgtgcttcaggccccgggcactggacccgcacagacagagcttctgtgttgcctggtcaaaatggaaagtctggagcccgatgcacaggtccttatgctggggcaaattcttgagcttccctggaaggaagagacttttcttgtcctgcagagtctacttgaaaggcaggtggaaatgacccccgaaaaattctccgtattaatggaaaagctctgtaagaaaggccttgcagctaccacttcaatggcctatgcaaaactgatgcttactgtgatgaccaagtatcaggcgaacataacagaaactcaaagactaggcctggccatggccctggagcccaatacgactttcctccggaaatcattaaaagcagccctcaagcacctcgggccttag

SEQ ID NO: 210079 - DNA, 1470 bp, Artificial Sequence
  Description of Artificial Sequence: Synthetic coding sequence
atgcccctgcgggacgagaccctgcgggaggtgtgggccagcgacagtgggcacgaggaggagagtttgtctcctgaagcacctcgcaggcccaagcagcggcccgctccagcccagagattgaggaagaagaggacagaggccccggaatcaccgtgccctacagggtcaaagccccgcaagcccggcgaagaagaagaggaggaggaagacgaagaagacgaggaggaggaggccgaggaaaagaaggaaaagattcttctgccacccaagaagcccttgcgagagaagtcctctgctgatttaaaagagcgtagagccaaggcccagggacccagaggtgatctgggcagcccagatcctccacccaaaccattacgggttagaaacaaggaggccccggcgggagagggcaccaagatgcgcaaaacgaaaaagaagggcagcggagaggctgataaggaccccagcggtagtcccgcttccgctcgcaagtcaccggcagcgatgttcctggttggggagggcagtcccgacaagaaggccctgaaaaaaaagggaaccccgaagggggccaggaaggaggaggaggaggaggaggaagcagcgactgtcatcaaaaagtctaaccagaaaggaaaggccaaaggtaaaggtaagaaaaaagccaaagaagaaagggctcctagtcctcccgtggaagtggatgaaccaagagaattcgtgttacgcccagcaccccaaggtaggacggtaaggtgtcgactcacccgtgataaaaagggaatggaccggggaatgtacccctcatactttctgcaccttgacaccgaaaagaaagttttcttgcttgcaggacggaaacgtaagcgctcaaaaaccgccaactatcttatttcaatcgaccctacaaacctttcacgagggggagaaaactttattggaaagctgaggtccaacttgcttggaaacagatttacagtattcgataatggacagaacccccagagaggttacagcaccaatgtggcttccctgaggcaagagctcgcagccgtgatttatgagaccaatgtgctgggctttaggggccctcggcggatgactgtgatcatccccggaatgtcggcggaaaacgaaagagttcccattcgccctcgcaacgcttctgacggtttgctggtccggtggcagaacaagacattggaatcattgatagaattacataacaagcctcctgtgtggaacgatgactctggatcttatacacttaatttccaaggacgtgtgacgcaagccagcgtaaagaatttccagatagtgcacgccgacgaccctgattacatcgttttacaatttggcagggtggctgaggacgcctttactcttgactaccggtaccctctctgtgcgcttcaggccttcgcgattgctctgtcatccttcgacggtaagctggcatgtgaatag

SEQ ID NO: 210080 - DNA, 561 bp, Artificial Sequence
  Description of Artificial Sequence: Synthetic coding sequence
atgcccctgcgggacgagaccctgcgggaggtgtgggccagcgactcaggacacgaggaagagtccctttctcccgaagctcctcgaagacccaagcagagacccgcccccgcccagcgtctccggaagaagagaaccgaagctcctgagtctccttgtccaaccggtagcaagccaagaaagccaggtgaggaagaagaagaggaggaagacgaagaggatgaggaggaggaggcagaagaaaagaaggagaaaatactcttgccaccaaaaaaacccttgagagagaaatcatctgccgacctgaaagagagaagagccaaggcccaggggccccgcggggacttgggttccccggaccctccccccaaaccgttacgggtcaggaataaggaagcaccagctggtgagggcaccaagatgcgcaagacgaagaagaaaggtagtggagaagcagacaaggatccaagcggctcaccagcctccgccagaaaatcccccgccgccatgtttcttgtgggtgaaggtagccctgacaaaaaagcactgaagaaaaagtag

SEQ ID NO: 210081 - DNA, 3033 bp, Artificial Sequence
  Description of Artificial Sequence: Synthetic coding sequence
atgggcgcctacgcccgggccagcggcgtgtgcgcccggggctgcttagactccgcgggaccatggaccatgagtagagcactgcgacctcccctacctcctctatgtttctttcttctccttctcgccgcggctggtgctcgggccggcgggtacgagacatgcccgaccgtgcagcctaatatgctgaatgtacacctgctcccacatacccacgacgacgtgggatggctcaaaaccgttgaccaatacttctatggcatcaagaacgatatccaacacgctggtgtccaatacattctcgattctgtgatctcggccttgctggccgaccctacacgcaggttcatctacgtggaaatcgccttcttctcccggtggtggcaccaacagacgaatgccacgcaggaggtggtgcgggatctcgtgcgacagggccggttggagtttgccaacggaggttgggtcatgaatgacgaagccgcaactcactacggcgccatcgtcgaccagatgactctgggcctgagattcctggaagacacatttgggaacgatggcagaccaagggtagcatggcatatcgaccctttcggtcatagtagagaacaagcatcactcttcgctcagatgggttttgatggttttttcttcggccgcttggactatcaggacaagtgggttcgcatgcagaaattggaaatggagcaagtatggagagcctcaacctcattgaaacccccgactgctgacctgtttaccggcgtcttgccaaacggttataacccaccacgtaacctttgctgggacgtcctgtgtgtcgaccaacctctcgtagaagatcctcggtcaccggaatacaatgccaaagagcttgtggactacttcctgaacgtggccactgcccaaggacggtactacaggactaaccatactgtgatgactatgggtagcgatttccagtacgagaacgcaaacatgtggttcaaaaacctggacaagctgatccggctcgtcaatgctcaggccaaagggtcctctgtccacgttctgtatagtacccccgcttgctacttatgggaactgaataaggcgaacctgacttggtcagttaagcacgatgactttttcccttatgccgacggcccgcaccagttctggactggctacttcagtagcaggcccgcgcttaagcggtatgagagactgagttataactttttacaagtctgtaaccaactcgaggccttggtcggattggccgccaatgtcggaccttacggaagtggtgattccgcacccctgaatgaggccatggccgttcttcagcaccacgacgcggtgtccgggacgtccaggcagcatgtggcaaatgattacgcgcgccaactggcagccggctgggggccttgtgaggtcttattatccaacgcactggctagacttaggggcttcaaggatcacttcactttctgtcaacagcttaatatctcaatatgtcctttgtctcagaccgccgctcgcttccaggtgatcgtgtataatcctctaggacgtaaggtcaattggatggtacgactccctgtgagcgaaggagtgtttgttgtgaaagatcccaacggccggaccgtgccgtccgatgtagtgatttttccttcctctgactcgcaggcccatccccccgagctcctgtttagtgcctccttgcccgccttagggtttagtacctacagtgtcgcccaggtcccaagatggaagcctcaggctagggccccacaacccattccacgacggtcctggagcccagccctgactatagaaaatgaacatatccgggctacgttcgaccctgacaccggcctactgatggagattatgaacatgaaccaacaactgctgctgcctgtacgacaaacgttcttctggtataacgcctcaatcggagataatgaaagtgaccaggctagtggcgcttacatttttcgccccaatcaacaaaaacctctgcctgtgtctcggtgggcccaaatacacctggtcaaaactccattggtgcaggaggtgcaccaaaatttctccgcctggtgtagtcaggtggtcagattgtaccctggccagcggcacctggagctggaatggtccgtcgggcccataccagtcggggatacgtggggcaaggaggtgatctccaggttcgacaccccactggaaacaaaaggccggttctacaccgactccaacggaagagagatcctggaacgccggcgagactaccgcccgacctggaagcttaatcaaacagaaccagtcgccggaaattattacccagttaatacacgaatatacatcacagatgggaatatgcagctcacagttttgaccgaccgcagtcagggggggtctagcctgcgtgacggtagcctcgaactgatggttcacagaagactgttaaaggacgacgggagaggggtcagcgagccacttatggaaaatggatcaggggcatgggtgaggggccgccacctagttttgctggacacagcacaggctgcagccgctggccataggctgctcgccgaacaggaggtgcttgcaccacaggtggttttagctccaggcggcggcgctgcatacaatctgggggccccacctcggactcagtttagcggactgcggcgagacctcccccctagtgtacacctcctgacgcttgcaagctggggaccagagatggtgcttttgcgactcgaacatcagtttgctgtcggtgaggattcaggcaggaatttgtcagcccccgtgaccctgaacctgcgggacctgttcagcacgtttaccattaccaggctgcaagagaccactttggtggcgaaccagctccgggaggccgcctcgcgcctaaagtggacaaccaatactgggccgacgcctcatcagaccccgtatcagctggaccccgcgaacatcacattggaaccaatggagataaggacatttttagcgagcgttcagtggaaggaagtggatggatag

SEQ ID NO: 210082 - DNA, 1158 bp, Artificial Sequence
  Description of Artificial Sequence: Synthetic coding sequence
atgcacgtgtgcgtgtgcgtgtgcgtgtgcgtgtacatgcccgtgtgcgtcgacgcctgtatgtgttgcgaggccggtagacccgccttccgatcttttttattttcactatgttccgacctcggcgccgtcattagtttacttctgtggggccggcagttgtttgccttgtatagcggtaatgatgtcactgatatctccgacgatcgcttccccaagccaccagaaatcgccaacggctatgtggaacacctgttccgctaccagtgcaaaaactactaccgactgcgaacagagggagatggcgtgtacacactgaatgacaagaagcaatggatcaacaaggcagtgggagataagctgccagagtgcgaagccgtgtgcgggaagccaaaaaaccctgccaatcctgtgcagagaatcttgggcgggcaccttgatgccaagggatccttcccatggcaggccaaaatggttagccatcataatctgaccactggggccactctcataaatgaacagtggctgcttactacagctaaaaatcttttcttgaaccactccgaaaacgctaccgccaaagacattgctccgacactaaccctgtatgtgggcaaaaagcagctggtagagatcgagaaggtggttctgcaccccaactaccaccaagtagatatcggcttgattaagttgaaacagaaggtgctcgtgaacgagagggtcatgccaatttgcttgccttccaagaattatgctgaagtgggcagagtcggatatgtgagcggctgggggcagtcagataactttaagctcaccgatcatctcaagtatgtaatgttacccgtggcagaccagtacgactgtataactcattatgagggctctacctgccccaagtggaaggcacctaagtcgcccgtcggagtgcaacctatcctgaatgagcatactttttgcgtagggatgtcaaagtaccaagaggacacttgctatggcgacgcgggttcagcattcgcagtccacgatctcgaagaagacacttggtacgctgctggcatactatcgtttgataaatcatgtgcagtggccgagtacggagtctacgtgaaggtcaccagcatccagcattgggtccagaagactattgccgagaactag

SEQ ID NO: 210083 - DNA, 1329 bp, Artificial Sequence
  Description of Artificial Sequence: Synthetic coding sequence
atggaggccagccggtgccggctgagccccagcggcgacagcgtgttccacgaagaaatgatgaagatgaggcaggccaaattggactatcagcgcctgctattggagaaacgccaaaggaaaaaacgtttggaaccatttatggtacagcccaatcctgaggctcggttgcggcgggccaagcctcgggctagtgatgagcagactccgctggttaattgccatacaccccactcaaatgtcattttacatggcatcgacggccctgctgcggtgctgaaaccagatgaggtacatgcaccctcagtaagtagctccgtagtggaagaagatgccgagaacacagttgacactgcaagtaagcccggactgcaggaacgccttcagaaacacgatatttcagagtctgtgaatttcgacgaggaaacagatggcatcagccaatcggcttgcctggagagacctaactccgcctctagtcaaaacagtacagacactggtacaagcggatccgcaacggccgcacagcctgccgataacttgttgggggatatcgacgatttggaggatttcgtatattctcccgccccccagggagtgacagtgcggtgccggattatcagagataagagaggcatggatcgaggcctgtttccaacctattatatgtatctggaaaaagaagaaaaccaaaagattttcctcctggcagcccgcaagaggaaaaaatccaagaccgcaaactacctgatcagcattgatccagtcgacctgagcagggagggggagagttatgtaggcaagttacggagtaacttaatgggaacaaaatttaccgtgtatgacaggggcatctgtcctatgaaaggcagagggttagtgggagcagcccatacccgccaggagcttgctgcaataagttacgagaccaatgtgttgggattcaagggaccaaggaagatgagtgtcatcattcctgggatgaccctcaaccacaaacagatcccctaccagccacagaacaatcatgacagcttgctttctagatggcaaaatagaaccatggagaacttggtcgaactgcacaataaagcacccgtctggaacagcgatacacaatcctacgtccttaacttccgaggaagagtaactcaggctagtgtcaagaatttccagatagtgcacaagaacgatcctgactacatcgtgatgcagttcgggcgggttgcggacgacgtgttcactctcgactacaattacccactgtgtgctgtgcaggccttcggaatcggtctatctagcttcgactccaaactggcttgcgagtag

SEQ ID NO: 210084 - DNA, 513 bp, Artificial Sequence
  Description of Artificial Sequence: Synthetic coding sequence
atgatgaagatgcggcaggccaagctggactaccagcggctgctgttggagaaaaggcagcgcaagaagagacttgagccctttatggtgcaacccaatccggaggccaggctgcgtagagctaaaccacgcgcatcagacgaacagacacccttagtcaactgtcatacaccccacagtaatgtgatcctccatggcattgatggaccagcggcagtcctgaaacccgacgaggtgcacgctccgtcggtgtccagctctgtggtggaagaggacgcagagaacactgtcgatacagccagcaaacctgggctgcaggaaagattgcagaaacacgatatttccgaatctgtgaactttgatgaagagacggatggaatttctcagtctgcttgcctcgagcgcccaaattccgcttcatcacaaaattccacgttctcgtcattttgtcagaaaaccgaagacacagggtatcgccacttccggttttgttattgcagacccacttcttag

SEQ ID NO: 210085 - DNA, 801 bp, Artificial Sequence
  Description of Artificial Sequence: Synthetic coding sequence
atgctgaagaccccctggatcctgctgcccagccaggacttccggtccgtttctaagagcatggatacaggcacatccgggagtgccaccgccgctcagcccgctgataacctccttggagatattgatgatctggaggacttcgtatatagccccgcacctcaaggcgtgaccgtcaggtgccgcatcattcgagacaagagggggatggatcgcgggttgttcccgacctactacatgtatcttgagaaggaggagaatcagaaaatttttctgctggcagcgcgcaagagaaaaaagtctaagaccgcaaattacctaatctcaatcgatccagttgacctgtcccgcgaaggagagtcctacgtgggcaaactccggtctaatctcatgggcactaaatttacagtatatgatagaggaatctgcccaatgaaggggagaggcttggttggcgctgcccatacacggcaggaactggctgcgatcagctataatcacgatagcctcctctctagatggcagaaccgcacaatggaaaacctggtggaactgcataataaggctcccgtttggaattctgatacccaatcctacgtcctgaacttccgggggcgcgtcacacaggccagcgtcaaaaatttccaaatcgttcacaagaatgatcccgactacatagtgatgcagtttggacgcgtcgccgatgatgttttcactctggactacaattaccctctctgtgcagtgcaggcctttgggatcgggctctcttcctttgacagcaagctggcctgtgagtag

SEQ ID NO: 210086 - DNA, 1506 bp, Artificial Sequence
  Description of Artificial Sequence: Synthetic coding sequence
atggaggccagccggtgccggctgagccccagcggcgacagcgtgttccacgaagaaatgatgaagatgcgccaagccaaactggactaccagcgactgctcctcgagaagagacagcggaaaaagaggctggagccctttatggtccagccaaatcctgaggccaggctgcggagagccaaaccaagggctagtgatgagcagacacctttagtcaattgtcacacccctcactcaaacgtcatcctccacgggattgacggccccgccgcagtgcttaagcccgatgaggtgcacgccccaagcgtcagcagttcagtggtggaggaggatgccgagaacacagtggatactgcaagcaagcccggtctccaggaaaggctccagaagcatgatatttctgaatccgtgaacttcgatgaagagaccgacgggatctcccaaagcgcttgcctggaaaggcctaattctgcctcatctcagaactctacggacactggcacctccggtagtgcaacggctgcgcagcccgccgataatttgctaggagacattgacgatttggaagacttcgtatacagccccgcaccacagggggtgactgtccgctgccgtatcatacgcgataagcggggcatggacagagggctgtttccaacctattatatgtacctggagaaggaggaaaaccagaagatcttcctgctcgctgcacgcaaaagaaagaagtcaaagacagcaaattaccttatttctattgacccagtggatctgtcacgggagggcgaatcatacgtcggtaaactgaggagtaacctgatgggaacaaagttcactgtatatgaccgggggatctgcccaatgaagggccgagggctggtgggggctgctcatactaggcaggaacttgcggccatctcttacgaaacaaatgtgctcgggttcaaaggtccaaggaagatgtccgtgatcatcccaggcatgactctgaaccacaaacagattccataccagccccagaataatcatgattcactgttatctcggtggcagaataggacaatggagaacctggtggagctgcataacaaagctcccgtatggaattccgacacccaatcctacgttctgaactttcgcggccgggtcacacaggccagtgtgaagaactttcagatcgtccataaaaacgatcccgactacattgttatgcagttcgggcgggttgccgatgatgtgttcaccttggactataactatcctctctgcgccgtgcaagccttcggcattggtctctcttcttttgacaagtgtattcaaactctgcgaatgcaggagctgtgtgaactgcaccgacagcaccactcagccgcaagcctggttcacaggacagtatgccagcggtgggtgggacatccgtggcgcctactacctcagacctcccttctgtggaccgacctgagtccaccccctgtggtgcccgcacctcatcagatctccatgtag

SEQ ID NO: 210087 - DNA, 1269 bp, Artificial Sequence
  Description of Artificial Sequence: Synthetic coding sequence
atggccctgagcgacgagcccgccgccggcggccccgaggaggaggcagaagatgagacgctagcctttggcgcggcacttgaggctttcggtgagtctgcagagacgagagctctgctcggaagactacgcgaggtgcatgggggaggcgccgagcgcgaggtggccctagagcgcttcagggagtggatgatgaaccttttgctagacattgttcaagaccagacatcccccgctagcctggtgcatctcgctttcaagtttttatacattattaccaaagtgcggggttacaaaacatttcttagattattcccccatgaggtggctgatgtggaaccagtgctggacctggtgacaatccagaacccaaaggaccacgaagcctgggaaacaaggtacatgcttctcttatggctatccgttacttgcctcattccctttgacttttcccgactcgatggcaatttgcttacccagccaggccaagcgaggatgtccataatggatcggatcctccagatagctgagtcttatttgattgtttccgacaaggcacgcgatgctgccgcagtcttggtaagcaggttcatcacaaggccggacgttaagcagagtaagatggccgagtttctagactggagtctgtgtaacctggcccgaagttcctttcagacaatgcagggcgtgatcactatggatggcacactgcaggctctggcccagatcttcaaacacggcaaacgggaagattgtttaccatacgcggcaacagtcctgcggtgtttagacggatgtaggcttcctgaaagtaatcagactctgctgagaaagttaggcgtcaagcttgttcaacgcctagggctcacctttctcaaacctaaggtggccgcttggaggtaccagcgcggttgccgaagtttagctgccaatctccagctcctgactcaggggcaatctgagcagaagcccctcatacttacggaggatgacgacgaggacgatgacgtgccagaaggtgtggagcgggtgattgaacagcttctggtgggtctgaaagacaaggatacagtagtgcgatggagcgcagccaaggggatcggacgtatggctgggcgactgccaagggctctggctgacgatgtggtgggctccgtgttggattgctttagtttccaagaaacagacaaagcctggcacgggggctgtctcgcactcgcagagctgggcaggcgcgggctgctactcccgtctagattggtggactag

SEQ ID NO: 210088 - DNA, 2997 bp, Artificial Sequence
  Description of Artificial Sequence: Synthetic coding sequence
atggacggcaccctgcaggccctggcccagatcttcaagcacggcaaacgcgaggattgtctgccctatgctgcaacggtgctaaggtgtcttgatggctgtaggctgcccgagagcaaccagactctgcttagaaagcttggtgtcaagcttgttcagcgactcggtctgacatttctgaagcccaaggtcgccgcttggcggtatcaaagggggtgtcggagcctcgccgcgaacttgcagctgctgacacaggggcagtctgaacagaagcccctcatcctgaccgaggacgatgacgaggacgacgacgtccctgagggcgtagagagggtcatcgagcagttgttggtggggctgaaagacaaggatacggtcgtcaggtggtctgccgccaaaggaattgggcggatggcggggaggctgccacgtgcgcttgcagacgatgttgtaggctctgtcctcgattgtttctcctttcaagaaacagacaaagcgtggcacgggggatgccttgcactcgcggaactcggtagaaggggactcttgctgcctagtaggctcgtggatgtcgtagcagtgatcctgaaagctctgacttacgatgagaaacgcggcgcttgttccgtgggaacaaacgtgcgggatgccgcctgttacgtctgctgggccttcgctcgtgcatacgagcctcaagagctcaaacctttcgtgaccgccatcagcagtgccctggtgattgccgccgtgttcgatcgtgatataaattgtagacgggctgcatctgcagcatttcaagaaaatgtcggacgccaagggacctttccacatggcatcgatatcctgacgacagccgattatttcgccgttggcaatcggtctaactgttttctggttatctccgtattcatagccgggtttcctgaatatacccagcctatgatcgatcacttggtgacaatgaagatctcgcactgggatggtgttattagagaattagccgcccgcgccctgcataatctggcccaacaagcccccgagttttccgctacccaggtgttccctagactcctatccatgaccctctcccctgacctccacatgagacatggatcaatcctcgcctgcgcggaagtggcttatgctctttacaaactggccgcccaggagaaccgaccagtgaccgaccatctcgatgagcaggccgtgcaggggctaaagcagattcatcagcagctctacgaccggcagctgtatcggggcttaggcggacaactgatgaggcaagcagtttgcgtcctgattgagaagctctccctcagcaaaatgccctttcggggtgataccgtcattgatggctggcaatggctgattaatgacacactgagacacctccatttgattagcagtcatagcagacagcaaatgaaggatgccgcggtttctgctctagccgcactctgctctgagtattacatgaaggagcccggggaggcagacccagccatccaggaggagttgatcacacagtacctagccgagcttcgtaaccccgaagaaatgaccagatgtggcttttctctagccctgggtgctctaccgggcttcctgctcaaaggacgcctccaacaggtgctaaccggtcttcgggctgtcacccacacttccccggaagacgtgtcctttgccgaaagccggcgtgatggcctgaaggccattgccaggatatgccaaacagtcggggtgaaagcgggagcgcctgacgaggcagtgtgcggggagaacgtgtcacagatttattgtgcgctactgggatgcatggatgactacacaaccgattcccgcggggatgtgggtacatgggtaagaaaggccgccatgacctctttaatggatctgaccctgctgctcgcccgaagccagcccgaactgatagaagcccacacctgtgaacggatcatgtgctgtgttgcccaacaggccagcgaaaaaatcgaccggttccgtgctcatgcggcttcagtgtttttgactttgctgcattttgactccccgcctataccacatgttccacatcgcggggagcttgaaaaactttttcccagatccgacgtcgcgagtgtgaattggtctgcaccgtcccaggctttccctagaattactcagttacttggattgccaacctatcgctaccacgtcctgcttggcctggtcgtgtctctcggcggcctaacagagagtaccatcagacactctacccaatcattatttgaatacatgaagggcattcagtctgacccccaagccctcggctctttctccggtaccttactgcagatctttgaggacaatctcctcaacgagagagtgagcgtccctttgctcaaaacattagaccatgtccttacacatgggtgcttcgatatttttaccactgaggaggaccacccttttgccgtcaagctactggccctctgtaagaaggaaatcaagaattctaaggacattcagaaactcctttccggtattgcagttgactttccctctgccacactggtgtgcgtcggcacagtgcagatgtacgcccatacccatctgcggttaggggcacccggcccgcactgcgctcatggctccgctttgcctaggttttgtgagatggtgcagttcccaggggatgtccgccggcaggcgctgctacagctgtgccttctactatgccaccgttttcccctgatcaggaaaactactgctagccaggtctacgagaccctgctgacctatagtgacgtcgtcggagcggatgtgttggacgaggtggtgactgtgttaagcgacacagcatgggacgcggagctggctgtagtcagagagcagagaaaccggttgtgcgatctcctcggtgttccaccatcatggtgccccacctggtgcctattaaaacctgtactggagccaatccctcatccctgcctggttcgaatgagttgcagttag

SEQ ID NO: 210089 - DNA, 3579 bp, Artificial Sequence
  Description of Artificial Sequence: Synthetic coding sequence
atggccctgagcgacgagcccgccgccggcggccccgaggaggaggccgaagacgaaacattagctttcggggccgcactggaggccttcggcgaatctgccgagactcgtgctttgttgggaaggctccgcgaggttcatggcggaggtgccgagagggaagtagccctggagaggttcagagtcataatggataaataccaggagcagccccacctacttgaccctcacctggagtggatgatgaacttgcttctggacatcgtccaggaccaaactagccctgcctctctggtccacctggccttcaagtttctgtacatcattactaaggtgcggggatataaaacatttcttcggctcttcccacatgaggtagcagatgtcgagccagtgttggatctggtgacaatccagaatccgaaggaccacgaggcctgggagacacggtatatgctgctgctgtggttatctgttacctgcctgattccgttcgacttctcacgtctggatggcaatttactgacgcagccagggcaggccagaatgagcatcatggacagaattttgcagatagctgagtcatacctgatcgtgagcgacaaggctagagacgcagcggccgtgctcgtgtccagattcatcactcggccagacgtaaagcagagcaagatggcagagtttttggactggtccctgtgcaacctcgctcgatcatcttttcagacaatgcagggtgtgatcaccatggatgggactttgcaggccctcgcgcagatattcaagcacggaaagagagaagactgtctgccgtatgctgctacggtcctccgctgtctagatggatgtagacttcccgagtccaaccagaccctgctccggaagctgggagttaaactggtgcagcggctggggctgactttcctgaagcctaaggtggccgcctggcgctatcaaagaggatgccgctctttggcagctaacttgcagcttctgacccagggccagtccgaacaaaaacctcttattctgactgaagatgatgatgaggacgacgacgtccctgagggcgtggaacgcgttatcgaacagcttttagttgggttgaaagacaaggataccgtcgtaaggtggagtgcggctaaaggcattggcaggatggcgggcaggctgcccagagctctcgcggacgacgttgtgggatcagtactggattgtttcagttttcaggaaacagataaagcttggcacggcggatgtttggcactcgccgaattaggtaggcggggactgctccttccttcccggctggtcgatgttgtggctgtgatcctgaaggcgctcacctatgatgagaaacggggtgcctgctccgtgggtactaacgtgcgggacgccgcgtgctacgtttgttgggcttttgcacgtgcttacgagccacaggaactgaaaccatttgttaccgcaattagcagcgcactggtgatcgctgcagtgttcgaccgcgacattaactgtcgaagagcggcctctgcagcctttcaggaaaatgtgggacggcaagggacatttcctcacgggatcgacatactgacgaccgccgattatttcgcggttgggaaccgatctaattgttttttggttattagcgtctttatagccggctttcctgaatacactcagcctatgattgatcatctcgtgaccatgaaaataagccactgggacggagtaattagggaactggcggctagagcattgcacaatctggcacagcaggcccccgagttcagtgcaacacaggtgttcccccgcttgttgagcatgaccctgagtcctgatctgcatatgcggcatggctctatcttggcttgcgccgaggtggcatacgccctctataagttggccgcgcaagaaaatcgcccagtgactgatcatctggacgagcaagcagtccaagggctgaagcaaattcaccaacagctttacgatcgacagctctaccggggacttggaggccagctgatgcgacaggctgtctgtgtgctcatcgagaagctgagtctgagcaagatgccctttcgcggggataccgtcattgacggttggcaatggctgatcaacgacacccttcgtcacctgcaccttatcagctcacacagcagacaacagatgaaggacgccgccgttagcgccctcgctgccctgtgctcagagtattatatgaaggaaccaggcgaggcagatcccgcaattcaagaagaactgatcactcagtacctggccgagctccggaaccctgaggagatgactcgatgcggattctcactcgcactaggcgccctgccggggttcctgttgaaaggtagattgcagcaagtgctgactggacttcgagccgtgactcatacgtctccggaggatgtttctttcgctgaatccagacgcgacgggctaaaggccatagcgaggatttgccagacagttggagttaaggccggggcacctgacgaggcggtctgtggagaaaatgtctcccagatttattgcgccctgctggggtgtatggatgattacaccacagactccaggggtgacgtcgggacttgggtccggaaggcagctatgacaagtctgatggatctgacattgctcctggcacggtcgcaaccagagctgattgaggcccacacctgcgagcgcattatgtgttgcgtagcacagcaggcgtctgagaaaattgatcgcttcagagcccacgccgcttccgtgttcctgacactgttgcacttcgactctccacctatcccacacgtgcctcatcggggcgagctcgaaaaactctttccaaggagtgacgtggcgtccgtgaactggagcgccccatcacaggccttcccaaggattacccagcttctgggcttgcccacataccggtaccacgtgctgctggggcttgttgtcagcctgggggggctgacggagtccacaatccgccacagcacacagtcgctctttgaatacatgaagggtatacagtccgacccccaggctctcggctccttcagtggcacactattgcagatctttgaagataacctcctaaatgagagagtgtcagtcccactgctaaagaccctggaccacgtgctgacgcatgggtgttttgacatatttacaaccgaagaggatcacccattcgctgtcaaactgctagcgttgtgcaagaaggaaattaagaactcgaaggatatacaaaaattgctctctggcatcgcggttttctgcgagatggtgcagttccctggtgacgttagacggcaggcacttcttcagctgtgtctgctcctgtgtcaccggtttcccttgatcagaaaaactactgcaagccaggtgtatgagacccttctcacctacagcgacgttgtcggtgctgacgtgctggacgaagtggtcacagtgttatccgacaccgcctgggatgccgagcttgccgtggtaagggagcagaggaaccgcctctgcgatctgctcggtgtgcctcggcctcagctggtgccccagcccggtgcttgctag

SEQ ID NO: 210090 - DNA, 936 bp, Artificial Sequence
  Description of Artificial Sequence: Synthetic coding sequence
atggccggccggctgccccgggccctggccgacgacgtggtgggctccgttctggattgtttctcctttcaagagactgataaggcttggcatggaggatgtctcgcactggcggagctgggtcgacgcggactgctgctgccgagccgtctggtggacgtggtagccgtgatcctgaaggcccttacgtacgatgaaaaacgaggggcctgttccgtcgggaccaacgttagggatgccgcttgttatgtgtgttgggcgttcgccagagcatacgagccacaggaactgaagccgttcgtgactgcaatcagctcagctctggtgattgccgctgtgttcgatagggatattaactgtaggcgcgccgcctcagccgccttccaggagaacgttggacggcaggggacgttcccccacggcattgacatcctgactacagccgattatttcgccgtcgggaataggtctaattgctttctcgttatctcagtctttatcgccggctttcctgaatatactcagcctatgatcgaccatctggtgaccatgaaaatctcacactgggacggcgtgataagagagctggctgctagggcgctgcataacctggctcaacaagccccagaattttctgctactcaggtttttcctcgcttgctgagcatgacactttcccctgacctccatatgcggcacggttctatcctagcttgtgctgaagtcgcttacgcgctgtataaattagctgcgcaggaaaatagacctgtcacagatcacctggacgagcaggccgttcagggcttgaaacagatacatcaacagccttgcatctgttcctggggactgatgtcaccagaatcgaaagcagaattctgcgtatgcgtgtgccgcataagcctcgggaggcagtgtgtccatttgtccggactctag

SEQ ID NO: 210091 - DNA, 2253 bp, Artificial Sequence
  Description of Artificial Sequence: Synthetic coding sequence
atggccctgagcgacgagcccgccgccggcggccccgaggaggaggctgaggatgagactttggcgtttggtgccgccctcgaagccttcggtgagagcgctgaaacaagggctctgctcggtaggctgagagaggtgcatggtggcggcgccgaacgggaggtcgccttggagagatttcgtgttatcatggacaaataccaagaacagcctcacttactagaccctcacttggagtggatgatgaatttgctgctggacatagtgcaggatcagacgtccccagcctcactggtccaccttgccttcaaatttctctatatcatcaccaaagtacggggttacaaaactttcctacgactctttccacacgaagtcgcagatgtggagccggtgctggatcttgttacgattcaaaacccaaaagaccacgaggcctgggaaacccgatacatgctcttgctgtggctttcagtaacatgtcttattccattcgacttttcccgtctagatgggaacttacttactcagcctggccaggctcgtatgtccattatggaccggatcttgcagatcgcagagtcttacctgattgtctccgataaagcccgagacgcagcggccgtgctagtgtcaagatttattacgagaccggatgttaaacagtctaagatggctgaattcctagattggtcactctgtaatctggcacggagctcttttcagacaatgcaaggagtcatcacaatggacggaaccctacaggcattagcccagatctttaaacatggtaagagagaagactgcttgccgtatgcagcaactgtgctgcgttgcctcgacgggtgtagactgccagagagtaatcaaacattactgcgaaagctgggggttaaactggttcaacgcctgggcctcactttcctgaagccaaaagtcgccgcctggcgatatcagcgtggatgtcgatcccttgcggctaacctccagttactgacgcagggacaaagtgagcaaaagcctttaatccttacggaagatgatgacgaggatgatgatgtcccagagggggtggagagggttatcgaacaacttttggtggggctgaaagataaggacaccgttgttcgctggtcggctgcaaaaggcattggaaggatggccggaaggcttcctcgagctttggctgacgatgtcgtgggctccgtcctagactgcttctcatttcaggagaccgataaagcctggcatggaggatgcctggccctggctgaactcggcaggcggggccttctcctgcccagccggttggtggacgtcgtcgccgttatcctcaaagcactgacctacgatgaaaaacgcggggcttgctcagttggcacaaacgtccgcgacgcagcatgttatgtctgctgggcttttgcgcgggcttacgagcctcaggagctaaagccctttgtgacggcaattagctctgcccttgtgatcgcagcagtgtttgaccgcgatataaattgccggcgcgccgcttccgccgccttccaggaaaacgtcggtcgtcaagggacgtttccacacggcattgacattttgacaaccgctgattattttgcagtcggtaatcggagcaattgttttctggtgatcagcgtgttcattgccggttttcccgagtacacccagccaatgattgaccacctggtgactatgaagataagtcactgggacggcgtgattagagagcttgcagcccgggctctgcataacctcgctcaacaggctcccgagttcagcgcaacacaggtctttccccggctgctgagtatgacactgtcgcctgacttacacatgcgacatggctcaatcttggcctgtgccgaggtggcctacgctctctacaaattggcagcgcaagagaatagaccggtgactgatcacctcgacgagcaggcagttcagggattgaaacagatccaccaacaactgtacgaccgccagctgtatcgcgggcttgggggacagctcatgcgtcaagccgtttgtgtcctcattgagaaactttccttgtcaaagatgccgttcagaggtgatacggtgatcgatggctggcagtggctgatcaacgattctctgtggctcttggtgggcctgggtcggccctcccgcttacctagtgaacggccagcacccgccgggagtcaccggtttaagtcttcatacccacattttccacggggaagaaagttttgttag

SEQ ID NO: 210092 - DNA, 555 bp, Artificial Sequence
  Description of Artificial Sequence: Synthetic coding sequence
atgaagggcatccagagcgacccccaggccctgggcagcttcagcgggaccctgttacagatattcgaggacaacctcctcaacgagcgtgtgagtgtgcctctgctgaagacactggaccatgtcctcacccatgggtgttttgacatcttcactacagaggaagaccacccctttgcggtgaagcttttggccctttgtaagaaagagataaaaaattctaaggatattcagaagttactgtcaggtatcgccgtgttttgcgagatggtgcaattcccaggagatgtgaggcgacaagccctgttgcaactgtgtctccttctctgccatagattccccttgatcaggaaaactacagcgtctcaggtgtacgagacacttctgacttactcagatgtggtgggggctgatgtgctggatgaggtcgtgactgtactgagcgatactgcttgggacgccgagttggccgtggtccgggagcagcggaacagattgtgcgatctgttgggagtgccaaggcctcagctggtgccacagccgggtgcttgttag

SEQ ID NO: 210093 - DNA, 1584 bp, Artificial Sequence
  Description of Artificial Sequence: Synthetic coding sequence
atgagcgacaccctgaccgccgacgtgatcggccggcgggtggaggtgaatggcgagcacgctaccgtgcgtttcgctggcgtcgttccacccgtggcagggccctggctcggtgtcgaatgggataatcccgagagaggcaaacacgacgggtcgcacgaaggtacagtgtatttcaaatgtcgtcaccctactggtgggtcattcatccggcccaacaaggtgaatttcggaactgatttcctgacggctatcaagaatcgatacgtcctcgaggatggaccagaagaagaccggaaggagcagatcgttaccatcgggaataaacctgtcgaaacaatcggctttgacagcatcatgaagcaacagtcccagttatctaaactgcaagaggtgtccctccggaattgtgcagtgtcttgtgcaggtgagaaggggggcgtagctgaagcatgcccaaacattcgaaaggtagacctgagcaagaatctcctgagcagctgggacgaagtgatacacatagcagatcagctgcgtcacctcgaagtactgaacgtgtccgaaaataagctaaagtttcctagtggttccgtgctgacaggcactctctctgttctaaaagttctggttctcaaccagactggaatcacatgggctgaagtattgagatgcgttgccggctgccctggtctggaagagctttacctcgaaagcaataacatctttatatctgagcgtccaactgacgtgttgcagaccgtcaagttactggacctctccagcaaccagctcatcgatgagaaccagctttatttgatcgcacatctcccaagactcgagcagctgatcctcagtgataccggcattagcagtctgcacttccctgatgctggtatcggttgcaagacttcaatgttcccctctcttaaatatttggtggtcaacgataatcagattagccaatggtcctttttcaatgagctcgagaaattacccagcctcagggcactgagttgtctcagaaatcctttaacaaaagaggataaggaagccgaaaccgcacggttgctgatcatcgcctccatcggacagctgaagacactgaataagtgcgaaattctgcctgaggaacgtaggcgggccgagctggactatagaaaagcttttgggaatgagtggaagcaagcaggaggccataaagaccccgagaagaataggctcagcgaagagtttctcactgcacacccacgctaccagtttctatgccttaagtacggggcgccagaggactgggagcttaagacccaacagccactcatgttaaaaaatcagctgctgacgctcaagatcaaatatccccatcagttggaccagaaagtcctcgaaaaacaactgcccgggagtatgaccatacagaaggtgaagggtcttctgagtcggctcctgaaggtccctgtgtcagatctgcttttatcatatgagtctcctaaaaaaccggggagggagattgaactggagaacgacctgaagagcctccagttctacagcgtggagaacggggattgcctcctagtcagatggtag

SEQ ID NO: 210094 - DNA, 1584 bp, Artificial Sequence
  Description of Artificial Sequence: Synthetic coding sequence
atgagcgacaccctgaccgccgacgtgatcggccggcgggtggaggtgaacggtgaacacgctaccgtgcggttcgctggcgtggtaccacctgtggccggaccatggctgggcgtcgaatgggacaaccccgaacggggtaagcatgacgggtctcacgaggggactgtttacttcaaatgcaggcaccccaccggagggagtttcattcggcccaataaagtgaatttcgggactgactttctcaccgccattaagaaccgatatgttctggaggacgggcctgaagaggaccgtaaagaacagattgtgacgattggcaacaaaccagtggaaaccattggattcgatagtatcatgaagcagcagtcccagctcagtaagcttcaggaggtgtccctcagaaactgtgctgtaagctgtgcaggtgagaaagggggagtggccgaggcttgcccgaacattcggaaggtcgacctgtccaagaatttgttgagcagttgggatgaggtcatacacatagccgatcaacttcgacacttggaagtgctgaatgtgagcgaaaacaagttaaaattcccctctggttctgtgctgacaggaactctgagtgtgctcaaggttctcgtgctcaaccagacgggaatcacatgggccgaggtgttacgctgtgtggctggctgcccaggtctcgaggagctctacctagagtctaataacatcttcatctctgaaagacccaccgacgtgctgcagaccgtgaaactcctggacctgtcttcgaatcagctcattgacgaaaaccagctctatttgattgctcatttaccccgcttggagcagctcatcctctcagacacggggataagctctttgcacttccctgatgctggcataggctgcaagacttccatgttccccagtttgaagtatcttgtggtcaacgataaccaaataagtcagtggtctttcttcaacgagctggagaaactgccgtcactaagagccttgtcctgcctgcgcaatcctctgaccaaagaggataaggaagcagagaccgctaggttgctcatcatcgcctctataggccaactgaaaacactgaacaagtgcgaaattctccccgaggagcggcgccgggccgaactcgactatcggaaggcctttggcaacgaatggaaacaggcgggcggtcataaggatcccgagaagaacaggctctcagaggagttcttaactgcacatccccgctatcaattcctgtgccttaaatatggagccccagaggactgggagctaaagactcagcagcccctgatgctgaaaaaccagctgcttaccctcaaaattaaatacccccatcagctggatcagaaagtactggaaaagcagctgccaggatcgatgaccatccagaaggtgaagggcctgttaagcagactgctcaaggtccctgtttctgacctactgctcagctatgaatcccccaagaaacctggacgtgagattgagctcgaaaatgatttaaagtcgttgcaattttactccgtggaaaacggggactgcctgcttgtgaggtggtag

SEQ ID NO: 210095 - DNA, 1737 bp, Artificial Sequence
  Description of Artificial Sequence: Synthetic coding sequence
atgagcgacaccctgaccgccgacgtgatcggccggcgggtggaggttaacggggaacacgcaacagtccgattcgctggcgtagtgcccccagtcgccggaccctggttaggcgtggagtgggacaaccctgaacggggaaagcacgatggaagtcatgagggcactgtttattttaaatgcagacatcctaccggtgggtcctttatcaggcctaacaaagtcaattttgggactgattttctgacagctatcaaaaaccggtacgtgttggaggatggtccggaggaagacaggaaagaacagattgtgaccataggaaataaacccgtagaaaccattgggttcgactctatcatgaagcagcagagtcagctgagcaagttacaggaagtgtctctgaggaactgtgccgtgtcttgtgctggggagaaagggggcgtagcagaggcttgtcccaatatccgcaaggtggacctgtcgaagaacttattgtcatcttgggatgaagtgatccacatagcggatcagttgcggcatttggaggtgctgaacgtgtccgagaacaagttgaaattcccctcaggtagcgtgctgacaggcactctctccgttttgaaagtgttggttcttaaccagaccggcatcacttgggccgaggcgcatgctcagtgtggcgggtctagacatggccttgacatgcaaaaggacgcctcaaagttcgtcgacttgtgtgtgctacagaagtgtagcacatccaattgcatcatcagcgccaaagaccacacctctatgcggatgaatgtagcaaaggtgctgcgctgcgtggctggctgcccaggcctggaggagctgtatctcgaaagcaacaacatattcatcagtgagcgccctaccgacgttttgcagactgtaaagctgctggaccttagcagtaaccagctaatcgacgagaaccaactctacctaattgctcatctgcccaggctagaacaactgatcttgagcgacaccggtatctcatcgctgcacttccccgacgccggcatcggctgcaagacatccatgtttccgtctctgaagtatctggtcgtgaatgacaatcagattagccagtggtcattctttaacgaactcgagaagctcccatcactgcgggccctcagttgcctccgcaatcctttaacaaaggaagacaaggaggcagagacagctaggctcctcataatcgcaagcatcgggcagcttaagaccctgaacaaatgcgagattctacctgaggaaagacggagagcagaattggattaccgcaaggccttcggcaacgagtggaagcaggcggggggacataaggaccctgagaagaatcgactgtctgaagagttccttacagcgcaccccaggtatcagtttttgtgtctcaaatatggtgctccggaagattgggagttaaaaacacagcagcccttgatgcttaagaatcagctcttaaccttgaaaatcaagtatccccaccagctggaccaaaaggtgcttgagaagcagctgccaggcagcatgacaattcagaaagtcaagggcctcttaagtcggttgctcaaggtgcctgtgtcggatcttctgctgagctatgagtcacccaagaaacccggccgagaaatagaactggaaaatgatttaaagagcctgcaattttactctgtggagaatggagattgcctccttgttagatggtag

SEQ ID NO: 210096 - DNA, 2001 bp, Artificial Sequence
  Description of Artificial Sequence: Synthetic coding sequence
atgatccacgagctgctgctggccctgagcggctaccccggcagcatttttacatggaataagagatctggattacaggtttctcaggacttcccattcctccaccccagcgaaacctctgttctgaacagactgtgtagattgggcactgattatatacgctttacagagttcatcgaacagtacaccgggcacgtgcaacaacaagaccaccatccctcccagcaggggcagggaggactgcacggaatttacttacgtgcattctgcaccggcttggattctgtcctccagccctatcggcaggcactgttggaccttgagcaggaattcctgggcgatccccacttatcgatctcacacgtgaattattttcttgatcaatttcagttgctgttcccttcagtgatggtcgtggtggagcagatcaaatcccagaaaatccatggttgtcagatattagaaaccgtgtacaagcacagctgcggcggcctcccaccagtgcgatcagcgcttgaaaaaatcctggccgtttgtcatggcgtgatgtacaagcagctgtctgcctggatgctgcacggcctgctccttgatcaacacgaggaattttttataaagcagggaccttcctcaggcaacgtctctgctcagcccgaagaggacgaggaggaccttgggatcggcgggctgaccgggaaacagctcagggagttgcaggaccttcggctgattgaagaggaaaatatgcttgcaccttctttaaagcaattctcgctaagggtggagatcctgccctcttatattcctgtccgggtggccgagaagattttattcgtgggtgagagtgtccagatgtttgagaatcagaacgtcaacttgactaggaagggctctattcttaagaatcaggaggataccttcgccgcagaactacaccgacttaagcagcagcctcttttcagcctggtcgactttgagcaggtcgttgatcggatcagaagtacagttgcagaacatctatggaaactcatggttgaggagtctgatcttttaggccagctaaagatcattaaggatttttacctgcttgggcgaggggagctatttcaggcttttattgatacagcacagcacatgctgaagacccctccgaccgccgtgactgaacacgacgtcaatgtagcctttcagcaatcagctcacaaggtccttctcgatgatgataacctccttcctctgctccacttaaccatcgagtatcacggcaaagaacataaagatgccacccaggcccgggaaggcccctctagggaaacctccccaagggaggcacccgcctcggggtgggcagctcttggcctttcttacaaagtacagtggcctttgcatattctattcacaccggcggtcctggagaagtacaacgttgtctttaagtacttactgagtgtcagacgggtccaggccgagctccagcactgttgggctttacaaatgcagaggaagcatcttaaatccaatcagacggacgctatcaagtggcgcttgagaaatcatatggcgtttctagtggataatctgcaatactacttgcaggtggatgttctggaatctcaatttagtcaactacttcatcagattaattcaacacgggattttgaatctatccgacttgcccatgaccacttcttgagtaatcttctcgcccagagctttatcctcctgaaacccgtgtttcactgcctgaatgaaattcttgacttatgtcactcattttgcagccttgtgtctcagaacctgggtccgctcgatgagagaggcgccgcacaactctcaatcctggtgaagggattttcccgacagtcaagcctgctattcaagatactttcttccgtgcgaaaccatcagattaattccgatcttgcgcagctcctgctccgactagattacaacaaatattatactcaagctggcggcactctcggttcattcgggatgtag

SEQ ID NO: 210097 - DNA, 660 bp, Artificial Sequence
  Description of Artificial Sequence: Synthetic coding sequence
atggccgacaaggccaagcccgccaaggccgccaaccggaccccccctaagtcacccggggatccatctaaggaccgagctgccaagagactaagtcttgaatcagaaggtgccggtgaaggggccgcagcctcccctgaactatctgctctcgaagaggcctttaggcggtttgctgtccacggagacgcgcgggccactgggagagagatgcacgggaagaactggtccaaactgtgtaaagactgccaagttattgacggccgtaacgtgacagtgaccgacgtggacattgtcttctcaaagattaagggcaagtcatgtcgcaccatcactttcgagcagtttcaagaggctctcgaagagctggcaaagaaaaggtttaaggacaagtcctctgaggaggccgtgagggaggtgcacagactcattgagggtaaggcgccgattatcagtggagtcactaaagccataagctcccccacggtcagtcggctgaccgatactaccaagttcactggctcgcacaaagagcgatttgacccgagcggcaaaggcaagggaaaggctgggagggttgatcttgtcgacgagtccggatatgtttccggctataaacatgccggcacctatgatcagaaggtgcagggcggtaaatag

SEQ ID NO: 210098 - DNA, 1071 bp, Artificial Sequence
  Description of Artificial Sequence: Synthetic coding sequence
atgagcaagctgtggcggcggggcagcaccagcggcgccatggaggctcccgagcccggggaagccctggaactgtctctcgctggcgcacatggtcatggcgtgcataaaaaaaagcacaaaaaacacaagaagaagcacaagaaaaagcaccaccaagaggaagatgcgggacctactcagccctccccggccaaaccccagctgaagttgaaaatcaagctgggcgggcaggtgctgggaactaagagtgtgcctactttcacagtaatccccgaagggccacgtagtccgagccctctcatggtggtggacaacgaggaggagcccatggaaggcgtgcctctggagcagtatagggcttggctggacgaagacagcaacctcagccccagtccactgcgagacctgtcaggcgggctcggcgggcaggaagaggaggaggagcagaggtggttagatgcacttgagaagggcgagcttgacgacaacggtgatctcaagaaggagattaatgagagactcctaaccgcacgacaacgagctctgttgcaaaaagcgcgatctcagccctcgccaatgctcccgctccccgtagctgagggatgccctcctcctgctctaaccgaggaaatgttgctgaaacgagaggaacgagctcggaaacgcaggttgcaggcggctcgcagagctgaggaacataaaaaccagactatcgagcgactcaccaaaaccgctgccacgtccgggaggggtggtcgcggcggggcaaggggggagcgaagaggggggagggccgcagcccctgccccaatggtgcgctactgctctggagcccagggttctaccctgtcattccctcccggcgtgccagcgcccacagcggttagtcaacgcccgagcccttccggacccccaccccgctgctcagtgccgggctgcccacacccaaggcggtacgcatgctcgagaacaggtcaggcgctgtgctcactgcaatgttatcgtatcaatcttcagatgagattgggagggcctgaaggccctggatcaccactcctggccacatag

SEQ ID NO: 210099 - DNA, 1272 bp, Artificial Sequence
  Description of Artificial Sequence: Synthetic coding sequence
atggccggcaaggtgaagtgggtgaccgacatcgagaagagcgtgctgataaataattttgagaaacgggggtgggtacaggttaccgagaatgaagactggaatttctactggatgagtgtccagaccatccgaaacgtgttttccgttgaggccgggtatcgactgtccgacgatcaaatagtgaatcacttcccaaaccactatgagctgacccgaaaagacttgatggtgaagaacatcaaaaggtacagaaaagagctcgaaaaagaaggcagccctctggccgagaaagacgaaaacgggaaatatttatacctcgacttcgtaccggtgacctacatgctacctgcggactacaatctgttcgtagaggaatttcggaaaagccctagttctacctggatcatgaagccctgcggtaaagcccaaggtaagggcatctttctgatcaacaaactttctcagatcaagaagtggtcgcgcgattctaagaccagtagtttcgtgagtcaaagcaataaagaggcgtatgtgatttctctttatattaacaaccccctcctcattggcggacgcaagtttgatttgcgtctatatgtgttggtgtctacctatcgcccccttaggtgctatatgtataagctgggattttgcagattttgtactgttaagtatactccgtccacatcagagctggataacatgtttgtacacttaaccaatgtcgcgatacagaagcacggagaggattacaaccacatccacggtggaaagtggacggtgtctaacctgcgcctgtacctcgagtccactcgtggcaaagaggtgacaagtaagctgtttgatgaaatccattggatcatcgtgcaatcactcaaagctgtggcaccagtcatgaataatgataaacactgttttgaatgctacggctacgatatcattatagacgacaaactgaagccctggttgatagaggtcaacgcctcaccatctctgacctcttcaacagctaacgaccgaatccttaagtacaacctcatcaacgatacattgaacattgccgtgcccaatggagaaataccagattgcaagtggaataagtcacctcctaaggaggtactgggaaactacgagatcctgtatgatgaggaactcgcacagggggacggcgccgaccgggagctgagaagcaggcagggacagtccctgggccctagggctgggaggagcagagatagcggcagggcagtcctcacaacgtggaaatag

SEQ ID NO: 210100 - DNA, 1185 bp, Artificial Sequence
  Description of Artificial Sequence: Synthetic coding sequence
atggccggcaaggtgaagtgggtgaccgacatcgagaagagcgtgttaatcaacaactttgagaagaggggctgggtccaagttactgagaatgaggactggaatttctactggatgtctgttcagaccatccggaatgtgttcagtgtggaggctggctaccggctctcagatgaccagatcgtgaaccacttccccaatcattatgaactgacccggaaagacctcatggttaagaacattaaacggtacaggaaggaactcgagaaggagggcagccctcttgcggaaaaagacgagaatggcaagtacctatatctggatttcgtgcccgttacttacatgctaccagccgattataatctgtttgtagaggaattccgcaagtcgccaagttcaacctggataatgaagccgtgcggcaaagcacaggggaaggggattttcttaattaacaaactgagccagatcaagaaatggtcccgagattccaaaaccagttcatttgtaagtcagtccaataaggaggcctacgttatttccctctatataaacaaccccctgctcattggcgggcgtaagttcgacctcagactctatgtactggtctccacatacaggcctctccggtgttacatgtacaagttgggattctgcagattctgcacggtcaagtacacccccagcacaagtgaattagataacatgtttgtgcatcttacaaatgtcgcaatccagaaacacggggaggattacaaccatattcatggtggtaaatggaccgtgagcaacctgaggctttacctggagtctacacggggcaaggaggtgacatcaaagctgttcgacgaaattcactggattatagttcagtcccttaaagcagtggctgtgaatgcgagtccctctctcacttccagtaccgccaacgataggatcctcaagtataatctgattaacgacacattaaacatcgcagtaccaaatggtgaaattcccgactgtaagtggaacaagtcacctccgaaggaagttctgggcaactacgagatcctgtatgatgaggagctagcacaaggagacggcgcagatagggagctccggagccgacagggccagtccctcgggcctagagctgggcgctccagggactcagggcgggcagtccttactacttggaaatag

SEQ ID NO: 210101 - DNA, 180 bp, Artificial Sequence
  Description of Artificial Sequence: Synthetic coding sequence
atggccggcaaggtgaagtgggtgaccgacatcgagaagagcgtgctgatcaacaatttcgagaaacggggttgggtgcaggtgactgaaaacgaggactggaatttctactggctgctggacctcccagagttcagatatcggtcttgccttaatgagtttcctgatttcagggtctag

SEQ ID NO: 210102 - DNA, 1068 bp, Artificial Sequence
  Description of Artificial Sequence: Synthetic coding sequence
atgccccaccagcccaccatcctgctgaacaccgtgagcgccagcgcatccccatgtttgcaccccggagcccaaaacatccctagtcccacgggcttgcctaggtgtaggtcaggttctcacacaattggcccctttagtagctttcagagtgcagctcatatctactcccaaaagctgtccagaccaagcagcgctaaggccgccggaagttgctacctgaataagcatcattcgggcatcgccaaaacgcagaaagagggtgaggacgcaagtttatattcaaagcgatataaccaatcgatggtgaccgcagagcttcagcgactagcagaaaagcaggccgcccggcagtatagccccagctctcacataaacctcctgacccagcaagtcacaaatttgaacctcgccacaggaataattaacaggtcgagcgcctctgccccacctaccctccgaccaattatcagtccaagtgggccaacttggagcacacagagtgacccacaggcccccgaaaatcacagcagtagtccaggttctcgcagcttacaaactgggggctttgcgtgggagggggaggtggagaacaatgtctactcgcaggctaccggcgtggtgccccagcacaagtatcatcccacagctggatcgtatcagctgcaatttgccctgcagcagttggagcaacaaaagcttcaatcccgccagctactggatcagtctcgggctagacatcaggccatttttggcagtcagacccttcccaattctaatctgtggaccatgaataatggagctgggtgcagaatttcttccgccacagcaagcgggcagaagccgaccaccctgcctcagaaagtcgttccccccccaagctcttgcgcctccctggtgcctaaaccaccccccaaccatgagcaggtgttgcggagagctacaagccagaaggcctcaaagggcagttcagccgagggacagttgaacggtttgcagtcctccctcaatcctgctgcctttgtccccatcactagttcgacagtgaactctcataccgccctgtag

SEQ ID NO: 210103 - DNA, 3846 bp, Artificial Sequence
  Description of Artificial Sequence: Synthetic coding sequence
atgcccatcgtgatggcccgggacctggaggagaccgccagcagctcagaggatgaagaagtaatctcccaggaagaccacccctgcattatgtggaccgggggctgccgcaggatccccgtactggtctttcatgccgatgccattcttaccaaagataacaacattcgcgtcattggggagagataccacctttcctataaaattgtgcggaccgattcaaggttggtgaggtcgatccttactgcccacggttttcacgaggtccatcctagctctaccgattataatctgatgtggactggtagccatctgaaaccattcctgctacggaccctttctgaggcccaaaaagtgaatcatttcccgcggtcctatgaacttacacgcaaggatagactgtataagaacattattaggatgcagcacacccacggcttcaaagcttttcatattctgcctcaaacgttccttctgcccgccgagtacgccgagttctgtaatagttattctaaggatagggggccttggatcgtaaagcctgtggccagcagcaggggccggggcgtgtacttaatcaacaacccaaatcagatctctttggaggaaaatatcttggtatctcgatacattaacaaccctctgcttattgatgatttcaagttcgatgtccggttgtatgtgctggtgacctcctatgatccactggttatctatctttatgaggaaggactggcccgatttgcaaccgttcggtacgaccagggcgctaagaatatccgaaatcagttcatgcatctgacaaactatagtgtcaataagaaatctggcgactatgtttcatgtgacgaccctgaagtcgaagattatggtaacaagtggagcatgtccgctatgttacgctatctaaagcaggaaggacgggacacgactgcccttatggcccatgttgaggatttgattatcaagaccatcattagcgcagaactggccatcgctaccgcctgcaaaacctttgttcctcataggagttcctgcttcgagttgtacgggttcgacgtcttgatcgacagtaccttgaaaccttggctgcttgaagtaaatctgagcccctcactcgcatgcgacgcccccctggatctgaaaatcaaggcaagcatgatctctgatatgttcaccgtggtcgggttcgtgtgccaagaccccgcccagcgcgcgtctacacggcccatttaccccaccttcgagtccagcaggcgaaacccgttccagaaaccccagaggtgccggcccctgagcgcctcagacgccgaaatgaagaacctggtcggatctgctagggaaaaaggaccagggaaactaggaggttccgtgttaggcctatccatggaagagattaaggtcctccgtcgggtcaaggaggagaacgaccgacggggcggattcattagaatcttcccgaccagcgaaacatgggaaatttacggctcatatctcgagcacaagacctccatgaattatatgctggccactaggcttttccaggatcgcatgacggccgatggtgcccctgagctgaagatcgagtcactgaattctaaagcaaagctgcacgcggctttgtatgagcgtaagctgttgagtctggaggtccgaaaacgccgaagacgctcttctagactgcgtgctatgcggccaaagtatcccgtgattacacaaccagccgagatgaacgtcaagaccgagactgagtctgaggaagaggaagaagtggctctggataatgaggatgaggaacaggaagcctcccaagaagagtctgctgggttcctgagagagaatcaagcaaaatacacccccagcttaaccgcactcgtggagaatactcctaaggaaaactcaatgaaagtgagggaatggaacaacaaagggggccactgttgtaagctggagactcaagaattggagcccaagtttaacttaatgcaaattctccaagacaatgggaaccttagcaagatgcaggctagaatcgcttttagcgcctacttgcaacacgttcagatccgactcatgaaggacagtggagggcagacgttttccgcgtcttgggcagccaaggaagacgaacagatggagttggtggtgcgttttttaaagcgtgcttcaaacaacctgcagcacagtctcagaatggtgctgccctcacgacgcttagcattgctggaacggcggcggattctggcccaccaacttggagattttatcattgtgtacaacaaggaaacggagcaaatggccgagaaaaaaagcaagaaaaaggtagaagaagaggaggaggatggagttaatatggagaattttcaggagttcattagacaggcatctgaggcggagctggaggaggttctgactttttatacccagaagaataaatccgccagcgtgttcctcggcacgcactccaaaatttctaaaaataataacaactactcagactcaggcgccaaaggcgaccacccggagactataatggaggaggtgaagataaagccacctaaacagcagcagaccaccgaaattcacagcgacaaactctcaaggtttacaacctccgccgaaaaagaagccaaactagtgtacagcaatagttcttctgggcccaccgccaccctgcagaaaattcccaatactcacctgagctctgtgaccacctccgatctctcacccggaccgtgccaccactccagcctgtcccagattccgtccgccataccgagtatgccacaccaacccacgatacttctcaacaccgtttcagcaagcgcatccccttgcctccaccccggtgctcagaatataccctcccccaccgggctcccgcggtgcaggagcgggtcacacaccattggccccttcagctcattccagtcagccgctcacatctattcccagaagctctccaggccttcctctgccaaagccggtagctgttacctcaataaacatcactctgggattgctaaaacacagaaggagggcgaggacgccagtttgtactcaaaacgttataaccaaagtatggtgaccgccgaactgcagcggttggcagagaagcaggccgcgcggcagtattcacccagcagccatattaacctgctgacccagcaagtgactaaccttaatctcgccacagggatcatcaaccgcagtagtgctagcgcacctccaacactcagaccaatcatcagccctagcggacccacatggtccacacaatcggaccctcaggcacctgagaatcattccagcagcccgggctccaggtcactacagactggcggattcgcatgggaaggggaagttgaaaacaatgtgtattcccaagcaaccggcgtggtacctcagcataaataccacccaactgcaggtagctatcagctgcagtttgccctccaacagctggagcaacagaagttgcaaagccgccagctgcttgaccaatcccgggccagacatcaagctattttcggcagccaaaccctgcctaactccaacctgtggactatgaacaatggggccgggtgccgcatttcttctgctaccgcgtccggccagaagcctactacactgccccagaaggtcgtgcctccccctagcagttgtgcgtcactggtgccgaagcccccaccaaatcacgagcaggtacttcgccgcgcaacatctcagaaggccagcaaaggttctagtgcggagggacagctgaatgggttgcagagctctcttaacccggcagcatttgtcccaatcacatcatcgacagacccagcacataccaagatatag

SEQ ID NO: 210104 - DNA, 2454 bp, Artificial Sequence
  Description of Artificial Sequence: Synthetic coding sequence
atgaaggagatcaaggtgctgcggcgggtgaaggaggagaacgaccgccgaggcggattcatcaggattttccctacgtctgaaacctgggaaatttacggatcctacctcgagcataaaacatcaatgaactacatgctggcaacccgcctcttccaggacagggggaaccctagacgcagcctgctgacagggcggaccagaatgacagccgatggtgctcctgaactgaagatagaatcactgaattctaaggcgaaattgcatgcagccctgtatgagagaaagttgctcagtttggaagttcgaaagcggcgccgacgcagctccaggcttcgcgcgatgcgtcccaagtatcccgtcattactcagcccgccgaaatgaatgtgaagaccgagaccgaaagcgaggaagaagaggaggtcgccctggataacgaggacgaagagcaggaagcatcccaggaagagtctgccgggtttctgcgggagaaccaggccaagtatactcccagcctgacagctctagtggagaatactccgaaggagaatagtatgaaagtacgcgagtggaacaacaagggcggtcattgctgtaagctggagactcaggaactggagcccaagtttaatctcatgcagattttacaggataacgggaacctctctaagatgcaggcccgcatcgcattttccgcatacctgcagcacgtgcagatccggctgatgaaggacagtggcggacagacattttcggcaagctgggccgcaaaggaagacgagcaaatggaattagtagtgcggttcttgaagagagcaagtaacaatttacagcatagtttgaggatggtgttgccatccaggagattagcacttctggaaagaaggaggatactggcacaccagttgggcgattttatcattgtgtataataaagagaccgaacagatggccgagaaaaagtctaagaaaaaggtggaggaggaggaggaggacggcgtgaatatggaaaatttccaggagttcattaggcaagcatctgaggcggaactggaagaggtcctcaccttttatacacagaaaaacaagagcgccagcgtctttctggggacccacagcaagatcagtaaaaacaacaataattattctgactctggtgcaaaaggtgaccaccccgagacaattatggaggaagttaagatcaaacctcctaagcagcaacagacaaccgagattcacagcgacaagttatcccgctttactactagcgccgagaaagaagcgaagctggtctattcaaattctagctctggacccactgctacacttcaaaagatccccaatactcacctgtcttcagtgacgacgtctgacctctcacctgggccatgccatcattcttcgttgtcacagattccctcggcaattcccagcatgccacaccaacctactattcttctcaacaccgtgagtgctagcgcttcaccatgcctccatccaggcgctcagaatatccccagtccaaccggccttcctcgctgcaggtctgggagccacactattggaccgttttcttcattccagagcgcagcacacatatattcccagaagctgtctcgcccatcatcagccaaggctgggtcctgctacttaaacaagcaccattcaggcattgccaaaacacaaaaagagggggaagacgcgagtctctacagtaaacggtataatcagtcaatggtaaccgcagaacttcagcggctggctgagaaacaggccgcaaggcagtattcaccttctagccatattaacctccttacacaacaggtcacaaatctcaaccttgcaaccggaattattaatagatccagcgctagcgcaccgcctactttgcggcctattatcagtccttcaggacctacttggtccactcagagcgacccccaggcccccgagaaccactccagcagccccggaagtaggtcgttgcagaccggcggatttgcctgggaaggcgaagtcgaaaataacgtgtactcccaggctaccggcgtggtacctcagcataagtaccacccaactgctgggagttatcaacttcaatttgccctccaacagcttgagcaacagaaactgcagtctaggcagctgcttgatcaatcacgtgccagacatcaagccatattcggatcccagaccctcccaaacagtaacctctggacaatgaacaatggcgctggctgcagaatttcttctgccactgcttcaggccagaaaccaacaacattaccgcaaaaagtcgtgcccccacctagtagttgtgcctcgttggttccaaagcctcctccaaatcacgagcaagtattaaggagggcaactagtcagaaggcctccaacactagatttcggtcaagcttccagaattatctgtggtatttcttccaagccgtgtcctag

SEQ ID NO: 210105 - DNA, 2337 bp, Artificial Sequence
  Description of Artificial Sequence: Synthetic coding sequence
atggcccacgtggaggacctgatcatcaagaccatcatcagcgccgaactggccatcgccacagcatgcaagacctttgttcctcaccgctctagctgctttgagctctacgggttcgacgtgctcattgactcaactctcaaaccctggcttttagaggtgaatttaagcccatctttagcctgcgatgcaccattggatcttaagatcaaggcctctatgattagtgatatgttcacggtggtgggcttcgtgtgccaggacccagcccaaagggctagcacccggccaatctaccctaccttcgagagctctcgacgaaatcctttccagaaaccccaacggtgcaggccactcagcgcatctgatgcggagatgaaaaacttagtgggttcagcacgagagaaggggccagggaagctgggaggaagcgtcctgggactgtcaatggaggagattaaggtgctcaggcgagtaaaggaggagaacgaccgacggggcggattcattagaatctttcctactagcgaaacttgggagatctatggttcgtaccttgaacacaaaacaagtatgaactacatgttggcaacaaggctattccaagatcggatgactgctgacggcgccccagagctaaaaattgaaagtctgaatagtaaagccaaactccacgccgccctctatgaaagaaaactcctgtctctcgaagtaagaaagagacggcggcggtcaagtcgccttagggccatgcgaccaaaatatcccgtgataactcagcccgcagaaatgaatgtgaagaccgagaccgaatctgaagaggaggaagaagtggcattagacaacgaagacgaggaacaagaggcatcccaggaggagtctgccggattcctcagggagaatcaggccaaatatacgccaagcctaaccgcgttggtggaaaacacgcctaaggaaaacagcatgaaagtgcgagaatggaataacaagggtggtcattgctgcaaactggagactcaggagctggaaccaaagttcaatctgatgcaaattctccaggacaacggcaatctctctaaaatgcaggctcggattgccttcagcgcctacctgcagcatgtgcaaatcaggctcatgaaggacagcgggggacagacgttcagcgctagctgggcggcaaaggaagatgagcagatggaactggtagtgcggttcctcaagcgcgctagtaacaatttgcagcattcattgcggatggtcctgccctccagacggctggctttgctcgagaggagacgtatcttggctcatcaattgggtgactttattatcgtctacaacaaggagactgaacagatggccgagaaaaagtctaagaagaaggtggaggaagaggaagaggatggggtgaatatggaaaactttcaggaattcatccggcaggcgtccgaagctgaactcgaggaagttctgactttctacacccagaagaataaaagcgcttcagtctttttgggaactcacagcaagatttcaaaaaataacaataactatagcgactcaggcgcgaagggggatcatcctgagacgattatggaggaggtaaaaatcaagcctccgaaacagcagcagaccaccgagatccacagcgacaagctgtctcgctttacaacttccgccgagaaggaagctaagttggtatactccaacagcagttcaggccctacagctaccctacagaaaatccccaatactcacctgtcctcggtgacaactagtgatctgtcccccggtccctgccaccactcaagcctgtctcagataccctccgcaatcccaagtatgccccatcaaccaaccatcttgctcaacaccgtttccgcctctgcctctccatgcctgcaccctggcgcccagaacattccctcacccacggggctcccaaggtgtcgcagcggatcgcacacaattggaccctttagttctttccagtctgccgcgcacatctacagtcaaaaattatctcgcccgtcttccgcaaaggctggttcatgctacctcaacaaacatcactccgggatagcaaagactcagaaggaaggcgaggatgcgagcctctacagtaagaggtacaatcagtctatggtgacggccgagttacagcgtctcgctgaaaaacaggccgctcgccagtattccccttcgagccataccgacccctggaaatatgaccgctccatccgcatgtgctcaccgttgaatattctcgaacccgaatttaaaaaataccttatgggcatctattcaccgcactcatctaaaaagaagaagaaatag

SEQ ID NO: 210106 - DNA, 1755 bp, Artificial Sequence
  Description of Artificial Sequence: Synthetic coding sequence
atgcggatcggcacccccaccgccggccccggccccagcgccgtgatggagggctgcttaggggtcgctgagcttcgcaagctttctaccttttcagcgtaccttgaagaccattcatacaatgtcgagcagatctggcgagatattgaggacgtgataatcaaaactttaatctccgcacacccgattatccggcataactatcacacctgttttcccaatcacactctgaatagtgcatgcttcgaaattcttggttttgatattctactggatcataagctcaaaccatggttgctcgaggtgaatcacagtccgtcttttagcactgactcacgccttgacaaggaggtcaaggatggactgctgtatgacactctggtcctgattaatttagaaagttgcgataagaagaaagttctggaagaagaacggcagagaggacagttcctgcagcagtgttgttcacgggagatgagaattgaggaggcaaagggttttagggctgtacagcttaagaaaactgagacttatgagaaggagaactgtggcggttttcgactcatctacccttcacttaactcggagaagtacgaaaagttctttcaggataacaactccctgttccagaacacagtcgcatcaagggcccgggaggagtacgcgcgacagcttattcaggagctgcggttgaagcgcgagaagaagccctttcagatgaagaagaaggtagaaatgcagggagaatccgccggagaacaggtgcgaaaaaagggaatgagagggtggcagcaaaagcagcaacagaaggacaaagcagcaacacaagcttccaagcagtacattcaacccctgactctggtgtcatacacccctgatcttctcctctctgtgcgcggagagcggaagaatgagaccgactccagcctgaatcaggaggcccccactgaagaggctagttctgtctttcccaagctgacaagcgcgaagccattcagttccttgcccgacctgcgaaacatcaacttatcctccagcaagctggagcctagcaagcctaattttagcattaaagaggcaaagtccgccagtgccgtgaatgttttcacaggaactgttcatctgacttccgtggagacaacccccgaatctacaacccagctctcaatttcacccaagtcccctcccactctggctgtgactgcatcttcagaatacagcggtcctgagactgatcgcgtggtgtcctttaagtgcaaaaaacagcagacacctccacaccttacccagaagaaaatgctgaagagcttcttacccactaagagcaaaagtttctgggaaagtccaaacacaaattggacattgcttaaatcagatatgaataagccccatcttatctccgaactgctgaccaaactgcagctgagcggtaagctctcctttttcccggcccattacaatcccaaactaggcatgaataacttgagtcaaaatccaagtctacctggagaatgtcattctagaagtgatagctccggagagaagaggcaactggacgttagctccctcttactccagagtcctcaatcatataatgtcaccctgagagatctcctggtgatcgctacccctgcacaactcgacccgagaccttgccggagccacgcaagtgctatgcgtgacccatgcatgcaggaccaggaggcgtacagtcattgcctcatcagtggacagaagggttgtgagcgctcctag

SEQ ID NO: 210107 - DNA, 2532 bp, Artificial Sequence
  Description of Artificial Sequence: Synthetic coding sequence
atgccccagtgccccaccctggagagccaggagggcgagaacagcgaggaaaaaggagactcttccaaggaagacccaaaggagacagtggctctggcattcgtgcgtgagaatccgggcgctcagaacggcttacagaacgcacaacagcaaggtaagaagaaacgaaagaagaagcgcctcgtaatcaacttgtccagttgtcgctatgagagtgtgcgtagagccgctcagcagtacggatttagggaaggaggagaagatgacgactggactctctactggactgactatagcgtgtccctagagcgggtaatggaaatgaaatcgtaccagaagatcaatcacttccctggaatgtctgaaatctgccgcaaggatttgcttgccaggaatatgagcagaatgctaaaaatgttcccaaaggactttagatttttcccccggacctggtgtctgccggccgattggggagatctgcaaacatatagtcgtagtcggaaaaataagacctatatttgcaaaccggattcggggtgtcaaggtaaaggcatatttatcacccggaccgtgaaagagatcaaaccaggggaggacatgatctgtcaactgtacatctcaaaacccttcataattgatgggttcaaatttgacctgcgaatctacgttttggtgacttcatgcgatcccctaagaattttcgtttataacgaaggtttagctaggtttgctacaaccagctattcacggccatgcaccgacaatctggatgatatatgcatgcacctcaccaactactccatcaataagcattcatcaaatttcagccgcgacgcgcactccggtagcaagcgaaagctgtctacctttagcgcctacttggaagaccactcctacaacgtggaacagatatggcgcgatatcgaggatgtcatcatcaagaccctcatctctgctcaccccatcattcgccacaattaccatacctgtttccctaaccacaccctgaattctgcttgcttcgagatactgggatttgatatcctattggaccacaaactcaaaccctggctattagaggttaatcatagcccctccttttctacagatagcagactcgataaagaggttaaagacgggttattgtatgatacacttgtactgataaaccttgagagttgcgataagaaaaaggtgctcgaggaggaaagacaacggggccagtttctgcagcagtgctgttcacgggaaatgcgcattgaagaggcaaagggattccgagccgtccagctgaaaaaaaccgaaacgtatgaaaaggaaaactgcggcgggttcaggctgatctacccttctctcaattccgagaagtatgaaaagttcttccaggataacaactccctcttccagaatacggtggcctccagagctagagaggaatatgctaggcagcttattcaggagctgcgtctgaagcgggaaaaaaagccatttcagatgaagaaaaaagtggaaatgcaaggcgaatccgccggagagcaggtgaggaaaaaggggatgcgaggctggcagcagaaacagcaacagaaagataaggcagccactcaggccagcaaacagtacatccagcctctaactctggtgtcatatactccagacctattgctgtcagttcgtggtgagagaaaaaacgagacagactcaagcctgaatcaggaggcaccaacagaagaggccagttctgtgtttcctaaattaaccagcgccaagccatttagctcactccccgatctccggaatatcaaccttagtagctctaaacttgaaccatcaaagcctaatttctccataaaggaggcaaagagcgccagcgcggtcaatgtttttactggaactgttcatttgacaagtgttgaaacgacacctgaaagtaccacacaactctctatttcgccaaaaagcccgccaacactggctgttacagcaagtagcgagtactctggaccagagaccgatcgggttgttagctttaagtgcaagaaacagcagacaccaccccatcttacacagaagaaaatgctgaaaagtttcctccccactaaatccaagagcttttgggagtcgcccaacaccaactggacgttgcttaagtccgacatgaataagccccaccttatctcagagctacttactaaactgcagctcagcggaaagttaagtttctttcctgcccattataaccccaaactgggaatgaacaacctgagccagaatccctctctgccgggcgagtgtcattctagatccgattccagtggagagaagaggcagcttgatgtcagttccttactcttgcagtcaccacagtcttacaacgtgacccttcgggacctccttgtaatagccacgccggctcaactggaccctcgtccttgtcgctcccacgcatctgcgatgcgggacccttgcatgcaggaccaggaggcttacagccattgtctcatctcgggtcagaaggggtgtgagagaagttag

SEQ ID NO: 210108 - DNA, 558 bp, Artificial Sequence
  Description of Artificial Sequence: Synthetic coding sequence
cagcccatgggcgccctgctgctgcaccccagccggcggggccccgccggagtggttgcctcttggactagcagccccgctggcagggatggtggggtggggattgcaggtgcctggtacttccctagggcatcttcacaagcaagagaaatgccccagtgtccgacactggagtctcaagaaggagaaaacagcgaggaaaagggggattcttccaaggaagacccaaaggaaacggtggcactggcatttgtgcgggaaaatcctggggcccagaatggtctgcagaacgcccaacagcagggaaaaaaaaagcgcaagaagaagagaatgccacttaagaactcgagaaagaggcggttcccttgcttcaagaaagctctgatctgtcctggtaacttggtgcgtctgcaatatgattccaccatcctcacataccaggaccccacagcggcatgcgcatttcagttcctgtttaacatttccccttgcctggctcctttcagattgatcgacgaagggaagctggttcattttctgatacactcttttccctag

SEQ ID NO: 210109 - DNA, 1710 bp, Artificial Sequence
  Description of Artificial Sequence: Synthetic coding sequence
atggagggctgcctgggcgtggccgagctgcggaagctgagcaccttcagcgcctatttagaagaccattcgtacaatgtcgagcagatatggcgtgacatcgaggatgtgatcatcaagacgcttatctccgcccaccccattatccggcacaattatcacacctgctttcccaatcatacactcaactctgcgtgttttgagatcctggggtttgatattctcttggatcacaagctgaaaccctggctgttggaggtcaaccattctcctagtttcagcacagacagccgattagataaggaggtgaaggatggactgctatatgacacgcttgtgctcattaatttggagtcctgcgataagaaaaaggtgctcgaagaggagagacaaagaggccagttcctgcaacagtgttgcagcagggaaatgaggatcgaggaggccaagggctttagggccgttcaactgaagaagactgagacgtatgagaaggagaactgcggcggattcagacttatctacccttcccttaactccgaaaaatatgaaaaattcttccaggataacaactcgctctttcagaacaccgtagctagtagagctcgggaggaatacgcacgacagctgatccaggagctgaggcttaagcgagagaagaaaccattccagatgaaaaaaaaagtggaaatgcagggtgaatcggccggtgaacaggtgcgaaaaaagggtatgaggggttggcaacagaaacagcaacagaaggacaaggccgcgacacaggcgtctaagcaatacatacaacctctgactctggtgagctataccccagacctgctactgagcgttagaggcgagcgaaaaaatgagacagattcttctcttaatcaggaggcacctaccgaagaggctagctcagtatttcctaaactaaccagtgccaagcccttctcttcgcttcccgacctgaggaacatcaatctaagctcatcaaagctcgagccttcaaaaccaaattttagtattaaggaagccaagagcgcatctgccgtcaatgtgtttacgggaaccgtccacctcaccagcgtggaaaccacaccagagtctacaacgcagttatccatctcacccaagtcacccccaactctggctgtgaccgcaagtagtgaatattccggtccagaaactgacagggtggtgagctttaagtgcaagaagcagcagactccgccccatctgacacagaagaaaatgctaaagagctttttgccaaccaagtctaaaagtttttgggagtccccaaacaccaactggactctactgaagtctgacatgaataagccccatctgatttcggagcttctgacaaagttgcagctctccgggaaactctctttttttcctgcccattacaaccccaagctggggatgaacaacctgtcccagaacccgtccctgcccggggaatgtcactctagaagtgactcctcaggcgagaaaagacagctagacgtgtcttcattgctactgcagagtccccaatcttataacgtgactctcagggatctgcttgtgatcgctacccccgctcagttagatccccggccatgtcgcagccacgcctctgctatgagggacccttgtatgcaggaccaagaagcctactctcactgtctcatctctgggcagaagggctgtgagcggtcatag

SEQ ID NO: 210110 - DNA, 2676 bp, Artificial Sequence
  Description of Artificial Sequence: Synthetic coding sequence
atgggcgccctgctgctgcaccccagccggcggggccccgccggcgtagtcgcatcttggacgagctcccccgcaggtagggacgggggcgttggaattgccggggcctggtacttccccagggccagcagtcaagcaagggagatgccgcaatgtccaaccttagagagtcaggaaggcgagaactccgaggaaaaaggcgacagttctaaagaagatccaaaagaaaccgtggccctcgcctttgtgagagagaatccaggtgctcagaacggcctgcagaacgcacagcagcagggaaaaaagaaaaggaaaaagaaacgattggtgatcaatcttagttcctgccgctacgaatccgtgcggcgcgccgcccagcagtacgggtttcgcgagggcggggaagacgacgattggaccctgtactggaccgactactctgtatccctagagcgggtgatggagatgaagagctaccaaaaaatcaaccacttcccaggaatgagcgaaatatgccgaaaagacctcttggcccgtaacatgtcacggatgctaaagatgtttcccaaagacttccgttttttccccaggacgtggtgtctccccgctgattggggcgatctgcagacttactctcggtcccgcaagaataagacttatatttgcaagcccgattcaggttgtcaaggcaaggggatctttatcacccgtaccgtgaaggaaatcaaacccggggaggatatgatatgccagttatatatctcaaagcccttcattatcgatggatttaagttcgatcttaggatctatgttctcgtgacttcctgtgaccccctgagaatttttgtatataacgaaggtctggcgaggttcgcaaccacatcatacagccgtccatgtactgacaacttggatgacatctgcatgcatcttacaaactactctattaacaaacactccagtaacttcagcagggatgctcacagtggctccaagcgcaagctgagtaccttttctgcttatttggaagaccatagctataacgtggagcagatctggagggacattgaagacgtgatcattaaaactctgatctcagcccatcctataatcagacacaactaccatacttgttttccaaatcacacattgaattctgcatgttttgagatcctgggcttcgacattcttcttgatcataagttaaagccctggctacttgaagtgaaccactccccttcatttagcaccgatagtagactagataaggaggttaaagacggtctgttgtatgatactctggttcttattaatttggaatcctgcgataagaagaaggtgctggaagaagagcggcagcgtggacagttcctgcaacagtgctgttctagagagatgaggattgaggaagcgaagggatttcgagctgtgcaactcaaaaagacagagacttacgagaaggaaaactgcggcggatttaggctcatctaccctagcctcaactccgagaagtacgagaagttcttccaggataataacagccttttccaaaataccgttgcctcgagagccagggaagagtatgccagacagttaattcaggaacttcgactaaagcgggaaaaaaaacccttccagatgaagaaaaaggtggaaatgcagggagagtcagcgggcgaacaggtgcgcaagaaagggatgcggggctggcaacagaaacagcagcaaaaagacaaagccgctactcaggcctccaaacaatacattcagcccctgaccctggttagctatactccagacttactgctgtcagtacggggtgagcgtaaaaacgagaccgactccagcttgaaccaggaagctccaactgaggaggcgtcttccgtcttccctaaactgacaagcgccaagcctttctccagcctccccgacctgagaaacataaacctttctagttccaagctagaaccctctaaacctaatttttccattaaggaagctaagtcagcgagcgcggtcaacgtgttcacagggacagtgcacttgacgtctgtggagaccacccccgagtctaccacacagctttccatttctcccaagagccccccaactctagcggtcaccgctagttccgagtactccggcccagagacagacagagttgtgagttttaaatgcaaaaaacagcagaccccgccacatttgacacaaaagaaaatgctgaagagttttctgcccacaaaatccaagtctttctgggagtcgccgaatactaactggacactattaaagagcgatatgaacaagccgcacctgatcagcgagctcttaactaaactccagctcagcgggaaactgtcgttcttccctgcacactataacccaaagttaggcatgaacaatctgtcccagaacccctctctccccggggagtgtcatagtagatctgactccagcggcgagaaacggcaactggacgtgtcctcgctgctcctgcagtcccctcagagttacaatgtaaccctgagggacctattggtgatcgccactcctgctcagctcgacccaagaccctgcaggagtcatgccagtgcaatgcgagatccttgcatgcaagaccaagaagcttatagccactgcctcatcagcggccaaaaagggtgtgaacggagctag

SEQ ID NO: 210111 - DNA, 306 bp, Artificial Sequence
  Description of Artificial Sequence: Synthetic coding sequence
atgccccagtgccccaccctggagagccaggagggcgagaacagcgaggaaaagggggattcttcgaaagaggatcctaaggagacagtggccctggccttcgtacgagaaaatcccggcgcccagaatgggctgcagaatgcccaacaacaaggtaagaagaagcgaaaaaaaaagaggctggtcataaacctgtccagttgtagatacgagagtgtgagacgcgcagcccagcagtacgggttcagggagggcggggaggacgacgattggacgctgtattggaccgattacagtgtctcttag

SEQ ID NO: 210112 - DNA, 1356 bp, Artificial Sequence
  Description of Artificial Sequence: Synthetic coding sequence
atgcgggagtgcatcagcatccacgtgggccaggccggcgtgcagatcgggaacgcttgttgggagttgtactgcctagaacacggcatccagcctgacggccaaatgccctccgataaaacaatcggcggcggcgacgactcatttaatacctttttctctgagacgggggcggggaagcatgtgccacgggccgtatttgttgatctggagcccactgtaatcgacgaggtgcgaacaggcacctatagacagctctttcatcctgagcagctcattacaggcaaagaggacgccgctaataactacgcaagaggacactatacaatcggtaaggagatcatcgatctggttctcgatcgcattcggaagttggccgatcagtgtactggtctccaaggcttcctggtattccattccttcggcgggggtacaggatctgggttcacttcacttttgatggaacgtctgagtgtggattatgggaaaaagtccaagttggaattttctatttaccctgcgcctcaagtgtctacagcagtggtcgaaccctacaatagcattttgaccacgcacaccaccttggagcacagtgactgcgccttcatggtggataatgaagccatctacgacatttgccgcaggaacctcgacatcgaacgccctacgtatactaacctgaatcggctcattggacagatcgtcagtagcattactgctagcctcaggtttgacggcgccttgaatgttgaccttaccgagttccagaccaatcttgtcccatatcctagaattcacttcccgctcgctacttatgcacctgtcatcagcgccgaaaaagcctaccacgaacaactcagtgtggctgaaatcacaaatgcatgctttgaacctgcaaatcagatggtcaaatgtgacccaaggcacggcaagtacatggcctgctgcctgttgtacaggggagatgtggttcctaaggatgtcaatgccgctatcgcgaccatcaaaaccaagagaaccatccagtttgttgattggtgcccgacgggcttcaaggtgggcatcaattaccagcctcccactgtcgtcccgggcggagacctcgcaaaggtccagcgcgctgtgtgcatgctgtccaacaccaccgccattgcagaagcatgggctcggttagaccataagtttgatctgatgtatgcaaagcgggcgtttgtgcactggtatgtgggggaagggatggaggagggagagttctccgaagcacgcgaagacatggcggccttagagaaagactacgaggaagtgggggtggattccgtcgagggcgagggtgaagaagaaggcgaggaatactag

SEQ ID NO: 210113 - DNA, 1356 bp, Artificial Sequence
  Description of Artificial Sequence: Synthetic coding sequence
atgcgggagtgcatcagcatccacgtgggccaggccggcgtgcagatcgggaacgcttgttgggaattgtattgcctggagcatgggatccagccggatggtcagatgccaagcgacaaaactattggcggcggggatgacagctttaacaccttttttagcgagaccggggcgggcaagcacgttccacgcgccgtgtttgtggatctcgaaccaactgtgatcgatgaggtgcggacgggcacttaccgacaattgttccatcccgaacaattgatcaccggaaaagaggatgccgcgaataactacgccagggggcattacactatcggaaaggagatcatagacctggtccttgatcgcatcagaaagttggccgatcagtgtactggactgcaggggttcctcgttttccattccttcggaggcggcactggcagtggctttacctccctgcttatggagcggctcagtgtggactatggtaaaaagtccaagctggagttttctatatatcctgcaccacaggtatcgacagctgttgtggaaccctacaatagtatccttacaacacatacaacactggagcacagtgattgcgcatttatggttgataatgaagccatatacgatatctgtagacgcaatttggacatcgaacgccccacttacacaaatctgaaccggctgattgggcagatcgtgagctctattaccgcatctctgagattcgatggcgccctgaatgtggatctgactgagttccaaaccaatttggtcccgtatcctagaattcacttccccttggccacatatgctccggtcatctccgctgagaaagcctaccatgaacagttgtccgtggctgaaattacaaacgcatgttttgagccagctaatcaaatggtgaagtgcgatccacgccacggcaagtacatggcctgctgcctactctacagaggggatgtggtgccgaaagacgtcaacgctgccatcgctacgatcaagactaagaggactatacagttcgtggactggtgccctaccggatttaaggttgggattaattatcagcctcctaccgttgttcctggtggagacctggccaaagttcagcgcgccgtatgcatgctgagcaatacaactgccatagcagaagcctgggcacgtttggaccacaaatttgatctgatgtacgccaagcgagctttcgtccactggtatgttggcgagggcatggaagaaggcgaatttagtgaagcgagagaagacatggccgctcttgaaaaggattacgaagaggttggcgtggatagtgtagagggcgagggcgaagaagagggggaggagtattag

SEQ ID NO: 210114 - DNA, 1152 bp, Artificial Sequence
  Description of Artificial Sequence: Synthetic coding sequence
atgatcgacctggagcccaccgtggtggacgaggtgcgggccggcacctatagacagttgtttcaccctgaacagttgatcacaggcaaagaagacgctgctaataactatgccagaggacattacactgtggggaaggaaagcattgacctggtgctcgacaggatcaggaagcttactgatgcctgctccggactacagggcttcttaatcttccactcatttgggggcggtacagggtctggattcacaagccttctaatggaaagactgtccctggactatggtaaaaagagcaagctcgaatttgcaatataccctgctccacaggtgtctacggccgtggtcgagccttataactccattttgaccacgcacacaaccttagaacactccgactgtgctttcatggttgacaacgaggccatttatgatatctgcaggcggaaccttgacattgagcgccccacatatacgaacctgaacagattgatctcacagatagtctcaagtattacagctagcctccgattcgatggagctctgaacgtggacctgaccgaatttcaaacaaatctcgtcccctacccacgaatccacttcccgttggtgacctatgctcctattatctccgccgagaaggcgtatcacgaacagctgtccgtggcagagatcacatcttcctgttttgaaccgaacagccaaatggtcaagtgtgatcctcgccacggtaagtatatggcttgttgcatgctgtaccgtggtgacgttgtgcctaaggacgtgaacgtcgctatcgctgcaatcaagaccaaaagaacaattcagttcgtagactggtgtcccactgggttcaaggttgggattaactaccagccacctacggtggtccccggaggcgacctggctaaggtgcagcgggcggtgtgcatgctgtctaataccaccgctattgccgaagcatgggcccgcctagaccacaagtttgatctgatgtacgccaaaagagcgttcgtgcactggtacgtgggcgaagggatggaggaaggtgagtttagcgaggctcgggaagacctcgccgcactcgaaaaagactatgaagaagtcggcacagatagttttgaagaagaaaatgagggcgaggagttctag

SEQ ID NO: 210115 - DNA, 1350 bp, Artificial Sequence
  Description of Artificial Sequence: Synthetic coding sequence
atgcgggagtgcatcagcgtgcacgtgggccaggccggcgtgcagatcggtaacgcctgttgggagctgttttgcctggagcacggaatccaggccgacggcaccttcgacgcccaagcatcaaaaataaatgacgacgacagctttaccacattcttcagcgaaaccggcaatggaaaacacgtgcctcgggcagttatgattgatctggaacccaccgtggtagatgaggtaagagctgggacctacaggcagctgtttcatccagagcagctgatcacaggcaaggaagatgccgccaataactatgcacgcgggcactataccgtaggcaaggagtcaatcgacctagttctggaccggattcggaaactaacagacgcttgctctggcctgcagggctttttgatcttccacagttttggaggaggcaccgggtccgggttcaccagcttactcatggaacgattgagccttgactacggtaagaagagcaagttggagttcgccatttaccccgctccccaggtgtctaccgcagttgtcgagccctacaactccatccttacgacacacactaccctagagcactctgactgtgccttcatggtggataatgaagccatctacgatatctgccgacgcaatcttgatatcgagcgacccacttacacgaatctcaatcgactgatttcccaaattgttagctctattacagcctcactaaggtttgatggtgcactgaatgtggacctgactgaattccaaacaaatcttgtgccttacccacgcattcactttcctctggtgacttatgcccccattattagcgccgaaaaagcttaccatgagcagttatcggttgctgagattacctcttcctgttttgaaccgaatagccagatggtgaagtgtgaccctcgccacggcaagtatatggcctgctgtatgctgtatcgcggcgacgtggtgccaaaggatgtgaacgtcgcaattgccgccataaaaacaaaaaggacaattcagtttgtggactggtgcccaaccggattcaaagtggggataaattaccagccccccactgttgtaccaggcggggacctggctaaagtccagagggctgtgtgtatgttatcaaacactactgctattgccgaggcctgggcgcgtttagatcacaaattcgaccttatgtatgctaagagagcatttgttcactggtacgtgggtgaaggcatggaagaaggggagttttcagaggccagagaggatctggcagccctcgaaaaggactacgaagaggtgggcactgattcattcgaggaggagaatgagggcgaagagttctag

SEQ ID NO: 210116 - DNA, 912 bp, Artificial Sequence
  Description of Artificial Sequence: Synthetic coding sequence
atggcccggcggggccccggctggcggcccctgctgctgctggtgcttctcgccggagcagcccaggggggactgtacttcagaagggggcagacctgctacaggccactgaggggcgatggccttgcaccactgggacggtcaacttacccacgaccgcacgaatacctctcacctgccgatctgcccaagtcctgggactggcggaatgttgacggggtgaattacgcctccatcacaagaaaccagcacattccacagtactgtgggagctgctgggcacatgcctctacaagcgctatggccgacagaataaacatcaaaaggaagggtgcctggcctagcacgctcctgtctgtgcagaatgttatcgactgtggtaatgctgggtcctgtgagggcggcaatgacctcagcgtgtgggattatgctcatcagcacggaattccggacgagacctgtaacaactaccaggctaaggatcaggaatgcgataagttcaatcagtgtggcacatgtaatgaattcaaggagtgccatgccattaggaactacacgctttggagagtaggggactacggcagcctgagcggccgggaaaaaatgatggcagaaatctacgcaaacgggccaattagctgcgggatcatggccaccgagcgacttgccaactacacaggaggcatctacgctgagtatcaggacacaacctatatcaatcatgtagtcagcgtagccgggtgggggatctctgacggcactgaatactggatcgtgaggaatagctggggagaaccctggggagagaggggctggttacgcatagtcactagtacttataaggacggaaaaggtgcccggtacaatctggcgattgaggagcattgcacctttggcgaccctatagtgtag

SEQ ID NO: 210117 - DNA, 1338 bp, Artificial Sequence
  Description of Artificial Sequence: Synthetic coding sequence
atgcgggagatcgtgcacatccaggccggccagtgcggcaaccagatcggagccaaattttgggaggtaattagcgatgagcatggcatcgaccctacaggctcctatcacggcgacagcgatcttcagctggaacgaattaatgtgtattacaacgaggccaccgggaacaagtacgttccacgggcaattctcgtcgatctcgagcctgggactatggattctgtgaggagcggccccttcggacagatcttccgcccagacaattttgtgtttggtcagtccggtgccggcaacaactgggcaaagggtcattataccgagggcgctgagctggttgacagtgtcctggacgtggttagaaaagaaagtgaatcatgtgattgtttacagggattccagctcacgcatagtctagggggggggacaggatcaggaatgggtaccctgctcatctcgaaaatccgcgaagagtatcccgatcgaattatgaacaccttttctgtcatgccttcgcccaaggtaagcgatacagtcgtggagccgtacaatgccactctgagtgtacatcagctcgtagagaacacagacgagacctactgcatagacaacgaggccctctacgatatttgcttcagaaccttgaaactgacgaccccaacgtacggcgatttgaatcacctcgtaagcgccacaatgtcaggcgtgaccacttgcctaagattcccaggccaactgaacgccgacttacggaaattagccgtcaatatggtaccctttcctagactccacttcttcatgcctggttttgcccccctgacctccagaggatcccagcagtatcgcgccttgactgtcccagaattgacccagcagatgtttgactcaaagaatatgatggcagcttgcgatccccgccatggcaggtatttgacagtcgcagccatattcaggggtagaatgtctatgaaagaagtggacgagcaaatgctgaacgtgcaaaacaagaactcttcctattttgtcgagtggatccctaacaacgttaagacggctgtgtgtgacattccgccccgtgggctgaagatgagtgctaccttcatcggcaacagcacggcaatccaagagctgttcaagcggataagtgaacaatttactgctatgttccgacgcaaagcctttcttcattggtatacaggtgagggtatggatgagatggaattcaccgaagctgaatcaaatatgaatgacctcgtgtcagaatatcaacagtaccaggatgccacagcagatgagcaaggagaatttgaagaggaggaaggcgaggatgaggcgtag

SEQ ID NO: 210118 - DNA, 1353 bp, Artificial Sequence
  Description of Artificial Sequence: Synthetic coding sequence
atgcgggagatcgtgcacatccaggccggccagtgcggcaaccagatcggcgctaagttctgggaggttattagcgatgaacacggcattgatccctccggtaactacgtcggggactccgatttgcaactggaaaggatctcagtgtattacaacgaggcctcttcgcacaagtacgtaccccgagccattctcgttgacctcgaaccaggaactatggacagtgttcgctccggggcgttcggacacctgtttaggccagacaacttcattttcggacaatccggggccggaaataattgggccaaggggcactataccgagggcgcagaactggtggactcagtgctcgacgtggttcgcaaggagtgcgagaactgcgattgtctgcaggggttccagttaacccactctctgggagggggaactggttccggcatgggaaccctgctcatctcgaaggtgcgtgaggaataccctgacagaattatgaacaccttctccgtggtcccctctccgaaggtgtccgataccgtcgtggagccatacaatgcgacgttgtcgatccaccagctggtggaaaatacagatgaaacctattgtatcgacaatgaggccttgtatgatatctgttttcgaacccttaagctagcaacaccaacatacggcgatctaaaccatctggtgtcggcaacaatgtcaggggtcacaaccagcctgaggttccccggccagttaaatgctgatctcaggaagttagctgtgaatatggtgccttttccacggctgcatttcttcatgcctggcttcgcaccactcacggccaggggctctcagcagtaccgggccctgacggtacccgagctaacacaacagatgtttgatgccaaaaatatgatggctgcatgcgacccaaggcacggaagatacctaacagtcgcgactgtcttccgcggacgtatgtccatgaaggaggtggacgaacagatgcttgcgatccagtccaagaacagctcttactttgtggagtggatcccgaacaacgtcaaggtggccgtctgcgatatcccacccagaggattgaaaatgtcctcaacatttatcggcaactctaccgccattcaagagctgttcaagcgaatttctgagcaatttaccgctatgtttagaaggaaggccttcctgcactggtacactggcgaaggtatggatgaaatggagtttacagaggcagagtccaatatgaatgacttggtgtcggagtatcagcagtatcaggatgccacagcagaagaggaaggagagatgtacgaagatgacgaagaagagagcgaggcacaaggaccaaagtag

SEQ ID NO: 210119 - DNA, 1137 bp, Artificial Sequence
  Description of Artificial Sequence: Synthetic coding sequence
atggacagcgtgcggagcggcgccttcggccacctgttccggcccgataactttatcttcggccaaagcggggctggcaacaattgggctaagggtcactacactgaaggggccgaactagtggatagtgtgctagacgttgtgcgtaaggaatgtgagaactgtgactgcctgcagggattccagctgacccactccctgggagggggtactggatctggcatggggaccctactgatcagcaaggtcagggaagagtacccagacaggattatgaacactttttcagtcgtcccgtctcccaaggtttccgacaccgtggtcgagccatacaacgccactctgtccatacaccagctagttgagaacacagatgaaacctattgcatcgataacgaggcattatatgatatctgttttagaaccctaaagctggcaactcccacatacggcgaccttaaccacctcgtttctgccacaatgagcggtgttacaaccagcctgcgatttccaggacaactcaacgccgacctgcggaaactggcagttaacatggtcccattccctaggctgcatttcttcatgcctggcttcgcgccgctcacagctcggggatcgcagcagtatagggccctaacggttccggaactaacacagcaaatgttcgacgcaaaaaacatgatggcggcatgcgacccccggcatggtcgatacttgacagtggccaccgtgtttcgcggacgcatgagcatgaaggaggtagacgagcagatgttggccattcagtctaaaaactcctcctacttcgtcgaatggattccaaacaatgtaaaggtagccgtttgtgacatacctcctcggggccttaaaatgtcctccacctttataggaaattccacagcaattcaggaactttttaaaaggatttccgagcagtttacggcaatgtttcgcaggaaggcatttctgcattggtataccggggaggggatggacgagatggaatttaccgaggctgaaagcaatatgaatgatcttgtgtcagagtaccagcagtaccaagacgctactgccgaggaggagggagagatgtacgaggacgacgaagaagagagtgaagcccaaggcccgaagtag

SEQ ID NO: 210120 - DNA, 1335 bp, Artificial Sequence
  Description of Artificial Sequence: Synthetic coding sequence
atgcgggagatcgtgcacatccaggccggccagtgcggcaaccagatcggggcgaagttctgggaggtgatttcggatgaacacggaatcgacccgacgggaacctatcatggggattccgacctgcagctggatcgtatctccgtgtattataacgaagccactggtggaaaatatgtgccaagagccattctggttgaccttgagccagggacgatggatagcgtgcggtcaggaccgtttgggcagatctttcgcccagacaacttcgtttttggccagtcaggggccgggaataattgggccaagggacattataccgagggcgccgagttagtggactccgttctcgacgtggtgcgaaaagaggctgagagctgcgattgcttgcaaggcttccagcttacacattccctggggggtgggactggaagcggaatgggtaccctcttaatctccaagatacgtgaagagtaccccgacagaattatgaatacatttagcgtggtgccttcacccaaagtctcagataccgtcgtcgagccctacaacgcgactctctctgtgcaccaactggtggagaacaccgacgagacctattgtatagacaatgaggcactgtacgatatttgctttcggacactgaaactgactaccccaacttatggcgatctgaatcacctggtctctgccacgatgtcaggtgttactacttgtctaaggttcccaggtcagctgaacgcagatctgcgtaaacttgccgtaaatatggtcccattccctcgcctgcatttctttatgcctggatttgcccctctgacatctcggggcagccagcaataccgagccctcaccgtgcctgagctgacacagcaggtatttgacgctaaaaatatgatggccgcctgtgaccctcggcacggccgttacctcactgtggcagccgttttccgcggccgcatgtccatgaaagaagttgacgagcagatgctaaatgttcagaacaaaaattccagttactttgtggagtggatcccgaataacgtgaagactgccgtgtgcgacattccacctcggggactgaagatggccgtgactttcattgggaatagcactgcaatccaagaactgtttaagcggataagtgagcaattcaccgccatgtttcgtaggaaagctttcctccattggtatacaggggagggcatggatgagatggagttcaccgaggccgaaagtaacatgaatgatctggtgagtgagtaccagcagtaccaggacgcaacagctgaagaagaggaagacttcggagaggaggcagaggaggaagcgtag

SEQ ID NO: 210121 - DNA, 1119 bp, Artificial Sequence
  Description of Artificial Sequence: Synthetic coding sequence
atggacagcgtgcggagcggccccttcggccagatcttccggcccgacaattttgttttcgggcagtcaggcgcgggaaacaactgggcaaaaggacactacacagagggtgcggaactggtggattccgtgcttgacgtggttaggaaagaagcagaatcttgtgactgcctgcaaggtttccagctcacacattcactcggcgggggaactgggagcggcatgggaactctcttgatttcaaagatccgggaggagtatccagatagaatcatgaatacattctcagtggttcctagccccaaagtgtctgacaccgttgtggaaccctacaacgcgaccctgtcggttcaccaactggttgaaaacactgacgaaacctactgcattgacaatgaggccctctatgatatctgcttccgtacgctgaagctaaccacccctacttatggtgatcttaaccacttggtaagcgctaccatgagtggtgtcacaacctgcctgcggttcccaggccagttgaacgccgatttaagaaagctggccgtcaatatggtcccctttcctaggctccacttcttcatgccaggattcgccccgctcacatcacgggggtctcagcaatatagagcgctcaccgttccggagctaacgcaacaggtgttcgatgccaagaatatgatggcggcttgcgatccccggcacggccgctatctcactgtcgcagctgtctttcgcggaaggatgagcatgaaagaggtggacgaacagatgctgaacgtccagaacaagaacagctcttacttcgtcgagtggattcctaataatgtcaaaaccgccgtctgcgatattccaccccgcgggttgaagatggccgtcacattcatcgggaactctacagctatacaagaactgtttaagcggatttctgaacagtttactgctatgttcagacggaaggccttccttcactggtacaccggcgaagggatggacgaaatggagttcacagaagcagaatctaacatgaacgatcttgtatccgagtaccagcagtatcaggacgcaaccgccgaggaggaggaagacttcggagaagaagccgaagaagaggcctag

SEQ ID NO: 210122 - DNA, 1335 bp, Artificial Sequence
  Description of Artificial Sequence: Synthetic coding sequence
atgcgggagatcgtgcacatccaggccggccagtgcggcaaccagattggtgcaaaattctgggaagtgataagtgacgagcatggcatcgacccaaccggtacttaccatggcgactcagatttgcagttggaccgaatttctgtctattacaacgaagctactggtggtaagtatgttcccagagcaattctggtagacctcgagccaggtactatggacagtgtgcggagcgggcctttcggccagatctttagacctgacaacttcgtgtttgggcagtcgggggcaggcaataactgggcgaaggggcattacactgagggcgctgagctggtggacagcgttcttgacgtggtgagaaaagaggcagaaagttgtgactgtctccaggggtttcaactgacccacagcctgggtggaggcaccggatcaggcatggggaccctgctcatttccaagattagagaagaatatccagaccgcatcatgaacacattttcggtggttcccagcccgaaagtctctgacactgtggtggagccttataatgcaacactgtctgtgcatcagctcgtcgagaatacagacgaaacctattgcatcgataacgaggccctgtatgacatatgctttcgaacccttaaattgaccacacccacatacggggacctgaaccaccttgtctcggctaccatgtcaggagtcacaacctgcttgagatttccagggcagctgaacgcagacttaagaaaattagcggtgaacatggttcccttcccgaggctgcatttctttatgccaggattcgccccgttgacatcaagaggcagtcaacagtacagagctctgacggttcctgagctgactcagcaagtcttcgacgccaaaaacatgatggccgcgtgtgatccgagacatggcaggtacctcacggtggccgcagtgttccgcgggcggatgtcgatgaaagaagtggatgagcaaatgctgaatgtgcaaaataagaattcctcatactttgtcgaatggatccctaacaatgtgaagaccgccgtctgtgatatccctccccgcggacttaaaatggccgtgactttcattggtaactctactgctattcaggagttattcaagcggatttccgaacagttcacagcaatgtttagacgcaaggcattcctacactggtatacaggggaggggatggacgaaatggagttcacagaagctgaatcaaatatgaacgacttagtctccgagtaccagcaataccaagacgcaactgcagaagaggaggaggactttggtgaagaggctgaggaggaagcctag

SEQ ID NO: 210123 - DNA, 1119 bp, Artificial Sequence
  Description of Artificial Sequence: Synthetic coding sequence
atggacagcgtgcggagcggccccttcggccagatcttccggcccgacaactttgtgttcggccagagcggagcgggcaacaattgggcgaaggggcattatactgagggcgccgagcttgtggactcagtcctggacgtggttcgaaaggaggccgagtcgtgcgactgcctacagggcttccagttgacccacagcctgggtgggggaaccggaagcggcatgggtacactactgatttccaaaatcagagaggagtacccagatcgtataatgaatacattttccgtcgtaccttcccctaaggtgagcgatacagtagtggagccgtacaacgcaaccttgtcagtccaccagctagttgaaaatactgacgagacgtactgtatagataacgaggcactctatgacatctgtttccgaacgctcaaactgaccacaccgacctatggggacctgaatcatcttgtaagcgctactatgtcaggagttaccacatgtctgcggttccccggacagctgaatgccgatcttcgcaagctggccgtcaatatggttcccttcccccggctgcacttcttcatgcctggcttcgcccctctgactagccgggggagccagcagtatcgcgcactgacagtccctgagctgacacagcaagtgtttgacgcaaagaatatgatggctgcatgtgatcccaggcatggtcgctatctgactgtggcagcggtctttcgaggaaggatgtctatgaaagaggtggatgagcagatgctgaatgtgcagaacaagaattcctcgtatttcgttgagtggatacccaacaacgtcaaaaccgcagtgtgtgatatcccaccccggggactcaaaatggcagtgacatttatcggcaactctaccgccatccaggagttgttcaaacgtataagtgaacagtttaccgccatgtttagaaggaaagcctttctgcattggtatacaggtgaggggatggatgagatggagtttactgaagctgagtctaatatgaatgatctcgtgagcgagtaccagcaatatcaggatgccacggccgaagaggaagaagactttggtgaggaagccgaggaagaggcctag

SEQ ID NO: 210124 - DNA, 1281 bp, Artificial Sequence
  Description of Artificial Sequence: Synthetic coding sequence
atgttctgggaggtgatcagcgacgagcacggcatcgaccccaccggcacctaccatggggattcagatctgcaactggacagaatctctgtttactataatgaggccaccggcggcaagtacgtccccagagccatcttggttgatctggagcctggcacaatggatagcgtccgcagtggcccttttggtcagattttccgaccggacaacttcgtgtttggccagtccggcgccggaaataattgggccaaggggcattacacagagggggctgaactcgtcgactccgtactggacgtcgtgcgcaaggaagccgagtcttgtgactgcctccagggtttccagctaacccattcgctggggggtggtacagggagcggaatgggcactctgctgatttccaagatccgagaggagtaccctgatcgtatcatgaacaccttcagcgtagtgcctagtcccaaagtgagcgacacagtggtggaaccgtataacgccaccctgtcggtccaccaactggtagagaacaccgacgagacttactgcattgataatgaagccttatatgacatttgctttcgaacactgaaactaaccacacctacgtacggcgacctgaaccatttagtgtccgcgaccatgagcggagtgaccacgtgtctgaggttcccagggcagctgaacgcagacctgcgaaagctggcagtcaacatggtgccattcccccggctccatttctttatgccaggctttgctccgctcactagtaggggctcccagcagtatcgagcactgacagtgccagagctgacccaacaggtgtttgatgctaagaatatgatggccgcctgcgacccgagacacggacggtatttaactgtggcggcagtctttcgcgggcggatgtctatgaaggaagtagatgaacaaatgctgaatgttcagaataagaattcctcatatttcgtcgagtggattccaaataacgtaaaaacggccgtgtgtgacatccctccaaggggtctgaaaatggccgtcactttcattgggaattccacagctatccaggaactgttcaaacggatctccgaacagttcaccgctatgtttcgaagaaaggctttcctccactggtacaccggggagggcatggacgaaatggaattcactgaagccgaaagcaacatgaacgacctcgtgagcgagtaccaacagtaccaggatgccactgcagaagaggaggaagatttcggcgaggaagctgaagaagaagcttag

SEQ ID NO: 210125 - DNA, 1119 bp, Artificial Sequence
  Description of Artificial Sequence: Synthetic coding sequence
atggacagcgtgcggagcggccccttcggccagatcttccggcccgataatttcgtctttggccaatcaggcgccggcaataattgggcaaaggggcactataccgagggagcagagctggtggattctgtgttggacgtggtacgcaaggaggcagagagttgcgattgcctgcagggatttcaattgactcacagtctgggagggggcactggatcaggcatgggcaccctgctcattagcaagatacgcgaggagtatcctgaccgaatcatgaacactttctctgttgtgcccagccccaaagttagcgacaccgtggtcgaaccctacaacgccacactgtctgtgcaccagctcgttgagaacactgacgagacgtactgcatagacaatgaagctctgtatgatatctgtttccgcaccctgaaactgacaaccccaacttatggcgacttaaaccacttggtgagtgccaccatgtctggcgtcactacatgtcttcggtttcctggacagctgaatgctgacttgcgaaagcttgcagtgaacatggtgcctttcccaaggcttcactttttcatgccagggttcgcaccgttaacttcaaggggatcccagcagtatagggctttaactgtcccagaactaacccagcaggtgttcgacgctaagaatatgatggctgcctgtgacccgaggcacggccggtatcttacagtggcggccgtgttccggggtaggatgtcgatgaaggaggtcgatgaacaaatgcttaatgtgcagaataaaaactcctcctactttgtggagtggatcccaaacaacgtgaaaacagccgtctgtgatatccctcctcggggcctaaaaatggcagtcacgttcatcggcaatagtacagccattcaggaactgtttaagagaatttctgaacagttcacagcaatgtttcggagaaaggcctttctgcattggtacactggagagggaatggatgagatggaattcactgaggctgaaagcaatatgaacgacctggtgtctgaatatcagcaataccaggacgctacagccgaggaggaagaggatttcggagaagaggccgaggaggaagcctag

SEQ ID NO: 210126 - DNA, 1119 bp, Artificial Sequence
  Description of Artificial Sequence: Synthetic coding sequence
atggacagcgtgcggagcggccccttcggccagatcttccggcccgataactttgtgttcggacaatctggagctgggaacaattgggctaaaggtcactatacggagggtgctgagctggtagactccgttctggacgtcgtgcgcaaggaggcagaaagctgcgactgcctccagggatttcagctgactcattctttaggagggggaacgggtagcggcatgggaaccctgttgattagtaagatccgtgaagagtatcccgataggataatgaacactttctctgtcgtacctagccccaaagtaagcgacacagtggtggagccatataatgcgaccctttccgtgcaccagttggtagagaacacagacgagacttattgtattgataacgaggcattatacgacatctgctttcggactctcaaactgacgactcccacttatggggacctgaaccacctggtgtccgccacaatgtccggtgtgacgacatgcctacggtttccgggacagctgaatgctgacctcaggaaactggccgtaaacatggtcccatttccacgactccacttttttatgcctggtttcgccccactgactagtagggggtcgcaacagtaccgtgccctgactgtgcctgagctgacccagcaggtgttcgatgcaaagaatatgatggccgcatgtgatccccgacacggccgatatctgacagtcgcagcggtgtttcgaggccggatgtccatgaaagaagtggatgaacagatgctgaatgtgcagaacaagaattcgtcatacttcgttgagtggataccgaacaacgtgaaaaccgccgtgtgcgatatacctcctagggggctgaaaatggccgtcacgttcataggaaactccactgccatacaggagttatttaaaagaattagcgagcaattcacagccatgttccgacgcaaagccttcctgcattggtacaccggggagggcatggacgagatggaatttacggaggctgaaagcaatatgaatgacctagtcagcgaataccagcagtaccaggatgcaactgcagaagaggaagaggattttggcgaggaagccgaagaggaagcctag

SEQ ID NO: 210127 - DNA, 1281 bp, Artificial Sequence
  Description of Artificial Sequence: Synthetic coding sequence
atgttctgggaggtgatcagcgacgagcacggcatcgaccccaccggaacatatcacggcgattccgacctccagctcgatcgaatcagcgtgtactacaacgaggcaacaggcggcaaatacgtacctagggccatactggtggatctcgaacctggcactatggattccgttagaagcggcccatttggacagatattccggcccgataatttcgtgtttggccagagcggcgcaggaaataactgggccaaagggcactatactgagggtgctgaactcgtggacagcgtgttggatgttgtacggaaggaagcagagtcatgcgactgtctgcaggggtttcagttaacccactcactgggaggcgggaccggtagtgggatggggacattgttgatttcaaagatacgcgaggagtaccccgataggatcatgaacacattctccgtggtcccctcaccaaaggtcagtgataccgtggtcgaaccgtacaacgcaaccctgagcgtgcatcagttggtggagaatactgatgagacatattgtatcgacaatgaggccctctacgatatctgttttcggactttaaagctgacaactcccacatacggcgacttaaatcacttggtaagtgcaacaatgtccggcgtaaccacctgtctgcgcttccctggacagctgaacgctgacctccggaagttagccgtgaatatggtcccctttcctcggttacacttttttatgccagggtttgcccctctgacctctcggggctcccagcaataccgtgctcttacagtcccagaattgacccagcaagtattcgatgcgaaaaatatgatggcagcctgtgacccccggcacgggcggtacttgaccgtggcggcggtctttcgcgggagaatgtccatgaaagaagtggatgagcaaatgctgaacgtgcagaacaagaattcgagctattttgtggagtggatccccaacaacgtcaaaacggctgtgtgcgacatcccaccgcgtggactgaaaatggccgttacattcattggcaattccaccgccatccaggagctgtttaagaggatctctgaacagtttacagcaatgttcaggagaaaagcattcttgcattggtataccggcgaagggatggacgagatggaattcaccgaggccgagtctaacatgaatgacttggtatctgaataccagcaataccaggatgcaaccgccgaagaggaggaggacttcggagaagaagccgaagaagaagcttag

SEQ ID NO: 210128 - DNA, 1281 bp, Artificial Sequence
  Description of Artificial Sequence: Synthetic coding sequence
atgttctgggaggtgatcagcgacgagcacggcatcgaccccaccggaacttaccatggagactcagacctacagttagacaggataagtgtttattataatgaagccacaggaggcaaatatgttccccgcgcaattcttgtggacctggaaccaggcaccatggattccgtgagatctggtccttttgggcagattttcagaccagacaactttgtttttggtcagagcggcgcaggtaacaactgggctaaagggcactacactgaaggcgctgagttggtggactcagttctcgatgtggtgcgcaaagaggcggaatcttgcgactgcctgcagggttttcagctgacgcactccctcggaggggggactggatctgggatgggcactctgctgatcagcaaaataagggaggaatacccggatcgaatcatgaatacattctccgtcgtgcctagtcctaaggtgtctgatacggttgtggagccttacaacgccactctgtcagtgcaccaactggtcgagaatacggatgagacttactgcatcgacaatgaggccttgtatgatatatgtttccggactctgaagcttaccacccctacgtatggtgacttgaaccaccttgtctccgccaccatgtctggcgttacaacatgcctcagattccccggccaattgaatgctgacctgagaaagctcgccgtcaatatggtcccttttccccggctgcacttcttcatgccaggtttcgcgcctctgactagtcgtggctcccagcagtacagggctctaaccgtgcctgagcttacccagcaagtgtttgatgctaagaatatgatggccgcctgtgacccacgccacggaagatatcttactgtggcagccgtctttaggggccgaatgtctatgaaagaagtggacgaacaaatgttgaacgtgcagaataagaattccagctactttgtggagtggattcccaacaacgtcaagacggcagtgtgcgacatccctcccagaggcctgaagatggccgtgacctttatcggaaactctaccgcgatccaggagttattcaagagaatcagcgaacagtttactgctatgttcagacggaaagcttttttgcactggtacacaggggaagggatggacgagatggaattcacagaagctgagagcaacatgaatgacctagtcagcgagtatcagcagtatcaagacgccaccgcggaggaggaggaagactttggggaggaggctgaggaagaagcttag

SEQ ID NO: 210129 - DNA, 1119 bp, Artificial Sequence
  Description of Artificial Sequence: Synthetic coding sequence
atggacagcgtgcggagcggccccttcggccagatcttccggcccgacaacttcgtttttggccagagcggtgctggaaacaattgggctaagggacattacaccgaaggagctgaattggtcgatagcgtcctggacgtcgtgcgtaaagaggcagagtcttgtgattgcctccagggctttcagctcacccactcattgggcggtggaactggcagcggtatgggcacactgttgatcagcaagatccgggaggagtaccccgataggataatgaatacctttagtgtggtgcccagccctaaagtgtccgatactgtagttgaaccctataacgcaacactcagtgtgcaccagctggtagagaacacagatgaaacatattgtattgataacgaagccctttacgatatctgttttcggacacttaaactcacaacgcccacttatggggatctcaaccacttagttagcgccactatgagcggcgttacaacatgtctgaggtttcccggccagttgaatgctgacctgaggaagcttgcagtcaatatggttcccttcccaaggctccacttctttatgccaggattcgcgcctctgacttccagagggagccagcaatatagggcgctgaccgtgcccgaactgacccagcaggtcttcgatgctaagaatatgatggctgcatgcgatccccgtcacggtcggtacctcacagtggccgccgtctttagggggaggatgtcaatgaaggaggttgatgagcagatgctcaacgtacagaacaagaactcaagctacttcgtagaatggataccaaataacgtcaaaacagccgtctgtgacattccccccaggggcttgaaaatggcagtaacattcataggcaacagcacagctattcaggagctcttcaaacgcatttccgagcagtttaccgccatgttccggcgcaaggcctttctccactggtatactggcgagggaatggacgagatggagttcactgaggcagagtccaatatgaacgacctggtcagtgaataccagcagtaccaggacgccacagcggaggaagaggaagatttcggagaggaagccgaggaggaggcctag

SEQ ID NO: 210130 - DNA, 1281 bp, Artificial Sequence
  Description of Artificial Sequence: Synthetic coding sequence
atgttctgggaggtgatcagcgacgagcacggcatcgaccccaccggcacatatcatggcgattcggacctccagttggaccgcatttctgtttattataatgaggccacgggagggaagtacgttcctagagctatcttggtggacctcgagcctggaaccatggactctgtgcgctctggcccattcggacagatcttccggccagacaatttcgtttttggccagagtggcgcagggaacaattgggcaaaaggccattataccgaaggagccgagctggtagattccgtcttagacgtcgtgcggaaagaggctgaatcctgcgattgtctccagggatttcagcttactcactccttgggtggtgggactggcagcggcatgggtacactcctcatctctaagatccgcgaagagtatcctgatagaattatgaacacatttagcgtagtcccaagccctaaggtgtcagacactgtggtggagccctataacgctaccttgagcgtacatcagctggtggagaacacggatgaaacgtactgcattgataacgaggcactctacgatatctgcttccgaaccctgaaactcaccacccctacgtatggagacctgaaccatctggttagtgccacgatgtctggcgtgacaacctgtctgagattcccgggccaactcaacgcagacttgaggaagcttgccgtcaatatggtgcctttcccccgattgcacttcttcatgcccggatttgctccccttactagccggggctcccagcagtatcgcgctctgaccgtacctgagctgacgcagcaagtgtttgatgctaagaatatgatggcagcctgcgatccacgacacgggcgatacctgactgtcgctgcggtgtttcgcggtcggatgtccatgaaagaggtcgatgagcaaatgttaaatgtgcagaataagaatagcagctactttgtggagtggattccaaataatgtgaaaacggcagtttgcgacatccctcctcgaggccttaagatggccgtgacttttattggtaactccaccgctatacaggaattgtttaagcgaatatccgaacagtttacggctatgtttcgacgaaaggccttcctccactggtatactggggagggcatggatgagatggaattcactgaggcagagtcaaacatgaacgaccttgtatccgaataccagcaatatcaggatgccaccgcagaggaagaagaagactttggcgaggaggctgaggaggaagcttag

SEQ ID NO: 210131 - DNA, 1335 bp, Artificial Sequence
  Description of Artificial Sequence: Synthetic coding sequence
atgcgggagatcgtgcacatccaggccggccagtgcggcaaccagatcggggcaaaattttgggaagtgatctctgacgaacatggcatcgatccgactggaacctatcatggggatagcgatctgcagctggatagaatcagtgtttattataatgaggccaccggtggcaagtacgtgcctcgagcaatcctcgtggacctggaacctgggactatggactctgtccgcagcgggccctttggccagattttcagacccgataactttgtatttgggcagtcgggggccgggaataattgggcaaagggacattataccgagggcgctgagttggtcgacagcgtgctcgatgtggtcaggaaggaggccgaatcttgcgactgtctacaaggattccagctgacccactcgctcggaggtggaaccgggagtggcatgggcactcttcttatctcgaaaattcgcgaagagtatcccgatcggatcatgaacacttttagcgtggtgccatctccaaaagtcagtgataccgtagtcgaaccatataacgccacactgagcgtgcaccaactggtggagaataccgatgagacatattgcatcgacaatgaggcactgtatgacatatgcttccgtacattgaaattgactacacccacttatggagatctgaaccacctggtatctgctacgatgagtggcgttacgacctgcctgcggttccccggtcagctcaacgctgatttgcggaaactggcggtaaacatggtgccatttccccgactgcactttttcatgcccggattcgccccgttgacctcaaggggctcccagcaatacagagccttaacggttcccgagctgacccagcaagtgttcgatgctaaaaatatgatggcggcctgtgacccacgtcatggacgctatcttacagttgccgctgtgtttcgcggacgcatgtcaatgaaagaggtggatgaacaaatgttgaatgtgcagaacaaaaatagcagctattttgttgagtggataccaaacaatgtgaagaccgcggtgtgcgacatcccacccagaggcctcaagatggccgtgaccttcatcgggaattccaccgccattcaagagcttttcaaaagaatctcagagcaattcacagccatgttccgtcgcaaagcatttctgcactggtacacaggcgagggtatggacgagatggagtttacagaggctgagtctaatatgaacgacctggtcagtgaataccaacagtatcaggacgctaccgccgaagaggaagaagacttcggggaagaagctgaagaagaggcttag

SEQ ID NO: 210132 - DNA, 1281 bp, Artificial Sequence
  Description of Artificial Sequence: Synthetic coding sequence
atgttctgggaggtgatcagcgacgagcacggcatcgaccccaccggcacctatcacggcgatagcgacctgcaacttgatagaatcagtgtgtattacaacgaagccaccggggggaagtatgttcccagagctatcttggtggacctcgagccggggaccatggacagcgtaagatctgggccatttggccagatctttcgccccgacaatttcgtcttcggacaaagtggggcaggtaataattgggccaaaggtcattatactgaaggcgcagagttggtcgacagtgtcctggacgtggtccgaaaagaagccgagtcctgtgactgcctgcaggggtttcagctgactcacagccttggcggagggacgggaagcgggatgggtactctgttaatcagcaaaattcgcgaggagtaccccgatcggataatgaataccttctccgtagtgccttccccaaaagttagcgataccgtggtggagccttacaatgctacattatccgtacatcagctggtggaaaatacagatgagacatattgcattgataatgaggcactctacgacatctgctttcgcacactgaagctcacgactcccacctatggagaccttaaccatctggtttcagctacgatgagcggggtgaccacgtgtctgagatttcccggacagctcaatgccgacctgagaaaactcgcagtgaatatggtgccatttccgcgcctacatttctttatgcctggcttcgcgccgctgacttccaggggcagccagcagtaccgcgccctgacagtgccagaacttacacaacaggtgtttgatgccaagaacatgatggctgcgtgcgatccacgccacggtcgatacctcacagtcgctgctgtttttaggggacgcatgtccatgaaggaggttgacgagcagatgctgaatgtccaaaacaaaaattcctcttactttgttgagtggattcccaataatgttaagacagccgtgtgcgatattccacctcggggcttgaagatggccgttacctttatcggaaatagcacagctattcaggaactctttaagcgaattagtgaacaattcaccgccatgttccggcgcaaggctttcctgcactggtacacgggcgaggggatggatgagatggagttcacggaagctgagtccaatatgaatgatctggtctctgagtaccagcaataccaggatgccaccgccgaagaagaagaagacttcggtgaggaagctgaggaagaggcctag

SEQ ID NO: 210133 - DNA, 1119 bp, Artificial Sequence
  Description of Artificial Sequence: Synthetic coding sequence
atggacagcgtgcggagcggccccttcggccagatcttccggcccgataactttgtgtttggtcagtcaggagccggtaataattgggctaaaggccattatactgagggcgccgaattagttgacagtgtgctggatgtagtcagaaaagaggcggagagctgcgattgtctgcaaggattccaactcacccattctctgggaggcggtacaggaagcgggatggggactctgctcattagtaagattcgcgaagaatatccagataggattatgaacacattttccgtggtcccttctcctaaagtgtcagataccgtagtcgaaccctataacgctacgttatccgtccaccagcttgtagaaaataccgatgagacttactgcatcgacaacgaagccctgtatgacatttgctttcgaactctgaaactgacaaccccgacgtatggcgatctcaatcacttggtctcggctactatgtccggagtgactacctgcttaagattccccggccagcttaacgctgatttacggaagttggcagtaaacatggtcccatttccaaggctgcatttcttcatgccgggcttcgccccactgaccagcaggggttctcagcagtacagggcactgactgtgcctgaattgacacaacaggttttcgacgcaaagaacatgatggccgcgtgcgacccaagacatggccgctacctgaccgtcgctgctgtgtttaggggtagaatgagcatgaaggaagtggatgaacagatgctgaacgtgcaaaacaaaaatagttcttacttcgtcgaatggattccgaataatgtgaaaaccgcagtgtgtgacattccaccacgcggactaaagatggcagtaacctttattggcaatagcaccgctattcaagagttattcaagagaatcagcgaacaattcactgcgatgttccgtaggaaagcctttctacattggtacactggggagggcatggacgaaatggaattcactgaggctgagagtaacatgaacgacctcgtgtctgagtatcagcaatatcaggatgcaaccgctgaggaagaggaagactttggtgaggaggccgaggaggaggcatag

SEQ ID NO: 210134 - DNA, 1335 bp, Artificial Sequence
  Description of Artificial Sequence: Synthetic coding sequence
atgcgggagatcgtgcacatccaggccggccagtgcggcaaccagattggagccaaattctgggaggtgatttcagatgaacacggcattgatccaacagggacatatcatggggattccgaccttcaactggatcgcatttccgtctattataatgaagctaccggcggcaaatatgttcctagggccatcctggtcgacctggaacctggaaccatggactccgtcagaagcggccccttcggacagattttccggccggataattttgtgtttggccaatcaggcgccggaaataactgggcaaaaggtcattatacagagggggcggaactggtggattcagtcctggacgtggtccgtaaggaagctgaatcctgtgactgtctccaggggtttcaactcacccactcactcggaggtggcacagggtcagggatgggtacacttctgatctctaagatccgtgaagagtaccctgatcgaattatgaataccttttccgttgtcccatcccccaaggtgtccgacacagtcgttgagccatacaatgctaccctgtccgtacatcaactggtggagaataccgatgagacatattgtatcgataatgaagctctctatgatatctgttttcgtacgttgaaacttactaccccgacctacggtgacctgaaccacctagtctcggctacaatgtcaggagttacaacatgtttgaggtttccgggccaactcaacgctgacttgagaaaactcgctgtgaatatggtgccatttcccagactccacttcttcatgcctggattcgcaccattaacttctcgcggatcccaacagtatcgggcactcaccgtgcccgaacttactcagcaggtcttcgatgcgaaaaacatgatggccgcgtgcgatcctaggcatgggcggtatctgactgtggcagctgtcttccgcggccgcatgagcatgaaagaggtggacgagcagatgctaaacgtgcagaacaaaaactcgagctatttcgtggaatggatccctaataacgtgaagaccgcggtgtgtgacattcccccacgaggtctgaagatggccgttacatttatcggtaactctaccgccatccaagagctcttcaagaggatctcggaacagttcaccgcgatgttcaggcgtaaagccttcctgcattggtataccggcgagggcatggacgaaatggagtttaccgaagccgaatcaaacatgaatgaccttgtatctgagtaccagcagtaccaagatgctaccgccgaggaggaagaagattttggggaggaggctgaggaggaagcctag

SEQ ID NO: 210135 - DNA, 1335 bp, Artificial Sequence
  Description of Artificial Sequence: Synthetic coding sequence
atgcgggagatcgtgcacatccaggccggccagtgcggcaaccagattggcgcaaagttctgggaggtgatctcagacgaacacggtatagacccgactgggacttatcacggagatagcgatctgcagctcgatagaattagcgtgtactataacgaggccacgggagggaaatacgtgccccgcgccatcctggttgacttagagcccggcacgatggattctgttcgctcaggaccatttggtcaaatcttcaggcctgacaattttgtgtttggtcagtcaggcgcaggcaacaactgggcgaagggtcactacactgagggtgcagaacttgtggatagcgtcctggatgtcgtgagaaaggaggcagaaagctgtgactgcctgcagggcttccagctgacacacagcttaggcggtgggaccggatccggtatgggcaccctcttaatatctaagattcgcgaggaatatcccgatagaattatgaacacgttcagtgtcgtgccctcacctaaggtttccgatactgtggttgagccttataatgctacgctgagcgtccatcagctagttgaaaacacagatgagacatattgtatcgataacgaggcgctgtacgatatttgtttccgcaccctgaagctcactacccccacatatggagacctgaaccacttggtttcagccactatgagcggtgtgacaacctgcctgcggttccctggacagctgaatgcggacttgcggaagctggcggtcaacatggtgccctttccacggctgcactttttcatgcctgggttcgctcccttaacttcgagagggagccagcagtacagagctctgaccgttcctgaattgacgcaacaggtttttgacgctaagaacatgatggctgcctgcgatccaaggcatggcagatacttaactgtggctgcagtcttccggggtcggatgtctatgaaagaggtggatgaacagatgctgaatgtccagaacaagaatagcagctactttgtggaatggatcccaaataacgtaaaaactgcagtgtgcgacattcctcccaggggactgaagatggcagttacgtttatcgggaatagcacagcgatccaagagctttttaagaggatttcagagcagtttactgcaatgtttcgtaggaaggcctttctgcactggtacacaggcgaaggaatggatgaaatggagttcactgaggctgagagtaacatgaacgatcttgtgagtgagtaccagcagtatcaagatgcaactgccgaggaagaggaggatttcggggaggaggccgaagaggaggcgtag

SEQ ID NO: 210136 - DNA, 1335 bp, Artificial Sequence
  Description of Artificial Sequence: Synthetic coding sequence
atgcgggagatcgtgcacatccaggccggccagtgcggcaaccagatcggcgcgaagttttgggaggtgatctcggacgagcacggaattgaccctacaggaacctaccacggcgactcagatttgcagctcgatcgaatttctgtctactacaacgaagccaccgggggcaagtacgtaccaagggccatacttgtcgacctggagcccggaacgatggatagcgtccgctccggcccatttggacaaatatttcggcctgacaattttgtctttgggcagtctggagcaggcaataactgggctaaaggccattacaccgagggggcagaattggttgatagcgttctggacgtggttcggaaggaagccgagagctgcgactgtctgcagggatttcagctgacccactcattggggggcggcaccggatctggcatgggaacactgttaattagtaagattcgcgaagaataccccgaccggatcatgaataccttttcagtggttccttcccccaaagtgtcggacaccgtcgttgagccttacaacgctacactgtccgtacatcagctcgtggaaaacacagacgaaacttactgtatcgacaatgaggctctctacgatatctgcttcaggacgctgaagcttactacccccacatacggagacttgaatcacctggtcagtgcaacaatgtccggagtcacaacctgcctccggttcccgggccaactgaatgccgatctgcgcaagctggctgtaaatatggtccctttcccacggttgcatttcttcatgcccggcttcgcaccgctaacatctcgggggagccaacaatatcgtgcactcacggtacctgagctgactcagcaggtttttgatgcaaagaatatgatggctgcctgtgacccacgccacgggcgctatctgacagttgcagctgtgtttagaggccgcatgagcatgaaggaggtggacgagcaaatgttaaacgtgcagaacaagaactcatcctactttgttgaatggattccaaacaacgtcaagacagcagtctgcgatatccctccaaggggcctgaagatggccgtcacgttcatagggaatagtaccgctattcaggagttattcaagaggatatccgaacaattcacagctatgtttaggagaaaggcctttctccactggtacactggggaagggatggatgagatggaatttacggaagccgaaagcaatatgaacgacctggtcagcgagtatcagcaataccaggatgccactgctgaggaggaggaagattttggcgaagaggccgaggaggaagcgtag

SEQ ID NO: 210137 - DNA, 1062 bp, Artificial Sequence
  Description of Artificial Sequence: Synthetic coding sequence
atgcgggagatcgtgcacatccaggccggccagtgcggcaaccagatcggggccaagttctgggaggttattagcgatgagcacggaatcgaccctactgggacttatcacggggacagcgacctgcagctgacccacagcctcggcggtggcaccggttcaggcatggggacactcctgatcagtaagatccgtgaggaataccccgatagaattatgaatacattttcagttgtaccaagtcctaaggtctcagacacggtggtagaaccatataacgccactcttagtgtacatcaactcgttgaaaatacagacgaaacgtattgcatcgacaatgaggcactctacgacatttgttttaggacacttaaactcactacacccacttacggagatctcaatcatttggtttcagcaaccatgagcggagtgacgacatgcctgaggtttccgggacagttaaatgccgatcttcggaagttagccgtgaacatggtacctttccctcgattacatttcttcatgcctgggtttgctccccttacatctcgtgggagtcagcagtacagggccctgaccgtgcctgaattgactcagcaggtcttcgacgcaaagaacatgatggctgcctgcgaccctcggcatggccggtacctaaccgtcgccgccgtttttagaggtcgcatgtccatgaaggaggtggatgaacaaatgctcaacgtgcaaaacaagaatagttcctacttcgttgaatggataccaaacaatgtgaagacagccgtctgcgatattcccccgagggggttgaaaatggcggttacctttattggcaatagcacagcaatacaggagctttttaagcggatctctgagcagtttactgccatgttccggagaaaagctttccttcattggtacacgggggagggcatggatgaaatggagtttaccgaagcagaatccaacatgaacgacctcgtttcagagtatcagcagtaccaggatgccacagcagaggaagaggaggatttcggagaggaggctgaagaagaagcttag

SEQ ID NO: 210138 - DNA, 1281 bp, Artificial Sequence
  Description of Artificial Sequence: Synthetic coding sequence
atgttctgggaggtgatcagcgacgagcacggcatcgaccccaccgggacctaccatggcgattctgacctgcagctagatcggatctccgtgtactacaacgaagccaccggcggaaaatatgtacccagggccatactggttgatctggagcccgggaccatggacagcgtcaggagcggacctttcggtcagatcttcagaccagacaattttgtttttggtcagagcggggctggcaataattgggctaagggccactatactgagggtgcggagttggtagattctgtgctggatgtggtccgtaaggaggcagagtcctgtgactgccttcaaggatttcagctgactcattcccttgggggggggacaggctccggcatgggcacactgctgatcagcaagatcagagaggaatatccggacaggattatgaataccttttctgtggtcccctcccccaaagtttcagacaccgtcgtggaaccctataatgcgaccttatctgtacaccagctcgtggaaaacactgatgagacatattgtatcgataatgaggccctgtatgacatctgctttcggacactcaaactgaccacccccacatacggggacctgaaccatcttgtgagcgccaccatgtctggcgtcacgacatgccttagattccccggacagctgaacgccgatttacgtaagctcgctgtgaatatggtgccattccctcggttacactttttcatgccaggcttcgcaccactgacctcacgagggtcacagcagtaccgggccttaactgttcccgaacttacacaacaggtattcgatgcgaagaacatgatggcagcctgcgacccacggcacggacgttatttgaccgtggcagctgtctttcggggtcggatgtccatgaaggaggtagatgaacaaatgcttaacgttcagaataagaactcttcctactttgtggagtggattccgaacaacgtgaagactgcagtatgcgacattcctcctcggggtcttaaaatggccgtgacctttataggaaactctaccgccatccaggaactgtttaaaaggatcagtgaacaatttactgcgatgtttagaaggaaggctttcctgcattggtacaccggggagggcatggatgaaatggaattcaccgaggctgaaagcaatatgaatgacctggtgagcgagtaccaacagtatcaggacgccactgctgaggaggaagaggatttcggcgaagaagccgaagaggaagcatag

SEQ ID NO: 210139 - DNA, 1119 bp, Artificial Sequence
  Description of Artificial Sequence: Synthetic coding sequence
atggacagcgtgcggagcggccccttcggccagatcttccggcccgacaacttcgtgttcggtcagtcaggagcaggtaataactgggcaaagggtcattatacagaaggagccgagctagtggatagtgtgctcgacgtagtaaggaaagaggctgagtcctgcgattgcctgcagggcttccagctcactcatagtctgggtggagggaccgggtcgggaatgggtacgctactgatttccaagatccgtgaggagtatcccgatcgaataatgaacacattcagcgttgttccatcccctaaggtttcggataccgtcgtggaaccgtataatgcgacgctgtcggtgcaccagctagtcgaaaacacagatgaaacatactgtatcgacaacgaggctttatacgacatatgcttcagaacactgaaattgacaaccccaacctatggggacctcaaccatctggtgtctgcaactatgtctggtgtgactacctgcctgagatttccaggacagctgaacgcagatcttaggaagctggcagtgaacatggtccctttcccacggctgcatttctttatgcctggattcgcacctttaacgagtcgaggctcacaacagtatagggccctgaccgtgccagaattgacccaacaggtgttcgacgcaaaaaatatgatggcagcctgcgaccccagacacggccgctatctgaccgtggcagccgtttttaggggccgaatgtcaatgaaagaggtggatgagcagatgctgaatgtccagaataagaactcctcatattttgtcgagtggatcccaaacaacgtgaaaacagcagtctgtgatatccctccaagaggcctgaaaatggccgtcacatttatcgggaacagtaccgctattcaggagctgtttaagcggatctcagaacagtttaccgcgatgtttcggagaaaggcatttctgcattggtacacgggcgaggggatggatgagatggagttcacggaggctgaatcaaacatgaacgacctcgtgtcagagtatcagcagtaccaggacgctaccgccgaggaagaagaagacttcggagaggaggctgaagaggaggcatag

SEQ ID NO: 210140 - DNA, 1281 bp, Artificial Sequence
  Description of Artificial Sequence: Synthetic coding sequence
atgttctgggaggtgatcagcgacgagcacggcatcgaccccaccggcacttatcatggggactctgatctccagttggacaggattagcgtgtattacaacgaggccaccggcggcaagtacgtgccacgggctatcctcgtcgatctggaacccggaactatggatagcgtccggtcgggacctttcggccagatatttagaccggacaatttcgtgttcgggcagtctggagccggaaacaactgggcaaaaggccattacaccgagggagcagagttggtcgactctgtgttagacgtcgtcagaaaggaggccgagtcttgtgattgtcttcagggtttccagctaactcatagcctcggtggaggcactggtagcggcatgggcaccctgctcatctctaaaattcgtgaagagtatcctgacagaatcatgaataccttttcagttgtgccaagcccaaaggtatctgatactgtggtggaaccttataacgctacactatccgtacatcagctggtggagaacacagatgagacgtattgcatcgataacgaggctctgtacgacatctgtttcaggactctaaaactgactacccccacctacggggacctgaaccacttagtctctgccactatgtccggtgttactacatgtctgcgatttcctgggcagctgaacgctgacctgcgcaagctcgcagtgaacatggtaccatttcctagattgcactttttcatgcccggcttcgcacctctgacctccagaggctcacagcagtaccgtgcactcacggttcccgagctcacccagcaggtgtttgatgctaagaatatgatggcggcgtgtgacccacgacacgggagatatctcaccgtcgccgctgtattccgcgggaggatgtctatgaaagaagtggacgagcagatgctgaatgttcagaataaaaactcctcatacttcgtggagtggatccccaacaatgttaagaccgcagtctgcgacattccaccacgaggcctcaaaatggcagttaccttcataggaaattccaccgcaatccaggagctgttcaaacggatcagcgagcagtttaccgccatgtttcgtaggaaggcattccttcattggtatactggagagggcatggacgagatggagtttaccgaggccgagtccaatatgaacgacctggtctctgagtaccagcagtaccaggacgcaacagccgaggaggaagaagacttcggtgaagaagcagaggaggaggcatag

SEQ ID NO: 210141 - DNA, 1281 bp, Artificial Sequence
  Description of Artificial Sequence: Synthetic coding sequence
atgttctgggaggtgatcagcgacgagcacggcatcgaccccaccggaacctatcatggggactccgatctgcagcttgatagaatttcagtatactataacgaggcgaccgggggcaaatacgtacctcgtgcaattttggtggacttagaaccgggcacaatggactccgtcaggtctggccccttcggccaaattttccgccccgacaactttgtcttcggccagtcaggagccggaaacaactgggctaaaggccactatacagagggggcggaacttgttgactcagtcctcgacgtagtgagaaaagaagccgaatcttgtgattgcctccaaggtttccaactgactcactcactcggcggcggcaccgggtctggaatgggaacgctgctcatttctaaaatccgtgaggagtaccccgaccggattatgaacaccttcagtgtcgtgccgtctcctaaagtgagcgacaccgtggtggagccctataacgcaacgctctccgtgcatcagctggtggagaacactgacgagacctactgcatcgacaacgaggcactctatgatatttgcttccggacgctgaaactgacgacgcctacctacggggacctcaaccacctggtgtccgcaactatgagtggggtgactacttgtctgcggtttccaggtcaacttaacgccgatctgcggaaattggcggtcaacatggtgcccttcccgcggttgcatttttttatgcctggatttgcacctctgacgtcgagagggtctcagcaatacagggcactcacggtcccggagctgacgcaacaggtgtttgatgctaagaatatgatggccgcctgcgacccccggcatggaagatatttgaccgtcgctgcagtattcaggggtagaatgtcaatgaaagaagttgacgagcagatgttgaacgtccaaaataaaaactctagctactttgttgagtggatccctaacaacgtcaagacagccgtgtgtgacattcctccgcgggggcttaagatggccgtcaccttcattggaaattcaaccgcaattcaggagctgtttaagcgcatttcagagcaatttacagcaatgtttagacgaaaagcgttccttcactggtatacaggagagggcatggacgaaatggagtttacagaggctgagtccaacatgaacgatctggtgtccgagtatcagcagtatcaggatgccaccgctgaggaggaggaagacttcggagaagaggcagaggaggaagcatag

SEQ ID NO: 210142 - DNA, 1119 bp, Artificial Sequence
  Description of Artificial Sequence: Synthetic coding sequence
atggacagcgtgcggagcggccccttcggccagatcttccggcccgacaacttcgtgtttggccaatcaggcgccggcaataattgggcgaagggacactacacagagggcgccgagttggtggattctgtgctggatgttgtgaggaaggaagccgaatcttgtgactgcctgcagggattccaattgacacacagcctggggggtgggacagggagtggtatgggcacccttctgatcagcaagattagagaggagtatcccgacagaatcatgaatacattttcagtggttccttcacccaaggtaagcgacaccgtggttgagccttataacgcaaccttgagcgtgcaccagctggtggagaatacggatgaaacatattgtatcgataacgaggcactctacgacatctgctttcgaaccttgaaactcaccaccccaacatacggcgatctgaatcacttggtcagcgccacgatgtccggcgtgacaacatgcctccgttttccaggccagcttaacgcagatctgaggaagcttgctgtaaatatggtgcctttcccaaggttacacttttttatgccgggcttcgcaccactcacgagccgggggtctcagcagtaccgggccctgacggtgcccgaactaacacagcaagttttcgacgctaagaatatgatggctgcctgtgatccacgtcacggacgatatctgacagtggccgctgtctttagggggaggatgtccatgaaagaagtggacgagcaaatgctgaacgtccagaataagaactcctcctatttcgtagagtggatcccaaacaacgtcaagaccgccgtatgtgatatacccccacggggcctgaaaatggcagtgacctttatcgggaacagcaccgccattcaggagctatttaaaagaataagcgaacagtttactgcgatgtttcgtaggaaagctttcctccattggtacaccggggaaggaatggatgaaatggagttcacagaagcagaatctaacatgaatgatttagtatcagaataccagcaatatcaggacgccacagcagaagaagaggaggactttggggaggaagctgaggaggaggcttag

SEQ ID NO: 210143 - DNA, 1335 bp, Artificial Sequence
  Description of Artificial Sequence: Synthetic coding sequence
atgcgggagatcgtgcacatccaggccggccagtgcggcaaccagattggggccaagttttgggaggtaatcagcgatgaacatgggattgatccgaccggcacctaccacggtgatagtgacctccaacttgacaggatctcagtttattataatgaggccaccggtggtaagtatgtgccaagagctatcctcgttgacctagagcccggtacaatggactccgtcaggtcagggccttttggtcagatctttagaccagacaacttcgttttcggccagtctggggcaggcaataactgggccaagggccactatactgaaggagccgagttggtggacagtgtgctggacgtcgttcgcaaggaagctgagtcgtgtgactgtcttcaggggttccagctgactcactccctcgggggcggcaccggatcaggcatggggaccctcctcatctcaaagattagggaagaatatcccgaccgaattatgaacacctttagcgtggtgccctcccccaaagttagcgacaccgtggttgagccttacaatgccacactgtctgtgcaccagctcgtggagaacacagatgagacctactgtattgacaatgaagccctctacgatatctgtttcagaacactgaaactgaccacccctacttatggagaccttaaccacctcgtttccgccaccatgtcaggtgttacaacatgtttgaggttcccagggcagctcaacgcggaccttaggaaactggcagttaatatggtgccgtttcccaggctgcactttttcatgcccgggttcgctcccctgaccagtcggggtagccagcaataccgggcattaactgtgcctgaattgacgcagcaagtcttcgacgccaagaatatgatggctgcctgcgatcccaggcacgggcggtaccttacggtggcggccgtatttaggggtagaatgtctatgaaggaagtggacgagcagatgttgaatgtccaaaataaaaacagctcctacttcgtcgaatggattcctaataacgtgaaaactgcagtctgcgacatcccccctaggggcctcaaaatggccgtgacattcatcggtaattctacagcaattcaggaattgtttaaaaggatatctgaacagttcaccgcaatgttccggcggaaagcattcctgcactggtataccggggagggaatggacgagatggagtttacagaggcagagagtaacatgaatgatctggtaagtgaataccagcagtaccaggacgctaccgcagaggaagaagaagactttggcgaagaagcagaagaggaggcctag

SEQ ID NO: 210144 - DNA, 732 bp, Artificial Sequence
  Description of Artificial Sequence: Synthetic coding sequence
atgcgggagatcgtgcacatccaggccggccagtgcggcaaccagattggcgctaagttctgggaagtgatctcagatgagcatgggattgaccccactgggacgtaccacggtgacagcgacttacagctggatcgcatatctgtgtactacaacgaagctacaggaggcaagtacgtgcctagggcaatcttggtggatctggagccaggcacaatggactctgtcagaagcggtcctttcggtcagatctttagacctgataattttgtgttcggccagagcggggcgggcaacaattgggctaaaggacactacaccgagggtgctgaacttgttgattccgttctcgatgtggttagaaaggaagaggttgatgagcagatgctgaacgtgcagaataaaaatagcagctacttcgtggaatggatacctaacaacgtgaaaaccgctgtctgcgatatccctcctcgggggttgaaaatggctgtgacatttatagggaactctacagccattcaggagctctttaagaggatctcggaacaattcacggctatgttccgacggaaggcatttctccattggtacactggagagggtatggatgaaatggaattcaccgaggctgagtcaaacatgaatgacctggtcagcgagtatcagcaataccaagacgcaaccgcagaagaggaagaagattttggagaagaagccgaggaggaggcgtag

SEQ ID NO: 210145 - DNA, 1119 bp, Artificial Sequence
  Description of Artificial Sequence: Synthetic coding sequence
atggacagcgtgcggagcggccccttcggccagatcttccggcccgataattttgtttttgggcagagcggagcagggaataattgggctaaaggacattataccgaaggcgcagaacttgtggactccgtgcttgacgtggtgcgaaaggaagccgagtcttgcgactgtttacagggattccagcttacccactcattggggggaggaactggcagcggaatgggaactctattgattagtaagattagggaggagtaccctgacaggataatgaatacgttttccgtggtgcccagccctaaagtgtccgacactgttgtggagccctacaatgctacattatccgtgcaccagttagtagagaacacagacgagacttattgtatagacaatgaggcgctatatgacatttgttttaggacacttaagctgacaaccccgacctacggtgacctgaatcatttggtgtctgcaacgatgtcaggagtaacaacgtgtttgagattccctggccagctcaacgccgaccttcgcaagctagccgtgaatatggtgccttttcctcggcttcactttttcatgcctggattcgcccctctgacctccaggggtagccagcagtatcgagcactgacagtgcccgagctgactcagcaggtcttcgacgcaaagaatatgatggctgcatgtgaccccagacacggccggtacctgacagtagctgcggtgttccgcggcagaatgtcaatgaaagaggttgacgaacagatgctgaacgtacagaacaaaaactcttcttactttgttgagtggataccaaacaatgttaagacggcggtgtgcgacatcccacccaggggcctcaaaatggcagttacctttattggcaactctacagccatccaggagctatttaaaaggatcagcgagcagtttaccgctatgttccgccggaaggccttccttcattggtacactggagaggggatggacgaaatggagttcacggaggctgagtctaacatgaatgatctggtgtctgagtaccagcaatatcaggatgccaccgcagaggaagaggaggacttcggggaggaggccgaggaggaagcgtag

SEQ ID NO: 210146 - DNA, 1119 bp, Artificial Sequence
  Description of Artificial Sequence: Synthetic coding sequence
atggacagcgtgcggagcggccccttcggccagatcttccggcccgataactttgtgttcgggcagtctggggccggtaacaactgggcaaaaggtcactacaccgagggagccgaactcgttgattccgttctcgacgtggtgaggaaagaagccgaaagctgcgactgcctccaggggttccagcttacccattccttgggaggaggaaccggaagcgggatgggcaccctgttaataagcaaaattcgggaagagtacccagacagaatcatgaacaccttcagcgtcgtcccctctcctaaagtcagtgatactgttgtggagccatacaacgctactttgtccgtgcatcagctagttgaaaatacagatgaaacatattgcatcgacaatgaagcgttatatgatatatgcttcaggacgctgaagcttaccaccccaacctatggtgacttgaaccacttagtgtccgctaccatgagcggggtcacaacgtgcctgagatttcctggccagctgaatgccgacctgaggaagctggccgtcaacatggtccctttccccagactgcattttttcatgcccggcttcgctcctctgaccagccgcgggtcccagcaatatagagccctgacagttccggagctgacgcagcaggtatttgatgccaagaatatgatggccgcttgcgatccgagacatggtagatacctcaccgtggccgctgtttttaggggtcgcatgagcatgaaggaagtggatgagcagatgctgaatgtgcagaacaaaaactcctcctattttgtagagtggatcccgaacaatgtgaaaacagctgtttgcgacatccccccccggggtctgaagatggccgtaacgtttatcggaaactccaccgctatccaggaactcttcaaacgcatttctgaacagttcacggctatgtttcgacggaaagcctttctccattggtacacgggcgagggtatggacgagatggaatttactgaagcagagtctaatatgaacgatttggtgagcgaatatcagcagtaccaggatgctacagcagaggaggaggaagattttggcgaagaggctgaggaggaagcttag

SEQ ID NO: 210147 - DNA, 1335 bp, Artificial Sequence
  Description of Artificial Sequence: Synthetic coding sequence
atgcgggagatcgtgcacatccaggccggccagtgcggcaaccagattggagccaagttctgggaagtgatcagcgacgagcacgggatcgaccccacgggcacctatcatggggattcagatctgcagctcgacaggatctccgtttattacaacgaagccacaggaggtaagtatgttccccgagctatacttgtggacctggaacccgggacaatggattccgtccgttcgggtccgttcggccagatctttagaccagacaacttcgtatttggccagtccggcgccggcaataactgggccaaggggcactacacagaaggcgcggaactggtggactcagtgctggatgtggtgcgcaaggaggcggagtcttgcgattgccttcagggcttccaactcacccactctcttggggggggtacaggatcgggaatgggcacactgttgattagtaaaatccgggaagagtacccggaccgaatcatgaacaccttttcagtagttccttccccaaaggtctccgacaccgtggtggaaccctataacgccaccctctctgtgcaccagcttgtcgaaaataccgacgagacctactgtattgacaatgaagctctctacgatatatgcttccgaaccctcaaactcactacccctacctacggtgacttaaatcacctcgtatccgcaaccatgtcgggcgttaccacctgtttacggttcccaggtcagctaaacgctgatttacggaagctggcagtaaatatggtgcctttccccaggttacacttctttatgcccgggttcgcccccctgacatcccgcggatctcaacaatatagggccctgacggtgcctgagctgacccagcaggtcttcgatgcaaaaaatatgatggctgcttgtgatcctaggcacgggcgatatctcacagttgcggctgtatttcgtggacggatgagcatgaaagaagtggacgaacagatgttgaatgtgcagaataaaaacagctcgtactttgttgagtggattcccaataacgttaagacagccgtctgtgatataccaccgcgcggtctaaaaatggccgttacatttatcgggaatagcaccgccatccaggagttgttcaaaagaatatctgagcagtttacagccatgttcagacggaaagcattcttgcattggtacaccggtgagggtatggacgagatggagtttaccgaggctgaatctaatatgaacgacttggtttcagagtaccaacagtatcaggatgcaacagctgaggaagaggaagactttggcgaggaggcggaagaggaagcatag

SEQ ID NO: 210148 - DNA, 1119 bp, Artificial Sequence
  Description of Artificial Sequence: Synthetic coding sequence
atggacagcgtgcggagcggccccttcggccagatcttccggcccgacaacttcgtctttggccaatctggtgccggaaataactgggctaagggtcactatactgagggagcggaattagtcgactcagtgctggatgtggtgcggaaggaagccgagtcttgtgattgcctccagggatttcagctaacccatagtctcggaggaggcactggatcagggatgggaaccctcctgatcagcaaaattcgcgaggagtatcccgaccggatcatgaacactttcagcgtcgtgccaagccccaaggtgtccgataccgttgttgaaccatataacgccaccttaagcgtacatcagctggtcgagaataccgatgaaacctactgtatcgataacgaagctctgtacgatatttgtttccggacgttgaagctaaccaccccgacatatggcgatctcaaccacctagtgagtgcgaccatgtcaggcgtcaccacctgcttacgttttcccggacagctgaacgcggacctgagaaaacttgcagtgaacatggttcccttcccaagattgcacttcttcatgcctggtttcgcccccttgacttcacgggggtcccagcaataccgggcattgaccgtgcctgagctaactcagcaggtgttcgacgccaaaaatatgatggctgcctgcgacccacgtcacggacgctatctgaccgtggcagcggtgtttagaggaagaatgtcgatgaaggaggttgacgagcagatgttaaacgtgcagaacaagaactcgtcatacttcgtggagtggatccccaacaacgtgaagacagctgtttgcgatataccacctcgggggttaaagatggccgtcaccttcatcggaaatagcactgccattcaggagttattcaagagaatcagcgagcagttcaccgccatgttccgccgcaaagccttcctgcactggtataccggcgagggcatggatgaaatggagttcacggaagcagagtcgaacatgaacgatctcgtgagtgaatatcaacagtaccaggatgctactgctgaagaagaggaagactttggcgaggaggctgaggaggaggcctag

SEQ ID NO: 210149 - DNA, 1119 bp, Artificial Sequence
  Description of Artificial Sequence: Synthetic coding sequence
atggacagcgtgcggagcggccccttcggccagatcttccggcccgacaatttcgtgtttggccagtcgggcgctgggaataattgggcaaaagggcactatacagagggagctgaacttgtcgattccgtgctcgacgtcgtgagaaaagaggccgagagctgtgattgcctgcagggtttccagcttacccacagtctgggaggagggaccggatctggtatgggtactctgttaatttctaaaatcagggaggagtatcctgacaggattatgaataccttttctgttgttccgtccccaaaggtaagcgataccgtggtagagccttacaatgcaactctttcggtccaccaactcgttgagaatacagacgagacatactgcatcgataatgaggctctatatgacatttgctttcggactttgaagctgactacgcctacatatggcgacttgaatcaccttgtgtctgctacaatgtctggggtgacaacctgcctgagatttcctggacagttgaatgccgaccttaggaaactggctgttaacatggtgccattccctcgcttgcatttcttcatgcctggattcgcccctctgacttcccgagggtctcaacagtacagggctttgacagtgccagaattgacacagcaggtgttcgacgccaaaaacatgatggccgcatgtgacccccggcatggcaggtatctgacagtggccgcagtctttaggggtagaatgtctatgaaggaagtggatgagcagatgctgaacgtccagaacaaaaactcctcctacttcgtggagtggattccaaataacgtgaaaacagccgtgtgcgatatccctccccgcggcctgaagatggcagtgactttcatcgggaacagtaccgccatccaggagctctttaagagaatttcagagcaatttacagccatgtttcgtcgaaaagccttcctgcactggtataccggggaaggcatggatgaaatggagtttactgaggctgagtccaacatgaacgatctggtctccgaatatcaacagtaccaggatgccaccgcggaagaggaggaagacttcggcgaagaggcagaagaagaagcatag

SEQ ID NO: 210150 - DNA, 1119 bp, Artificial Sequence
  Description of Artificial Sequence: Synthetic coding sequence
atggacagcgtgcggagcggccccttcggccagatcttccggcccgacaacttcgtctttggtcaatccggcgcaggaaataactgggccaaaggacactataccgaaggagcagagctcgtagacagcgtgctggacgtcgttcggaaggaagccgagtcttgtgattgcctgcagggctttcagctcacccatagccttggcggcggtacagggagcggcatgggtaccctgctaatctccaaaatacgggaggagtatcccgacaggatcatgaatacctttagtgtcgtgccaagccccaaggtatctgacacagtggtagaaccctacaatgcaactctttccgtgcaccagctggtggaaaacacggacgagacctattgtatcgacaacgaagcactgtacgatatctgttttaggactctcaagctcacaacgccaacttatggcgacctgaaccacctggtgagcgccactatgtccggcgtgacgacctgtctcagatttccgggccagctcaacgcggacttgagaaagctcgccgtaaatatggttccatttcctaggctgcacttcttcatgcctgggttcgcgccactcacttcacgcggctctcagcaataccgggcacttacagtcccagagctgactcagcaagtctttgatgcgaaaaacatgatggcggcctgtgatccccggcacgggcgatatctcaccgtggccgcggtctttagaggccgaatgagtatgaaagaggtcgacgagcagatgcttaacgtgcagaacaagaactcctcttatttcgtagagtggatccccaataatgtgaagactgccgtgtgtgacatcccaccgcgaggattaaagatggctgtgacatttatcgggaattctacagctatacaggaactgtttaaacgcatttccgagcaattcaccgccatgtttcgacggaaagctttccttcattggtatactggagaaggcatggacgagatggagtttacggaagctgagtcaaatatgaacgatctcgttagtgaatatcaacagtatcaggatgcaaccgccgaggaggaggaggattttggggaggaggctgaagaggaggcctag

SEQ ID NO: 210151 - DNA, 1119 bp, Artificial Sequence
  Description of Artificial Sequence: Synthetic coding sequence
atggacagcgtgcggagcggccccttcggccagatcttccggcccgacaacttcgtctttgggcagtctggcgcagggaacaattgggcaaagggtcattacacagagggggctgaactggttgactcggtactagacgtagtgcggaaagaggcagagagctgcgactgcctgcagggatttcagctcacacacagccttggggggggaactggctccggcatggggacactcctgataagcaagatccgtgaagaatacccagatagaatcatgaacaccttcagcgtggtcccgagcccaaaggtgagcgacaccgtggtggaaccatataatgcgaccctgagcgtgcatcaactcgtagaaaacaccgacgaaacatactgtattgacaacgaagcattgtatgatatctgttttaggactctcaagctcacaacccctacatatggggatctcaaccatctggtatcagccactatgtctggggtgacgacttgcctccggttccccggacagttgaacgccgacctgcggaaactggcagtcaacatggtgccttttccacggcttcacttttttatgcccgggtttgccccgctcacttctcgcggtagccagcaatatagggccctgaccgtgcctgagcttactcagcaagtcttcgacgccaagaacatgatggctgcatgcgatccccgacatggtcgatacctgactgttgccgcagtgtttaggggtcggatgtccatgaaggaggtggatgagcagatgttgaacgtccagaacaagaatagcagctactttgtggagtggattcccaataacgtcaagactgctgtttgcgacatccctccccgtgggctgaaaatggccgttaccttcatcggaaactccacagcaattcaagagctttttaaaaggataagcgagcaattcactgcgatgttccgccgcaaagcctttctccattggtacacaggcgaggggatggatgaaatggagttcacagaagcagaaagcaatatgaatgacttggtatcggagtatcaacagtatcaagacgccacagctgaagaggaggaagattttggtgaggaggcagaagaggaagcatag

SEQ ID NO: 210152 - DNA, 1119 bp, Artificial Sequence
  Description of Artificial Sequence: Synthetic coding sequence
atggacagcgtgcggagcggccccttcggccagatcttccggcccgataacttcgtgttcggacagtcaggcgcagggaacaattgggccaagggtcactataccgaaggggccgaattggtggacagtgtcctggatgtggtccgcaaggaggcagagtcttgcgattgccttcaaggtttccagctgacacactcactaggaggaggcacaggaagcggcatggggaccctacttatatccaagatccgggaggagtatcctgaccggattatgaatacattcagcgtggtcccatcacctaaggtcagcgatacagtagtcgaaccctataacgccacactcagtgtccatcagctcgtcgaaaacacggatgagacctactgtattgataacgaggcactctatgatatatgcttccggaccctgaaactgacgacccccacctatggcgatctcaaccacctggtaagtgccacaatgtctggagtgactacatgcctccggtttcccgggcagctgaatgctgatcttcggaagctggctgttaacatggtacctttccccaggctgcacttctttatgcccggctttgcgcccctcacatctcggggatctcagcagtacagggcattgactgttccggagctgacccaacaggtctttgatgccaagaatatgatggctgcctgcgatccaagacacggccgctatctgaccgtcgccgccgtctttagaggtcggatgtccatgaaggaagtagatgagcagatgctaaatgtgcagaataagaactccagctacttcgtcgaatggattcctaacaatgttaaaactgcggtgtgcgatatccctcctagggggttgaagatggcggtcaccttcatcggaaactcaactgctatacaggagcttttcaagcgaattagtgagcagttcactgccatgtttaggaggaaggcatttctgcactggtacacaggtgagggaatggatgaaatggagttcacagaagctgaatccaacatgaacgatttggttagcgagtaccagcagtaccaggatgcaaccgcagaggaggaggaggactttggcgaagaggctgaagaagaggcgtag

SEQ ID NO: 210153 - DNA, 1119 bp, Artificial Sequence
  Description of Artificial Sequence: Synthetic coding sequence
atggacagcgtgcggagcggccccttcggccagatcttccggcccgataactttgttttcgggcagagtggagctggcaacaattgggcaaaaggccactacactgaaggcgccgaactggtggactcagttctggacgtggtccgaaaagaggccgagtcatgtgattgcctacagggttttcagctgacacattctctggggggcggtaccggtagcggcatggggacacttctcatttctaagattagagaggaatatccagataggattatgaataccttctccgtcgtgccgagccccaaggtctcagacaccgttgtcgagccttacaatgcaacgctgtccgtgcatcagctcgttgaaaacacagatgagacctactgcatcgataacgaagcgctgtacgacatctgtttccggacgttgaagctgaccacccctacctacggcgatctcaatcacctggtgagcgccaccatgtctggcgtgactacatgcctaagatttcctggccagcttaacgcagaccttcgtaagcttgccgtcaatatggtgccattcccccgccttcacttcttcatgccggggtttgcccccctgacatccagagggtcacaacagtaccgcgcattgacggtcccagaacttacccagcaggtgttcgacgccaaaaatatgatggctgcttgcgacccccgccatggccggtatctgaccgtcgcagctgtgttccggggacgcatgtctatgaaggaggtggacgagcaaatgctgaatgtacagaacaaaaattcttcgtacttcgtggagtggattccaaacaacgtcaagaccgctgtgtgtgacattccaccgagaggtctgaaaatggctgttacctttatcgggaacagcaccgcaatccaggaactgttcaaaagaatcagcgagcagttcacagcgatgtttagacgtaaagctttcctgcattggtacaccggcgaaggcatggacgaaatggaatttaccgaggcagagtccaatatgaacgaccttgtctccgagtaccagcagtaccaggacgctaccgctgaggaggaagaggactttggggaggaagctgaggaggaagcatag

SEQ ID NO: 210154 - DNA, 624 bp, Artificial Sequence
  Description of Artificial Sequence: Synthetic coding sequence
atgggcaccctgctgatcagcaagatccgggaggagtaccccgacaggatcatgaacacattctcagtcgtgccaagtccgaaggtgagtgacactgtggtcgagccatacaacgcaacattgtctgtgcaccagctcgtcgagaataccgatgaaacgtactgcatcgataatgaggccctctatgatatttgttttcggacccttaaactgaccaccccaacctacggagatctaaatcacctcgtgagcgcaactatgtcaggcgtgactacctgcctacgtttccccgggcagcttaacgcagaccttaggaagctagctgtgaatatggtgcccttcccacgcttgcacttcttcatgcccggctttgctcctttaactagtaggggaagccagcaataccgagctctgaccgtgcccgaattgactcagcaggtgtttgacgcaaagaacatgatggctgcatgtgacccaaggcacggacggtatctgacagtcgccgcggtcttcagaggcaggatgtccatgaaggaagtcgacgagcagatgttgaatgtccagaataagaattcatcctactttgtggagtggcctcagcagtgtcaggactcccgcctctag

SEQ ID NO: 210155 - DNA, 1248 bp, Artificial Sequence
  Description of Artificial Sequence: Synthetic coding sequence
atgcgggagatcgtgcacatccaggccggccagtgcggcaaccagattggggccaaattttgggaagtgatttctgacgagcacgggatcgaccctacagggacctaccacggggacagtgacctgcaactggaccgcatctcagtgtattacaatgaagcgactggcgggaaatatgttcctcgagccatactggtggacctggagcccgggaccatggacagtgtccgcagcgggccatttggccagatcttccgccccgacaacttcgtctttggtcagtcaggggccgggaataactgtctgcagggtttccagctgacgcactctctcgggggaggaaccggatcaggcatgggcaccttacttatcagcaagattagggaggaataccccgataggataatgaacactttttctgtcgtccccagccctaaagtctcggacactgtcgtggagccttataacgctacactgtccgtccaccagctggtggagaacaccgacgagacctactgcattgacaacgaagctttgtatgacatatgtttcaggacactgaaactgacaaccccaacgtacggcgatctgaaccatctggtttccgccactatgagcggcgtgactacttgtttgcgtttcccaggtcagcttaacgccgatctgaggaagctggcggttaatatggtgcctttccctcggctgcattttttcatgcctggcttcgccccgctgactagccggggcagccagcagtatcgggccctgacggtacctgaactgacacagcaggtcttcgatgccaagaacatgatggctgcttgcgacccacggcatggaaggtatttgacagtggcggccgtgttcaggggcagaatgagcatgaaggaagtggatgagcagatgcttaacgtgcagaataagaactcctcttatttcgtggaatggatccccaacaatgtcaagacagccgtctgtgatattcccccgagaggcctcaagatggccgtgaccttcattggaaattccactgctatacaggagctgttcaaaagaatcagcgaacagtttactgcaatgttccgcaggaaagcatttttgcactggtacacaggtgaagggatggacgagatggagtttacagaggccgaaagcaacatgaacgacctggtgtcagaatatcaacagtatcaggacgccacggcggaagaagaagaggacttcggggaggaagccgaagaggagtag

SEQ ID NO: 210156 - DNA, 1062 bp, Artificial Sequence
  Description of Artificial Sequence: Synthetic coding sequence
atgcgggagatcgtgcacatccaggccggccagtgcggcaaccagattggcgcaaaattctgggaggtcataagcgatgagcatggaattgatccaacagggacttaccacggggacagcgatctacagcttacacacagtctcgggggaggaacaggcagtggaatgggtacattgttaatctccaaaattcgcgaggagtaccccgatagaattatgaatactttttccgtggtcccatcaccaaaagtaagcgacaccgtcgttgagccttataacgcaaccctttccgtccatcaactcgtggagaacacagacgagacttactgtattgataacgaggcactatacgacatctgtttcagaacactgaagttaaccactcccacttacggcgacctgaaccatctcgtctcagctactatgtctggtgtgactacctgtctccgattccccggacaactgaacgccgatttgcgtaaattggcagttaacatggtaccgtttcctaggcttcacttttttatgcccggatttgcgccactaacaagccgggggtcgcagcagtatcgagcactcaccgtgcccgagctgacccaacaggtctttgacgctaagaacatgatggcagcatgtgaccccaggcacggacgttacctcactgttgcagctgtgttcaggggcaggatgtctatgaaggaggttgacgagcagatgttgaacgtccagaacaaaaattctagttattttgttgaatggattcccaataatgtgaagaccgcagtgtgtgacatccctccaaggggcctcaagatggccgtgacctttattggcaactctactgctatccaggaactcttcaaaagaatttctgaacaatttaccgccatgttcaggcgaaaagcgtttctacattggtatacgggcgaagggatggatgagatggaattcacggaggccgaatctaacatgaacgatcttgttagcgaataccagcagtaccaagacgccaccgcagaggaggaggaggattttggtgaggaggctgaagaagaggcctag

SEQ ID NO: 210157 - DNA, 1062 bp, Artificial Sequence
  Description of Artificial Sequence: Synthetic coding sequence
atgcgggagatcgtgcacatccaggccggccagtgcggcaaccagatcggggcgaaattctgggaggtgatctcggatgagcatggaatagatcctacgggaacttatcatggtgattccgatctccaattgactcactcgttaggcggggggacaggatccgggatgggcactctcctgatatcaaaaatacgggaggaataccccgaccggataatgaacaccttctccgtcgtccccagccctaaagtttccgacacagtcgtcgagccctataacgccacgctaagcgtgcaccaactcgtggagaacacagacgagacttactgcatcgacaacgaagccctctacgacatttgcttcagaacgttgaagcttactacacctacgtacggcgatctcaatcacctagtcagtgccacaatgagcggcgttactacctgtctgcggttccctggccagctaaacgctgacctgcggaagctggcagtgaacatggtgccttttccccgtctccatttttttatgccgggctttgccccgcttacctcacgggggagccagcagtaccgggccctgacggtgcccgagctcacccaacaagtgttcgacgcaaaaaatatgatggcagcctgtgatccaagacatggcaggtacttaaccgtcgccgcagtgtttcgggggcgcatgtctatgaaagaggtagacgaacagatgctaaacgtgcaaaacaagaactcgtcatattttgttgagtggattccgaacaatgttaaaaccgcggtgtgcgacatcccccctcggggcctcaaaatggctgtcacgttcattgggaactccactgccatccaggagctattcaagcggatttctgaacagttcacagctatgttccggcggaaagctttcctgcattggtatacgggcgaggggatggacgagatggaattcactgaggccgaatccaacatgaatgatttggtcagtgaatatcaacaataccaagacgccaccgctgaggaagaggaggactttggggaggaggccgaggaggaggcctag

SEQ ID NO: 210158 - DNA, 1308 bp, Artificial Sequence
  Description of Artificial Sequence: Synthetic coding sequence
atgcgggagatcgtgcacatccaggccggccagtgcggcaaccagataggagccaagttttgggaggtcatatcagacgaacacggtattgatcctacaggcacctaccacggtgacagcgacctgcaattagaccggatctccgtctattataatgaagccacaggcggcaagtatgtgcctagagccatcttggtggatctggaaccggggaccatggactccgtgaggagtggaccattcggtcaaatctttcgccctgacaacttcgtcttcggtcagtcaggggctgggaacaactgggccaaagggcactatactgaaggcgctgaactagtggacagtgtattggatgtggtgaggaaggaggccgagtcgtgcgattgtttgcagggatttcagctcacacactccctcgggggcggtacaggctcaggaatggggaccctgctcatttcaaaaatccgggaggagtatcccgacagaatcatgaatacttttagcgtcgtcccctctcctaaggtttctgatactgtggtcgagccctataacgccaccctcagcgtacaccaactggtagagaatacagatgaaacctactgtattgacaacgaagccctttacgatatctgtttccgaacactgaagttgactacccccacttacggggaccttaaccacttagtgtctgctacgatgtccggcgtaaccacctgcctaaggtttcccgggcaactgaacgcggacctgagaaaactggcagtgaatatggtcccattccccaggctgcacttcttcatgccgggtttcgctcccttgacatcaagaggcagccagcagtatcgggcactcaccgtgccggaacttacccagcaagttttcgacgcgaaaaatatgatggctgcttgcgatccacggcacggccgctacctgacggtggctgcagtgtttcggggaaggatgagtatgaaagaggtcgatgaacaaatgttgaacgttcagaacaaaaattcgtcttactttgtggaatggattcccaacaatgtcaaaacagcagtgtgcgatatccctcctaggggcctaaagatggcagtgacctttataggaaattccaccgccatacaagaactgttcaagaggatctccgaacaatttacagccatgtttcggcgcaaagccttcctgcactggtatacgggggaggggatggacgaaatggaatttacggaggctgagtcgaatatgaacgatttggtttccgaatatcagcagtaccaagatgcaaccgcagaaggcggagggctgtag

SEQ ID NO: 210159 - DNA, 1308 bp, Artificial Sequence
  Description of Artificial Sequence: Synthetic coding sequence
atgcgggagatcgtgcacatccaggccggccagtgcggcaaccagatcggggcaaagttctgggaggtgatatccgacgagcacggtattgaccccactggaacttatcacggggatagcgatttacaactcgatcgcatcagcgtgtattataatgaggcaaccggcggcaagtatgtcccaagggctatcttagtggacctggagcccggtactatggactcagtgcgctccggaccttttggccagatttttcggccagacaatttcgtttttgggcaaagcggagctggcaacaactgggctaaggggcattataccgaaggtgctgaactcgtagattcagtgcttgacgtggtgaggaaagaggcggaatcttgtgattgtctgcagggtttccagctcactcattccctggggggcggcaccggtagtggcatgggtactttgctgatttctaagatacgagaggagtatcccgaccgaatcatgaacacattttcagttgttccgagtccaaaggttagtgatacagtggtggagccctataacgcaactttgtcagtgcaccagctggttgagaacaccgatgaaacatactgcatcgataatgaagccctttacgatatctgttttcggactttgaagctgaccacgccaacatacggagacctcaaccacttggtaagcgctaccatgagcggagttaccacttgccttcggtttcctgggcagttgaatgcagacttgcgcaagctggctgtgaacatggttcccttcccaaggctgcacttttttatgcccggattcgcaccgctgacctcccgcggttcgcagcaataccgggccctcacagtacctgagctgacacagcaagtcttcgatgcgaagaacatgatggcagcatgtgaccccagacatggccgttatctcaccgtcgctgctgttttcagaggccgaatgtcgatgaaggaggtcgatgagcaaatgctgaatgtgcagaataaaaattcctcctactttgtcgagtggatacctaataatgtcaaaactgcggtgtgcgacatccctccgcggggcctcaaaatggccgtaacgtttatcgggaacagtaccgcgatccaggaactctttaagaggataagcgagcagtttactgcaatgtttcgcaggaaagccttcctacactggtacacgggcgaaggtatggacgagatggaatttactgaggctgaatcgaatatgaacgaccttgtgagtgagtatcagcagtaccaggatgcaacagctgagggcggggggttatag

SEQ ID NO: 210160 - DNA, 1308 bp, Artificial Sequence
  Description of Artificial Sequence: Synthetic coding sequence
atgcgggagatcgtgcacatccaggccggccagtgcggcaaccagattggcgctaaattttgggaggtgatttcagacgagcatgggattgatcccacgggcacataccatggcgactctgacctgcaattggacaggattagcgtttattataacgaggccacaggcggcaagtacgtgccaagggctatccttgtggacctcgagcctggaaccatggacagtgtgaggtcaggacctttcggtcagatcttcaggcccgataatttcgtgttcggacaatctggggccggaaacaactgggccaagggccattatactgagggtgcggagttggtggacagcgttttagatgtggtaaggaaggaggccgagtcctgtgattgtcttcaaggtttccaactcacacacagcctgggcgggggaacaggatcaggcatgggaactttgttgattagtaagatcagagaagagtacccagaccgcattatgaatacatttagcgtggtgccatcccccaaggtgtccgacacagtagtggaaccatataatgccacgctcagcgtgcaccagttggtagagaacaccgacgaaacctactgtatcgacaatgaggccctgtacgatatttgcttcaggactttgaaacttacgacccccacatatggggatttgaatcacctcgtgagtgcgaccatgagtggcgtcactacctgtttgcggttcccggggcagttaaacgctgatcttcgaaagttggctgttaacatggtgcccttcccacgcctgcatttctttatgcccggatttgctcccctgactagtcggggctcccaacagtacagagccttgacggtacccgagttaacacagcaagtcttcgacgccaaaaacatgatggcagcctgcgaccccagacacggacgctaccttacagttgctgcggtgttccgggggaggatgagtatgaaagaggttgacgaacagatgctgaatgtgcaaaacaagaactccagctattttgtcgaatggatcccaaacaatgtcaaaaccgccgtgtgcgacatccctccgcgcggactaaagatggccgttacttttattggaaactcaactgcaatccaagagctgttcaagaggatcagtgagcagttcaccgctatgttcagacggaaagcattcctgcactggtacaccggggaaggtatggacgagatggagttcaccgaggccgagagtaatatgaatgacctcgtaagtgagtaccagcagtaccaggacgcgaccgctgagggcggaggcttgtag

SEQ ID NO: 210161 - DNA, 1248 bp, Artificial Sequence
  Description of Artificial Sequence: Synthetic coding sequence
atgcgggagatcgtgcacatccaggccggccagtgcggcaaccagattggcgctaagttttgggaagttatttcggatgagcatgggatcgatcccacaggcacataccacggggattccgatctacaactggatcgcatttcagtctactataacgaggctaccggaggtaagtacgtgccacgggctatcttggtggacctggagcctggcacgatggatagcgtgcggtccgggccgttcggccaaatctttaggccggataacttcgtattcggacagtcgggcgccggaaacaattgcctgcagggctttcagctcacccattcactaggcggaggcactggatcgggaatgggtactctgttaatttcaaagatccgggaggaataccctgatcgcataatgaatacattctctgtcgtcccctcaccaaaagtgagcgatacagtagtggaaccgtacaatgccacactttccgttcaccagttggtggagaataccgatgagacctactgtattgacaacgaggccctgtatgatatatgtttccgcacactgaaacttactacaccaacctacggagacctgaatcacctggtctctgccacgatgagcggcgtgacaacctgcctgaggttcccgggccaactcaatgccgacctgaggaaactggccgtcaatatggtccccttcccccgcctgcacttcttcatgcctggcttcgcaccccttacgtcaagagggtcccagcagtaccgggcattgacagtgcctgagctgacacagcaggtgttcgatgccaaaaacatgatggcagcctgcgatccccgacacggccgttatctaaccgtcgccgctgtctttcgaggcaggatgagtatgaaggaagttgacgagcagatgctcaacgttcagaacaagaactcatcatacttcgtggagtggatcccgaataatgtcaagactgctgtctgcgatataccacccagaggacttaaaatggctgtgactttcatcggtaatagtacagcaatccaagagctctttaagcggatttctgaacagttcacagcaatgtttcgaaggaaagcttttttgcattggtacaccggagaggggatggacgaaatggagttcactgaagcagagagtaatatgaacgacctggtgtcggaatatcagcagtaccaagacgctaccgcagaagaagaggaagatttcggcgaggaagccgaagaagaatag

SEQ ID NO: 210162 - DNA, 1248 bp, Artificial Sequence
  Description of Artificial Sequence: Synthetic coding sequence
atgcgggagatcgtgcacatccaggccggccagtgcggcaaccagatcggagctaagttttgggaggtgatctctgatgagcacgggatcgaccctactggcacataccatggcgatagcgaccttcagctcgatcgcatttccgtttattataacgaggcaaccggaggcaaatacgtgcctcgcgctattttggttgatcttgaacctggcacgatggattcggtgaggagtgggccttttggacagatctttagacctgacaacttcgtttttggccagtccggtgctggaaacaactgcctgcagggattccagctgactcactctctgggaggtgggaccggctctggtatgggaaccctgctcatatcaaagatccgagaagagtaccccgacaggataatgaacacattctccgtggttcctagccccaaggtcagtgatacagtggtggaaccttacaatgctacgctgagcgttcatcagcttgtggagaacaccgacgagacttactgcattgataatgaggccctgtacgatatttgttttcgcacactcaaactgactactcccacttacggtgatcttaaccacctagtgagcgccaccatgtctggggtgacaacctgcctaagatttccgggccaactgaacgccgatctcaggaaattagctgtgaacatggtgcctttcccccggctgcatttcttcatgcccggttttgcgccccttacaagcagaggtagccagcagtatcgggcactgacggtgccggagctgactcagcaggtgtttgacgccaaaaatatgatggccgcttgcgacccacgacacgggaggtacctcaccgttgctgcggtgttccggggcagaatgagtatgaaagaggtagacgagcagatgttaaatgtacagaacaagaatagttcatatttcgtagagtggatccctaacaacgtaaagaccgccgtttgcgacattcccccgcggggtctgaagatggccgtgactttcatcgggaattcaactgccatccaggagctgtttaaacgtatttctgaacagttcactgctatgttccgtcgcaaggcatttcttcactggtataccggcgagggcatggacgagatggagtttaccgaagcagaatccaacatgaacgatctggtcagtgagtaccagcagtaccaggatgctaccgctgaagaggaagaagactttggagaggaggccgaggaagagtag

SEQ ID NO: 210163 - DNA, 1248 bp, Artificial Sequence
  Description of Artificial Sequence: Synthetic coding sequence
atgcgggagatcgtgcacatccaggccggccagtgcggcaaccagataggcgccaagttttgggaggtcatatcagacgaacatggaatagaccccacaggtacctatcacggcgattctgacttacagctcgaccggattagcgtgtattataacgaagccactggaggcaaatatgtacctagggcaattctggttgatctcgagccagggaccatggattcagtacgcagtgggccttttgggcaaatcttcagaccagataatttcgtattcgggcagtctggggctggcaacaattgcttacaggggttccaattaactcatagcctgggcggcgggaccggttcaggaatgggtactctgcttatctccaagatccgcgaggagtatccagatagaataatgaacacctttagcgtggtgccttcccccaaagtctctgataccgtggtcgagccttataacgctacactatcagtgcaccagctcgtggagaatactgatgagacctactgtatcgataacgaggcgttgtatgacatctgctttcgaacactgaagctgaccacccccacatatggggatcttaatcacctggtgtccgccaccatgtcaggggtgactacgtgtctcagatttccgggccaactgaatgcagacctgagaaaattagccgtgaacatggtcccgtttccaaggctgcactttttcatgccagggttcgcccctctaacatctagaggcagtcagcagtaccgggcattgaccgtacccgagttaacccagcaggtattcgacgccaagaacatgatggccgcttgcgaccctagacacgggaggtacttaaccgttgcagccgtgtttcgcgggaggatgtccatgaaggaagtcgacgaacaaatgttgaacgtgcaaaataaaaacagcagctacttcgtggagtggatccctaataatgtgaagaccgccgtctgcgatatacctcctcggggcctgaagatggcggtgaccttcattgggaactctaccgcaatccaggaactttttaagcggattagcgaacaatttacagccatgtttagacgcaaggcctttctgcactggtataccggcgaagggatggatgagatggagtttacagaggctgagagcaacatgaatgacctggttagcgagtatcagcagtatcaggacgcgaccgccgaggaagaggaagacttcggggaagaagcagaggaggagtag

SEQ ID NO: 210164 - DNA, 1308 bp, Artificial Sequence
  Description of Artificial Sequence: Synthetic coding sequence
atgcgggagatcgtgcacatccaggccggccagtgcggcaaccagattggagcaaaattctgggaggttatatcagatgagcacgggattgaccccaccggcacttatcacggtgattcagacctgcagctagatcgaattagcgtttattacaacgaggctaccggaggaaaatacgtgcctagagcgatccttgtcgacctggaaccaggcaccatggactcagtgcgcagcgggccctttgggcagatttttagacccgataattttgtgttcggtcaatctggagcgggcaacaactgggcgaaagggcattatacagaaggggcggaactggtggattccgtcctggatgtcgtgcggaaggaagcagagtcttgcgattgcctccagggctttcagctcacgcacagtttggggggagggacgggatctggcatgggcacattgttaatatccaagatcagagaggaatatcccgatcggatcatgaacaccttctctgtggtcccttcacccaaggtgtcggatacagtggtcgaaccttacaatgctaccttgagcgtacatcagctggtagaaaatacggatgaaacctactgcatcgataatgaggccctctatgatatttgcttccggaccctgaaactcaccactccaacttatggcgatcttaatcacttggtcagcgcaacgatgtctggggttacaacctgtctccggttcccaggtcagctgaacgccgacttgcgtaaactagcagtaaacatggtgccgtttccacggctgcacttcttcatgccaggctttgctccacttacctcacggggcagccagcagtaccgggccctgaccgtgcctgagttgactcagcaggtattcgatgcgaaaaatatgatggccgcatgcgatccccgccacggtcggtatctgacggttgctgccgtttttaggggaagaatgtctatgaaagaggtagacgagcaaatgttgaatgtccagaataagaactcctcttacttcgtcgaatggatacccaataatgttaagacagctgtatgtgacatcccaccacggggcctaaagatggcggtgacctttattggcaactcaaccgccatccaggagctctttaagcgcatcagcgaacagttcactgccatgttcaggagaaaggcttttcttcactggtacacgggtgaggggatggacgagatggagttcaccgaggcagagtcaaacatgaatgatcttgtgagcgaataccagcaatatcaggacgcaactgccgaggggggtggactttag

SEQ ID NO: 210165 - DNA, 1308 bp, Artificial Sequence
  Description of Artificial Sequence: Synthetic coding sequence
atgcgggagatcgtgcacatccaggccggccagtgcggcaaccagatcggagccaaattttgggaggtcatctctgatgagcacggtattgatcctacagggacctaccatggcgattctgatctgcagctcgataggataagtgtctattataatgaggcaaccggaggcaagtatgtgccaagagcgatcttagtggaccttgaacctgggacaatggatagcgtccgaagcggcccatttgggcaaatctttcgccctgacaatttcgtgtttggtcaaagcggggccgggaacaactgggctaaaggtcactacacagagggggctgagcttgtcgatagtgtgctggacgtcgtccggaaggaagcagagagctgtgactgcctgcagggattccagctcactcacagcctgggagggggcacagggagtgggatgggaaccctgctgatctctaaaatccgagaagagtatcccgatcggattatgaatacgttctctgtggtgccatctccgaaagttagtgatacagtcgtggaaccttataacgctacccttagcgtgcaccagctggttgaaaatacggacgagacatactgcattgataacgaagctctgtacgacatctgtttccggacgctaaagctgacgacccccacttacggagatttgaatcacctggtgtcagccactatgagcggggtgaccacctgtttacggttccctggccaactgaatgctgacctgaggaaactggcggtgaacatggtgccgtttcctaggctgcattttttcatgcccggatttgcccctctcaccagccgcggatcacagcaatatcgcgcccttactgtgccagagctaacccaacaggtcttcgacgcaaagaatatgatggccgcctgtgatccccgtcatggaagataccttaccgtggccgccgtatttcggggcagaatgagcatgaaggaggtcgacgaacaaatgctaaatgtgcagaacaaaaactctagctattttgtggagtggatccccaacaatgtcaaaaccgccgtgtgcgacattccccctagaggactgaaaatggcggtcacttttattggaaattctacagccattcaggaattgtttaaaagaattagcgagcagttcactgcgatgttccggcgcaaggcttttctacattggtacaccggcgaggggatggatgaaatggagttcaccgaagcggaatccaacatgaatgatctcgtgtcggaatatcaacagtatcaggacgccaccgctgaggggggcggcctctag

SEQ ID NO: 210166 - DNA, 1308 bp, Artificial Sequence
  Description of Artificial Sequence: Synthetic coding sequence
atgcgggagatcgtgcacatccaggccggccagtgcggcaaccagatcggggctaagttttgggaggtaattagcgatgagcacgggatcgacccaaccgggacctatcatggtgattctgaccttcagctggaccgcatttccgtctactataacgaggcaacaggaggcaagtacgtgccgcgagccattctggtcgatctcgagccaggcaccatggactcagtgagaagcggaccttttggtcagatcttccggccggacaactttgtctttggacagagtggagcggggaataactgggcaaagggacactatactgagggagcagagttggtggactccgtgctggatgtagtgcggaaagaagctgagtcatgtgactgtcttcagggatttcagctaacacactctctgggggggggtacaggctccggcatggggaccctcttgatctcaaagattcgcgaagaataccccgatcggataatgaacaccttctcggtggtaccctcaccaaaggtatcagatacagtggtagagccttacaacgccacattatccgtacaccaattagtggaaaataccgacgagacctactgtatcgacaacgaagctctgtatgacatctgctttcggacactgaagctgacaacccccacgtatggcgatctgaaccatctcgtttctgctactatgagtggagtgactacatgcctccggtttcctggacaactcaacgctgacttaaggaagctggcagtgaacatggtgccctttcctagactccacttcttcatgccgggctttgcccccctgacaagccgcggatctcagcagtaccgagcacttacggtccccgaattgacccagcaggtgtttgatgccaaaaacatgatggccgcctgcgatcccagacatggtcgatacctgacagtcgcggctgtgtttcgcggacgtatgtccatgaaggaggtagatgagcagatgctgaacgtgcagaacaaaaatagcagctattttgtggaatggattccgaacaatgtaaaaacagccgtctgtgatatcccaccacgggggcttaagatggccgtgactttcatcggcaactcgacagcaattcaggagttgtttaagcgcatttctgagcaatttaccgctatgttcagaagaaaagctttcctccactggtataccggggaaggaatggatgaaatggaatttaccgaggcagagagcaatatgaatgacctcgtgtcagaataccaacagtatcaagatgccacagctgaaggcggaggcctgtag

SEQ ID NO: 210167 - DNA, 1062 bp, Artificial Sequence
  Description of Artificial Sequence: Synthetic coding sequence
atgcgggagatcgtgcacatccaggccggccagtgcggcaaccagatcggagctaagttctgggaggttatctccgatgagcatggcatcgacccaaccggcacatatcacggagatagtgatctgcaactgactcactcattgggtggaggaacaggaagcggcatggggacactgctcatcagtaaaatccgtgaggagtatccggaccgcattatgaataccttctccgttgtgccgtcccctaaagtgagcgacactgtagtagagccctacaatgccaccctgagtgtccatcaactcgttgagaatacggacgaaacctattgcatcgacaacgaggctctgtacgatatttgctttagaacattgaaactaacaacccccacatacggggatctcaaccatcttgtgtccgcgactatgtctggggtcaccacttgtctccggtttccgggacaactgaacgccgatctgaggaagttggctgtcaatatggttccattcccaagactacacttttttatgcccgggtttgcgcctctgacaagtcggggatcccaacaatatagagcacttactgtgccggaactgacacaacaggtgttcgacgcgaaaaacatgatggcagcttgtgatcccagacatggcagataccttacggtcgccgcggtgttccgaggcagaatgagtatgaaggaagttgatgaacagatgctgaatgtacagaacaaaaattcttcttactttgtggagtggatcccaaataacgtgaaaactgccgtgtgcgatattcctcctagaggactgaaaatggctgtaacattcatcggcaactccaccgccatccaggagttgtttaagcgcatttcggagcagtttacggctatgttccgcagaaaggcgttccttcactggtataccggtgaaggaatggatgaaatggagtttactgaagcagagtctaatatgaacgacctggtgtcggagtatcaacagtaccaggatgcgactgcagaagaggaagaagacttcggcgaggaggccgaagaggaggcatag

SEQ ID NO: 210168 - DNA, 1248 bp, Artificial Sequence
  Description of Artificial Sequence: Synthetic coding sequence
atgcgggagatcgtgcacatccaggccggccagtgcggcaaccagatcggagctaagttctgggaggtgatctccgatgagcatggcatagatccaactgggacctaccacggcgactcagatctgcagctcgatcggatcagtgtgtactataatgaggctaccggaggcaagtatgtgccacgcgctatattggtcgacctagagccaggtaccatggacagtgtcagaagtggaccttttggacaaatttttagacccgataacttcgtgttcggccaatccggagcagggaacaattgcctgcagggttttcagctgacccacagcttgggaggcggcaccggatctgggatggggaccttgttgatcagcaaaattagagaggagtatcccgatcggataatgaatactttctccgtggtcccatcccccaaagtttccgacacagtggttgagccatacaacgccaccctcagcgtacatcaactggtcgagaacacagacgagacttattgcattgataacgaggccctgtacgatatttgctttcggacactcaaactaactactcccacctacggagacctaaaccacctggtgagcgcaaccatgagtggagtcaccacctgccttcgcttccccggccagctcaatgctgatttgcgcaagctcgccgtgaatatggtgcccttcccacgcttgcacttttttatgccaggatttgcccccctcactagccgcggctctcagcagtatcgggctctgaccgtgccagaactgacccagcaggtatttgatgctaagaatatgatggctgcatgtgatccacgtcatggcagatacctcaccgtagccgcagtctttcgaggcaggatgtcaatgaaggaggtggacgaacagatgctaaatgtgcagaataaaaactcttcctactttgtggaatggatccccaacaacgtcaaaacagcagtgtgcgacatcccaccaagaggactaaagatggcagtcacttttatcgggaactccactgccattcaggagttgttcaaaaggatatccgaacagttcacggccatgtttcgccggaaagcattcctgcattggtataccggggagggcatggatgagatggagttcaccgaggcagagtccaacatgaacgacctggtgtcggagtatcaacagtatcaggatgctactgcagaggaggaagaagactttggggaggaagccgaggaggaatag

SEQ ID NO: 210169 - DNA, 1308 bp, Artificial Sequence
  Description of Artificial Sequence: Synthetic coding sequence
atgcgggagatcgtgcacatccaggccggccagtgcggcaaccagataggggctaagttctgggaagttatctccgatgagcatggaattgaccccactggaacttaccacggggattctgacctgcagctcgaccggatttcggtgtactataatgaggcaacaggtggtaaatacgtacctagagctatattggtcgaccttgagccggggaccatggatagcgtgaggagtggcccttttgggcaaattttccggcccgataacttcgtgtttggacagtccggagcaggcaacaactgggcaaagggtcattacactgaaggagcagaactggtagacagcgtgctcgacgtggtgcgcaaggaggccgagtcatgcgactgtctccaggggtttcagctgacgcattcgctagggggcgggaccggatccggaatgggtaccctcctgatcagcaagattcgggaagaataccccgaccgtattatgaacacatttagtgtagttccctctccaaaagtgtccgacaccgtggtcgagccttacaacgccactttgtcagtgcaccaactagtagaaaacacagacgaaacttattgcattgacaatgaggccctctatgacatctgctttcggactcttaagttgacaactccaacgtatggagacctgaatcaccttgtctctgctaccatgagcggtgtcacaacgtgcttacggtttcctggtcaattgaatgctgacctgaggaagctagcagtcaacatggtcccctttccccgacttcacttcttcatgccaggattcgcgcccctgacctctcgtggctcccagcagtatcgggccttgacagtgccggagctgacacagcaggtgtttgacgctaaaaacatgatggccgcgtgcgacccacggcatggtagatacctgactgtagccgcggtcttccgcgggcggatgagcatgaaagaagtggacgaacaaatgttgaatgtgcagaataaaaacagcagttattttgtagagtggattcccaacaacgtcaagacagccgtatgtgacattcctccgcgcggtcttaagatggccgttacatttattggcaactccacagccatacaggagctgtttaagcggataagcgagcagttcaccgcaatgttcagaagaaaggcctttctccattggtatacaggggaaggtatggacgagatggagtttaccgaggccgagtctaacatgaacgacctggtctctgaataccagcagtatcaggatgccacagccgaagagggaggggtttag

SEQ ID NO: 210170 - DNA, 1062 bp, Artificial Sequence
  Description of Artificial Sequence: Synthetic coding sequence
atgcgggagatcgtgcacatccaggccggccagtgcggcaaccagatcggggccaagttttgggaggtgataagcgacgagcacgggatcgacccaacgggtacataccacggggatagcgatttacagcttacccattctttaggaggaggaacgggctctgggatggggacgctcctgattagcaaaattcgcgaggagtacccagatcgaatcatgaatacatttagtgtggtgcccagccccaaagtgtctgacacagtggtggaaccttataacgctactctatctgtccaccagctcgtggagaacacagatgaaacctattgtatcgacaacgaggccttgtatgacatctgcttcaggaccttgaagttaacaactcccacctacggtgacttgaaccacttagttagcgcaacaatgtctggggtgacaacatgcctgcggtttcctgggcagctgaacgccgacctgcggaaactggctgtcaatatggtgcctttcccccggctgcattttttcatgccaggctttgcccccttaacctcccgaggttcacagcagtaccgggcgttaaccgttcccgaactgacccagcaggtattcgacgctaaaaatatgatggctgcctgcgacccgcgccacgggagatatttaactgtcgccgccgtattccgaggaagaatgtccatgaaagaggtggacgaacagatgctgaacgtgcagaataaaaactcgtcctacttcgtggaatggatccctaataatgttaagaccgctgtctgcgacatcccaccaaggggcctgaaaatggccgtcacattcatcggtaattctaccgctattcaggagcttttcaagagaatcagtgaacagttcactgccatgttccgtcggaaggctttcctacattggtacaccggggagggcatggacgagatggagtttacagaggccgagtcaaacatgaacgacttggtatccgagtatcagcagtaccaggatgccaccgccgaagaagaggaggactttggcgaggaggccgaggaggaagcatag

SEQ ID NO: 210171 - DNA, 1062 bp, Artificial Sequence
  Description of Artificial Sequence: Synthetic coding sequence
atgcgggagatcgtgcacatccaggccggccagtgcggcaaccagataggcgccaagttttgggaggtgatcagcgatgaacacggcatcgatcctaccggcacctaccacggcgattcagacctccagctcactcattcacttggcggtggaaccggcagcgggatgggtaccctgctcattagtaaaatacgtgaggagtatcccgatagaataatgaacaccttctctgtggttccaagcccgaaggtgtccgataccgtcgtggaaccctataacgctactctctcagtacaccagctggttgagaacaccgacgagacttactgtattgataatgaagccctgtatgacatctgtttccgcacactgaaactcacaaccccaacatatggtgacctgaatcacctggtttccgccaccatgtcaggagtgacaacatgcctgagatttcccgggcagctgaacgctgacctccgtaaattggccgtaaacatggttccctttcccagattgcactttttcatgcccggttttgccccgctaacttcccgtgggagtcaacagtaccgcgccctcactgtgccagagctcacccagcaggtctttgacgccaagaacatgatggctgcttgcgacccccgccacggaagatacctaaccgtggcagctgtgttccgaggtaggatgtctatgaaggaggttgacgagcagatgctgaatgttcagaacaagaacagtagctattttgtagagtggattcccaataacgtcaaaactgccgtctgcgacatccctcccagaggattgaaaatggccgtcacattcatcgggaatagtactgccattcaagagttgttcaagcgaatcagcgaacagtttacagccatgtttagacgtaaagcatttcttcattggtataccggagagggaatggatgaaatggagtttactgaagctgagtcaaatatgaacgacctggtgagtgaatatcaacagtatcaagacgcaacagccgaggaagaggaggatttcggggaggaggccgaagaggaggcatag

SEQ ID NO: 210172 - DNA, 1062 bp, Artificial Sequence
  Description of Artificial Sequence: Synthetic coding sequence
atgcgggagatcgtgcacatccaggccggccagtgcggcaaccagattggagccaaattttgggaggtgatcagtgatgaacatggaattgatcccaccggaacttatcacggggatagcgatcttcagctgacccactccctgggcggagggactggttcgggcatgggaacgcttctcatatctaaaatccgagaggagtatcctgatagaattatgaacaccttttcggttgtgccaagcccgaaagtctcagataccgtggtcgaaccatacaacgccaccctttccgtacaccagctggttgaaaacaccgatgagacatactgtattgataatgaggcattgtacgacatttgcttcaggacccttaaactaactacaccaacgtatggtgacctgaaccaccttgtgagcgccacaatgtcaggcgtcaccacttgtctgagattccctggacagctcaacgccgaccttcgaaagctcgccgtaaacatggtgccgttccctcgtctgcactttttcatgcctggttttgcaccgctgacctcaagagggagtcagcaatacagagcactgactgtgcctgagctgactcagcaggtatttgatgctaagaatatgatggccgcttgcgatcccaggcatggcagataccttacggtggctgctgtattcagagggaggatgagtatgaaagaagtggacgagcagatgttgaacgtacaaaataagaactctagttattttgttgaatggattccaaacaatgtgaaaacagccgtctgcgacatccctcccagaggtttgaaaatggccgtcacgtttataggtaacagcaccgccatccaggagctctttaagaggatctccgaacagttcacagccatgttcaggcggaaggccttcctccactggtatactggggagggtatggatgaaatggagttcacagaggcggagtctaacatgaatgacctggtaagcgagtaccaacagtatcaagacgccacagcagaggaggaggaggactttggggaggaagccgaggaagaagcctag

SEQ ID NO: 210173 - DNA, 1248 bp, Artificial Sequence
  Description of Artificial Sequence: Synthetic coding sequence
atgcgggagatcgtgcacatccaggccggccagtgcggcaaccagatcggcgctaagttctgggaagtgatttccgacgaacacggcatcgaccccacaggtacctatcacggggatagtgatttacagctcgacaggattagcgtgtactacaatgaggctacaggcggaaagtacgtgccacgcgctatcctggttgatctggagccgggcaccatggactctgtgagatcaggaccctttggccagatctttcgtcctgacaattttgtgttcggacaaagtggcgccggaaacaactgcctacagggtttccagctaacacacagcttgggcggcggcactggatccggcatgggcaccctactaatttccaaaatccgggaagagtaccccgaccgcattatgaacactttctccgtggttccttcacccaaagtctcggacacggtagtggagccatataatgccacactgagtgtgcatcagttggtggagaacacggacgagacctattgtatcgacaacgaagcactttacgatatatgtttcaggacgctgaagctcaccacacctacatacggggacctcaatcatttggtgagtgccacaatgtctggggtaactacttgtttgaggttccccgggcagctcaacgcagacctgcgcaaactggctgtgaatatggtgccatttcctcggttacatttttttatgcccggctttgccccactgacaagtcggggttcgcagcagtacagggcattaacagtacccgaattgactcagcaggtctttgatgctaagaacatgatggctgcatgtgaccccagacatggtaggtacttgacggttgcagccgtttttagaggacgcatgagcatgaaagaggttgatgagcagatgctgaatgtacaaaataaaaatagcagctactttgtggagtggatccccaataatgtcaagacagctgtctgcgacatccccccccgtgggctaaagatggccgtcacttttatcggcaactctacggctatacaagagctattcaaaagaatatccgaacagttcaccgccatgttcagacgaaaagccttcctgcattggtacacaggagaggggatggatgagatggagtttacagaagcggaaagcaacatgaacgacctcgtgtccgagtatcagcagtaccaggatgctacagctgaagaggaggaggatttcggcgaagaggccgaggaagagtag

SEQ ID NO: 210174 - DNA, 1248 bp, Artificial Sequence
  Description of Artificial Sequence: Synthetic coding sequence
atgcgggagatcgtgcacatccaggccggccagtgcggcaaccagattggtgctaagttttgggaagtgatcagtgatgaacacggaatcgatcctacaggcacttaccacggtgactctgatcttcaactggacaggattagtgtatactacaatgaagctacgggcgggaagtacgtgccaagggccattctggtagacctggagccgggcaccatggattccgtacgatccggtccattcggacagatctttagacctgataacttcgtgtttggtcaaagcggcgcaggaaacaattgtctgcaggggtttcagctaacacattccttagggggtgggacgggatcaggcatgggaaccctccttatctccaagatccgggaggagtatccagataggatcatgaataccttcagtgtagttccctcccccaaagtaagcgacactgtggtggagccttacaatgccaccctgtcagttcaccaactcgtggaaaacaccgacgagacttattgcattgataacgaagcactttacgatatatgtttcagaacactgaagctgacaacgcctacttatggagacctcaaccatctcgtctcagctaccatgagtggggttacaacctgcctgaggttccccgggcagctgaatgctgacctgcgcaaactagccgttaacatggtgccatttccacgtctgcatttcttcatgcctgggttcgccccactgacctcccgcgggtcacagcaataccgcgctcttaccgtccctgagctcacacagcaggtcttcgacgcgaagaacatgatggctgcctgtgacccgcggcacgggagatacctaacagttgccgccgtgttccgcggacgtatgtctatgaaggaggtcgacgaacagatgcttaatgttcagaataagaattcgagttacttcgtggagtggattcctaataatgtaaagacggcagtgtgtgacatcccgcctagagggcttaaaatggctgtcacgttcatcggaaattccaccgctattcaggagctattcaagcggataagcgagcagtttaccgctatgttccgtaggaaagccttcctgcattggtatacaggcgaagggatggatgagatggagttcaccgaggccgagagtaatatgaatgacttagtgtctgagtaccaacagtaccaggacgccactgccgaagaagaggaagattttggcgaagaggctgaagaggagtag

SEQ ID NO: 210175 - DNA, 1062 bp, Artificial Sequence
  Description of Artificial Sequence: Synthetic coding sequence
atgcgggagatcgtgcacatccaggccggccagtgcggcaaccagattggagctaagttctgggaggtgatatcggacgagcatgggattgaccccacgggaacttaccacggcgactccgatttacagctgactcattcccttggcggaggtacaggctcaggcatgggaaccctattgatctcaaaaatccgagaagagtatcctgacaggattatgaacacattctctgtggtcccctctcctaaggtgtcagatactgtggttgaaccttacaacgctacactctctgtgcatcagctggtcgaaaacacggatgaaacttactgtatcgacaatgaggccctgtacgacatctgcttccgtaccctgaagttgactacacctacctatggagatctgaatcacctggtctctgcaaccatgagtggcgttaccacatgcctaagatttccgggccaactgaatgccgatcttaggaagctggccgttaacatggtgcccttccctagacttcattttttcatgccggggttcgcaccccttaccagtagaggctcgcagcagtaccgagcacttacagttcccgaacttactcagcaggttttcgacgcaaaaaatatgatggcggcttgcgatccaaggcatggtcgctatcttacggtggccgctgtgtttagaggccgaatgtctatgaaagaggtcgatgagcagatgttaaacgtccagaataaaaattcctcctatttcgtagaatggatcccaaataatgtgaagactgcggtgtgcgacattcccccaaggggcctgaaaatggccgtgacctttattgggaatagtaccgcaatccaagaattgttcaagagaatctcagagcagtttacagctatgttcagacggaaggcctttctgcattggtacactggagaggggatggacgagatggagttcactgaggctgaatccaacatgaatgacctcgtgagtgaatatcagcagtatcaagacgctactgctgaggaggaagaagatttcggtgaggaagccgaggaagaggcctag

SEQ ID NO: 210176 - DNA, 1362 bp, Artificial Sequence
  Description of Artificial Sequence: Synthetic coding sequence
atgagcatcgtgaccgtgcagctgggccagtgcggcaaccagatcggattcgaagtttttgatgcccttctcagcgactcccatagtagtcagggactatgcagtatgagagagaacgaagcctatcaggctagctgtaaggaacgctttttctccgaagaggagaacggcgttccaatcgcgagagccgtactagtggacatggagccaaaggtgattaaccagatgcttagcaaagccgcccagtccggacagtggaaatacggccaacatgcttgtttttgccagaagcagggcagcggtaacaactgggcatacgggtactcagtccatgggccccgccacgaagaatctataatgaacataattcgaaaggaggtcgagaagtgcgactctttctctggtttcttcataatcatgagcatggcgggagggaccgggagtgggctgggagctttcgtgacccaaaatctagaggaccagtacagcaatagtttaaagatgaaccaaatcatctggccatacggaaccggggaagtcattgtacagaattataattcaattttgaccctgtctcatctgtaccggtcatccgatgctttgctcctgcatgaaaatgacgctatccacaagatatgcgctaagctcatgaacatcaaacagatctctttcagtgacatcaatcaggttctggcacatcagctcgggtctgtattccagccaacctattccgctgagtcttcattccattatcggcgcaatccactaggcgacctgatggagcacctggtgcctcaccctgagttcaaaatgctgagcgtcagaaatatcccacacatgtctgagaattcacttgcctacaccacctttacttgggctggtctcctgaagcacctgcgacagatgctaatctcgaacgcgaaaatggaggagggcattgacagacacgtttggcctccgttgagtggtctgcctcccctaagcaaaatgtccctgaataaagacctccacttcaacaccagcatcgccaatttggttattctgcgcgggaaagacgttcaatctgccgatgtcgaagggtttaaagatcctgctctgtacacttcctggctgaagccagtcaacgcgtttaacgtttggaagacacagagggccttctccaaatatgaaaaaagcgcggtcctagtttctaatagccagttcttggttaagcctcttgatatgatagtcggcaaggcttggaacatgtttgccagcaaggcttacattcaccagtataccaagttcggcatcgaagaggaagattttctcgattcctttacgtctctggagcaagtggtagcctcctattgcaatctttag

SEQ ID NO: 210177 - DNA, 1197 bp, Artificial Sequence
  Description of Artificial Sequence: Synthetic coding sequence
atgagcatcgtgaccgtgcagctgggccagtgcggcaaccagatcggattcgaggtgttcgatgccctcctctccgatagccacagtagccaaggactgtgctccatgagagagaatgaagcttaccaagcgagctgtaaagagcgttttttttctgaagaagaaaatggcgtgcccattgcgcgggccgtgctcgtggatatggaacccaaggtgatcaatcagatgttatccaaggctgcacagtccggtcagtggaagtacgggcagcacgcttgtttttgccagaagcagggatctggaaacaattgggcatacgggtacagcgtgcatgggcctagacacgaagagtctataatgaatataattagaaaggaggtggagaaatgcgatagcttttctggcttttttattataatgagtatggcagggggtaccggctctgggctcggagctttcgtgacacagaatctggaagaccagtattctaactctttgaagatgaatcagatcatctggccatacggcacaggcgaggtcatcgtacagaattacaactccatactgactctcagtcacctgtaccggagttccgatgcactactgctccatgaaaacgacgctattcataagatatgcgctaaactcatgaatattaagcagatctctttttcagatattaatcaagtgctggcccaccaactgggaagcgtttttcagccaacttacagtgcagagtctagtttccactaccgccggaatcccctgggtattgacaggcacgtgtggcctccactatcgggcctgccccctctgtctaagatgtcccttaataaagacctgcacttcaatacctcaattgcgaacttagtgattctacgggggaaggatgtacagagtgctgacgtggaggggttcaaggaccccgccctatatacctcttggctgaagccagtgaatgcctttaatgtgtggaaaacacagcgcgcattctccaagtatgaaaaatccgccgtcctggtctcgaactcgcaatttctggttaaaccactggacatgatcgtggggaaggcctggaacatgttcgccagcaaagcatatatccaccagtatactaagtttggcatcgaggaagaggactttctcgactctttcacgtccttagagcaagtggtcgcgagctattgtaacctgtag

SEQ ID NO: 210178 - DNA, 600 bp, Artificial Sequence
  Description of Artificial Sequence: Synthetic coding sequence
atgagcatcgtgaccgtgcagctgggccagtgcggcaaccagatcggtttcgaggtgttcgatgctctcctctccgatagtcactcaagccagggactgtgctctatgagggaaaacgaggcctatcaagcatcctgcaaagagcggtttttctccgaggaggaaaatggaggaatagacagacatgtgtggccacctttaagcggtctccctccactttccaagatgtcactcaataaagatctccacttcaacacatcaatagccaacttagtaatcctgagaggaaaagatgttcagagcgctgatgtggagggattcaaagaccctgctctatacacttcatggctcaagccagtcaacgccttcaatgtttggaagacacagagagccttttcaaaatacgagaaatctgccgtcctggtctccaacagccagttcctggttaagccgcttgatatgatcgtcggaaaggcatggaatatgttcgcgagcaaggcatacatccaccagtataccaagttcggaattgaggaagaagacttcctcgactcctttacgtccctggagcaggttgttgcctcttattgtaatctgtag

SEQ ID NO: 210179 - DNA, 1056 bp, Artificial Sequence
  Description of Artificial Sequence: Synthetic coding sequence
atgagcatcgtgaccgtgcagctgggccagtgcggcaaccagatcggattcgaagtctttgatgccttgctctctgattcacattcttcccaagggctctgtagtatgcgggagaacgaggcctaccaagccagctgcaaggagcggttctttagtgaggaagagaacggggtgccaatcgcccgcgctgtgttagtagacatggaacctaaggtgatcaatcagatgttatccaaggccgcacagtctggtcagtggaagtacgggcagcacgcttgtttctgtcagaagcagggttcagggaacaattgggcctacgggtacagcgtgcacggtcccagacacgaagagtccatcatgaacatcattaggaaagaagtggaaaaatgcgactctttctcggggtttttcatcataatgtcaatggcggggggcacaggcagcggattaggagcctttgtgacccagaacctggaagaccaatactctaattctcttaagatgaatcaaattatctggccttatggcactggagaagtgatcgtccaaaattacaattcaatccttaccctgtctcacctataccggagctcagacgccttgctgttacacgagaacgacgcgatacacaaaatctgcgcaaagctaatgaatatcaagcagataagcttctccgacataaaccaggtcctcgcacaccagctgggatccgtgtttcaacccacgtattccgcagaatccagctttcactatagacggaacccattggagggattcaaggatccagccctctacacctcatggctaaagccggttaatgcatttaacgtttggaagacacagcgcgccttttctaaatatgaaaaatctgccgtcctggtcagtaactctcagtttctagttaaaccactcgacatgatagtaggaaaagcatggaatatgttcgcttcaaaggcatatatacaccagtatactaagttcggcatcgaggaagaggacttcttggactccttcacatccctcgaacaagtggtggcctcatactgcaacctctag

SEQ ID NO: 210180 - DNA, 1191 bp, Artificial Sequence
  Description of Artificial Sequence: Synthetic coding sequence
atgagcatcgtgaccgtgcagctgggccagtgcggcaaccagatcggctttgaggtatttgacgctctactctcggactcccactctagtcaggggctgtgtagcatgcgagagaacgaagcctatcaggcctcatgtaaagagaggtttttctccgaggaagaaaacggcgtcccaatcgcaagggctgtgctcgtcgatatggaaccgaaggttatcaaccagatgctgtccaaagccgcccaatccgggcagtggaagtatggccagcacgcatgtttctgtcagaagcagggaagcggtaataactgggcgtacgggtatagtgtgcacggcccacgccacgaagagtccataatgaacatcattcggaaggaggtggagaaatgcgacagttttagcggattttttatcatcatgagcatggccgggggaacaggaagcggactcggggcattcgttactcaaaatctggaggaccaatactctaacagcctgaagatgaatcaaatcatatggccttatggcactggcgaagtcatcgtgcaaaactacaattcaatcctgaccctgagtcacctctaccgttccagtgatgcgctgctccttcatgaaaatgacgccattcacaagatatgcgccaaacttatgaacataaaacagatatccttctctgatatcaatcaggttttggctcatcagctcggctctgtgtttcagcctacttatagcgctgagagctcattccactatcggcggaacccgttaggggatcttatggagcatctcgtgccccatcccgagtttaaaatgctgtccgtacggaatatcccccacatgagtgaaaattcactcgcatacacgacttttacctgggccggcctactgaagcacctgcgtcagatgctgattagcaacgccaagatggaggagggaatcgaccgtcacgtctggcctcctctaagcgggttgcccccactgtccaaaatgagtctcaataaggacttgcactttaacacatccatcgctaacctagtgattctgcgcggcaaggatgtgcaaagtgccgacgtggggaagaaattccgtgcttatatccatcagtacacgaaatttggcatcgaagaggaagacttcttggacagcttcacctcccttgagcaggtggtggctagctattgcaacctgtag

SEQ ID NO: 210181 - DNA, 714 bp, Artificial Sequence
  Description of Artificial Sequence: Synthetic coding sequence
atgaacatcaagcagatcagcttcagcgacatcaaccaggtgctggctcaccaactgggttccgtttttcagcccacctactcagccgagagctctttccattacagacggaaccccctgggtgacctgatggaacacctggttccccaccctgaattcaaaatgttgagtgtacggaacatcccccacatgtctgagaatagccttgcttatacaacttttacttgggcggggctgctgaagcacctgagacaaatgctgatttctaacgcgaagatggaagagggcatcgatcgacacgtgtggccaccactgtccgggttgccccctctgtccaaaatgtccttgaataaggacctgcattttaatactagtatagctaacctggtgatactcagaggcaaagacgtgcaatctgctgatgtggagggtttcaaggatccagccctttataccagctggctgaaacctgtcaatgccttcaacgtgtggaagactcagagagccttcagcaaatacgaaaaaagtgccgtcctagtgtctaatagccagtttcttgtgaagcctctagatatgatcgtgggtaaagcgtggaacatgttcgcttcaaaggcttacatccatcagtatactaaattcggcatcgaggaggaggactttcttgactcttttaccagcttggaacaggtcgtggcctcctactgcaacctatag

SEQ ID NO: 210182 - DNA, 378 bp, Artificial Sequence
  Description of Artificial Sequence: Synthetic coding sequence
atgagcatcgtgaccgtgcagctgggccagtgcggcaaccagatcggtttcgaggtctttgatgctctgttgagcgactctcactctagccaggggctgtgtagcatgagagaaaatgaggcatatcaggcctcttgcaaggaacgcttcttttctgaggaagaaaacggcgtaccaatagctcgtgctgtcctggtcgacatggaaccaaaggtaatcaatcagatgttatcaaaggccgcacagagcgggcagtggaaatacggccaacatgcttgtttctgtcagaagcagggctcaggaaataattgggcctacggaagggacaaggattcagcctgttatcctgactggtctggcaccccagggctacagtag

SEQ ID NO: 210183 - DNA, 492 bp, Artificial Sequence
  Description of Artificial Sequence: Synthetic coding sequence
atgacccagagcgtggtggtgcaggtgggccagtgcggcaaccagatcggatgctgtttctgggatctggccttgagggagcacgccgctgtgaatcagaaggggatttacgacgaagcaatcagctccttttttcgcaacgttgatacacgtgtggtaggagatggcgggtccatttcaaagggaaaaatctgttccttgaaggctcgggctgttctgatcgacatggaggaaggggtagtgaacgaaattttacagggccccctgcgggacgtcttcgatactaagcaactgattacagacattagcgggtccgggaacaactgggccgtcgggcacaaggtgttcggcagcctgtaccaggatcagatactggagaaatttagaaagtcagccgagcattgcgactgcctgcaatgtttcttcattatacactcaatgggtggagggaaaatcttccattccttcgcttgcaactcagtcaagggttag

SEQ ID NO: 210184 - DNA, 621 bp, Artificial Sequence
  Description of Artificial Sequence: Synthetic coding sequence
atggagagcgaccagcggaaggtggtgggcgacggcggcagcatctctaagggcaagatctgcagcctaaaggctcgcgcagtgctgatcgacatggaggagggtgttgtgaacgaaatcctacaagggccacttcgggacgtattcgataccaagcaactcattaccgatattagtgggtccggcaataactgggccgtcggacacaaagtcttcgggagcctataccaggaccagatactggagaagttcagaaagagtgcagagcactgtgactgtctacagtgcttctttattattcattccatgggcggcggcaccggatccggcctgggaacgttcctcctgaaagttttagaggacgagtttcctgaggtctaccggttcgtgacatccatttacccaagtggggaagatgatgttatcacctctccttacaactctattctcgctatgaaagagcttaatgagcacgctgactgcgtattgcccattgacaatcagagtctctttgacatcattagcaaaattgatctgatggtaaactccggaaagctcgggaccacggtaaaaccgaagagtctggttacttccagcagcggtgccctgaaaaaacagtag

SEQ ID NO: 210185 - DNA, 1428 bp, Artificial Sequence
  Description of Artificial Sequence: Synthetic coding sequence
atgacccagagcgtggtggtgcaggtgggccagtgcggcaaccagatcggatgctgcttctgggacctggcacttagagaacacgccgccgtaaatcagaaggggatttacgacgaagcgatttctagcttctttcgtaacgttgatactagagtggtgggtgatggaggttctatcagcaaagggaagatctgttcactgaaggcacgcgctgtgctgattgatatggaggagggtgtcgtcaacgagatcctgcagggccctctccgtgacgtgtttgacaccaaacagttgatcaccgatatttcgggctcaggcaataactgggccgttgggcacaaagtgtttggctctttgtatcaggatcaaatactggaaaagttcagaaagtctgccgagcattgtgattgcctgcagtgcttctttattatccattccatggggggaggtacaggatccggcctgggtaccttcctgctgaaggtgctcgaagacgaattccctgaggtgtaccgctttgtcactagcatatatccatccggtgaagatgacgtaataaccagtccttacaattccatcctcgctatgaaagaactgaatgaacacgccgactgtgttttgcctattgataatcagtcactgttcgatattattagcaaaattgatctgatggtcaatagcggaaaactgggaaccactgtgaagcctaaaagtctggtgacttcaagttccggggcattaaagaaacagcacaagaaaccgtttgacgcaatgaacaatatcgttgctaacctgctgctgaatctgaccagctcagcgaggtttgaaggttcgctaaatatggacttaaacgagatctcaatgaatctggtgccgttccctcagctgcattacctggtatccagcctcacccctctctatacactgaccgacgtcaacatcccccctcggagactggatcagatgttttccgacgcctttagcaaggaccatcagttgctccgtgctgacccaaagcacagcctttacctggcttgtgccctgatggtcaggggaaacgtccagatcagtgatctgcggaggaatatcgaacggctgaaaccttccctgcagttcgtgagctggaaccaggaagggtggaagacatccctgtgctccgtgcccccagtcggccattctcactctcttttagctctcgctaataatacctgtgtgaagcctacttttatggagctgaaggagagatttatgaggctctacaagaaaaaagctcatctccaccattatctgcaggtggagggaatggaagaatcgtgcttcacggaagctgtgagtagtctgagtgccctgatccaagagtatgatcagctggacgctaccaaaaacatgcccgtgcaagatctgccgaggctttccattgccatgtag

SEQ ID NO: 210186 - DNA, 621 bp, Artificial Sequence
  Description of Artificial Sequence: Synthetic coding sequence
atggagagcgaccagcggaaggtggtgggcgacggcggcagcatcagcaaggggaaaatctgctccctgaaggcacgggccgtactgatagatatggaggaaggagtcgtgaacgaaattttgcagggcccactcagagacgtttttgacacaaagcagctgattaccgacataagtgggtccggcaacaactgggcagtcggacataaggttttcggttctttgtatcaggaccagatattggaaaaatttaggaagtctgccgagcattgtgattgtctgcaatgcttcttcatcattcattccatgggcgggggcacaggaagcggactgggcacctttctgctgaaagtcctggaagacgagttccctgaagtttaccggtttgtaacctccatttatccttctggagaagacgacgtcatcacatcaccatataactccatcctggcaatgaaagagctcaacgaacacgccgattgtgttctacccatagacaaccaatcgctgtttgacatcattagtaaaattgatctgatggttaatagcgggaagctggggacaacagtgaaacccaagtctctcgtgacctcttcttcaggtgccctgaagaagcaatag

SEQ ID NO: 210187 - DNA, 1356 bp, Artificial Sequence
  Description of Artificial Sequence: Synthetic coding sequence
atgccccgggagatcatcaccctgcagctgggccagtgcggcaaccagattggctttgagttctggaagcagttgtgcgcagagcacggcatttctcctgaaggaatcgtcgaagaattcgccaccgagggaactgataggaaagacgtgttcttctaccaagccgacgacgaacactacatccctcgtgctgtgctcctggacctcgagcccagggtcatccactcaatcctgaatagcccctatgcgaaactctataatccagaaaacatttacctctcagagcacggtggaggggcggggaataactgggcctccggcttcagccaaggtgaaaaaatccatgaggatattttcgacatcatcgacagagaagctgacggttccgattccctggaaggcttcgtgctgtgtcattctattgcgggcggaacagggtcagggctcgggtcctacctgctggagcgtttgaacgaccggtatccgaaaaagttggtgcagacttacagcgtgttccccaaccaggacgagatgtcagatgtggtggtccagccttacaactctctcctgaccctgaaacggttgacccagaatgctgattgcgttgtggttcttgataatactgcccttaaccgaatcgctactgacaggttgcacatccagaaccctagctttagccagattaatcagctcgtctccactattatgtcagcctcaactacaacgcttcgttatcccggctacatgaataatgatcttatcggcctgatcgcctccctaatacccactccaagactgcatttccttatgacgggctacacgccactgacaaccgaccagagtgtcgcctcggtgagaaaaaccacagtcctcgacgtgatgagacggctcttacagccaaagaatgtcatggtttctactgggagagatcgacaaaccaatcattgctatattgccatcttgaatattatccagggggaggtggatcctacccaggtgcacaaaagccttcaaagaatacgcgagaggaagctggccaatttcatcccatggggcccggcatccattcaggtggccttgtctcgcaaatctccatatctgccctcagctcatagagtctccggcctcatgatggctaatcatacatcaattagctccctgttcgagcgcacttgtcgacagtatgataagcttagaaagcgcgaggcatttctcgagcagtttagaaaggaggacatgtttaaggataattttgacgaaatggacaccagcagggaaatcgtacagcaactgatcgatgagtaccacgccgccacgagacctgattacatatcctggggcactcaagagcaatag

SEQ ID NO: 210188 - DNA, 1356 bp, Artificial Sequence
  Description of Artificial Sequence: Synthetic coding sequence
atgccccgggagatcatcaccctgcagctgggccagtgcggcaaccagattggtttcgaattttggaagcagctgtgtgctgaacatggtatttcgcctgaggggatcgtcgaagagttcgctaccgaaggcacagaccggaaggatgtgttcttttatcaggccgacgacgaacactatatacccagagcagttctgctcgacctggagccccgcgtcatccatagcatactcaatagcccgtacgctaaactgtataaccccgaaaatatttacctctcagaacatgggggcggggccggaaacaactgggcatctggattttcccaaggagagaagattcacgaggacattttcgacatcattgaccgcgaggcagatggctcagatagcctggagggctttgtactgtgccactccattgcaggtggtacagggtccggcctgggctcctacctcctggagcggctgaatgataggtatcccaagaagttagtgcagacttactccgtcttcccttatcaagacgagatgtctgatgtcgttgtgcagccttacaatagcctcctcacgcttaaacgactgacacagaacgccgattgcgtggttgtcctggataatactgcacttaacaggattgccacagaccgactgcatatccaaaatcctagtttctcacagattaatcagttagtcagcacaattatgtccgcaagtacaaccaccctgaggtacccaggatatatgaacaatgacttaatcggcctgattgcatccctgattcctacgcctagactgcactttcttatgacagggtataccccgctaacgaccgaccagagtgtggcctccgtgcggaaaacaacagtgctggacgtcatgagaagactgttgcagcccaagaacgttatggtgagcacaggacgagatagacagactaatcattgttacattgccattctaaacatcattcagggggaggtcgaccccacccaggtccacaagagtctccaacgcatccgagaacggaaactggcaaacttcatcccttggggccctgcctctatacaggtggccctctccagaaagtccccatatctgccatcggcacacagagtgtccggtctgatgatggccaaccacacctctatatcatccctcttcgaatcttcgtgtcaacagttcgataaactgcgtaagcgcgacgcctttctggaacagttccgcaaggaagatatgttcaaggacaacttcgacgaaatggataggtcccgcgaggtggtccaggagttgatagacgagtaccatgccgccacccagcccgactacatctcttggggcacacaggaacagtag

SEQ ID NO: 210189 - DNA, 2001 bp, Artificial Sequence
  Description of Artificial Sequence: Synthetic coding sequence
atgatccacgagctgctgctggccctgagcggctaccccggcagcatcttcacatggaataaaagaagcggcctgcaggtctcccaggacttccctttccttcacccgtcagagacatcagttctcaacaggctgtgtcgcctgggaaccgactatattcggtttactgagttcattgaacagtacactggccatgtgcaacagcaggatcatcacccttcccaacagggtcaaggaggcctacacggcatttacctgagggcattctgtaccggattggattctgtactgcaaccttaccgacaagctctgctcgatcttgaacaggagttcctgggagacccgcacttatccatcagtcatgttaactactttctagaccaatttcagctgttgttcccatcagtgatggtggttgtggagcagataaagagtcagaaaattcacggctgccagatcctcgaaactgtgtataagcattcctgcgggggtttgccacctgtgcgctcagcgttggaaaaaattctggccgtgtgtcacggagtgatgtacaagcaactgtctgcttggatgctgcacggattacttctggaccagcatgaggagttcttcatcaagcagggccctagcagcggtaacgtgtcagcccaacctgaggaggacgaggaggatctgggcatcggaggcctcaccgggaaacagctccgggaactgcaggacctacggctgattgaggaggaaaacatgcttgcaccttctctgaaacagttctcccttagggtggaaatcctgccttcttatataccagtgcgggttgccgagaagatcttgttcgtaggggagagtgtgcagatgttcgagaatcaaaatgtgaaccttaccagaaagggatcaatcctgaaaaaccaagaagataccttcgccgctgagctccaccgtctgaaacagcaacctctgtttagtctcgtagactttgagcaggtggtggacaggatccggagcacagtcgcagaacatctgtggaaactcatggttgaagagagcgatctgctgggacagcttaagattattaaggacttttatctccttggacggggcgagctcttccaggcttttatcgacacggctcagcacatgctgaaaactcctcccacggcagtgactgagcacgacgtgaacgtggcattccaacagtccgcacataaagtcctcttggatgacgacaatcttttgcccctcctgcacttaaccattgagtatcatgggaaggagcacaaggatgcaacgcaggctagagaggggccatcacgcgaaacatctccccgggaggctcccgcttctgggtgggcagcactcggcctgagttataaggttcagtggcccttgcatatattattcacccctgccgtcttggagaaatacaatgtcgtttttaaatacctcttgtccgtgcgccgagtccaggccgaactccagcactgctgggcgctgcagatgcaacgtaagcacttgaagagcaatcaaactgatgctatcaaatggagactcaggaaccatatggctttcctcgtcgataatcttcaatactatttacaggtggacgtactggagtctcagttttcccagctgctgcaccagattaactcgactagagacttcgaaagcattaggcttgcgcacgaccatttcctgtcaaatctgcttgctcagagcttcatcctcctcaagcccgtttttcactgtctgaacgaaatcttggacctgtgccactcgttctgctccctggtttcacagaacctgggcccattggatgagcggggagctgcccaactgtccatcttggtaaagggattttctcgccagtcctctctgcttttcaagatcctctcttctgtgaggaatcaccaaatcaattcagacttggcccagctgctcctgcgactcgactataacaagtattatactcaggccggcgggacgctggggtcttttgggatgtag

SEQ ID NO: 210190 - DNA, 1029 bp, Artificial Sequence
  Description of Artificial Sequence: Synthetic coding sequence
atggtggtggtggagcagatcaagagccagaagatccacggctgccaaatacttgaaacagtgtacaaacactcctgtggcggactgccccccgtgcggtctgccctagaaaagatcttggcagtgtgccatggagtgatgtacaaacagttatctgcttggatgctgcatggcttgctcctggaccagcatgaagaattcttcatcaagcaaggaccctcatctgggaacgtatccgcccagcccgaagaggacgaagaagatcttggcattggtgggctgaccggaaagcagctgcgcgaactgcaggatctgcgcctaatagaagaagagaatatgttggcccctagtctaaaacaatttagcttaagggtcgaaattctcccaagctatattcctgtgagagtggccgagaaaatcctgttcgtgggagaatctgtccagatgttcgaaaatcagaatgttaatctgactcggaaaggaagtatcctgaagaatcaggaggacacattcgctgccgaacttcatagactgaaacagcagcccttgttcagcctagtcgacttcgagcaagtggtggatagaattcgttctaccgtcgctgagcacctttggaagctcatggtcgaagagtctgatctcctggggcagctcaagatcattaaggacttctacctgcttggtcgtggagagttgtttcaggcctttatagatacggcgcagcacatgctcaagactcctccaactgcggtgactgaacacgatgtaaatgtcgcgtttcagcaaagcgctcataaggttcttctagacgacgacaacctactgccgctcctgcaccttacaattgagtatcatgggaaggaacacaaagccgatgctacacaagctcgggagggccctagcagagagactagcccgcgggaggctcctgcaagtggatgggcagccctggggctgagctacaaggtgcaatggcccctccacatactcttcacccctgccgtcctcgaaaaaaacaggcagttttag

SEQ ID NO: 210191 - DNA, 3075 bp, Artificial Sequence
  Description of Artificial Sequence: Synthetic coding sequence
atggcccggcacggccccccctggagccggctggacgcccagcaggaacgggatgtgcgggaactggtccgcggtgtggccggactgcaggacgaagccgatcctaacttccagctggcgctcaatttcgcttggtccaatttccgattccaccggttcctcgatgtaaactctcataaaatcgaaaagacaatagaaggcatatacgagaagttcgtcatacatagtgacctttctaaagcagcctcatggaaacgactcacagaggaatttctgaacgcccctcttccttccatcaaggaaattaagacggatgctcactactccattttgagcctgctgctttgtctgtcagacagtccctcgaattcaagctacgttgagacacccaggaacaaagaggtggaaaaaaaagacgacttcgattggggtaaatacttgatggaggatgaggagatggacatcggaccgtatatggatacaccaaattggtctgaggaaagcgaagaagagaatgaccagcagcccttaagcagagaggatagcggtatccaagtagatcgaactcccctagaggaacaggatcagaaccgcaagcttgacccatgcatcagctggaaggatgagccagacgacaggtcctggttagagcatcatgtggtccatcagtattggacagcccgtccatcgcaatttccacactctctacatcttcactccaacttggccgcggtgtgggaccagcatctttactcttccgatccactctatgtacctgatgatagggtgcttgtgacagaaacccaagtgatcagggaaaccctgtggctgcttagcggcgtcaagaaactgtttattttccagctcatcgatggcaaagtcacggtgaggaataatatcatagtgacgcacctcacgcattcatgtctgcgctcggtgctggagcagattgcggcgtacgggcaggtagtgtttcggctccaggaatttatagacgaagtgatgggccattcgagtgaaagtatgctccctggaagcggtagtgtccctaagaaatccacggaggcaccatttcgtacgtatcaggcattcatgtgggctctgtataagtattttattagcttcaaagaagagctcgcagagatagagaagtgtataattaacaacgacaccacgatcaccttggccatcgtggtggacaagctggcaccgcgcttatcgcagctgaaagttctccacaaggtgttttcaacaggtgtggcggaggtgcctccggatactcgcaacgtagtaagggcctcacatctgctgaatacactctacaaagccattctagaatatgataatgtgggggaggcttcagagcagaccgtttctcttctgtttagcttatgggtagagacagtccgaccataccttcagacggtcgatgagtggatagtgcacggccatctatgggacggcgcgagggagttcattatccagcgaaacaaaaatgtgccggtcaaccatcgcgatttctggtacgcaacatataccctgtacagcgtttccgaaaagactgaaaacgaggaaaagatgagcgacaacgcctccgccagctcaggctcggaccagggaccttccagccgccagcatacaatggtaagttttttaaaacctgtcctgaagcagataataatggctggaaagagcatgcagctcctaaaaaatctacaatgtgccgaatccacaacttgtcaggcaggcgctagagacgccgagagaaaatccctatacactttatttctggaatccgtgcaatccaggttgcggcacggagaggatagcacaccacaggttctgaccgaacagcaagcaactaaagagaacctgatgaagatgcagtcgattgccgagagccatcttgaattggatgatgtgcatgatcccctgctggctattaattttgctagaatgtacctggagcaatcggattttcacgaaaagttcgccgggggtgatgtctgcgtggacaggtccagcgagtcggtcacttgccagacttttgaactaaccttgaggtcctgcctgtaccctcacatagataaacaatatctcgactgttgcggcaaccttatgcaaactctaaagaaagattacagactcgtagagtatctgcaggcaatgcgcaacttctttctgatggagggaggagatacaatgtacgacttctacacgagtattttcgacaaaatcagggaaaaggaaacgtggcagaatgtatccttccttaacgtgcaattgcaggaggccgtgggacagcggtatcctgaagattcctctcgccttagtatttcattcgagaatgtcgatacagccaaaaaaaaattgcccgtgcacattctggacggccttaccctcagctacaaggtaccctggccggtggacattgttatttccctcgagtgccagaaaatctacaaccaagtatttcttcttctgttgcagataaagtgggcaaagtattcactggatgttctactattcggggagttagttagcactgcggagaagcccagattaaaagaggggctcattcacgagcaggatactgtggcacagtttggcccccagaaggagccggtgcgccagcagatccatcgaatgtttctgctcagagttaaactcatgcactttgtaaacagcctccacaattacatcatgacaaggattctacactctactggtctagaatttcagcaccaggtggaagaggcaaaagacttagatcaactcatcaagattcactatcggtacctgagtaccatccatgacaggtgtctgctgagagaaaaggtgtcattcgtaaaagaagctataatgaaggtgctaaatctggcgctgatgtttgccgatgggtggcaggctggacttggcacatggagaatggagtccattgaaaagatggagtctgatttcaagaactgccatatgtttttggtgacaatcctgaacaaggcggtctgtaggggcagttttccgcacttggagagcttagcacttagtctcatggccggtatggagcagtcctag

SEQ ID NO: 210192 - DNA, 3075 bp, Artificial Sequence
  Description of Artificial Sequence: Synthetic coding sequence
atggcccggcacggccccccctggagccggctggacgcccagcaggagcgggacgtgagggaactcgtaagaggtgttgccggcctccaagatgaagctgatccgaattttcagctcgcgctgaattttgcttggtctaatttccggttccaccggttcctggacgtgaattctcacaaaattgagaagacgatagagggtatttacgaaaagttcgtgatacattccgatttatccaaagccgcttcttggaaacgactgacagaggagtttctgaatgccccacttccctccattaaggagattaaaactgatgctcactatagtatcctcagtctgctgctgtgtctctcagattcacccagtaattcttcctacgtggagacaccacggaacaaagaagttgagaagaaggacgacttcgattggggcaaatatctcatggaggacgaggagatggatattggcccttatatggatacacctaattggagcgaagagagtgaagaggaaaatgaccaacagcctctctcacgagaggatagcggcatccaagtggaccggactccactggaagaacaggaccaaaaccgaaagctagatccgtgtatctcgtggaaggatgaacctgatgaccgaagttggctcgaacatcatgtggtgcaccagtattggaccgccaggccatcccaatttccacattctttgcacttacactccaatcttgctgcagtttgggatcagcacctgtattcatctgatccactttacgtgcctgatgacagagttcttgtgaccgaaactcaggtgataagagaaacattatggttgctgagcggggtgaaaaaattgttcatattccaactcatcgacggcaaagtgacagtgaggaataacatcattgtgacacacttaacccatagctgtctgaggtctgtcctagaacagatcgcagcatatggccaggtggtctttaggctccaggagtttatagatgaagtgatgggccacagctcagagagcatgctgccaggctcaggttccgtacctaaaaaatccactgaggcccctttcaggacatatcaggctttcatgtgggctctgtacaaatattttatctccttcaaagaagagcttgcagagatcgagaagtgtatcatcaataatgacaccacgattacgctcgcaatcgttgtggacaaattggcacctaggctctcgcagctgaaggtccttcacaaagtcttctctaccggggtcgcggaggtcccccctgatacccgaaacgtcgtgcgcgcatcacatctactaaatactctttacaaagccatccttgaatatgataatgtgggtgaggcttctgagcagacagtatctctgctcttttctctatgggttgaaacagtgagaccctatttgcagactgtcgatgagtggatagtacacggccacctgtgggacggagctagggaattcatcattcaacgcaacaaaaatgtgccagtgaaccatcgggatttttggtatgcaacttacaccctgtattctgtgtccgagaaaaccgaaaacgaagaaaagatgagtgataatgccagcgcatccagcggctctgatcaagggccctcctccaggcagcacacaatggtcagcttcttgaagcccgttctgaagcagatcatcatggccggcaaaagcatgcaactgctcaaaaacttacagtgtgcggaatctaccacatgccaggcaggtgcgagggacgcagagcgaaagtccctctacacactcttcctcgagagcgtccagagcagactgcgccatggcgaggattccactccacaggtcttgacagagcaacaggcgactaaagaaaatctcatgaagatgcagtctatagcagagtcgcacctagagctggacgacgtgcatgaccccctgctggcgatcaacttcgcacgcatgtatttagagcaatccgattttcacgagaaatttgccggcggcgacgtgtgcgttgaccgctcttcagaatcggtcacgtgccagacattcgagttaacgttgcggtcttgtctgtacccacatattgataagcagtaccttgactgctgcggaaatctgatgcagacgctgaagaaagattatcgtctcgtggagtacctccaagctatgagaaacttcttcttgatggaaggaggtgacaccatgtacgacttttacacatccatttttgacaagattagagagaaggagacctggcagaacgtatcttttctgaacgtgcagctgcaggaagcagtcgggcagcgctatcccgaagacagctcaaggttgagtatttcttttgagaatgtggatactgcaaagaaaaagctccctgttcacatcctggacggcctgaccttgagctacaaggtgccttggccggtcgacattgtgatctctctcgagtgccagaaaatctacaaccaggttttcttacttttgcttcagattaagtgggccaaatatagcctggacgtcctgcttttcggcgaactcgtgagtactgccgaaaaaccacgcctgaaggagggcctaattcatgaacaggacaccgtcgctcagtttgggccacagaaagagcctgtgaggcagcaaatacatcgcatgttccttctgagagtgaaattgatgcactttgtaaatagcctccacaactatattatgacgcggattcttcacagtacaggtttggagttccagcaccaggttgaggaggctaaggacctggatcagctgattaaaatccactataggtatctcagcacaatccacgaccggtgtttactacgagagaaggtgtctttcgtgaaggaggcaattatgaaagtgctgaatctcgcattaatgttcgccgatgggtggcaagccgggcttggcacttggcgtatggaaagtatcgaaaaaatggagtccgatttcaagaactgccacatgttcctggtcactattctgaacaaagccgtctgtcggggtagcttcccccactgtgagtatataatgctgaagtatttctatttgtgtatttctttgtag

SEQ ID NO: 210193 - DNA, 1431 bp, Artificial Sequence
  Description of Artificial Sequence: Synthetic coding sequence
atgtggaccggctacaagatcctgatcttcagctacctgaccaccgaaatctggatggagaaacagtacttaagccagcgcgaagtagacctggaagcctattttacccggaatcacacagtccttcagggtactcggttcaagcgggcaatcttccagggacagtattgtagaaatttcggttgctgtgaggatcgcgatgatggctgcgttaccgaattctacgctgcgaacgccctgtgttactgcgacaagttttgcgaccgcgaaaacagcgactgctgccccgactataaatccttctgtagggaggaaaaggaatggcctccccacacccaaccctggtaccccgaaggttgtttcaaggatggtcagcattatgaggagggctctgtcattaaagaaaactgcaactcttgtacatgctcaggccaacagtggaaatgttcacagcacgtttgcttggtgcgcagtgagctgatcgagcaggtgaacaaaggcgactacggttggacagcccaaaactactctcagttttggggaatgacactagaggacggttttaaatttcggcttggaacactgccccccagccccatgctcctgagcatgaacgaaatgacagcctccttgcctgctacaacggatcttccagaattcttcgttgcgtcatacaaatggccagggtggacccacgggccacttgatcagaagaactgtgccgccagctgggccttcagcaccgccagtgtggccgcggataggatcgcaatacagtcaaagggccggtatacagctaacctcagccctcagaacctgataagttgctgcgctaaaaatcggcatggctgtaatagtggttctatagacagagcttggtggtacctgcgaaaacgcgggctggtgagtcatgcctgttacccattatttaaggaccaaaatgctacaaacaatggttgcgcaatggctagccgctcggacggtcgaggtaagcgccatgcaactaaaccttgtcccaacaatgttgagaagtcaaatcgcatttatcagtgcagtcccccgtacagagtgtcctcaaatgagactgagattatgaaggaaatcatgcagaatggtcctgtgcaggcgatcatgcaggttagggaagacttttttcattacaaaacagggatttaccgccatgtcaccagcactaataaggagtctgaaaagtaccgtaaactccaaacgcatgcagtaaagttaacggggtggggcaccctcagaggcgcacaagggcagaaagagaaattctggattgcagcaaactcctggggtaaaagttggggggaaaatgggtactttcgcattctccgcggggtgaatgagtctgatattgagaagctcatcatcgccgcttggggccagctaacctcatctgatgaaccatag

SEQ ID NO: 210194 - DNA, 1008 bp, Artificial Sequence
  Description of Artificial Sequence: Synthetic coding sequence
atgtggaccggctacaagatcctgatcttcagctacctgaccaccgaaatctggatggaaaagcaatatctgtcacagcgagaggtggatctagaggcctacttcaccagaaaccatactgtcctgcagggcacacgctttaagagagccatatttcaaggccagtactgccgaaacttcggatgctgcgaagatagggacgatggctgcgtaaccgagttctacgcggctaacgccttatgctactgtgacaaattctgcgacagagagaactccgactgctgtccggactacaaatctttctgtagggaggagaaagagtggcctccccacactcaaccatggtaccccgaagggcgttggaccgcccagaactactcgcagttctggggtatgactctcgaggacggattcaaatttcgcctgggcacactgcccccctcgcccatgctcctcagcatgaacgaaatgacgcggcttgtgagccacgcgtgctatcccctgttcaaagatcaaaacgccacaaacaacggttgcgcaatggcatccaggtccgatgggcggggcaaaagacacgcaacgaagccgtgccctaataacgtggagaaatcaaacaggatttatcagtgtagcccaccttatcgggtgtccagtaacgaaaccgagataatgaaagagatcatgcagaatgggcccgtccaagccattatgcaggtacgtgaggatttcttccattacaaaacaggaatctacaggcacgtcacatctacaaacaaagagtcagagaagtatcggaagttgcaaacccatgccgtcaaactgacaggctggggcacacttcgaggcgcacaaggccaaaaggagaaattctggatagccgccaacagctgggggaaatcctggggcgaaaatggctacttccggatcctacggggagttaatgaaagcgacatcgagaaattaataattgcggcttggggccagctgactagctccgacgagccctag

SEQ ID NO: 210195 - DNA, 612 bp, Artificial Sequence
  Description of Artificial Sequence: Synthetic coding sequence
atggagaagcagtacctgagccagcgggaggtggacctggaggcctacttcactcggaaccacaccgtgctacagggaacaagatttaagcgcgcgatcttccagggccagtactgcagaaacttcgggtgttgtgaggacagagatgacgggtgcgttacagagttctatgcagccaacgctctgtgttattgcgacaagttttgcgatagagaaaacagtgattgctgccctgattacaaatccttttgtcgtgaagaaaaagaatggccaccacacactcagccctggtatccagaagggtgtttcaaagacggccagcattatgaggagggatctgtgattaaagaaaactgcaactcttgcacttgttccggccagcagtggaaatgctctcaacatgtgtgcctcgtccgttcggagctgatcgagcaagtcaacaagggtgattatggatggactgctcagaattactctcagttctgggggatgactctggaagatggtttcaaatttcgcttgggcacactgcccccttcaccaatgttgctgagcatgaatgagatgactgtaagtgttccttccgacagcaggatgtgcatgtatctctag

SEQ ID NO: 210196 - DNA, 468 bp, Artificial Sequence
  Description of Artificial Sequence: Synthetic coding sequence
atggccagccggagcgacggccggggcaagcggcacgccaccaagccttgtcccaataacgtggaaaagagcaatcggatctatcagtgcagccccccctaccgagtgagtagcaacgaaacggagatcatgaaggagatcatgcagaatggcccagtgcaagctatcatgcaggtgcgtgaagacttttttcactacaaaaccgggatctaccgccacgtcacctccaccaacaaagagagcgagaagtaccggaaactgcagacccatgcggtcaaactaaccggttggggaacactgcgtggcgcgcagggacagaaggaaaagttctggatcgccgctaattcttggggcaagtcttggggggagaacggctatttccgaatcttgagaggggttaatgagagcgacatcgagaagttgatcatcgccgcctggggccagctcactagcagcgacgagccctag

SEQ ID NO: 210197 - DNA, 618 bp, Artificial Sequence
  Description of Artificial Sequence: Synthetic coding sequence
atgcgggcctggatgttcgtgagcatgcaggccgagatctggatggagaaacaatacctgtcccagcgtgaggtggacctggaggcctactttactcgaaaccacacagtccttcaggggactcgattcaaacgggcaatttttcagggccagtactgcaggaacttcgggtgctgcgaagaccgtgatgatggatgcgttacagaattttacgcggcgaatgcgctgtgttattgcgataagttctgcgatagagaaaatagcgattgctgcccggattacaagagtttctgtcgtgaggaaaaagaatggccaccccacactcagccatggtatccagagggttgttttaaggacggacaacactacgaggagggctctgtgatcaaggagaactgtaatagttgcacctgcagcggccagcagtggaaatgttctcagcacgtgtgcttggtgcggagtgagctgattgaacaggtgaataagggagactacggatggaccgcgcaaaattactctcaattttggggcatgactctggaggacggctttaagtttagacttggtaccttacctccgagcccaatgctcttatctatgaatgaaatgaccgagtag

SEQ ID NO: 210198 - DNA, 3570 bp, Artificial Sequence
  Description of Artificial Sequence: Synthetic coding sequence
atgagcgtgaagagccccttcaacgtgatgagccggaacaacctggaagccccaccatgcaaaatgactgaaccattcaatttcgagaaaaatgaaaacaaattaccacctcacgaaagtctgagatcccccggcactctccctaatcatccgaatttccgtcttaagagcagtgagaacggcaataaaaaaaataatttcctattatgcgaacaaacgaagcagtacttggctagccaggaggataatagcgtttcttctaatcctaacgggatcaacggcgaggtcgtcggttcgaaaggggataggaaaaaactgccggcaggtaactccgtatccccacctagcgccgaaagcaactcacccccgaaggaggttaatatcaagccaggaaataatgttaggcccgccaaatccaagaaactcaacaagctggtggaaaactcgttgagcatttccaacccaggactgttcacgtctctgggtcccccactcagaagtacgacatgtcatagatgtgggctctttgggtctctgcgatgttctcaatgcaagcaaacgtattattgctccactgcctgccaacggcgggattggtctgctcacagtatcgtctgtcgtcccgttcagccaaactttcacaaactggaaaacaagtcttccatcgagactaaggatgtcgaggtgaataataaatccgactgccctctgggagtgacaaaagaaattgccatttgggccgagcggataatgttcagcgacttgagatccctccagctgaagaagaccatggagatcaaaggaactgttactgaattcaaacaccccggcgacttctacgtgcagctctattccagcgaggtactggagtatatgaaccagctgtcggctagtcttaaggaaacttacgctaacgttcacgagaaggattatattcctgtgaaaggggaagtgtgcatcgctaagtacaccgttgaccagacatggaatagagccattatacagaatgtggatgtgcagcagaaaaaagcccatgtgctgtacatcgattacggaaatgaggaaattattcctcttaacaggatttatcatctgaaccgtaacattgatttgttcccaccttgtgcgatcaagtgcttcgtcgccaacgttattccagccgagggaaactggagttctgactgcattaaagcaaccaagccattgttgatggagcagtactgctcaattaagattgtcgacatcctggaggaggaagtggtgactttcgcagtcgaagtggagctgcccaactcagggaaactgctggatcacgtgcttatcgagatggggtatggacttaaaccttctggacaggacagtaaaaaagaaaatgccgatcagtctgacccagaagatgtaggcaagatgactactgagaacaacatcgttgtggataagtctgacttaatccccaaggtgctcaccttgaatgtcggagacgaattctgcggtgtcgtggcccacatccagacgccagaagatttcttctgtcaacagttgcaaagtgggcgcaaattggcggaactgcaggccagtctgtccaagtactgcgatcagctgcctccaagatcggatttctacccagcaatcggcgacatctgttgtgcccagttttcagaagacgaccagtggtatagggcatcagtattggcatacgcctctgaagaaagcgtattagtaggctacgtggattacggcaatttcgagatcttgtctctcatgcggctttgtccaatcattcccaaattgctggagctgcctatgcaggcaattaagtgtgtgctggccggcgtgaagccttcacttggaatctggacccccgaagccatttgtttgatgaagaaactggtccagaataagataattacagttaaggttgtcgataagcttgaaaacagctcgctggtcgagctgattgacaagagcgagactcctcacgtgtcagtctctaaggtgttgctggacgccggatttgccgtcggcgagcagtcgatggtcactgataaacccagcgacgtgaaggagacttccgttcctcttggcgtcgagggaaaggtgaaccccctggagtggacgtgggtggagctgggtgtggatcagaccgtggacgtggtggtttgtgtaatatacagtcctggtgagttctactgccacgtgctgaaggaagatgcgcttaaaaagttgaacgacttgaacaaatccctcgctgaacactgccagcaaaagctgccaaacggctttaaagctgagatcggacagccgtgctgtgctttcttcgccggggacggtagttggtaccgggccctcgtaaaagaaattctgccaaatggccatgttaaagtccattttgttgattacgggaacattgaggaggtaacagcagatgaactgcgaatgatttcatcaactttcctaaacctgcctttccaaggcattcgatgccagttagctgacatacagtcacggaataagcactggtccgaagaagcgataacacggtttcagatgtgcgttgccgggataaaactgcaggcgcgggttgttgaggtcacagagaatgggatcggagtggaacttactgacctctctacttgttatcccaggattatcagtgatgtgctcatcgacgagcacctggtcctcaaatctgccagcccccacaaagacctgcccaatgacaggttagttaacaaacacgaactgcaggtccatgtgcagggcttgcaggccaccagctctgctgagcagtggaagactatagagctccccgtggacaagacaatccaggcaaacgtcctggaaatcatctcacctaacttgttttatgccctgcctaagggcatgcctgagaaccaggagaagctttgtatgctgacagcagagctcctcgagtattgcaacgcacctaagagtaggcccccataccgcccgcgaattggcgacgcctgctgtgcaaaatacacaagcgatgacttctggtacagggcagtcgtgctcggtacgtccgacactgacgtggaagtcttgtacgccgactacggcaacatagagacactgcccctgtgccgagtccaaccgatcaccagttcgcatctcgccctgccctttcagattataagatgctcccttgagggcttaatggaacttaacggcagcagttcccagctcatcatcatgttgcttaagaacttcatgctgaaccaaaatgtgatgctgtccgtgaagggaatcaccaaaaacgtgcatactgtgtctgtggaaaagtgttccgagaacggaactgtagatgtagccgataagctagtcacattcgggctggctaagaacataactccgcaacgacaaagcgctctgaacacagagaagatgtatcggatgaattgctgctgcacagagctgcagaaacaggttgagaagcatgaacatatacttctgttcctgctaaacaactctacaaatcaaaataaatttattgaaatgaaaaagttgctcaagaagactgcctccctgggaggcaagcctctgtag

SEQ ID NO: 210199 - DNA, 3315 bp, Artificial Sequence
  Description of Artificial Sequence: Synthetic coding sequence
atgagcgtgaagagccccttcaacgtgatgagccggaacaacctggaagcccctccatgcaaaatgacagaaccttttaacttcgagaagaacgaaaacaaactgccgccccatgagtcattgaggtctccaggaacactgccaaaccatccaaatttccgactcaagtcatcagaaaatggcaacaaaaagaacaacttccttttatgtgagcagaccaagcagtacctggcaagccaggaggacaacagcgtttcgagcaaccctaatggaattaacggagaggtcgttggaagtaagggagatagaaaaaagctgcccgctggaaactctgtatctcccccatcagcagagtccaatagcccaccgaaagaggtgaatattaaaccaggcaataacgtgcgacccgccaagagcaagaagctgaacaaactggtggaaaacagtttgtctatcagcaatcctgggttgttcacaagcctcgggcctccgctgcgttcaacgacttgccaccgctgcggactgtttggcagcctgaggtgctctcagtgtaaacagacatactattgctccaccgcctgtcaacgtagagactggtcagctcattcaattgtttgccggccagtgcaacccaatttccataaacttgaaaacaaaagctctatcgagacgaaagacgtggaagtgaataacaaaagtgattgtcctttgggcgtgacaaaggagatcgccatatgggctgaacgaatcatgttttctgatctccgcagcctccagttgaagaagactatggagattaaagggacggtgactgagtttaagcaccccggcgacttttatgtgcagctatattctagcgaagtgctggagtatatgaatcagctgtctgcctctctcaaggagacgtatgcgaacgtccatgagaaggattatataccggtgaagggagaagtgtgcatcgctaagtataccgttgaccagacctggaatagagctattattcagaacgtggacgtgcaacagaaaaaggcgcacgtgctttatatcgactatggcaacgaggagatcatccccctgaataggatatatcatctgaataggaacatagatctgttccccccatgcgctatcaaatgtttcgtagcgaacgtgatcccggctgaggggaactggtccagcgattgtatcaaagctaccaaacctctccttatggagcagtactgcagtatcaagatcgtggacatcctggaagaagaggtggttacattcgccgtcgaggtggaacttcccaacagtggtaagctgcttgaccatgtgctgatcgaaatgggctatgggctgaaaccttctgggcaggacagcaaaaaagaaaatgctgatcaaagcgatcccgaggacgtgggcaagatgacaacggagaacaatatcgtggtggataagagcgatctgattccaaaggtgctgaccctgaatgttggggatgaattttgtggagtagttgctcacatacaaactccagaggattttttctgtcaacagctgcaatcagggcgtaagctggctgaattgcaggcatctctgagcaagtattgcgaccagttacccccacggtcagatttttatcccgccataggcgacatttgttgtgcgcagttttccgaggatgaccagtggtaccgggcttcagtgctcgcctacgcatccgaagagtcggtgctggttggctacgtcgactatggaaatttcgagatccttagcctgatgaggctgtgccctatcattccaaagctgctggagctgcccatgcaagccattaagtgcgtcctcgcaggggtcaagccatctctgggtatttggactcccgaggccatctgtttgatgaagaagttagtacaaaataagataattaccgttaaggtggtggacaagcttgaaaactcctctctggttgagcttatcgacaaatcagagacacctcatgtttcagtgtccaaagtgctgcttgacgcaggcttcgctgttggcgaacagtcaatggtgacagataaaccttctgacgtaaaagaaacatctgtgccactgggtgtcgaggggaaggtaaatcctctcgagtggacttgggtggagctgggagtggatcagaccgttgatgtcgtggtgtgcgttatatattcacctggtgaattctactgccatgtgcttaaagaggatgcacttaaaaaactcaatgacttgaataagtcccttgccgagcattgtcagcagaagctacctaacggctttaaggccgagattggacagccttgctgtgcgtttttcgccggggacggttcttggtacagggctctcgtgaaagaaatactgcccaatggacatgtcaaggtgcattttgtggactatggaaacatcgaagaagtaacagccgacgagttgaggatgatcagttcaactttcctcaacttgccttttcagggcatccgctgccagctggccgacattcagtccagaaataagcattggtccgaagaggcaattaccaggttccagatgtgtgttgccggaatcaagcttcaagctcgcgttgtcgaagttactgagaacggaattggagtcgagttgactgatctgtcaacctgctacccgcggataataagtgatgtgctcatcgatgagcacctcgtgctgaaatcagcaagtccccataaagacctccccaacgacagactggtaaataagcacgagctgcaggttcacgtgcagggattgcaagccaccagctcagccgagcagtggaaaactattgagcttcctgtggacaagacgatccaggctaatgtactggagatcatttctcccaaccttttttacgccctcccaaagggcatgcctgaaaatcaggagaagttatgcatgcttacagctgagcttctcgaatattgcaatgctcctaagtcccgtccaccctacaggcctcgaatcggagatgcttgttgcgccaaatatacctctgacgatttttggtatagagccgtggtgttagggacctcagacaccgacgttgaggttctgtacgcagattacgggaatattgagactctgccgctctgtagagttcaaccaattaccagctctcatcttgcacttcctttccaaattattcggtgttctcttgaagagaaaatgtataggatgaattgctgctgcaccgaactgcagaaacaggtcgaaaagcatgaacacatcctgctgtttctactgaataattcaaccaatcaaaataaattcatcgaaatgaaaaaattgctgaagtcctag

SEQ ID NO: 210200 - DNA, 3228 bp, Artificial Sequence
  Description of Artificial Sequence: Synthetic coding sequence
atgagcgtgaagagccccttcaacgtgatgagccggaacaacctggaggccccaccatgcaagatgacagagcccttcaacttcgagaagaacgagaataaactgcccccacacgagagcctccgatcaccaggcactctgcctaaccaccccaacttccgtctgaaaagttcggaaaacggcaacaaaaaaaataattttctcctgtgcgaacaaactaaacagtatttggcaagccaggaggataactctgtgagttctaatccaaacggtatcaacggagaggttgtcggctctaagggcgaccgcaagaagctgccagccgggaacagcgtgagtcccccttctgccgaatcaaattctcccccaaaggaggtgaatattaagccaggtaataatgtgcgaccagccaaaagtaagaagttgaacaagcttgtcgaaaactcactgagtatctccaatcccgggctcttcacctccctgggtcctccgttgaggtccacgacgtgccaccgttgcggactttttggctctctgaggtgcagtcagtgtaaacagacctattattgcagcaccgcatgtcaaagaagggactggagtgcgcacagcatcgtttgcagacctgttcaaccaaacttccataagcttgagaataagtctagcatcgaaacaaaggatgtcgaagtcaataataagtcagactgcccactcggagttacaaaagagatcgccatctgggctgagaggatcatgtttagtgatcttagaagtctgcaactaaaaaagaccatggagatcaaagggaccgtgactgaatttaagcaccccggggatttttatgtgcagctgtacagcagcgaggtgctggagtacatgaatcaactttcagctagcctgaaagagacctatgctaacgtgcacgagaaagactatattccagtgaaaggagaggtctgcatcgctaagtacacggttgatcagacttggaaccgcgcaattattcagaacgtggatgtacagcaaaagaaggctcacgttttatatattgactatgggaatgaggaaataatacctctgaatcgcatctatcacctgaaccgaaacattgacttgttccccccgtgtgccattaaatgctttgttgcaaatgtgatccccgcagaaggaaattggtccagcgactgtatcaaagctacaaaacctctgttaatggaacagtactgctctattaagattgtggacatcctcgaggaggaggttgtcacgtttgcggtggaggtagagcttccaaactcaggaaagctcctggaccatgttctcatagagatgggctatggcctcaagccctctggccaggatagcaagaaggaaaacgcagaccagagcgacccagaagatgtcggcaagatgactacggagaacaacattgtcgttgacaagagtgatctgatacctaaagttctgacattgaatgtcggcgatgagttttgcggagtggttgcacatattcagacccccgaggacttcttttgtcaacagctccagagtggccgtaagctcgcagaactgcaagcttccttgtccaagtactgtgatcagctcccacctagatcggacttctaccctgcaattggagacatttgttgcgcacagttctcaggagtcaaaccatccctcgggatttggactcccgaagcaatttgtctcatgaagaaactggtgcagaataagatcatcaccgtcaaagtggttgataaactcgaaaattcttctctcgtagagctcattgacaaatcggaaacaccccatgtcagtgtgtctaaggtgcttctggacgccggctttgcagtgggggaacagtcaatggtaaccgataagcctagcgacgttaaggaaaccagcgtgcccctcggagtagagggaaaagtcaaccctctggagtggacctgggtggagctgggtgtggaccagacagtagacgtggtcgtttgtgtcatttactcccctggcgaattttattgtcacgtgctgaaagaggacgctctcaagaaactgaacgacctaaataaatcacttgctgagcattgccaacagaaactgcccaacggcttcaaagccgagatcggacagccgtgctgtgcgttttttgccgacatccaatcacggaacaagcattggagcgaggaagccattacaaggttccaaatgtgcgtcgcagggatcaagctgcaggcccgggtcgtggaagtcacagaaaatggcatcggtgtggaactgaccgatttaagcacctgttacccaaggatcatctccgatgtattgatagacgagcacttggtccttaaatctgcaagtccacataaagacctgcctaacgatcggctggtcaacaagcacgaactgcaggtccacgtccagggactccaggccacctcttcagcagaacagtggaagacaatcgaactgcctgttgacaagacaatccaggctaacgttctggagatcatttcaccaaatcttttctacgcattacccaagggaatgccggagaaccaagagaagttatgtatgctcaccgccgaactgctggagtattgcaatgcacctaaatcccgtcccccctatcgcccacggatcggggacgcttgttgtgcaaagtacactagcgatgatttttggtaccgtgcagttgtcctgggaactagcgatacggacgtggaggtcttgtacgcagactatggtaacatcgagactcttcccctctgccgggtccagcctatcacaagcagtcatctggcactgccattccagatcatcagatgctcgctcgagggcctcatggagctcaatggcagctcaagccagttaattattatgcttctaaaaaacttcatgctcaaccagaatgtgatgctgagtgtaaagggtatcacaaagaacgtgcatacagtctccgttgagaaatgctccgagaatggcacagtggatgtcgccgacaagcttgtgaccttcggactagccaagaatatcacaccgcaaaggcagtccgctcttaataccgagaagatgtaccgcatgaactgctgctgtacggagctgcagaaacaggtcgagaaacacgaacatattctgctgttcctgctcaataactctacaaatcagaacaagttcatcgaaatgaagaagttgctgaagaagaccgcctcattgggagggaaaccactctag

SEQ ID NO: 210201 - DNA, 3342 bp, Artificial Sequence
  Description of Artificial Sequence: Synthetic coding sequence
atgagcgtgaagagccccttcaacgtgatgagccggaacaacctggaggccccaccttgtaagatgaccgagccatttaacttcgaaaaaaatgaaaacaagctgccaccccatgaaagtctgagatctccaggaacccttccaaaccatccaaactttcgtctaaaatcatcagagaacggtaacaaaaagaacaactttctcctgtgcgagcagaccaagcagtaccttgcaagtcaagaagacaactctgtatcatcaaatccgaacggcatcaatggagaagtagtgggaagcaaaggggacagaaagaagttgccagccggtaattcagtctcgcccccttccgcagaatccaactctccgcctaaggaggtgaacattaagcctggcaacaatgtacgcccagccaagtcgaagaaactaaacaagctggttgaaaactcactcagtatttcaaatccggggctcttcacgtctctgggacctccactgagatcgactacatgccaccgctgtgggttgtttgggagcctcagatgttctcaatgcaaacaaacgtactattgctcaacggcttgccagcggcgagactggtccgcacattccatcgtctgtagaccagtgcagccaaattttcataagctggaaaataaatccagtattgagactaaggatgtagaggtcaacaacaagagtgactgtccgcttggtgtgacaaaggagatcgccatttgggccgagcgaattatgttctcagacctaagatctctgcagctgaaaaagacgatggaaataaagggaaccgtcactgaattcaagcacccaggggatttttatgtccaattgtattctagcgaagtcctggaatatatgaatcaactctccgcgtctctgaaagaaacctatgccaacgtgcacgagaaagactatatcccggttaaaggcgaagtatgcatcgccaaatacaccgtggatcaaacatggaacagagcgatcattcagaacgtcgacgtccaacagaagaaggcccatgtgctttacatcgattatggcaacgaggaaattatccccctgaaccgaatttaccacctgaaccgcaatatcgacttgttccccccctgtgccataaagtgcttcgtggccaacgtaattcctgcagaggggaactggagtagcgactgcatcaaagccaccaagcccttgctgatggaacaatattgcagcatcaagatcgttgatatcttagaggaggaagtagtcacttttgccgtcgaagtggaactgccgaattccggaaaactactggatcacgtattgattgaaatgggatatggtctaaaaccttcgggtcaggattccaaaaaggaaaatgccgatcagagcgacccggaagacgttggcaagatgaccacggaaaacaacattgtggttgacaagtctgatttaattcccaaagtgttgacactgaatgtcggcgacgagttttgtggcgttgtcgcgcacatccagacgccagaggacttcttctgccagcagctacaaagtgggcgaaagcttgctgaactgcaggcctccctgtcaaaatattgcgatcagctgcccccccgaagtgatttctaccccgctatcggggacatctgctgcgcacagttctccgaagatgatcagtggtacagagcctccgtgctggcctatgccagcgaagaatcagtcctagtgggatacgtggactacggaaactttgaaatcctcagccttatgagactgtgcccaatcattcctaaactgctggagttgcctatgcaagccatcaaatgtgttctggctggggtgaaacccagtctaggaatatggactcctgaggccatctgtcttatgaagaaacttgttcaaaataaaatcatcaccgtcaaagtggtcgacaagctcgaaaactcatccctggtggaactgatcgacaagagtgaaacccctcacgtctctgtaagcaaagtactgctcgacgctggcttcgcagtgggggagcagagcatggtcactgataaaccatccgacgttaaagaaaccagcgtgccattaggcgtggaaggtaaggtgaatcccctagaatggacatgggtcgaacttggtgtggaccaaaccgtggacgttgtggtgtgtgtgatttacagtccgggcgagttctactgtcacgtattgaaggaggacgcactgaagaaacttaatgacctgaacaagtccttagctgaacactgtcagcaaaagctccccaatggcttcaaggccgaaatcgggcagccctgctgcgcttttttcgcaggggatggaagctggtacagagctctggttaaagagatcctaccaaatggccacgtgaaggtccacttcgtggattacggcaatattgaggaggtcacggcagacgaactaaggatgatttctagcaccttcttgaacttgccattccaaggcattcgctgtcagctcgctgacattcagagccgcaacaagcattggtcagaggaagccatcacaaggttccagatgtgtgtcgcaggcataaagcttcaggcccgggtggtggaggtgacggagaacggtatcggcgttgaactgacagaccttagcacctgctacccaagaatcattagcgacgtgctcatagacgaacacctcgttctcaaaagcgcctctccccataaagaccttcctaatgatcgactggtaaacaaacacgaactacaagtacacgtccaggggcttcaagctacaagcagcgctgagcagtggaagaccatagagttacccgtggataaaacaattcaggctaacgtgctggaaattatctcacctaatctgttttacgcactgcctaagggtatgcccgaaaaccaggaaaaactgtgtatgttaaccgccgagcttctggagtattgtaacgcacctaagagtcgtcccccgtaccgaccgcggatcggggatgcatgttgcgccaagtatactagcgatgatttttggtaccgtgcggtggtcctgggaacgtccgataccgacgtggaggtcctctatgcagattatggaaatatcgagaccttgcctctgtgtagggtgcagcctattacctcgtcccacctggcactacccttccagatcataagatgttcattggaggagaagatgtataggatgaactgctgctgtaccgaactgcaaaagcaggtcgagaagcacgagcatatactgcttttcctgctgaataactcaactaaccagaataaattcattgaaatgaaaaagctgctaaaaaagacggcctcactgggcggtaaacccctctag

SEQ ID NO: 210202 - DNA, 2154 bp, Artificial Sequence
  Description of Artificial Sequence: Synthetic coding sequence
atgaaccagctgagcgccagcctgaaggagacctacgccaacgtgcacgagaaggactatattcctgtcaaaggggaggtgtgtattgccaagtataccgtcgatcaggccatcaaatgctttgttgcaaacgtgatccctgccgagggaaattggagcagcgattgtatcaaggctactaagccactgcttatggaacagtattgctccataaagatcgtggacattctggaagaagaggtggttaccttcgctgtggaagtggagctgcctaattctggcaagctgctggatcacgtgctgatagaaatgggttacgggctgaaaccctctggccaggacagtaaaaaagaaaacgccgaccagtcagaccccgaggatgttggcaaaatgaccaccgagaataacatcgtagtggataaatccgatcttatacccaaggtactgacgttgaacgttggcgacgaattttgcggcgttgtcgcccatattcagacgccagaggatttcttctgtcagcagttgcaaagcggtcgaaaacttgcggagctccaggcctccttgtccaagtattgcgaccaactgccacccagaagtgacttttatcccgccatcggtgatatatgttgcgctcagttcagcggggtgaagccatcgctgggaatttggactccagaagccatatgtctgatgaaaaagcttgtccagaataagatcatcaccgtgaaagtagttgataagctcgaaaacagttctcttgtcgagctaatcgataagtccgaaacaccacacgtcagcgtcagtaaagtccttctagacgcagggttcgctgtgggagaacagtccatggttacggacaaaccttcagatgtgaaggaaacaagcgtgcctctcggcgtggagggcaaggtgaatcctttagaatggacatgggtagagttgggcgtggaccaaacagtcgatgtggttgtttgtgtcatatactcaccaggagagttctactgtcatgtcctgaaagaagacgccctcaagaagcttaatgacctgaataagagcctcgcggaacactgtcagcagaaactcccgaatggctttaaagccgaaatcggtcagccatgctgtgccttttttgctggggacgggtcttggtacagggcccttgtaaaagagattctgcctaatggtcatgtcaaagtgcattttgttgattatgggaacatcgaagaggtaactgccgacgaactccggatgattagttcgacctttctgaacctgcctttccagggaatacggtgccagttggccgacatccagtcccgcaacaagcactggagcgaggaagcgataactcggttccagatgtgtgtggctggtattaaacttcaggctagggtggtagaggtgacagaaaacggcatcggcgttgagctaacggatctgtcgacttgttacccacggatcatcagcgatgtactgattgacgagcatcttgtgctaaaaagtgcctctccccataaagacttacccaatgaccgattggtcaataagcatgaactgcaggtgcacgtgcagggacttcaggccactagctccgcagagcagtggaagacaattgaattaccagttgataaaacaattcaagcaaatgttctggagataattagtcccaacctcttctacgcattgcctaaaggaatgcccgagaatcaggaaaagctgtgcatgctgaccgccgaactgttagagtactgtaacgcccccaagtcccggccaccttaccgaccgaggattggggatgcctgctgtgctaagtatacgagtgacgacttttggtatagggccgtcgtcttggggactagcgatacggacgtggaggtcctttacgctgattacgggaacatcgagaccctaccactgtgcagggtccagccgatcacctcaagtcacctggccttgcccttccagataatccgctgcagtttggaggaaaagatgtataggatgaactgctgttgcactgagcttcagaagcaagtggagaaacacgagcacattttacttttcctcctaaacaactcaacaaaccagaataagttcatagagatgaagaaactcctcaagaagacagcgtccctgggcggtaagccgctgtag

SEQ ID NO: 210203 - DNA, 1956 bp, Artificial Sequence
  Description of Artificial Sequence: Synthetic coding sequence
atgctgcggctgcagatgaccgacggccacatcagctgcaccgccgtcgagttcagctatatgagtaaaatctcactcaatactccacccgggactaaagtcaaattatctgggatagtggacataaagaatggctttttgctgctaaacgattcaaatacaactgtgctggggggggaagtggagcatttaattgagaaatgggagttacagaggagtctctcaaaacacaaccgttctaatattgggacagagggggggcctcctcctttcgtgccatttgggcagaagtgcgtgagtcatgtacaggtggatagtagggaactggatcggcgaaaaaccttgcaggttacaatgcccgtgaagcccactaatgacaacgacgaatttgagaaacagaggaccgctgccatcgctgaggttgccaaaagcaaagaaacaaaaacttttggggggggcgggggcggggcacggtctaatctgaacatgaatgccgccgggaataggaatcgcgaggtgctgcagaaggaaaagtccaccaaaagcgaaggcaaacacgagggggtttaccgagaacttgtggatgaaaaagccttaaagcacatcactgagatgggtttttcaaaagaggctagccgccaggctctgatggacaatggtaataatctagaagcggcattaaacgtgctgctgacaagcaacaagcaaaagccagttatggggccaccactccgagggcgcggaaaaggacgcggccgcatccgctcggaggacgaagaggatctgggcaacgcacgcccaagcgcaccctcaaccctgtttgatttcctggaatctaaaatgggaactctcaacgtggaggagcctaagagccagccacagcaactgcaccagggccagtatagatccagcaatacggaacagaacggagtgaaggacaataaccatctgcgacacccacctcgaaacgacacgcgccaaccaagaaatgagaaacccccccgattccagcgcgattcccagaattcaaagagtgtgctggaagggtctggactgcctagaaaccgaggaagcgagcgccccagcacctccagcgtctccgaggtgtgggccgaggacagaattaaatgtgacagaccctacagtcgatatgatcggacaaaggatacatcctacccactgggctcccagcattccgacggtgctttcaagaagagagacaactctatgcaatcaaggtcgggtaaagggcctagtttcgccgaagccaaggagaatccacttccccaggggagtgtggactacaacaatcagaaacgtggcaagcgggaatcacagaccagtatcccagattacttctacgaccggaagtctcagacgattaataacgaggccttctcaggaattaagattgagaaacacttcaatgtgaacaccgattaccaaaacccagtgagatcaaactcttttatcggcgttcccaacggagaggtcgagatgcctctgaaaggccgcagaattggccctatcaagcccgcaggaccggtaacagccgtgccatgtgacgacaaaatcttctataacagtgggccaaagcggcggtctggaccaattaaacccgaaaagatcttggagtctagcattcctatggagtacgctaaaatgtggaagcctggggacgagtgctttgctttgtactgggaagataacaaattttacagggcggaggtggaagcccttcattcgtccggcatgaccgctgtagtgaaattcatcgactacggcaattatgaggaggtcctgctttcaaacatcaaaccaattcaaacagaggcatgggaagaggaaggcacttacgatcagactctggagttcaggagaggaggagatggccagccacgacgctccaccaggcctactcaacagttttaccagccaccaagagccagaaactag

SEQ ID NO: 210204 - DNA, 1956 bp, Artificial Sequence
  Description of Artificial Sequence: Synthetic coding sequence
atgctgcggctgcagatgaccgacggccacatcagctgcaccgccgtagaattttcctacatgagtaaaatcagcctgaatactccgccaggtacgaaggtaaagctgtcagggattgtcgacatcaaaaatgggtttcttctcctcaatgattctaatactacggtcctggggggcgaggtagagcacctcatcgagaaatgggagctgcagagaagtctgtccaagcataaccgttcgaacatcggaacggagggcgggcctccaccattcgtgccattcgggcagaagtgcgtctcccatgttcaggtcgacagccgagagttggacaggagaaaaacattacaagtgactatgcctgtgaagcccaccaatgacaatgatgagtttgaaaagcaacgaaccgcggctattgctgaagttgctaagtccaaggagacaaagacatttggcggcggcggcggaggtgcacggtcgaatctgaacatgaatgctgcaggaaatagaaatagagaagtgttacagaaggagaagtctacaaagtcagaaggcaaacacgaaggagtctatagagagctagtagacgagaaggccctgaaacatatcaccgagatggggttcagcaaggaagctagtcgacaagctttgatggacaatgggaacaaccttgaggccgcactgaacgtccttctgacttcaaacaagcaaaagcctgtgatgggaccccccctgcgtgggcggggcaaggggcggggtcggatccggagtgaagatgaggaggacctcggcaatgccaggcctagcgctcctagcaccttgttcgattttctggaaagcaaaatgggaacgctcaatgtagaggagccaaaaagccagcctcagcagctgcaccaggggcagtacaggtcctcaaacacagagcaaaacggggttaaggacaataaccacttgagacaccccccaaggaacgacaccagacaaccgcgaaacgaaaagccaccccgttttcagcgagactcccagaactccaagtctgttttagagggctccggactgcctcggaaccgcggctccgagagaccatcaacctccagcgtctccgaggtatgggcagaagacaggatcaagtgtgaccggccttatagcagatacgacagaactaaagacacctcctaccctctggggtcacagcatagcgacggtgcgttcaagaagagggacaattcgatgcagtcacgcagcggaaaagggccatcatttgcagaggccaaagagaatccactcccccaggggagtgtggactacaacaaccagaaacgaggaaagcgtgagtcacagacttccataccggactatttctacgatagaaagtcccagaccattaataatgaggccttcagcggcataaaaattgagaaacatttcaatgtgaacaccgattaccaaaaccccgtccggtcaaacagcttcatcggcgtacccaacggggaggttgaaatgccgctgaagggccgcaggattggtcccattaaacccgcggggccagtgacagcagtaccctgtgacgacaagattttttataattcaggcccaaagcgcagaagtggacctattaaaccagaaaaaatcctggagtcttctatacccatggaatacgcaaaaatgtggaagcccggagatgaatgctttgcattgtactgggaagataataaattctacagagctgaagtggaggcactgcacagcagcggcatgaccgctgtagtgaagtttatagattacgggaactacgaggaggtgctcttaagcaatattaagccaatacagaccgaagcttgggaggaggagggaacatatgaccagacgctggaattcagaagaggcggggacggtcagccacgccggtccaccagacccacgcagcaattttaccagcccccgcgtgccaggaactag

SEQ ID NO: 210205 - DNA, 390 bp, Artificial Sequence
  Description of Artificial Sequence: Synthetic coding sequence
atgctgcggctgcagatgaccgacggccacatcagctgcaccgccgttgaatttagttatatgtctaaaatctccctgaacaccccgccgggaaccaaagtgaagctctctggtatcgtggacatcaaaaacggatttctactgctaaacgactcaaatactactgtattgggaggggaggttgagcatctgattgaaaaatgggagctgcaacgatctctctctaagcataatagaagcaacatcggcaccgaggggggcccacctcctttcgtcccctttggccagaaatgtgtctcccacgtgcaggtcgacagcagagagctggatcgtcgcaagaccctccaggtgacgatgcccgtgaaacctacaaacgataatgacgagtag

SEQ ID NO: 210206 - DNA, 1956 bp, Artificial Sequence
  Description of Artificial Sequence: Synthetic coding sequence
atgctgcggctgcagatgaccgacggccacatcagctgcaccgccgtggagttttcatacatgtccaagatatctctcaacaccccccctggaacgaaggtcaagcttagcggaatagtggatatcaagaatggcttcctcttgctgaacgacagcaataccacagtgctgggcggggaggtggagcacttgattgagaagtgggaattgcagcggagcctttctaagcacaacagatccaacatcgggacggagggtggaccgcctccttttgttcctttcgggcagaagtgtgtgtcacatgtgcaagttgacagtcgtgagctcgaccgacgcaagaccttgcaagtcacaatgccagttaagcccactaacgataacgacgaatttgagaagcaacgcacagctgcaattgccgaggtcgcgaaaagtaaagaaaccaagactttcgggggcggcggcggaggagcccggtctaacctgaacatgaacgccgccgggaaccgcaatcgcgaggtgctgcaaaaagagaaaagtaccaaaagtgagggaaagcacgagggggtgtatagagaactggttgacgagaaagctttgaagcatattactgagatggggttcagtaaggaggccagtcgccaggccctcatggacaacggcaataatctggaagcagccctgaacgtcctgctaacgtcaaacaagcagaagccggtgatggggcctcctctgaggggcagaggcaagggcaggggccgaatcaggtccgaggatgaggaggatctgggaaacgctcgaccctcagcgccctcaacattgtttgacttcctggaatcaaaaatgggtaccctgaacgtagaagagccgaaatcccagccccagcagctccaccagggccaataccggtctagtaatacagaacagaacggcgttaaggacaacaatcacttgcggcatccacctcggaatgatacaaggcaaccgcgcaacgagaagcccccccggttccagcgcgacagtcagaactccaagtctgtcctggagggcagcgggctgccccgtaatagaggatcggagcgcccttctacctcttctgtgagcgaggtgtgggctgaagataggattaagtgtgacagaccctattccaggtatgaccgcaccaaggatacatcctaccccttaggtagtcagcactccgatggggccttcaagaaacgggataactccatgcagtccaggagtggcaagggaccgtccttcgccgaagctaaagagaaccccctaccgcagggaagcgtcgactataataatcagaagcgcggtaagagggaatcccagacttccatcccggactacttctatgaccgaaagagccagacaatcaataacgaggccttcagcggcatcaaaattgagaagcacttcaatgtcaatacagactatcaaaatcccgtcaggagcaattccttcatcggtgttcctaacggtgaagtggagatgccacttaaggggcgcaggattggccccattaaaccagcgggccccgtgactgcagttccctgtgatgataaaattttctataactccgggcctaaacgtcggagtggaccaataaagcctgaaaagatcctcgagtcctccattccaatggaatatgcaaaaatgtggaagcctggagatgaatgcttcgctctctactgggaggataacaagttctacagagccgaggtcgaagctctgcattccagcgggatgacagcagtcgtcaaattcatagattacggaaattatgaggaagtcctgcttagtaacataaaacctatccaaacagaagcatgggaggaggagggaacctacgatcaaactctcgagtttagacgtggcggagatggccagccacgcaggtcaaccagaccaacccagcagttctaccaaccgcctcgcgcccgcaactag

SEQ ID NO: 210207 - DNA, 2235 bp, Artificial Sequence
  Description of Artificial Sequence: Synthetic coding sequence
atggcccaggtggccggcgccgccctgagccaggccggctggtacctcagcgacgaaggtatcgaagcctgtacctctagtccagataaagtgaacgtcaacgacattatattgatcgccttaaatacagacttgaggactattgggaaaaaattcttgccgagtgatatcaactcgggaaaagtggagaaattggagggtccctgcgtcctccagatccagaagattcgtaacgttgctgctcctaaggataatgaggaaagccaggccgccccacgcatgttgcgcctacagatgacggatggacacataagctgtactgccgtggagttctcttacatgtcgaagatttcattaaacacccctcccggcactaaagttaaactgtccggcatcgtcgatattaaaaacggtttcctgcttctgaacgatagcaacaccaccgtgctgggcggggaggtagaacatctgatcgagaaatgggagctacagcgaagccttagcaagcataatagaagtaatataggcacagagggtggacctcctcctttcgtgcccttcgggcagaagtgcgtttcccacgtgcaggttgactccagggaactggacaggaggaagaccctacaggtgaccatgcccgtgaaacctacgaacgataatgatgagtttgagaagcaacggacagcggcgattgctgaagtggcaaagagcaaggagaccaaaacatttggaggcggcggagggggtgctaggtctaatctcaacatgaacgccgcaggaaatcggaacagagaggtcctccagaaggagaagtctaccaagtctgagggcaagcacgagggcgtctatcgagagctcgttgacgagaaggcccttaagcacatcactgagatggggtttagcaaggaagcgtctaggcaagccctcatggataacggtaacaacctcgaggcagcactgaacgtcctgttgacctccaacaagcagaaacccgtgatgggcccacctctccggggaaggggtaaagggcgtggcagaattcggagtgaggacgaagaggatttaggcaacgcaagaccttctgctccatccaccctctttgattttctcgaaagtaaaatgggtaccctgaatgtcgaggagcccaagtcccagccacagcagctgcaccagggccaataccgatccagcaacacagaacagaatggtgtgaaagataacaaccacctcaggcaccccccccgcaatgacacgagacagcccaggaatgagaagccaccgcgattccagagagatagccaaaattctaaaagcgtgctggaaggtagtggtctcccgcgtaataggggatccgagagaccttctacatcctctgtgtccgaagtgtgggctgaagataggataaaatgcgacaggccttattcccgctatgatcgcaccaaagatacttcataccccctcggttcacagcacagcgatggagcctttaagaagagggacaatagcatgcagtctagatccggtaaaggaccatccttcgccgaagccaaagaaaatcctctccctcaagggagtgtcgactacaacaaccagaaaaggggtaaaagagagagtcagacaagcattccagactacttttatgaccgaaagtctcaaaccattaacaacgaagcattctcggggataaaaatcgagaagcactttaatgtcaataccgactatcagaaccccgtgaggagtaatagctttattggcgtccctaatggtgaagtggagatgccactcaaagggcggcgcatcgggcccataaaaccagccggccctgtgaccgctgtaccatgcgatgataaaattttctacaattccggccctaagcgccggagcgggccaatcaagcctgagaaaattctcgaatcctcaatcccaatggaatatgctaaaatgtggaagccaggggacgagtgcttcgccctgtactgggaggataacaagttttacagggctgaggttgaggctctgcactcctcaggcatgaccgcagtggtcaaattcattgactatggcaattacgaggaggtccttctgagcaatatcaaacccattcagaccgaggcctgggaggaggaaggaacttacgaccagaccctggaattcagacgcgggggagacgggcagcctcggcggtccacaaggccaacgcagcagttctaccaaccgcccagggccagaaattag

SEQ ID NO: 210208 - DNA, 3297 bp, Artificial Sequence
  Description of Artificial Sequence: Synthetic coding sequence
atgctggagggcgacctggtgagcaagatgctgcgggccgtgctgcaaagccataagaacggcgtagcgctgccccggcttcaaggagaatatagatccttgaccggcgattggatcccattcaagcagctgggcttccccaccctggaagcctacctccgctcggtacctgctgtggtgagaattgagaccagccgctcaggagaaatcacctgttatgcgatggcctgtaccgaaaccgccagaatagctcagctcgtggcacgacagcggagcagcaaacggaaaaccgggcgccaggtaaactgccagatgcgcgtcaaaaaaactatgccattctttctcgaagggaagccaaaggcaacgctgcgtcagcctggattcgccagcaatttctctgtgggtaagaaacccaaccctgctcctctgcgcgataaaggcaatagtgtgggggtgaagcctgacgcagagatgtctccctatatgctccacactaccctcggaaacgaagcatttaaagacatccctgtgcagagacatgtgacaatgtcaacgaacaacaggtttagtccgaaagcaagcctgcagcctcctctgcaaatgcacctcagcagaacatctactaaggagatgagcgataacctgaaccagaccgttgagaaacccaacgttaagcctccagcctcttatacatacaagatggatgaagttcagaatcgtattaaagagattcttaacaagcacaataatggtatctggatctccaaactgccacacttttataaagagctttataaggaagacctcaaccaaggcattctgcagcaatttgaacattggccacatatatgcacagtcgagaaaccctgctctggaggccaggatctcctgctgtatcctgccaagcggaagcagctgctccgatccgaattggatactgaaaaggtgcctctatcccccctcccggggcctaaacagactcctcctcttaagggatgtccaactgttatggcaggcgattttaaggagaaggtggccgatttgctagtgaaatatacaagcggactctgggctagcgctctccctaaggcctttgaggaaatgtataaagttaagttccctgaagatgcgctgaagaacctcgcttcactgagtgacgtctgctcgattgattatataagtggtaatccccaaaaggctatcctctacgccaagcttcccctgcctacagataagattcaaaaggatgcgggccaggctcacggagacaatgacattaaagctatggttgagcaggagtatttgcaggtggaggaaagcatcgcagagtctgctaacacctttatggaagacattactgtgccacctttgatgatcccaacagaagctagtcccagcgttctggtggtggaactaagtaacaccaacgaagtggtgattcggtacgttggcaaggactatagcgctgctcaagaattaatggaagatgagatgaaggagtactattcgaagaatcccaaaatcactccagtacaagctgttaacgtgggccagctgctggctgtcaacgccgaagaagacgcctggctacgggcgcaggttatatccaccgaggagaacaagattaaagtctgttacgtggattatgggttctcagagaacgtcgagaaaagtaaagcttataagcttaaccctaaattttgtagtcttagtttccaagcaacaaagtgcaagctcgcaggactcgaggtgctgtccgatgacccagacctggtcaaggtggtcgaatcactgacttgcggtaaaatcttcgccgtggagatcctggacaaggccgatatcccactggtcgtgttgtatgacacgtccggggaggacgacatcaatattaatgctacatgcttaaaagcaatctgcgacaagtccctggaagtccacctacaagtggatgcaatgtacacaaatgtgaaggtcacgaacatctgctccgacggaacgctatattgccaagtgccatgtaaggggctgaacaaattgtcggatctgctccgcaagattgaagattacttccattgcaaacatatgaccagcgagtgctttgttagcctccccttctgtggaaaaatttgccttttccattgtaaaggaaaatggttgcgcgtggaaatcacgaatgtccacagttcccgcgcgctcgacgtgcaattcctggattccggcacggtgacaagtgtcaaggtaagtgagcttagagagatcccaccgcgcttcctgcaggaaatgattgccatccccccacaggcgattaaatgctgtctcgcggatttgccgcagtccatcggcatgtggacgcctgacgctgtgctatggctgcgggattccgttctgaactgctccgattgcagcattaaagtcacgaaggtggacgaaacccgggggatagcccacgtataccttttcacacctaagaacttccccgacccccaccgcagcatcaataggcagataacaaacgccgatctttggaaacaccagaaggacgtctttctgtccgcaatctctagcggggccgattcgccaaattccaaaaacggaaatatgcccatgagtggcaacactggagagaacttccggaaaaatcttactgatgtcatcaagaaatcgatggtagatcatacttccgctttcagtactgaggaactgcccccacccgtacaccttagtaagcccggcgagcatatggatgtttatgtcccggtcgcttgccaccctggttatttcgtgatccaaccatggcaggaaattcataaacttgaggtgctcatggaggagatgattctgtactattctgtgtcagaggagcgccacattgccgttgaaaaggaccaggtttatgctgccaaagtcgagaacaagtggcaccgggtgctgctgaagggtatcctaactaatggcttggtgtctgtgtatgagttggactacggaaaacacgagctcgttaatatccggaaggtgcagcccttagtggatatgtttcgcaagctgcccttccaagccgttacagcacagcttgcgggcgtcaagtgtaaccagtggtccgaggaagcttctatggtgtttagaaatcacgtagagaaaaaacctttggtcgctcttgtgcagacagtcatcgagaatgcgaatccctgggatagaaaggtggtggtgtatctcgtcgatacttcactgccagacaccgatacatggatccatgatttcatgagcgagtatttgatcgagttgtcgaaagttaattag

SEQ ID NO: 210209 - DNA, 3075 bp, Artificial Sequence
  Description of Artificial Sequence: Synthetic coding sequence
atggcctgcaccgagaccgcccggatcgcccagctggtggcccggcagcggagcagcaaacgcaagactggccgccaggtgaattgccagatgcgagtaaagaaaaccatgcctttcttcctcgagggcaagcctaaggccaccctaagacagccgggattcgcatccaacttttctgtgggcaagaaaccaaatcccgccccactgcgcgataagggaaactccgttggcgttaaaccagacgccgaaatgtcaccttatatgttgcacaccactctcggcaatgaagcctttaaggacattcctgtgcagaggcacgtgacaatgtctacaaacaatcgctttagtcctaaggctagtcttcagccacctttgcagatgcacctctcccggaccagcacaaaagagatgtccgacaatcttaaccagactgtggaaaagcccaatgttaagccccccgctagctatacttacaagatggacgaggtgcagaacaggattaaggagattctgaacaagcataataatggcatatggatctctaaattgccacatttctacaaagaactgtacaaagaggatcttaaccagggaatactgcagcagtttgagcattggcctcatatttgcactgtggagaagccctgctctggtgggcaggatttgctcctctacccggcgaagaggaagcaattactgcggagcgagttggacacagaaaaagtccccctgtctcccctgcccggccctaagcaaactccccctttaaagggttgcccgaccgtgatggccggagatttcaaagaaaaagtagcagacctgctagtaaagtatacctcgggcttgtgggctagtgcactgccaaaggccttcgaagagatgtataaggtcaaattcccagaagatgccctgaaaaatctcgccagcctgagtgatgtttgctctatagactatattagcggtaatcctcagaaggctatcctgtatgcgaagctgccactacctacagataaaattcagaaagacgctggccaggcccacggggacaatgacataaaggccatggtcgaacaggaatatcttcaggtggaagagtctattgcagaaagcgctaacacattcatggaggacattacggtgccccccttgatgataccgacggaggcttctcctagcgttttggtggtcgaactgtccaatactaacgaggtggttattagatacgtagggaaagactactctgctgctcaggaactgatggaagacgagatgaaggagtactactcaaagaaccccaaaattacgccggtacaagccgtaaacgtggggcagttgcttgctgtgaatgcagaagaggacgcctggttacgagctcaggtcattagcaccgaggaaaataagataaaggtgtgttacgtggattatggatttagcgagaacgtagagaaatctaaggcttacaaactgaatcctaaattctgctccctcagcttccaggccacaaaatgcaagttagcaggcttagaggtgctgagcgatgatccagacctggtgaaggtggtggaatctctaacctgcggcaaaattttcgccgttgaaatcctggacaaagcggacatcccactcgtggtattatatgatacctccggggaagacgatatcaacatcaatgccacatgtctgaaagcgatatgcgataaatctctggaagttcatctgcaggtcgacgccatgtacaccaatgtaaaagttacaaacatctgctccgacggtaccctgtattgtcaggtaccttgtaagggcctgaataagctaagcgatttactgcggaaaatagaagattactttcactgcaagcacatgacttccgaatgctttgtgtctctccccttctgcggcaagatctgtctatttcattgcaagggcaaatggcttagggtcgagataacaaatgtgcattcttctcgtgccctggatgtgcagttcttggattcagggaccgtcacaagcgttaaagtatctgaattacgtgaaattcctccgcgttttctacaggagatgatagccattccgcctcaggcgataaagtgttgcttggccgacctaccccagtctattgggatgtggacacctgatgcggtcctgtggttacgcgacagcgtgctgaactgctcggactgctcgatcaaggtgacaaaggtcgacgaaactcggggaattgcccacgtttatctgttcacaccaaagaatttccctgacccccacaggagcatcaatagacagattactaacgccgatctttggaagcaccagaaagatgttttcctgtctgcaatctctagcggcgccgattctcccaactctaaaaacggcaatatgcccatgtcaggtaatactggagaaaactttaggaaaaatctcacagatgtgattaagaagtctatggtagatcatacctccgcgttctcaacagaggagctccctccaccagtccacctatcaaagcccggtgaacacatggacgtttatgtgcctgtcgcttgccatcctggttacttcgtcatccagccttggcaggaaatccacaagctggaggtcctcatggaagaaatgatcttgtattatagcgtgagcgaggagcgccatattgccgtggagaaggaccaagtatacgcagcgaaggttgaaaataagtggcacagagtcctgcttaaggggatcttgaccaatggcctcgtcagcgtttatgaactcgactacggaaagcatgaactcgtgaatatcagaaaggtgcagcctctggttgacatgttcaggaagcttccattccaggcagtcaccgcccagctggccggagttaaatgcaatcagtggtcggaggaggccagtatggtttttcgcaaccatgtggaaaaaaaaccactggtggcgttggtccaaaccgtgattgaaaacgctaacccttgggacaggaaggtcgtggtgtatctagttgacacctcactcccagatactgacacatggatccacgattttatgtcggagtatttgattgagctttccaaagtgaactag

SEQ ID NO: 210210 - DNA, 1257 bp, Artificial Sequence
  Description of Artificial Sequence: Synthetic coding sequence
atgtacaccaacgtgaaggtgaccaacatctgcagcgacggcaccttgtattgccaagtgccgtgtaaaggattgaacaagctgagcgaccttctgaggaaaatcgaggactactttcactgtaaaatcaccaacgtacatagctcccgggctctggacgtgcagttcctggattccggcactgtaacaagtgttaaggtttcagagctgcgcgagatcccaccacgcttcctacaggaaatgattgcaatccctccgcaagctatcaaatgctgcttagctgatttacctcaaagcataggcatgtggacccccgacgctgttttgtggctgagagactcggtgttaaattgctcggattgttctataaaagtcactaaggtggacgaaacacgaggtatcgcccacgtttatttgttcacacctaaaaacttccctgacccacacagaagtatcaacagacaaattaccaacgccgacctttggaaacatcagaaggacgtgttcctgagcgctattagctctggggccgacagtccgaacagcaagaatgggaacatgccgatgagcggtaatactggagagaactttagaaaaaacctgacagacgtgattaagaaatccatggttgaccatactagtgcctttagcaccgaggagctgcctccgcctgtccatttgagcaagcccggggaacatatggacgtttacgtaccagtggcatgccaccccggatactttgtcattcaaccttggcaggagattcataagctggaggttctcatggaggagatgattctatactattcggtgtctgaggaaagacatattgctgtagaaaaggatcaggtctacgccgccaaagtggaaaataaatggcacagggtgcttctgaagggaatcctcaccaatggactggtttccgtctacgagctcgactacggtaagcacgagctggttaacattaggaaggttcagcctcttgtggacatgtttcggaagctcccctttcaagccgtgacagcccaactggcgggggtgaaatgtaaccaatggagtgaggaagccagcatggtctttagaaaccatgttgagaagaagccactggtggccctggttcagaccgtcattgaaaatgccaacccttgggatcggaaggttgtcgtctatctcgtggacacctcattgcccgacactgatacatggatccatgacttcatgtccgagtatctgatagagctgtctaaagtgaactag

SEQ ID NO: 210211 - DNA, 2514 bp, Artificial Sequence
  Description of Artificial Sequence: Synthetic coding sequence
atgagcctgagccacctgtaccgggacggcgagggccggatcgacgatgacgatgacgaaagggagaatttcgagatcacagactgggacctgcagaatgagtttaatccaaaccgacagagacactggcagacaaaggaggaggccacctacggcgtttgggcagagcgtgactccgatgacgagcgaccctcttttggcggcaagcgcgcacgggactacagtgctccggttaattttattagtgcaggcttgaaaaagggcgcagcagaggaggctgagcttgaggattccgatgatgaggagaagccagtgaagcaggacgattttcctaaggacttcgggccaagaaagttaaaaacaggcggaaatttcaaaccctctcagaaggggttcgctggtggtacaaaatcgtttatggacttcggttcatgggagagacatactaagggaattgggcagaagctcctgcagaaaatgggctacgttcccggcagggggttggggaaaaatgcgcaggggatcattaacccgattgaagccaagcagcggaaaggcaaaggcgcagtgggcgcttacgggtccgaacggacaacgcagtcgatgcaggacttccctgtggtggactctgaggaggaggcggaggaggaattccagaaggaactttctcagtggcgcaaggacccaagtggatcaaaaaagaaacctaaatacagctataaaacagtagaggagctgaaggccaagggcaggatctccaagaaattgacagctccacagaaggagcttagccaagttaaggtcattgatatgaccggccgtgaacagaaggtttattacagctactcccagatctcgcataagcataatgtcccggacgacggcttacccctccagtctcagcagttgccacagtctggcaaagaggctaaggctcctgggttcgctctgcccgagttagagcacaacctccagctgctgatcgacttgacagagcaagaaataatacaaaatgatcggcagctgcagtacgagagagatatggtcgtcaatctctttcatgagttggaaaaaatgactgaagttttagatcacgaggaacgtgtgatctcgaatttgtcgaaggtgttggaaatggtggaggagtgtgaacgcagaatgcagcccgactgttctaatcccctgacactggacgagtgtgctaggatcttcgaaaccctgcaggacaaatattacgaggaatatcgaatgagcgaccgagttgatctggccgttgctatcgtttaccccctgatgaaagagtactttaaagaatgggatccactcaaggattgcacttacgggaccgaaatcatatccaaatggaaaagtttgcttgagaacgatcagttactgagtcatgggggacaggatctctcagcagatgccttccacagactcatctgggaagtgtggatgccgtttgtcaggaacattgtgacccaatggcagccgagaaactgcgatcctatggtggattttttggatagctgggtccatatcataccagtgtggatactggacaacattctggatcagcttatttttcctaagctccaaaaggaggttgaaaattggaacccactcaccgacaccgtcccgatccattcttggatccatccctggctgccattgatgcaagcacggctggaaccgctgtacagcccgatccgatccaagctttcatcagcactgcagaagtggcatccttctgatagctccgccaagctgatcctgcagccatggaaagacgtctttacccccggatcatgggaagcttttatggtgaaaaacattgtgcccaaactcggcatgtgtttgggcgagctcgttatcaaccctcaccaacaacatatggacgcgttctactgggttatcgattgggaaggaatgatttccgtctccagcctcgttgggctactggagaaacattttttccctaaatggctgcaggtcctttgttcctggcttagcaatagccccaactacgaggaaattaccaagtggtacctgggctggaagtcaatgttctcagatcaggtgttagctcacccatcagtgaaggacaagtttaatgaggccttggacattatgaatcgcgcagttagctcaaatgtaggagcttacatgcagccaggtgcccgcgaaaatattgcttatctaacacacaccgaaagacgaaaggattttcaatatgaggccatgcaggaacggagggaagcggaaaatatggcccaaaggggaataggggtcgcagcttcttcagtacctatgaacttcaaagacttgatcgaaacaaaagccgaggagcataatatcgtgtttatgcctgtgatcggtaaacgacacgaaggcaagcagctctataccttcggccgaatcgtaatttacatagatcgcggcgtggtatttgttcagggagagaagacctgggtgcctacctccctacagtctctcattgatatggccaagtag

SEQ ID NO: 210212 - DNA, 2514 bp, Artificial Sequence
  Description of Artificial Sequence: Synthetic coding sequence
atgagcctgagccacctgtaccgggacggcgagggccggatcgacgacgacgatgatgagcgcgagaacttcgagataacggactgggatcttcagaatgaattcaaccctaatagacaacggcactggcagacgaaagaggaggcaacctatggggtgtgggccgaacgcgattccgatgacgagcgaccttccttcggagggaagcgagctcgagactacagtgcacctgtcaacttcattagcgctggtttgaagaaaggggccgccgaggaggcggaactcgaagattccgacgatgaggagaagcccgtgaagcaggatgactttcccaaggacttcggccctaggaaactgaagactgggggcaacttcaagcccagtcagaagggcttcgccggtggcacaaagagttttatggacttcggctcctgggaaagacatacaaagggcatcggccagaaactgcttcagaaaatgggctatgtgcccgggaggggcctgggcaaaaatgctcaaggaataatcaatcccattgaggctaagcagcgcaagggcaaaggagcagtcggggcttacggaagcgaaagaacgactcagagcatgcaggatttccccgttgtggatagcgaagaagaagcagaagaggagttccaaaaagaactgtcacagtggcgaaaggatcccagcggatccaagaaaaagcctaagtacagctataagaccgtcgaagagctgaaggcaaaaggccgaatctctaaaaagctgactgccccccagaaggaactatcccaggttaaagtgatcgacatgaccggtcgggagcagaaagtgtactattcatactcccagattagtcataagcacaacgtgccagatgatggccttccgctgcagagtcaacaactgcctcagtctgggaaggaggccaaagcacctggatttgccctgcccgagctggagcacaatttacagctgctgatcgatctaactgagcaggaaattattcagaacgatagacagttacagtacgagcgggatatggttgtcaacctcttccacgaactcgagaagatgacagaagtcttagatcatgaggaacgcgtgatctcaaatctaagcaaagtactggaaatggtcgaagagtgcgagagaagaatgcagcccgattgtagcaatccgctcactctcgacgagtgcgcgaggattttcgagacattgcaagataagtattacgaagagtaccgtatgagtgaccgggtggaccttgcagtggccatcgtctatccattgatgaaggaatacttcaaggagtgggatcccctgaaagattgcacctacggcactgagattatctcaaaatggaagtccttgttggagaacgatcagctgcttagccacgggggccaagacctgagcgctgacgctttccatagacttatctgggaggtgtggatgccatttgtcagaaatattgtgacacagtggcagccccgaaattgtgatccaatggtggattttctcgacagctgggtccatatcatccctgtctggattctagataatatcttggatcaactgattttccccaagctgcagaaagaggttgaaaactggaatcccctgacagataccgttccaatccattcttggatccacccctggctgcccctgatgcaggctcgcctggagcctttgtattccccgattagatcaaagctgagctccgccctacaaaagtggcacccttccgacagctcggcaaaactgatcctccaaccctggaaggatgtcttcacccctggctcatgggaggcgttcatggtcaagaatattgtccctaagctcgggatgtgcctaggcgagcttgtgattaatcctcatcagcagcatatggacgccttctactgggtcatagactgggagggcatgatctctgtgtctagtctggttggattattagaaaaacattttttcccgaaatggctccaagtgttgtgtagttggctttccaactctccaaattatgaagaaatcactaagtggtacctgggttggaagtctatgttcagcgatcaggtccttgctcatcctagcgtcaaggataagttcaatgaagccctcgatataatgaaccgggccgtctctagtaatgttggtgcctatatgcagccgggcgctcgggagaatatagcctacctgacacacaccgaacggagaaaggatttccagtacgaggccatgcaggagcgcagagaggccgaaaatatggcccagcggggcatcggcgtcgctgcgtccagtgtgcctatgaatttcaaagacctgatcgaaacaaaggccgaagagcataacattgtgttcatgccagttattggcaagcggcatgaagggaagcagctgtacacatttggtaggatagtaatatatattgacagaggggttgttttcgtccaaggagagaaaacctgggtgcctacttcacttcagtctctcattgacatggcaaaatag

SEQ ID NO: 210213 - DNA, 2514 bp, Artificial Sequence
  Description of Artificial Sequence: Synthetic coding sequence
atgagcctgagccacctgtaccgggacggcgagggccggatcgacgacgacgatgacgagagagagaattttgagataaccgactgggatctgcagaatgagtttaaccctaatcggcaacgtcactggcaaaccaaagaagaagccacttacggggtctgggccgaaagggactcggatgacgagcgcccctcattcgggggcaagagggcacgagattacagcgcccccgtgaatttcattagcgctggcctgaaaaaaggcgctgctgaggaagctgagctggaagactcagacgatgaagagaagcccgtcaagcaggatgatttcccaaaagattttggcccacgcaaacttaaaaccgggggaaattttaaacctagtcagaagggctttgcaggcggaacgaaaagctttatggattttggcagctgggaacgccataccaaaggcattggacagaaactcttgcagaagatggggtatgttcctggacgaggattggggaagaatgcacagggcatcatcaaccctatagaggccaagcaacgcaagggtaagggcgccgttggcgcatacggcagcgaacggacgacccaatccatgcaggacttcccagtggttgatagcgaagaagaggccgaggaagagtttcaaaaagaactcagtcagtggagaaaggatcctagcgggtccaagaaaaagcctaagtatagttacaagacagtggaggaactcaaggccaagggaagaatatccaaaaaactcacagctccacagaaagaattgtcacaggtcaaggtgatcgacatgactggcagggagcagaaggtgtactatagctattctcagataagccacaaacataatgttcctgatgacggcctgccactccagtctcagcagctgccccaaagcggaaaggaagccaaggctccgggcttcgcactgcccgagctagagcacaatttgcagctgttgatagatctgactgagcaggaaatcattcagaacgatagacagctgcagtatgagagagatatggttgtgaacctgttccacgagctggagaagatgactgaggtcctcgaccacgaggagcgagttatttccaacctgtctaaggtgctggagatggttgaggagtgcgagcgtcgaatgcaacctgattgctctaaccctctgactctggacgagtgcgcccggatttttgagacacttcaggacaaatactatgaggaataccggatgtcagaccgggtggatctggcggtcgccattgtttaccccctcatgaaagaatacttcaaggagtgggatccgctgaaggactgtacctacgggactgaaataatttctaagtggaaatcacttctggagaatgaccaactgctgtcccatggcggacaggacctgagcgccgatgcctttcacagactgatttgggaggtgtggatgccattcgtgcggaacatagttacacagtggcagccaaggaactgcgatcctatggtcgactttctcgattcttgggtccacatcatccctgtctggatccttgataatatcttggaccagcttatctttcccaaactgcagaaagaggttgagaactggaacccgctgacagatacagttccgatccactcatggatccacccttggctacctctgatgcaggcccggctggagcctctgtactcccctataaggagcaagttgtcgtccgcattgcagaagtggcacccatcagactcctccgcaaagctgattctgcaaccctggaaggacgtgttcaccccaggctcctgggaggctttcatggtgaagaatatagttcccaagcttggtatgtgcctgggagaactcgtgattaatccgcaccaacaacatatggacgccttctactgggtcattgactgggaaggtatgatctccgtgagcagtctggtgggactcctggaaaagcacttcttccccaaatggttgcaagtgctgtgctcttggctgagcaatagcccaaattacgaggaaattacgaagtggtatcttggctggaagtcaatgttctcggaccaggtgctggcacacccttccgtgaaagataagttcaatgaagctcttgatatcatgaatcgcgcggtgtcaagcaatgtgggagcctacatgcaacccggggcacgcgagaatatcgcctacctgacgcatacagaaagaagaaaggacttccagtacgaagctatgcaagaaaggagagaagcggagaatatggcccagcgcggaatcggtgtagcggcttcgtctgtgccaatgaacttcaaggatcttatcgagacaaaagctgaagagcacaacattgtatttatgcccgtgatagggaagaggcacgaaggcaagcagctttatacattcggccgtatcgtcatatacattgacaggggcgttgtgtttgtgcagggagagaagacatgggtgcccacctccctgcaatccttgattgacatggccaagtag

SEQ ID NO: 210214 - DNA, 2514 bp, Artificial Sequence
  Description of Artificial Sequence: Synthetic coding sequence
atgagcctgagccacctgtaccgggacggcgagggccggatcgacgatgacgacgacgagagggaaaactttgagattacggactgggacctccagaacgaatttaaccctaacaggcagcgtcactggcagaccaaagaagaggccacatacggagtatgggctgagagggactctgacgatgagcgccccagtttcggcggaaagcgagctagggactacagcgcaccagtgaattttatttcagctggtcttaagaaaggagcggccgaggaagcggagctggaagatagcgacgacgaagagaagcccgtgaaacaggatgatttcccgaaagattttggtcctagaaaactgaagaccggcggtaatttcaaacctagccaaaagggcttcgccggaggcacaaagtcatttatggacttcggaagctgggagcggcatacaaagggtatcggccaaaaactgttgcagaagatgggttatgttcctgggaggggactaggcaaaaacgcccaaggtataattaacccaattgaggctaaacaacgcaaaggtaagggcgcagtgggggcctacggaagtgagagaaccacacagtctatgcaggacttcccagtggtggattcagaggaagaagcagaggaggagttccaaaaggagctctcccaatggcgaaaagacccatccggcagcaaaaagaagccgaagtatagctacaagaccgtggaggagctaaaagctaagggacgaatttctaagaagcttaccgcaccccagaaagagctctctcaggtaaaggtaatcgacatgaccggtcgagagcagaaggtttattattcttacagccaaatctcacacaaacacaacgtgcctgatgatggactccctctccaatcgcagcagctgcctcagtccggaaaggaagctaaggcccctggtttcgccttacctgagctggagcataacctgcagctcctgattgatttaactgagcaggagattatccagaacgacagacagctgcaatacgagagggatatggtcgtgaatcttttccacgagttagaaaagatgacagaagtgctagaccatgaagaaagggtgatcagcaatttgagcaaagtgcttgagatggtggaggagtgcgagaggcgcatgcagccagattgctcgaaccctcttacattagacgagtgtgctcggattttcgagacgctgcaggataagtactatgaagagtacaggatgtctgatagagttgacctggctgtggcaatcgtgtatcccctgatgaaggaatatttcaaagagtgggacccacttaaagattgtacatacgggactgagatcatctccaagtggaaaagtctgcttgaaaatgatcagctgttgagccatggaggacaagatctgagcgccgacgcttttcacagattgatatgggaggtttggatgcctttcgtcaggaacattgtgactcaatggcaaccacggaactgcgatcccatggtggacttcctggacagctgggtacatattatccccgtctggatactagataacatcctggaccaactcatctttcccaaactgcagaaggaagttgagaattggaaccccctcactgatacagttcccattcattcttggatccacccatggttacccctcatgcaggcccggctcgagcccttatatagcccaatccgaagtaagctatcttccgcactccagaaatggcatccctccgactcttctgcaaagctcatcctccaaccctggaaggatgtgttcacgcctggctcttgggaagccttcatggtgaaaaacatcgtgccgaagttggggatgtgcttgggcgaactcgtcataaatccgcaccagcagcacatggatgccttctactgggtcattgactgggagggtatgattagtgtgtcatccttagtggggctcttggaaaaacactttttccctaaatggctgcaagtgttatgctcatggctgtcaaactcgcctaactacgaggaaattacgaagtggtacttgggttggaaatctatgttctcagatcaggttctggcccatccttctgtcaaagataaatttaatgaggccctggatatcatgaatcgcgcagtctcatccaatgtgggggcgtacatgcagccaggcgcccgcgaaaatatcgcctatctgacacataccgaacgtcgaaaggactttcagtacgaagccatgcaggaaagaagggaggcagaaaacatggcgcagcgtggcataggagttgccgcttcatccgtgccaatgaattttaaagatctcatcgagaccaaagcagaagagcacaatatcgtgtttatgccagtgattgggaagcggcacgaaggcaaacaattgtatacctttggccggattgttatctacatagatcgcggtgtggtttttgtgcagggcgaaaagacttgggttcctacatccttgcagtctctcattgatatggccaagtag

SEQ ID NO: 210215 - DNA, 267 bp, Artificial Sequence
  Description of Artificial Sequence: Synthetic coding sequence
atgagcctgagccacctgtaccgggacggcgagggccggatcgacgacgacgacgacgagagggaaaatttcgagattaccgattgggatctgcagaacgagtttaatccaaataggcagcggcattggcaaaccaaggaggaggccacctacggcgtgtgggcagagcgcgactctgacgatgagagaccctcttttggcgggaagcgggcccgtgactattccgccccggtcaacttcatcagcgcgggcctgaaaaaaggttag

SEQ ID NO: 210216 - DNA, 261 bp, Artificial Sequence
  Description of Artificial Sequence: Synthetic coding sequence
atgagcctgagccacctgtaccgggacggcgagggccggatcgacgatgacgatgacgagcgcgaaaatttcgaaattaccgactgggatctgcaaaatgagtttaacccgaatcgacagagacactggcagactaaggaggaggccacatatggagtgtgggcagaacgtgactccgatgatgaaaggccttcttttggcggcaagcgagcaagagactacagcgctccagtcaattttatttctgccggcttgaagtag

SEQ ID NO: 210217 - DNA, 129 bp, Artificial Sequence
  Description of Artificial Sequence: Synthetic coding sequence
atgagcctgagccacctgtaccgggacggcgagggccggatcgacgacgacgatgacgagcgggagaatttcgagatcactgactgggacttgcagaacgaatttaaccctaataggcagcgtcattag

SEQ ID NO: 210218 - DNA, 1569 bp, Artificial Sequence
  Description of Artificial Sequence: Synthetic coding sequence
atgagcctgagccacctgtaccgggacggcgagggccggatcgacgatgacgatgatgagagagagaacttcgaaataacagattgggacctacagaacgaattcaatttgtttcatgagctcgagaagatgacggaagttctcgatcacgaagaacgcgtgattagcaatttatcaaaggtgttggagatggtggaggaatgtgagaggcgaatgcagcctgactgctccaacccgctgacactggatgagtgtgcaagaatctttgaaacactgcaagacaagtactatgaggaataccggatgtcagaccgagtggacctggcagtagcgattgtgtaccccttgatgaaagaatacttcaaagagtgggacccactgaaagactgcacatatggcactgaaatcatcagcaagtggaaatcgctcttggaaaacgaccaactgctgtcccacggcggccaggacttaagcgccgacgctttccaccggctcatatgggaggtttggatgccctttgtaaggaacatcgtgacccaatggcaaccaaggaattgtgacccaatggtggattttctcgacagttgggtgcatattattcccgtgtggattcttgacaacatcctcgaccaactgatctttccgaagctccagaaggaagtggaaaattggaatcctctgaccgacaccgtcccgatccattcctggatacatccctggctccctttgatgcaggcgcgtcttgagcctttatactcacctatcaggtccaagctgtcaagcgccctgcagaagtggcatcccagcgacagttccgctaagctcattctccagccttggaaggacgttttcacccccgggagctgggaggcctttatggtcaaaaacatcgtccctaagctggggatgtgccttggcgaactggttataaacccccatcagcaacacatggatgcattttactgggttatcgactgggagggcatgatctccgtttcttctctggtgggccttcttgagaagcatttcttcccgaagtggcttcaggtgctgtgttcctggctgtctaactctccaaactacgaagaaataactaagtggtatttgggttggaaaagcatgttctctgaccaggtcctcgcgcaccctagcgtgaaagacaagttcaacgaggctcttgatataatgaatcgcgccgtctcttctaatgtcggcgcctatatgcagcccggtgcaagagagaatatcgcctatcttactcacacagagcggagaaaggacttccagtacgaggcgatgcaggagaggagggaagccgagaatatggctcagcgtggtatcggggtggcagctagctccgtacccatgaattttaaggatctgatcgaaacaaaggctgaagagcataatattgtattcatgcctgtaattggcaaacgacatgagggtaagcagctctacactttcggtagaatcgttatttacattgacaggggggtcgttttcgttcaaggcgaaaagacctgggtccctacctctctgcaatccctgatcgatatggccaagtag

SEQ ID NO: 210219 - DNA, 576 bp, Artificial Sequence
  Description of Artificial Sequence: Synthetic coding sequence
tgaggccggggcctgggcaagaacgcccagggcatcatcaaccccatagaagctaagcagcgcaaaggcaagggggcggtgggcgcatacgggtcagaaaggaccacccagtcaatgcaggacttcccggttgtcgatagtgaagaggaggccgaggaatggctgttcctggcggcaagtgactgtatcctgctggtgcaggagtttcagaaagagctgtcccagtggagaaaagatccatctggaagcaagaagaagccaaagtacagctacaaaaccgtagaagaactcaaggcgaagggccgtatatcaaagaaactgacagctccacagaaagagctctcccaagtgaaggtaatcgatatgactggtcgagagcagaaggtgtattacagctacagccagatatctcataagcacaacgtgcccgatgatggattacccttacagagccagcaactgccccagagcggcaaggaggccaaggcacccgggtttgctttgccagagctggagcataacctccagctcctcattgacctgactgaacaagagatcatccagaatgataggtag

SEQ ID NO: 210220 - DNA, 366 bp, Artificial Sequence
  Description of Artificial Sequence: Synthetic coding sequence
atgagcctgagccacctgtaccgggacggcgagggccggatcgacgatgacgacgacgagcgcgagaacttcgaaatcacagattgggatcttcagaacgagttcaaccccaatcggcaaaggcactggcagacaaaggaggaggcgacttacggagtgtgggctgagagagactctgacgatgagagacctagctttggcggcaaaagggcccgcgattatagcgcccctgtgaacttcatttctgccggcttgaagaagggcgccgctgaagaagctgaattggaggatagtgatgatgaggagaagcccgtcaagcaggacgattttcccaaggactttggcccacgcaagctaaagacttag

SEQ ID NO: 210221 - DNA, 723 bp, Artificial Sequence
  Description of Artificial Sequence: Synthetic coding sequence
atggaggagagcgtggtgcggcccagcgtgttcgtggtggacggccaaacagacatcccctttaccaggctggggaggagccaccgaaggcagtcatgctctgtggctagagtggggctgggactattgctactgttgatgggagccggactcgcggttcaaggctggtttctgctgcagctacactggagactgggggaaatggtgacaaggctgcctgacggccctgccgggtcgtgggagcagctcatccaggaaagacgaagtcacgaagttaatccagctgcccacttgaccggcgcaaacagcagcctgaccggaagcggaggccctttgctttgggaaacccaactgggattggcttttctgcggggcctatcttaccacgacggggccttggtggttactaaggccgggtattactatatttactcaaaggttcagcttggaggagtagggtgcccattaggtctggcctcaacaataacccatggcctgtacaagaggaccccccgctatcctgaggagctggagctactggtaagccagcagtcgccttgcggcagggctacctcctctagcagagtttggtgggacagtagcttcctgggcggcgttgtgcacttggaagccggcgaaaaggtggtggtccgcgtcttggacgagcgcctcgtcagactgcgcgacggcacccggtcttattttggcgccttcatggtgtag

SEQ ID NO: 210222 - DNA, 954 bp, Artificial Sequence
  Description of Artificial Sequence: Synthetic coding sequence
atgcggcgggccagccgggactacaccaagtacctgcggggcagcgaggagatgggtggagggccaggtgctccccacgagggccctttgcacgcgcctccacctcctgctccacaccagcccccagctgctagccgctcaatgtttgttgctctcttgggcttgggtcttggacaggttgtgtgttccgtggctctcttcttctacttcagagctcagatggacccaaataggataagcgaggatggtacacactgtatttaccgaattctgcgcctgcacgaaaacgccgattttcaggatacaacactcgagagtcaggataccaaattgatccctgattcatgccgccgcattaaacaggccttccagggcgctgtgcaaaaggagcttcagcacattgtcggaagccaacatattcgggcagaaaaagcaatggtcgacggatcatggctggatctggcgaaaagatctaaattagaagcccagccatttgcccacctcaccatcaacgccaccgacatcccctccggctcccacaaggtcagcctgagcagctggtaccacgatcgaggatgggccaagatttcaaatatgacattcagtaacgggaaattgatcgtaaatcaggatggcttctactatctgtacgccaacatatgctttagacaccacgagaccagcggcgacctcgccaccgagtatctgcagttgatggtgtatgtgaccaaaacatccattaaaatccccagctcccatactttgatgaaggggggctcaacaaagtactggtctggcaactcagagtttcatttctatagtattaatgtcggtggttttttcaagttacgctccggtgaggagatctccattgaggtgtcgaatcccagtctgctggaccctgaccaagatgcaacatacttcggcgctttcaaagtgagggacatagactag

SEQ ID NO: 210223 - DNA, 735 bp, Artificial Sequence
  Description of Artificial Sequence: Synthetic coding sequence
atggaccccaaccggatcagcgaggacggcacccactgcatctaccggattctgcgcctccacgagaacgccgactttcaggacacaacacttgagtcccaggacaccaaactaattccagactcctgcaggcgaattaaacaagcatttcagggggctgtccagaaagagttgcagcacattgttgggagtcaacacatacgcgccgaaaaggccatggttgacggaagttggctcgatctagcgaagcgtagcaaacttgaggcccagccttttgcccacttaaccattaacgctaccgatatacctagcgggagtcataaggtgtccctcagttcctggtaccatgacaggggctgggcaaagatctctaatatgacatttagtaatggcaagctaatcgttaaccaagatggtttctactacttgtacgccaatatatgttttaggcatcatgaaacatcaggggacctggccaccgagtacctgcagctgatggtgtacgtcactaagaccagcatcaagatcccctcctcccacacacttatgaagggcggtagcactaaatattggagtgggaacagcgaattccatttctactcgatcaacgtagggggtttttttaagctgcggtcgggagaggaaatctccattgaggtgagcaacccatctctgctcgatccagatcaagatgcaacttacttcggtgcctttaaagtgcgagatattgactag

SEQ ID NO: 210224 - DNA, 735 bp, Artificial Sequence
  Description of Artificial Sequence: Synthetic coding sequence
atggaccccaaccggatcagcgaggacggcacccactgcatctaccggatccttaggttacacgagaatgctgatttccaggacacaactttggagtctcaggacacgaaactcataccggatagctgccgacgcataaaacaggcatttcagggggccgtccagaaagagctgcagcacatcgtagggtcccagcatattagagcagaaaaggctatggtggacgggagctggctggatctcgcgaagagatcaaaactcgaggcccagccatttgcccatcttactatcaacgcaacagatatccccagtggctcacacaaggtgtccctgtcgtcttggtaccacgatagggggtgggctaagatctctaacatgaccttctcaaatggcaaattgattgtgaaccaggacgggttttactatctatatgccaatatctgctttaggcaccatgagaccagcggggaccttgcgacagaatatcttcagctgatggtatacgtgaccaagacttcaatcaagattcctagttctcatactctgatgaagggtgggtccactaaatattggtccggaaacagcgaatttcacttctattctattaacgtgggtggcttttttaagctgagatcaggtgaggagatctctatcgaggtatcaaatccctctttgctggatcccgaccaggacgcaacctatttcggcgcatttaaagtccgagacatcgactag

SEQ ID NO: 210225 - DNA, 735 bp, Artificial Sequence
  Description of Artificial Sequence: Synthetic coding sequence
atggaccccaaccggatcagcgaggacggcacccactgcatctaccggattcttcggctgcacgagaatgctgactttcaggacaccaccctggaaagccaagacaccaaattgattcccgactcctgcagacgcataaagcaggcttttcagggggcagttcagaaggagctgcaacatatcgttgggagccagcatatccgagcagaaaaggccatggtcgatggcagctggctggacctggccaagcggtcgaaacttgaggctcagccgttcgctcatctcacaataaatgctacagacataccttcaggcagtcacaaagtaagcctgtccagctggtaccatgatagggggtgggcaaaaattagcaacatgaccttcagtaatgggaaacttatcgtgaatcaagatggattttactacctctacgcaaatatttgtttccggcatcacgagacgtctggagatctagccacagaatatctccagctgatggtctatgttaccaagacctccattaagatcccctcaagccacaccctgatgaagggcggctcgaccaaatattggagtggaaattctgaattccacttctactcgatcaacgtcggaggattttttaagctgcggtcaggcgaagagatctctatcgaggtatctaacccctccctgcttgaccccgatcaggatgccacctattttggtgctttcaaagtcagggatatcgactag

SEQ ID NO: 210226 - DNA, 735 bp, Artificial Sequence
  Description of Artificial Sequence: Synthetic coding sequence
atggaccccaaccggatcagcgaggacggcacccactgcatctaccgcatactaaggctccacgagaatgcggacttccaagacaccactctagaaagccaggataccaaactgatcccagacagttgtcgccgtataaaacaggccttccagggagctgtgcagaaggagctccagcatatcgttggatcacagcacatacgggcagagaaagcaatggtggatgggagttggcttgacctggcgaagcgatccaagctagaggctcagccgtttgctcacctcaccattaatgcaacagacatcccttcggggtcccataaagtatcactttccagctggtaccacgacaggggctgggcgaagatcagcaacatgacctttagcaacggaaagctgattgtcaatcaggatggtttctactacctgtatgctaatatctgctttcggcaccacgaaacttccggagaccttgccacagaatatctgcaactcatggtctacgtgaccaagacctcaattaaaattcctagcagtcacacccttatgaagggcggatctacaaagtattggagtggaaacagcgagttccacttttatagtattaatgtggggggattcttcaagctccgctcgggggaagagatctctatcgaagtgtccaacccgtcacttctcgatcctgaccaggatgctacctatttcggagcatttaaagttcgggatattgattag

SEQ ID NO: 210227 - DNA, 750 bp, Artificial Sequence
  Description of Artificial Sequence: Synthetic coding sequence
atggccgcccggcggagccagcggcggcggggccggcggggcgagcccggcaccgctctgcttgtcccactggcactcgggctggggctagcgttagcttgtctgggactactgctggcggtagtttcactgggcagcagggcctccctaagcgctcaggaacccgcacaagaagagctcgtggcagaggaggaccaggatccctctgaacttaatccccagacagaggagtcccaggatcccgctccctttttgaatagactagttagaccacgcaggtctgcccccaagggaagaaagacccgagccagacgcgctatcgccgctcactacgaagtgcacccaagacccgggcaggatggtgctcaggctggagtcgatggaaccgtgtcaggatgggaggaagcgcgcataaattccagcagtccgctgagatataaccggcaaatcggcgagttcatcgtaacaagggctggactctattacctctactgtcaggtgcactttgatgagggtaaggcagtttacttaaagctggatttgcttgtggacggcgtgctggccctgcggtgccttgaagaattctcggccaccgcggcctcttcgctgggaccccaactgcgattatgtcaagtgtccggactgcttgcactgagaccaggaagttctctgcgtatccggactctgccctgggctcacttgaaggcagctcccttcctgacttactttggcttgttccaggtgcactag

SEQ ID NO: 210228 - DNA, 993 bp, Artificial Sequence
  Description of Artificial Sequence: Synthetic coding sequence
atggccgcccggcggagccagcggcggcggggccggcggggcgagccggggactgctcttctcgtgcccctggcgctgggtctgggtctggccctcgcttgtttggggctgctgctggccgtggtttccctgggcagtcgtgcaagtctaagtgctcaggaacctgcacaagaggaactggtggccgaggaggatcaggatcctagtgagctcaacccgcagaccgaagaatctcaagatccggcacccttcttaaaccgtctcgtccgcccaaggcgttctgctcccaagggacgcaaaacaagggccaggagagccatcgctgcacactatgaggtccatcctcggccgggacaagatggagcgcaggctggggtggatgggacagtgagtggctgggaggaggcaaggatcaacagttcgagtccacttcgttacaaccgccaaattggggaattcattgtcacccgcgcagggctgtactacctgtactgccaatcgtccgatgctctagaggcctgggaaaacggggaacggtcacgcaagagaagagcagttctgactcagaaacaaaaaaagcagcacagcgtcttacaccttgttcccatcaatgccacaagcaaagatgattcagatgtcacggaagtcatgtggcagcccgccctccgcagggggcgcgggctacaggctcagggatacggggttcgcattcaggatgccggcgtctaccttttgtacagccaggtcctattccaagacgttacatttaccatgggacaagtagtctcaagagaaggacaggggcgccaggaaactctgttccgatgcataaggtctatgccaagtcaccccgatagagcttataactcctgttactccgccggagtgttccatctgcaccagggagatatcctgtcagttatcatcccaagggcacgggccaagctgaatctaagtccccatgggactttcctgggcttcgttaagctgtag

SEQ ID NO: 210229 - DNA, 723 bp, Artificial Sequence
  Description of Artificial Sequence: Synthetic coding sequence
atggaggagagcgtggtgcggcccagcgtgttcgtggtggacggccagacagatattcccttcacccgcctggggcgaagccaccgtaggcagtcttgtagcgttgcccgtgtggggctggggctgctcttgctgttaatgggcgccggtctggcggtgcagggctggtttctccttcagttgcattggcgattgggcgagatggtcacacggctgccagatgggcccgccgggtcttgggagcagctcattcaggagcgccggagtcacgaagttaaccccgcggcacatctgaccggggccaactcaagcctgacggggtctggcggccccctgctctgggagacccaattgggactcgcattcctgagaggactgagctaccatgatggagccctggtggtgacaaaggcaggctattattacatttacagcaaggtgcagctagggggtgtaggttgtccactaggactggcttcaaccattacccatgggctgtacaagagaactccccggtaccccgaagagctcgagctcctggtctcacagcaaagtccttgtggacgggccacttcctctagtcgtgtgtggtgggactccagctttctcggcggagttgtccacttagaggccggggaaaaggtcgtggtccgcgtcctcgatgagagactcgtgcgcctgcgtgatggcacgcggagttactttggagcttttatggtgtag

SEQ ID NO: 210230 - DNA, 615 bp, Artificial Sequence
  Description of Artificial Sequence: Synthetic coding sequence
atggaggagagcgtggtgcggcccagcgtgttcgtggtggacggccagacggatatcccatttacacgcctcggtcggtctcatcgccgacaatcatgtagcgtggctagggacgggccggccggttcttgggaacaactcatccaggaacgtagatctcacgaggttaatcccgctgctcatctcaccggcgcgaatagctccctgacaggctccggaggcccgttgctgtgggaaacccaactagggctggcctttctgagaggtctgtcttatcacgacggggcccttgttgtgacgaaggctgggtactattacatatatagtaaggtgcagctcggaggcgtagggtgccctctaggtttagcttcgactatcacacatgggctgtacaaacgcacgccccggtacccagaagagctggagctgctggtcagccaacagtctccatgtgggcgcgccacgagcagtagtagggtgtggtgggattcttccttcttaggcggggttgtccatcttgaggctggggagaaagttgtggtgcgcgttctcgacgaacgattggtgagactcagggatggcacacggagctactttggggcttttatggtatag

SEQ ID NO: 210231 - DNA, 525 bp, Artificial Sequence
  Description of Artificial Sequence: Synthetic coding sequence
atgcggcacttcctgagcaaggtgtacagcttccccatgcggaagctgattctcttcctcgtcttcccggtagtgaggcagacacctacccagcactttaagaaccaatttcctgccctgcactgggagcacgagcttggtctggctttcaccaaaaatcgcatgaattatactaataaatttctgctcatccccgaatctggggattactttatctactctcaggtgacctttcgaggcatgacttcagaatgcagcgaaatccgtcaggcaggtaggcccaacaaaccagattcgataaccgtggtaatcacaaaagtaaccgacagctaccctgagcctactcagttactgatgggaaccaagtcagtctgcgaggtcggatccaactggtttcagccaatataccttggggctatgtttagcctacaggagggggataaattgatggtaaacgttagcgatattagcctcgttgattacacaaaggaagacaagacattctttggcgccttcctgctctag

SEQ ID NO: 210232 - DNA, 756 bp, Artificial Sequence
  Description of Artificial Sequence: Synthetic coding sequence
atggccgaggacctgggcctgagcttcggcgagaccgccagcgtggaaatgctgcccgagcacggtagctgccgcccgaaggcaagatcctcatccgccagatgggccctgacgtgctgcctggtccttctgcctttcttggctggattgacgacatacctgctcgtgagtcagctccgagctcagggcgaagcttgcgttcagtttcaggcactaaaaggtcaggaattcgctccgtcccaccagcaggtttacgcccctctgagggccgatggggacaagcctcgagctcaccttacagtggtcagacaaaccccaacccaacatttcaagaatcaatttcccgccctccactgggaacacgagcttgggctcgctttcacgaagaaccggatgaactacaccaataagttcctgttgatcccggagtccggcgactactttatatactcccaagtaacctttcgtggaatgacgagcgagtgttccgagatacggcaagctggacgcccgaacaagcccgacagtattactgttgttataactaaagtgaccgattcttaccccgagcccacccagctcttaatgggcacaaagtcagtgtgcgaggtgggaagtaattggttccaaccgatttatctgggggctatgtttagtctgcaggagggggataaattaatggtgaatgtgtcagacatctcactggtggattacacaaaagaggacaagacatttttcggcgcattcttgctgtag

SEQ ID NO: 210233 - DNA, 534 bp, Artificial Sequence
  Description of Artificial Sequence: Synthetic coding sequence
atgtgcctgagccacctggagaacatgcccctgagccacagccggacccaaggcgctcaaagatcttcctggaaactctggctgttttgcagcattgtcatgctgttgtttctgtgcagtttctcatggctgatctttatcttccttcagctggagactgctaaagaaccttgtatggctaagtttggcccattgccctctaagtggcagatggccagctcagagccaccgtgcgtgaataaagtgtcggactggaagcttgagattctccagaatggactgtacttgatctatggacaggtggcaccgaacgcaaattataacgacgtggctccgttcgaggttagactgtacaaaaacaaagatatgattcagacgctgactaacaagagcaagatccagaacgtaggaggtacatacgaacttcacgttggggatacaattgacctcatcttcaatagcgaacaccaggtgcttaagaacaatacatactggggcatcattctgctggccaacccccagtttatatcttag

SEQ ID NO: 210234 - DNA, 600 bp, Artificial Sequence
  Description of Artificial Sequence: Synthetic coding sequence
atgaccctgcaccccagccccatcacctgcgagttcctgttcagcacagcattgatctctcctaaaatgtgtcttagtcatctagagaacatgcccctatcccatagtcgtactcagggagcacaaaggtcgtcttggaaactctggttgttctgctctatcgttatgctcctgttcctctgctctttttcctggctgatcttcatctttctccagctggaaactgctaaggagccctgcatggccaaatttggccctctgccttctaaatggcagatggcctccagcgagccgccatgtgtgaataaagttagcgactggaagcttgaaatcttgcaaaatggattatatctgatctacggccaggtggctcctaatgctaactataacgacgtggctccatttgaggtgcgactgtataagaataaagacatgattcagactctaacgaacaagagcaagattcagaacgtcggagggacctatgaactgcatgtgggcgatactatcgacctgatctttaattccgagcatcaagtcctgaagaataacacttattgggggataatcctgctcgcaaacccccagttcatctcctag

SEQ ID NO: 210235 - DNA, 552 bp, Artificial Sequence
  Description of Artificial Sequence: Synthetic coding sequence
atggagcgggtgcagcccctggaggagaacgtgggcaacgccgcccgcccgcgttttgagcgaaataagttactgcttgttgcatctgtgatacaggggttgggtttacttctttgctttacatatatttgtctccactttagtgcgcttcaggtatcccatcggtacccgcgcatccagtcaatcaaggtccagttcactgaatataaaaaggagaaaggattcattctgacttcacaaaaagaggacgaaatcatgaaagtgcagaacaactctgtaattataaactgcgatgggttctatctgatcagtctgaagggatattttagccaggaagtaaatatttcactacattatcagaaggacgaagaaccactttttcaactgaagaaagtccggtccgtgaactccctgatggttgctagccttacctacaaggataaagtctatttaaacgtcacaacagataacactagcctcgacgatttccatgtgaacggaggtgaactgatattgatccatcaaaaccccggcgagttctgcgttttatag

SEQ ID NO: 210236 - DNA, 402 bp, Artificial Sequence
  Description of Artificial Sequence: Synthetic coding sequence
atggtgagccaccggtacccccggatccagagcatcaaggtgcagttcaccgaatacaagaaggagaagggttttatcctgacgagccagaaggaagacgagattatgaaggtccaaaacaactcagtcatcataaactgcgatggattttacctgatctctctgaaagggtacttctcccaggaagtgaatattagcttgcactatcaaaaagatgaggagcctctattccagctcaagaaggtcagaagcgtcaatagtctgatggtcgcatcattaacctataaagacaaagtatatctaaatgtgacgacagacaatacatccctcgatgattttcacgtcaacggaggcgaactcattctgatccaccagaatccaggggaattttgcgtgctgtag

SEQ ID NO: 210237 - DNA, 402 bp, Artificial Sequence
  Description of Artificial Sequence: Synthetic coding sequence
atggtgagccaccggtacccccggatccagagcatcaaggtgcagttcacagagtacaagaaggagaagggatttattctcacaagtcagaaagaagatgagatcatgaaggttcagaacaactcagtcattattaattgcgacggattctatctcattagcctcaaaggctatttcagccaggaggtcaatatcagcctgcactaccagaaggatgaggaacctctctttcagctgaaaaaagtccgctctgtgaattccctcatggtcgcttccctgacctacaaggataaagtttatttgaacgttacaacagataatacatcgctggacgacttccatgtgaatggtggcgaactaattctaatacaccaaaatccaggcgaattttgtgtcctttag

SEQ ID NO: 210238 - DNA, 765 bp, Artificial Sequence
  Description of Artificial Sequence: Synthetic coding sequence
atggagtacgccagcgacgccagcctggaccccgaggccccctggcctcccgcacctcgggcccgcgcctgccgggttctcccatgggctctcgttgccggtttgctgttgcttttgctgctggcagcagcctgtgccgtgttcttggcctgtccatgggcagtaagtggcgctagggcaagtcccggtagcgctgcttccccaagactccgggagggcccagagctgagtccagatgatcctgccgggctgctcgacctgcggcagggtatgttcgcccagcttgtggctcagaacgtgctgttgatcgacggcccccttagctggtactcagatccaggactggctggcgtgtccctgaccggcggcctgtcctacaaagaggataccaaggagcttgtagtggccaaggcgggggtgtactatgttttcttccagttggagctgaggcgtgtcgtggcaggagaaggctccggcagtgtctctctggcactgcacttacagcctctgaggtccgcggctggcgctgccgctcttgctctcaccgtcgatctgccgccagccagttctgaggcccgaaacagcgctttcgggttccagggaagattgctgcatctgtcggctggccaacgactaggggtgcatttgcataccgaggctcgtgctcggcacgcctggcagctgactcaaggagcaactgttcttggtcttttccgagtgactcctgaaatcccagccggcctgccttccccccgtagcgaatag

SEQ ID NO: 210239 - DNA, 1851 bp, Artificial Sequence
  Description of Artificial Sequence: Synthetic coding sequence
atggccccccgggcccggcggcggcggcccctgttcgccctgctgctgctctgcgccttattggcccgactccaggttgcgttgcaaatcgcaccaccctgcacttcggaaaagcactacgagcacctcggacggtgctgcaacaagtgcgagccaggcaagtacatgtcaagcaagtgtacaacgaccagcgatagtgtgtgcctgccctgtgggccagatgaatatctggatagttggaatgaggaggataagtgcctgctgcataaggtgtgtgacaccggcaaagcactggtggcggtcgtcgcaggaaacagcaccacccctaggaggtgtgcttgcactgcgggttaccattggtcccaggactgcgaatgctgccgccggaacaccgagtgtgcccctgggctgggagctcagcatccactgcagctcaacaaggataccgtgtgtaagccctgcctggccggttacttttccgacgccttttctagcactgacaagtgtagaccatggaccaactgcacattcctggggaagagggtcgaacatcatggaaccgagaagagtgacgccgtctgcagctccagccttccagctcgcaaacctcctaatgagccccacgtttatctgcctggcttgatcatcctgttactctttgcctctgtagcattggtcgctgccattatcttcggcgtttgttaccgaaaaaaggggaaggccttaactgccaacctctggcactggatcaatgaggcttgtggacggttaagcggagacaaggagtcctccggggactcttgtgtgtcgactcacacggcaaattttggacaacaaggcgcatgtgagggtgtgttgctcctgacccttgaagagaaaactttccccgaagatatgtgttatccagaccagggtggtgtgtgccagggaacttgcgtgggaggcggcccttatgcccagggcgaggacgctcgtatgctgtcacttgtgagtaaaaccgagatagaggaagattcttttaggcagatgccaaccgaagacgaatacatggatcggccttctcaacccacagatcagctgcttttcctgaccgaacccggttctaaatcaacgcccccattttctgaacccctggaggtgggggagaacgatagcctgtcccagtgcttcaccggtactcagtctaccgtggggagcgaatcatgcaactgcactgaacccctctgtagaaccgactggacgcccatgagcagtgaaaactatctccagaaagaagtcgactccggccactgtccacattgggccgcgtccccatcaccgaactgggccgatgtttgcaccgggtgtcgtaacccccccggcgaggattgtgaacctctggtcggaagcccgaagagaggacctcttcctcagtgcgcctatggcatggggttgccacctgaagaggaagcctcaaggacagaggccagggaccagcctgaggatggggctgacggtagactgccctcctctgcccgggcaggggccggatccggtagttccccgggaggacagagtcctgcctctggaaacgtgacgggaaatagtaattctacgttcatctcttccggacaggtgatgaacttcaagggcgatatcatagtagtgtatgttagtcagacctcccaggagggggccgccgccgcagccgaacctatgggccggccagtgcaggaggagactctcgcccgacgcgactcttttgctggtaatggtcctcgttttcccgatccatgcgggggccccgagggattgcgggagcctgaaaaagccagcagaccagttcaggagcagggtggagcaaaggcgtag

SEQ ID NO: 210240 - DNA, 780 bp, Artificial Sequence
  Description of Artificial Sequence: Synthetic coding sequence
atggcccggatccccaagaccctgaagttcgtggtggtgatcgtggccgtgttactgccggtccttgcttactccgcaacaaccgcccgccaggaagaagtgccgcagcagacagtggccccccaacagcaacgtcatagttttaagggcgaggagtgtccggccggttcccacaggagcgagcacaccggagcttgtaatccctgcaccgaaggggtagactacactaatgcttccaataatgaaccaagttgcttcccttgtactgtctgtaagtcagatcagaagcataagagctcgtgcactatgactagagatacagtgtgccagtgcaaggaggggacttttaggaatgagaatagtcctgagatgtgtcggaaatgctctcggtgtccttccggtgaggtgcaggtcagtaactgcacgtcttgggacgacatccagtgcgtagaggaattcggcgccaacgccaccgtcgaaactcccgctgcggaagagaccatgaataccagccccggcacccctgccccagcggcggaggagaccatgaatacgtcccctggcaccccagcgcccgccgccgaggagacaatgaccactagcccaggcacgccggcgccagcggctgaagagaccatgacaacaagcccaggaactcccgcccctgcagcggaagagaccatgatcacatccccaggtacgccggcaagctcacactatctctcttgtacaatcgtcggcatcatcgtgctcatcgttttgttgattgtcttcgtgtag

SEQ ID NO: 210241 - DNA, 474 bp, Artificial Sequence
  Description of Artificial Sequence: Synthetic coding sequence
atgacccgggacaccgtgtgccagtgcaaggagggcaccttccggaatgagaatagcccggaaatgtgtcgcaagtgctcaaggtgtccttctggcgaggtgcaggttagcaattgcacctcttgggacgacatccagtgtgtggaggagttcggcgcgaatgcaaccgtggaaactccagccgctgaagagaccatgaatacctctccaggcacgccagcgcccgccgccgaggagacgatgaacacaagccctgggaccccagcccccgctgccgaagagactatgacaacgtctccgggtacccctgcaccagccgctgaagagactatgaccacctcccccggtactcccgcccccgcggctgaagaaacaatgatcacgtccccgggcactcccgcgtcatcgcactacctgagctgcaccatcgtgggaataatagtactcatcgtgctgctcattgtgtttgtttag

SEQ ID NO: 210242 - DNA, 834 bp, Artificial Sequence
  Description of Artificial Sequence: Synthetic coding sequence
atggcccggatccccaagaccctgaagttcgtggtggtgatcgtggctgtattgttgcccgtgctagcctactctgccacaaccgccaggcaggaggaggttccccaacagaccgttgccccgcagcagcagcggcactccttcaagggagaggagtgccccgcaggttcacataggtccgagcacacaggcgcctgcaacccatgtaccgagggcgtggactacacgaatgcgtccaataatgagccctcctgttttccttgtaccgtctgtaagagcgatcagaaacacaagagtagttgtactatgactcgggataccgtgtgtcagtgtaaggaaggaacattccggaacgaaaactcacccgaaatgtgccgcaaatgctcaaggtgcccgtcaggggaggtccaggtctccaattgtacgtcctgggatgatatccagtgcgtggaggaattcggagccaacgcaactgtagagaccccggccgccgaggagacgatgaacacgtccccggggaccccagctcctgccgccgaggagacaatgaataccagccccggcactcctgctcccgccgcagaggaaacaatgacaaccagcccaggcaccccggccccggccgcagaagaaaccatgacgacatcacccggaacaccagcccccgcagccgaagaaaccatgattacttcccccgggacgccagctagctctcactatctgtcttgtaccatagtgggaataatagttctgatcgtgctcctaatcgtgccctacctcaagaagaaaaaaaagaaaaaacttaagaaaaaacagaaaaggaagtctaagtag

SEQ ID NO: 210243 - DNA, 1851 bp, Artificial Sequence
  Description of Artificial Sequence: Synthetic coding sequence
atggccccccgggcccggcggcggcggcccctgttcgccctgctgctgctctgcgccctattggcaaggttgcaggtagccctgcagatagcaccgccatgcactagcgagaaacattacgaacacctcggcaggtgttgcaacaagtgtgaacccgggaagtacatgtcaagcaaatgtactactaccagtgattccgtctgtttgccatgcggtcccgacgaatatctggactcttggaatgaagaagataagtgccttctgcataaagtttgtgataccggaaaagcactggtggccgtggtggctggcaatagtacaaccccgaggcgatgcgcctgtaccgccgggtaccattggagccaggattgcgaatgttgtagaaggaacacggagtgtgccccgggtctgggagcgcagcatcctctccagcttaataaggatactgtgtgcaaaccgtgccttgctggatacttttctgatgctttttcctcaacagataaatgtcggccttggaccaactgcacgtttctcggcaaacgagtcgagcaccacggaactgagaagtcagatgctgtctgctcatcaagcttgccagctaggaaacctccaaacgaaccacatgtgtacctccccggcctcatcattctgttgttatttgcgagcgtcgcactggtcgccgccattatcttcggagtgtgttatcggaagaagggcaaggcattaactgctaacctctggcactggattaatgaggcttgtggtcgcctctcaggcgacaaagagtcgagcggggactcctgtgtttccacccacactgccaactttggacagcaaggggcttgtgagggcgttctgctgttgactctggaagagaaaaccttccctgaagatatgtgttacccagaccagggtggagtgtgccagggaacctgcgtggggggaggtccatacgcgcagggggaagatgcaaggatgttgagcctggtgtccaagaccgagattgaggaagactctttccgacagatgcctacagaggacgaatacatggatcgcccgtcacagcctactgaccagttgctgttcctgaccgagcctggaagcaagagcaccccgcctttttctgaaccactcgaggtgggagaaaacgacagcctctcccagtgtttcaccggtacccagagtactgtcggcagcgaaagttgcaactgcaccgaacccctttgccgcaccgactggacccctatgtcttctgaaaattacctccagaaagaagtcgatagcggacactgcccccactgggcggcaagtccgagtcccaattgggcagacgtgtgcactgggtgtcgtaacccacccggggaggactgtgaacctctcgtaggcagtccaaagcgcggaccattaccacagtgcgcttatggcatggggttgccccctgaggaggaggctagtcggaccgaagcacgtgaccagcctgaggacggagccgatggcaggttgcccagcagtgctcgagctggcgcaggatctggatcctcaccaggcggccaatcacctgctagtgggaatgtgacgggtaacagtaacagcacgttcattagctccggccaggttatgaatttcaagggtgacatcattgtggtgtacgttagccagacgagtcaagaaggcgctgctgcagcagctgagcccatgggacgtcctgtgcaggaggagactctcgctagaagagacagtttcgctggaaacggaccccggttccccgatccttgcggcggccctgagggcctgcgagagcctgagaaggcctctcgccctgtgcaggagcagggcggggcaaaagcatag

SEQ ID NO: 210244 - DNA, 966 bp, Artificial Sequence
  Description of Artificial Sequence: Synthetic coding sequence
ggcagccgggcccggtgggccaccgaggccgccgaggccgccgccccggcctctctctcacgggctatggcaccaagggcacgcaggagaaggccgctctttgccctgctcctcctctgcgcactcttagcccgcttacaggtcgccctgcagatcgccccaccttgcaccagtgagaagcactacgagcacctgggcagatgttgcaataagtgcgagccaggcaagtacatgtcatccaagtgtactacaacctcagatagtgtttgtctgccttgtggcccagacgaatacctggactcatggaatgaggaggataaatgtctgttgcataaagtttgcgacaccgggaaggcactcgttgcagtggtggccgggaattcgacaacaccacgccgctgtgcatgcactgcaggctaccactggtcacaggattgtgagtgttgtcgtaggaacacagaatgcgctcctgggttgggtgcgcaacaccccctccaacttaacaaggatactgtctgcaaaccttgcctggccgggtacttctccgacgcctttagctccaccgataagtgcaggccttggacgaattgtacttttctcggcaaacgcgtggaacatcatgggaccgaaaaatcagatgctgtttgctcatcgtctctgccagccaggaagccccccaacggcaatgttaccggcaatagtaactccacatttatatcctccgggcaggtaatgaatttcaagggagacataattgtggtgtacgtgagtcaaacctcccaggaaggagctgctgctgccgccgagcctatggggcgccccgtccaggaggagactctggctaggcgggactctttcgctgggaacggacctagatttccggacccctgcggcgggcccgaaggcctgagagagcccgaaaaggcatcaaggcctgtccaggaacaaggcggcgctaaagcctag

SEQ ID NO: 210245 - DNA, 1206 bp, Artificial Sequence
  Description of Artificial Sequence: Synthetic coding sequence
atgaacaacctgctgtgctgcgccctggtgttcctggacatcagcatcaagtggactacacaggaaactttcccgccaaagtatctacattatgatgaggaaacctcccatcaactgctgtgcgataaatgtcctcctggaacctatctgaagcagcactgcacagccaagtggaagaccgtgtgcgcgccctgtcccgatcattactacaccgactcctggcacacaagcgatgagtgtctgtattgtagccctgtgtgcaaggagctgcaatacgtcaaacaagaatgcaacaggactcataacagggtgtgtgaatgcaaggagggtcgctatctggagatcgagttttgcctcaagcaccgatcctgcccgcctggttttggcgtagtacaagccggcacaccagagagaaataccgtgtgtaaacggtgtccagacggcttcttctctaatgaaacctctagcaaggcaccttgccgcaagcacacgaactgtagcgtgtttggcctgctcttaacccagaaagggaacgccacccacgacaacatctgctccggtaacagcgaaagcacccagaaatgcggcattgacgttacactttgtgaggaggcgtttttcagatttgcagttcccaccaagttcactcctaattggctgagcgtgttagtcgataatttgccaggcactaaggtgaatgccgaatccgtcgagagaattaagcggcaacactcttctcaggagcagacctttcaactactgaaactctggaagcaccaaaacaaggaccaggacattgttaaaaagatcatacaggatatagatctgtgcgagaatagtgttcagcgccacatcggacatgctaatcttacattcgagcagttgaggagcctgatggagtcactgcctggcaaaaaagttggagcagaggatattgaaaaaacaataaaagcgtgcaaaccgtccgaccaaatattgaagctactgtcgctgtggagaatcaaaaatggtgatcaggataccttaaagggcctgatgcatgccctgaaacattcaaagacttaccatttccctaagacagtcacacagtccctgaaaaaaacaatccgctttctgcattcctttacaatgtacaaactgtaccagaaattgttccttgagatgataggcaaccaggtgcagtcagttaaaatttcctgtctgtag

SEQ ID NO: 210246 - DNA, 390 bp, Artificial Sequence
  Description of Artificial Sequence: Synthetic coding sequence
atggcccggggcagcctgcggcggctgctgcggctgctggtgctggggctgtggctagcactgctgcgaagtgtcgcaggcgaacaggctcctggaaccgcaccatgcagccggggaagttcatggtccgcagacctggacaagtgcatggactgcgcctcatgtagagcacgaccccattccgatttctgcctgggctgcgccgctgcaccacctgcgccttttagacttctctggcctatcttaggcggtgccttgtcactcacttttgtattgggcctcctgagcggatttcttgtctggagaaggtgtcgtaggagagagaagttcacaacaccaattgaggagacaggcggggaggggtgccctgcggtggcgttgatccagtag

SEQ ID NO: 210247 - DNA, 285 bp, Artificial Sequence
  Description of Artificial Sequence: Synthetic coding sequence
atggcccggggcagcctgcggcggctgctgcggctgctggtgctgggcctgtggctggccctccttcggagcgtggccggagaacaggctccaggtgcggctgcaccccctgcacctttccggctcctctggccaattctggggggagccctcagcctgacctttgtgctgggtctgctgtccggttttttggtgtggcgaaggtgtcgccggagagaaaagtttacgactcctatagaggagacgggtggagaaggatgtcctgcagtggccctgatccagtag

SEQ ID NO: 210248 - DNA, 882 bp, Artificial Sequence
  Description of Artificial Sequence: Synthetic coding sequence
atgagcggcctgggccggagccggcggggcggccggagccgggtggaccaggaagagagattccctcagggactgtggactggtgtcgccatgcgctcttgccctgaggagcagtactgggatccgctgctcgggacatgcatgagctgtaagaccatctgtaatcaccagagtcaacgcacctgtgccgctttctgcaggagtctgtcctgccggaaagagcagggaaagttttacgaccatctgttgcgtgattgtattagttgtgcaagtatctgcggccagcaccctaagcagtgcgcctatttctgcgagaataaactccggtctccagtgaacctccctccagagctgcggaggcagaggtctggcgaagttgagaacaactctgacaacagcgggcgctaccagggcctagaacacagaggctcagaagcctccccggctctgcccgggctgaagcttagtgccgatcaggtggccctggtctattcaaccctcggcctatgtctctgcgccgttctatgctgcttcctggttgctgtcgcatgttttcttaagaaacggggagatccatgcagctgccagcccaggtctcggcccagacagagccctgcgaaatcttctcaggaccacgcaatggaggccggaagccccgtgtcaacctcaccagagcctgtagagacgtgctcattttgttttcctgagtgcagggctcctactcaggagtccgcggttacaccaggcacacctgatccaacctgcgcagggcgctggggatgtcacactcgtactacagttctccaaccttgccctcatatcccagattctggactagggattgtctgtgttccagcccaggagggcggtcccggtgcctag

SEQ ID NO: 210249 - DNA, 747 bp, Artificial Sequence
  Description of Artificial Sequence: Synthetic coding sequence
atgagcggcctgggccggagccggcggggcggccggagccgggtggatcaggaagagaggtggagcctgagctgcagaaaggaacagggtaagttttatgatcatttgctgcgcgactgtatatcttgtgccagtatctgcggtcagcatcctaagcagtgtgcttatttttgtgagaacaagttaaggagcccagttaatcttccacccgagctgcggagacaacggagtggcgaagttgaaaataacagcgacaattctggaaggtatcaaggtctggagcaccggggaagtgaggccagccccgccttaccaggtctgaagctaagcgctgaccaggtcgccttggtgtattccactcttgggctgtgcctgtgtgccgtgctctgctgttttctcgtcgctgtcgcctgcttcttgaaaaaaaggggcgacccttgttcttgtcaaccacggtcccgcccacggcagagccccgcaaagtcatcgcaagatcatgccatggaggcaggaagcccagtatccacatcgcccgaacctgtcgaaacttgcagcttctgtttccctgagtgtagagcacccacacaggagtcagctgttacacctggaaccccagaccctacctgtgccggccgcaaaaccaaaccacctccagtgctgaccgctggcaattgcggtgtacatcgccctcctcccgagacaagtaccggaagcccacgaggacaacgcttgctttggacccagtag

SEQ ID NO: 210250 - DNA, 555 bp, Artificial Sequence
  Description of Artificial Sequence: Synthetic coding sequence
atgcggcggggcccccggagcctgcggggccgggacgcccccgcccctacaccctgcgtgccggcagagtgcttcgatcttctggtgcgccattgcgttgcctgcggtttgctgcgtactccgcgcccaaagccagccggcgccagcagccctgcaccaagaacggcactccagccacaggagtcagtgggagctggagcaggggaggctgcactgcctctacctggtctcctctttggtgcacctgcactcttaggcctggcgttggtgttggctctggttctcgtgggcctggtttcatggaggcggagacaaaggaggcttaggggtgcttcctctgcagaggcacctgatggcgataaggacgctccggagccactggacaaggtgattattcttagcccgggtattagcgatgccactgcgccagcctggccgcccccaggggaggatcccggcactactccaccgggtcatagtgtgcctgttcctgccactgagttgggaagcacagaactcgttaccacaaaaacagcaggtccggagcagcaatag

SEQ ID NO: 210251 - DNA, 852 bp, Artificial Sequence
  Description of Artificial Sequence: Synthetic coding sequence
atggagccccccggcgactggggcccccccccctggcggagcacccctaaaacagacgttttacgactggttctgtacctgacgtttctgggcgctccctgctatgcccctgcgctaccttcttgtaaagaggacgaatacccagtggggagcgagtgttgtccaaaatgttcacccggctacagagtgaaagaagcctgcggagaactgacagggaccgtttgcgaaccttgccctcctggtacatacattgcacacctcaatggtctttctaagtgcctgcagtgccagatgtgcgatcccgccatgggtctgcgcgcatcccggaattgctccaggacagaaaatgccgtatgcgggtgttctcccgggcatttctgtatcgtgcaggacggcgaccattgtgcagcctgtcgtgcgtatgcaaccagttctccaggccagagagttcaaaaaggtggcacagagtctcaagatactctgtgtcagaattgtccccccggtaccttctctcccaatggtacactagaagagtgtcagcaccagaccaaatgtagctggctcgtgaccaaggcaggcgcagggacgagctcctcccattgggtctggtggttcctgtcgggcagcctggtgattgtgattgtgtgttctacggtgggcttgatcatctgcgtgaaaagaagaaaaccacgtggtgacgtggttaaggtgattgtgagcgtccagaggaagaggcaggaggccgagggagaggctaccgtgatcgaagcccttcaggccccgcctgacgtgactactgttgctgtggaagaaacaattcccagcttcactggacgaagtccaaatcattag

SEQ ID NO: 210252 - DNA, 522 bp, Artificial Sequence
  Description of Artificial Sequence: Synthetic coding sequence
atggagccccccggcgactggggcccccccccctggcggagcaccccaaagaccgacgttctgagattagttctgtacctgaccttcctcggggctccctgctatgcccccgcactaccctcttgtaaggaggacgaatacccagtgggatcggagtgttgtcctaagtgtagtcctggatacagagtgaaggaggcatgtggcgagctcacagggacagtgtgtgaaccttgtccccctggaacgtatatagctcacttaaatggcctatctaagtgcctgcagtgtcaaatgtgcgatcccgatattggatccccctgtgatctgcgcgggcgcgggcacctggaggcgggcgctcacctgagtcccggtcggcagaaaggagagccggatcccgaggtggcatttgagagcctgtcagccgagccacacgctcgcctgagcatggcctccgcaccctgcgggcaggccggccttcaccttagggatcgggccgatggcacccccggcgggagggcatag

SEQ ID NO: 210253 - DNA, 552 bp, Artificial Sequence
  Description of Artificial Sequence: Synthetic coding sequence
atggagccccccggcgactggggcccccccccctggcggagcacccccaagaccgacgtgctccggctggtgttatatcttacctttttgggagcaccgtgctacgccccagccctaccctcttgtaaggaagacgagtacccggtggggtcagagtgctgccctaagtgctccccgggatatcgtgtgaaagaagcttgtggcgaactgaccgggacagtctgcgagccctgtcccccaggcacatatatagcccaccttaatgggctgtccaaatgtctgcagtgccagatgtgtgatcccgcaatggggcttagagcttcaagaaactgctcgcgcacagaaaacgccgtgtgcggttgttcccccggccacttttgtatcgtgcaggatggcgatcactgtgcagcatgtagggcttatgctaccagtagtcccggccagcgggtccaaaaagggggcactgaaagccaggataccctgtgtcagaattgtcctcccggcaccttcagccccaatggaaccctagaggagtgccagcatcagacctag

SEQ ID NO: 210254 - DNA, 696 bp, Artificial Sequence
  Description of Artificial Sequence: Synthetic coding sequence
atggagccccccggcgactggggcccccccccctggcggagcacccctaagacggatgtgcttcgcttggtcctttatctgacttttctcggtgcaccctgttatgcccccgcactccccagctgcaaggaggatgaatacccggtaggcagcgagtgttgccccaagtgctccccaggttaccgcgtcaaagaagcgtgtggtgagctgactgggaccgtgtgtgagccctgcccaccaggcacttacattgctcacctcaatggcctgagcaagtgccttcagtgtcagatgtgcgaccctgccatgggtttgagggcaagcaggaactgctcaagaaccgaaaacgccgtttgtgggtgcagccccggacacttttgcattgtccaagatggcgatcactgcgccgcctgcagggcctacgccacttctagtcccgggcagagggtgcagaagggaggcacagagtcccaggatacactgtgtcagaattgcccccccgggaccttctcccctaatgggacactagaagaatgccagcatcaaacgaagtgcagctggttagtcaccaaagcgggcgctggcacaagctcttctcattgggtttggtggtttctgagcgggagcctggtcattgtcatcgtttgttccactgtcgggctgataatctgtgtaaaaagacgtaaaccccgctag

SEQ ID NO: 210255 - DNA, 696 bp, Artificial Sequence
  Description of Artificial Sequence: Synthetic coding sequence
atggagccccccggcgactggggcccccccccctggcggagcacccctaagacagatgtcctgagactagtactgtatctgactttcctaggcgccccctgctatgcccctgccctgccgtcgtgtaaggaagatgagtatcctgtcggatcagaatgctgtcctaaatgtagtccagggtacagagttaaggaagcatgcggcgaacttacaggcacggtgtgtgagccatgcccaccgggaacctacatcgcccacttgaatggactgtccaaatgcttgcagtgtcaaatgtgtgatcctgcaatgggccttagggcatctcgcaactgttctcgtaccgaaaacgctgtgtgcggctgctctcccggacacttctgtatcgtgcaggatggggatcactgtgcagcatgccgggcttacgccacctccagccccggccagcgggtgcaaaaaggaggtaccgaaagtcaggatacactttgccagaactgcccgcctggcaccttttcaccaaatggcaccctggaagaatgccaacaccagacaaagtgcagttggctggtgactaaagctggcgccggaacttcttcatcccactgggtatggtggttcctctcgggcagcctggtgatcgtgattgtgtgctcaacagttggtctgattatctgcgtcaagcgaaggaaaccccgctag

SEQ ID NO: 210256 - DNA, 696 bp, Artificial Sequence
  Description of Artificial Sequence: Synthetic coding sequence
atggagccccccggcgactggggcccccccccctggcggagcacccccaaaactgatgtgctccgacttgtattgtacctcacatttctcggtgcaccctgctatgcacccgctctccccagctgcaaagaagatgagtacccggtgggctcagaatgttgtccaaagtgcagtcctggataccgagtgaaggaagcttgtggcgagctgaccggtacagtgtgcgagccctgtccccccgggacctacattgcccatttgaatggcctgtccaagtgcctacagtgccagatgtgcgaccccgctatgggattacgggcatcaaggaattgtagtaggacagagaacgcagtatgtggctgtagccctgggcatttctgcattgtacaggacggggaccattgcgcagcctgcagagcttacgcaacctctagccccggccaacgagtgcaaaagggcgggaccgaatcccaggatactctctgtcaaaattgtcctcccgggacgttctcaccgaacgggaccttagaggagtgtcagcaccaaacaaaatgttcatggctcgtgacaaaagcgggtgcggggacatcatccagtcactgggtatggtggttcctaagcggttccctggtgatagtgatagtgtgttccactgtgggtttgattatttgcgttaagaggcgaaagcctagatag

SEQ ID NO: 210257 - DNA, 555 bp, Artificial Sequence
  Description of Artificial Sequence: Synthetic coding sequence
atgctgcagatggccggccagtgcagccagaacgagtacttcgacagcttactgcatgcctgcattccttgccagctgcggtgctcttccaatactccacctctgacctgtcagcggtattgtaatgcatcggtgaccaactctgttaaaggtacaaatgccattctgtggacctgcctggggctgtccctgatcatctctctagctgtgtttgtgctgatgtttcttctgcgcaagattaactccgagcctctgaaggatgaattcaaaaacacaggctccgggctgctgggcatggccaatatcgacctggagaagagccgcaccggggacgaaatcattttaccaagaggactcgaatataccgtggaggagtgtacctgtgaagactgcattaaatctaaacctaaagtggactcagatcactgctttcctctgccagctatggaagaaggggccaccatccttgtgacaacgaaaacaaatgattactgcaaatctctccccgccgctctttctgcaactgagatcgagaagagcattagcgccagatag

SEQ ID NO: 210258 - DNA, 408 bp, Artificial Sequence
  Description of Artificial Sequence: Synthetic coding sequence
atgctgcagatggccggccagtgcagccagaacgagtacttcgactcactcctgcatgcatgcatcccgtgtcagctcagatgtagctcaaacacgcccccactcacgtgccagcgctactgtaacgcccggtccggcctgttggggatggcgaatattgaccttgaaaagtcacgcactggagatgaaattattctgcctcgtggtctcgagtacaccgtggaggaatgcacctgcgaggactgcattaagagcaaacctaaggtggattcagaccactgcttcccactccccgcaatggaagagggagcaaccattctcgtcacaactaagactaatgattactgtaagtcccttcccgccgcactgtcagccactgaaattgaaaaaagcatttcagctcgctag

SEQ ID NO: 210259 - DNA, 417 bp, Artificial Sequence
  Description of Artificial Sequence: Synthetic coding sequence
atggccggccagtgcagccagaacgagtacttcgacagcctgctgcacgcgtgcattccctgccagctccggtgcagtagtaacaccccacccctgacctgccaacgctactgtaacgccagcgtgacaaacagtgtgaaaggcacaaacgccattttatggacctgtctcggtctctcacttatcattagtctggcggtcttcgtgctgatgtttctgctccggaaaataaactcagagccactgaaagacgaatttaagaacaccgagatggagagtcgatcggttgcccaggcaggcgttcagtggcgggatctcaattcactccagccgttgccactagggttcaagcagttttctcatttgtcgctgttgtcgaactgggactatcgcattcggtcacccggacacgggtag

SEQ ID NO: 210260 - DNA, 768 bp, Artificial Sequence
  Description of Artificial Sequence: Synthetic coding sequence
atggcccagcacggcgccatgggcgccttccgggccctgtgcggcttggcgctgctctgcgctttgtcactcggccagcgcccgacagggggtcccggttgcggccctgggcgccttcttctgggaaccggaaccgatgcccgctgttgccgcgtgcacaccactagatgctgccgcgattatcccggtgaggaatgctgcagcgaatgggattgcatgtgtgtccaaccagaatttcactgcggcgacccctgctgcacaacatgtcggcaccacccatgtcccccgggccaaggagtgcagagccaggggaaattttcatttggattccagtgtatcgattgtgcgtcaggcactttctctgggggtcacgagggacactgtaaaccctggaccgattgctgctggagatgccggaggcgtccgaagacccctgaagctgcgagctcccctaggaaatcgggcgctagcgatagacagaggcgaagggggggctgggagacatgtggctgtgaacctggtaggccgcctgggcccccgacagcggcatctccgtcaccaggggcccctcaggccgccggagccctgaggtctgcattgggtcgggcactgctgccctggcagcagaagtgggtgcaggagggaggatctgaccaaaggcccggcccctgctcctctgctgcagccgccggcccctgtaggagagaaagagagacacaatcctggccaccctctagtttggctggtcctgacggcgttgggagctag

SEQ ID NO: 210261 - DNA, 705 bp, Artificial Sequence
  Description of Artificial Sequence: Synthetic coding sequence
atggcccagcacggcgccatgggcgccttccgggccctgtgcggcctcgccctgctttgcgcactctctctgggccagcgtcccaccggcggccccgggtgcggtcccgggcgcctgctcttgggcacaggtactgatgcccggtgctgccgcgtgcacacaacaaggtgctgccgtgattatccaggagaagagtgctgttcagagtgggactgcatgtgcgtccaacctgaatttcactgcggtgacccctgctgtaccacttgcagacaccacccttgtccacctggtcagggggtccagagccaggggaaattttcatttggcttccagtgtattgactgcgctagcggtacattcagtggaggccatgaagggcactgcaagccttggacggattgcactcagtttggctttctgacagtcttccctggcaataaaactcataatgccgtgtgcgttcctggatcccctcctgcagaacccctaggatggctaactgtggtccttctcgccgtggcagcatgtgtcctcctccttacttctgcccagctggggctgcatatctggcagctccggaagactcagttgctgctcgaggtcccgccaagcactgaagatgcaagaagttgccagttcccagaggaagagagaggagaaaggagtgctgaggagaagggtcgacttggagatctgtgggtctag

SEQ ID NO: 210262 - DNA, 726 bp, Artificial Sequence
  Description of Artificial Sequence: Synthetic coding sequence
atggcccagcacggcgccatgggcgccttccgggccctgtgcggcctggctctcctgtgtgcgcttagcctaggtcagaggccaaccggtgggccaggatgtggccctggtagactacttcttgggacaggaacagatgctaggtgctgcagggtgcacaccacgaggtgttgtcgcgactatcccggcgaagagtgctgctccgagtgggactgtatgtgcgtgcagccagaatttcactgcggggatccctgttgtactacttgccggcaccacccctgcccaccagggcagggcgttcagtcgcagggtaaattttcctttgggtttcaatgcatcgattgcgccagcggtacatttagtggcgggcacgaaggccactgtaaaccctggactgactgcacacagtttggatttcttactgtgttcccaggcaataagactcacaatgctgtatgcgtaccaggaagcccacccgccgaaccactgggttggctgaccgttgttttgctcgccgtggcggcttgcgtgctgctgttgacctcggcccagctgggacttcatatttggcagctccgatcccaatgcatgtggccgagggagacgcagctgttgcttgaggtccctccaagtactgaggatgctagaagttgccaattcccagaggaggagcgtggcgaaaggagtgctgaggagaaaggcagactgggcgacctctgggtgtag

SEQ ID NO: 210263 - DNA, 834 bp, Artificial Sequence
  Description of Artificial Sequence: Synthetic coding sequence
atgtgcgtgggcgcccggcggctgggccggggcccctgcgccgccttgcttctgctcgggctcggcctgagcacggtcacagggctccactgtgtgggggacacctatcccagcaatgaccggtgctgccacgagtgccgccccggaaatggcatggtcagcagatgtagccgaagccagaatacagtttgtcgcccttgcggacccggtttctataacgatgtggtttcatcaaagccatgcaaaccatgtacctggtgcaatctgaggtccgggtcagagcgaaagcagctctgcaccgccactcaagacactgtctgcagatgtcgcgccggtacgcagcctttggacagctataaacctggtgttgattgtgccccttgtccccccgggcatttcagcccgggggacaaccaggcatgtaagccttggacgaattgtaccctggctgggaagcacacactgcaacccgcaagcaattcatctgatgctatctgcgaggaccgggacccccctgccactcagcctcaggagacacagggaccacctgcccgccctatcacagtccaacctaccgaggcttggcctagaacgtcccaagggccaagtacccgccccgtggaagtgcccggtggtcgggcggtggctgctatcctggggctaggccttgtactaggcctcctagggcctctggccatcttgctggcactctacttgcttagacgcgaccagcgactgccacctgatgctcataagcctcctggcggtggaagtttccgaacgccaattcaggaagagcaggcagacgctcactccaccctcgcgaaaatttag

SEQ ID NO: 210264 - DNA, 399 bp, Artificial Sequence
  Description of Artificial Sequence: Synthetic coding sequence
tgacccggcgccccccccctgccccccggcgcccagacccggccccgtcctcggggtgtgggcgagacaacattagctatgtggcctgggctcgctgggctcagcagaagcggatctgagcgcaagcaattgtgtacggctacacaggatacggtatgccggtgcagagcgggcacacagccactggactcttacaaacctggggtagactgcgctccatgcccacccggccatttttcccctggcgacaatcaagcatgtaaaccgtggacgaattgtacactggcgggcaaacacaccctgcagcccgccagcaatagttcagatgctatatgtgaggaccgggatccgcctgccacacagcctcaagagacccaggggccacccgcacgcccttag

SEQ ID NO: 210265 - DNA, 423 bp, Artificial Sequence
  Description of Artificial Sequence: Synthetic coding sequence
atgcgggccctggagggccccggcctgagcctgctgtgcctggtgttagccctaccagccctgctgccggtaccggcagttagaggcgtcgcagagactccaacctacccatggagggatgccgaaacaggagagcgcctagtgtgtgcgcagtgcccgcccggaactttcgtgcagcggccctgtaggcgcgattcacctacgacatgtggaccttgccctccaagacactacacacaattttggaattatctcgaaaggtgccgttattgtaacgtgctgtgcggcgagcgtgaggaggaggcccgggcctgtcacgccacccacaaccgggcctgctgtggctgttgcaggcggtgcgcctggccagggtgccctggatggagcggcgccagtgtctccgcctccagtttgtgtacttag

SEQ ID NO: 210266 - DNA, 903 bp, Artificial Sequence
  Description of Artificial Sequence: Synthetic coding sequence
atgcgggccctggagggccccggcctgagcctgctgtgcctggtgctcgcactgccagccctattacccgtgccagctgtgcgtggagtcgcagagactcccacctatccttggcgagacgccgagactggagagaggctggtctgcgcccagtgcccacccggaacatttgttcagagaccatgcagaagagactcacctacgacatgcgggccgtgtcctccacgccactatacccagttttggaactatctcgagcgttgccgctactgcaatgtgctgtgcggcgaacgtgaagaagaagcacgagcttgccacgcgacccacaatcgagcctgccgttgtagaactgggtttttcgcacacgccggcttttgtcttgagcatgctagctgtccgcctggcgccggcgtgattgcccccggcaccccatctcagaacacccagtgtcagccctgcccacccggcacattctcagctagcagctccagcagcgaacagtgccagcctcatcgcaattgtacggctcttgggctagcattgaacgtaccaggttcttctagtcatgacactctctgcactagctgtactgggttccctctgagcacgcgagtgccgggagccgaagaatgcgagagagccgtgatcgatttcgtggcatttcaggatattagcattaagaggctccaaagactgttgcaggctctggaagcccctgagggctggggacccacgccaagggctggcagagcggccctgcaattgaagctccgcaggcgactcacagaattgcttggcgcacaggatggcgccttgcttgtgagacttcttcaggccctgagggtggctcgtatgccaggtcttgaacgctctgttagggagcgttttctcccggttcactag

SEQ ID NO: 210267 - DNA, 903 bp, Artificial Sequence
  Description of Artificial Sequence: Synthetic coding sequence
atgcgggccctggagggccccggcctgagcctgctgtgcctggtgttagctttgcccgctctgctccccgttccagctgtccgcggggtcgccgaaaccccgacctacccatggcgagatgcggagacgggagagaggttggtgtgtgcacagtgtccgcccggcactttcgtgcagagaccctgtagacgtgattcaccaactacttgtggaccatgtccccctcgccattatacacagttttggaactacttggagagatgcaggtactgtaatgttctctgcggtgaaagagaggaggaagctcgggcatgtcacgccacacacaatcgcgcatgtcgatgccggactggcttcttcgcccacgctggcttctgcctggagcatgcatcgtgccccccaggcgcaggggtgatagcaccagggacaccaagccagaatacacaatgccagccctgcccgcctggcaccttcagcgcatcatcgtcatccagtgagcaatgccagccgcaccggaactgcactgccctgggcctggccctgaatgtgcccggctctagctcccacgatactttatgcacttcctgtaccggtttccccctcagcaccagagtaccaggagcagaagagtgtgaacgggccgtgatcgatttcgtagcatttcaggacatcagcatcaagcggcttcagaggctcctccaggcactagaggcccccgaagggtgggggccgacccctagggccggtcgtgcagccctgcaacttaagctgagaaggagactgacagagctgctgggtgctcaggatggagccctgttggttagacttttgcaggctctgagagtagcccggatgcccgggttagagcgaagcgtcagggagcgctttctgcccgtccattag

SEQ ID NO: 210268 - DNA, 1788 bp, Artificial Sequence
  Description of Artificial Sequence: Synthetic coding sequence
atgcgggtgctgctggccgccctgggcctgctgttcctgggcgccctgcgagctttccctcaggacaggcctttcgaagatacctgtcatggaaaccctagccactattatgacaaagctgtccgcagatgctgctaccgatgtccaatgggattgttcccaacccagcagtgccctcagaggcccactgattgccgaaaacagtgtgagccagactattatcttgatgaggccgaccggtgcacagcatgtgtcacctgttccagggacgacttggttgaaaaaactccgtgtgcctggaacagttcccgcgtttgcgaatgccgtccaggcatgttctgttccacgagcgcagtgaattcttgtgcaaggtgtttttttcactccgtatgtcccgcaggaatgattgttaagtttcctgggacagcgcagaaaaataccgtgtgtgagccagcaagcccaggggtcagccccgcttgtgccagccccgaaaattgcaaagagccttcttcaggaaccatcccccaggccaagcctactccagtaagcccagcaacgagcagcgcatccactatgcccgttagaggaggtaccaggctagctcaggaggcagcgagcaagctgacgcgagcccccgatagcccgtcatcagtgggtcgtcctagcagcgacccaggcttgtcccctacacagccctgccctgagggatcaggagattgtagaaaacaatgtgagccagactactacttggacgaggccgggaggtgtaccgcatgtgtgtcttgttcccgtgatgacctggtggaaaagacgccatgtgcttggaattctagccgcacctgcgagtgtaggcctggcatgatatgtgcgacaagcgcaaccaattcccgagcacggtgcgtcccatacccaatctgcgcagcagagacggtcaccaagccgcaggatatggctgagaaggacacaacattcgaggccccccctctgggcactcaacctgactgtaatcctacgcctgagaatggcgaggcgcctgctagcacctcccccacgcagtccctgctggtggactcccaggcttccaagacacttcccatccctacctctgcaccggtggccttgtcttccactggcaaaccggttctggatgctggaccagtgcttttctgggttatactcgtgttagtcgtcgtggtcggatcgagtgcctttctgctctgtcaccggcgagcctgtcgcaaacgaatacggcaaaagttacacctatgttacccagtgcaaacctcccagcctaaactggagcttgtggattccagaccacggcggtcatccacccagctacggtccggtgcctccgtcacagaacctgttgccgaggaaagagggcttatgtctcagccactaatggaaacctgccacagtgtaggtgccgcttatctggaatccttacctctacaggacgcaagtcccgccggcggaccatcgtctcctagagatctacccgaacctcgtgtgtccacagaacatactaataataaaatagaaaagatctatattatgaaggcggatacagtgatcgtagggaccgtgaaggctgaactgcccgaagggaggggtcttgccggccccgccgaaccagaactggaagaggaattggaagccgatcatacccctcattatccggagcaggagacagaaccccctctggggagctgttccgatgttatgttgagcgttgaggaggaaggcaaggaagatcctctacctactgctgccagcgggaagtag

SEQ ID NO: 210269 - DNA, 399 bp, Artificial Sequence
  Description of Artificial Sequence: Synthetic coding sequence
atgagccagcccctgatggagacctgccacagcgtgggcgccgcctacctggagtctctgcctcttcaggatgcctccccagctggcgggccctcctcaccccgggacctgcccgaaccgcgcgtttcaactgagcacaccaacaataagatcgagaagatttacatcatgaaggccgatactgtgatcgtcggcactgtcaaggccgagctgccggaaggtagaggcctcgcaggccctgctgaaccagagttagaggaagagttggaggccgatcataccccgcactatccagagcaggagaccgagccccctttaggaagttgtagtgatgtgatgctctctgttgaggaggaaggcaaggaggatccactgccaaccgcagcttccggcaagtag

SEQ ID NO: 210270 - DNA, 1452 bp, Artificial Sequence
  Description of Artificial Sequence: Synthetic coding sequence
atgttctgcagcaccagcgccgtgaacagctgcgcccggtgcttcttccactcagtgtgccccgccggtatgatcgtcaagtttcctgggactgcgcaaaagaacacagtgtgtgagccagccagtcccggtgtctccccagcatgcgcatcgcccgaaaattgtaaagaaccaagtagcgggacaataccccaagccaaaccgacccctgtctcaccagctacttctagtgccagcacaatgccagtccgaggcggcacccggctggcccaggaagccgccagcaagctcacacgggccccagactccccgtcctccgtcggcaggccgtcatctgatccaggtttgtcacccacgcaaccttgtccggagggttctggcgattgcaggaagcaatgtgaacctgactattatttagacgaggctggtaggtgcacggcatgcgttagctgctcacgtgacgacctggtggagaagacaccttgcgcctggaactccagccgaacatgcgagtgtcgtcccggcatgatttgcgccacctctgcaaccaattctcgagcccgatgcgttccctatcctatctgcgctgccgagaccgtgaccaagccacaggacatggccgaaaaggacaccacctttgaagcacccccccttggtacacagccagattgtaatccaacccctgagaacggggaagcacccgcatcaaccagccctacccagtctctgctggtcgacagccaagctagcaagacccttcccatacctacctccgctccagtggccctttccagcacaggaaagcctgttctggacgccggacccgtgcttttctgggtaatattggtcctggttgtcgttgtgggcagctcagcgttccttctatgtcataggcgggcatgtagaaagcgcatacgacagaaactccacctttgttaccctgtgcaaacaagccaacccaaactggagctcgttgactcaagaccccggcgttcttccaccttgcgctcaggagcatccgtgacggagccagtggcggaagagcgagggctcatgtcccagccgcttatggagacatgtcatagtgtgggcgcagcttatttggaatcactgcccctccaggacgcatctcccgcgggaggcccttcatccccaagggacctccccgagccaagagtctccaccgaacacacgaataataaaattgagaaaatttacatcatgaaagccgacactgtcatcgtggggaccgtgaaagcagaactgcccgagggacgcggactggcaggccctgccgagccggaactggaggaggaattggaagctgatcacacaccacattatcctgagcaggaaaccgagccgcccctggggtcctgctcagacgtgatgctttccgtggaagaggagggaaaggaggatcctctgccaacggccgcttcgggcaagtag

SEQ ID NO: 210271 - DNA, 1437 bp, Artificial Sequence
  Description of Artificial Sequence: Synthetic coding sequence
atggcccccctgcggcccctgctgatcctggccctgctggcctgggtggccctcgccgaccaagaatcttgtaagggcaggtgtacagaaggatttaatgttgataagaagtgccaatgcgatgaactctgcagctactatcaaagttgctgcaccgactatacagctgaatgcaagccacaagttaccaggggggacgtgttcaccatgcccgaggacgagtacactgtgtatgacgatggggaggagaagaataacgctaccgttcacgaacaggtaggaggacctagcctgacaagcgatctgcaggcccagtccaagggcaacccggaacagacacctgtgctgaaacccgaggaagaggcaccggctccagaagttggagcctccaaacctgagggaattgactcacggccagagacgttacatcccggccgcccccagccgcctgctgaggaggaactatgcagcgggaaacccttcgacgccttcacagatctgaagaacgggtctctctttgcgtttagaggacagtactgttacgaattagatgaaaaagccgttaggccgggataccctaagttaatcagagatgtgtggggaatcgaaggccccatcgacgctgccttcacacgtattaattgtcagggaaagacctacttgtttaagggctcccaatactggcgatttgaggacggcgttctcgaccccgactaccccaggaatatcagtgatggcttcgatggcatccctgacaacgtcgacgcagcattggccttacctgcccattcttattcaggacgggagcgcgtttacttctttaagggtaaacagtactgggaataccaattccaacaccaaccatcccaagaggaatgtgagggtagctcactctccgcagtcttcgaacatttcgccatgatgcagagagactcctgggaggacatctttgagctgctgttctgggggcggacctctgctggtaccaggcagcctcagttcatttctcgcgactggcacggggtgcccggccaggtggacgcagccatggcaggcagaatatatatttccggcatggcccctcgcccctctctggccaagaagcagcggtttaggcaccggaatagaaaagggtaccgcagccagcgggggcattctagaggccggaaccagaatagtcgcaggccaagtagggccacctggctaagcctattttccagcgaggagtcaaacttgggtgccaacaattacgatgattatagaatggattggctagtccccgccacctgtgagcccatacagtctgtgttttttttttctggggacaagtattatcgcgtgaatctgcgcacaaggagggtggacaccgtcgacccaccatatcctagatcaatcgcacagtattggttggggtgccccgcccccggccacctgtag

SEQ ID NO: 210272 - DNA, 639 bp, Artificial Sequence
  Description of Artificial Sequence: Synthetic coding sequence
atggccgaggccaagtactacctgatccagggcctggtgaacatgtgccagagtgcattgcaggacaaaaaggacagctaccagccagtctgcaatattcctattatcacctcacttaaagaagaagagcggctgatcgaatcttcaaccaagccagtggtcaagctgctctataataggagcaacaataagtattcttatactagcaattctgacgaccacttgctcaagaatattgaattgttcgataaactgtctttgcgcttcaacggccgggtcctgttcattaaagacgtgataggcgacgagatctgctgttggtcattctacgggcaaggcagaaaattggctgaagtgtgctgcaccagcatcgtgtatgccactgaaaagaaacagactaaggtcgaatttcccgaagccaggatttatgaggagacactcaacgtgcttctgtatgaaacccctagagtgcctgataacagtctgctggaggccacaagtcggtctcggagtcaagccagcccatcagaggacgaagagaccttcgagctccgggaccgcgtgcgaaggatccatgtcaagcgctacagcacatacgacgatagacaactaggacaccagagtacacatcgcgactag

SEQ ID NO: 210273 - DNA, 1965 bp, Artificial Sequence
  Description of Artificial Sequence: Synthetic coding sequence
atgagcgaggccagcagcgaggacctggtgccccccctggaggccggagccgcaccctatcgcgaagaagaggaagcagctaagaagaagaaggagaagaaaaagaagtccaagggcctcgctaatgttttttgcgtgtttacaaagggcaaaaagaagaagggccagccatcctctgctgaacccgaggatgccgcgggatctcgccaagggctggacggaccaccgcctacagtggaggaactgaaagccgccttagagagagggcaactggaggctgctaggcctctcctcgcgctcgagagagagctggctgccgcagcagccgctggcggcgtgtcagaggaggagcttgtgaggcggcaatcaaaagtggaggccctgtacgaacttctgagggatcaggtactcggggtgctccgccgacccctcgaggcgccccctgaaaggctgagacaagccctggctgtggtggctgaacaggaacgtgaggatagacaggccgctgctgccggacctggaacctccgggctagccgcaacgagaccgcgtaggtggctgcagctttggagacgtggggtcgccgaagcagcggaggaaagaatgggacagcgtcccgccgccggcgcggaggtgcctgagtcagtgttcctccatcttggtcgaactatgaaagaagatctggaggccgtagtcgagagactgaaacctctattccctgctgagtttggtgtagtggcagcctatgccgagagttatcaccaacacttcgcagcgcatctagcggccgtggcccagtttgagctgtgtgagcgggacacctatatgttactgctgtgggtccagaacctctaccccaacgatatcatcaactcacctaagctggtgggcgagcttcagggaatgggcttaggtagcctgctgccacccaggcagatcagactgctggaagccacgttcctatcttctgaggcggcaaatgtgagggagctcatggaccgcgccctggaactggaggcccggagatgggcagaggacgtccctccgcagcggctggacgggcactgccacagtgaactggcgatcgatattatccaaattacctcccaggctcaggcaaaggccgaatcgattacactggacctaggctcgcagatcaaacgggtgctactggtggaattacctgcctttctgcgctcttatcaaagagctttcaatgagttcctggagcgtggaaaacagctgacaaactaccgcgccaatgtgattgccaatatcaacaactgtctctcatttagaatgagcatggagcagaactggcaggtcccccaggataccttgtcacttctcctgggcccactcggggaacttaagtctcacggctttgacactctcctgcaaaacctccacgaagacctcaaacctcttttcaagagatttactcatacaaggtgggctgctcccgttgaaactctcgagaatatcatcgccaccgtcgacaccaggctgcctgaattttctgaattgcaggggtgctttcgtgaggaactgatggaagctctccatcttcacttagtgaaagaatacatcattcaactcagcaaaggacgcctggtcctgaaaaccgcagagcagcaacagcagttagcgggttacatactagccaacgctgatacaatccagcatttttgcactcagcacggcagcccagccacttggctgcaacccgctcttcctacgctcgcagaaattataagactgcaagacccttctgctataaaaatcgaagtggccacctacgcaacctgctatcctgattttagtaaggggcatctgagcgctatcctggctatcaaagggaacctcagcaattccgaggttaagcggatcagatcaattctggatgtttccatgggggcccaggagcccagccgccccctgttttctctgataaaagtgggctag

SEQ ID NO: 210274 - DNA, 972 bp, Artificial Sequence
  Description of Artificial Sequence: Synthetic coding sequence
atggaccgggccctggagctggaggcccggcggtgggccgaggacgtgccgccacagcggttagatggccactgtcactccgagctcgcaattgacatcattcaaatcacttctcaggcacaggctaaagccgagtcgatcaccctcgacctcggcagccagattaagagggtgctgctggtggagctgcctgccttcctgcggagttaccaaagagccttcaatgagtttctggaacgtgggaagcagctgactaactacagagcgaacgtaattgctaatatcaataattgcctatcttttcgaatgtctatggagcagaattggcaggtgccacaggatacactgtctttactactgggacctcttggcgaacttaagagccatggctttgacacactgctgcaaaacctgcatgaggatctgaaaccccttttcaaacgatttacacacacccgatgggcagctcctgtagaaacactggagaatattatagccactgtcgacacgaggctcccagaatttagtgaactccagggctgcttcagggaggagctcatggaggcgcttcaccttcaccttgtcaaggagtacatcatccagctatccaaaggcaggctggtcttgaagactgccgaacagcagcagcagctggccggatatattttggccaacgccgacactattcagcatttctgcacacagcacggttcccccgcgacgtggctacagccagcactgccgaccctggctgagatcatccggttgcaagacccgtctgctataaagatcgaagtggctacatatgctacttgctaccccgatttctctaaaggacacctcagcgctatcctggcaattaaaggaaacctgtcgaattctgaagtgaaacgaattaggtcaatcctcgatgtcagcatgggcgcccaggaacctagccgcccactatttagcttgattaaggtgggttag

SEQ ID NO: 210275 - DNA, 600 bp, Artificial Sequence
  Description of Artificial Sequence: Synthetic coding sequence
atggaggccctgcacctgcacctggtgaaggagtacatcatccagctctcaaaggggcgtcttgtactgaaaactgctgaacagcagcaacaactggccggatatatcttggctaacgctgatactattcagcacttttgcacgcaacatgggagtcccgctacgtggctgcagcctgcccttccaaccctggccgagatcattaggctgcaggacccaagcgcaataaagattgaagtggccacctatgctacatgctaccccgatttttctaagggccacctgtccgctatcttagctataaagggaaacctgtctaactcagaggtcaaaagaatcagatccatcttggatgtatcaatgggggcccaggagccgtcgaggccgcttttctcgctgattaaacctagagcagctgtgtcggggatccagcagtggtggaacggccgccaaaattggaaaaggaagaaagagaaaatgagcagccgccttgccggcgcatttcgggtgctttggagggcggtgtctacagcttctattagacgccacatccaggtggctccacgccctctccaggctggacctgctatgggcccatag

SEQ ID NO: 210276 - DNA, 120 bp, Artificial Sequence
  Description of Artificial Sequence: Synthetic coding sequence
atgagcgaggccagcagcgaggacctggtgccccccctggaggccggtgcggccccctatcgcgaggaggaggaagccgccaagaaaaagaaggagaagaagaagaaatccaagggatag

SEQ ID NO: 210277 - DNA, 1965 bp, Artificial Sequence
  Description of Artificial Sequence: Synthetic coding sequence
atgagcgaggccagcagcgaggacctggtgccccccctggaggccggcgctgccccctacagggaagaggaggaggccgctaaaaagaaaaaagaaaagaagaaaaagtccaagggtctggccaatgtgttctgtgtgtttaccaagggtaagaaaaagaaggggcaaccttcatcggcggagccggaggacgcggctgggtctcgtcagggtctcgacggtccacctcctacagttgaggaacttaaagctgcattggagcgaggtcagctagaggccgccaggcccttgctggcactcgagcgcgaactagccgccgctgccgcggccgggggagtcagcgaggaagagctggtgagacgccagagtaaggtggaagccctctacgaattgctcagagaccaggtgctcggcgtcctgcgacgcccactcgaggcaccgccagagcggctgcggcaagccctggccgtcgtggccgaacaggagcgtgaggacaggcaggccgcagctgctggacctggcactagcgggcttgccgcgacacgccctagacggtggctgcagctatggagaagaggcgttgcagaagcggccgaggaaagaatggggcagagacccgccgctggagctgaagtgccagagtccgtgttccttcacctgggcaggacaatgaaagaagatctggaggctgtagtggagagacttaagccactcttccccgccgagttcggcgtagtggcagcctatgcagaaagctatcaccagcacttcgccgcccacctggctgctgtggctcaattcgagttgtgtgaaagggatacatacatgctactgctatgggtgcaaaacttgtacccaaacgatatcattaactccccaaagctggtcggggagctgcaggggatgggactcggttctctgttgccacctcgacagataagactgcttgaagctacattcctctcctccgaagccgccaacgtaagagagctgatggatcgggcgctggagctggaggccagaagatgggcagaagacgtgccacctcagagactggacggacattgccactcagagttggccatcgacattattcagattaccagccaggcccaagcaaaggcagagtccattacgctcgacctagggtcgcagatcaagagagttctcttggtagagctcccggcatttctccgatcttatcagcgcgcctttaacgagttcttggaacggggaaaacagcttaccaattaccgggccaacgttattgcaaacattaataactgtctctcatttcgtatgtcgatggaacagaattggcaggtgccacaggacaccctctctctcctcctgggccctctgggcgaattgaaatctcatggatttgatacccttctgcaaaacctgcacgaagacctaaagcctcttttcaagcgattcacccatactaggtgggccgctcccgtggaaactctcgagaacatcatcgcaacggtagacacaagactgccagagttttccgagcttcagggctgtttccgtgaggagttgatggaggccctgcacctgcatctcgtgaaagaatatataattcagttgtcaaaaggccggctggttctcaagacggcagagcagcaacagcaacttgccgggtacatcctggctaacgccgacacgatacagcacttttgcacacagcacggatctcccgcaacctggctgcagccagccctccccactctggcagagatcattaggctccaggacccgtcagcgataaagatcgaagtcgcaacatatgccacgtgctatcccgacttttccaagggacacctctccgccatcctggcgattaaggggaatttgtcaaactctgaggtcaagcggatcagaagcattctggatgtgtccatgggcgcccaggagccctcccggcccttattctcattgataaaggtgggatag

SEQ ID NO: 210278 - DNA, 2373 bp, Artificial Sequence
  Description of Artificial Sequence: Synthetic coding sequence
atggccgagcaggtgctgccccaggccctgtacctgagcaacatgaggaaagccgtcaagatccgggagaggacgccggaggatatttttaagccaaccaatggcatcatacatcattttaagacaatgcacaggtatactctcgagatgttccgcacttgccagttttgtccacagttccgggaaattattcacaaggcactgatcgaccggaatatccaggcaaccctcgagagccaaaagaagctgaattggtgcagagaggtgcgaaagctcgttgctctgaaaaccaacggtgacggcaactgcctgatgcatgccacgtcccagtacatgtggggagttcaggatactgacctggtcctgcgtaaggccttgttctccacattgaaggagaccgacacaaggaacttcaagtttcgctggcagctcgaaagtctgaagtcccaagagtttgttgagacaggtctgtgctatgacacccggaattggaacgatgaatgggataacttgataaaaatggctagtaccgatacacctatggcacggtccggccttcaatacaactctctggaggaaattcatatcttcgttctctgcaacatactgcggcgtcccataatagtgatatcggataaaatgttgaggtcacttgaatccggatcaaactttgctccactgaaggttggagggatttatctgccactgcattggcccgcccaggagtgttaccgctatccaattgtgctagggtatgactcccatcacttcgtcccactcgtcacattgaaggacagcggccctgagatacgggcagtgcccctcgttaatcgggatagaggtaggtttgaggacctcaaggtgcattttctgaccgatcctgagaacgaaatgaaggagaagcttctcaaagagtacctgatggttattgaaatccctgtgcaaggttgggatcatggtacaacccacctaatcaatgccgctaagctcgatgaggccaaccttcccaaggaaatcaacctggtggacgactactttgagctggttcagcatgagtataaaaagtggcaggagaattccgagcaggggaggcgggagggtcacgcccagaatccgatggaacccagcgttccccagttgtcccttatggacgtgaagtgtgagactcctaactgcccgtttttcatgagtgtaaatacacagcctctctgccatgaatgttcagagcggagacaaaagaaccagaataagctccccaaactgaactccaagcccggcccggagggcctgcccggtatggctcttggcgcgtcacggggggaggcctacgagccattggcctggaacccggaagagagtaccggcgggccccacagcgcccctcctactgctcccagcccttttctgttctccgaaactaccgccatgaaatgccgcagccctgggtgcccctttactttaaatgttcagcacaatggattttgcgagcggtgccataatgctaggcaactgcacgcctctcatgctccagaccacactaggcacctggaccccggcaagtgtcaggcctgcctgcaggacgttacccgcactttcaacggcatttgcagcacatgtttcaaacgtaccactgcggaggcaagctcctcactgtccacgagtctgcctccgagctgccatcaaaggtccaagtcagatccaagcaggctggtccgatccccaagccctcacagttgccaccgggccggtaatgacgcgcctgccggctgtttgtctcaggccgcaaggacccccggtgataggaccggaacctctaagtgtaggaaagcaggctgtgtatacttcggaaccccagagaacaagggcttttgcacactgtgcttcattgaatatcgagagaacaaacacttcgcagccgctagcggcaaagtgagtccaacagcttctcgtttccagaataccatcccatgtctcggccgggagtgtggtacactaggctcaactatgtttgaaggctattgccaaaagtgtttcatcgaggcccagaatcagcgctttcacgaggccaaacgtaccgaggagcagttaagatcatctcaaagacgggatgtgccaagaaccacgcaaagtacctctcgcccaaagtgtgccagggcctcctgcaagaacatcttggcatgcaggagtgaagaactgtgtatggaatgccagcaccccaatcagagaatgggccccggagcgcacagaggcgaacctgctccggaggatccacctaagcagcgatgccgtgcgcctgcctgcgatcattttggaaatgcaaagtgcaatggatattgtaatgaatgctttcagttcaaacagatgtacggctag

SEQ ID NO: 210279 - DNA, 489 bp, Artificial Sequence
  Description of Artificial Sequence: Synthetic coding sequence
atggccgagcaggtgctgccccaggccctgtacctgagcaacatgcggaaggctgtgaaaattagggagagaacacctgaagatattttcaagccaacgaatggaattatccaccatttcaaaaccatgcacagatacactcttgagatgttccgtacctgtcaattttgtcctcagttccgcgaaatcattcacaaagctttgattgatagaaatatacaggctacactagagtcccagaagaagctaaattggtgccgggaggtccgcaaactggtagcactgaagactaacggggacgggaattgtctaatgcacgctacttcgcagtacatgtggggcgtccaggatacggacttagtgcttaggaaagccctcttcagtacactaaaggaaactgacacccggaactttaaatttcgatggcagctggaaagtctcaagtctcaggagttcgttgaaaccgggctctgctatgatacgaggtag

SEQ ID NO: 210280 - DNA, 81 bp, Artificial Sequence
  Description of Artificial Sequence: Synthetic coding sequence
atggccgagcaggtgctgccccaggccctgtacctgagcaacatgaggaaggctgtgaaaattagagaaagaaccccgtag

SEQ ID NO: 210281 - DNA, 297 bp, Artificial Sequence
  Description of Artificial Sequence: Synthetic coding sequence
atggccgagcaggtgctgccccaggccctgtacctgagcaacatgcgcaaggcggtgaagatcagagaacgcacacccgaggacattttcaagcctaccaacggtataatacatcattttaagacaatgcacagatacaccctcgagatgtttcgaacctgtcagttctgtccccaatttagggagatcatccacaaggctctgattgataggaatatacaggctacccttgagagccagaagaagctgaactggtgcagggaagtcaggaaactcgtggcactgaaaacaaattag

SEQ ID NO: 210282 - DNA, 813 bp, Artificial Sequence
  Description of Artificial Sequence: Synthetic coding sequence
atggccgagcaggtgctgccccaggccctgtacctgagcaacatgcggaaagcggtgaaaattagggagcggactcctgaggatatatttaagccgacaaatgggatcattcaccattttaaaaccatgcatcggtatacgctggaaatgttcagaacatgccaattttgtcctcaattccgcgagataattcacaaagctctgattgatcgaaatatccaggctacactggaatctcagaaaaagttgaattggtgcagagaggtgcgaaagttggtcgcccttaagacaaatggagatgggaactgtctcatgcacgccacctcacagtacatgtggggggtgcaggatacagatctcgtgctccgaaaagcccttttctcgaccctgaaggagactgatacaagaaatttcaaatttagatggcagctagagtccctgaaatcccaggagttcgtagagaccggactttgttacgatacccgcaactggaatgatgagtgggataacctgatcaagatggccagcactgatacacccatggcgaggtcagggctgcagtacaacagtctggaggaaattcatatattcgtgctttgcaacatcctccggcggccaattatagtaatcagtgataagatgttgcgctccctggagtctgggtcaaactttgccccactgaaggttggcggaatttatttacccttgcactggcctgcccaggaatgttatcgctatcccattgttctgggctacgactctcaccatttcgttccactggtcactttgaaggatagcggtcccgacatctag

SEQ ID NO: 210283 - DNA, 2250 bp, Artificial Sequence
  Description of Artificial Sequence: Synthetic coding sequence
atggccgagcaggtgctgccccaggccctgtacctgagcaacatgcgcaaggctgtgaaaattcgggagcgcactccagaggacatctttaaaccgaccaatggcattattcaccacttcaaaaccatgcaccggtacacgctcgaaatgtttaggacctgtcagttctgtcctcagtttagggagatcattcacaaggccctgattgatagaaacattcaggcaactctggagtcacagaaaaagttaaattggtgcagagaagtgagaaagctcgtggcccttaagactaatggcgacggaaactgccttatgcacgcaacttctcagtatatgtggggcgttcaggacacggaccttgttttgcggaaggccctgttctccaccttgaaggaaacagacacacggaactttaaattcaggtggcagctggagagcctgaagagccaggagtttgttgagactggactctgctacgacaccaggaactggaatgatgagtgggacaacctaatcaaaatggcctccacagacacaccgatggctcgtagtgggctgcagtataattcacttgaggagatccatatcttcgtactgtgtaatatcctgagaagacccatcattgtgatcagcgacaagatgttgcgctcgctggagagcgggtctaatttcgccccactcaaagtcggtgggatctacctgccgctccattggccagcccaggagtgttaccgttaccccattgtgctgggatacgattcacatcactttgtccctctcgtcactctgaaggattcagggcctgagatacgggctgtcccccttgtaaatcgtgaccggggacgttttgaagacctgaaggtgcatttcctgactgaccctgaaaatgaaatgaaggagaagctgctgaaggagtatctgatggttattgagataccagtacagggatgggaccacgggacgacccatcttatcaacgccgcaaaattggatgaggctaatctgccaaaggaaatcaatctggtagatgattattttgaactagtccagcacgaatacaagaagtggcaggagaactcagagcaaggccgtcgtgaaggacatgctcaaaaccctatggagcccagcgttccacaattatctctgatggacgttaagtgtgaaactcctaattgtccctttttcatgagcgtgaacacacagcccctttgtcacgagtgctcagaacgccgacaaaagaaccaaaataagctccctaagttaaacagcaagcccgggcctgaaggcttaccggggatggctttaggagccagccgcggagaggcctacgaacctctcgcttggaatcccgaggagtcaacagggggcccccactccgccccaccaaccgcaccctcacccttcctttttagtgagactaccgctatgaagtgtagaagccccggatgccctttcacactgaacgtgcagcataatggattctgcgagcggtgtcataacgccagacaattgcatgcatctcacgccccagatcacacaagacatctggacccaggcaagtgccaggcttgcctgcaggacgtgacccgcaccttcaacgggatctgtagcacatgctttaaacggactactgccgaagcatcatcctcactgtcaacatcactgcccccctcctgtcaccagcggtctaagagcgatccctccagactcgttcggtccccctctccccactcttgccaccgcgctgggaatgacgctccagccggttgtctttcacaagccgcccgtactcccggtgacaggaccggcacttctaaatgccggaaggcagggtgtgtctacttcggtactccagagaacaaaggcttctgtacactctgcttcatcgagtaccgagagaacaaacatttcgctgctgcatctgggaaggtttctcccactgcttcccggttccagaatactattccttgtttagggcgtgaatgcggcacactgggaagcacaatgttcgagggatattgtcagaagtgttttattgaggcacaaaatcaacggttccatgaggctaagcgcaccgaagaacagctgcggagttcccagcgtcgagacgtgcctaggacgacacagagcacttcgcggcctaagtgcgcccgcgcgtcatgcaagaacattctggcctgtaggtctgaggagttgtgtatggagtgccaacatcagccagaggacggaccatggggtccccccggctag

SEQ ID NO: 210284 - DNA, 459 bp, Artificial Sequence
  Description of Artificial Sequence: Synthetic coding sequence
atggccgagcaggtgctgccccaggccctgtacctgagcaacatgcgtaaggctgttaaaatccgggaaagaactcccgaggatatctttaaaccaaccaacggcatcatccaccactttaagaccatgcatcggtatacgctagagatgttcagaacctgccagttctgcccccagttccgggagattattcacaaagcactgatagaccgaaatattcaggcaactcttgagtcccaaaaaaagctgaattggtgtcgagaagtgagaaaactggtcgcactgaaaacgaacggtgacggcaactgtctgatgcatgcgacttcacaatacatgtggggtgtacaggataccgacttagtcctgcgaaaggctctgtttagcactctgaaagaaaccgacacacgcaatttcaagtttcgctggcagttggaaagtcaaatctcgggtatttgctag

SEQ ID NO: 210285 - DNA, 645 bp, Artificial Sequence
  Description of Artificial Sequence: Synthetic coding sequence
atggccgagcaggtgctgccccaggccctgtacctgagcaacatgaggaaagctgtgaagataagggagcgaactccggaagacatcttcaaacccaccaatgggattatccaccactttaagactatgcacagatataccctggagatgttccggacctgccaattttgcccacaattcagagagattatccataaagccctcatcgaccgaaatattcaggccacacttgaatcccaaaaaaagctgaactggtgccgtgaagtgaggaaactcgttgcacttaagacgaatggagatggcaactgcctcatgcatgccacctcccagtacatgtggggcgtccaggatactgatctggtgcttcgaaaggccttgttctccacactcaaagagaccgacactcgtaacttcaaatttcgttggcaacttgaaagcctcaagagccaggagttcgtggagaccggcctctgttacgacacaagaaactggaacgacgaatgggacaatcttatcaaatggctgcctcagacacatccatggccggaagtggatttcagtaccacccattggaaaaaatatacatatctatcgtttgctacatcctcagaagggcagagcctgtcgtttcagacaaagtgctag

SEQ ID NO: 210286 - DNA, 2010 bp, Artificial Sequence
  Description of Artificial Sequence: Synthetic coding sequence
atggccgagcaggtgctgccccaggccctgtacctgagcaacatgcgtaaggctgtcaagatacgcgagaggacgcctgaggacatcttcaagcctactaacggcatcatccatcatttcaagaccatgcatcgatatacactggagatgttccggacctgccagttctgcccccagtttagggagatcattcacaaagccctgatcgaccggaacattcaagcaacactggaatctcagaaaaagctgaactggtgtcgggaggtcaggaaactagtggcactgaaaacaaatggggacggtaactgcctcatgcatgctacgtcacagtatatgtggggggtccaagacactgacttggttctccgtaaagccttgttctctaccttgaaggagactgacacccgcaatttcaaattccgatggcagttggaatccctgaagtcacaggaatttgtggagacaggtctgtgctacgatactcggaactggaatgacgagtgggacaatttgatcaagatggcgtccaccgatacgcccatggcgagatcaggactacagtacaacagtctggaggagattcacatctttgtcctgtgcaacattctgcggagaccaatcatcgttatcagcgacaagatgttacgcagcctggagagtgggagcaatttcgcacctctgaaggtcggcggcatttaccttcccctccactggcctgctcaggaatgctaccgatacccgattgtgctggggtacgactcccatcattttgtacctctggttaccctcaaagactctgggcctgaaatccgagcagtgccgctcgtcaatagggatcggggacggttcgaggatctaaaagtccactttctcaccgaccccgagaacgaaatgaaagaaaagctgctgaaagagtacctaatggtaattgagatccctgtgcaggggtgggatcacggaaccacccacctaattaacgccgcaaaactggatgaggccaatctgcctaaagaaattaaccttgttgatgattacttcgaactcgtccaacacgagtacaaaaagtggcaagagaacagcgagcaaggaagaagggagggacatgcacagaatccaatggagccatctgttccgcagctgtcgcttatggacgtaaagtgtgagacaccgaattgcccctttttcatgagtgttaacacacagcctctgtgccacgagtgctcggaacgcagacagaagaatcagaataaacttcctaaattgaactcaaaaccaggcccagaggggctgcccgggatggcactgggggcatccaggggagaagcttacgaacccctggcgtggaacccagaagagtctacaggaggcccccactctgccccccctaccgcgccatcgccctttctgttctctgagacaactgccatgaagtgtcgaagcccaggatgtccatttacactgaacgtccagcataatggcttttgcgagcggtgccacaacgcaaggcaattgcacgcatctcacgctcccgatcatacaaggcatctcgaccccggaaagtgccaggcatgccttcaggacgtcaccaggacattcaacggcatctgttcgacttgttttaaaaggacaacggcagaggcctcttcctcacttagtacttccttaccaccctcttgtcaccagaggagcaaaagcgaccccagcagactggttcgatccccgagcccccactcgtgccacagggccggcaatgacgctccggccgggtgtctgtcgcaagccgcacggaccccgggagatcggactgggactagcaaatgcaggaaagcaggatgcgtctattttggcaccccggagaataagggcttttgtaccttgttccatcgcgtgcagcggaaacaaacattctgctgctgcttgagagaatcccagtcacatagtgtgcaggtgccggagcatcatagcgtacccggggaaggaatgagacatccgtggaagcaccacgtatag

SEQ ID NO: 210287 - DNA, 834 bp, Artificial Sequence
  Description of Artificial Sequence: Synthetic coding sequence
atgatcatcctgatctacctgttcctgctgctgtgggaggacacccagggttggggcttcaaggatggaatctttcataatagcatatggctggaaagagccgccggcgtctatcatcgcgaagctcggagtgggaagtacaagctcacatacgctgaggccaaagccgtttgcgagtttgaggggggccatctggctacatacaagcagctggaggccgctcgcaaaataggatttcacgtgtgcgccgccggttggatggccaagggtagggtagggtaccccatcgtgaaacctgggcctaactgtggatttggaaaaacaggcattatagattatgggattcgtctaaaccgatcagagcggtgggacgcatactgctacaacccacatgccaaagagtgcggaggtgtgttcacagatcccaaacaaatctttaaaagccccggattccctaacgaatacgaggacaaccaaatttgctactggcacattcgactcaagtatgggcagaggattcacctgagctttctagatttcgacttggaagacgatcccgggtgcctggccgattatgtggagatctatgattcatatgatgacgtccacggattcgtggggcggtactgcggggatgagctccctgatgatataatcagcacaggcaacgtaatgacattaaagtttctttctgatgccagtgttacagccggcgggttccagattaagtacgtggccatggaccccgtgagtaagtcaagccaggggaagaataccagcacaaccagcaccgggaacaaaaattttcttgctgggaggttctcgcacctgtag

SEQ ID NO: 210288 - DNA, 567 bp, Artificial Sequence
  Description of Artificial Sequence: Synthetic coding sequence
atggccaccgacgtgttcaacagcaagaacctggccgtgcaggcccagaagaaaatcctcggcaaaatggtatcaaaatctatcgccactacgctgatagatgacacctcttcagaggtgttagatgaactgtaccgggtgactcgtgagtacactcagaataaaaaggaggccgagaagattataaaaaatttaatcaagaccgtgattaagcttgcgatcctgtacagaaacaatcagtttaaccaagatgaattagccctgatggagaaattcaagaagaaagttcaccaactggcaatgaccgtcgtgagcttccaccaggtagactacacttttgatcgaaatgtactatcgagactcctcaacgagtgtcgtgaaatgctccatcagattattcagcgacatctgacagcgaaaagccacggaagagttaacaatgtttttgatcacttctctgattgcgaattcctggctgctctctataacccgttcggaaacttcaagccacatttgcagaagctgtgtgacgggatcaataagatgcttgatgaggagaatatttag

SEQ ID NO: 210289 - DNA, 597 bp, Artificial Sequence
  Description of Artificial Sequence: Synthetic coding sequence
atgcacagcgaggccgaggagagcaaggaggtggccaccgacgtgttcaactccaagaatctggccgtgcaggcccagaaaaaaattttgggtaagatggtaagcaaatcgatcgcaaccacactcatagacgatacttcaagtgaggtcctggacgagctgtaccgcgtcacgagagagtatacgcagaacaaaaaggaggccgagaagattattaagaacctgatcaagacagtgatcaagctcgccattctatatcgcaataaccagtttaaccaagacgagctggcccttatggagaaattcaagaagaaggttcaccagctggctatgacagtagtgtcatttcatcaggtggactatacctttgacagaaacgtgctgtcccgtctcctgaacgagtgccgagaaatgcttcaccagatcatacaaagacacctcacagcaaagtcacatggccgcgtcaataacgtattcgaccacttctctgattgtgagttcctggctgctctgtataatccctttggtaacttcaagccgcacttacagaagctgtgcgacggcatcaacaagatgctggatgaagagaacatctag

SEQ ID NO: 210290 - DNA, 597 bp, Artificial Sequence
  Description of Artificial Sequence: Synthetic coding sequence
atgcacagcgaggccgaggagagcaaggaggtggccaccgacgtgtttaactccaaaaacctggcagtacaggcccaaaaaaagattctgggaaagatggtgtcaaagagtatcgccactacactgatcgatgatacctcttccgaggtcctggacgagctttatcgcgtgacaagagaatacactcagaacaagaaagaagcggagaagattattaagaacctgattaagacggttataaaattggctattctgtaccgtaataaccagttcaaccaagatgagctcgctttaatggagaaatttaaaaagaaagtccaccagctagccatgaccgttgtctccttccaccaggtcgactataccttcgatcgcaatgttttgagtcggctgctaaatgaatgccgtgaaatgctgcaccaaatcattcagaggcatttgaccgctaaatcacatgggcgcgtcaataatgtgttcgatcatttctcagattgtgagtttctggccgcgctgtacaaccctttcggaaatttcaagcctcacctgcagaagctctgcgacggcattaacaagatgctggatgaagagaatatatag

SEQ ID NO: 210291 - DNA, 555 bp, Artificial Sequence
  Description of Artificial Sequence: Synthetic coding sequence
atggagagcttcagcagcaagagcctggccctgcaggccgagaagaaactgctctcaaaaatggctggaagaagtgtggctcatttgttcatcgatgaaacttcaagtgaagtgctagacgagctctaccgcgtgtcgaaagagtacacccactcccggcctcaggcccagagggtgatcaaagatttgatcaaggttgcaataaaagtggccgtgctccatagaaatggcagtttcgggccctctgagctggctctcgcaacacggtttcggcagaagctcagacagggcgctatgactgccctgagctttggcgaggtcgatttcacattcgaagcagccgtgttggccggcctgctgaccgagtgtcgcgacgtgctgctcgagctggtagagcaccacctgacaccaaagtcacacggcaggattcggcacgtgtttgaccacttctctgaccccgggctactgacggccctttatggcccagacttcactcagcacctgggaaagatctgcgacggcctgcgcaagttgctcgatgaggggaaactgtag

SEQ ID NO: 210292 - DNA, 1296 bp, Artificial Sequence
  Description of Artificial Sequence: Synthetic coding sequence
atgtaccggaccaaggtgggcctgaaggaccggcagcagctgtacaagctgatcattagccaattgctgtatgatgggtacatcagcattgcaaacgggcttatcaatgagattaaaccgcagtccgtttgcgccccaagcgagcagctcctgcacctgattaaactaggcatggaaaacgatgacacagccgttcagtacgcaattggacgatcagacactgtcgccccgggtacgggtatcgatcttgagtttgacgcggatgtacagacgatgagcccggaagcctccgaatatgaaacatgttatgtgacgtcccataagggcccttgccgggtcgctacctattccagagacggtcaactgattgcgacagggtcagccgacgcttctatcaaaattctggatacagaaagaatgcttgccaagagtgccatgccaatagaggtcatgatgaacgagaccgcccagcagaatatggagaatcaccccgtgatccgcactttatacgaccacgtggatgaggtgacttgtctggcctttcaccccaccgagcaaattctagcctctggttctagggactacacgctcaagctctttgactacagcaagcctagcgccaaacgggcttttaagtacattcaggaggccgaaatgctccgcagcatttcttttcacccgagcggggactttattctcgtgggcactcagcatcccactcttcggctttatgatatcaatactttccagtgcttcgtttcttgcaacccccaagaccagcacaccgatgcaatttgttctgtgaattataactcaagcgctaatatgtatgtgaccgggagtaaggacggatgcatcaaactgtgggatggggtgtccaaccggtgtattacaacctttgagaaggcacatgatggggctgaagtctgtagtgctatcttctccaaaaactctaagtacatcctctcgtccggtaaggatagtgtcgctaaattatgggaaatctctaccgggcggacactggtcaggtacaccggggccggcctgtccggaaggcaagtgcataggacccaggctgtgtttaatcatactgaggactatgtgctgttaccagatgagcggaccatttccttgtgttgttgggacagtcgcacggccgaaaggcggaacctgctgtcactgggtcataataatatcgtgcgctgtattgtgcacagtcctacaaacccaggatttatgacttgttctgacgatttcagggcacggttctggtaccgtagaagcacaactgattag

SEQ ID NO: 210293 - DNA, 621 bp, Artificial Sequence
  Description of Artificial Sequence: Synthetic coding sequence
atggacagcgccggccaggacatcaacctgaacagccccaacaagggactcctgagcgacagtatgaccgacgttccagtggacactggagtggcagcccggactcctgctgtagaggggctgaccgaggctgaagaggaagaactcagagctgagcttactaaagtggaagaagaaattgtgacgctgcgccaggtgctcgccgcaaaggagcgccactgcggcgagttgaagcgaaggttagggttgtcaaccttaggggaactgaagcagaacctgtcccgaagctggcatgacgtgcaagtaagttctgcgtatgtgaagactagtgagaagctgggagagtggaacgagaaagttacccagtccgatctgtataagaaaacccaggaaactctgagccaggccggacagaagacctcagccgcactttctactgtagggtcggctatatctcgaaagctgggcgatatgcgtaactccgccacgttcaagtccttcgaagatcgcgtggggaccatcaaaagcaaagtcgttggtgatagagagaacgggagcgataacctgccctcatccgctggctctggcgacaagcctctgagtgatcctgcccctttctag

SEQ ID NO: 210294 - DNA, 561 bp, Artificial Sequence
  Description of Artificial Sequence: Synthetic coding sequence
atggacagcgccggccaggacatcaacctgaacagccccaacaagggcttgctctctgactcaatgacagacgtccctgtcgacaccggagtggcggcaaggactcccgctgtggaagggctaacagaagccgaagaagaggaactgcgtgctgagttgaccaaggtcgaagaggaaatcgtgacgttacgtcaggtactggctgctaaggagcggcactgcggagaattgaagagacgcttagggctgtctactttgggcgagctaaagcagaatctgtccagatcctggcatgatgtacaagtttctagtgcatacaaaaaaacgcaagagacactctcccaggctggacaaaagactagtgcggccctttctactgtgggctccgccatcagccgcaaattgggtgacatgaggaactccgccacctttaaatctttcgaggaccgggtgggcacaataaaaagcaaagtggtcggggaccgggagaatggcagcgataatttgccatcaagtgccggcagcggtgacaaaccgctgtccgatcctgccccattctag

SEQ ID NO: 210295 - DNA, 630 bp, Artificial Sequence
  Description of Artificial Sequence: Synthetic coding sequence
atggacagcgccggccaggacatcaacctgaacagccccaacaagggcctcctgagtgattcaatgactgacgtgccggttgacacgggtgtggctgctcgcactccggctgtggaagggctgaccgaggccgaggaagaggagctgcgcgctgaactgaccaaagtagaggaggagattgtcacgttacgacaggtgcttgccgccaaggagcgccattgtggcgagctgaaacgaagattggggctcagcacgttaggtgaattaaaacagaatttgtcacgctcctggcacgacgtacaagttagtagcgcctataagaaaactcaggagaccttaagccaggcagggcagaagacctccgctgccttgtccaccgtgggttctgctatttcgaggaaactcggcgacatgcgcgcacatccattttctcactccttctcttcttacagtatcagacattctatcagcatgccggccatgcggaactccgccacttttaagtcattcgaggaccgggtagggaccattaagagcaaagtcgtaggtgatcgtgaaaacgggagcgacaatctgccatcatccgctggatcaggagataagcccttgtcagatccagcaccattctag

SEQ ID NO: 210296 - DNA, 663 bp, Artificial Sequence
  Description of Artificial Sequence: Synthetic coding sequence
atggacagcgccggccaggacatcaacctgaacagccccaacaagggactgctctctgattcaatgacagacgttccagtcgacacaggagtggcagccagaacccccgccgtagaaggccttaccgaggcagaggaagaggagctgcgagcagaactgacaaaggttgaagaagagatagttacgctgcggcaggtactggctgcgaaggagaggcactgcggggagctcaagcgtagactgggcttgtcgacacttggtgagcttaagcagaatctatctagaagctggcacgatgttcaggtgagctccgcctatgtgaagacctccgagaaactgggggagtggaacgagaaagttactcagtccgatttgtataaaaaaacgcaggaaactctgtcgcaggctggccagaagacatccgcagctttgtccacagttggcagtgctattagtaggaagctgggcgatatgagttcctatagcattcgacattctatctccatgcctgcaatgcgaaattcagcaacttttaagagcttcgaggaccgcgtgggtaccatcaaaagcaaagtggtgggggaccgggagaacgggtctgataacctgccgagtagcgctggatcaggggacaagcctctgtcagatcccgctccattctag

SEQ ID NO: 210297 - DNA, 603 bp, Artificial Sequence
  Description of Artificial Sequence: Synthetic coding sequence
atggacagcgccggccaggacatcaacctgaacagccccaacaagggcctcttgtccgattccatgacagacgtgccagtggatacgggggtcgctgctcggacccctgccgtagaaggattgactgaagccgaggaagaggagcttagggctgaactgaccaaggtggaagaggaaattgtgaccctcagacaagtgttagcagctaaagaacggcattgtggcgaactgaagaggcgacttggactgtccacgcttggcgagttgaaacagaacttatcccggtcttggcatgacgtgcaggtttctagtgcatataagaagactcaagagaccctcagtcaggctggacaaaaaaccagcgccgccctgtctactgtcggaagcgccatctcccgtaagctcggagacatgagcagctacagcatacggcacagcatctctatgcccgccatgcggaatagcgcaacattcaaatcttttgaggatagagttggcaccataaaaagtaaagtcgttggggaccgagaaaacggctctgacaatctaccatcctcagcgggaagcggtgataaaccattgagcgatcccgcccccttctag

SEQ ID NO: 210298 - DNA, 492 bp, Artificial Sequence
  Description of Artificial Sequence: Synthetic coding sequence
atggacagcgccggccagggcgtggccgcccggacccccgccgtggagggcctgactgaggctgaggaggaggaactgcgggccgagctgactaaagtggaggaggagattgtgaccctcaggcaggtgttggcagctaaggagagacactgcggcgagctgaagagacgactggggctgtctacactgggggagttaaagcagaatctcagccgcagctggcacgatgtgcaggtgtcctccgcctacaaaaagacacaggagaccttgtctcaggcgggtcagaagactagcgcagcgctgtctactgtggggtccgctatcagccgcaagcttggtgatatgcgcaattcagctacatttaaatcctttgaggaccgcgtcggcacaatcaaaagtaaagtcgtaggtgatagggagaacggcagcgataatttgcctagctccgcgggaagcggggataaacccttatccgatcccgctcccttttag

SEQ ID NO: 210299 - DNA, 3405 bp, Artificial Sequence
  Description of Artificial Sequence: Synthetic coding sequence
atgcggttcggcagcaagatgatgcccatgttcctgaccgtgtacttaagcaataatgagcaacacttcacagaggtgcctgttactcccgagacaatttgtagagacgtggtcgacctgtgcaaagagccaggggagtctgactgccatcttgcggaagtatggtgtgggtccgaaagaccagtggcggacaacgaacgaatgttcgatgtactccaaagattcggatcacagcgtaatgaggtgagatttttcctcagacatgaacgaccccccggcagagatatcgtaagcgggccccgttctcaagacccttcccttaaaagaaatggcgtcaaagtacctggcgaataccgtagaaaggagaacggcgtgaacagcccccgaatggacctaactttggccgaactacaagagatggcctcccggcagcagcagcagattgaggcccagcagcaactgttagcaaccaaagagcaacgcctgaaatttctgaagcagcaagaccaacggcagcagcaacaggtagcggagcaggaaaagcttaagaggctcaaagaaatcgctgagaaccaggaggcaaagctcaaaaaagtgcgcgcactgaaaggccacgtcgagcagaaacggttgagcaatggaaaactggttgaggaaattgagcagatgaacaatttgtttcaacaaaagcaacgcgagctggtattagcagttagcaaagttgaagaactgacccgacagctggaaatgctcaaaaatggtcgtatagactcacaccatgataatcagtcagctgtggctgaattggatcgattgtacaaagaactacaactgcgaaataagttgaaccaggagcagaatgccaaactgcagcaacagcgcgaatgtttaaataagcgaaacagcgaggtcgcagtgatggataagagggtcaatgaacttcgggaccggctttggaaaaagaaggcagctcttcagcagaaagaaaatcttcctgtgtcttcagatggcaatctgccccaacaagctgcgtctgcgcccagtcgagtggccgccgttggcccctacattcagtccagtacgatgccacggatgccttcgaggccagagcttcttgtgaagccagccctgcctgacggcagcctggtcatccaggccagtgaaggcccaatgaaaatccaaaccctgcccaacatgagatcaggcgccgcatcacaaactaagggttcgaagatccacccagtgggacctgattggagtccctcaaacgctgatctcttcccctcgcagggaagcgcctcagtcccacagagtactggcaatgccctcgatcaggtggacgacggggaggtccccttaagagagaaagagaagaaggtgcggccattctctatgttcgatgctgtcgaccagagcaacgccccaccttcttttggaacactgagaaaaaaccaaagtagcgaagatatactgcgggatgcccaggtggccaacaagaacgtggcaaaggtccccccacccgtaccaacaaagcccaagcaaattaacttaccttactttggccagaccaatcagcctccatctgatataaagcctgatggctcttctcaacagctgtctactgtagttccatcgatgggcaccaagcccaaaccggcggggcagcagcccagggtgctgctgtctccatcaattccttccgttggccaagatcagacactgtctccaggatccaagcaggagtcgccacccgcagctgccgtacgaccctttacgcctcaaccatctaaggatacacttttgcccccattccgaaaaccccaaacggttgctgcctcatcaatttactcgatgtacactcaacagcaggctcccggaaagaatttccagcaagccgtgcaatcggctctgacaaagacccatactagagggccacacttcagctccgtatatggaaaaccagtgattgccgctgcccaaaatcaacagcagcatcctgagaatatctacagtaatagccagggtaagccaggtagtcctgagcctgaaacagagcccgtcagctctgtgcaagaaaaccacgagaatgagaggatcccacgcccgttatcaccaactaaactgctgccgtttctgtccaacccatacaggaatcagtccgatgcagatttggaggccctgaggaaaaagttatccaacgctccacggcctttaaagaagcggagctcaatcactgagccagagggaccaaatggaccgaacatccagaaactcctgtaccagcgcacaactatagccgccatggaaactattagcgttccatcttatccttccaagagcgcaagtgtgaccgcctctagcgaaagtccggtcgagatacagaacccttatctccacgttgaaccagagaaagaggtcgtgtctctcgttccggagtcactttccccagaggacgtgggtaacgcttcgactgaaaatagcgatatgcccgcgccatctccgggactggattacgagccagaaggggtgccagataattctccgaacctgcaaaataatccagaggaacccaaccccgaagcacctcacgtgctagatgtgtacttggaagagtaccccccctatcctcctcctccatatccttctggcgaacctgaggggcccggagaggatagcgtgtctatgaggccgccagagattacagggcaagtctcacttccacccggtaagagaaccaatctccgcaagactggatcggagcgcatagcacatgggatgcgggtgaagtttaacccgctggccctgctgctagatagttctctggaaggggagtttgacttggtgcagaggataatctatgaagttgacgacccttccctgccaaacgacgagggcattactgccctgcataacgcagtgtgcgcgggccacacggaaatcgtgaagttcctcgtgcaatttggcgtcaacgtgaacgctgcggacagcgacggatggactccattgcactgcgccgcttcatgtaataacgtgcaggtgtgtaaattccttgtcgagagcggggctgcggtctttgctatgacatattccgacatgcaaacagcagctgataagtgtgaggaaatggaagagggatacacccagtgcagccagttcttatatggtgtacaagaaaagatgggaattatgaacaagggggttatatacgcattgtgggactacgagcctcagaacgatgatgaactgcccatgaaggaaggcgactgtatgacaataatccatcgggaagacgaagacgagatagaatggtggtgggccaggctgaacgataaggaaggctacgtaccacggaatcttctaggtctttacccacgcattaaaccccgccaacgcagcctcgcatag

SEQ ID NO: 210300 - DNA, 3018 bp, Artificial Sequence
  Description of Artificial Sequence: Synthetic coding sequence
atggacctgaccctggccgagctgcaggagatggccagccggcagcaacagcagatcgaggcacagcagcagttgcttgccacaaaggaacagcggctgaagttcctcaagcagcaggaccagagacagcagcagcaggttgccgagcaagagaagctgaaacggcttaaggaaatcgccgaaaatcaggaggccaaattgaaaaaagtgcgtgccttgaagggccacgtggaacagaagaggctgagtaatggaaagctcgtggaagagatagaacagatgaacaaccttttccaacagaagcagcgggagctggtgctggccgtgagcaaggtagaagagctgacacgccagcttgagatgctcaagaacggaaggatcgacagccaccacgacaatcagagcgcagtcgcagaactggaccgtctctataaggagctgcagctcagaaacaaacttaatcaggagcaaaatgcgaagctccaacaacaacgcgagtgcctgaataagcggaacagtgaggtcgccgtgatggacaagcgtgtgaacgagctgcgagaccggctgtggaaaaagaaggccgcattgcagcaaaaagagaatttgccagtgagcagtgatggcaaccttccgcagcaggcagccagcgctccttctcgagtggccgctgtcggtccatacattcagtccagcactatgcctcgaatgccaagcaggcccgaactcctagtaaaacctgccttgcccgatggctccctggtgatccaagcttcagaagggcccatgaagatccagaccttgccaaatatgcgtagcggagctgcttcacagaccaagggatcgaagatccaccccgttggccccgattggagcccttccaacgccgacctgttccctagtcagggtagcgcctcagttcctcagtctaccggcaacgctttagatcaggtcgacgatggcgaggtacccttgagagagaaggagaagaaggttcggcccttctctatgttcgatgcggttgaccagagtaatgctccacccagctttggtactttacggaagaaccaaagctcagaagatattctccgtgatgcacaagtggctaacaagaatgttgcgaaggtgcccccacctgtgcccaccaagccaaaacagattaacttaccatacttcggccaaactaatcagcccccatcagacattaaacccgacggaagctcacagcaactgagcaccgtggtcccatccatggggaccaaacccaagccagccgggcagcaacctcgcgtgctgctgagcccctccatacctagcgtaggccaagaccagacactgtcgcctggctcaaaacaagaatctccgcctgccgctgccgtacggccctttacacctcaaccgtctaaggacacgttgctgcccccatttcgcaaaccacagaccgttgccgcatcatccatctatagcatgtacactcagcagcaggcacctgggaagaattttcagcaagcagtccagagtgccctgactaaaacccacacgaggggtccccatttctcctcagtgtatggaaaaccagtgatcgcagccgcccagaatcagcaacagcaccccgagaacatctacagtaactctcagggcaagcctggaagcccagagcctgagacagaacccgtatcttccgtgcaggagaaccacgaaaatgagagaatccctcgtcccctgagtcccacaaaactcctccccttcttgagcaacccataccgcaatcaaagtgacgccgatctggaggccctacgaaagaagctttcaaacgctccccgccccctgaagaagagatcaagcatcactgagccggaaggtcccaatggaccaaatatacagaaactcctgtatcagagaacaactattgcggctatggagacaattagcgttccttcctacccatctaagagtgcaagcgtgactgcctcctctgagtcccctgttgaaatccagaacccatacctgcacgtggagccggaaaaggaggtcgtaagtttggtaccggagtccttatctccggaggacgtcggcaatgcatctacagaaaactctgacatgccggcgccttctccagggctggactatgaacctgaaggcgtgcccgataactctcccaatctgcagaacaatcccgaggagccaaacccggaagctccgcatgtgctggacgtgtacctggaagaatatccaccctaccctccacctccttacccgagtggcgagcccgagggcccgggggaagattcagtttcaatgaggccacctgagataaccggacaagtctctctaccgcccgggaaaagaacgaatttacggaagaccggtagcgagcgcattgctcatggtatgcgagttaagtttaatccattggccctgttactggacagttccctagaaggagagttcgatctggtccaacggattatctatgaggtggacgacccaagtctccctaacgacgaaggcatcaccgccctgcacaatgccgtctgcgccggccataccgagattgtcaagtttctggtccagtttggggtcaatgtgaacgccgccgacagcgatgggtggacccccttgcactgtgccgcttcatgcaacaacgttcaggtgtgtaagttcctcgtggaatccggagccgcagtgttcgccatgacttatagcgacatgcaaacagccgccgataaatgtgaggagatggaggagggatatactcagtgttcccagttcctttacggggtccaagaaaaaatgggcatcatgaacaaaggcgttatctatgcactgtgggactatgagcctcagaatgatgatgaactgcctatgaaagagggggactgcatgactatcatccacagagaggatgaggatgagatcgaatggtggtgggcgaggctgaacgacaaggaaggatacgtgccacggaatctgcttgggctgtaccctcgaatcaagcccagacagcgaagcctggcctag

SEQ ID NO: 210301 - DNA, 1104 bp, Artificial Sequence
  Description of Artificial Sequence: Synthetic coding sequence
atggagaccatcagcgtgcccagctaccccagcaagagcgccagcgttaccgcctcgagcgaatcacccgtggaaatccaaaatccatacctccatgtcgaacctgagaaagaggtggtgtccttggttcctgaatcactgagcccagaggacgtggggaatgcgtccacagaaaactccgatatgcccgccccgagccctggcttagactacgaaccagaaggggtgccggacaactcccccaacctgcagaacaatccggaggagcctaacccagaagcccctcacgtgctggatgtttaccttgaggaatatcctccttatcccccacctccttatcccagcggagagcccgaggggcccggcgaagacagcgtgtcgatgagacctcctgagataacggggcaggtttctctacccccaggaaagaggaccaacctcaggaaaacaggatcagaacgcatcgcacacggcatgagggtgaagttcaatcctctggctctccttctcgactcaagtcttgaaggggaattcgacctcgtacagcgaattatctatgaagtagatgaccccagcctacctaatgatgagggtataaccgctcttcacaatgctgtgtgtgcggggcacaccgagatcgtgaaatttctggtccagtttggcgtgaacgtgaacgccgctgactctgacgggtggaccccgctgcattgcgccgcttcctgtaacaacgtgcaggtgtgcaaatttttggtggagagcggggcggcagtgttcgctatgacctactcggatatgcaaaccgccgcagataaatgtgaagagatggaagaagggtatacgcagtgtagtcaatttctctacggagttcaggagaagatgggtatcatgaataagggagtgatctacgccctctgggactacgaacctcagaatgacgatgagctacctatgaaggagggcgactgtatgacaatcattcaccgggaggatgaagacgagatcgaatggtggtgggccaggctcaacgataaggagggctacgtgcctcgtaatctcctggggttatatccacgaatcaaaccaagacagcgatcactggcttag

SEQ ID NO: 210302 - DNA, 2043 bp, Artificial Sequence
  Description of Artificial Sequence: Synthetic coding sequence
atgaacttcgagaccagccggtgcgccaccctgcagtactgccccgacccttacattcagcgtttcgtggaaactccggcccacttctcttggaaggagtcctattatcgctcgacaatgagtcagtcgacacagacaaacgagttcttatccccagaagtcttccagcacatttgggattttctggagcagcctatatgttccgtccagcccatagacctgaacttcgtagacgaaccctcggaagatggggccacaaataagatagaaatctcaatggactgtatcaggatgcaggacagcgacctcagtgacccaatgtggcctcagtacacaaatttggggctgctcaactctatggatcagcagatccagaacggctccagttcaacatccccatataataccgaccacgcccaaaactcagtcaccgcgccgtctccttatgcccagccaagctcaactttcgacgctctttcacccagtcccgctattcccagtaacacagactatcccgggccacattccttcgatgtcagcttccaacagagctctacggccaagagcgcaacctggacttactctactgagttgaagaaactctattgtcagatcgcaaaaacatgtcctatccagattaaggtgatgacacctccaccacaaggggccgtaatcagggccatgcccgtgtacaagaaggctgaacacgtgaccgaagtggttaagcgctgtcctaaccatgagctgagtcgagagttcaacgagggacaaatcgcccctccatcccacttgatcagagtcgagggcaattcccatgcacagtacgtcgaagatcccatcactggtagacagagtgttcttgtcccgtacgagccaccacaggtcggcactgaattcaccacagtcttgtacaatttcatgtgcaattccagctgcgttggcgggatgaatcgccgacctattttaatcatcgtgacactggagaccagagatggccaagtcctggggcgaaggtgcttcgaagcacgcatttgcgcgtgtcctggaagagatcgcaaggcagacgaggactcgatacgcaaacagcaggtaagcgactcgacaaagaacggggatgggaccaaaaggccgttccgacagaacactcacggaattcagatgacctcaataaaaaagcggagatccccggacgatgaactgttgtatttgccagttagaggccgcgagacttatgagatgttactgaagataaaagagagcctggagctgatgcagtatttgccacagcataccatcgagacatatcgccagcagcagcaacagcagcaccaacacctgttgcaaaagcaaacctccattcaatcaccttccagctacggaaactcaagtcctcccttgaacaaaatgaattcgatgaacaagttacccagcgtctctcagcttattaaccctcagcagcgaaacgcgctgacaccaacaacaatacctgacggcatgggcgctaatattcccatgatggggactcacatgccaatggccggtgacatgaatggtctgtccccaacacaagccttgccaccacctttgtcgatgccatctacttcccactgcactccccctcccccgtaccccactgattgtagtattgtgtcttttttggccagactgggatgcagtagctgtttggactacttcacaacacagggattgaccaccatctaccagattgagcactatagcatggatgaccttgcgtcactgaagattcccgagcagtttagacacgccatctggaagggtattctcgatcaccgacaactgcatgagttttcatcaccttcgcatctgctgaggaccccttcatctgctagcaccgtgtccgtgggatcaagcgagaccaggggcgagcgcgtgattgacgctgtgagatttactttgcgccagacaatctctttccccccaagggacgaatggaacgatttcaactttgacatggacgcccggagaaataaacaacagaggatcaaagaggaaggtgaatag

SEQ ID NO: 210303 - DNA, 1533 bp, Artificial Sequence
  Description of Artificial Sequence: Synthetic coding sequence
atgaacttcgagaccagccggtgcgccaccctgcagtactgccccgatccatacatacagaggttcgtcgagactcctgcccattttagttggaaggaatcttactatcgtagtaccatgtctcagtctactcagacaaatgaattcctgagtcccgaagtgttccagcacatttgggacttccttgaacagccaatctgttctgtccagcccattgatttgaattttgtggacgagccaagtgaagatggcgctactaacaagatcgagatcagcatggactgcataaggatgcaggattcagacctttctgaccccatgtggcctcagtatacaaacctgggtctcctgaacagtatggaccagcagattcagaacggatcttccagcacatctccatataacacagatcatgcacagaattctgtgaccgcaccgagtccttacgcccaaccctcaagtactttcgacgcgctcagccccagtcctgcaatcccctctaacaccgattaccccggtcctcactcatttgacgtaagtttccagcaatcgagcaccgccaagtccgctacatggacctacagcaccgagctaaaaaaactctattgtcaaattgcgaaaacgtgtccaatccaaattaaagtgatgacaccccccccacagggggccgtgattagagccatgcccgtgtacaagaaggctgagcacgttaccgaggtggtgaaaaggtgcccaaaccatgagctaagtcgggagtttaacgaaggacaaatagcgccccctagccacctgattcgcgtggagggcaactcccacgcacagtatgtggaggatcccattaccgggaggcaatctgtgctggtcccttatgagcctccccaggtcggcacggaattcactacagtcctgtacaactttatgtgcaattccagctgcgtggggggcatgaatcgacggcccatccttatcattgtcactctggaaaccagagacggtcaggtgctgggccgacggtgcttcgaagcgaggatctgcgcttgccccggccgcgatagaaaagcagatgaagacagcatcaggaaacagcaggtgtccgactccactaaaaatggtgacggaactaaacggcccttccgccagaatacacacggaatccagatgactagcatcaagaagcgtcggtcccccgatgatgaactgttgtacctgcccgttcgaggccgggaaacctatgaaatgctgctgaagatcaaagaatctctcgagctcatgcagtatctgccacaacatacaatcgagacttataggcagcagcagcagcagcagcaccagcacctattgcagaagcagacaagcatccagagtccgtcaagctacggtaattcctcgcccccactgaacaaaatgaatagcatgaacaaactcccttcagtctcccagctcataaatccccagcagcgaaacgccttaacccccaccacaattcctgatgggatgggggcaaataggagtggcaaatcggagaacccatag

SEQ ID NO: 210304 - DNA, 1761 bp, Artificial Sequence
  Description of Artificial Sequence: Synthetic coding sequence
atgctgtacctggagaacaacgcccagacccagttcagcgagccccagtacaccaacctggggttgctcaactcgatggaccaacaaatccaaaacggatcaagtagtacatcaccctacaatacggatcacgcacagaactccgtgactgccccatccccatatgctcagccttcctcaacttttgacgccctatctcccagcccagctattccttccaatacagattaccccggcccacactccttcgatgtgagctttcagcagagttctaccgccaagagcgccacttggacctatagcactgagcttaaaaagctgtactgccagatcgctaaaacttgtcccatccaaattaaggtaatgacgcctcctccgcaaggagccgtaatacgagccatgcctgtgtacaagaaggccgaacacgttacagaagtagtgaaacgctgccccaatcacgagctgtcccgtgaattcaacgaaggccagattgctcccccatcacacctcatcagagtggagggaaactctcatgcgcagtatgttgaagatcccatcacaggccgtcagagcgtgcttgtcccatacgagccaccccaggttggaaccgaattcaccactgtactctacaatttcatgtgtaatagctcctgcgtgggcggcatgaataggcgccccatactgattatcgtcactcttgagacccgagacgggcaggtgctcggtcgtcggtgttttgaagccagaatttgtgcatgcccagggcgggatcggaaggctgacgaggattccatccggaaacagcaagtgtcagacagcaccaagaacggcgacggaacaaaacggccattccgccagaatacccatggtatccagatgaccagcatcaagaaaagacgctctcccgatgacgagctcttgtacctacctgttcgaggcagggagacctacgagatgctgctcaaaattaaagagagtctcgaactcatgcagtatctgccacagcataccatcgagacctaccgtcagcagcagcagcaacagcaccagcatttactccaaaagcaaacctctattcagagtccctctagctatgggaactcatcccctcccctgaacaagatgaacagtatgaataagcttccgtccgtgagccagctgatcaatccgcagcagcggaacgctttaacacctacgaccataccggatggtatgggcgctaatatcccgatgatgggtacccacatgccaatggccggagacatgaatggactgtccccgactcaggccttacccccacccctttccatgcccagcacctctcattgtacaccgcctccaccatatccaaccgattgctctatcgtatctttcttggctaggctaggctgtagtagctgccttgattacttcacgactcaggggctgacaactatctaccagattgagcactacagtatggacgatctggcctcgctgaaaatcccagaacagttcagacacgccatctggaagggaatcctcgaccatagacagttgcatgaattctcctcccccagtcaccttctgcgcacaccctcttccgctagcactgtctccgtaggctcaagcgagacaaggggcgagcgcgtaatcgacgcagtgcgcttcacacttaggcaaactatttcttttccacctagggacgaatggaacgacttcaacttcgacatggatgccaggcggaataaacagcagcgcattaaggaggaaggggaatag

SEQ ID NO: 210305 - DNA, 1788 bp, Artificial Sequence
  Description of Artificial Sequence: Synthetic coding sequence
atgaacttcgagaccagccggtgcgccaccctgcagtactgccccgatccttacatacagaggtttgtagaaacgcctgcgcacttttcttggaaagaaagctattatagatctacaatgtcccaaagcacacagacaaatgaattcttaagcccagaggtcttccagcatatctgggatttccttgagcagcccatctgttccgtccagcccatagatctcaactttgtggacgagcctagcgaagacggcgcaaccaataagatcgagatcagcatggactgcattagaatgcaagactcggatctgtctgaccccatgtggtatagcaccgaactgaaaaagctctattgtcagatcgcgaaaacttgccccatccagatcaaggtgatgacaccccctccccagggtgcagtgatccgggccatgcccgtctacaagaaagccgaacacgtgaccgaagtcgtgaaaaggtgtcctaatcacgagttgagcagggagtttaatgagggacagattgcccccccaagccaccttattcgggtagagggcaacagccacgcccagtatgtcgaagaccctatcactggacgacagtctgttctggtcccctatgagccccctcaggttggaaccgagttcacgacagtcttatacaacttcatgtgcaactcctcttgcgttgggggaatgaacagacgccctatcctaatcatagttaccctggagacccgagacgggcaggtgctcggcagacgatgttttgaggccaggatctgcgcctgccctggccgagacagaaaggctgatgaggacagtatacgcaagcagcaggttagcgactcaacaaagaatggcgacggcaccaaacgtccctttcgccagaatacccacggcattcaaatgacctcaataaagaagagaaggtcccctgacgatgagctgctctatctaccagtaagagggcgggagacatacgagatgcttttgaagatcaaggagtccctggaactgatgcaatacctaccacaacacactatcgagacctacaggcagcagcagcagcaacagcaccagcacctgcttcagaaacagacgagcattcagtctccctcatcatatggcaacagtagccctcctcttaacaaaatgaactctatgaacaaacttccttctgtaagtcaactgatcaatccacagcagcgaaacgcattgacccccaccaccatacctgacggcatgggggctaacataccaatgatggggacgcatatgccgatggctggcgacatgaacggcctgtctccaacacaggcccttccacccccactgtctatgccgtcaacaagccactgtactccccctcccccatatcccaccgattgcagcatcgttagttttctcgcccgcctcggttgtagctcttgtctggactattttacaacccaagggctcaccaccatatatcaaatcgaacattatagcatggacgacttggccagcttgaagattcccgagcagtttcgccacgctatctggaagggtatattggatcacaggcaattacacgagttttcaagcccttcccacctgctgcgtacgccatcaagcgccagtacagtgtcggttggaagtagcgagacacgcggtgagagagtgatcgacgctgtgaggtttacgcttaggcagacaattagcttcccaccccgggacgaatggaatgactttaactttgatatggatgctcgccgtaacaagcaacagaggattaaagaggaaggtgagtag

SEQ ID NO: 210306 - DNA, 1668 bp, Artificial Sequence
  Description of Artificial Sequence: Synthetic coding sequence
atgaacttcgagaccagccggtgcgccaccctgcagtactgccccgacccttacatccagaggttcgtcgaaacgcctgcccatttctcttggaaagagtcttactacaggtcaacaatgtcacagtcaacgcagactaacgagttcctcagccctgaagtcttccagcatatctgggattttctggaacaaccaatctgctccgttcagccaatagatctgaattttgtcgacgagcctagtgaggacggcgcaactaataaaatagaaatttctatggattgtatccgcatgcaggacagtgatctaagtgaccccatgtggccacaatacaccaacctgggcctgctaaatagcatggaccagcagatccagaacggatcaagttccaccagcccgtacaacactgaccacgcacagaactctgttaccgcaccatcaccatatgcccagccatcctctacctttgacgctctatctccctcccccgccatcccttccaacactgattaccccgggccgcattcatttgacgtctcttttcaacagtcttcaaccgccaaatcggcaacgtggacctactcaacagagctgaaaaaactttactgccagatagctaaaacctgcccgatccaaattaaagtgatgactccgcccccccaaggggccgtcatccgggcgatgccagtttacaaaaaggccgaacatgtgaccgaggttgtgaaaagatgccccaatcacgagctgtcccgcgagttcaatgaaggccagattgcaccccccagccatctcattcgggtcgaaggcaacagtcacgctcaatacgttgaggaccctattacaggacgccaatctgttctagtcccatatgaaccccctcaggtcggtacggagttcaccactgtgctgtataatttcatgtgcaatagtagttgcgttggcgggatgaataggcgcccaatcctcatcatcgtcacccttgagacacgggacggccaggtgctcgggaggcgatgttttgaggctcgcatttgtgcctgtccgggaagggacaggaaggctgacgaggactctatcaggaagcagcaggtaagtgactcaacaaaaaatggagatggcaccaagcgacccttccgtcagaatacacatggaattcagatgaccagtataaaaaagcgacgttcaccagacgacgaactgctttacctgcctgtgcggggccgtgagacatacgaaatgcttttgaagattaaggagagtctggaactcatgcagtatctgcctcagcacacaattgaaacctaccggcagcagcagcagcaacagcatcagcaccttctgcaaaagcagacatcaattcagagtccctcttcatacggaaattcctcaccaccgctgaacaagatgaattcaatgaacaaactgccatccgtcagccagctgatcaacccccaacagcgcaacgccctgactcctacaacaattccagacggaatgggggcaaacatcccaatgatggggacccacatgcctatggccggagacatgaatgggctgtcccccacacaggcccttccccctcctctgagtatgccttctaccagtcactgcactcctccacctccctaccccacggattgcagcattgtaaggatctggcaagtttag

SEQ ID NO: 210307 - DNA, 1251 bp, Artificial Sequence
  Description of Artificial Sequence: Synthetic coding sequence
atgctgtacctggagaacaacgcccagacccagttcagcgagccccagtacactaatctgggtttgctgaactctatggaccaacagattcaaaatggaagctcaagtacctcgccttataataccgaccatgcccaaaattctgttactgctccaagtccttatgctcagcctagttccacatttgacgctctttcgcctagccccgccatcccctctaacacggactacccgggacctcattcgtttgatgttagtttccaacagtctagcactgccaaatcagccacttggacatatagcaccgaactgaagaaactgtattgccagatagcaaaaacatgtcccatccaaatcaaagtgatgacgcctcccccccagggcgcagtaatccgagcaatgcctgtatataaaaaggctgaacatgtaaccgaggtcgtgaaaaggtgccctaatcacgaactgagtcgggagttcaacgagggtcagatagcccctcctagccacctcattagggttgagggcaatagccatgcccagtacgtggaagatccgattacagggcgccagagcgtgttggtcccctatgagccccctcaggtcggaaccgaatttaccacagtattgtataacttcatgtgcaattcatcctgcgtggggggcatgaaccggcgaccaattttgattatcgtgaccctcgaaacacgcgacggacaagtgttgggacgaaggtgctttgaggccagaatctgtgcttgccctggccgggaccgaaaagcagatgaggacagcatcaggaaacagcaggtgagtgattctaccaaaaacggagatggaacaaaaagaccctttagacagaatacccatggaatccagatgacctccattaaaaaacgcagaagcccagacgatgagcttttatatctgccagtgcgcggacgggagacttatgaaatgctcctgaagatcaaggagtcattggagcttatgcagtacctaccgcagcacactatcgaaacatatcgccaacaacagcagcaacagcatcaacacctgcttcaaaagcagacatccattcaatccccgtcttcctacggcaacagctcccctccacttaacaaaatgaacagtatgaacaagttaccctccgtgtctcagctgataaacccacaacagagaaacgctctgacaccaacaacgatccctgatggaatgggggcaaaccgcagcggaaaaagcgagaatccatag

SEQ ID NO: 210308 - DNA, 1386 bp, Artificial Sequence
  Description of Artificial Sequence: Synthetic coding sequence
atgctgtacctggagaacaacgcccagacccagttcagcgagccccagtacactaacctaggcttgttgaattccatggaccaacagatccagaacggctcgagttctacctcaccatataatacagaccatgcccaaaacagtgtcacggctcctagtccatatgcccaaccttcctccactttcgacgcactgagcccctctcccgccatccccagcaacaccgactacccgggccctcactcttttgacgtctccttccagcaatcctctacagcaaagtctgccacctggacatattcaacggagctcaagaaactctattgccagatcgctaagacatgccccattcagataaaagtgatgacaccccccccccaaggggctgtaatcagggccatgcccgtgtataagaaggccgaacatgtaacagaggtggtcaagcgctgcccaaatcatgaactcagccgggaattcaatgaggggcagatcgcgcccccatcccatcttattcgcgtagaaggtaactctcatgcccagtacgtcgaggacccgatcacaggacggcagtcggtcctggtgccatatgagcccccacaagtcggcactgaatttacaacggttctgtacaacttcatgtgcaattccagctgcgttggaggtatgaataggcggccgatactgatcatcgtcacgctggagactcgcgatggccaggtattggggcgccgttgtttcgaagcacggatctgtgcctgccccggtcgagatcgaaaggccgacgaggatagcatccgcaagcagcaggtgagcgatagcacaaaaaacggagacggcacaaaacgtcccttcaggcaaaatactcacggtattcaaatgacctcaatcaagaaacgacggagcccagacgacgaacttctgtatctgcccgtccggggccgggagacgtacgagatgctgctgaagattaaagagtccctggaactaatgcagtatctccctcaacatactatcgaaacgtaccgtcaacagcagcagcagcagcaccagcacttacttcagaaacagacatctattcaatctccgtctagttacgggaacagtagtccacctctcaataagatgaactcaatgaacaagctgccgtccgtgtcccagctgatcaatcctcagcagcggaacgctttgacaccaacaaccattcccgatgggatgggcgccaacatcccaatgatgggtacgcatatgcctatggctggagacatgaatgggttgtcccccacccaggcgctaccacctcctctgtcaatgccatccacatcccactgtacgccacctcctccgtatcctactgactgtagcattgtaagaatatggcaggtgtag

SEQ ID NO: 210309 - DNA, 1464 bp, Artificial Sequence
  Description of Artificial Sequence: Synthetic coding sequence
atgaacttcgagaccagccggtgcgccaccctgcagtactgccccgacccctatattcaaagattcgtggaaacccccgctcacttcagttggaaagagtcctattaccgcagcactatgtcacagtctactcagaccaatgagtttttgagcccagaagtgtttcagcacatatgggatttcttggagcaaccaatttgctctgtgcagcccattgatctgaacttcgtcgatgagccaagcgaagatggagcgaccaacaagattgagataagcatggattgtatccggatgcaggattccgacctcagcgatcccatgtggcctcagtataccaatctcggcctgctgaactctatggaccaacagatacagaacggcagctcttccacaagtccatataacaccgaccatgctcagaatagcgtgaccgctcctagcccctatgcacaacctagctctactttcgacgcactctctccatctcccgcaattccaagcaataccgactaccccggcccccacagctttgacgtatcatttcagcagtcctccacggccaagtccgcaacttggacctattccaccgagctgaagaaactatactgccagatcgcaaagacttgtcctatccagatcaaagttatgaccccacctcctcagggggccgtgatcagagccatgccagtctataaaaaagccgagcacgtgacggaagtcgtcaaaaggtgcccaaaccacgaattgtcacgggaattcaacgagggtcaaattgccccaccctctcatctgataagagtggaagggaacagccatgcccaatacgtcgaagatcctataacaggacgccaatccgtgctggtgccatacgagcctccccaggttggtactgaattcactaccgttctatacaactttatgtgtaacagctcttgtgtcggaggaatgaaccgccgacctatcttaatcattgtcacccttgagaccagagatggacaggtcctgggacgtaggtgttttgaggctcgcatctgcgcctgccctggtcgtgaccgtaaagccgacgaagacagtattagaaagcagcaggtgtcagacagtacaaagaacggcgatggcaccaagagaccattcagacagaacacacacggaatccagatgacctctatcaagaagcgccgctcgcccgatgatgaactgctctacttgcccgtgcggggaagggagacttatgagatgctgttaaagatcaaggaatccctcgaactgatgcagtacctgccccagcatacaatcgagacatatcgtcagcagcaacagcagcagcaccagcatctgctgcagaaacacctattgtctgcatgtttcagaaatgagctggtcgagccccggcgggagacacccaaacagtcagacgtgttcttccggcatagtaagccgcctaatcggtcagtctacccgtag

SEQ ID NO: 210310 - DNA, 1182 bp, Artificial Sequence
  Description of Artificial Sequence: Synthetic coding sequence
atgctgtacctggagaacaacgcccagacccagttcagcgagccccagtatactaacctaggcttattaaattctatggaccagcaaattcagaacggctcttcttcaaccagcccatacaacaccgaccacgcccaaaacagtgtgactgccccatccccctacgcccagcctagttcgacattcgatgctctctccccgtctcctgccattccaagcaacactgactaccccgggccacatagctttgacgtgagctttcaacagtccagtacagctaaatcggctacgtggacatacagtaccgagctgaagaaactttactgccagatagctaaaacatgccccattcaaatcaaggtcatgacccctcccccacagggggctgtgatacgggccatgcctgtttacaaaaaagcggagcatgtgacagaagtggtgaagagatgtcctaaccatgagttgtcacgggaatttaatgagggacagattgctcctccaagccacttaattagagtggagggcaattcccacgcccaatatgtggaggaccccataacaggtcggcagtctgtcttggtcccttacgagcctccccaggtgggcaccgagtttaccaccgtactgtacaacttcatgtgtaattccagttgcgtggggggaatgaaccgacggccaatcctgatcattgtaaccctggaaacacgcgacggtcaggtcttggggcggcggtgtttcgaggctcgcatctgtgcttgtcccgggcgcgaccgaaaggccgacgaggattctatccggaagcaacaggttagcgacagcacaaagaatggggacggcaccaagaggccttttcggcagaacactcacggcatccaaatgactagcattaaaaagagacgcagccccgatgatgaactactgtatctgccagttcgtgggagagagacatacgaaatgctcctgaaaatcaaagagtcgctagaactcatgcagtatctcccccaacacactattgagacctacaggcagcagcagcagcaacagcaccagcatctgctgcagaagcatctgctgtcggcttgttttcggaatgagttggtggagccaagacgcgaaaccccaaaacagtctgacgtgttcttccgccatagcaagccaccaaacaggtcagtttatccttag

SEQ ID NO: 210311 - DNA, 2031 bp, Artificial Sequence
  Description of Artificial Sequence: Synthetic coding sequence
atgaacttcgagaccagccggtgcgccaccctgcagtactgccccgacccctacatccagcgcttcgtagagacccccgctcacttcagttggaaagaatcctactacaggagcaccatgagccagagtacccaaacgaatgaattcttgagccccgaagtcttccagcacatatgggatttcctggagcaacccatctgttctgtgcagccaatcgatctgaattttgtcgatgaacccagcgaagacggggccacaaataaaatcgagataagtatggactgcatccgaatgcaggactccgatctgtcagacccaatgtggccgcaatacaccaatctgggtctacttaactccatggaccagcagatccagaatggctccagtagcacgtctccctacaacaccgaccatgctcagaatagtgtgacagccccatctccatacgctcagccatcttcgacattcgatgcgctgtcaccctctcctgcaataccatctaacacagattatcccggacctcactctttcgatgtttcgtttcagcaatcaagcactgccaagtccgccacctggacttacagtactgaactcaagaagctgtactgccagatcgccaagacttgccctatccagatcaaggtcatgacgcctcctccacagggagccgtaatcagagccatgcctgtgtataagaaggcagaacatgtgactgaggttgtgaaacgttgtcctaatcacgagcttagccgggagttcaatgaaggccagatcgctcccccgtctcatctgatccgggtggagggcaattcccacgctcagtacgtcgaagacccaatcaccgggcgccagagcgtgcttgtgccttatgagcctccacaagtgggaaccgagttcacaactgtgctgtataactttatgtgcaactccagttgcgtcggagggatgaatcgaagaccaattctcataatcgttacacttgagacaagagacggccaggtgctgggacggaggtgcttcgaagcccgtatatgtgcctgcccgggccgggacagaaaagctgacgaggatagtatacggaaacagcaggtcagtgattccacgaaaaatggagacgcattcagacaaaatacccacggcatccagatgacttctatcaagaagaggcgctcccccgacgacgagctgctgtacctgcctgttcgcggccgtgaaacctacgagatgctcctcaaaataaaggaatccctcgagctgatgcaatatctaccacagcataccatcgaaacctaccggcaacagcagcagcagcagcatcagcatcttctgcagaaacagactagtatccagagtccgtcttcctacgggaattctagccccccactgaacaaaatgaactcaatgaataagcttccctctgtcagccagctgataaatccgcagcagagaaacgccctcacccctactaccatacctgatggcatgggcgccaacattcctatgatgggaactcacatgccgatggccggtgacatgaacggattaagcccaactcaagctctgccaccgcccctcagtatgccgagcacctcccattgtacgccgccccctccttatcccactgattgttccatcgtaagcttcctggcccggctcggttgttcttcctgtctggactactttacaacgcaagggttgaccactatttaccagatcgaacactattctatggacgatctggccagtttgaaaattccggaacagttccggcacgctatttggaaaggcattcttgatcatcgccagcttcacgagttttcctcaccaagccatctcttacggacaccgtcatccgcttcaactgtttctgttgggtcctctgaaacaagaggtgaaagagtaatcgacgccgtgcgatttactctgaggcagacaatttcctttcctccccgggacgagtggaacgatttcaacttcgacatggacgccaggcgcaacaaacagcagcgtatcaaagaggagggcgagtag

SEQ ID NO: 210312 - DNA, 1506 bp, Artificial Sequence
  Description of Artificial Sequence: Synthetic coding sequence
atgctgtacctggagaacaacgcccagacccagttcagcgagtactcaacggagctaaagaagttgtactgccagattgctaagacatgtccaattcagattaaagttatgacaccccccccgcagggcgctgtgattcgtgcgatgcccgtatacaagaaagctgagcacgttactgaagttgtgaagagatgcccaaaccacgagctgagccgcgaattcaacgaaggtcagatcgcccctccaagtcatctaatccgggtggaaggaaactcgcacgcccagtatgtcgaggatcctattacgggacgccagtcagtgttggtgccgtacgagccaccccaggtaggtaccgagttcaccactgtcctttacaacttcatgtgcaactcaagttgtgttggtggtatgaaccggagaccaatattgataattgtcacattggagaccagagatgggcaagtgttagggcgaagatgttttgaggctcgcatatgcgcatgccctggacgcgataggaaggccgacgaggacagcatccgcaaacagcaggttagtgacagcacgaaaaacggtgatgggacaaagcggcctttcagacagaatacccatgggattcagatgacaagtattaaaaagagacggtcgcccgacgatgagttattgtacctgccagtgcgcggcagggagacatacgagatgctactgaagatcaaagagtccctggagctgatgcaatacctcccccagcacaccatcgagacatatcgacagcagcaacaacaacagcaccaacatttgctgcaaaagcaaactagcatccagagtccctcctcttatggcaatagcagccctcccctgaataagatgaattctatgaataaactgccctcagtgagtcagctgattaacccgcagcaacggaacgcactgacacctacaacgatcccagatggcatgggcgcaaacattcctatgatgggcactcatatgcccatggccggcgatatgaatgggctctcgccaacccaggccctacccccgccactgtctatgcctagcacatctcactgtacaccgcctcctccatacccgacggactgtagcatagtgtccttcttggcgcggttagggtgtagctcttgtctggactattttaccacccagggactaaccactatttatcaaatagagcactatagcatggatgacttagcttcacttaaaatcccagagcaattccgtcacgccatctggaagggtatactggatcatcgccagcttcatgaattctcttccccttcccatctattaaggacccctagctccgcatccaccgtgagtgttggtagctctgagactcgcggcgaaagagtgattgatgccgtcagattcacgttgcgccagaccatctcgttcccgccaagagatgagtggaatgactttaatttcgacatggacgcccggagaaacaagcagcaacggattaaagaggaaggagagtag

SEQ ID NO: 210313 - DNA, 1749 bp, Artificial Sequence
  Description of Artificial Sequence: Synthetic coding sequence
atgctgtacctggagaacaacgcccagacccagttcagcgagccccaatatacaaacttagggctgctgaattcaatggatcagcagatacagaacggaagctcttctaccagtccatacaatacagatcacgctcagaatagtgtgactgccccgagtccttatgctcaaccttcctccaccttcgacgccctgtccccgtctcccgcgatcccaagtaatactgattacccaggaccacatagctttgacgtgtcctttcagcagtcaagtaccgccaagtcggcgacatggacctattcaaccgaactcaagaaactgtactgccagatcgccaagacatgccccatccagattaaggtgatgaccccgccgccccagggagcggtaatccgcgcaatgcccgtttataaaaaagccgagcatgtaacagaggttgtgaagcggtgcccgaaccacgagcttagtcgcgagttcaacgaggggcagatagctccaccgtcccatttgatccgggtagagggaaacagccatgcccagtatgtagaagaccctatcaccggcaggcagtctgtgttagtcccatatgaacctcctcaggtgggcacagaattcactactgtgctgtacaactttatgtgcaattcctcatgcgtcggcggaatgaacagacggcccattctcattatcgtaaccctggagacgagggacgggcaggtactgggacgacggtgcttcgaagcccggatatgcgcgtgtcctggacgagatcgtaaagcggatgaggacagcatcagaaagcagcaggtctctgatagtaccaagaacggcgatgccttccggcagaatacacacgggattcagatgacctcaatcaagaagcgcaggtcccccgacgatgagttgctatatctgccggtaagaggtcgggagacatacgaaatgctgcttaagatcaaggagagcctagagctgatgcagtatctcccgcaacacaccattgaaacataccgccagcagcaacagcagcaacatcaacacttactccagaaacaaacatccatccagtcacctagcagctatggaaattctagtccccccctgaataagatgaactctatgaataagctgccgagcgtctcccaactgatcaaccctcagcagcgcaatgccctgactccaactacaatccctgacgggatgggcgcgaatatacccatgatgggtacacatatgcccatggcaggggatatgaacgggctgtcccctacgcaggccctgcctcctcccctatcgatgccttctacttcccactgcacccctcctcctccgtacccaacggattgctctattgtgtcctttctggcaaggctgggctgcagtagctgtttagattatttcactacacagggtttgacgacaatctatcagattgagcactattcgatggatgatcttgcatcgctgaaaattcccgaacagtttcgtcatgccatctggaaaggaatcctggaccacaggcagctacatgagtttagctcaccatcccacctgctcagaacaccatcttccgcctctacggtgagcgtaggatcttcagagacgcgaggagaacgggttatcgacgccgtgcgctttacactccgtcagaccatctcctttcccccgcgggacgaatggaacgacttcaattttgatatggacgctcgaagaaataaacagcagcgtataaaggaagaaggggaatag

SEQ ID NO: 210314 - DNA, 567 bp, Artificial Sequence
  Description of Artificial Sequence: Synthetic coding sequence
atgatcatctaccgggacctgatcagccacgacgagatgttcagcgatatttacaagatcagagaaatcgcagatggcttgtgccttgaggtggaaggaaagatggtcagtaggacggaaggcaatattgacgactcattgattggggggaatgcatctgccgagggccccgagggggaaggcaccgagtcaacagtgattacgggggtggacattgttatgaatcaccacttacaagagaccagctttacaaaagaggcatataagaagtatatcaaggattacatgaagtccatcaagggaaagctcgaagagcaaagaccagaaagggtaaagccatttatgacaggcgcggccgagcaaatcaaacatatactcgccaacttcaaaaactatcagttctttatcggagagaacatgaaccccgacggcatggtggccctgttggattatcgcgaggacggcgttacaccatacatgatattcttcaaggacggtctggagatggagaagtgtgtctccactcgtaaatgggtaaagattaataatgtgaaaaagaccttctag

SEQ ID NO: 210315 - DNA, 417 bp, Artificial Sequence
  Description of Artificial Sequence: Synthetic coding sequence
atggtgagccggaccgagggcaacatcgacgacagcctgatcggcggaaatgcgtccgcagaaggccctgagggtgaaggaacggagagcacagtcatcacaggggtggatatcgtcatgaatcatcacctacaggaaacaagctttacaaaggaggcctacaaaaagtacatcaaggattacatgaaatcgatcaaaggcaagcttgaagagcaaagacccgaaagggtgaagccatttatgacaggagcagctgaacaaatcaagcatatcttagccaatttcaagaactaccagttctttatcggtgaaaacatgaatcccgatggaatggttgcccttttggactatcgggaagatggagtaaccccatatatgattttcttcaaagacggtcttgaaatggagaaatgttag

SEQ ID NO: 210316 - DNA, 417 bp, Artificial Sequence
  Description of Artificial Sequence: Synthetic coding sequence
atggtgagccggaccgagggcaacatcgacgacagcctgatcggcggcaatgccagcgccgaaggacctgagggagagggcaccgagagcaccgtgatcacaggtgttgacatcgtcatgaatcatcacctccaggagacctcatttaccaaggaggcatacaagaagtatattaaggattacatgaagagcattaagggcaagctggaggagcagcgcccggagagggtcaaacccttcatgaccggagcggctgagcagatcaaacatatcctcgcgaacttcaaaaactaccagttcttcatcggcgagaatatgaatccggatggcatggtggcactgttggactatcgcgaagatggtgtgactccctatatgatcttcttcaaggatggcctggaaatggagaagtgctag

SEQ ID NO: 210317 - DNA, 483 bp, Artificial Sequence
  Description of Artificial Sequence: Synthetic coding sequence
atgttcagcgacatctacaagatccgggagatcgccgacggcctgtgcttagaagtggagggtaagatggtgtccaggactgagggaaatattgacgactcgttgataggggggaatgcttccgccgaaggaccggagggggaagggacagaatctacagtcatcaccggcgttgacatcgttatgaatcaccaccttcaggaaacatcttttactaaggaggcctacaaaaagtatatcaaagactacatgaaatcaattaaggggaagttagaggagcaacggcccgaacgtgtcaaaccatttatgactggggctgcggagcagatcaaacatattcttgccaacttcaagaattaccagttcttcatcggcgagaacatgaacccagatggcatggttgcactgctcgactatcgcgaagatggagtgactccctacatgatcttcttcaaagatggactggagatggaaaagtgttag

SEQ ID NO: 210318 - DNA, 519 bp, Artificial Sequence
  Description of Artificial Sequence: Synthetic coding sequence
atgatcatctaccgggacctgatcagccacgacgagatgttcagcgatatttacaagatcagggagattgccgacggcctgtgcctggaggtggaaggcaagatggtgagccgaactgaagggaatattgatgacagcttgattggaggcaacgcctccgcagagggaccggaaggcgaggggaccgagagtaccgtcatcacaggagttgacattgtgatgaaccaccacttacaggagacctcctttacaaaggaagcttataaaaaatacattaaggactatatgaagtcaatcaaaggaaaactggaggagcaacgaccagaaagggttaagccttttatgactggcgccgctgagcagatcaaacacattttagccaattttaagaactaccagttctttattggggagaacatgaaccccgacggcatggtggctctgttggattatagggaggatggcgtgaccccatatatgatttttttcaaagatggactggagatggaaaaatgttag

SEQ ID NO: 210319 - DNA, 1164 bp, Artificial Sequence
  Description of Artificial Sequence: Synthetic coding sequence
atggaggacgacgcccccgtgatctacggcctggagttccaggcccgcgctcttacaccccaaacagctgaaactgatgcaatccgttttcttgtgggcactcagtccttgaaatatgataaccagattcatattatagatttcgacgatgaaaacaatattattaataagaacgttcttctgcaccaggcaggagaaatctggcatatctccgcgtcccccgccgaccgtggcgtgctaacaacttgctacaaccgcacatcagattctaaggtccttacctgcgctgccgtttggaggatgccgaaggagctggaatcgggctcacacgaatctcctgatgactcgtccagtaccgcacagactctggagttgttgtgccatctggacaacaccgcccatggaaatatggcctgcgtggtgtgggaacccatgggtgatggcaaaaaaatcatttctttggcagacaaccatattctcctgtgggacctgcaggagagttcaagccaggcagtcttggcgtcttctgcctccctcgagggcaagggtcagttgaaattcacaagcgggcgctggtcgccacatcacaattgtacccaggtggctaccgctaatgacaccaccttgcgtgggtgggatacgaggtctatgtcacaaatctactgcatcgaaaatgcccatggccagctggtaagggatttggactttaatcctaataaacagtattacctcgcgagttgtggcgacgattgtaaagtgaagttctgggatactagaaacgttactgaaccagtcaagaccctggaagagcactcccattgggtatggaatgttcgatataatcactctcacgatcagttggttctcactggctcctcggactccagggtgattctgtccaacatggtgagcatttccagtgaacccttcggacacctagttgacgatgatgacatcagcgatcaggaggatcacaggagcgaggaaaagagcaaggagccactgcaggacaatgtcatcgccacctacgaggaacatgaagactcagtctacgcagtagactggagttccgcggacccttggctgttcgcttcactgtcctacgacggcaggcttgtgattaacagagtgccaagggcccttaagtaccacattctactgtag

SEQ ID NO: 210320 - DNA, 990 bp, Artificial Sequence
  Description of Artificial Sequence: Synthetic coding sequence
atggccgaggccggcaccggcgagcccagccccagcgtggagggcgaacacggtacagaatatgatacgctcccttccgatacagtgagcctctcggactcagattcggacttgtccttgcctggaggggcggaggtagaggctctgtctccaatgggcctgcccggcgaggaagattcagggccagacgagccacccagtccgccgtctggattactgcctgctacagttcagccttttcaccttagaggcatgtcatctaccttttcccagagatcccgtgatattttcgattgtttggagggggctgcccggcgagctccaagctcagtcgcgcatacaagcatgtctgacaacggtgggttcaagcgacctcttgcaccgtctggtcgctctccagtggagggtctgggccgggcccacaggtctcccgctagtcctagagtgccgcctgtgccagactacgtggcacacccagagcgctggaccaagtactccctcgaggacgtgacagaagtatcggagcagagtaatcaggctacagccctcgccttcctggggtcgcagagcttggctgcgccaactgattgtgtgagtagtttcaatcaggacccctcctcttgcggggaaggacgagtcattttcacgaagcctgtgagaggagtcgaggcccggcacgagaggaagcgcgtcttaggtaaggttggggaacctggcagaggggggctcggaaatccagccacagatagaggagagggcccagtcgaactggcacacctggccggcccaggttcacccgaagctgaggagtggggatcacatcacggaggattgcaagaggtggaggctctgtctggaagtgtccattcagggtcagtgccggggctgcctcccgtagaaacagtgggattccatggctcacggaagcgttcacgcgaccatttcaggaataaaagctcttccccagaagaccctggagctgaggtatag

SEQ ID NO: 210321 - DNA, 798 bp, Artificial Sequence
  Description of Artificial Sequence: Synthetic coding sequence
atggccgaggccggcaccggcctgctgcccgccaccgtgcagccctttcatctacggggaatgtcctccactttttcgcaacggagtcgcgacattttcgactgtttagaaggagctgccagaagggcaccgagttccgttgcacacacttctatgtcagacaatggtgggttcaagcgcccgttggcccctagtggcaggtctcctgtcgaagggctggggcgggctcatagaagtcctgcctcccctcgagtgccgccagtgccggattatgtggcgcaccccgagcgatggaccaaatatagcttggaggacgtaacagaggtcagcgagcagagtaatcaagccactgccctcgcatttcttggaagccagtcacttgccgcgccaacggattgcgtgtcctcctttaatcaggatcctagtagttgtggggagggacgggtaatattcacaaaaccagtgcggggcgtggaggcccgtcacgagaggaagagagtgctgggcaaagtcggtgaaccgggccgcgggggcctgggcaaccctgccacagaccgcggagagggcccagttgagctcgcccacttggcgggccctggatctcccgaggccgaagaatggggatcccatcacggaggacttcaggaagttgaagccctgtcagggagcgtccacagcgggtcagtcccagggctaccacccgtcgagacggttggattccatggttctagaaaaaggagtagagatcattttcggaataagtcctcttcaccagaggaccccggtgccgaagtgtag

SEQ ID NO: 210322 - DNA, 339 bp, Artificial Sequence
  Description of Artificial Sequence: Synthetic coding sequence
atggccgaggccggcaccggcgagcccagccccagcgtggagggcgagcacggtacggagtacgacactctgccttctgataccgtcagccttagtgattctgacagtgatctcagccttccaggcggggccgaagtggaagcactgagccctatgggtctgccaggcgaagaggacagcggaccagacgagcccccgtcccctccctcagggctccttcctgctacggttcaacccttccacctcagaggtatgtcttccaccttctcccagcggagtcgggacattttcgactgcttggagggagcagcccggcgcgcacccagctcagtggcctag

SEQ ID NO: 210323 - DNA, 612 bp, Artificial Sequence
  Description of Artificial Sequence: Synthetic coding sequence
atggccgaggccggcaccggcgagcccagccccagcgtggagggcgaacatggcacagagtacgatacactgccgagtgacacagtctcgctatccgactccgacagtgacctatccctccccggtggagcagaggtggaggcactctctcctatgggtctgcctggagaagaggacagcggccctgatgagccgccatcaccaccctccggtctcctgcccgccacagtgcagcccttccacctcagaggaatgtccagtacattcagccaaaggtctagggacatcttcgactgcttggaaggcgcggcccggagggctccatcatccgttgctcacacctccatgtccgataacgggggcttcaagagaccgttagctcccagtggcagatcacctgtggaagggctgggccgcgcacaccgctctccagccagccctcgggtaccaccagtgcctgattacgtggctcaccccgaacgttggaccaagtacagtctggaggacgtgacagaggtctccgaacaatccaatcaggctaccgcgctggcgtttttggggagccagtccctcgcagcaccgacggattgtgtttcatcttttaaccagtag

SEQ ID NO: 210324 - DNA, 627 bp, Artificial Sequence
  Description of Artificial Sequence: Synthetic coding sequence
atggccgaggccggcaccggcctgctgcccgccaccgtgcagcccttccatttgcgaggcatgtcatccactttctctcagaggagtagagacatatttgactgtttagagggggcggcccgccgcgcacctagctcggttgcacacacctcaatgtcagacaacggagggttcaagagacccctggctccatctgggcggagccccgtagaaggactggggagagcacatcggtcgcccgcatcacctagggtgccccccgtgccagattatgtcgcccaccccgagcgctggacgaagtacagtctagaggatgtcacggaggtgtccgagcagagtaaccaggcaacagccctggcctttttaggatcccagagcctcgccgccccaaccgattgcgttagttcattcaaccaggacccctcaagttgtggcgagggtcgggtgattttcactaagcccgtcagaggtgtcgaagccaggcacgagagaaaacgcgtcttaggaaaagtgggtgaaccaggaaggggcggactgggtaaccccgctacagatagaggggagggcccagtcgagctggcccatctggcaggccccggcagtcctgaagccgaggaatggggctag

SEQ ID NO: 210325 - DNA, 990 bp, Artificial Sequence
  Description of Artificial Sequence: Synthetic coding sequence
atggccgaggccggcaccggcgagcccagccccagcgtggagggcgaacacggaacagagtacgacactctcccatctgacaccgtttcattatcagactccgattcggacttgagtctacccgggggggccgaggtggaggctcttagccccatgggcctccccggggaggaggacagtggcccagacgaacccccctctccgccttctgggcttttacctgccacggtgcaacctttccatctgcgggggatgtcttccaccttttcccagaggtctcgcgacatttttgactgcctggagggcgccgccaggcgcgctccctcctcagtggcccacactagcatgtcagataatggcgggttcaagcgtcctctcgcaccatccggccgctctccagtcgagggacttggacgtgctcaccgttcaccggcttccccacgggtccctccagtgcccgactatgttgctcatcccgagagatggacaaaatatagtctggaggacgtgaccgaggtgtccgagcagtccaaccaggccaccgctttagcattcttgggcagccagagtcttgctgcacctactgactgcgtttcctctttcaaccaggatcctagcagctgcggagaaggacgcgtgatcttcaccaaaccagtacgaggcgttgaggcaagacatgagagaaaacgcgtgctcggtaaagttggagagccaggacgtggagggctgggcaacccagctaccgataggggagaaggccctgtagaacttgcacacttggctgggccggggagtcccgaggcagaagagtggggctcccatcacggcggcctgcaggaggtggaggcccttagtggcagcgtccattccggttctgtaccaggtctcccgccagttgaaaccgtcgggtttcacggcagtcgtaaaagatcacgcgatcattttagaaataagtcctcttcacccgaggatcctggtgccgaagtctag

SEQ ID NO: 210326 - DNA, 333 bp, Artificial Sequence
  Description of Artificial Sequence: Synthetic coding sequence
atggccgaggccggcaccggcgagcccagccccagcgtggagggcgagcacggcaccgagtacgatactcttccatctgacactgtgagcctttcagatagtgacagtgacttgtctctgcctggtggggccgaagtagaagctttgtctccaatgggcctgcctggggaggaagactccggacctgatgagccaccttctcctccctctggcctcctgcccgcgactgtgcagccgttccacttgaggggaatgtcatcaacttttagtcagcggtccagggatatttttgattgtctggaaggcgctgccagaagggccccaagcagctag

SEQ ID NO: 210327 - DNA, 576 bp, Artificial Sequence
  Description of Artificial Sequence: Synthetic coding sequence
atggccgaggccggcaccggcgagcccagccccagcgtggagggcgagcacggtaccgagtacgataccctgccaagtgacaccgtaagtttgtcagactcggatagtgaccttagtctgcctggaggggcggaggtggaggcactgtctcccatgggcctgcccggtgaagaggacagtgggcctgacgagcctccaagccccccttctgggctgctgccagcaacggtccagccgtttcaccttcgcggaatgtcaagcacattcagccagagaagtagagacatttttgactgcctcgagggcgcggcacgccgcgcaccttcaagtgtcgcgcacacgtccatgtccgataacggcggctttaaacgacccctggctccgagcggccgatcacccgtcgagggattagggcgagcccaccgcagcccggcgagcccaagagtaccacctgtaccagattacgtggcccatccggagcgatggaccaagtattcgttggaggatgtcacagaagtgtctgagcagtcaaatcaggccactgccttagctttcctggggtcacagagtttatag

SEQ ID NO: 210328 - DNA, 639 bp, Artificial Sequence
  Description of Artificial Sequence: Synthetic coding sequence
atgggccccatgtggcggatgcggggcggcgccacccggcggggcagttgttgtggtggtgacggagctgcggatggcagagggcccgggcgtagcgggagggcgagaggtggaggttccccgtctgggggaggaggcggcgttggttggagaggacgtgcagacggcgcccgccagcagttagaagaacggtttgccgacctggctgcctctcatctcgaagccattcgcgcacgtgatgagtgggacaggcagaatgcccgattgcgtcaggaaaacgcgcgactacggctagaaaatcgccggctgaaaagggagaaccgctctttgttccgccaagcactcagactacccggcgagggtggcaacggtaccccagctgaggcccggagggtcccggaggaggcgagtaccaaccgccgcgcacgcgattccggcagagaggatgaacctggctctcctcgagcgttgcgggcgaggttggaaaagcttgaagccatgtataggcgagccctgctgcagttgcacctggagcagcgagggccccggccttccggcgacaaagaagagcagcccctgcaggaaccagacagcggactgagatcacgggattccgagccttctggcccatggctgtag

SEQ ID NO: 210329 - DNA, 1047 bp, Artificial Sequence
  Description of Artificial Sequence: Synthetic coding sequence
atgggcgcccggggcgcccccagccggcggcggcaggccggccggaggctgcgctacctccccactgggtctttccctttcttgctgctcctgctgcttctctgtatccagttgggaggaggacagaaaaagaaagagaatctcctagccgaaaaagtcgagcagttgatggagtggtccagccggcgaagcatcttccggatgaatggtgataaattccgaaaatttatcaaggcaccccccaggaattactctatgattgtcatgtttacggcattgcagcctcagagacagtgcagcgtgtgtaggcaagctaatgaggagtaccagattctcgcaaattcttggcgctacagctccgcattttgtaataaactattcttcagcatggtggattatgatgagggaactgatgtgttccagcaacttaatatgaattccgcaccaacatttatgcacttccctcccaaagggcgccccaagcgcgcagatacgttcgacttgcagcgaatcggcttcgccgccgaacaactggcaaaatggattgcagaccggactgatgtacatatcagagtttttcgacctcccaactacagcggtactatcgcactggcactgctcgtgagcctcgtcggggggctcctgtatctgcggcggaataaccttgagttcatctacaacaagaccggatgggcaatggtgtccctgtgtatcgtcttcgcaatgacaagtggccagatgtggaaccacatcaggggcccgccttacgctcacaagaacccccataacgggcaggtgtcttacatccacggatcaagccaggcacagttcgtggctgagagtcacataatcttggttctcaacgcagctattacaatgggcatggttctgctgaacgaggccgcgacctccaaaggagacgtgggcaagaggcggataatttgtttagtgggcttagggttagtcgtcttcttcttctcttttctgctgtccatttttcggtctaagtaccatggatacccttattctgacctggatttcgagtag

SEQ ID NO: 210330 - DNA, 1044 bp, Artificial Sequence
  Description of Artificial Sequence: Synthetic coding sequence
atgggcgcccggggcgcccccagccggcggcggcaggccggccggagactccggtatctccccacggggagtttcccattcttactgttactcctgctgttgtgcattcaattgggaggtggccagaaaaagaaggagaacctgctggcagaaaaagttgagcagctcatggagtggtcaagccgtcgatcaatcttccgcatgaatggcgacaagttcaggaagttcatcaaggcgcctcctcgcaattatagcatgatagtgatgtttaccgcactccaacctcagaggcaatgtagtgtgtgccgccaagcaaacgaagagtaccagattctggcgaactcctggcgttatagcagcgcattctgcaacaaattgttctttagcatggtggattacgatgaaggaactgatgtattccaacagctcaacatgaacagcgccccaacctttatgcatttcccgccgaaagggcgccctaaacgggcagatacttttgatctacagagaattggattcgccgccgagcagctcgccaagtggatagccgaccgcaccgatgtgcatatcagagtctttaggcccccaaattattccggaacaattgccctggcactgctggtgtctctggtgggcggactgttgtacctgaggaggaacaacctggagtttatctataacaaaaccggctgggctatggtttctctgtgtatcgtgttcgcaatgacctctgggcagatgtggaaccacattagaggtccgccatacgcccacaagaacccacacaacggccaggtatcctatatccacgggtctagccaggcccagttcgtagcagagagccatatcatcttggtcctgaacgcagcaatcacaatgggcatggtgcttcttaacgaagccgctacttccaaaggtgacgtgggaaaaaggcggatcatatgtctagtggggcttggcctcgtcgtcttcttctttagcttcctgctgagtatcttccgctccaagtaccacgggtacccctactcatttctgatcaagtag

SEQ ID NO: 210331 - DNA, 1047 bp, Artificial Sequence
  Description of Artificial Sequence: Synthetic coding sequence
atgggcgcccggggcgcccccagccggcggcggcaggccggccggaggcttcggtacctgcccactggctcctttccatttctcttactactcctgctgttatgcatccagctcggcggagggcagaagaagaaggaaaacttgctggcagaaaaggtcgagcagcttatggagtggtcttcacggcgctccattttcaggatgaatggggataagtttcgtaaattcatcaaggctccccctcgaaattactccatgatagtgatgttcactgcgctgcagccgcagcggcagtgttccgtttgtcggcaggctaacgaggaatatcagatccttgccaattcctggaggtactcatcagctttctgtaataagttgttcttctcaatggtggactatgacgaaggcacagacgtgttccaacagcttaatatgaattccgcccccaccttcatgcactttccaccaaagggccggcccaaacgcgctgacacgttcgatttacagcggattgggttcgctgcagagcaactggctaaatggatagcagaccgtaccgatgtgcacatccgggtctttcgtccccctaattacagtggcaccattgccctcgcgctgctcgtttccctcgtgggaggtctgctgtatttgcgcagaaataacctggaattcatatacaataagaccggctgggcaatggtctcactgtgtatagtctttgcaatgacaagcgggcagatgtggaaccatattagaggacctccttacgctcacaaaaatcctcacaatggccaggtgtcatatatccacggaagcagtcaggcacagtttgtggccgaatcccacataatccttgtgctgaatgccgcaatcactatgggcatggtcctgctgaatgaggctgccacaagcaaaggcgacgtgggtaaaaggcgcatcatctgcctggtcggactgggtctcgtggtcttttttttttcttttcttcttagcatttttcggtcaaagtaccatgggtatccttacagtgatctcgattttgaatag

SEQ ID NO: 210332 - DNA, 1047 bp, Artificial Sequence
  Description of Artificial Sequence: Synthetic coding sequence
atgggcgcccggggcgcccccagccggcggcggcaggccggccggagactgcgctatctgcctaccggaagtttcccctttttactgttgttgctgctcctctgtatccagttgggtggaggccagaagaagaaagagaacttactcgcagaaaaggttgagcagctgatggaatggtcctcacgccgcagcatcttcagaatgaacggtgacaaatttcgaaagttcatcaaggcccctccacggaattactcgatgattgttatgtttacagcgctgcagccacagaggcagtgcagcgtgtgtaggcaggctaatgaagagtatcaaattctggctaattcttggcggtactcttcggccttctgtaacaaactcttcttttcaatggtggactacgatgagggcactgacgtcttccaacagctcaacatgaacagcgcgccaacatttatgcacttcccccctaaaggaaggcccaagcgtgccgacacgttcgacctccaaaggatcgggtttgctgccgagcagctcgctaagtggattgcagaccgcactgacgtgcacatccgggtgttcagacctcccaattacagtggcaccatcgccctcgccctgctggtgtcactagtgggtgggcttctctacttgcgcaggaataaccttgagttcatctacaataagactggatgggccatggtatcactttgcattgtctttgcaatgacgtccggccagatgtggaaccatatcagaggcccaccctatgcacacaaaaacccacataatggccaggtctcctatattcatggctcctctcaggctcaatttgtggctgagagccacattatcctcgtgcttaatgccgccattactatgggcatggtattactgaatgaggctgctacaagtaagggcgatgttggcaagagaagaataatttgcctggtagggctgggactggtggtgttctttttcagttttctgctttccatatttagatctaagtatcacggctatccatactctgatctggactttgagtag

SEQ ID NO: 210333 - DNA, 534 bp, Artificial Sequence
  Description of Artificial Sequence: Synthetic coding sequence
atggcccaccccgtgcagagcgagttccccagcgcccaggagcccggctccgccgctttcctagatcttcccgaaatggagatcctcttaaccaaagcggagaacaaggacgacaagacacttaacctgtccaaaaccctcagcgggcctctggatctggaacagaactcccagggattaccttttaaggccatcagtgaaggtcacctcgaggcacccctgcctcggtcaccaagcagagcaagcagtaggagggccagttcgattgcaacaacaagctatgcccaggatcaggaagccccacgggactatctcattcttgcagtggtggcctgtttttgccctgtctggcctctgaatctgatccctctgatcatcagcataatgtcgaggtctagcatgcagcaggggaatgtcgacggagctcggcgactcgggcgcctggctcgcctgctgtccataaccctaattataatggggatcgtgattattatggtagcagtcaccgtaaacttcaccgttcagaagaaatag

SEQ ID NO: 210334 - DNA, 1173 bp, Artificial Sequence
  Description of Artificial Sequence: Synthetic coding sequence
atggccgtgagcgagagccagctgaagaagatggtgagcaagtacaagtaccgggacttgacagtacgggagactgttaacgtgatcacattgtataaagatttgaaaccggtgcttgatagttacgtgttcaacgatggttcgagtagagagctaatgaaccttactggcactatccctgtaccttatcgcggcaatacctacaatattcccatctgtctctggctgctcgatacctatccatataatcctcccatttgcttcgtgaaacctaccagctcaatgaccattaagacaggcaagcatgttgacgccaatggaaagatatatctaccttacctgcatgagtggaagcaccctcagtccgatctgctggggttgatccaggtgatgattgtggtgtttggcgacgagcctcctgtgtttagcaggccgatatctgcttcatatccaccttatcaggcgactggacctcctaacacctcttatatgcccggcatgcctggaggtatcagcccctatccatcaggataccctccaaacccaagcggatacccaggttgtccctatcctcctggtggcccttaccctgccaccacgtccagccagtatccctcacagccacccgtcactacagtgggaccaagccgggacggaacgatttcagaagacacaatccgcgcttctctcatcagcgccgtgtccgacaagctgcggtggagaatgaaagaggaaatggaccgcgcccaagctgagctgaatgcgctgaaacgcacagaagaggacctcaagaaaggacatcagaagcttgaagagatggtgactcgacttgatcaggaggtggccgaagtcgacaagaatatcgagcttcttaaaaaaaaagatgaagagttgtcatccgctctggaaaagatggagaatcagagcgagaacaacgacattgacgaggttattatccccaccgcacccttgtataagcagatattgaacctttacgcagaagaaaatgccatcgaggatactatcttttacctgggcgaggcacttcgccggggcgtcatagaccttgatgtgttcttaaagcacgtgcggctgctatcgagaaagcaattccagctacgcgctttaatgcagaaggccaggaaaactgccggattgtctgacctgtactag

SEQ ID NO: 210335 - DNA, 858 bp, Artificial Sequence
  Description of Artificial Sequence: Synthetic coding sequence
atggccgtgagcgagagccagctgaagaagatggtgagcaagccccaaagcgatttgctcgggctgatccaagtcatgatcgtggtcttcggggatgaaccacccgttttttcccggcctattagcgccagctaccctccttaccaagcaaccggtcccccaaatacttcgtacatgcccggcatgcccggcggaatcagtccctacccatctggctacccccccaatcccagtggctatccgggctgcccctaccccccggggggcccttatcccgccaccacctcttcccagtatcccagccaaccaccagtaacaactgtgggcccgagtcgcgatgggaccatttccgaggacactatcagagcttcattaatcagtgctgtctcagataaactcagatggcggatgaaggaagagatggacagggctcaagccgaattaaacgccctgaaacgtacggaagaagatctgaagaaaggacaccagaagcttgaagagatggtcactagactggatcaggaagtggccgaggtggacaagaatatagagctcctcaagaagaaggatgaggagctgtcctccgccctggagaagatggagaaccagagtgaaaacaacgatattgacgaggtcatcatccccaccgcacccctctacaagcagatactgaatctctatgccgaagagaatgcgatcgaggacacaattttttaccttggggaagctctgcgccgaggagtgatcgacttagatgtgtttctcaagcatgttagattgctgagtaggaaacagtttcagttacgagccctgatgcagaaagccaggaaaacagctgggctatcagacctgtactag

SEQ ID NO: 210336 - DNA, 972 bp, Artificial Sequence
  Description of Artificial Sequence: Synthetic coding sequence
atggcccggggccccggcctggcccccccccccctgcggctgcccttgctgcttctggtactggccgccgtcaccgggcatacagccgctcaagataactgtacttgccctactaataaaatgaccgtgtgcagccccgacggtccgggcggcagatgtcagtgtcgggcactcggatctggcatggcagtggactgtagcactctcacatctaagtgtctgctgctcaaggcaagaatgagtgccccgaagaatgctaggaccctggtgaggccctccgaacacgccttggtggacaacgatggattgtatgaccccgactgcgatccggagggacgattcaaagcacgccagtgcaatcagacaagcgtgtgttggtgtgtgaatagtgttggggtacggcggacagataagggagacttatcactgcggtgcgacgaactggtgaggactcaccacatactcattgacctccgacatcgacccaccgccggtgcttttaaccacagcgacctggacgctgaactcagacgtttgttccgagagaggtacagattgcacccaaagttcgttgctgccgtccactacgagcaaccaacaatccagatagagctcaggcagaacacctcacagaaagctgcgggggacgttgatattggcgatgcagcatactatttcgaacgtgacatcaagggcgagtcgctgttccagggcaggggcggactcgatctccgcgttcgtggcgagccactccaagtggagaggacgcttatctactacctggacgaaataccccccaagttctctatgaagcgactaacagcaggactgatagccgtgatcgtggtggtggtggtggccctggtggccggtatggcagtgttagtgattactaataggcgaaaaagcgggaagtacaagaaggtggaaatcaaagaactgggggagttaaggaaagagcccagcttatag

SEQ ID NO: 210337 - DNA, 1353 bp, Artificial Sequence
  Description of Artificial Sequence: Synthetic coding sequence
atgggcgccccccccggctaccggcccagcgcctgggtgcacctgctgcaccagctaccgcgcgccgatttccagcttcggccagtccccagcgtcttcgccccccaagagcaagaataccagcaggcattactgctggtggccgcacttgccggcctcggactcggtctatccctgatattcatcgcagtgtacctcatccgcttctgttgttgcaggcctccagaaccgcctggttccaagatcccctcgcctggaggcggatgcgtgacctggtcttgtatcgtagccctcctggcagggtgcaccgggataggtattggcttctacggtaattcagagacttcagatggtgtatcccagctttcttccgcactcctgcatgccaatcatacactatcaactattgaccacttggtacttgaaaccgtggagaggttgggagaagcagtccggacagagttaacaacacttgaggaagtattagagccaagaaccgagctcgtggccgccgctagaggtgccaggagacaggccgaagccgcagcccagcaactgcagggactcgctttttggcagggtgttcctttgagcccactgcaggttgcagaaaacgtgtctttcgttgaagagtatcgatggcttgcctatgtgctgttgctgctcctggagctcctggtctgtcttttcaccctgcttggcctggcaaagcagtctaaatggctagtgatcgtcatgactgtaatgagcctcctagtgttggtgttaagttggggatctatgggcctggaggccgcaactgccgttggtctgtccgacttttgtagcaaccccgatccttacgtgttgaacctgactcaggaggagaccgggctcagttcagacatcctctcttactacctgctgtgcaatagggcagtcagcaaccccttccagcagaggttgaccctgtcccagcgggctttggccaacatccactcccaactgctaggcttggagagagaagccgtaccacagttccccagcgcacagaagcccctcctgtccttagaggaaacgctcaacgttactgagggcaactttcaccagctcgtcgcgctactccactgccgttccttgcataaagattatggagcagccctgcggggtctctgtgaagatgctcttgagggtctgctgttcctcctgttattttctctgctgtctgctggggcactggccacggcgctgtgttcccttcccagagcttgggccctcttccccccatctgacgattacgatgacacggatgatgatgatccatttaatcctcaggagtccaaacggtttgtccaatggcaaagtagcatatag

SEQ ID NO: 210338 - DNA, 1383 bp, Artificial Sequence
  Description of Artificial Sequence: Synthetic coding sequence
atgggcgccccccccggctaccggcccagcgcctgggtgcacctgcttcatcagctgccaagagcagacttccaactcaggccagttcccagcgtgtttgccccacaggagcaggaatatcagcaagccctcctactcgtggccgctctggcggggttagggcttggacttagcctcatctttatcgctgtgtacttaatccgattttgttgttgtaggcccccggagcctcccggttctaagattccatctcctggaggcggctgcgtaacctggtcctgcattgtggctctgctggccggctgcacggggatagggatcgggttttacggcaactccgaaaccagcgacggcgtctcgcaactgagtagcgccctgcttcatgccaaccacaccttgagtaccatcgaccacctagtactggaaaccgttgaacggttgggcgaggcagttcggactgagttgacaactctggaagaggttcttgagccaaggactgagctggtggctgctgctaggggcgcacgacgacaggcagaagccgcagctcagcagctgcaggggttggcattctggcaaggggtgccgttgtccccactccaggtggccgagaacgtgagtttcgtggaggagtaccggtggctagcctacgtgctgctgttattgctcgagttgctcgtatgcttattcaccctgctgggtctcgctaaacagtcaaaatggcttgtcatagttatgaccgtgatgagcctgctggtccttgtcttaagttggggctcaatgggcctcgaagccgctacagccgtggggttgagcgatttctgctctaacccagatccatacgtcttgaatctgacccaggaagaaactgggttatccagcgatattctgtcctactacctcctttgtaatcgggcagtgtcaaatcccttccagcagcgactgactctgagccaaagagcgctggccaacatccactctcagctgctcggactcgaacgtgaggcggtcccccagtttcccagcgcccagaagcccctcctctcccttgaggagaccttgaatgttaccgaaggcaacttccaccagctcgtcgccttactgcactgcaggtctctccacaaagattatggggctgccctgagggggctgtgcgaggacgcgctggaaggactgctcttccttttgttatttagtctcctgtctgccggggcacttgcgaccgcgctgtgttccttgccacgggcgtgggcgttatttcctcctcgaaatccaagtgctttatgctcaggctcacggctcagtgagccccttcttccggccggcctggaacccggcagccctctgcggtcttttcccggctgtcgtcggcggccgcattag

SEQ ID NO: 210339 - DNA, 1362 bp, Artificial Sequence
  Description of Artificial Sequence: Synthetic coding sequence
atgggcgccccccccggctaccggcccagcgcctgggtgcacctgctccatcagctcccccgggccgattttcagctccgtccggtaccatctgtgttcgctccacaagaacaggaataccagcaggaccagtcttctctggctgtcacacagaggccaccgccaacgaccccactccaccgcctccggccccgccccaggctcacaccagccttggctcggaggccgcctgaggcagccagaggggaccctcggccacagagtccccccgaagctctgctgctggttgctgccctggccgggctgggattaggactgtcactcatcttcattgcagtgtatctgattcgtttttgctgctgtcgaccaccagaacctcctggatctaaaatccctagtcccggtggtgggtgcgtaacctggagttgcatcgtggcactgttagctggttgcacaggaattggcatcggtttttatgggaatagtgaaacaagcgacggtgtgagccaacttagctcagccttgctacacgcaaatcacaccctgagcacaatcgatcatcttgtcctggagaccgtggagcgcttaggcgaggcagtgagaactgaattaaccaccctggaggaagtgcttgaaccaagaacagagctggtggcagccgcacgcggcgcacggcgacaggcagaggccgcggcccagcagctgcagggactggctttctggcagggagtgcctctctccccactccaagttgccgagaatgtgtcttttgtagaggaatacaggtggctcgcttacgtgttgctgctgctcctagagctgctggtctgtctgttcacactgctgggtctggcaaagcaatctaagtggctcgtgatcgtgatgaccgtgatgtctctgctagtcttagtcctgtcttgggggagcatgggcctagaggcggccactgcggttgggctgtctgatttctgtagtaatccagatccatatgtcctgaatctaactcaggaggagaccggcctgtcctccgaggccgatagtgtccccgcaagctctggccaacaccccttgcctgccgctggacccggggcaaggagctgcgcatccgtgccgtttagcgcggaagctagcgcggtacttggaggcgattccgaatgcgatcgccgaaagtttcctccagtgggtggcaccgcgactctgccccagccagctcaggggctgtggtgcagcccagctggtcccgtaagaagacggccggggcgtcccgccctgcctgcgaccctattacctgccgtgtgtcggtctgctggacactgccctctgcagcctgcgcctagcctgggtccactgcccacgcagtag

SEQ ID NO: 210340 - DNA, 1356 bp, Artificial Sequence
  Description of Artificial Sequence: Synthetic coding sequence
atgggcgccccccccggctaccggcccagcgcctgggtgcacctgttgcatcagctgcctagagccgactttcaactgaggcccgtcccgtccgttttcgctccacaggaacaggaataccagcaggcccttctgctagttgccgctctcgccggactggggctgggcctgagtctgatcttcatagcagtctatctcatccgcttttgttgctgtaggcctcctgaaccacccggttcaaagatcccaagccccggcgggggctgcgtgacatggtcgtgtattgtggcattactcgcggggtgcacagggataggcattgggttctatgggaatagtgaaacttccgacggtgtatcccagctgtctagcgcactgctgcacgcgaatcacactctgtccactatcgaccacctggtcctcgagactgtggaaaggcttggtgaagctgttagaacggagctgactacgcttgaggaggtgctggaaccccgcacggaactggtggcagcagctcgaggtgctcgcaggcaggcggaggctgcagcccaacaactccagggacttgccttctggcaaggcgtcccattatcaccactgcaagttgccgaaaacgtctctttcgtggaagagtaccgctggctcgcttacgtgctgcttcttctcctggagctcctggtgtgtttatttactctgctcggccttgccaaacagtctaagtggcttgttattgtgatgaccgtcatgtccctgcttgtgctggtgttgtcgtggggaagcatgggccttgaagcagcgacagccgtagggttaagcgatttctgctcaaatcctgatccctatgttttgaatttaactcaagaagaaacaggtttatcctcggacatcctaagctactaccttctgtgcaacagggctgtttcaaacccctttcagcagagactgactttatcccagcgagcacttgccaacattcatagccagctgctcgggcttgaaagggaagcagtaccccagttcccctccgcccagaagcctctgttgtccctagaggagaccctaaacgttactgaaggaaactttcatcagttggttgccctcctgcactgccggtctcttcacaaagattacggagcagctctgagaggcctgtgcgaagatgccctggagggattactgttcctcctgctcttctcactgttaagcgctggggccctggccaccgccctgtgctcgctgcccagagcctgggcgctcttccctccaagcgatgattacgatgatacagacgacgacgatcccttcaatccccagcaggagtcaaaacgcttcgtgcagtggcaaagcagtatctag

SEQ ID NO: 210341 - DNA, 1155 bp, Artificial Sequence
  Description of Artificial Sequence: Synthetic coding sequence
atgacccggcggggccggcggcggagcagccacttcctgggccccccagccggtgctgccggttgtacacagaggagatcccgcgagttggctgctgccgccatgtcccatcaaaccggcatccaggcctcagaggacgtcaaggaaatttttgccagggcccgtaacggcaagtacaggctcttaaaaatttccatcgaaaacgagcagcttgtcatcgggtcatatagccagccgtccgatagctgggataaggattatgatagcttcgtgttaccacttctcgaggacaagcaaccttgctatatactctttcggttggatagccaaaatgcacagggctacgaatggatttttatagcatggtctccagaccacagccatgtgaggcagaagatgctgtatgcggcaactagggccacactgaaaaaagaattcggagggggacatatcaaggacgaggtgttcggaactgtcaaggaggacgtgtccctccacggctataaaaagtatcttctgtcccagagttcccccgcacccctgaccgccgcagaagaggaactccgccagatcaagatcaacgaagttcagaccgatgtgggcgtggacactaagcaccagacactgcagggagtcgcatttcccatctctcgtgaggctttccaggcactcgagaagctcaacaaccggcagctgaactatgtgcagttagagatagatattaagaatgaaatcatcatactggcgaatacaacgaacacagagctcaaggaccttcccaaaagaatccctaaggattccgccaggtatcatttttttctgtacaaacacagtcatgaaggagactatctcgaaagtattgtgttcatttattcaatgccgggctatacctgttcaatccgggagagaatgctttacagttcctgtaaatcccggctgttggagatcgtggagaggcaactccagatggatgtgatacgaaaaatagagattgacaacggggacgaattgaccgctgattttctgtatgaggaagtccaccctaaacagcacgcacacaagcagagctttgcaaaacctaaaggcccagctggtaaacggggaatacggcgactgataagaggcccggccgagaccgaagctactactgattag

SEQ ID NO: 210342 - DNA, 1053 bp, Artificial Sequence
  Description of Artificial Sequence: Synthetic coding sequence
atgagccaccagaccggcatccaggccagcgaggacgtgaaggagatcttcgctcgggcaagaaacggtaaataccggcttctcaaaatcagcattgagaacgaacagttggttatcggttcctactcccaacccagcgatagttgggataaggactacgatagcttcgtactgccactgctggaggacaagcaaccttgttatatccttttccgtttggattcacagaatgcacagggatacgaatggatttttatagcctggtctcctgatcacagtcacgtgaggcaaaaaatgctgtacgccgctacacgcgctacattgaagaaggaatttggcggaggccatattaaagacgaggtgttcggcacagtgaaggaggatgtgtctctgcacgggtataagaagtatttacttagtcagagcagccccgcccccctgacagcagcggaagaagaactgagacagatcaagatcaatgaggttcaaaccgacgtcggtgtggatacaaagcatcagacactgcagggtgtggcatttccgatctctagagaagcctttcaagcacttgagaaactgaataatagacaactcaactacgttcagcttgagattgatattaaaaacgagatcatcattttggccaataccaccaataccgagctgaaggatctgcccaaaagaataccgaaggatagtgcgaggtaccacttctttctgtacaaacacagtcatgaaggggactatctcgagtctattgtgtttatctattcaatgcctgggtatacatgctctattagagaacgcatgttgtatagctcctgcaagagccgcttattagagatcgtagagaggcaactgcaaatggacgtgattcgcaagatagaaatagacaatggggatgaattaaccgccgacttcctgtacgaagaggtgcatcctaaacaacatgcccacaagcaatcctttgccaaaccgaagggacccgcagggaaacggggaatcaggcgtctgattcggggacctgccgaaaccgaggccacaactgactag

SEQ ID NO: 210343 - DNA, 1074 bp, Artificial Sequence
  Description of Artificial Sequence: Synthetic coding sequence
atgagccaccagaccggcatccaggccagcgaggacgtgaaggagatattcgccagagcacgaaatggtaaataccggcttttgaagatcagcatcgagaatgagcaactggtgataggatcttattcgcagccaagcgactcctgggataaggattatgacagtttcgtgctcccactactggaggacaagcaaccatgttacatcctgtttaggttggactctcaaaacgcccaaggctatgagtggatcttcatcgcttggtctcctgatcacagccatgtcaggcagaaaatgctgtatgcagccacccgggccacgctcaagaaggaatttggcggcggacatatcaaagacgaggtattcggtaccgtgaaggaagatgtgtccctgcatggctacaagaagtaccttctttcacagtcctcacccgctcccctcacagccgccgaagaggagctacggcagattaagattaacgaaagccccgaagatcacattggcgtacagaccgatgtgggagtggatacaaagcaccagaccctccagggagtagcctttccaatcagtcgggaggccttccaggctctcgagaaacttaacaatcgtcagcttaactacgttcagctggagatcgatattaagaacgagattattatactggcaaacacaaccaacactgaactcaaagacttaccaaaaagaatccctaaggattccgccagataccacttcttcctctacaagcacagccatgaaggtgactatcttgagtctattgtgttcatatactccatgccaggatatacttgtagcatccgagagagaatgctgtactcctcttgtaagtcacgacttctagaaatcgttgagcgccagctgcagatggacgttattcggaagatcgagatcgacaacggggatgaattgaccgctgattttctgtacgaggaggtccatcccaaacaacacgcacacaaacagagtttcgcaaaacctaagggcccggctggaaaacgcggcatcagaagactaatcagaggcccggcagaaaccgaggctacaactgactag

SEQ ID NO: 210344 - DNA, 1050 bp, Artificial Sequence
  Description of Artificial Sequence: Synthetic coding sequence
atggcccaccagaccggcatccacgccaccgaggagctgaaggagttcttcgctaaagctcgcgctggttctgtccggctgataaaagttgtcatagaggacgagcagcttgtgctaggggcttcacaggagccagtgggaaggtgggatcaggattatgatagagcggtgctgccattactggacgcgcagcagccatgttacttgctctatcggctggactcgcaaaatgcccagggatttgagtggctgttcctggcctggtctcccgacaacagtcctgtgagacttaaaatgttatatgcagcgactcgcgcaactgtgaagaaggagtttggtggaggacatattaaagacgaactgtttgggacagttaaagatgacctgtccttcgccggttaccagaagcacctgtctagctgcgcggccccagcacctctgactagtgctgagcgggagctccagcagatcagaattaatgaggtcaagacagagatttccgtcgaaagtaagcatcagactttgcaaggcctggccttcccactgcagcccgaagcccaacgtgccctacagcagctgaagcagaaaatggtgaactatatacagatgaaactcgatcttgagagagagacaatcgagctagtccacaccgaacccaccgacgttgcacaactgccaagccgcgttcccagagacgcagctcggtaccacttcttcttgtacaagcacacccacgagggagatcccctggaaagcgtggtgtttatttactccatgccaggatacaaatgctcgatcaaggagcgaatgctgtattcctcctgcaaatcccgtctgctggacagcgttgagcaggattttcacctggaaattgcgaagaagatagaaatcggtgacggagccgagttaaccgcagagtttctgtacgacgaggttcatccaaaacaacacgcttttaaacaggcttttgcgaagcccaagggccccggaggaaaaagaggacataaaaggttaatcagagggcccggagaaaatggcgatgacagctag

SEQ ID NO: 210345 - DNA, 483 bp, Artificial Sequence
  Description of Artificial Sequence: Synthetic coding sequence
atggaggagggcagcagcagccccgtgagccccgtggacagcctgggcacttcagaggaagaactcgaaagacagccaaagcgcttcggccgaaagaggaggtattccaaaaagtccagtgaagacggcagccctacccccgggaaacggggcaaaaaagggtccccaagtgctcagtcatttgaggagctacagtctcagcggattctggccaacgtgcgagaaagacaaaggacccagtccctgaatgaagcattcgctgcgctccggaaaatcatcccaacacttccatccgataagctttcaaaaatccaaaccctgaagttagcagcccggtacatagatttcctgtaccaagtgctccaatcagacgagatggataacaagatgacatcctgcagctatgttgcacatgaaaggctcagttacgcatttagcgtatggagaatggaaggtgcctggtccatgtctgcctcccactag

SEQ ID NO: 210346 - DNA, 1476 bp, Artificial Sequence
  Description of Artificial Sequence: Synthetic coding sequence
atgaaccccgccgccgaggccgagttcaacatcctgctggccaccgacagctacaaagtaacacattataagcagtaccccccaaacacttccaaggtgtactcgtactttgagtgccgggaaaagaagaccgagaactcaaagctgcggaaggtgaaatatgaggagactgtgttctatggcctgcaatacattcttaacaagtacttgaaaggcaaggttgttacaaaggaaaagatccaggaggcaaaggacgtgtacaaggaacactttcaggacgatgtcttcaacgagaagggctggaactatattctggaaaaatatgatggacaccttccaattgagatcaaggccgtgccggaaggcttcgtcatccccagaggaaacgtgctcttcacagtggaaaacaccgaccctgaatgttattggctgacaaactggatagagactatccttgtccagtcctggtatccaatcacagttgcgaccaactcacgcgagcagaagaagattttagctaagtatctattggagacatcaggtaatcttgatggcctggagtacaagctgcacgattttgggtacagaggtgtgtccagtcaggaaaccgcaggaattggagcttctgcacacttggtgaattttaaaggcaccgataccgtagctggactcgcccttatcaaaaagtattatggtaccaaggaccccgtacctggatattccgtgccagcagcggagcacagtacgattacggcatgggggaaggaccacgaaaaagacgcatttgagcacatcgtcacccagttttcaagcgtgccagtgagcgttgtgtctgacagttacgacatttataatgcttgtgagaagatatggggcgaagatttaaggcacctgatcgtatccaggtccactcaagcccctctgattattcgccctgattctgggaaccccctcgataccgtgctaaaggtgctcgagattcttgggaagaaattcccggtgactgagaacagcaagggatacaaactgctccccccctatctgcgcgtgatacaaggggatggggtggacattaacacattacaagagatcgttgaaggcatgaagcagaagatgtggtctattgaaaacatcgcctttgggtctggcgggggccttttgcagaagctgacacgcgacctactgaattgttcctttaagtgttcctacgttgtgacaaacggactaggcatcaacgttttcaaagatccagttgccgacccgaacaaacgatctaagaagggtaggctgagtctgcaccgcaccccagcgggaaacttcgttactctcgaggaaggaaaaggagacctggaagaatatggacaggacctccttcacaccgtattcaagaatggcaaagttaccaagtcttacagcttcgatgagatcagaaaaaatgcgcagctgaacatcgagctagaggctgcacatcattag

SEQ ID NO: 210347 - DNA, 672 bp, Artificial Sequence
  Description of Artificial Sequence: Synthetic coding sequence
atgaagctgcactacgtggccgtgctgaccctggccatcctgatgttccttacatggctgcccgagagcctttcctgcaataaagcactgtgcgcctccgacgttagcaaatgtttgattcaagagctgtgtcagtgtcgccctggtgagggcaactgctcttgctgcaaggagtgcatgctctgcctaggcgctctgtgggatgaatgctgtgattgcgttggcatgtgcaatccccggaattacagcgacacaccccccacaagcaaaagtacagtggaggagctgcatgaacccatcccctcactgttccgagctctgacagagggtgatactcagctgaactggaacatagtatcctttccagtcgccgaagaactgtctcaccacgagaacctggtcagctttctggagaccgtcaaccagccccaccaccaaaacgtcagtgttcctagcaacaacgtgcacgccccctactccagtgacaaggagcacatgtgtacagtggtgtatttcgacgactgcatgagcatccaccagtgcaagataagctgcgagtctatgggtgcgtctaaatataggtggttccacaacgcatgctgtgagtgcataggcccagaatgtattgactacggctcaaaaacggtgaaatgcatgaactgtatgttttag

SEQ ID NO: 210348 - DNA, 2451 bp, Artificial Sequence
  Description of Artificial Sequence: Synthetic coding sequence
atggccgtgagcctggacgacgacgtgcccctgatcctgaccctggacgaaggtggctcggcaccacttgccccaagcaacggcttaggtcaagaagagctgcctagtaagaatgggggtagttatgctatccacgatagccaagcgcctagccttagtagtggcggggaatcttcaccctcctcccccgcacacaactgggagatgaattaccaggaagctgctatttacctgcaggaaggagaaaacaacgacaagttcttcacacatcccaaagacgccaaagctcttgcggcatatctgttcgcccataaccatctcttctacctcatggaactcgcaactgcactgctgctgctcctcctctctttatgtgaggctcccgctgtccccgctttgaggttggggatttacgtgcacgccaccctggagttgttcgccctaatggtggttgtgttcgagctctgtatgaagctgagatggctcggactccacacattcatcaggcacaaacgaacgatggtgaagacttctgttctcgtcgtacaattcgtagaagcaatagttgtcctcgtccggcagatgtcacacgtcagagtcaccagggccttaagatgtatctttctggtggattgtcggtattgtggcggtgtgcgacgcaacctgcgccagatcttccagagtttgcccccatttatggatatcctgcttctgctgctgtttttcatgattatttttgccatcttaggcttctatctattcagtccgaacccatctgacccatatttctctaccctggagaattctatagtctcactgttcgttctactgaccaccgctaacttcccagacgttatgatgccttcctactctcggaatccttggtcatgcgttttctttatagtttacctgagcattgagctttactttatcatgaatctgctcctggcagttgttttcgatacgttcaacgatatagagaagagaaagtttaagagcctcctgctgcataaacgcactgccatccaacacgcctacagactcttaatcagccagcggaggccagctggtatctcttacagacagtttgaaggattgatgaggttctataaacctcgcatgagtgcccgtgaacgctatttgactttcaaagccctgaaccagaataatacacccctgctctcgctgaaagacttttatgacatttacgaggtggcagccttaaagtggaaggccaaaaagaacagagagcactggttcgatgaactgcccaggacggcactgttaatctttaagggcatcaacatcctcgttaagagcaaagcttttcagtacttcatgtacttggtcgtggccgttaatggtgtgtggatactggtggagaccttcatgttaaagggcggaaactttttctcgaagcacgttccatggtcttacctcgttttcctgaccatatatggcgttgaactttttctgaaggtcgctggattaggcccagttgaatacctctcttccggttggaatctatttgatttctcggtcaccgtgtttgctttcttggggttattggccttggcactcaatatggaacccttctactttatcgtggtcctcaggcctctccagctgctgagattatttaaactgaaagaaaggtatcgaaatgttctggacacgatgtttgagctccttccaagaatggcatccctcgggttgaccttgttgatcttctattattcatttgctatcgtggggatggagttcttctgtgggatcgtctttccaaactgctgtaatacaagcacggtggccgatgcttatcgctggagaaatcacacagtgggtaatcggacagtagtcgaggagggctattattatcttaataacttcgacaacattttgaacagtttcgtcaccctctttgagctcacagttgtcaacaactggtatattataatggaaggagtgacgagccagacatcccactggagtaggctctactttatgaccttttatattgttacaatggtcgttatgacaattatcgtggcctttattctcgaggcctttgtgttccgtatgaactactctagaaagaaccaagactccgaggttgacgggggaattacactcgagaaggaaatctcgaaggaagaactggtggcagtgctcgagctgtaccgggaagcccgaggggcaagttcagacgtgactagactgctggaaaccttatcccaaatggagcggtaccagcagcactcaatggtgttcttgggccgcaggtcccgcaccaaaagcgatttgagtctgaaaatgtatcaggaggagatccaggaatggtacgaagagcatgcaagagaacaagaacagcagagacagttatccagctcagcagccccagccgcccagcagccccctggaagcaggcaacggtctcagacagttacatag

SEQ ID NO: 210349 - DNA, 2247 bp, Artificial Sequence
  Description of Artificial Sequence: Synthetic coding sequence
atgaactaccaggaggccgccatctacctgcaggagggcgagaacaacgataaattcttcacccacccaaaagatgccaaagcattggcagcatacttgttcgcacacaatcacctgttctatcttatggagctggcaacagcgctcctgttattactgctctctctttgtgaggcccccgccgtccctgccctgcgtttaggcatctacgttcacgcaaccctggaattgtttgccctcatggtcgttgtgttcgaactctgcatgaaattgagatggcttggactccatacatttataagacacaaacggaccatggttaaaaccagtgtgcttgtagttcagtttgtagaggccattgttgtgctggttcggcagatgagccatgtgagggtaaccagggccctgaggtgcatcttcctggtagactgtcgctactgcggcggggtgagacggaatctaaggcagatcttccagtctttacccccctttatggatatcttgcttctgctgctctttttcatgatcatatttgctattctgggtttctacctattctctcccaatcctagcgacccctattttagcacactggagaatagcatcgtgtccctttttgttctgctcacgacggccaacttccccgacgtaatgatgcccagctacagtcggaacccttggagttgtgttttcttcattgtatacttgagtatcgaactgtactttataatgaacctcctcctagccgtcgtatttgatacgttcaacgacatcgagaagcggaagttcaaatcactattgttacacaaaaggactgccatccagcatgcctacagacttctcatatcacagagacggcctgcgggaatcagttatcggcagtttgagggactgatgagattttataaacctcggatgtccgctagggagagatatcttactttcaaggctctaaatcagaataatacacctcttctatccttgaaagacttttacgatatctatgaggtggcagctcttaagtggaaggcaaaaaagaaccgcgaacactggtttgacgagttacctcggacagcactactcattttcaagggaataaatatcttggtgaaatccaaagcattccagtacttcatgtatctcgtcgtcgctgtgaatggggtctggatcctcgtggagactttcatgctcaagggcggcaatttctttagtaagcacgtgccatggtcctacctggtctttcttacaatctacggtgtggaactttttctcaaagtggcaggacttgggcccgtcgaatacctgtcttctggatggaatctcttcgacttctccgttacagtttttgctttcctgggcctgctcgctctggctctgaacatggagcctttctatttcatcgttgtgcttcggcccctgcagctcctgaggttattcaaactgaaagaaaggtatcggaatgtccttgataccatgtttgagttgctgcctaggatggctagcctgggactgaccctattgatattttattacagcttcgcgatcgtgggaatggagtttttttgcgggatcgtgttcccaaactgttgcaatacctctacagtggccgatgcctatcggtggaggaatcatacagtgggcaatagaaccgtggtcgaggagggatattactacctcaacaatttcgacaatatcctgaacagtttcgtcacactctttgagctgaccgtagtaaacaactggtatattatcatggagggtgtgacgtcccagacttctcactggtcccgtttatattttatgactttttatatcgtgacaatggtcgtgatgacaatcatcgtagcattcattctcgaggcctttgtgtttaggatgaactacagtcgcaagaaccaggactcagaggttgacggcggaatcacacttgagaaagagatctctaaagaagagctggtagctgtcctcgagctctatcgggaggcccggggggcctcctccgatgtgacacgactattggaaacactttcccagatggagagatatcagcagcatagcatggtgtttctggggcggagatccagaacgaaatccgacctgtccctaaaaatgtaccaagaggagatacaggagtggtacgaagagcacgccagggagcaggaacaacaaaggcagctgagcagttctgctgctccagcggctcaacagccccctgggagccggcagagatcgcagactgttacatag

SEQ ID NO: 210350 - DNA, 2667 bp, Artificial Sequence
  Description of Artificial Sequence: Synthetic coding sequence
atggagagctgctacatcgcccaggccggcctggagctgctgggctctagtagtagcccaactctgactagccagtcagccgaaattacagaggacgcttcaaatggcggggtaagtgaacagcacccttggcccagcggcttcgaacgagagctgaaaccagaaaccatctcatcacccgggtatcacatattgagggcaaccggggaggaaaatatggctgtcagtctggacgatgacgtccctttgatccttaccctggatgagggcgggagcgcgccattagctccgagcaacggtctagggcaggaggagttgccgtcaaagaatgggggatcctacgctattcacgacagccaagcgccctcgttgtcctctggtggcgaatcctccccatcaagccccgcccacaattgggagatgaactaccaggaagcagcgatctacctgcaggaaggcgaaaacaacgacaaattctttacccaccccaaagacgcaaaggccctcgcagcctacctgtttgcccataatcacttgttttacctcatggagctcgctacggccctgctgctccttctactatctttatgtgaagcccccgccgtgcctgcattgagactaggaatctatgtacatgcaacactggaattattcgctctgatggtcgtggttttcgagctttgcatgaaactccggtggctgggacttcacacatttattaggcacaagaggaccatggttaagacgtcagttttagtagtacagttcgtggaggcgatcgttgtcctcgtcaggcagatgtcacacgtaagggttacaagagcccttcggtgtatcttcttggtcgattgtaggtactgcggaggcgtgaggaggaacctgagacagatcttccagtctcttccccctttcatggacatcctgcttttgctactcttttttatgattattttcgcgatcctcggattctaccttttttcccccaatccaagtgatccttattttagcacactggagaatagcatcgtctctctctttgtgctcctgaccaccgcaaattttccagatgttatgatgccctcctatagcagaaatccatggtcctgtgtgttctttatagtgtacctatctatagagctgtactttatcatgaacctactcctcgcagttgttttcgatacgtttaatgatatcgaaaagagaaagttcaaatcactccttctccacaaaagaactgctatccagcacgcatatcgactcctgatttctcagcgtcggcccgctgggatctcatatcgacagttcgaaggtctgatgcgcttttataaaccgcggatgagcgcccgcgagcgatatctgacatttaaggctctcaaccagaataatacccccctcctgtccctgaaagacttctacgatatatacgaggtggccgccctcaagtggaaagcgaagaaaaaccgggaacactggtttgatgaacttccccggacggccctcctgatttttaaaggcattaacatacttgtaaaatctaaggccttccaatacttcatgtatttagtagtggccgtgaatggcgtctggattctagttgaaactttcatgctgaagggcggcaatttcttcagcaagcacgtgccatggtcataccttgtgtttttgacaatttatggtgtggagctctttcttaaggtggccggtctcggtcctgtagagtatttgagttctggctggaacctttttgacttttcagtcacagtgttcgccttcctgggcttgttagccctggcactgaacatggagcccttctacttcatcgtggtcctgcgccccctgcagctgctgcggctcttcaaacttaaggagaggtatcgcaatgtgttggacactatgttcgagcttctacctaggatggcctctctggggctgaccctgctgattttttactattcgttcgccatagttggtatggaatttttctgcggcatagtttttcctaattgctgtaatactagtacggtggcggatgcatatagatggaggaaccatacagtaggcaatagaaccgtggtggaagagggctattactatctgaataactttgataatattctgaacagcttcgtcacgctcttcgagttgactgtggtgaataattggtacatcatcatggaaggagtgacatctcagacatctcattggtctcgactgtacttcatgaccttctatattgtgacgatggtggtgatgacaatcattgttgccttcatcctggaggccttcgtgtttaggatgaactatagccgaaaaaatcaggattcagaggtggacggaggtatcactcttgagaaggaaatctcaaaggaagagctggtcgccgtgctggaactgtaccgcgaagcccgaggcgcgtctagcgatgtaacaagactccttgagacactctctcaaatggaacgctaccaacagcacagtatggtgtttttagggcgccgctcaagaacaaagtctgatctgtccttgaagatgtaccaggaagaaatacaagagtggtacgaggagcatgcaagagaacaggagcagcagagacagctgtccagtagtgccgcacctgctgctcagcaacctcctgggagtaggcagcggagtcaaacagtgacctag

SEQ ID NO: 210351 - DNA, 2667 bp, Artificial Sequence
  Description of Artificial Sequence: Synthetic coding sequence
atggagagctgctacatcgcccaggccggcctggagctgctgggcagtagctcatcacctacgcttaccagccagtccgccgaaattacggaggacgcatctaatggaggtgtgagcgagcagcacccatggccgtcgggcttcgagagggagctgaagcccgaaactatctcctctccgggttatcatatcctgcgtgctactggcgaggagaacatggccgtgtccttggacgacgacgttcctcttatactcacactcgatgaaggcggatccgccccacttgctccaagcaacggcttggggcaggaggagctgccatctaaaaacggaggatcgtatgccatacatgatagccaggcaccaagcctgagttccggcggcgagtcgagcccttcaagcccagcacacaactgggagatgaactaccaggaggccgcaatctatttacaggagggagagaacaacgataagttctttactcacccgaaagacgccaaggccttagccgcctatctctttgcacacaaccacctgttttatctgatggagctcgcgaccgcactgctgcttctgctcctcagtctgtgcgaagcacctgcagtgcctgctctgcggctagggatatacgtgcatgccacactggagctgtttgcgcttatggttgtcgtttttgagctgtgtatgaagttgcgctggctggggcttcacacctttattaggcataagcggacaatggtgaaaacctccgtattggttgtgcagttcgtagaagccattgtagtcctcgtgagacaaatgtcccatgtgcgcgttacgcgcgcattgagatgtatcttcttggtggactgtcgctattgcggaggagtccggcggaacctgcggcagatctttcagagcctgccgccattcatggacatcttactgctgctcctatttttcatgataatatttgcaatactgggcttctatctcttcagccctaaccccagcgacccatacttttccaccctggaaaattccattgtgtcactattcgttctgttgactacggcaaatttccccgacgtgatgatgccatcatatagcagaaatccctggtcttgcgtcttctttattgtgtaccttagtatcgaattatattttattatgaaccttcttctggccgtcgtattcgacacttttaatgatatcgagaaaagaaagtttaagtcactgctgcttcacaagaggacggcgatacagcacgcataccgattattgatcagccaacgtcggccggccgggataagctacagacagttcgaggggctgatgagattctacaaacctaggatgtcagccagggagcggtacctcacctttaaggcactgaatcaaaataacacccctctattgtcccttaaagacttctacgatatctatgaggttgccgcactgaagtggaaggcaaagaagaatcgggagcactggttcgatgagcttcctcgtactgccttattgatcttcaaaggaattaatattctcgtcaaaagcaaagcgttccagtactttatgtacctcgtcgtggcagtgaacggagtctggattctggtcgagacattcatgctcaagggcggcaacttcttctccaagcatgtgccctggtcctatctggtctttctgacaatctatggtgtagaactatttctgaaagtggccggcctcggcccagtggagtatctgagtagcgggtggaatcttttcgatttctcggtcaccgtgtttgcctttctaggcctgcttgcactcgccctcaatatggagccgttttactttatcgtcgtgctacggcctcttcagttgcttcgtctatttaaactgaaggagaggtataggaatgtccttgacacaatgtttgaactccttccacggatggccagcttaggtcttaccctcctgattttctactattccttcgcgatagtaggaatggagtttttctgtgggatagtatttcctaactgctgcaacacttctaccgtcgccgatgcctaccggtggaggaaccacaccgtgggcaaccggacagttgttgaagagggctattattacctaaataattttgacaacatcctgaattcgtttgtgactcttttcgagctcacagtggtcaacaactggtatattatcatggagggggttaccagtcagacgtcgcactggagtcgtctgtattttatgacgttctacatcgtgactatggtagtgatgactataattgtggcattcatcctggaggctttcgtttttcggatgaactacagtcggaagaaccaggattccgaggtcgatggcggaattaccctggagaaggaaattagcaaagaggagctggtggctgtgctggagctgtacagggaagcaaggggtgcatcatctgacgtcacaaggttgctggagacactgtcccagatggagcgatatcaacagcattccatggtgtttctgggacgtaggagtagaaccaagtcagatctgtcccttaaaatgtatcaggaggaaattcaggagtggtacgaggagcacgcaagagaacaggagcaacagcgccagttgagtagtagcgctgctcccgccgcacagcaaccaccaggtagtaggcagcggtcacagacagtgacgtag

SEQ ID NO: 210352 - DNA, 258 bp, Artificial Sequence
  Description of Artificial Sequence: Synthetic coding sequence
atggccgtgagcctggacgacgacgtgcccctgatcctgaccctggacgaaggggggagtgccccattggcgccctccaacggtctgggacaggaggagttgccctctaagaatgggggctcttacgcaattcatgattcccaggccccctccctttcttcgggcggcgaaagttcacctagtagcccagcccataactgggagatgaactaccaggaagccgctatctatctgcaggaaggggagaacaacgattag

SEQ ID NO: 210353 - DNA, 303 bp, Artificial Sequence
  Description of Artificial Sequence: Synthetic coding sequence
atggccgtgagcctggacgacgacgtgcccctgatcctgaccctggatgaaggcggctctgctccactcgcaccgtctaatggactgggccaggaggagttgccatcaaagcggcgctgctgcatgctctgttcctctaaacagaagccatggatcccgtgcagggttattagcgatgttgcatgtaaagcagcctcttgctttgagggagcttctggtccttgtgacatctcgatgtgggagtgttacagggtgtgcaagcagatggctgcggccatgccatccacaactcctcgtccatag

SEQ ID NO: 210354 - DNA, 2259 bp, Artificial Sequence
  Description of Artificial Sequence: Synthetic coding sequence
atggccgagccccaggccgagagcgagcccctgctgggcggcgcccggggcggcggcggcgattggcccgccggcctgacgacttaccggagcatacaggtcggccctggggctgcggcacgatgggacctgtgcatcgatcaagccgtggtctttatcgaggacgcaattcagtatcgctccatcaaccacagagtggacgcctcatccatgtggctgtaccggagatactacagcaatgtgtgtcagcgaacactgtctttcacaattttcttaatcctgttcctcgcattcatagagactcccagctcactcacgtccacggcagatgtgcgataccgcgctgccccttgggagccaccgtgtggcctgacggaaagtgtggaggtcttgtgtctgctcgtgttcgccgccgacctttcagtgaagggatatctcttcggatgggctcatttccaaaagaacttatggctactggggtacctggtggtgctcgttgttagtctcgtcgattggacagtctctctgagtctggtttgtcatgaacctttgaggataaggcgtctccttaggcccttcttcctcctccaaaatagttcaatgatgaagaaaacgctcaagtgcatcagatggtcactgccagaaatggcgtcagtgggcctgctgctggccatacacctgtgtttatttactatgtttggtatgcttttgttcgctggtggaaaacaggatgatggccaggaccgtgaaaggttaacttatttccagaatctgcccgagtccctgacaagtctgctggtcctgctgacgacagctaacaatccagacgtcatgattcctgcctactccaagaacagagcttacgcgatcttttttattgtgtttactgtgatagggagccttttcctgatgaatcttctaacagctattatttactcacagttccggggctacctgatgaaaagtttgcaaacgagcctttttagaagacgactgggcacccgcgccgccttcgaagtcctaagctctatggtcggcgaaggcggtgcatttccacaggcggttggcgtaaagcctcagaacctccttcaagtgctgcagaaagtccagctcgacagctcccataagcaggcaatgatggagaaagttcgctcgtatgggagcgtcctgttgtcagccgaggagtttcagaagctcttcaatgagctggatcgctccgttgtaaaagagcatccccccaggccagagtatcagtcacccttcctgcagtccgctcagttcctattcgggcactattactttgactaccttggaaacctgattgcacttgctaacttagtgtccatttgtgtttttcttgttcttgacgctgacgtcttacccgctgagcgcgacgatttcatcctgggaatcctaaactgcgttttcattgtgtactatttgctggagatgctgctgaaggtttttgccctagggctcaggggatatctctcctaccctagcaacgtgtttgatggattgctgaccgtggtgctgttggtgttggagatctcaactctggcagtgtacagactgccccacccagggtggaggcctgaaatggtcgggcttctctcattatgggacatgacaagaatgctgaacatgctgatcgtcttcagattcctgcgcatcataccgtctatgaagttgatggcagtcgtggcctctactgtcctaggactggtgcaaaacatgcgcgcatttggtggcatcttagtcgtggtttattatgtgttcgccataatagggataaatctgtttcgaggggttatcgtcgctctgcctggtaattcttcgctcgctcccgccaacggttccgcgccttgtggttccttcgagcagctggagtactgggccaacaattttgacgattttgctgccgctctggtgactttgtggaatctgatggtggtgaataattggcaagtctttctggatgcatatagaaggtactcaggtccatggtcaaagatctatttcgtgctctggtggttggtctcgtccgtcatatgggtcaacctgttcttggccctgatcctggaaaacttcctgcacaagtgggaccctagaagccaccttcaaccactggctggcactccagaagccacctatcagatgaccgtggaattactcttcagggacatattggaagagccaggggaagacgagctgactgagcggctctcccaacatccacatctgtggctatgccgatag

SEQ ID NO: 210355 - DNA, 1407 bp, Artificial Sequence
  Description of Artificial Sequence: Synthetic coding sequence
atgtggctgtaccggcggtactacagcaacgtgtgccagcggaccctaagctttacaattttcctgatcctcttcttagcttttatcgaaactccgagctctcttacctctacggctgacgtgagatacagagcagctccctgggaacctccttgtgggctgactgagagcgtggaggtcttatgcttgctcgtgtttgcagctgatttgagcgtcaaaggctacttgtttggatgggcacacttccagaaaaatctttggctgctgggctacttagttgtgctggtggtaagcctggtggactggacagtctcactgtcactggtgtgccatgaaccccttcggatccgccgtctgctaaggcccttcttccttctgcagaattccagcatgatgaagaagaccctgaaatgcattaggtggagcctccccgaaatggccagcgtgggcctgctgctcgccatacatttgtgcttgtttacaatgttcgggatgctacttttcgccggggggaaacaagacgacggacaagaccgagaacggctcacctacttccagaatctgcccgagagtttaacctcattgctcgtactcctgacaactgctaataaccctgacgtcatgattccagcctacagcaagaatcgcgcttacgccatttttttcatcgtgtttacagtgatcggtagcctgttccttatgaatctgctgaccgctataatctactcccaattcagagggtacctgatgaagtctctacagacgagtctgtttcgacggcgattagggaccagagcagcgttcgaggtcctgtccagcatggttggggaaggaggtgcattccctcaggccacacggcgaggtccttcaaccagcttgagattctgccgggcccccagttcttcctctgctaccaccacactgaccacgtggggaactagcagcccctggcagacatggtgtccattcgcctgtagctggtgctggatgcaaatgtgttgtctcctaagtgtgatgacgtcaagctgggggttttcaaccgcctctagcctgtgtaccacatgctggcggtgctgcagccgtagcctcccctgggcttgcgaaggcacttgtcctaccccggctacttgtttaactgggtcatcaccactttcttgctggcggcccgagatggtgggcctgctttcactctgggatatgacccggatgttaaacatgctgatcgttttccggttcctccggattattccatcaatgaaattgatggcggtggtggctagtacggtactgggcctagtgcaaaacatgagggccttcggggggatcctggtcccggggccctgccaatggctcggcgcattgtgggagctgcgggccgccggagtgttgggacagcagttacgttag

SEQ ID NO: 210356 - DNA, 1584 bp, Artificial Sequence
  Description of Artificial Sequence: Synthetic coding sequence
atgatcctgagcagctacaacaccatccagagcgtgttctgctgctgttgctgctgttccgtgcaaaagcggcaaatgcgcacacagatttccctgtctaccgatgaggagcttcccgagaagtatacccagcgaagacggccctggttgtcccaattgagcaataaaaaacagagcaacactggcagagttcagccttctaagcggaaacctctgccgccgctgccaccgagcgaagttgcggaggagaagatccaggtgaaagccctttatgactttctgccgcgagagccatgcaacctagcgctgagaagagctgaggagtacttaatcctcgagaaatataaccctcactggtggaaggctcgtgacagactgggcaacgaagggctgattcctagcaactatgtgacagaaaataaaatcacgaatttggaaatctacgaatggtaccacagaaacataacgagaaatcaggctgagcatctgcttcggcaggagtcaaaggaaggtgccttcatcgtacgagacagtcggcacttagggagctatacaatatcagtcttcatgggagcccgccgcagcacagaagctgcaattaaacactaccagatcaagaagaatgactcgggacagtggtacgtcgcggagcgccacgccttccagtctattccagaattgatctggtatcaccagcacaacgcagcagggttgatgacacgcctccgctatcccgtcggcctgatgggctcctgtctccctgctactgccggcttttcttatgaaaagtgggagatcgaccccagcgagctggcgtttatcaaagagatcgggtctggccaatttggcgttgtgcacctcggggaatggcggagccatattcaggttgccatcaaggccattaacgaagggagtatgtctgaggaagactttattgaggaagccaaagtcatgatgaagttaagccattccaagctggtgcaactatatggggtctgcatccagcgtaaaccactgtacattgttaccgagttcatggaaaacggctgtctgctgaattatctgagggagaacaagggcaagttgcgcaaggagatgctcctttccgtgtgtcaggacatctgcgaaggtatggaatatctggaaaggaatggctatatccatcgcgacctggccgcccgtaattgtctggttagctcgacatgtatcgtaaagatctcagatttcggcatgactcgatatgtgctggacgatgaatatgtgtcgtcgttcggagcgaagttccccattaaatggagtcctcccgaagtcttcttgttcaacaagtactcatctaaatcagatgtgtggagtttcggagtgttgatgtgggaggtgtttactgaaggtaaaatgccgtttgaaaataagagcaacctgcaggtggtggaggccatcagcgaggggtttcggctctacagaccgcacctggcccctatgtccatctacgaagtgatgtactcttgctggcacgagaaaccagaggggagaccaacatttgccgagctgctaagggctgtgaccgagatcgcagagacatggtag

SEQ ID NO: 210357 - DNA, 342 bp, Artificial Sequence
  Description of Artificial Sequence: Synthetic coding sequence
atgggcggcctggagccctgcagccggctgctgctgctgcccctgctgctagctgtgtcaggactgaggccagtgcaggcacaagcccaatcggactgttcctgcagcaccgtgtcaccaggcgtactagcggggatcgtcatgggggatctcgtcctgacagttctcatcgctctggcagtatattttctgggaagactggtaccacggggacgaggagcggccgaggcggccactagaaagcagcgcatcactgagaccgagagcccctatcaggaactgcagggccagcgctccgatgtgtattctgatttgaacactcaacggccttattataagtag

SEQ ID NO: 210358 - DNA, 339 bp, Artificial Sequence
  Description of Artificial Sequence: Synthetic coding sequence
atgggcggcctggagccctgcagccggctgctgctgctgcccctgctcctggccgtgagcggactgcgacccgtgcaggcgcaggcacagagcgactgttcctgctctactgtgagtcctggtgtcttggccggaatcgtgatgggcgatctcgtcttgaccgttctgattgctctggctgtgtatttcctcgggagacttgttccccgagggaggggggcagcagaggccactcggaaacagcgtataaccgagactgaatctccttaccaagagttacagggccaacgcagtgacgtgtactccgacttgaacacccagcggccgtactacaagtag

SEQ ID NO: 210359 - DNA, 309 bp, Artificial Sequence
  Description of Artificial Sequence: Synthetic coding sequence
atgggcggcctggagccctgcagccggctgctgctgctgcccctgctcctcgcggtttcagactgcagttgctcgaccgtgagcccgggcgtgcttgccggcatcgtgatgggggacttagttttgactgtgctcatagctctggccgtttattttttggggcgcctggtgcctcggggccgcggtgcagccgaggcagctacaaggaaacaaaggataactgagactgagagcccataccaagagctgcagggccagcggagtgacgtttactccgacctaaatacccagagaccttactataaatag

SEQ ID NO: 210360 - DNA, 339 bp, Artificial Sequence
  Description of Artificial Sequence: Synthetic coding sequence
atgggcggcctggagccctgcagccggctgctgctgctgcccctgttgctggcagtcagcggattgagaccggtccaggcccaggctcaatccgattgttcctgcagtacggtgtcgcccggggtgctggcagggattgtgatgggtgaccttgtgttaacagtactgatcgccctggctgtgtactttctgggcaggttggtgccgcgcggtaggggcgcagctgaagctacccggaaacagaggattacggaaacagaatcaccttaccaagagttgcagggacaaaggtccgatgtgtattccgatttgaacacccagaggccctactataagtag

SEQ ID NO: 210361 - DNA, 2673 bp, Artificial Sequence
  Description of Artificial Sequence: Synthetic coding sequence
atggccctgcggcggagcatgggccggcccggcctgccccccctgcccttgccaccacctccgagactgggcttactgctcgcagctctggcgagccttctgctgcccgaatcagcagcagccggcttaaagctaatgggggccccagtgaagctgacggttagtcagggccagccagtgaagctcaattgcagtgttgaaggcatggaagagccagatattcaatgggtgaaggacggcgctgtggtacaaaacctggaccagctctacatccctgtcagcgaacagcactggattggattcctcagtctgaaatccgtggaacgtagcgatgctggcaggtactggtgtcaagtggaggatggaggcgagacagagatctctcagccggtatggcttaccgtggagggcgtccccttttttaccgtggagcctaaagacttggctgtcccccctaatgcaccttttcagctgtcatgtgaggccgtcggcccacctgagccagtcactattgtctggtggcgaggaaccactaagattggcggtccagcccctagtccctccgtgctgaacgtaacaggtgtaacacaatccacaatgttttcttgcgaggcccataacctgaagggcctggcctcttccagaaccgcaaccgtccatctgcaggccctgcctgcagcacctttcaatattacagtaactaagctgtctagcagtaacgcttccgtggcttggatgcctggagccgatggccgagctctgctgcaaagctgcactgtccaggtgactcaggccccgggaggctgggaggtgctggctgtggtggttccggtgccgccattcacatgtcttctgagggacctggtgcccgcgacaaattattccctaagggtcaggtgtgctaacgcgctggggccttctccttacgccgactgggtgcccttccaaactaagggcttggctccggctagcgccccccagaatctgcacgctattagaaccgactccggcttaattctggagtgggaggaagtgataccagaggcgcctcttgaagggcccctcggcccctataaactgtcctgggttcaagataatggcacccaggacgaacttaccgtggaaggcacgagagctaacctgacaggctgggatcctcagaaggaccttatcgttagggtatgcgtttctaacgccgtgggatgcggcccctggtcccaaccgcttgtggtgtcctctcacgatcgtgcagggcagcaaggaccaccccattctaggactagctgggttcctgtggtcctaggtgtccttacagccctagtcacagccgccgcactcgccctcatactgctcaggaaacggaggaaggaaacaagatttggccaggcgttcgactccgtgatggcaagaggcgagccagccgtccatttcagggctgcacgttccttcaaccgggagcgaccagagcgaatcgaagcgaccctggattctctcggaatttcggacgaactgaaagaaaaattagaagatgtactcattcctgagcaacaatttaccctcggaaggatgctgggcaaaggcgaattcgggtctgtcagagaggcgcagttgaagcaggaggacggttccttcgtgaaggttgccgtgaaaatgttgaaggccgatatcattgcctccagcgatattgaggagttcctgagagaggctgcctgtatgaaggaattcgatcacccacacgttgcgaagcttgtgggagtttccctcaggagtcgggctaaaggacgccttcctatcccaatggtcatcctgcctttcatgaaacacggggatcttcatgcttttttgctggcaagcaggatcggagaaaacccctttaacctccctctccaaaccctcatcaggttcatggtggacatcgcttgcggcatggagtatctctcttcccggaattttattcacagggacctcgccgcccggaactgtatgctggccgaagacatgacagtctgtgtggcagacttcggcctgtcgcggaagatctactccggggattactatcgccagggctgcgcaagcaagctgcctgtcaagtggctagcactggagtctctggctgataacctgtacactgttcaatctgatgtttgggcattcggcgtaacaatgtgggagattatgacgcgtggccaaaccccctacgccggcatcgaaaacgcagagatctacaactacttaataggcggaaaccgtttgaagcagccgcccgagtgtatggaggatgtctacgacctgatgtaccagtgttggagcgctgatccaaagcagcgaccatcgttcacgtgtttacgcatggagctggagaacatactggggcagctctcagtgctgagtgcctcccaggaccctctgtacattaacattgagcgggcagaagaaccgaccgctggaggctcattagaattacctggacgagatcagccttattccggtgctggcgatggctctggaatgggagcagtgggtgggactccctccgactgtcgctatatcctgaccccaggggggttagccgaacagccgggtcaggccgaacaccagccagaatcaccactcaatgaaacacaacgtctgctgctactccagcagggcttgctcccacactcaagctgttag

SEQ ID NO: 210362 - DNA, 2529 bp, Artificial Sequence
  Description of Artificial Sequence: Synthetic coding sequence
atggaggagcccgacatccagtgggtgaaggacggcgccgtggtgcaaaacttggatcagctttacattccagtcagcgagcagcattggatcggctttctgagcctgaaatcagtggagcggtccgacgcaggcagatactggtgtcaggtggaggacggcggggaaacagaaatcagccagcctgtctggctgacggtggagggcgtgcccttctttactgtggagcctaaagaccttgccgtgcctcccaacgcccccttccagctgagctgcgaggccgtggggccccctgaaccagttaccatcgtgtggtggcgaggtacaacgaagattggcggaccggccccgagtccatcagttctgaatgtcacgggagtaacccagagcaccatgttctcatgcgaggcccacaacttgaaaggcctcgcatcatctagaacagccaccgtgcatttgcaggctcttccggccgccccttttaacattactgtgaccaagctcagtagctccaacgccagtgtcgcctggatgcccggtgctgatggacgtgcccttctccagagttgcacagtgcaagtaacacaggcacccggcggctgggaagtactggccgttgtggtccctgtacccccctttacttgtttgctgcgtgacctggtccccgcaacaaattatagcctgagagtgagatgcgctaacgcactcggtcccagcccttacgcggattgggttcccttccagacaaagggccttgcacctgccagtgctcctcagaatctgcacgctatccggactgatagcggcttgatattggaatgggaagaagttatacccgaggctccactggagggaccacttggcccatacaagttgtcttgggtccaggataacggtactcaggacgagctcaccgtggagggcacccgggcaaacctgacaggatgggacccccagaaggaccttattgttagagtgtgtgtgtctaatgctgttggctgtggcccgtggagccagcctctcgtcgtatcaagccatgaccgggccgggcagcaggggccccctcattcgcgcacctcatgggtgcccgtggtactgggagttctgactgctctggtcaccgcagccgccctggccctgattctgctgaggaagcggcggaaggagaccagattcgggcaagcctttgacagcgtgatggctcgaggagagcccgctgtccactttcgggccgcccgtagctttaaccgagaacgtccggagcgcattgaagctactcttgattctctgggaattagtgatgagctcaaagagaaactggaagacgttctaatcccagagcaacagttcacgctcggacgcatgctgggcaagggagagttcggaagtgtgcgggaagcgcagctcaaacaggaagacggtagcttcgtcaaggtggccgtcaaaatgctcaaagcagacatcatcgcatccagcgatatcgaggaattcttaagggaagctgcttgcatgaaggagtttgatcaccctcacgtagccaagctcgtgggagtgagccttcgtagccgcgcaaaagggcgtctgcctataccgatggtaatcctgccattcatgaaacacggcgacctgcatgcttttttattggcgtcacggatcggcgaaaatccattcaacttaccattacaaaccctcattcggttcatggtagacattgcctgtggcatggagtacttgtcgagtcgcaactttattcacagagacttggcagcccgaaactgtatgctggctgaggacatgaccgtctgcgtggcggattttgggctgagccggaagatttactctggagactactatcggcaggggtgtgctagcaaactccccgtgaaatggctcgctcttgaaagtctcgccgataacctgtataccgttcagtccgacgtctgggcctttggagttacaatgtgggaaatcatgacacgcggtcagacaccctatgccggcattgagaacgctgaaatctacaattatctgattggcggaaacagactcaagcagccccctgagtgcatggaagatgtatatgatctcatgtatcagtgttggtccgcggatcccaagcagaggcccagtttcacgtgtttgcgcatggagctggagaatatcctggggcagctgagtgttctgagcgcttcccaagaccccctgtacattaacattgaacgcgctgaggagccaacagccggaggcagtctggaacttcccggacgggatcagccatattctggggcaggagacggatctggtatgggagccgtcggaggaacaccttccgattgccggtacatcttgactccgggcgggctcgcggagcagcccggccaggccgaacatcaacccgaatctccactgaatgagacccaacggctgcttctgttgcagcagggccttcataccgtggctgtatccccccaggcagaaggcatcggcgccatctggccagctctagttgctaccgagctggctgattag

SEQ ID NO: 210363 - DNA, 741 bp, Artificial Sequence
  Description of Artificial Sequence: Synthetic coding sequence
atgaccatggacaagagcgagctggtgcagaaggccaagctggccgagcaggcagagaggtacgatgacatggccgctgcaatgaaggccgtgaccgaacaggggcatgaactgagcaacgaagagcggaaccttttatctgtggcttataaaaacgtcgtgggcgctcggcgatctagttggcgggtgatttctagcatcgagcaaaagaccgagcgaaacgaaaagaaacaacagatgggcaaggaatatagagaaaagatagaagcagaactgcaggatatctgtaatgacgtgctggagcttctggacaaatacctcatccccaatgccactcagcccgagagcaaggtgttttatctgaagatgaaaggtgattacttcagatatctgtccgaagtggcatccggagacaacaagcagacaactgtgtccaatagccagcaagcgtaccaggaggcatttgaaatttccaagaaggaaatgcaacccacccatcctattcggttaggcctcgccttgaatttttccgtattctactacgagatcctgaattctcccgagaaagcatgtagcctggcaaaaaccgcttttgatgaggccattgctgaattggatacccttaatgaggaatcatataaggactccaccctgatcatgcagttgctgcgggacaacctgaccttgtggacttccgagaaccagggggatgaaggcgacgccggcgagggcgagaattag

SEQ ID NO: 210364 - DNA, 741 bp, Artificial Sequence
  Description of Artificial Sequence: Synthetic coding sequence
atgaccatggacaagagcgagctggtgcagaaggccaagctggccgagcaggcagagagatatgacgacatggcagctgccatgaaggctgtgactgaacaggggcacgaactgtcaaatgaggaacggaatttactgtcagttgcatataaaaacgttgtcggggcaagacgtagcagctggcgtgttatctcctctattgaacagaaaaccgaaagaaacgaaaaaaagcagcaaatgggaaaagaatatcgcgaaaagatcgaagcggaactgcaggacatctgcaacgacgttttggagctgctggacaagtatctgattcccaatgcaactcaaccggaaagcaaggttttttacctgaaaatgaaaggcgattacttccggtacctaagtgaggtggcgagcggggataataaacagacgaccgtgagtaacagccaacaggcgtaccaggaagccttcgagatcagcaagaaggaaatgcagcccactcatccaatacggctgggactcgccctaaatttcagcgtcttctactacgaaatccttaacagccctgagaaggcttgttccctggctaaaaccgctttcgacgaagccattgcagaactggacactctcaatgaggaaagctacaaggactcaaccttgattatgcagcttttgcgcgataacctaaccctgtggacatctgagaatcagggggatgaaggagatgcaggggaaggcgaaaactag

SEQ ID NO: 210365 - DNA, 303 bp, Artificial Sequence
  Description of Artificial Sequence: Synthetic coding sequence
atgaccatggacaagagcgagctggtgcagaaggccaagctggccgagcaagctgaacgctacgacgacatggccgcggccatgaaggctgtaaccgaacaaggccacgaactgtctaacgaggaacgcaatctactgtctgtggcgtataaaaatgttgtgggagcaaggaggtcatcatggcgggttatatcctcgatcgagcagaagactgaaaggaacgaaaaaaaacagcagatgggaaaagagtatcgggagaagatcgaggctgagctccaggacatctgtaacgatgtgctgtag

SEQ ID NO: 210366 - DNA, 225 bp, Artificial Sequence
  Description of Artificial Sequence: Synthetic coding sequence
atgaccatggacaagagcgagctggtgcagaaggccaagctggccgaacaggctgagcgctacgatgatatggctgcggccatgaaagctgtcaccgagcagggccatgaactgagtaacgaggagagaaacttgctaagcgtggcctacaagaatgttgtgggggctagacggtcaagttggcgcgtaattagctctatagagcagaaaacggagcggaactag

SEQ ID NO: 210367 - DNA, 768 bp, Artificial Sequence
  Description of Artificial Sequence: Synthetic coding sequence
atggacgaccgggaggacctggtgtaccaggccaagctggccgagcaagcggagaggtacgatgaaatggtcgagtctatgaaaaaggtagctggaatggacgttgagctgactgtcgaggaaagaaatctgctttcagtcgcatataaaaatgttattggtgcccggagggcgtcctggcggataatcagttccatcgagcaaaaagaggaaaataagggaggagaggacaaactcaaaatgatcagagaataccgccagatggtggaaacagaactgaaactgatctgttgcgacatcctggacgtgctagataaacatctgatacctgccgcgaacaccggcgagagcaaggtattctactataagatgaaaggcgattatcaccgatatctcgccgagttcgccaccggcaacgacagaaaagaggcagcagaaaattcgttagtcgcctataaggcagcatccgatatagcgatgactgaactgccgcccacccaccctataagactcggcctcgctctcaacttttcagtattctactacgaaatacttaactcacccgacagagcttgtcgactcgccaaggccgccttcgacgacgccatcgctgagctcgatacgttgtccgaagagtcatataaggatagtactttgatcatgcaacttctgagagacaatctgactctgtggacttctgacatgcagggagacggggaagagcagaataaggaagcattgcaagatgtggaggacgagaaccagtag

SEQ ID NO: 210368 - DNA, 702 bp, Artificial Sequence
  Description of Artificial Sequence: Synthetic coding sequence
atggtggagagcatgaagaaggtggccggcatggacgtggagctgactgtggaggagcgtaacctgctcagcgtcgcctataagaatgtgattggggcacggcgagcatcttggagaatcattagtagcatcgagcaaaaagaagagaacaaaggaggggaggacaagttgaagatgatccgcgagtacaggcaaatggtcgagactgaactgaagcttatctgctgcgacattctcgacgtcctggataagcatctgattccagccgctaacaccggtgagtctaaagttttctattacaagatgaagggtgattaccatcggtacctggcagagtttgctactgggaacgacagaaaggaagccgccgaaaattctctagtggcttacaaagctgcatcggatatagctatgaccgagcttccaccaacccatcccatcagactgggactggccctcaatttcagcgtgttttattacgagatcctgaacagcccagatcgggcttgtaggttagctaaggcagccttcgatgatgctatcgctgagttggatacccttagtgaggaaagctacaaagactccacccttatcatgcagctgctgcgagacaatctgacactgtggacatccgacatgcaaggtgacggggaggaacaaaataaagaagcactccaggatgttgaagatgagaatcagtag

SEQ ID NO: 210369 - DNA, 744 bp, Artificial Sequence
  Description of Artificial Sequence: Synthetic coding sequence
atggtggaccgggagcagctggtgcagaaggcccggctggccgagcaggctgaacggtacgacgatatggcagcagccatgaaaaacgtaactgaactgaatgaacccctgtccaatgaagagaggaacctgctgtctgtcgcctacaaaaacgtcgtcggtgcgcgaagatcaagttggagggtcatttcctccatcgaacaaaaaacaagcgctgacgggaatgaaaagaagatcgaaatggttagagcctacagagagaaaatagagaaagaactggaggccgtatgccaggatgtgctctccctactcgacaattacttaatcaagaattgttccgaaacgcagtatgaatctaaagtcttctatctcaaaatgaagggcgactactacaggtatctggcagaggtggccaccggggagaagagggccacagtggttgagtcatctgagaaagcatactctgaagctcatgaaatcagtaaggaacacatgcagcctacacatcccatccgacttggcctagccctgaattactctgtcttttactatgagattcagaatgctccagagcaggcctgtcatttagctaaaacagccttcgatgacgctatcgccgagctggacacgctgaacgaagattcttataaggattccacactgataatgcagctacttcgggataacctgacactctggacatctgatcagcaagatgacgatggcggtgagggtaacaattag

SEQ ID NO: 210370 - DNA, 624 bp, Artificial Sequence
  Description of Artificial Sequence: Synthetic coding sequence
atggtggaccgggagcagctggtgcagaaggcccggctggccgagcaagctgagaggtatgatgatatggcagcagccatgaagaatgttacagaactgaacgaacccctgagtaacgaggaaaggaaccttctctctgtcgcctataagaatgtggtgggagccaggaggagctcctggcgagttatatcgagtattgaacaaaaaacatccgccgacggcaacgaaaaaaaaatcgagatggtcagggcgtatcgcgaaaagatcgagaaggagctcgaggccgaggtggctaccggcgaaaaaagggccacagtggttgagagctcagagaaggcttacagcgaggcacatgaaattagcaaagagcacatgcagcccacacatcctatacgcctgggcttggcactgaattatagcgtgttttactatgagatccagaacgccccagaacaggcctgccacttggccaagaccgccttcgacgacgcgatcgcagagcttgatacgttgaatgaggacagctacaaggattccaccctgattatgcagctgctcagagacaaccttaccctctggacttctgatcagcaagacgacgacggcggggagggcaataattag

SEQ ID NO: 210371 - DNA, 678 bp, Artificial Sequence
  Description of Artificial Sequence: Synthetic coding sequence
atggccgccgccatgaagaacgtgaccgagctgaacgagcccctgagtaacgaggagcggaatcttctgtctgttgcctacaaaaacgtggtcggcgcacgccggtcaagctggcgtgtcataagttccattgagcagaagacttccgctgacggcaatgagaaaaagatagagatggtgagagcctatcgggaaaagatagagaaggagctcgaggcagtgtgccaggacgtgttgtcgctgcttgataactacttgatcaagaactgttccgagacacagtacgaatcaaaggtgttctacctaaagatgaaaggtgattattaccgctacttagcagaggttgcaaccggggagaagcgggcaactgtagttgaatcctcagagaaagcatactccgaagctcatgagatcagcaaggagcacatgcagccaacacatcctattcggctcgggctggcgctgaactacagtgtgttttactatgaaatccagaacgcccctgagcaggcttgtcacttggctaagactgcgttcgatgacgcgatcgcagaactagacaccctgaacgaggactcttacaaagatagtacgctgataatgcagctcctgcgggacaacctgaccttgtggacctcggaccaacaggacgacgatggcggagaagggaacaactag

SEQ ID NO: 210372 - DNA, 738 bp, Artificial Sequence
  Description of Artificial Sequence: Synthetic coding sequence
atggacaagaacgagctggtgcagaaggccaagctggccgagcaggcggaacgctacgacgacatggcagcctgcatgaaaagcgtgaccgaacagggtgcagaactgtccaatgaggaaagaaaccttctgtctgttgcctacaaaaacgtggtgggggcaagaagatctagttggcgagttgtgtcatcaatcgagcagaaaaccgagggcgctgagaaaaagcagcagatggccagggagtatagagagaagatcgagaccgaactacgggacatatgcaatgatgtgctgtctctgctggagaaattcctgattccgaatgcctctcaagccgaatccaaagtcttctaccttaagatgaagggagattattatcgctaccttgccgaagtggccgccggcgacgacaagaaggggatcgtggatcagagtcagcaagcctaccaggaagccttcgaaatcagtaaaaaggagatgcagccaacacaccctatacggttgggtctagccctgaacttcagtgtgttttactatgagatcctcaactccccggagaaagcttgtagtcttgccaagaccgcgtttgacgaagcgattgcggagctggatactctgtctgaagagagctataaagactccactttaattatgcagctgctccgcgataacctgacgctttggacttcggatacccagggggatgaagctgaggctggagaaggtggcgaaaactag

SEQ ID NO: 210373 - DNA, 507 bp, Artificial Sequence
  Description of Artificial Sequence: Synthetic coding sequence
atggcccgggagtaccgggagaagatcgagaccgagctgcgggacatctgtaacgatgtgttaagtcttctcgagaagttccttattcctaacgcctcacaggcagagagtaaagtcttttatctgaaaatgaaaggcgattattaccggtacttggctgaggtggctgccggcgacgacaaaaagggtattgtggaccagagtcaacaggcttatcaggaagcatttgagatcagcaagaaggaaatgcagcctactcacccgatcaggttaggcttggccctcaacttctcagtcttctactacgaaatcctcaactcccccgaaaaagcatgctcactcgcgaaaaccgctttcgatgaggccattgctgaactggataccttgtcggaggaaagctacaaagattctacactgattatgcaactcctccgcgataacctaaccctttggacctctgatacccagggcgacgaagccgaggccggtgagggaggcgagaattag

SEQ ID NO: 210374 - DNA, 738 bp, Artificial Sequence
  Description of Artificial Sequence: Synthetic coding sequence
atggacaagaacgagctggtgcagaaggccaagctggccgagcaggccgaaagatatgatgacatggctgcctgcatgaaatcagtcactgagcagggagcagagctgagtaacgaggaacgaaacctgctgtccgtggcctacaagaacgtggttggcgctcgtagatcttcctggcgtgtagtgtcatctattgaacagaaaactgagggcgctgagaaaaaacagcagatggctagggagtaccgagagaagatcgagacggaactccgggacatctgtaatgacgtgctcagcttgcttgagaagttcctgatcccgaacgcaagccaggccgaatccaaggtgttttacttaaaaatgaaaggagattattatcggtacctggcagaggtggcagctggagacgacaagaagggaattgtggaccagtctcagcaggcctatcaagaagcctttgagatatcaaagaaggagatgcagccaacccacccaatcaggctcggccttgcactgaatttcagcgtcttctactacgagatcttaaacagtccggaaaaagcctgctctctagcgaagaccgcctttgatgaggcaatcgcggaacttgataccctttctgaggagtcatacaaggacagcactttgataatgcaattactgcgagacaatctcactctgtggacctctgatacacaaggagatgaagccgaagcgggagaaggcggagagaattag

SEQ ID NO: 210375 - DNA, 738 bp, Artificial Sequence
  Description of Artificial Sequence: Synthetic coding sequence
atggacaagaacgagctggtgcagaaggccaagctggccgagcaggccgagcgctatgatgatatggcggcatgtatgaagagtgtgacggagcagggtgcagagttgtccaatgaagaacggaacctactgtcagtggcctataaaaacgtcgtgggcgcacggagatcttcctggcgcgtggtttccagcatcgaacaaaaaactgaaggggccgagaagaagcagcagatggctcgagagtaccgcgagaaaatcgagactgagttgcgggatatatgcaacgatgtattgtctcttcttgagaagtttctcattcccaatgcatcacaagccgaatctaaggtgttctaccttaagatgaagggagactattaccgctaccttgctgaagtcgctgccggagatgacaaaaaagggatcgtggatcagtcccagcaagcatatcaagaggccttcgaaatcagtaagaaagaaatgcagccaactcacccgattcggctaggactcgcgctgaatttctccgtcttctattacgagattttgaactctcccgaaaaggcttgcagcttggcaaagactgcttttgatgaagccatcgcagagctggacacactctctgaagagagctacaaggattctaccctgatcatgcagttgctgagagacaatcttacactgtggacatctgacactcagggcgacgaagcagaggcgggcgagggtggtgaaaattag

SEQ ID NO: 210376 - DNA, 738 bp, Artificial Sequence
  Description of Artificial Sequence: Synthetic coding sequence
atggacaagaacgagctggtgcagaaggccaagctggccgagcaggccgaacgatatgatgacatggcggcctgcatgaagtcagtgaccgaacagggggccgagttgtcgaacgaggaacggaacttgctatcagtggcctacaagaacgtggtcggggcgaggcgatctagctggcgggtggtgtctagcatagaacagaaaacagagggtgccgaaaaaaagcagcagatggcccgcgagtaccgcgagaagatcgagacagagctacgcgacatctgcaacgacgtactttctcttctcgaaaaattcttaatccccaacgcctcacaggcagaatctaaagtcttttatttgaagatgaagggcgactactataggtacctggcggaggtagccgccggtgatgacaaaaaaggcatagtggaccagtctcagcaggcctaccaagaggctttcgagatctctaagaaggagatgcagcctacccacccaattaggctcggtttggccctgaacttctctgtgttctactatgagatcctgaattcacccgaaaaagcttgcagccttgcaaagaccgctttcgacgaggccattgccgaactggatactctgtccgaggagagctataaggactcaacgttgataatgcagttgctgcgggataacttgacactttggacttcggacacccagggggatgaggcagaagcaggcgaaggaggagagaattag

SEQ ID NO: 210377 - DNA, 738 bp, Artificial Sequence
  Description of Artificial Sequence: Synthetic coding sequence
atggacaagaacgagctggtgcagaaggccaagctggccgagcaggccgaaagatacgacgacatggccgcttgcatgaaatctgtgaccgaacaaggagcagagctgagcaatgaagaaagaaacctgctgtccgtcgcatacaagaacgtagtgggggctaggcgatcatcctggcgggtggtttcatcaattgaacagaagaccgagggcgcagagaagaagcagcagatggcccgcgagtatcgagaaaagatagaaactgaactccgggatatctgtaatgatgtgctttctctcctcgagaaatttctcataccgaatgcctcacaggcagaatctaaagtgttttatctcaaaatgaaaggcgattactaccgctaccttgcagaggtagctgctggcgatgacaaaaaaggtatcgtcgaccagagtcaacaagcctaccaagaggcattcgagatttcaaagaaagagatgcaaccgactcacccaatcaggctgggcctggccctgaatttctccgttttttattacgagatcttgaactcccccgaaaaagcatgcagtctagccaagaccgctttcgacgaggctatcgccgaactagacaccttgagcgaggagtcttataaggatagcaccctaatcatgcagctgctgcgggacaatttaactctctggaccagcgatacacaaggggatgaagccgaggcgggagagggcggggaaaactag

SEQ ID NO: 210378 - DNA, 738 bp, Artificial Sequence
  Description of Artificial Sequence: Synthetic coding sequence
atggacaagaacgagctggtgcagaaggccaagctggccgagcaggccgagaggtatgacgacatggccgcctgcatgaagagcgtgacagagcagggggctgagttgtcaaatgaagaacggaatcttctgtccgtagcttataaaaacgtagtgggcgcgcgccgctcaagttggcgagtcgtgagttccatcgagcagaagactgagggtgcagagaaaaagcagcaaatggctcgcgagtatcgtgagaagatcgaaacagaattacgtgatatttgcaacgacgtgttatcactgctggagaagttcctcatccctaacgcaagtcaggctgagagtaaagtgttttatctgaaaatgaagggggactattatcgctaccttgcagaggtggccgcaggcgatgataaaaaagggattgtggaccagtcccagcaagcctaccaggaagccttcgaaatttcgaagaaagagatgcaacctacccaccccatcagactgggcttggctctgaacttttcagtcttttattacgagatcctgaatagccctgaaaaggcctgtagcttagcaaaaaccgcgtttgacgaggcaattgccgagcttgatacactatccgaggaatcttacaaggatagtacgttgatcatgcagctccttagagacaacctcactctctggacatcagacacacagggcgacgaagcggaggccggggaaggcggagagaattag

SEQ ID NO: 210379 - DNA, 297 bp, Artificial Sequence
  Description of Artificial Sequence: Synthetic coding sequence
atggacaagaacgagctggtgcagaaggccaagctggccgagcaggctgaacgatacgacgacatggccgcttgtatgaaatctgtgaccgagcagggcgccgagctgtccaacgaggaaaggaatctacttagcgttgcatacaagaacgtcgtaggcgccagaaggtcttcttggcgagtggtgtctagtattgagcagaagaccgagggggcagaaaagaaacaacagatggccagggaatatagggaaaaaatcgagactgaactgagagatatctgtaatgatgtattgtag

SEQ ID NO: 210380 - DNA, 738 bp, Artificial Sequence
  Description of Artificial Sequence: Synthetic coding sequence
atggacaagaacgagctggtgcagaaggccaagctggccgagcaggctgaaagatacgacgacatggccgcatgcatgaagagtgtgaccgagcagggggccgagttgagtaatgaagaacgcaatcttcttagcgtggcctacaaaaacgttgtgggggccagacgttccagctggcgggtggtgagctcaattgaacagaaaaccgaaggggccgagaaaaagcagcagatggcgagagagtatagagagaaaatcgaaactgaactcagggatatctgtaatgacgtgctttcactcttggagaagtttttaatccctaacgcatcacaagctgagtcaaaagtcttctacctaaagatgaaaggcgactactaccggtacttggccgaggtggccgccggagacgacaagaagggcatcgtcgaccagtctcagcaagcttatcaggaagctttcgagatatccaagaaagaaatgcagcctacacaccctatcaggctggggctcgctctgaactttagtgtattctactatgaaatactaaacagccccgaaaaagcctgcagcctggcaaagacagccttcgacgaggccattgctgaactggatacgttatcagaagaaagttacaaagactccacactcataatgcagctcctgcgcgacaacctgacactgtggacctctgatacccagggagatgaagcggaggccggagaaggaggcgaaaactag

SEQ ID NO: 210381 - DNA, 279 bp, Artificial Sequence
  Description of Artificial Sequence: Synthetic coding sequence
atggacaagaacgagctggtgcagaaggccaagctggccgagcaggctgagaggtacgacgacatggccgcttgcatgaagtctgtcaccgaacaaggtgccgaactctcaaatgaagaacggaaccttttaagcgtggcctacaaaaatgtcgtgggtgcccgccggtcttcctggcgggtagtgtcaagtatagagcagaaaacagaaggcgctgagaagaagcaacaaatggctcgtgaatatcgggagaagattgagactgagcttcgagactag

SEQ ID NO: 210382 - DNA, 738 bp, Artificial Sequence
  Description of Artificial Sequence: Synthetic coding sequence
atggacaagaacgagctggtgcagaaggccaagctggccgagcaggcggagcgctacgatgatatggcagcatgcatgaagagcgtcacggagcagggagccgagctatcaaacgaggagaggaatttactgtcagttgcatacaagaatgtggtaggcgcccgacgttcatcatggagagttgtatcgagcatcgaacagaagaccgaaggcgcagagaaaaaacagcagatggcacgggagtatagggagaagatcgaaaccgagctgagggacatatgcaacgatgtgctgtctctgctggagaaatttcttatcccaaacgccagccaggcagagtcgaaagtcttctacctcaagatgaagggagactactatagatatctcgccgaagtcgccgctggagatgataagaagggcattgtagaccagagccaacaggcctatcaggaggcttttgagatctccaagaaagagatgcaaccaactcaccccataagacttggtcttgccctgaatttcagcgtgttctactacgagatcctgaactcccccgagaaggcctgctcactggccaagacggccttcgacgaggctatcgcagaacttgataccctttctgaggagtcctacaaggactccacactgattatgcaattgctgcgagacaatctcaccctgtggactagtgatactcagggggacgaggcagaggctggggagggaggagaaaactag

SEQ ID NO: 210383 - DNA, 507 bp, Artificial Sequence
  Description of Artificial Sequence: Synthetic coding sequence
atggcccgggagtaccgggagaagatcgagaccgagctgcgggacatttgtaacgacgtgttgtcccttttggaaaaattcctcattccaaatgcctctcaggctgaaagtaaagtgttttaccttaaaatgaagggtgactactatagatacctggcagaggttgccgcgggggatgataagaaagggattgttgatcagtcacagcaagcgtatcaggaggcttttgagatttccaagaaagagatgcaacctacacatcccatccggttgggacttgcgcttaactttagcgtattttactatgagatcctgaattccccggaaaaggcctgttctctcgccaagacagcttttgacgaggctatcgcggagctggataccctgtcagaggaatcctacaaagatagcacgctgataatgcaactcctaagggacaacttgactctgtggacatccgacacacagggggatgaggctgaagctggtgaaggcggcgaaaactag

SEQ ID NO: 210384 - DNA, 378 bp, Artificial Sequence
  Description of Artificial Sequence: Synthetic coding sequence
atgaagggcgactactaccggtacctggccgaggtggccgccggcgacgataaaaagggaattgtcgatcagagtcagcaagcgtaccaggaagcatttgaaatcagtaagaaagagatgcaacctacgcacccaataaggctgggcctggccctgaatttttcagtgttttactacgagatcttgaactcccctgagaaagcttgcagcttagccaaaaccgcctttgacgaagctattgcggagctggatacgttatccgaggaatcctacaaagactccacattaatcatgcagctcttgcgcgacaacttgaccctgtggacaagcgacacacagggggatgaagccgaggcaggcgaagggggggagaattag

SEQ ID NO: 210385 - DNA, 414 bp, Artificial Sequence
  Description of Artificial Sequence: Synthetic coding sequence
atggacaagaacgagctggtgcagaaggccaagctggccgagcaggcggaaagatacgatgatatggcagcttgtatgaagtccgtgaccgagcagggcgctgagctaagcaatgaggaaagaaatctactatcagtagcctacaaaaacgtcgttggcgcccgacgcagttcttggcgcgtggttagcagcatcgaacagaaaacagagggtgctgaaaaaaagcagcagatggccagagagtatagagagaagatcgaaaccgaactaagagatatctgtaatgatgtgttgagtcttctggagaagtttttgattcctaatgccagccaggcagagtcaaaagtattttacctgaagatgaagggtgattattacaggtatcttgccgaggtggccgcaggggatgactag

SEQ ID NO: 210386 - DNA, 741 bp, Artificial Sequence
  Description of Artificial Sequence: Synthetic coding sequence
atggacaagaacgagctggtgcagaaggccaagctggccgagcaggcagagcgctacgacgatatggccgcctgcatgaaatccgtgaccgagcagggcgctgaattaagcaacgaggaacgcaacctactgtccgtggcctacaagaatgtagtgggtgcccgcaggtcctcctggagagtagtgagctcaatcgaacaaaagacagaaggtgccgagaagaaacagcaaatggctcgggagtatagggagaagatcgaaacagagctgagagatatatgtaatgacgtactttcactgctcgagaagttccttattccaaacgcatcgcaagccgagagcaaggtcttttacctgaagatgaaaggtgattattaccgctacctggcagaagtcgccgccggagacgacaaaaaagtaagatttggcgtgtcctatcctggaattgtcgatcaatcacagcaggcttatcaggaggcatttgagatctcaaagaaagagatgcagcctacacaccccattagactgggactggccttaaacttttctgtgttttattacgagatcctgaattcccctgaaaaggcatgcagcctggctaagacagcctttgatgaggctattgccgagctcgatactttgagtgaggagtcctataaggactccactttgatcatgcagctcctgagagacaacctgactctttggacatcagacacccagggtgacgaagcggaatag

SEQ ID NO: 210387 - DNA, 513 bp, Artificial Sequence
  Description of Artificial Sequence: Synthetic coding sequence
atgagccagccctgccggaagctgtggcggcacaactacgagacctcaagctgcattgaattcttaaagagcctgctcgagaaatttctcatccccaatgccagtcaggctgaaagtaaagttttttatcttaagatgaaaggagactactatcgatacctggccgaagtcgccgccggtgacgataaaaaaggaatagtagatcagtcacagcaggcataccaggaggcattcgagatctccaagaaagaaatgcagcctacgcaccctattagactcggactggccttgaattttagtgttttttattacgagatacttaatagtccagaaaaagcatgcagcctggccaagaccgccttcgacgaagccatcgccgaactcgatacccttagtgaggagtcgtacaaggattcaaccctgattatgcagctgctgagagataacctgactctatggacctccgatacgcagggcgacgaagcagaggcgggtgagggaggagaaaactag

SEQ ID NO: 210388 - DNA, 378 bp, Artificial Sequence
  Description of Artificial Sequence: Synthetic coding sequence
atgaagggcgactactaccggtacctggccgaggtggccgccggcgacgacaagaaaggtatcgtcgaccagtcacagcaggcttatcaagaggccttcgagatttccaaaaaagaaatgcaacccactcacccaatcagactggggctggccctgaactttagcgttttctattatgaaatcctgaattcccccgaaaaggcttgctcattagcaaaaaccgctttcgacgaggcgattgctgagctggacactctcagcgaggaatcatataaagattctactttgataatgcagctgctcagggacaatttgactttgtggacttctgatacccagggagatgaagccgaagcgggtgagggaggtgagaactag

SEQ ID NO: 210389 - DNA, 228 bp, Artificial Sequence
  Description of Artificial Sequence: Synthetic coding sequence
atggacaagaacgagctggtgcagaaggccaagctggccgagcaggccgagaggtatgatgacatggccgcgtgtatgaagagcgtaaccgagcagggagcagagctgtccaacgaagaacgcaacctattaagcgtggcctacaaaaacgtggtcggggcaaggcgctccagttggagagtcgtgagttcgattgagcagaaaactgaaggggcagagaagaaatag

SEQ ID NO: 210390 - DNA, 393 bp, Artificial Sequence
  Description of Artificial Sequence: Synthetic coding sequence
gtgttctacctgaagatgaagggcgactactaccggtacctggccgaggtagccgctggagacgataaaaagggaattgtggatcagtcccagcaggcatatcaggaggcctttgagatcagtaagaaggagatgcagcccacccaccccatcagactgggcctcgcgctgaatttcagtgtgttctattacgaaattctgaacagccctgagaaagcgtgcagcttggctaagaccgctttcgatgaggctatagccgagttagacacgctctcagaggaatcttacaaggactccacactgattatgcagcttctgcgcgataacttgactttatggacatctgacactcagggagacgaagctgaagctggcgagggcggcgaaaactag

SEQ ID NO: 210391 - DNA, 159 bp, Artificial Sequence
  Description of Artificial Sequence: Synthetic coding sequence
atggacaagaacgagctggtgcagaaggccaagctggccgagcaggcagagcgttacgatgatatggctgcctgcatgaagtcagtgaccgaacagggggcagagctcagtaacgaagagagaaacctgctgtcggttgcctacaagaatgtcgtatag

SEQ ID NO: 210392 - DNA, 1224 bp, Artificial Sequence
  Description of Artificial Sequence: Synthetic coding sequence
atgcccacccccgacgccaccaccccccaggccaagggcttccggcgggcagtgagcgagcttgatgccaagcaagccgaagctattatggtgcgcggccaatctccgcgctttattgggagaagacagagcctaatagaagacgctcgcaaggaaagggaagctgcggtggccgcagcagccgctgccgtgccttccgaaccaggcgatcccctagaggctgtggcattcgaggagaaggaaggcaaggccgtacttaacttactgttcagcccccgcgcgacgaagccatcagccctgtcacgtgctgtaaaagttttcgaaactttcgaagctaagatccaccatctagagactcggcccgcccaaaggcccagagccggtggaccacacctggaatactttgtgagactggaagtgagacgaggggatctcgctgctctgctctccggcgtgagacaggtgagcgaggatgtccgcagcccagccggtccaaaggtcccgtggtttccccggaaggttagtgaattggacaagtgccaccatctagtgacgaagttcgacccagatctcgacctcgaccatcccgggttcagcgaccaggtgtatagacagaggcgcaagctcatcgccgagattgcattccagtaccgccatggggatcctataccccgggtcgagtataccgcagaggaaatcgcaacatgggactgttgccacgagctgctggggcacgtgcctatgcttgctgatcggactttcgcacagtttagtcaggacattggactggctagcctgggtgcgtctgatgaagagatcgaaaaactctccaccctgtactggtttactgttgaatttggtttatgcaagcagaacggcgaggttaaagcttatggtgccggattattaagctcctacggcgaattactgcactgcctgtcggaagaaccggagatcagggccttcgacccagaagctgccgcggtgcagccctaccaggatcagacatatcagagtgtttacttcgtaagtgaatccttctctgatgccaaggacaagctgcgatcgtacgctagtaggatccaacgtcctttctctgttaagtttgatccttacacactggctattgatgtgctcgactcaccccaggctgtcagacgaagcctcgagggcgtgcaagacgagctggacaccctggcccacgccctctccgctatcggatag

SEQ ID NO: 210393 - DNA, 1494 bp, Artificial Sequence
  Description of Artificial Sequence: Synthetic coding sequence
atgcccacccccgacgccaccaccccccaggccaagggcttccggcgtgctgtgtccgagctggatgctaaacaggccgaggcaatcatgagcccccggtttattggacgtaggcagtcccttatcgaggacgcccggaaggagagagaggcagccgtcgctgctgctgcggctgcagtgccttctgaaccgggtgacccactggaagctgtggccttcgaggagaaggagggaaaggcagtgttgaatttgctgttttccccccgcgccaccaagccgagcgcactcagccgggccgtcaaggtttttgaaacttttgaagcgaaaatccatcatttagaaacccggcccgctcagcgaccaagggctgggggcccccaccttgagtactttgtgaggctcgaggtgcgccggggcgacttggcagccttactatctggggttcgacaggtatccgaggatgtgcgctctcccgctggccccaaagtaccctggtttcctcgcaaggtaagtgaattagataaatgccaccaccttgtgactaagttcgaccctgacttggatctagatcatcccggattttctgaccaggtgtaccgccagcggcgaaaactgatagccgagatcgcattccagtaccgtcatggtgaccctattcctagggtcgagtacaccgcagaagaaatcgccacttggaaagaggtgtacaccaccttgaaaggcctgtacgccacacacgcctgcggcgagcaccttgaggcttttgccctgttggagcggttttctggctacagggaggataacatcccccagctggaagacgttagccggttcttaaaggaacggacgggctttcagctgaggcctgttgccggcttactctccgcacgcgactttctggcatctctggctttcagggtcttccagtgtacacagtacataagacatgcctctagtccgatgcatagccccgagcccgattgttgccatgaactcctaggtcatgtgccaatgctggcagacaggacgttcgcccaattctctcaggacataggccttgccagtctgggagctagcgatgaagagatcgaaaaattgtcaacactgtattggttcacagttgagttcggcctgtgtaagcagaatggggaagtgaaggcctacggggcagggctgctctcctcttatggggaacttctgcactgtctcagcgaagaaccggagatcagggctttcgaccccgaagccgccgccgtgcagccataccaggaccagacataccaatcagtgtacttcgtatccgaaagtttttctgatgcaaaggacaagctgcgcagttatgcctcaaggattcagaggcccttttccgttaaatttgacccttacactctcgcaatcgacgtcctggatagtccgcaggcagtgagacgttctcttgagggcgtgcaggacgagctggatacgcttgcccatgccctgtcagccatcggctag

SEQ ID NO: 210394 - DNA, 1575 bp, Artificial Sequence
  Description of Artificial Sequence: Synthetic coding sequence
atgcccacccccgacgccaccaccccccaggccaagggcttccggagagccgtcagtgaactggacgcaaaacaggccgaagctattatgggtgctccaggtccctctttaacaggcagtccttggcctgggactgccgctcccgcagcctcatatacgccaacccctagatccccccgatttatcggcagacgacagtcgcttatcgaagacgccaggaaggagcgcgaggctgcggtggctgcggcagctgccgcggtgccttctgagcccggagatccccttgaagccgtcgcttttgaggagaaagaagggaaggcggttctaaatctactgtttagcccacgcgctacgaagccaagtgccctctcaagagccgtaaaggtattcgagacctttgaggccaagattcatcatctggaaaccagacctgcacagaggcctcgggcaggggggccccacctcgagtattttgttcgtttggaagtgaggagaggtgacctggccgccttattgagcggtgtgcgtcaagtgagtgaggacgttcgtagcccagccggaccgaaagtgccctggtttcctcggaaggtgagcgagctggacaagtgtcaccaccttgtcacgaagtttgacccagatctggacttggaccaccctggcttcagcgaccaggtgtatcggcagaggcgcaagctcatcgctgaaatcgcctttcaataccggcatggagatccaatcccccgcgttgaatatacggccgaagagattgccacatggaaggaggtctatactaccctgaaagggctttatgctacacacgcttgtggcgaacatttggaagcttttgcattattagaacggttcagtggatacagagaggacaacattccgcaacttgaagatgtttctcgctttttgaaagaacgaacaggtttccagctcaggccagtcgccgggctgctcagtgcccgggactttctggctagtctggcttttcgagtgttccaatgcacacagtacatccgccacgcctcgagtcccatgcattcccccgagcctgactgctgccatgaattgctgggccacgtgccaatgctggctgacaggacgtttgctcagttctcccaggacatcggtctcgcttccttaggcgcctccgacgaggaaatcgagaagctctcaactctatactggttcacggtagagtttggactgtgcaagcagaatggagaggtgaaggcctacggtgccggtctgctgtcaagttacggcgaactcctacactgtttaagcgaggagcccgagattcgggccttcgacccagaggcagccgctgttcaaccttaccaggaccagacctaccagtcggtatactttgtcagcgagtccttttctgacgccaaagataaactgcgcagttatgcatcacgcattcagcgaccctttagcgtaaaattcgatccctacacactcgctattgatgttctggacagtccccaggctgtccgacgctccctggaaggggtccaggacgaactggacaccttggcgcacgcgttatccgccatcggctag

SEQ ID NO: 210395 - DNA, 1587 bp, Artificial Sequence
  Description of Artificial Sequence: Synthetic coding sequence
atgcccacccccgacgccaccaccccccaggccaagggcttccggagagccgtcagtgaactggatgccaaacaggccgaggccatcatggtacgaggtcaaggtgcccccggaccttccttgaccggaagtccatggcctggaactgcagccccagccgcatcctatacacccactcctagatctcccagattcatagggcgcagacagagcctgattgaggatgccagaaaagaaagagaagcagccgtggctgctgccgcagccgctgtgccttcagagccaggtgatcctctggaggctgttgcgtttgaggaaaaggaaggtaaagccgtgctaaatctactattcagccctagggctaccaaaccatctgccctgtctagggctgtgaaggtgttcgagactttcgaagcaaagatccaccatctcgaaacaaggcctgcccagaggccacgggccggagggccacacctagaatacttcgtacgactcgaggttcgacgtggtgacttggccgctctgttgagcggtgtacgtcaggtatctgaggatgtgcgttctccagcaggacctaaggtcccttggttccctcgcaaggtgagtgaactggacaaatgccatcacctggtgacaaaatttgaccctgatttggatctggaccaccccggtttctccgaccaggtctacaggcagagacggaagctgattgcagaaatcgcctttcagtatagacatggcgacccgatccctcgcgtcgagtacactgcagaggagatagccacctggaaggaggtgtacacgaccctgaagggcctatacgcaactcacgcctgcggggagcaccttgaggcattcgccctgctggaacgcttctcgggttatagagaagacaatattccacagttagaggatgtgtcacgctttcttaaggaaagaactggattccagttacggccagtggctgggctgctgtccgcacgggacttcctggcaagtcttgctttcagggtgttccaatgcacccagtatatccgccacgcatccagccctatgcactcaccggaacccgattgttgccacgaactcctcggccatgtgccaatgttggccgatagaaccttcgcccagtttagccaggatatcgggttggcctctctgggtgcgagtgacgaggagatcgagaagctgtccacgctgtattggtttaccgtggaatttggcctgtgtaagcagaacggggaagtcaaagcctacggcgctgggctgctgtcatcttacggggaactgttgcattgcctcagtgaggagccagagattcgggctttcgatcctgaggctgctgcggtgcagccataccaagaccagacttaccagagcgtctacttcgtgtctgagagcttcagcgacgccaaagataagctgagaagctacgcctccaggatccaacggccattttctgtgaagtttgacccttacacactggctattgacgttttggattctcctcaggccgtgaggcggtccctcgaaggtgtgcaagacgagctggacactctcgcgcacgccttgagcgccattgggtag

SEQ ID NO: 210396 - DNA, 3564 bp, Artificial Sequence
  Description of Artificial Sequence: Synthetic coding sequence
atgcccctgcggcactggggcatggcccggggcagcaagcccgtgggagacggcgctcaacctatggccgcgatgggcggtctgaaggttcttctgcactgggctgggccaggaggcggcgaaccatgggtgacattctccgaaagctctctgaccgccgaagaagtgtgcatccatatagcccacaaagttggcattactcctccatgtttcaacctgttcgccttgttcgacgcccaggcccaggtgtggttaccccctaaccacatcctggagattcctcgcgacgcgtcgctcatgctctattttcgcatcagattttatttccgcaattggcacggcatgaacccccgcgaacctgctgtgtatcgatgcggaccaccaggcacagaggctagttccgaccagactgcacaaggcatgcagctactcgatccagcctcgttcgagtacctctttgaacagggcaaacatgagttcgtcaatgacgttgcctccctctgggagttgagtaccgaagaggaaattcatcatttcaaaaacgagtccctgggcatggcgtttctgcacttgtgccatctggccctgcgacacggcatcccactggaggaggtcgcaaaaaagacctcattcaaagactgcatcccacgatcctttagacggcacatccgtcagcacagcgcgctgacccggctgagactgcgaaacgtgtttcgccgcttcctgcgtgacttccagcccggaaggctgtcccaacagatggtgatggttaagtatctcgccaccctggaaaggctcgctccaaggtttggtacagagagggtgcccgtgtgccacctgcgcctgctggcacaagctgagggagaaccctgttacatcagagattctggtgtggcccctacggatccggggcccgaatccgccgccgggccacctacgcacgaggtcctggtgacagggacgggcggcattcaatggtggcctgtcgaggaggaggtaaataaagaagagggatcctccggttcaagcggcaggaacccccaggcctccctttttggcaagaaggccaaagcccataaggccgttggtcaacccgccgaccgtcctcgtgagcccttatgggcctatttttgcgattttcgcgatattactcatgtagtgctgaaagagcattgcgtatcaatccataggcaggacaataagtgtctcgaattatcgctgcccagccgagctgctgcactatcatttgtgtccctggtggatggttactttagactgactgccgactcctcccactacttatgccacgaggtggctccaccgcgcctcgtcatgtccatacgtgacggcatacatggtccgctcctcgagccctttgtacaggcaaagttgaggcctgaggatgggttgtatctaattcactggagcacctcccatccttacagactgatcctgacagttgcccagaggtctcaggctcccgacgggatgcagtccctccgcctgcggaaattcccgattgaacagcaggacggagctttcgttctcgaggggtggggaagaagcttcccttcagtgagagagctgggggccgcactgcagggctgtctgttgagggcaggtgacgactgcttcagcctgcgacgctgttgcctccctcagccaggtgagacatctaacctcatcattatgagaggtgctcgcgctagtcctcgaacgcttaatctgtctcagctttcttttcaccgggtagaccagaaagagatcacacagctgtcccaccttggccaaggtactcgcacaaacgtatacgagggcaggctccgggttgagggcagtggtgaccctgaagagggcaagatggatgatgaggaccccctggtgcctgggcgcgacagaggtcaggagctgcgtgtcgttttaaaagtcctcgacccctctcaccacgacatagcattggctttttatgagacagcatctctaatgtcccaggtatcgcacacacatctggctttcgtgcacggcgtgtgcgtgcgaggcccagaaaatatcatggtgaccgagtacgtagaacatggaccgctggacgtctggctgcggcgtgagcggggacatgtgccaatggcttggaaaatggtagtggcacaacagctcgcatccgccctgtcctacctcgagaacaaaaatctggttcatggaaatgtgtgtggtcgcaacattctgcttgcacgacttgggctagccgagggtacctcaccattcatcaagctgtccgaccccggggtcggtctaggcgcgctcagtagagaagagagagtggaacgaataccatggcttgctccagagtgtcttcccggaggcgcaaactctctctcgaccgcgatggataagtggggatttggcgctactctgctggagatatgttttgatggcgaagcgccactgcagtcaagaagcccatccgagaaggagcatttttatcagagacaacacaggctgccagaacccagttgtccccagttggcaaccctgacatcacagtgcctgacttacgagccgacacaacgacctagttttagaactattctgcgagacctcacccggttgcagccccacaatctagccgatgtgctgactgtaaaccccgacagtccagcatcagatccaactgttttccataaaagatacctgaaaaagataagagacctgggggaaggtcattttgggaaagtaagtctctactgctatgatcctacaaacgatggcacaggagagatggtcgccgtgaaggcactgaaagctgattgcggacctcagcatcgaagtggctggaaacaagagatcgatatccttaggaccctatatcacgagcacattatcaaatataaggggtgttgtgaagatcagggtgaaaagtccctgcagctggtcatggaatacgtccctttgggatccctgagagattatctccctcgccacagtataggactcgctcaattactgttattcgcgcagcagatctgcgagggtatggcctatttacacgctcagcactatattcaccgggatctggccgctcgtaatgtactcttggataatgaccgccttgtaaaaattggggactttggccttgccaaagccgttcccgaagggcacgagtattatcgtgtccgggaagatggcgattcccccgtgttctggtatgcgccggagtgtttaaaggagtacaaattttattacgcatctgatgtctggtccttcggcgtcacgctgtacgagttactgacacattgtgacagctctcaatcacctcctactaagttcctcgagctcattggtatcgcgcaaggacagatgactgtgctgcgcctgacagagttgctagagaggggtgaaaggctaccccgtccggataaatgtccatgcgaggtgtaccacttgatgaagaattgctgggagactgaggcttcattccgtcctacctttgaaaacttaattcccattctcaagaccgtgcacgagaaataccaagggcaagccccctctgtcttctccgtgtgttag

SEQ ID NO: 210397 - DNA, 3564 bp, Artificial Sequence
  Description of Artificial Sequence: Synthetic coding sequence
atgcccctgcggcactggggcatggcccggggcagcaagcccgtgggtgacggtgcacagccgatggcggctatggggggcctgaaggttctgctccattgggccgggccaggggggggagaaccctgggtgaccttcagtgagagttctctgacagccgaggaagtgtgcattcatatagcgcataaggttggtataactccaccttgctttaatctttttgcactctttgacgcccaggctcaggtctggttgccccccaatcacattcttgagatccccagggatgcaagcttgatgttgtacttccgcatacggttttatttcaggaattggcacggaatgaaccccagagaacccgcagtgtatagatgcggcccaccaggaacggaggcctcttccgaccaaacagcacagggcatgcaactcctggaccctgcatcttttgagtatctctttgaacaaggcaaacacgaatttgtgaatgatgttgcctccctctgggagctgagtaccgaggaggagattcatcatttcaagaacgaaagtctcggaatggcctttttacatctgtgccacttggccctaaggcacggtattccactggaagaggttgctaagaagacaagcttcaaagattgtatccccagatcatttcgacgacatataagacaacattcggcccttactcggctccggctgcgcaatgtgttccggagatttctgcgagacttccagcccggtaggttatctcagcagatggttatggtgaagtacctagccaccctggagcgcctcgccccccgctttggcaccgagagggtgccagtttgccacttgagactgctcgcacaggccgaaggggagccttgttacatcagggactccggcgtggcacctacggatccaggccccgagtctgctgccgggcctcctactcacgaagtgcttgtgactggaaccggtggtattcagtggtggcccgtggaagaggaggtcaacaaggaagagggaagctcaggctcatctggaaggaatcctcaagcctcactgtttggaaaaaaggcgaaagcacacaaggcagtcggtcagcccgcggaccggccaagagagcccctgtgggcatacttttgcgacttccgggacattacacacgtggtgctgaaggagcactgtgtttcaattcatcgtcaggacaataagtgcctggagttaagcctgccctctcgcgcagccgccttgagctttgtgagcctagtagatgggtattttagactcaccgctgatagtagccattatttatgccacgaagtagccccccctcgcttagtcatgagtatcagggacggaattcacgggcccctgctggagcccttcgtacaagctaagctcaggcccgaggacggcctgtatttgatccattggagtacgagtcatccttatcgactcatactgactgtggcgcagagaagtcaggcgcccgatggcatgcagtccctgcggctccgcaagtttcctatcgagcagcaagacggggccttcgtactcgagggctggggcagatcattcccaagcgtgagggagttaggggcagctttgcaggggtgcttgctgagagccggcgacgattgctttagcttgaggcgctgctgcctgcctcagccgggcgaaacttcaaatctgattataatgcgaggagcacgagcgtcaccgcgcactctaaatctttcccagctcagcttccaccgagttgatcaaaaagaaataacccaattatcccaccttggccagggcacacggacgaacgtctacgagggcaggctgcgagtcgagggatccggggacccagaagagggaaagatggatgacgaagacccactggtgccagggcgcgatcgtggccaggagctgcgcgttgtgctgaaggtcctcgacccaagtcaccacgacatcgcacttgcattctatgagactgcatctttgatgtcccaggtgtcccacacacacctggcttttgtccacggcgtatgcgtccgggggcccgagaatattatggttaccgagtacgtggaacacggcccactggacgtctggctgagacgcgagcgcggacacgtccctatggcgtggaaaatggtcgtagcccagcaattagccagcgctttgtcttacctggaaaataagaatttagttcacggaaacgtctgcggtcgcaacattttactggctagactcggactagcggaggggacctccccttttattaagctcagcgacccaggtgtgggccttggcgcgctatcacgggaagaacgggtggaaaggatcccgtggctggcaccagagtgtctgccgggaggagcgaactcactttctaccgccatggacaaatgggggttcggcgccaccctcctcgaaatctgcttcgatggagaagctcccctgcagagtaggtctccctccgagaaagaacacttctaccagagacagcatagactgcccgagccgtcctgcccccagttggccactctcaccagtcagtgcttgacctatgagccaacccagcggccctcattccgaaccatcttgcgcgatctgacaagacttcagccacacaacctggccgatgtgctgaccgtcaatccggattctccagcttcagatcctaccgtgttccacaagaggtatctcaaaaaaatccgggatctaggagagggccactttggaaaggtgagtctgtattgctatgacccaacaaacgacggcaccggggaaatggtggcggtcaaggcgctgaaggccgactgcggtccccaacataggtctggctggaagcaggagattgacattctgcgcacgctgtaccacgaacacataatcaaatataagggctgctgcgaggaccagggcgaaaagtctctacagcttgttatggagtatgtcccactcggcagtctgcgcgactacctgcctcgacattctatcggacttgctcagctgcttctgttcgcacagcagatttgcgagggcatggcttacctacatgctcagcattacatacaccgggacctcgctgctcgtaatgttctcttagacaatgaccgcctggtgaagatcggcgattttggtctggcaaaagctgttccagagggtcatgagtattatcgtgtgcgagaggatggggattcgccggtgttttggtatgccccggagtgcctgaaggaatataaattttattacgcctcagatgtgtggtcttttggcgtaaccttatacgagctgctgacacactgtgactcctcacagtctccgccaactaagttcctggaattaatcggcattgctcaaggccaaatgacagttctccggctcaccgagttattggaacggggcgaacggcttccgcggcccgacaaatgtccctgtgaagtctatcaccttatgaaaaattgctgggagaccgaagcctcatttagacccacattcgagaacctgataccaattttgaagacagtccacgaaaaataccagggacaagccccctcagttttcagcgtgtgctag

SEQ ID NO: 210398 - DNA, 357 bp, Artificial Sequence
  Description of Artificial Sequence: Synthetic coding sequence
atgcccctgcggcactggggcatggcccggggcagcaagcccgtgggggatggcgcccaacctatggccgccatgggtggcctgaaggttctgttacattgggccgggcccgggggcggagaaccttgggttacattttccgaatcatctctgaccgcagaggaggtgtgcatacatattgctcacaaggtcggcatcacaccaccttgctttaacctgtttgcactgttcgatgcacaagcccaagtctggttaccccccaaccatattctagagataccccgggacgcatcactaatgctctattttcgcattaggttctatttccgcaactggcatggtatgaatcctcgttag

SEQ ID NO: 210399 - DNA, 2805 bp, Artificial Sequence
  Description of Artificial Sequence: Synthetic coding sequence
atggtgatggtgaagtacctggccaccctggagcggctggccccccgatttgggactgagcgcgttccggtgtgccatctcagactgctcgctcaggcagaaggagagccctgttacatcagggattctggcgttgcccctactgatcccggccctgagtcggctgcgggtccgcccacgcacgaggttctggtgacaggcaccggagggatccaatggtggcctgtggaggaggaagtgaacaaagaagagggcagctctggctctagcggtcggaacccccaggcaagcctgtttggtaagaaagccaaagctcacaaagctgtgggacagcctgcggaccgcccaagggaacccctctgggcctatttttgcgacttcagggatatcacccatgtggtgcttaaagaacattgtgtctcaattcatcgccaggacaataaatgtttggagctgagcttgcccagtcgcgccgctgcactgagctttgtgagcctggtggacggttactttcgcctgaccgccgatagcagccactatttgtgtcacgaagtggccccacccaggctggttatgtcaatcagagatggaattcatgggccgctactggagccattcgtgcaggctaaattgcggccagaggacgggctgtacctgattcattggtctacttctcacccataccgcctgattctgaccgtggcacagcgctctcaagcccctgatggcatgcagtcactgcgactcagaaaattcccgattgaacaacaggacggggccttcgttctagagggctgggggcgctcttttccctctgtgagagaactgggagcagccctgcagggttgtctgctgagggcaggtgatgattgcttttccctgcgtcgctgctgcctgccccagcccggagagacttcaaaccttattattatgcgcggggcccgggcgtcaccaaggaccctcaatttatcccaactttcatttcacagggtggaccagaaagaaataactcagttgagccacctggggcagggcactagaacgaacgtgtacgagggcaggctgcgcgtggaaggcagtggtgaccctgaggagggcaaaatggacgacgaagaccctcttgtccctgggagggatcgtgggcaggaacttcgcgtcgtactgaaggttcttgatccaagtcatcacgacatcgctcttgctttttacgagaccgcctctctgatgtcccaagtgtcacacacccatctggccttcgtgcatggagtttgtgttagggggccagagaacattatggtcaccgagtacgtggaacatgggccccttgatgtgtggctgcggagggagcgaggccacgtgccaatggcatggaaaatggtggtggcacaacaacttgcatcagctctatcatatctggaaaacaaaaacctggtgcatgggaatgtctgtgggcgcaatatcctgctcgcccgcctagggcttgccgaagggacttcacctttcattaagctgtcggaccctggagttggcctgggggctctgtcccgggaggagcgagttgaacgtattccttggctcgcccctgagtgtttgcctggcggagcaaatagcctcagtacagccatggataaatgggggttcggagccaccctactcgagatatgctttgatggagaggcccccctgcagagtcgctcaccctcagagaaagagcatttctaccaacggcagcatcgactacccgagccttcttgcccgcagctggcgaccttgacatcccagtgcctcacgtacgagccgacccaacggccaagctttaggaccatcttgcgggacctcaccagattgcagccacacaacctggccgatgtactgaccgtcaacccggattccccagcctctgacccaaccgtgttccacaaacggtacttgaaaaagatccgagacttgggggagggacattttgggaaggtgagcttgtactgctacgatcctacgaatgacggcaccggggaaatggttgccgtcaaggccctgaaggctgattgtggaccgcagcacagatccggctggaagcaggaaatcgatattcttaggaccctgtaccacgaacatataatcaaatacaaaggctgctgcgaagatcagggtgaaaagtccttgcagttagtcatggaatatgtccctctaggctctctccgcgactaccttccaagacactctattggcctggcccaattgctcttatttgcccagcaaatctgcgagggaatggcatacctgcacgcccagcactatatccatcgcgacttggccgcccggaatgtgttgctggacaacgatcggcttgttaaaataggcgacttcggtcttgcgaaagccgttcccgaaggccacgagtattaccgggtgcgggaagatggcgactcaccagtgttctggtacgctcccgagtgcctgaaggagtataaattctactacgcgtcagatgtctggagctttggtgtgaccctgtacgagcttttaacccattgcgacagtagtcagtccccccctaccaagttcctagaactcatcgggattgcccagggacagatgaccgtcctccggttgaccgagctcctcgaacggggcgaacgacttcctagacccgataagtgcccctgtgaagtgtaccaccttatgaagaactgctgggagaccgaggcttcttttcggccaaccttcgaaaacctgatcccgatacttaagactgtgcacgaaaaataccagggtcaggccccatccgtgttcagtgtgtgctag

SEQ ID NO: 210400 - DNA, 1986 bp, Artificial Sequence
  Description of Artificial Sequence: Synthetic coding sequence
atgctgcccgaggccggcagcctgtggctgctgaagctgctgcgggatatacagctggctcaattctactggcccatcctggaggagctaaatgtgacacgccccgaacacttcgacttcgtaaagccagaagacctagacggcatagggatgggccggcctgctcagcgtcggttaagtgaagccctgaaacgactacgctccggtcctaaaagtaagaactgggtgtataaaatcttagggggtttcgcccccgagcacaaagagcccaccctgcccagtgacagcccaagacacttacccgaaccggaggggggcctcaaatgcctcatcccagagggcgcagtgtgtcggggtgagctgctggggtctggttgtttcggggtggtgcatcgtggcctctggactctgccctccggcaaatccgttccagtagccgtaaagtcgcttagagtgggccctgaaggtcccatgggcacagagctgggtgacttcctgagagaggtgtccgtgatgatgaacctagaacacccacacgtcctgcggttacatgggctcgtgctgggccaaccactacagatggtgatggaacttgcccccctcggatctctacacgcacgcctcaccgcaccagcgcccacgcctcccttattagtcgccctgctttgcttgtttctgagacagctcgctggggccatggcatacctgggcgctagggggctggtgcatcgcgacctagcaacaaggaatctcttgctagcatccccacgcacgattaaagttgcggattttggcctggttagacctctcggaggcgcccggggaagatacgtgatgggagggccccggcctattccatatgcctggtgcgcccccgaatccctgagacacggtgcgttcagcagtgctagcgatgtttggatgtttggagtcacattatgggaaatgttctccggaggggaagagccatgggccggcgtgcccccctacctcatacttcagcggttagaggatcgggccagattacccaggcctccactgtgttcgagggccttatactcccttgccctgcggtgttgggcccctcaccctgcagataggccctctttcagtcacctggaaggattgctgcaggaagctggcccctcggaagcttgctgcgtcagggatgtcaccgaacccggggcgctgcgaatggaaactggggatccaataactgtcattgagggtagccctgactctaccatttggaagggacagaatggcagaacgtttaaggttggcagttttccagcttcagccgttacactggcagatgcgggcggactgcctgccacccgacctgttcacaggggtacacccgcccgaggagaccaacacccagggtcgatcgacggggataggaaaaaggctaatctatgggacgcaccacctgccaggggtcagcggcggaatatgcctctggaacgcatgaaggggattagcagaagcctggagtctgtgctgtccctgggtccccgtcctactggcggcgggtcaagtcctcccgagatacggcaggccagggcagtcccgcaaggaccaccaggtttaccacctcgacccccactgtcctcctcctcaccacagccaagccagccctcccgtgaacggctgccatggcctaaacgcaagccaccccacaatcatcctatggggatgcctggggcacgaaaggccgctgcattaagcggcggtttgctcagtgatcccgagcttcagagaaagattatggaagtggaactgtccgtccatggagtgacccaccaggaatgtcagactgcactcggagccactggaggagatgtcgttagcgcaataagaaacctgaaagtggaccagctgtttcatctcagctcacggtccagggcagattgttggaggatcctggagcactaccagtgggacctgagcgctgctagccgatacgtccttgctagaccgtag

SEQ ID NO: 210401 - DNA, 1986 bp, Artificial Sequence
  Description of Artificial Sequence: Synthetic coding sequence
atgctgcccgaggccggcagcctgtggctgctgaagctgctgcgggacatccagctcgcacagttctattggccaatcctggaagaactaaatgtgactcggcctgaacacttcgattttgtgaaacctgaagacctggacggcattggaatgggccggcctgcacagcggagattatccgaggctctgaagaggctccgctctggacccaaaagcaagaactgggtgtacaagatacttggaggcttcgcccccgagcacaaagagcccactttgcccagcgacagcccccgccacctgcccgaacccgagggaggtctgaagtgtctgatcccagagggggctgtgtgtagaggggagttgctgggctctggttgctttggcgtggtgcatcgtggcctttggaccctgccctcgggtaagagcgtgcctgtcgccgtgaaatctctgagagtggggcccgagggtcctatgggtacagagctaggcgacttcctgcgggaggtaagtgtgatgatgaacctggagcacccacatgtgcttcgcttgcacgggctcgtgctgggacagccactgcaaatggtaatggagctggctcctctgggcagcctccatgctaggctgacagccccagccccgacaccaccgctcctggttgcactgctttgcctgttcctgagacagctcgctggcgcaatggcatatcttggggcccgcgggttggtgcaccgagacctagcaaccaggaacctgctcttggcatcacctagaaccattaaggtagccgacttcggactggttagacccctgggcggtgcgagaggacgatacgtaatgggcggacccagaccaataccgtatgcctggtgtgcccccgagtctcttcgtcatggagcattcagctctgcctccgacgtgtggatgtttggagttacactctgggagatgttttctgggggcgaagagccatgggccggggtcccgccctatcttattctacagcgcctggaagacagggcgcgactcccaaggcctcccctctgcagcagggcgctctactccctggcgctacggtgttgggccccccacccagccgatcggcccagttttagtcacctcgaggggttactgcaagaagccggaccaagcgaagcatgttgcgtgcgggacgtgacagaacctggagcactcagaatggaaaccggcgatccaatcaccgtgatcgaggggtcgcccgactctacaatctggaagggccagaacggcagaactttcaaagtggggagttttcccgcgtctgccgttaccctggccgacgcggggggattacctgccaccagacccgtacaccgaggaacacctgcacgcggggaccagcaccctggcagtatcgacggggatagaaagaaggccaacctgtgggatgccccccctgctcgaggccagcggcgcaacatgcccctcgaacgtatgaagggaatctcacgctccctagaaagcgtacttagcctcgggcccaggccaacaggaggggggtcttcaccccctgaaattcgacaggccagagctgtccctcaagggccccctggcttgccccctagacctccactcagtagcagttccccccagccttcgcaaccatcgcgcgagcgtttaccatggccaaagcggaaaccaccccataatcaccctatggggatgcccggggccaggaaggctgcagctctgagcggcggcctgttaagcgatccggaacttcaaaggaagattatggaagtggagctgtccgtccacggcgtcacgcaccaggagtgtcagactgccctgggcgccacaggaggggatgtggtttccgcaatccgtaatctaaaggtggatcagctattccacctctctagccgctctagagccgactgctggcgcatccttgaacattaccaatgggatctctctgctgcaagtcggtacgtcttggcaaggccatag

SEQ ID NO: 210402 - DNA, 1587 bp, Artificial Sequence
  Description of Artificial Sequence: Synthetic coding sequence
atgcagcccgaggagggcaccggctggctgctggagctgctgagcgaggtgcaattacagcagtactttctcaggctgagagatgatttaaatgttacgcggctcagtcatttcgaatatgtaaaaaacgaagatctggagaagattggtatgggaagaccaggccagcgcaggctgtgggaggcagtaaaaagacgtaaagccttatgcaagaggaagtcttggatgagcaaagtcttttcgggcaaaaggctcgaggctgaattcccccctcaccattcacaatcgaccttccgtaaaactagtccggcccctgggggtcccgctggagaaggaccactgcaatcgctaacctgtctgatcggggagaaggatctgcgcctcttagagaagctgggcgatgggtctttcggtgtggtccgcagaggagagtgggatgcaccctcaggaaaaacggtcagtgtcgcagtgaagtgccttaaacccgacgtgttaagtcaaccagaagcaatggacgatttcatccgcgaggtgaatgctatgcattctctggaccatcgaaatttgattcgcttgtacggagtcgtgttgactccgccaatgaagatggtgactgagctggcaccgctgggatcactgctggatagactacgaaagcaccaggggcactttctgctcggaacactgtccaggtacgccgtacaggtggcggagggtatgggctacctcgagtccaagcgatttatccatcgcgatctggctgcgcgtaacttgctgttagcaacacgggacctggttaagatcggcgacttcggattgatgagggcccttcctcagaacgatgaccattacgtaatgcaagaacatcgcaaggtgccattcgcctggtgtgcccccgagtccctgaaaaccaggacatttagccacgccagcgatacttggatgttcggagtgacactttgggaaatgttcacatatggccaagagccatggattggcctgaacgggagtcagatcttgcataaaattgacaaggagggcgagagactgccgcgaccggaagactgtccacaagacatctataacgtaatggtgcaatgttgggcgcacaaacccgaagatagaccgacctttgtcgccctgcgggacttcctgcttgaggcccagccaactgatatgcgggctctccaagactttgaagagccagacaagctccatattcagatgaatgacgtcatcaccgtgatcgagggacgggccgaaaactattggtggcggggacagaatactcgaaccttatgtgtggggcccttcccacgcaacgtggtaacgtccgtggccgggctgtccgcacaggatatttcccagcccctccagaatagcttcatccataccggacacggcgatagtgatccccgccactgttggggatttcctgacaggatcgatgagtgtccgttctccgccttctctccaggtcatccaccagctgagacgtgtggtcaggtgctgtggaccggccgccgtgaggcatgcgcttcagacccacgattgcatcctgtgtcttctcggactaagggcctctag

SEQ ID NO: 210403 - DNA, 3117 bp, Artificial Sequence
  Description of Artificial Sequence: Synthetic coding sequence
atgcagcccgaggagggcaccggctggctgctggagctgctgagcgaagtgcagcttcagcagtacttcctgcggttaagggacgacttgaacgtaactagactctcccactttgaatatgtgaagaacgaagatcttgagaagatagggatgggccgtcccggacagcgtaggctgtgggaagctgtgaaacggcgcaaggccctctgcaagcggaagtcctggatgtcaaaggtcttctcgggcaaacggctggaagccgagtttccaccccaccacagtcagtccacctttaggaagaccagccctgcacccggtgggcccgccggggagggacctcttcagtccctcacatgcttgatcggggaaaaggatcttagactgctcgagaagcttggcgacgggtcttttggagtggttcggcgcggggagtgggacgcccctagtgggaaaactgtgagcgtggcagtgaagtgcctaaagcccgacgtactgtctcaacccgaagcaatggatgacttcatacgggaagtcaacgcaatgcattccctggaccatcggaatctgatacggttgtacggcgtggttctcacccccccgatgaagatggtgacagaactagcccctctgggatcactattagacagacttcgtaagcaccagggacattttctccttggtaccctatcgcgttacgccgtacaggtggcagaaggcatgggctatctggaaagcaaaaggttcatccacagggacttggccgctaggaatttgctcctagccactcgcgatttagtcaaaatcggcgattttggactgatgagggcactgcctcagaatgacgatcactacgtgatgcaagagcatcgcaaagtaccgttcgcgtggtgtgcccctgagagcttgaaaacaaggacattctcgcacgcgagcgacacctggatgttcggagtgacgctttgggaaatgtttacatacgggcaggagccgtggattggtctcaatggctcccagatcctgcacaaaatagacaaagaaggcgagaggttgccgcgaccggaggattgcccccaggatatctataacgtgatggttcagtgttgggcacataagcctgaggacagacctactttcgtggctctgcgcgacttcttgctcgaggcacagcccaccgacatgagggcgctgcaagacttcgaagagccagacaagctccacatccagatgaatgatgttatcaccgtcattgagggcagggccgaaaattattggtggaggggacagaacaccagaacactttgtgttggtcctttcccgcggaacgtcgttacttcagttgccgggctgagtgcgcaagacatcagccagccgctccagaatagcttcatccacactggtcacggtgattctgatccgaggcactgctggggattccctgaccgcatagatgagctatatctgggaaatccgatggacccgcccgatttactctctgtggaactgtctacctctagacctcctcagcacctgggtggagtcaagaagcccacctacgatccagtctctgaggaccaggaccctctgagctctgacttcaagcgactgggactgcggaagcccgggctcccccgcggcctgtggctggcgaaacccagcgcccgggtccccggcactaaggcttcaagggggtcgggcgctgaggtcaccctgattgattttggggaagaaccggttgtgcccgccttgcgcccatgcgcaccatccttggctcagttagccatggatgcctgctccctgctcgacgagacccctcctcagagccccacccgcgcattgcctcggccactgcaccccacccccgtggtcgactgggacgctcgcccattaccaccacccccggcttacgacgacgtcgctcaggatgaggatgactttgaaatatgttccatcaatagtaccctggtgggcgctggtgtccctgcaggaccttctcaggggcaaactaactacgcatttgtgcctgagcaagcacggcctcccccccctctcgaggacaacttgttcttgccccctcaggggggaggaaaaccgccttcatccgcacaaaccgctgaaatattccaagctctccaacaggagtgcatgaggcagcttcaagcaccggcgggctctccggctccgtcgccaagccctgggggcgatgacaagccccaggtgcctccgcgcgtgccgatcccacctcgccctacacgcccccatgtgcagctctctcccgcaccaccaggagaggaggaaacctctcagtggcccggaccggcaagccccccacgtgttcctcctcgggaaccacttagtccccagggttctcggacaccctctcccttagttccacctggatcaagtcccctgccgccacgcttaagcagcagccccgggaaaaccatgccgaccactcagtccttcgctagcgatcccaagtacgctaccccccaagtgatccaggctccaggaccgcgcgctggcccgtgcatccttcccatcgtgcgtgatggaaaaaaggtcagcagcacccattactatctgcttcccgagcgtccaagctatctagaacgctatcaaaggttcctgcgtgaggctcaaagtccagaggaacccaccccattacccgtccctttgctcctgccacctccatcaacaccagcaccagcagcccccacagccactgtcagacctatgccccaagcagccttggacccaaaagcaaatttcagcaccaacaatagcaacccgggggcacgcccccctccgccaagggccacagctagactgccccagaggggttgtcccggcgacgggcctgaggccggacggccagccgacaagatacaaatggccatggtccacggagtcaccacggaagagtgccaggctgccctccagtgtcatgggtggagtgtgcagagagcagcccagtatctcaaggtggagcagctttttggcttgggcctgcggcctcgcggcgaatgtcataaagtactcgaaatgttcgattggaacctcgaacaggcggggtgccacctgcttggttcctggggtcccgcccaccataagagatag

SEQ ID NO: 210404 - DNA, 3261 bp, Artificial Sequence
  Description of Artificial Sequence: Synthetic coding sequence
atgctggaggcccggcccccccggacccagggcagcgacgccgccggggctgctgcggggagaggcctgcgggccctcttgttatcattaacagcagccgccgggatctggggatccatgggggagcgttccgcctatcaacgcctcgcaggaggagaagaaggacctcagcggctcgggggtggacgcatgcaaccagaggagggtaccggctggctgttagagctgttaagcgaggtccagctgcagcagtattttctccggctgcgagatgacttgaacgtgacgagactatcgcattttgagtatgtaaaaaacgaggacctggagaagattgggatgggcaggcctgggcagaggcgcctctgggaggcagtaaaacgcaggaaggccctgtgtaagcgcaagtcttggatgtctaaagtcttttcaggtaaacggctcgaggcggagttccctccacatcattcccagagcacattccgaaaaaccagccccgccccaggcggaccagccggagaagggcctctgcagtccctcacctgccttatcggggagaaagacctgaggctgcttgagaagcttggagacggtagcttcggcgtggttcgcagaggtgaatgggatgctccgtctggcaaaactgtgagcgtggccgtcaaatgtttgaagccagacgtcttgtcacagccagaggccatggacgacttcatcagggaagtgaacgctatgcactccctggaccaccgaaatctgattcgcctatatggggtggtcctcaccccacccatgaagatggtcactgagttagctccactggggagcctgttggacaggcttcgaaagcatcagggacacttccttctgggcacgctgagtcggtacgccgtgcaggtagctgagggcatgggctacctggagtccaagcgcttcatacatcgtgatctggcggcgcgtaatctccttttggccaccagggacttggtcaagataggtgacttcggtctcatgagggccctgccccagaacgacgatcattacgttatgcaagagcacaggaaagtgccctttgcctggtgtgcccccgagagcctcaagactagaacattcagtcacgcttctgatacttggatgttcggagtgacactgtgggaaatgttcacttatgggcaagaaccttggatcggcctgaacgggtctcagattttacataagatcgataaagagggtgaaagactgccccggccagaagattgtcctcaggatatttataacgtgatggtccagtgttgggctcataagccggaggataggcccacgtttgtggcattgcgtgatttcttgcttgaggcccagcccactgatatgagggcgctccaggatttcgaggaacccgacaagctgcatattcaaatgaacgatgtaattaccgtgattgagggccgggctgaaaattactggtggagggggcagaacactaggacgctgtgtgtcggacccttccccagaaatgtggttactagcgtggccgggttgtccgctcaggacatatcacaaccactccaaaactctttcatccataccgggcacggagactctgatccccggcactgctggggcttcccagataggatcgatgagttgtatctcggaaatcctatggatccacccgatttgctttcagtagagctgagtacaagccgaccaccccaacacttggggggcgtcaaaagagaacctccgccccggccgccacaaccagcattctttactcagaaacctacatatgatcccgtgtcagaggaccaggatcctctcagctctgatttcaaaaggctaggattacgaaaaccagggctccctagaggtctgtggctggcaaaaccatccgctcgggttcctgggaccaaagcctcccgggggtctggggctgaggttacactgatcgacttcggagaggaacctgtggtacccgcactgcgcccttgcgccccctccctggcccagcttgccatggatgcatgcagtctccttgatgagacccccccgcagagtccgacgagggcactgcctcgacccctgcatccgactccagttgtcgattgggacgcccggcctttgccaccgcctcctgcttatgatgacgttgcccaggacgaggatgattttgagatctgctcaatcaactctacgctggtgggcgccggcgtgcccgctgggccctcccaaggtcagacgaattacgcattcgtacccgagcaagctagaccccctcctcccctggaagacaatctctttcttccacctcaaggcggcggaaaacccccctcttccgcccaaaccgctgagatatttcaggctctgcaacaggagtgcatgcgccagctccaggcaccagcgggtagccctgcgccctctccttctcccggtggcgatgacaagccccaggtaccaccacgcgtcccgatccccccgcgccccacccgcccccacgtacaactttctcccgctccacccggcgaggaggaaacaagccagtggccggggccagcaagcccaccaagggtccctcccagggaaccactgtctcctcagggtagccgaacaccatctcccctcgttcccccagggtcctcgcctctgcccccgcggttgtcctcttcccctggaaagactatgccgaccacgcaatcattcgcatccgaccccaaatatgcaacgccacaagtaatccaagcccccgggcctcgcgccgggccatgcatcctcccaattgttagggacggcaagaaggtttcatcgacacactactacctgcttcccgagaggccatcttatcttgagaggtatcaaaggtttcttcgtgaggcacagtcacccgaggagccaacccctttgcccgtgcccctgctgcttccaccgccttccacaccggcccctgccgctcccaccgccactgttcgccccatgccccaggctgcgctagatccaaaagcaaacttcagcacaaacaacagtaatcccggcgcgagaccaccacctccccgagctacagcaagactacctcagcgtggatgccctggcgacggacctgaggcgggcaggccagccgataagatccaaatggtggagcagctattcggccttggcctccggccgagaggcgaatgccacaaggtcctcgaaatgttcgattggaatctggagcaggctggctgtcatctcctgggcagctggggcccagcccatcacaagcgatag

SEQ ID NO: 210405 - DNA, 3117 bp, Artificial Sequence
  Description of Artificial Sequence: Synthetic coding sequence
atgcagcccgaggagggcaccggctggctgctggagctgctgagcgaggtgcagctgcaacagtacttcctgaggctaagggacgatctcaatgtcactcggctgagccacttcgagtacgtgaaaaacgaggatctcgagaagattgggatgggtcgcccaggtcagcgccggctatgggaggcagtgaaacgtaggaaggcgctttgcaagaggaagtcgtggatgtcaaaagtgttttcaggcaagcgtctcgaagctgaatttcccccacaccatagtcagtcaacttttcggaaaacgagtccagcacccggggggccagccggcgagggcccactgcagtcattaacatgcttaattggggagaaagacctgagactgctggaaaagctaggggatggaagctttggtgtggtccgaagaggcgagtgggatgctcccagtgggaagactgtttctgttgccgtgaagtgtctgaagccagacgtgctcagccaaccagaggcaatggacgattttatccgcgaagtcaatgccatgcacagtctagatcaccgaaacctgatcaggttatatggagtggtcctgactcctcctatgaagatggtgacagaactggctcccctggggtctctgttagacaggctgagaaagcaccaaggtcattttctgctggggactctttccagatatgccgtgcaggtggccgagggaatggggtacctagaaagtaaacggttcattcatagagatctagccgcccggaacctgttactggctacacgggatctggtcaagatcggtgattttggcctaatgagagctttgccccagaacgacgatcattacgtgatgcaagaacaccgcaaggtgccttttgcgtggtgtgctcccgagagccttaaaacaagaaccttctcccatgcctcagatacctggatgttcggagtgactctgtgggagatgttcacctatggacaggagccttggataggattgaatggaagccagattctccacaagatcgacaaggaaggagagcgcctcccacgccccgaagattgccctcaggacatctataacgtgatggtgcagtgctgggcccataaacccgaggaccgccctacgtttgtcgccttgagagatttcctcttggaagcccaacctacagatatgcgggccttacaagacttcgaggagcctgataaattgcatattcaaatgaatgacgtgattacagtgatcgagggacgggcagagaactactggtggcgcggtcagaacacacgtactttatgcgttggccctttcccaaggaacgtggttacctccgtggcgggcctgagcgctcaagatatctctcaacctttacaaaacagtttcatccataccgggcatggtgacagcgatccccggcattgttgggggttccctgacaggatagacgaattatatttggggaatcccatggatcccccagatcttctgtctgtggagttgagcacttcgcgccccccccagcacctgggcggtgtgaagaaacccacctatgaccctgttagtgaggatcaggatcccctttcaagcgacttcaagcggctcggcttgcggaagcctggcctaccccggggtctgtggctcgccaagccctccgccagggtgcctggcacaaaagcatcaagaggcagtggcgcagaggtcacccttattgatttcggagaggaacccgttgtgccagcccttaggccttgcgctccctcactcgcccagctggcaatggatgcttgctcactgctggatgagacgcctccacagtcacccactcgggcactgccccgacccttgcaccctacgcctgtggtggactgggatgcaagacctctaccacccccccctgcctacgatgacgtggcgcaggatgaggatgatttcgaaatttgtagcatcaattccacacttgtgggggccggcgtgcccgctgggccaagccagggccagacaaattacgcttttgtccccgagcaggctcgacctcctcctcccctggaagacaatctgttcttgccaccccagggcggcggcaagcccccttcaagcgctcagacagccgaaatctttcaggccttgcagcaggaatgcatgaggcagctccaggccccggcaggctctccagccccaagccctagccccgggggggatgacaagccccaggtgccaccccgagtacctatcccaccccgccccacacggccccatgttcaactgtccccggccccccctggcgaggaggaaacctcccagtggcccgggccagcgtctcctcccagggtcccgcccagggagccactctctcctcagggctcaaggacccctagtccactggtgccccccgggagctctccactgcccccacggctttctagctctcccgggaaaaccatgccaacaacccagtcgttcgccagtgatcccaaatacgcgactccccaggtgatccaggctcccgggcctcgggccggcccttgtatcctgccaatagtccgggacggcaagaaagtttcatccacacactattatcttctgccagaacggccatcctatcttgagcggtatcagcggttcctgagagaggctcagtcacccgaggaaccaaccccactccctgtgccgctactgctgccgcccccttccaccccagcccctgctgctcccaccgccacggtgcgccctatgcctcaggcagctctggaccccaaggccaacttctccactaataactcgaatcctggcgcccgccctccgcccccacgagctacagcccggcttccccagcggggctgtcctggtgatgggcctgaagccggtaggcctgctgataagatccagatggcaatggtgcatggagtgaccaccgaagagtgccaggcagcgctccagtgccacggttggagtgtccaacgagcggctcagtatctgaaagtcgagcagctgtttggcctcggtctccgcccccggggagaatgccataaggtactcgagatgtttgattggaacctggaacaggccggttgtcatctcctgggttcctggggcccagcacatcataagcgctag

SEQ ID NO: 210406 - DNA, 294 bp, Artificial Sequence
  Description of Artificial Sequence: Synthetic coding sequence
atgcagcccgaggagggcaccggctggctgctggagctgctgagcgaagtccagcttcaacagtactttctcagactgagagatgacctgaatgtcactagactgtctcatttcgagtacgtgaagaacgaagatcttgaaaaaatcggaatgggtagacctggacagcggagactctgggaagcagtgaaacgtcggaaagcactatgtaagaggaagagttggatgtcaaaggtgttcagcgggaaacgtctggaagcagaatttccaccgcatcattcacagagcacctag

SEQ ID NO: 210407 - DNA, 1827 bp, Artificial Sequence
  Description of Artificial Sequence: Synthetic coding sequence
atgagccaggagggcgactacggccggtggaccatcagcagcagcgatgaaagtgaggaggagaagcccaaaccagataagccgtcaaccagctccctcttgtgtgctaggcagggagcagcgaatgagccacgctatacctgctccgaggcccagaaagctgcacataagaggaagatatcacctgtaaagttctctaacaccgactcagtgttgccgcccaagaggcagaagtcaggttcgcaagaggaccttgggtggtgcctctcttcttccgatgacgaactgcagcccgagatgccccagaaacaggctgagaaagtggtgataaagaaggaaaaagatatttccgcacctaacgacggtaccgcacagagaacagaaaaccacggggccccggcgtgtcaccgactgaaagaggaggaggacgagtacgaaaccagtggggagggacaggacatctgggacatgctggacaagggaaacccattccagttctatctgaccagggtgtcaggggtgaagcccaagtataactctggcgccctgcatatcaaggacattctgtcacctctttttggaactttggtgtcttccgcccagtttaattattgcttcgacgtagattggcttgtgaaacaatatccacctgaattcaggaagaaacctatcttgcttgtacacggtgacaagcgggaagccaaggcacacctccacgcacaagcgaagccctacgaaaacatttcactgtgccaggctaaactggatattgctttcggcacacaccacactaagatgatgttacttttgtatgaggaggggcttagggtagtgatccataccagtaacttgatccatgccgattggcatcagaagactcaaggcatttggctttcgcctctctatccccgaatcgctgacggaactcataagagcggcgagtctccaacacactttaaagctgacttaatcagctatctgatggcttataacgcaccttccctgaaagagtggatcgatgtcattcataaacacgatctgagtgagacgaacgtctatctgatcgggtcaacaccaggcaggttccaagggagtcagaaagacaattggggccactttagactgaaaaaactgttgaaagaccatgcaagcagcatgcccaacgcggaatcctggccggtggttggacagttttcctctgttggaagtttgggggcagacgagtccaaatggctgtgtagtgagtttaaggaatcaatgttgacattgggaaaggagagcaagacgccaggaaagtccagtgttcctttatacctgatctatcctagcgtcgagaacgtcagaacctctttggaggggtacccagccggtggcagtctgccatattcaatacagacagcagagaagcagaattggctgcactcttatttccataaatggtctgccgaaacaagtggaaggtctaatgctatgccacatattaagacctacatgaggccatccccagatttctctaaaattgcatggtttctggtgaccagtgctaacctgagcaaggcagcctggggggccctagaaaagaacggcactcagctgatgattcggagctatgaattgggcgtcctattcctgcctagtgcctttgggctggattccttcaaggtgaagcagaagtttttcgctggctcccaggagccaatggccaccttcccagtgccctatgaccttccgccagagctttacgggagcaaagatcgtccatggatttggaatatcccatatgttaaagcaccagatacgcacggcaatatgtgggtgccaagctag

SEQ ID NO: 210408 - DNA, 1110 bp, Artificial Sequence
  Description of Artificial Sequence: Synthetic coding sequence
atggtgatcagcgagcggctgcggctgaccagcatgccccggcccagtcttaccaggacaagtttatccgctcgcaaaatgatgctgttactctacgaagagggcctgcgcgtggttatacacaccagcaatttgattcatgctgactggcaccagaagacccagggtatctggctctctcccttatatcctagaattgccgacggtacccataagtcgggtgaatcccctacgcatttcaaggccgacctgatctcctaccttatggcatataacgcgccttccctgaaagagtggatcgatgtgattcataagcatgacctgtctgagactaacgtatacctcattggttcaacacccggaaggttccaggggagtcagaaagataattggggacatttccggttaaaaaaattactcaaggaccatgccagctctatgcctaatgctgaatcctggccggtggtcggccagttcagttctgttgggagcttaggggccgatgagagcaagtggctttgttccgaatttaaagaaagcatgcttacactcggaaaagagagcaagactcctgggaaatcctctgttcctttatacttgatttatccctccgtggaaaatgtgagaacttcattggaaggttaccctgctggaggatcattaccctattccatccagactgcagagaaacaaaactggctgcatagttactttcataagtggtctgcagagactagtggacgctcaaatgcgatgcctcacattaagacatacatgagaccgagtcccgatttcagcaaaattgcttggtttctggtgacctctgcaaacctgtcaaaagctgcatggggcgccctggaaaagaatggcacacagctgatgattcgcagctacgagctgggagtcctttttctgcctagcgcgttcggtcttgattcattcaaagtcaagcaaaagttcttcgctggcagccaagagcccatggcaaccttccccgtcccctacgacctgcctcccgagctttacgggagcaaggataggccctggatttggaatatcccctacgtgaaggctcctgacactcatggtaatatgtgggtgccatcctag

SEQ ID NO: 210409 - DNA, 1827 bp, Artificial Sequence
  Description of Artificial Sequence: Synthetic coding sequence
atgagccaggagggcgactacggccggtggaccatcagcagcagcgacgagtctgaggaagaaaaaccaaagcctgacaagccctcgacaagctctctgctctgcgctagacagggggcagcaaatgagcctcgatatacttgttctgaggcccagaaagctgcccacaagaggaagatttccccggtgaaattttccaatacagatagtgtgctccctccaaaaagacagaagagtgggtcacaggaagatctcgggtggtgcctgagttcttccgatgatgagctgcaacctgaaatgccacagaagcaggctgagaaggtggtgatcaaaaaggagaaggacatctcggcacctaacgacggaacagcgcagcgcaccgaaaatcacggcgcacccgcctgtcatagactaaaagaggaggaggatgagtacgaaacaagtggcgaagggcaggacatctgggacatgctggataaaggcaatcctttccagttctacctgacccgtgtgtccggtgtaaaaccaaagtacaattcaggcgcactgcatatcaaggatattctgtctcccctattcggcaccctcgtgagctctgcccagttcaattactgcttcgatgtggattggctcgtgaagcaatacccgcccgagttcaggaagaagccaatcctcttagtacacggcgataagagggaggcgaaagctcacctgcatgcccaggctaaaccgtatgagaatattagcctgtgtcaggcgaagctcgacattgcttttgggactcatcataccaagatgatgcttctgctgtacgaggaaggattgcgagtggtgattcatacctctaacctgattcacgccgactggcaccagaagacacagggtatttggctgtcgccgctttatccgcgcatcgcggacggcacccacaagtctggagagtcccctactcacttcaaggccgatctcatctcctatctcatggcttacaatgccccttcactaaaggagtggatcgacgtgattcacaagcacgacctttctgagacaaacgtgtacttaatcggtagcacgcccgggagattccaaggcagtcagaaggacaattgggggcactttcggttgaagaagctcttaaaggatcacgcttcttcaatgcctaatgctgaaagctggccagttgtgggtcagttctcctcagtgggctctctgggtgccgacgagtccaaatggttatgctccgagttcaaggagagcatgttgaccctcgggaaggagtcaaaaacaccgggcaaaagctccgtacccctgtacctgatttaccctagcgtcgaaaatgtgcgcactagtctggaggggtatccggccggaggctcactgccatacagtattcagaccgccgagaagcagaactggctccatagttactttcacaagtggtctgctgaaacttctggccggtccaatgctatgccccacatcaagacatacatgcggccatcccccgatttttccaaaattgcttggtttctggtgaccagcgctaacctctcaaaggctgcttggggtgccctagaaaaaaacggtacgcagttaatgatacgttcctacgaattaggagtgctgtttcttcccagtgcatttggattggattcctttaaagtaaagcagaaattcttcgccgggtcgcaggaacctatggcgacctttccagtcccatatgacctccctcccgagttgtacgggtcaaaggaccggccatggatctggaacattccatacgtcaaggcccctgacactcatggtaatatgtgggtcccttcatag

SEQ ID NO: 210410 - DNA, 897 bp, Artificial Sequence
  Description of Artificial Sequence: Synthetic coding sequence
atgagccaggagggcgactacggccggtggaccatcagcagcagcgacgagtcagaggaggagaagcctaaacccgataaaccgtcgaccagttcactgctgtgcgctagacagggcgcagccaatgaaccccgctatacctgttccgaggctcagaaggccgcccataagcgcaagataagtcctgtgaagttctccaataccgactccgtactgccccctaaacggcaaaagagtgggagccaggaggaccttggatggtgtttgagctccagtgatgacgagctgcagcccgagatgccccaaaagcaggcggagaaggtggtaataaagaaggagaaagatatctcggccccaaatgacgggactgcccagcgcaccgaaaatcatggagccccagcttgccaccgtctaaaagaggaggaagacgaatatgagacctccggcgaaggtcaagacatttgggatatgctggataaaggaaacccgtttcagttttatcttaccagagttagcggggtgaagccaaagtacaatagcggagctttgcacattaaggatatactgtctccactgttcggaacacttgtgtctagtgctcaattcaactattgcttcgatgtggattggctggtgaagcagtacccacccgaattcaggaaaaagccaatcctgctagttcacggagacaaaagagaagcaaaagcccatctgcatgcacaggctaaaccatatgaaaacatatccttgtgccaagccaagctcgatatcgccttcggcacacaccacactaagatgatgctgctcctgtacgaggagggattgcgcgtggtcattcacacgtctaatctgatccacgcagattggcaccagaagacccaaggcacccacctgtag

SEQ ID NO: 210411 - DNA, 441 bp, Artificial Sequence
  Description of Artificial Sequence: Synthetic coding sequence
atgagccaggagggcgactacggccggtggaccatcagcagcagcgatgaatcagaggaagagaagcccaagcctgacaaaccatctacctcttcgctgttatgcgcccgacagggcgccgcgaatgagccccggtatacatgcagtgaagcacagaaagccgcccataagagaaaaatttccccagtaaaattctctaacacagatagcgttcttcctcctaagaggcaaaagtctggctcccaggaagatctgggatggtgcttgtcatccagcgatgatgagctccagcctgagatgccccagaagcaggctgaaaaagtagtaataaagaaggaaaaggacatcagtgccccaaatgacggaaccgcgcagagaacagaaaaccacggcgccccagcatgccaccggctcaaagaggaagaagacgagtacgaatag

SEQ ID NO: 210412 - DNA, 447 bp, Artificial Sequence
  Description of Artificial Sequence: Synthetic coding sequence
atgagccaggagggcgactacggccggtggaccatcagcagcagcgatgagagcgaggaggagaagcccaaaccagataagcctagcacaagcagcttgctatgtgcccggcagggagcagccaacgagcctagatacacttgctctgaagcgcagaaggctgcccataaacgtaaaatttccccagttaagttcagcaatactgactccgtgcttccccctaagagacagaagagcggatctcaggaggacttgggctggtgcctgagttccagtgatgatgagctccaacccgaaatgccacagaagcaggcagagaaggtggtgatcaaaaaagaaaaagacatatccgccccaaacgatggcaccgcccagcgcaccgagaatcatggagctcccgcttgccaccgccttaaagaagaagaggacgagtatgaaacgagttag

SEQ ID NO: 210413 - DNA, 840 bp, Artificial Sequence
  Description of Artificial Sequence: Synthetic coding sequence
atgagccaggagggcgactacggccggtggaccatcagcagcagcgatgagtcagaagaggaaaaacccaaaccagacaagccctcaacgtctagcttactctgtgctaggcagggcgcagcgaacgaacctcgttacacatgtagcgaagcccagaaggccgcccataagaggaagatttcacctgtcaagttttctaacaccgactcggtcctaccccctaaaagacagaagtcaggctcccaagaggacctggggtggtgtctgtcctcatccgatgacgaactccagccagagatgccccaaaaacaagcagaaaaggtggttatcaagaaagagaaggatatttctgcccctaacgacgggaccgcacagcgaacagagaaccatggggcacctgcatgccaccgtttgaaggaggaggaagacgaatacgagacaagcggagaaggacaagacatctgggatatgctcgacaaaggaaaccccttccagttttacctgacaagggtttccggagtgaagccaaagtacaattcgggagctcttcatattaaagacatcctctctccactgtttgggacactggtgtctagcgcccagttcaactactgcttcgacgttgattggctggtcaaacagtacccccctgagtttcggaagaagcccattttgctggttcacggggacaagagagaagccaaggcccacctgcatgcccaggctaagccctatgaaaacattagcttatgtcaagcgaagttggatattgccttcggtacgcaccacactaaaatgatgctgctactctatgaagaggggctgcgagtcgttatttag

SEQ ID NO: 210414 - DNA, 486 bp, Artificial Sequence
  Description of Artificial Sequence: Synthetic coding sequence
atgagccaggagggcgactacggccggtggaccatcagcagcagcgatgagtcggaggaagaaaagcccaagcccgataagcccagtacaagttccctcctatgcgccagacaaggagccgctaatgagccgaggtacacatgctctgaagctcaaaaggcagcccataagaggaaaatcagccccgtaaaattttccaataccgattctgttctgccacctaaaaggcagaagtctggctcccaagaggacctgggctggtgtctctccagttccgacgacgagctgcagcccgagatgcctcaaaaacaggctgaaaaggtggtgatcaaaaaggaaaaggatatctcggcccctaacgatgggactgcgcagagaaccgagaatcacggcgctccagcttgtcaccggttaaaggaggaagaggacgagtacgagacttccggcgaggggcaggacatttgggacatgctggacaagggctag

SEQ ID NO: 210415 - DNA, 456 bp, Artificial Sequence
  Description of Artificial Sequence: Synthetic coding sequence
atgagccaggagggcgactacggccggtggaccatcagcagcagcgacgaatccgaagaagagaagccaaagcctgacaaaccttccacctcctcattgctgtgtgcccgtcaaggggctgccaatgagcctcggtatacgtgttccgaagcccagaaggccgcacataaaagaaagataagcccagtaaaattctccaacactgacagtgttctgcctccaaaaagacaaaaatcggggagtcaggaggacctcgggtggtgcctctcctcctcggacgatgaacttcagcctgagatgccacagaagcaagccgagaaagtggttatcaaaaaagaaaaagacatatctgctcccaatgatgggactgcacaacgtaccgaaaaccacggtgcgccagcttgtcaccgcctgaaggaagaggaagatgagtacgagaccagcggtgagggttag

SEQ ID NO: 210416 - DNA, 1113 bp, Artificial Sequence
  Description of Artificial Sequence: Synthetic coding sequence
atggtgggcaagctgaagcagaacctgctgctggcctgcctggtgatctcatcagtgactgtgttctacctggggcagcatgcaatggagtgccaccacagaatagaagagcgttctcaaccagtgaagctggaatcgaccagaaccacagtacggactggtctggaccttaaggccaataagaccttcgcctaccacaaggatatgccactcatatttataggcggagttccaaggtctggcaccactttaatgcgcgccatgctcgatgcccaccccgacattaggtgcggtgaagagacaagagtgatcccccgcatcctggccctcaaacaaatgtggagtcgctcatccaaagaaaagattcgcctcgacgaagccggggtgactgacgaagtcctcgactcagcaatgcaggcattccttttagaaatcattgtaaagcatggagagcccgcaccatacctttgtaacaaggatccgttcgccctgaagagcctgacctacctgtcacgcctgttccccaatgcaaaatttttactgatggtgagagatggtagggcttcagtccattctatgataagtagaaaggtgacaatcgctggtttcgacttaaactcataccgtgactgtttaacaaagtggaacagagctattgagacaatgtataatcaatgcatggaggtcggatataagaagtgtatgctggtgcactatgagcagctggtgctgcaccccgaaaggtggatgagaacgctgttgaaatttctgcaaataccctggaatcacagtgtactccatcacgaggaaatgattggtaaggctggtggcgtgagtctgagcaaggtggagcggtctactgaccaggtaatcaaacctgtcaatgtgggcgcactttccaagtgggttggaaagatccctcccgacgtgctgcaggacatggcagtaatcgcacctatgctggccaaactcggctacgacccatatgctaacccgcccaattatggaaaacccgaccccaagattatagagaatacccgccgggtgtataaaggggagtttcaactccctgacttccttaaggagaaaccgcaaactgaacaggttgagtag

SEQ ID NO: 210417 - DNA, 129 bp, Artificial Sequence
  Description of Artificial Sequence: Synthetic coding sequence
atggtgggcaagctgaagcagaacctgctgctggcctgcctggtgatctcaagtgtgaccgtattttatcttggacagcacgccatggaatgtcatcacaggattgaagagcgcagccaacctgtgtag

SEQ ID NO: 210418 - DNA, 423 bp, Artificial Sequence
  Description of Artificial Sequence: Synthetic coding sequence
atggtgggcaagctgaagcagaacctgctgctggcctgcctggtgatctcatctgttacagtgttttacttgggccagcacgcaatggagtgccatcatcgcatcgaagagcgtagtcagccagtcaaattggagagcacacggacgactgtgcggacgggcctagacctcaaggccaataagacatttgcctatcacaaagacatgcccctgattttcatcgggggagtgcctcgcagcgggactaccctgatgcgcgcgatgcttgatgcacatccggatatacggtgcggggaggagacccgagtgattccaagaatcctagccctgaaacaaatgtggagccgtagctctaaggagaagatcaggctcgacgaagctggcgtgacagatgaggttctcgattcagccatgcaggcgtag

SEQ ID NO: 210419 - DNA, 1083 bp, Artificial Sequence
  Description of Artificial Sequence: Synthetic coding sequence
atggtgggcaagctgaagcagaacctgctgctggcctgcctggtgatatcgtctgtcaccgttttttatctgggccaacacgctatggagtgtcaccaccggattgaggaaaggtcccagcccgtgaagcttgagtccacccggaccacagtgagaacgggactggacttgaaagctaacaagacgttcgcctaccacaaagatatgcctttaatcttcattggcggagtgcctcggtccgggactaccttaatgcgggctatgctggatgcccaccctgatatccggtgcggggaggagacccgagttatcccgagaatcttagctctgaagcaaatgtggagccgctcttcgaaggagaagatccgccttgacgaggccggtgtgaccgatgaggtgttggacagtgctatgcaggcctttcttctggagattatcgtcaaacacggggaaccggcaccctacctctgcaataaggacccgtttgcgttaaagtccctaacctacctgagccggctgtttcccaatgctaaatttctgctgatggtgagagacggtagagcctctgtgcatagcatgatcagccgcaaggtgactattgccggcttcgacctaaactcctatcgggactgcttgaccaaatggaaccgcgccatcgagacaatgtataatcagtgcatggaggtcgggtataaaaagtgtatgctggtacactacgagcaattggtccttcacccagaaaggtggatgagaaccttactgaaatttctacaaattccttggaatcatagcgtgctacatcacgaagagatgatcggaaaggcaggaggcgtttccttgtccaaagtcgagagaagtacggaccaggttatcaaacctgtgaacgtcggggctctgagcaagtgggtggggaagatcccccccgacgtgctgcaggacatggccgttatcgcccccatgcttgcgaaattagggtatgacccctatgcgaaccccccgaactatgggaaacctgatccaaagattatcgaaaacactaggagggaaaggctcctcccctttcagcaaaagggtaacagctag

SEQ ID NO: 210420 - DNA, 1134 bp, Artificial Sequence
  Description of Artificial Sequence: Synthetic coding sequence
atgcggctgagcgtgcggcgggtgctgctggccgccggctgcgccctcgtgcttgttttggccgtgcagctggggcagcaggtcctggaatgccgagccgtcttagccggcctgagatctcctcggggtgccatgcgtcccgaacaagaggaattagttatggtgggcacaaatcatgtggagtacagatacggaaaggccatgccgctgatttttgtcgggggggtacctcgctctggtaccaccctgatgagagctatgctggatgcacaccccgaggtaagatgcggcgaggagaccaggatcataccacgggtgctcgccatgcgacaagcatggtccaagtccggtcgcgagaagctgaggctggatgaggccggagtgactgatgaagtgcttgatgcagcaatgcaggcatttatccttgaagtcattgccaaacatggggagcccgctcgggtcctctgcaataaggaccctttcacactgaagagcagtgtgtacctttcaagactattcccaaattcgaaatttctgcttatggtcagagacggaagagcgtctgtgcatagtatgatcactcgtaaagttactatcgcgggttttgatttgagcagctatagggattgtctcacgaaatggaacaaggccattgaagtgatgtacgctcagtgtatggaggtgggaaaggagaagtgcctcccagtctattacgaacagcttgtgctgcacccccgtcgctccttgaagctgatcttagactttctagggatcgcttggtccgatgctgtccttcaccacgaggacctaatcggaaagcctggcggggtgagcctgtctaagattgagcgttcgacggaccaggtgataaagcctgttaatttggaagcactcagcaagtggacagggcacattcccggcgatgtggtcagggatatggcccagatcgcccccatgctggcacagctgggttatgatccctacgctaacccaccaaattatggcaatccagacccattcgtaatcaataatacccagagggtgctaaagggcgattacaagacacctgccaatctgaaggggtactttcaggtgaaccagaattcaacaagtagtcacctgggcagtagttag

SEQ ID NO: 210421 - DNA, 1134 bp, Artificial Sequence
  Description of Artificial Sequence: Synthetic coding sequence
atgcggctgagcgtgcggcgggtgctgctggccgccggctgcgcccttgtgctcgtgctggctgtacaactggggcaacaagtgctggagtgcagggcagtgctcgccgggttgcgctcccccagaggcgccatgcggcccgagcaggaggaactggtgatggtggggactaaccacgtggagtaccgctatggcaaggcgatgccgctaatcttcgtcggcggagtgccgagatccggcacaacgctcatgcgagctatgcttgacgcgcatccggaggtgaggtgtggggaagaaacacgaataatcccaagggtccttgccatgcggcaggcctggtcaaaatcgggcagggagaaactgaggctggacgaggccggggtaaccgatgaggtcctagacgctgctatgcaagcttttattttagaagtaatagccaaacatggggagccggcccgagtactctgcaacaaagaccccttcaccctgaaatcttccgtgtatctgagtcggctgtttcctaattcaaagttcctgctgatggtgagagatggcagagcatcagtgcactccatgattaccaggaaggtgaccatagctggtttcgacttgagctcatacagagattgcctaacgaagtggaacaaagcaattgaagtcatgtacgctcagtgcatggaagtcggtaaggagaagtgtctgccggtttattatgagcagctcgtccttcacccacgaagaagccttaaactcattctggattttctgggaatcgcttggtctgacgccgtgcttcatcacgaggatttgattgggaagccagggggtgtgagtttgtcgaaaatcgagaggtccaccgaccaggttattaagccagtcaacctggaggctctctcaaagtggactggacacattcccggagatgtcgtgcgcgatatggcccagatcgccccaatgctggcgcaactcggctatgacccatacgctaatcccccaaactacgggaaccctgacccctttgtaattaacaacacacaaagagtcctaaaaggtgattacaagacacctgctaacctgaaaggctactttcaagtgaatcaaaactcgactagctcacatctggggtcttcttag

SEQ ID NO: 210422 - DNA, 1134 bp, Artificial Sequence
  Description of Artificial Sequence: Synthetic coding sequence
atgcggctgagcgtgcggcgggtgctgctggccgccggctgcgccctcgttctggtgcttgccgttcagctggggcagcaagtgctcgaatgtcgcgccgtcctggctggcttgcgctcccctcgcggcgcaatgaggccggagcaggaagagttggtgatggttggaacaaatcatgttgagtacagatacgggaaagccatgcccttgatcttcgtgggcggtgttccccggtccggcacaacactcatgcgagctatgctggatgctcacccagaggtgcgttgcggagaagaaacgcggattatcccacgtgtccttgctatgaggcaggcctggagcaagagtgggcgtgagaagcttaggttggatgaggccggagtcacagacgaagttcttgatgccgctatgcaggccttcatacttgaggtgattgccaaacacggggaacctgcccgtgttttgtgtaataaggaccctttcacactcaagtcgtctgtgtatctgagccgattatttcccaattctaagttcctgttaatggtgcgtgatggccgcgccagtgtgcacagcatgattacacgcaaagtcactatagcggggttcgatctgtcctcctaccgggactgtttgaccaagtggaataaagcaatcgaggttatgtatgctcagtgtatggaagtagggaaggagaagtgtttacctgtgtactacgagcagttggtgctgcatccaaggaggtcgcttaaattgatccttgacttccttggcattgcgtggtccgatgccgtattacatcacgaggacctcattggaaagcccggaggcgtcagtctgtccaagatcgagagatccaccgaccaggtgatcaaacccgttaacctggaggctctctccaagtggaccggccacattccaggcgatgtcgtgcgcgatatggctcagatcgctccaatgctggcccagttggggtatgatccctacgccaacccccctaactacgggaaccccgatcctttcgtaatcaacaatactcagcgcgtcctaaaaggtgactacaagacgcctgctaatctgaagggatactttcaagtcaatcagaacagcacaagttcacacctcggatcctcttag

SEQ ID NO: 210423 - DNA, 195 bp, Artificial Sequence
  Description of Artificial Sequence: Synthetic coding sequence
atgcggctgagcgtgcggcgggtgctgctggccgccggctgcgcccttgtattagttctggccgtgcagctcggacaacaggtcctggaatgccgggctgttctggctggcctgcggagcccccgcggtgctatgaggccggagcaagaggaactggtcatggttgggaccaatcatgtggaatacagatactag

SEQ ID NO: 210424 - DNA, 429 bp, Artificial Sequence
  Description of Artificial Sequence: Synthetic coding sequence
atgcggctgagcgtgcggcgggtgctgctggccgccggctgcgccctggtgttggtgctggctgttcagctgggtcagcaagtgctggaatgcagagcagtgctggccggactcaggtcaccacgcggtgcaatgaggcccgaacaggaggagttggtgatggtcggcactaatcatgtcgagtatcgctacgggaaagccatgccattgatcttcgtggggggggttccacgcagtgggacgaccttgatgcgggccatgctcgacgcgcaccccgaggtccggtgcggggaggagacacggatcatcccacgagtgctcgctatgaggcaggcttggtccaagtcaggtcgggaaaaactgagacttgatgaggctggggtaaccgatgaagtccttgacgccgccatgcaagcatttattttgtag

SEQ ID NO: 210425 - DNA, 144 bp, Artificial Sequence
  Description of Artificial Sequence: Synthetic coding sequence
atgcggctgagcgtgcggcgggtgctgctggccgccggctgcgcccttgtgctggtgctggccgttcaactggggcagcaggtgctcgagtgccgggcagtcttggccggactccgaagcccacggggtgcgatgaggccttag

SEQ ID NO: 210426 - DNA, 147 bp, Artificial Sequence
  Description of Artificial Sequence: Synthetic coding sequence
atgcggctgagcgtgcggcgggtgctgctggccgccggctgcgccctggtgctagtcctggccgtgcagctgggacaacaggtgctcgaatgtcgcgccgtactggctggactgcggtcccctaggggcgccatgaggccagagtag

SEQ ID NO: 210427 - DNA, 363 bp, Artificial Sequence
  Description of Artificial Sequence: Synthetic coding sequence
atgcggctgagcgtgcggcgggtgctgctggccgccggctgcgccctggttctggtgctggccgtgcaactcggtcagcaggttttagaatgtcgcgctgttctggctggtctacgatccccccggggagctatgcgccctgagcaagaggagctcgtgatggtggggactaaccacgtcgaatatagatacggaaaggccatgccgctgatctttgtgggcggcgttcctcggtcaggaaccactctgatgagagctatgcttgatgctcatcccgaagtgcgctgcggggaggaaacaaggatcatcccacgcgtcctggctatgagacaagcgtggtcgaagagcggcagggagaagtag

SEQ ID NO: 210428 - DNA, 933 bp, Artificial Sequence
  Description of Artificial Sequence: Synthetic coding sequence
atgcccctgatcttcgtgggcggcgtgccccggagcggcaccaccctgatgcgcgcgatgttggacgcccaccccgaggtgagatgtggagaagaaactcgcataattcccagggtactggcgatgagacaagcctggtccaaatccgggagggaaaagctcaggcttgatgaggcaggcgtgaccgatgaggtgctcgacgccgccatgcaggcattcattctggaagttattgccaagcacggtgagcccgcgcgggtcctgtgtaataaagatccatttactctgaaaagttcagtgtatttgagtcgtctttttcccaattctaaatttctactgatggtgcgggatggccgggcttctgtacactcaatgatcaccagaaaagttactatcgctgggtttgatctttcatcttaccgcgactgtctcacaaagtggaataaggcaattgaagtgatgtatgctcaatgtatggaggtgggcaaggagaagtgcctccccgtttactatgagcagttggtgctccatccacgaagaagtttgaagttaattctggattttctcggaattgcatggtcagacgcagtgctgcaccatgaggatctgataggcaaacccggaggggtgtctttgtccaagattgagcgttccactgatcaggtgatcaaaccagtcaatttggaggcgttaagcaagtggaccggccatattcctggtgacgttgtgcgcgatatggcccagattgcaccaatgctggcccagctgggttacgatccctatgcaaatccccctaattatggcaatccagatccattcgttattaataacacacagcgcgttttaaaaggcgactataaaacccccgcaaacctgaaaggctatttccaggttaatcagaactccacatccagccacctcgggtctagctag

SEQ ID NO: 210429 - DNA, 1587 bp, Artificial Sequence
  Description of Artificial Sequence: Synthetic coding sequence
atgggcgacgcccccagccccgaggagaagctgcacctgatcacccggaaccttcaggaggtgctcggagaagaaaaactgaaagaaatcctcaaggaacgtgagctgaaaatttactggggcactgctactacaggtaaacctcacgtcgcctacttcgtgcctatgtcaaagatcgcagacttccttaaggcgggctgtgaagttacaatcctgttcgcagatctacacgcgtatctggataatatgaaggccccctgggagctcctggagttgagggtttcttactatgaaaacgtcatcaaggccatgcttgagagtattggtgtaccactagagaagctgaaatttattaagggcacagactaccagttgagtaaagagtacacgcttgatgtatatcggctgagttctgtggtcacacagcacgacagtaagaaggcaggcgccgaggtagtcaaacaggttgagcaccctctgcttagtggcttgttgtaccccggactgcaggcgctggacgaggagtatttgaaggtggacgcccagttcggcgggatcgatcagagaaaaatctttacctttgcagaaaaatacctcccagcacttggctactcaaaacgggtgcatttaatgaatccgatggtgccaggactcaccggcagcaagatgtccagctcagaggaggagtcaaaaattgacttactggaccgcaaggaggatgttaagaaaaagttgaagaaagctttctgcgaacccgggaatgtggaaaataatggcgtcctatcattcattaagcatgtcttgtttccacttaaaagcgagttcgtgatcctcagggatgagaagtggggcggtaacaagacatacactgcctatgtcgacctggagaaggacttcgccgcagaagtcgtgcatccaggtgacttgaaaaacagcgtcgaggtcgcactaaacaaattgctggaccctatccgagagaagtttaacacacccgccctgaagaaattggcttctgccgcctatcctgatccctccaagcagaagcctatggccaaaggccccgccaagaactccgaaccagaggaggtcatcccttccagactcgacattagagtcggaaaaatcatcacggtggagaaacatccagatgccgattctctgtacgtggaaaaaatcgatgtgggcgaagctgaacccagaacagtagtgagtggcctggtacagttcgttcccaaggaagagttgcaagatagattagtggtggtgctttgtaacctcaaacctcaaaagatgcggggcgttgagtctcagggcatgttgctctgcgcttccatagagggcattaatcggcaggtcgagcccctggatccaccggcaggatccgctcctggcgaacacgttttcgtcaagggatatgagaaggggcagccagatgaagagttgaaaccaaagaagaaggtcttcgaaaagctgcaggcggactttaagattagcgaggagtgtattgcgcagtggaaacaaacaaactttatgacgaagctaggctcaatttcttgcaaatcgctcaaggggggtaacatttcttag

SEQ ID NO: 210430 - DNA, 1434 bp, Artificial Sequence
  Description of Artificial Sequence: Synthetic coding sequence
atggccgcccccatcctgcggagcttcagctggggccggtggagcggaacattaaacttatccgtgctgctgcccctcggcctgaggaaggcacacagcggggcgcagggcctgcttgctgcccagaaagctaggggactcttcaaagatttttttcctgagaccggaacaaaaatagaattgccagagctgtttgaccgcggaaccgcgagttttccccagacaatttactgtgggtttgacccaaccgccgatagcctgcatgtagggcacctgttggcgctacttggcctttttcacctgcaacgcgctggacacaatgtgatcgccctagtgggaggcgccactgcaagattgggagatcccagcggacgcaccaaagagcgcgaggctctggagaccgagcgggtcagagctaatgctagagccctgcgtttgggactcgaggctcttgcagcaaatcaccagcagctctttaccgacggcaggtcctgggggagctttaccgtactggataacagcgcatggtatcagaagcagcacctggtggattttctggccgccgtgggcggacatttcaggatgggcactctcctgtctagacagtccgtgcagctccggcttaagagccctgagggcatgagtctcgccgagttcttctaccaggttttgcaggcctacgacttctattacctcttccagcgatacgggtgcagggtccagttaggcggtagtgaccagttgggtaatatcatgagcggctatgagttcattaataaactgaccggtgaagacgtcttcgggattaccgttcccctgatcactagcacgaccggggcaaaactcggcaagagcgccggcaatgcggtctggttgaatcgcgataaaacgagtccatttgagctgtaccagttctttgttagacagccggatgattctgttgagcggtacctgaagctgttcacctttctgcctctccccgagatcgatcatatcatgcaacttcacgtgaaagaaccggagcggaggggcccacagaagagacttgctgcagaggtaacaaaactggtacacgggcgcgaaggcctggattctgcaaaacgttgtacccaggctctctatcattcatcaatagacgcgcttgaagtgatgtccgaccaggaactgaaagagctatttaaggaagctcccttcagcgaatttttcctggaccccgggacgagcgtgcttgatacctgtcgaaaggctaatgccattccggatgggccacgcggctatcggatgattacagaaggcggagtgtcaatcaaccatcagcaggttaccaacccagaaagtgtcctcatcgtaggacagcacattcttaaaaatggtttgagcctcctgaaaatcggcaaaaggaatttctatattattaagtggctgcaactgtag

SEQ ID NO: 210431 - DNA, 723 bp, Artificial Sequence
  Description of Artificial Sequence: Synthetic coding sequence
atggccgagtacctggccagcatcttcggcaccgagaaggacaaggttaactgctccttctactttaagataggagcttgccgccacggtgatcggtgtagtcgcctacataataagcccaccttttcccaaactatagctctgctgaatatctaccggaatccacaaaacagttcacagtctgcagatggactgaggtgtgctgtgtctgacgttgagatgcaggagcactacgatgagttctttgaagaggtgtttaccgaaatggaggagaagtatggagaagtcgaggagatgaacgtatgcgataatttgggcgaccatttagtgggaaacgtgtacgttaagtttcgccgagaggaagacgctgagaaggcagtgattgacctcaataatagatggtttaatggccagcctatacacgccgaattatcaccagtgacagattttagagaagcttgctgccgtcagtatgagatgggggagtgcacccggggcggtttctgcaacttcatgcaccttaagcctatctcacgcgagctccgacgcgaactgtacggccgacgtcgcaaaaagcaccgttcccgttcgcgctcccgagaacggcggtctcgtagccgcgacagggggagaggcggcggcggaggcggagggggcgggggaggcggtagggaaagagatcgtcgcaggagtagagatcgagaacgatccggtcggttctag

SEQ ID NO: 210432 - DNA, 723 bp, Artificial Sequence
  Description of Artificial Sequence: Synthetic coding sequence
atggccgagtacctggccagcatcttcggcaccgagaaggacaaggtgaattgctccttctatttcaagatcggagcatgtcgacacggggatcggtgttcaaggctgcataacaaacccacgttttctcagactattctcatccagaatatatatcgcaatccccaaaactcagcccagacagcagacggatcccattgtgcagtttccgacgtggagatgcaggagcactacgatgagttctttgaagaggtgttcactgaaatggaggagaagtatggtgaagtcgaggagatgaacgtttgcgacaacctcggcgaccatctcgtgggcaacgtttatgtcaagtttaggcgggaggaggatgctgagaaggcggtgatcgacctcaacaacaggtggtttaacggccagccaatccatgcggagttgtctccagttactgattttagagaagcctgttgtcgccagtacgagatgggcgaatgcacaagaggcgggttctgtaatttcatgcaccttaaaccgatttcccgggaactgcggagagaactctacgggaggcgaaggaagaagcacaggtcgcgctcccgatcccgagaacgaaggagcaggtcacgcgacagaggacgcggcggcggagggggaggaggagggggcggcggcggcagggagagagatcgccggcgatccagagacagggagagatcaggaaggttttag

SEQ ID NO: 210433 - DNA, 504 bp, Artificial Sequence
  Description of Artificial Sequence: Synthetic coding sequence
atgcaggagcactacgacgagttcttcgaggaggtgttcaccgagatggaagaaaaatatggcgaggtggaagaaatgaacgtctgtgacaaccttggcgatcatctggtgggtaacgtgtatgtgaaattcagacgggaagaagatgcggagaaggccgtgatagatctgaataatagatggtttaacggccagccaatacacgctgaactgtctcctgttactgattttagagaggcttgctgcagacagtatgaaatgggggagtgcacacgtggcggcttctgtaacttcatgcatctgaaacccatttcccgcgagctgcgcagggagctctacgggcggcgccggaagaagcatcggtccagaagtcggtcgcgggaaaggagaagcaggagtcgggatcggggtaggggcgggggcgggggcgggggcggaggaggcggaggtcgcgagcgggacaggcgcagaagtcgcgacagagagcgctccggccgtttctag

SEQ ID NO: 210434 - DNA, 504 bp, Artificial Sequence
  Description of Artificial Sequence: Synthetic coding sequence
atgcaggagcactacgacgagttcttcgaggaggtgttcaccgagatggaagagaagtacggtgaggtggaggaaatgaacgtgtgcgacaatctaggggaccacctcgtcgggaacgtatatgtgaagttccgacgggaggaagatgctgaaaaggccgtgatcgacctgaataatcggtggtttaatgggcagcccattcatgccgaactctcccctgtgaccgacttccgcgaggcttgctgtcgtcagtatgaaatgggagagtgtactcgagggggattttgcaatttcatgcacctgaaacctatatcaagggagctacggcgcgagttgtacggaagaaggcgcaaaaagcatagaagtcgatctagaagcagggagagacggagcaggagcagggacagggggcgcggtggcggggggggaggcggggggggcggcggcgggagagagcgagaccggagacggtcccgggacagggagcggtcaggtagattctag

SEQ ID NO: 210435 - DNA, 1218 bp, Artificial Sequence
  Description of Artificial Sequence: Synthetic coding sequence
atgttcgtgcaggaggagaagatcttcgccggcaaggtgctgcggcttcatatttgtgctagcgacggagcagagtggttggaagaagcaacagaagacacatcagttgagaagctgaaggaacgctgtctgaaacactgcgcacacggatcactggaggatcccaaatcaataacacatcacaagctgattcatgcagctagcgaacgcgtcctttctgacgcccgcacaatactggaggagaatatccaggatcaggatgtgttgctgctgatcaagaaacgcgctccgtctccactgccaaagatggctgacgtgagtgcagaggaaaagaaaaagcaagatcagaaagcacccgacaaggaggctattctgcgagcaaccgcaaacttaccttcatataacatggacagagccgcggttcagaccaacatgcgggacttccaaaccgaattacgtaaaattctagtcagcctaatcgaggtggcccagaaacttctggcgcttaaccctgatgctgtggaactcttcaagaaagctaatgctatgctggatgaagacgaagatgagagagtggacgaggccgccctaagacagctgactgagatgggttttcctgagaacagagccacgaaagcgctgcagctgaatcacatgagcgtgccccaggctatggaatggttgattgagcacgccgaagaccctacaatcgataccccactgccaggacaagcacctcccgaagcagaaggagccaccgccgctgcttcagaggctgcggctggcgcgagtgcaaccgatgaagaagctagggatgaactgaccgaaattttcaagaaaattcgccggaagcgggagtttcgggcggatgcaagagctgttatttctctgatggaaatgggcttcgacgaaaaagaggtgatcgacgcccttcgagtaaataataaccagcagaatgctgcctgcgaatggttactcggagatcgaaagccctccccagaagagctcgacaaaggaatcgatccagactctccgctgttccaggcaatactggataacccagtggttcagctcgggttaacaaatcctaaaaccctcctggcatttgaggacatgctggagaaccctctgaattcaactcagtggatgaacgaccccgaaaccggaccagtgatgttacaaatatcacgcatcttccagacgctgaatcgtacgtag

SEQ ID NO: 210436 - DNA, 540 bp, Artificial Sequence
  Description of Artificial Sequence: Synthetic coding sequence
atggccgccagccaggtgctgggcgagaagatcaacatcctgagcggcgagaccgttaaagccggggacagggatccactcggaaacgactgtcccgagcaggaccgcctcccgcagagatcttggagacagaaatgtgccagctacgtgttggcactcaggccttggtcttttagcgcctcccttacccccgtcgccctcgggtcggccctcgcttatcgctcccacggtgtacttgaccccaggctgctggtgggctgcgctgtcgctgtgttggccgtgcatggcgccggaaatctcgtcaacacttattacgacttctccaaaggcatcgatcataaaaagtcagacgaccgaaccctcgtcgacagaattctagaacctcaggatgtagtgcgcttcggcgtcttcctatacacattggggtgcgtatgtgcggcttgtctatactacctgtctcccctgaagctcgagcacttggctcttatctattttgggggactaagcggctctttcctgtacacgggcgtactgatctag

SEQ ID NO: 210437 - DNA, 1017 bp, Artificial Sequence
  Description of Artificial Sequence: Synthetic coding sequence
atggccgccagccaggtgctgggcgagaagatcaacatcctgagcggcgagaccgtcaaagccggggacagggatcccttaggcaacgattgtcctgagcaggaccgccttccccaacggtcttggagacagaaatgtgccagctacgtgctggccctgcgaccttggtctttctctgccagcttgacccctgtggctctggggtcagccttagcctatcggtcacacggggtgcttgaccctcgactgttagtaggatgcgctgttgccgtgctggccgtgcacggtgcgggcaacctggtgaatacctactacgatttctctaagggcatagatcataaaaaatcggatgacagaaccctcgttgacaggatcctggagcctcaggacgtggttaggttcggggtcttcttgtataccctgggttgtgtgtgtgctgcgtgtctctactatctgagcccattaaagctggaacacctggctttgatttatttcggtggccttagtggatcatttttatacactggagggatcggatttaagtacgtagcactgggagacttgatcatcctgatcactttcgggcctctggcagtgatgtttgcctacgccattcaggtggggtcactggccatattcccactagtgtacgctatccctctggcactgagcacagaggccatcctccatagcaataacacacgggacatggagtccgatcgtgaagccggaatcgtcacacttgccatcctgataggacccacattctcctacatcctatacaatactctcctgtttctgccatatttagtctttagcatattagcgacacattgtaccataagcttggctctgcccttactgactatccccatggcattttctctcgagcgccagttcagatcccaagccttcaataaacttccccaaaggaccgccaaactcaacctcctgctcggcctgttctacgttttcggcattattctcgcgcctgcaggatctcttccgaagatctag

SEQ ID NO: 210438 - DNA, 3405 bp, Artificial Sequence
  Description of Artificial Sequence: Synthetic coding sequence
atgagcgagccccaccgggtgcagttcaccagcctgcccggcagcctcaatccagcattcctgaagaagtcaaggaaagaagaggcaggggctggggagcagcatcaggattgtgagcccgcggcagccgctgtgcgtatcactctgaccctgtttgaacctgaccacaaaaggtgtccagagttcttctacccagagctcgttaagaacattcgggggaaagtaaaggggctgcagcccggggataaaaagaaagatcttagcgaccctttcaatgacgaagagaaagaacggcacaaggttgaggcactagccaggaaattcgaggaaaagtacgggggaaaaaagagacgcaaggataggattcaagacctcattgatatgggctacggttacgacgagtctgactcatttatcgataacagtgaggcgtacgacgagttagtacccgcatctctgactaccaagtacggcggcttctatatcaatagtggcacactgcagtttagacaggctagtgagagtgaagacgactttattaaggagaagaagaaaaaatccccaaagaagcgaaaactgaaggaaggcggcgaaaagatcaaaaaaaagaaaaaggacgacacatatgacaaggaaaaaaagtctaagaagagcaagttctctaaggccgggttcactgctctcaatgctagcaaggaaaaaaagaagaagaaatatagcggagccttgagcgtaaaagagatgctgaagaaattccaaaaagagaaggaggcgcagaaaaagcgagaagaggaacacaagcctgtggccgtacctagtgccgaagctcagggcctaagagaactggaaggggcctccgatccactactgtccttattcggctccacatcggataatgacctcttacaggctgccacagcaatggattcacttacagacctcgatctggaacaccttctgtctgagtcaccagaggggagcccgttcagagatatggacgatggatctgattcccttggagtgggcctggaccaagagttccgacagccatccagcttacctgaaggattaccagcacccctcgaaaagcgggtgaaggagttggcgcaggccgcccgtgccgccgagggtgagagcaggcagaaattttttacacaagatatcaacgggatactgctggacatcgaggcgcagacccgtgaactgtctagtcaggttcgatccggcgtgtacgcatatttagcctcattcctgccctgctctaaagacgctttgctaaaaagagctagaaagctgcacctctacgaacagggaggacgccttaaagagccattacagaagctgaaagaagcaattggccgggcaatgcctgaacagatggccaagtaccaggatgagtgtcaggcccacactcaagcaaaagtcgccaaaatgctcgaggaggagaaggacaaagagcagagagaccgcatttgcagcgacgaagaagaagacgaggagaagggcgggaggaggatcatgggtccacgtaagaagttccagtggaacgatgaaattagggaactgctgtgccaagtggtgaaaataaagctggaaagccaggacctagagcggaataacaaagctcaggcatgggaagattgcgtcaagggtttcttggacgccgaggtcaaacctctttggcctaaagggtggatgcaggcgcggactctgtttaaagagagcagacgcggccatggacatcttacgagtatcttagctaaaaaaaaagtgatggcgccctccaagatcaaggtaaaggaaagctcaacgaagcccgacaagaaagtttctgtacctagcgggcagattggcggccctatcgccctcccaagcgaccatcagaccggaggtctgtccattggcgccagtagccgagagctgcctagccaggccagcgggggactcgcaaaccctccccccgtgaatcttgaggattctcttgacgaggacttgatcagaaacccggcctcttccgttgaggccgtcagtaaggaattagccgccttgaactcccgggcagcgggcaattcagagttcaccctgccagccccttccaaggcccctgcagaaaaggtaggtggggtactgtgtacagaggaaaagcgaaatttcgccaaaccgtccccctcagccccacctcccgcgtcatcattgcagagcccactaaatttcttggccgagcaggcattggcactcggacagtcatctcaggagaagaagcccgaatcatctggatataaagaactctcttgccaggctccactcaacaaggggctcccagaagtgcaccagtccaaggccaaacatcacagcttgccgcggacctctcacgggccccaggttgcagttccagtgcctggccctcaggtgaaggttttccacgctggtactcaacagcaaaagaattttactcccccaagcccattcgccaacaaactgcagggccctaaagcctcgcctactcagtgccaccggagcttactacagcttgttaagaccgccgccaaagggcagggctttcatccctctgctccagctacatctgggggtctctctgcctcatctagcagctcccacaagacacctgctagctcgtctagtgccttgtcgcatccggcgaaaccccatagtgtgagcagcgctggctccagctataaaaacaacccttttgccagcagcattagcaaacatggagtgtcctcaggcagtagcagcagtggcgggacccctgtgcaatcgagcgtgtccggtagcctcgtgcccggcatccagccaccctccgtggggcaagccaccagcagaccggtgccatcgtccgcaggcaagaaaatgcccgtatcgcagaaactcacgctcgtagccccaccaggtgggccgaacggggactcttcagggggaacgcagggtgtggccaagttattaaccagtccctccctgaaaccttcagctgtgagttcagtgacctcctccaccagtttgagtaagggggctagtggcaccgtgctgctggcaggtagttctctaatggcgagtccttataaaagcagctccccaaaattgtctggagccatgtcctccaattccctgggcataattacacccgtgccgatccctgttcatgtgcttagtttcagcgcagattcatccgcaaaggcgggagtgtccaaagacgccatagtcacagggccagcgcctggatctttccaccacggattaggccactcactgctggccggacttcattccagccccccacacgccgcaccactgcctcacgccgcagtgcctacacatatcccacagagtctgcccggtgcaagccaactacacggaaaagggcccgcagtaccacgtaaattatag

SEQ ID NO: 210439 - DNA, 3405 bp, Artificial Sequence
  Description of Artificial Sequence: Synthetic coding sequence
atgagcgagccccaccgggtgcagttcaccagcctgcccggcagcttgaacccagcatttcttaagaagagtcgcaaagaagaagctggagctggcgagcagcaccaggactgcgaaccagctgcagctgcagtgaggatcaccctcaccctgttcgaacccgaccacaaacgatgtcccgagtttttttatcctgagttggtgaagaatatcagaggaaaagttaagggcttacaacctggcgacaaaaaaaaagacctcagtgacccgttcaatgacgaagagaaggagaggcataaagtagaggcgctggcccggaagtttgaggagaaatacggtggcaaaaagagacggaaggaccggattcaggacttaatcgacatgggttacggctatgacgagagtgactctttcatcgataactctgaggcgtatgacgagcttgtgcccgcaagcctgacaaccaagtatggaggcttttacattaatagtggaactcttcagtttcggcaagcctccgaatctgaggatgacttcattaaggagaaaaaaaagaaatcccccaagaagcggaaactgaaagaggggggcgagaaaatcaagaagaagaaaaaggatgatacttacgacaaggagaagaagagcaaaaaatcgaaattctccaaggcaggctttaccgcccttaacgcttccaaagagaaaaagaaaaagaagtattctggggctctaagtgtgaaggagatgttgaaaaagttccagaaagaaaaagaagcccagaagaagcgggaggaggagcacaaaccggtggctgtaccatctgcagaggcccaaggtctgcgcgagctggaaggtgcctcagaccccctgctaagcctcttcggctccacaagcgacaacgatctgctgcaggctgctaccgctatggacagccttactgacctggacttggaacatttgctgtccgaaagccccgagggatctccctttcgggatatggatgatggaagcgattcattgggagtggggctggaccaggagttcagacaacccagttctctccccgaaggcctccccgcccctcttgaaaaaagagtgaaggagctcgctcaggccgcaagagcagcggaaggcgagagccggcaaaagttcttcactcaggacattaatggtatcctcctggacattgaagcccagaccagggagctgtcaagccaggtgcggtcaggagtttacgcttacctggcatcctttctgccttgctcaaaagacgctcttcttaagcgagctaggaagctgcatctgtacgagcagggagggcgactgaaggagccactccagaaattgaaggaagcaatcggccgggctatgcccgaacaaatggcaaaataccaggacgagtgtcaagcacatacacaggccaaagtagcaaagatgcttgaagaggagaaagacaaggagcagagggatcggatatgctccgacgaggaggaagatgaagaaaaaggcgggagaagaattatgggtcctcggaagaaattccagtggaatgatgagattcgtgaactgctctgccaagtggttaagatcaaactcgagagccaggacctggagcgaaacaacaaagcgcaggcttgggaggattgcgttaagggtttcctcgatgctgaggtcaaacctctctggcctaaggggtggatgcaggccagaaccttgttcaaagagtctagacggggacatggtcacctgacatctatactcgccaagaagaaagtgatggcgccgagtaaaatcaaagtcaaagagtcgtccaccaaacccgacaagaaagtgtccgtaccttctggacagataggaggcccgatcgccttaccatccgaccatcagactggtggtttgtctatcggcgcatcaagccgcgagctgccaagtcaggccagcgggggcctggccaatccccctccagtgaatctggaagactctctggatgaggatctaatcaggaatcctgcctcttccgtagaggcagtgtctaaggagcttgccgcacttaatagtagagccgctggaaattctgagttcactcttcccgccccttccaaggctccagccgagaaggtcggcggggtactgtgtaccgaggagaagaggaacttcgctaagccatctccctcggctcctccgcctgcctcgagcctccagtcccccctcaactttctggccgaacaggcccttgcccttgggcaaagctctcaggagaaaaagccagagagcagtggatataaagagctgagctgccaagcgccgctgaacaaaggtcttcctgaggtgcaccagagtaaagcgaagcaccactctctgccacgtacatctcacggacctcaggtagccgtgccggtacccggtccacaagttaaggtgttccatgcagggactcaacaacagaagaacttcacaccacctagtccctttgcgaacaagctgcagggcccgaaagccagtcccactcagtgccaccgaagcctccttcagctagtgaagacagcggccaaaggtcaggggttccacccctccgcccctgccacttctggaggcctctctgcttctagctcttctagccacaagacgccagccagcagctctagcgccttatcccacccagctaaaccacacagtgtgtcatccgcaggtagtagctataagaacaatccattcgcaagttctatatctaagcacggggtctcatccggcagctccagcagcggaggcacacctgtgcagagtagcgtttccggatcactggtgccaggtatccagcccccaagtgtcgggcaagctacaagcaggcccgtgccatcctcagccggcaaaaagatgccagtgtcacagaagctgacattggtcgcgcccccaggtgggcctaacggtgatagcagcggaggcacacagggggtggccaaactccttacttcaccctccctcaagccgagtgccgtgagctctgtgactagtagcaccagcctgtccaagggcgccagcgggactgtgctgctggccggctcttccctgatggcatcgccctacaaatctagcagcccgaagttgagtggtgccatgtccagtaattctctcgggatcattacgcccgtgcctattccagtccacgtgctgagtttttccgccgattcatctgcaaaggctggcgttagcaaagatgctatagtgaccgggcctgcccccggatcattccatcacgggttgggccactcactcctcgctggcctgcatagtagtccgccacatgcggcgccactccctcacgctgcggtgccaactcatataccgcagtcattgccaggggcctctcagctccacggcaaaggacccgctgtcccaagaaaactttag

SEQ ID NO: 210440 - DNA, 3315 bp, Artificial Sequence
  Description of Artificial Sequence: Synthetic coding sequence
atgagcgagccccaccgggtgcagttcaccagcctgcccggcagcctcaaccccgctttcctgaaaaaatctcggaaagaagaggctggggcgggcgaacagcaccaggactgtgaacccgccgccgcagctgtaaggataaccctcaccttgtttgagcctgatcacaagcgatgccctgagtttttttatcccgaattagtgaagaatatccgtgggaaggtgaagggtctgcaacccggggataagaagaaggacttgtccgacccctttaacgacgaagagaaagagcgccacaaggtcgaggccctggcgcgcaagttcgaagaaaaatatggcggaaagaagcggcgaaaggaccgaatccaagacctaatagacatgggctacgggtacgatgagtctgacagttttatcgataactcagaggcttacgatgagctggtacccgcatcccttaccaccaaatacggcggattctacatcaacagtgggactttgcagtttcggcaggccagcgagtccgaggatgactttatcaaggaaaagaaaaagaagagcccaaaaaagcgcaagttaaaggaggggggcgagaagatcaagaaaaagaaaaaggacgatacgtatgacaaggagaaaaaaagtaaaaagtccaagttcagcaaagcaggcttcaccgccctgaatgctagcaaggagaaaaagaaaaaaaaatactccggcgctctgagcgtgaaagagatgctcaaaaaatttcaaaaagagaaggaagcccaaaaaaaacgcgaagaggagcacaagcctgtcgccgtgccttctgctgaagcacagggacttcgagaactggagggggcctctgaccccctgttgtcactctttggatcgactagtgataacgaccttctccaggctgctacagcgatggactcgctcacggacttagacctagaacatctgctgagcgaatcccccgagggaagcccattccgcgacatggacgacggctccgattctctaggcgtcggcctcgatcaagaattccgacagccttcttccctgcctgaagggctcccagccccactggagaaacgagtgaaggagctcgctcaagctgccagggctgcagagggagaatccagacaaaagttcttcacccaagatattaacggtatcctgctcgatattgaggcgcagactagggagctctctagccaggtccgatctggagtgtacgcttatctcgcctcttttttgccatgttccaaggatgcccttttaaagagagcccggaaactccacctctacgagcagggcgggcggctcaaggagcctctgcaaaaactcaaggaagccattggcagggccatgcctgaacagatggccaaatatcaggatgagtgccaagctcatacccaggccaaggtggcgaagatgctcgaggaggagaaagacaaggagcaacgagaccgaatctgttctgacgaagaggaggatgaggagaagggagggcggagaataatggggccccggaagaaatttcagtggaacgacgagatcagagagctgctgtgtcaagtggtgaaaataaagctcgagagtcaggacctcgagcgcaataacaaggcccaggcctgggaagactgtgtgaagggctttctggacgcagaagtgaaacccctttggccaaagggctggatgcaagccaggacactgtttaaggagtcccgtcggggtcacggccatctaacaagcatcttagcgaaaaaaaaggtgatggccccaagcaaaatcaaggtgaaagagtcctcaactaagcccgataagaaagtgagcgtgccaagtggccagattggtggccctatcgcactccccagcgatcaccagactggaggcctctccattggcgcaagtagccgggaactgccctcacaggccagtgggggactggctaacccacccccagtgaacttggaggacagcctggatgaggacctgattagaaatcccgcatctagcgttgaggcggtcagcaaagaactcgccgctttaaattctagagccgcaggtaatagcgaattcacactaccagccccgagtaaggctccagctgagaaggtcggaggagtgctctgtacagaagagaaaaggaattttgccaaacctagccccagtgctcctcccccggcaagctccctccagagcccactgaatttcctggcagagcaggcattagccctggggcagtccagccaagaaaaaaagcccgagagctccggttataaggaactatcttgtcaagccccccttaacaaaggcctgcccgaggttcaccagtccaaggcaaaacatcatagtctcccaaggacatctcatggccctcaggtggccgttcctgtgcccggtcctcaggtgaaggtgtttcatgcgggtacccagcagcaaaagaatttcactccacctagccctttcgccaacaaactgcaggggccaaaagcatcacccacacagtgccaccggagtcttctccaactcgtcaagaccgctgccaaagggcaggggttccatcctagtgcacccgcaacttcagggggtttgtccgcgagctctagttccagtcacaaaaccccggcttcatcttcctccgctttaagtcatcctgctaaacctcactccgttagctccgctggcagctcctataagaataatcctttcgcttcctcaatttcgaaacatggcgtttcctctgggagctcatcgtctggtggaactccagttcaatcatctgtgagcggatcactcgtgcctggaatccagccacccagcgtgggccaggccacctctcgaccagtgccttcttcagctggtaagaaaatgcccgtgtctcagaaactgaccctggtcgccccacctggggggccaaacggcgactcatcaggaggcacacagggggtggccaagcttctgacttcaccatcacttaaaccatctgccgtgagctctgtgactagctccacctcattgagcaagggtgcaagcggcactgttctgttagccgggtccagtctgatggctagtccttataaatcatcaagtcctaagctaagcggagccatgtcaagtaacagtttgggtattatcaccccggtaccaatacccgtgcacgtactgagcttcagcgcagattcctccgccaaagccggtgtcagtaaggacgcaatagtgacaggcccggctccaggctccttccaccacgggctgggacatagtgccagccaactgcacggcaaaggtcctgctgtgcccaggaagctgtag

SEQ ID NO: 210441 - DNA, 3795 bp, Artificial Sequence
  Description of Artificial Sequence: Synthetic coding sequence
atgagcctgcagcgggagcccccccggcccgagccccccccccccttcccgccacttccattacaacctccacccccacgagagtccgcgtctcgggcagaacagccacccaggccccctcgcgaaactgttcggctcgaacttgtcctcaaggatcccaccgacgaatcttgcgtggagttttcctatcctgagctcctattgtgcggcgagcaaaggaaaaaacttatacacacagaagacccgtttaacgacgaacatcaagagcgtcaggaagtggaaatgctggccaaaaagttcgaaatgaaatatggcggcaagcctcggaagcacagaaaagaccggttgcaagatctcatagacatcggttttggctatgacgagaccgaccccttcatcgataacagcgaggcgtatgatgagttagttccggcatctttgaccacaaagtatggggggttctatattaatactggaaccctacaattccgccaggcatctgataccgaggaagatgacattaccgataaccagaaacataagccccccaaggttcctaagattaaagaggacgacatcgaaatgaaaaagcgaaagcgcaaggaggagggcgagaaggagaagaaaccccggaaaaaagtgccaaaacagcttggggttgtcgccttaaactcccacaagagcgaaaaaaagaaaaagcggtacaaagattcattgagtctcgctgccatgatccggaagttccaaaaggagaaagacgccctcaaaaaagagagcaatcctaaggttcccgtgacccttagcactccttccctcaataaacccccctgcgctgcagctgccctggggaacgacgtgccggacttaaacttgtcaagcggcgatccggatctaccaatttttgtgagtacaaacgagcacgaattgttccaggaagcagagaatgcacttgagatgctagacgactttgactttgatcggctgctggacgccgcgagtgatgggtcgccgctgtcagaatctgggggcgagaatggaacgacaacacagccgacctacacaagccaggtgatgcctaaagtcgtgccaactctacctgagggactgcccgttttgctggaaaaaaggatagaggatttacgcgtggccgcaaaactgtttgatgaagagggtaggaagaagtttttcacccaggatatgaacaacatcttgctggacatcgagctccaactgcaggagcttgggccagttatccgctctggcgtgtactcacatctagaggcctttgtcccttgtaacaaggagacgctggtcaagcggctgaaaaaattacatttgaatgtacaggacgaccgcctgcgggaacctctccagaagttgaagctagctgtaagcaatgtgatgcctgaacagctctttaagtatcaggaggattgccaggcaaggagtcaggcgaaatgtgccaagttgcagaccgatgaggagcgggagaagaatggctcagaagaagatgatgacgaaaagcctggcaaaagggtcattggccctaggaaaaaatttcattgggacgatacgatccgcaccctgctatgcaacttggtcgaaatcaaactggggtgttacgagttggagcccaataagagccagtccgctgaagactacctgaagtctttcatggaaacagaggtgaagccattgtggcctaaaggatggatgcaggcccggatgctttttaaagaatcaaggagcgttcataaccacctaacatcagccccagcaaaaaagaaggttattccagctcctaaacccaaagttaaggaagtgatggtcaagaccctacccctgcattcatttcctacaatgctgaaggagtgcagccctaagaaggaccagaaaaccccaacatcactggtggcgtctgtctccggcccacctaccagttcttctacggctgctatagcagctgcatcgtcctcaagtgcaccagcacaggaaactatatgtttagacgactcccttgatgaggatctgtcatttcacagcccctcgcttgatctggtgtctgaggccctggcagtgattaataacggcaataaggggcctccggtaggatcaaggatttccatgcctaccaccaagccgagaccaggcctgcgcgaggaaaaacttgccagcattatgtctaaattgccactcgccactccaaaaaaacttgatagtactcagaccacccactcaagttctctgattgcagggcataccggccccgtccctaagaagccacaggacctcgcacatacaggtatctctagcggactgatagcaggaagcagcatacagaatccaaaagtctccctggaacctctcccagctcgtctgttgcaacagggcctgcagagaagctcccagattcacactagctccagctcgcagactcatgtgagctcaagttcccaggcccaaatagccgcgagttctcacgctctgggtacttctgaggctcaggatgcctcaagcctcactcaagtgacaaaagtgcaccaacatagcgcagttcagcaaaactacgtgtccccactgcaggccacaatctccaagagtcagacaaaccccgtggtgaaacttagtaacaatccacagctgagttgtagtagctccctaatcaaaacttcggacaagccactcatgtatcgattgcctttaagtacgccatcacccgggaacggtagccaagggagtcatcccctcgtgagccggacggttccatccacaacgacgagcagcaattacctcgcaaaggctatggtatcccagatctccacgcaggggtttaagagccccttctccatggctgcttctcccaaactcgcagcttctccaaaacccgccacaagtcccaagccgcttcctagccccaaaccgagcgcttctcccaagccgtctctgagtgctaaaccaagtgtttcaacaaagcttatctccaaaagtaatcctactcctaaacctaccgtgtctccctctagtagctctcctaacgcactggtcgcccaaggttctcactcctcgaccaacagccccgtgcacaagcaaccctctggcatgaatattagtcggcagtccccaaccttgaatctcctcccatcaagtcgtaccagcggactgcctccaaccaagaacttgcaggcacccagcaaattgaccaattcatctagcaccgggaccgtcggaaagaattctttgagtgggatcgctatgaatgtccccgccagcagaggaagtaacctgaattccagcggagccaatcgcactagcctgagtggcgggacgggcagcggaactcagggcgcgacaaaacctctgtcaaccccacaccgtccctctaccgcaagcggcagctccgttgtcacggcgagtgtgcagagcaccgcaggcgcctcattgcttgcaaatgcgtcccccctgacacttatgacttcccccctaagcgtgaccaatcagaatgtgaccccatttgggatgctgggcgggcttgttccagtcaccatgcccttccaattcccgctggagattttcggcttcggtactgatacggcaggagttacgaccacctccggttcgaccagtgccgccttccaccattcattgacacagaacttattgaagggactgcaaccaggaggagcccagcacgccgccacgctttctcattccccattgcccgcgcacctgcagcaagcctttcacgatgggggtcagtccaagggggacacaaagttaccccggaaaagtcagtag

SEQ ID NO: 210442 - DNA, 4044 bp, Artificial Sequence
  Description of Artificial Sequence: Synthetic coding sequence
atggccgagccccggcgggtggccttcatcagcctgagccccgtgagacgcagggaggccgaatatcctggccctgagcgggaaccggaatacccccgagaaccgccgcggttggaaccccagccctaccgtgaacctgccagggctgagccacccgcccccagagaacctgccccccggagtgatgcacagccccccagccgagagaagcctctccctcaacgcgaagttagcagagccgaacctcctatgtctttgcagagggagccaccccgccctgagcctcctcctcctttccctccactgcccttgcaaccacccccccccagagagagcgctagccgtgcagaacagccaccgcgcccaccgcgcgagaccgtgcgcctggagctggtgctaaaggacccaacagacgagtcgtgtgtggaattctcgtacccagaactgctcttgtgcggtgagcaacggaagaaattgattcacacagaagatccctttaacgatgagcaccaggagcgtcaggaggtcgagatgcttgctaaaaaattcgagatgaagtatggtggcaagccgcgaaaacatcgaaaagaccggctgcaggaccttatcgatataggattcggatacgacgagacagacccatttattgataactctgaggcctacgatgagttggtgccagcctccctgacaacgaagtatggtggcttctatatcaacactgggaccctacaattccgccaagcctcggataccgaggaagatgacataactgacaaccaaaagcacaagccccctaaggtgcctaaaatcaaagaagacgatatcgagatgaagaaacgaaagcgaaaagaggagggcgaaaaggaaaagaagccacggaagaaagtacccaaacagttgggagtcgtcgcactcaatagtcacaagtcagaaaagaagaagaagagatacaaggactcattatccctagctgcgatgattagaaagtttcaaaaggagaaggacgctctgaagaaggagagcaatcctaaagtcccagttaccctgagtaccccctctctgaataaaccaccttgcgcggccgcagccctcggtaatgatgtcccagaccttaatctgtcttcaggtgacccagatctgccaatcttcgtgtctacaaatgagcacgagctgtttcaggaggctgaaaacgctctggaaatgctggacgattttgattttgataggctgcttgacgccgcctctgatggttcaccccttagcgagtcaggtggtgagaacggaacgactacccagcccacatacacaagccaagtcatgccaaaagtggtccccaccctcccagaagggctgccagtgctgttggaaaaacgaatcgaagacctgcgcgtggcagcgaagctttttgacgaagagggacgcaaaaaattctttacacaagatatgaataatatcctcctggatattgaactccagcttcaagaacttggccctgtgatccgctctggcgtgtacagccaccttgaggcctttgttccatgtaacaaagaaacactggtgaaacgattgaaaaaactacaccttaacgtccaggacgatcgccttagagagcctttgcaaaaactcaagctggctgtttcaaacgtgatgccagaacagctgtttaaatatcaggaggactgtcaagcgagaagccaagcaaagtgcgccaagctgcaaacagacgaggagagagagaaaaatggatccgaggaggatgatgacgaaaagcccggcaagcgcgtgatcggcccccggaaaaaattccactgggacgacaccatcagaacccttctgtgcaatctggtcgagatcaagctgggatgctatgaactcgaacctaacaagagccagtccgcagaggactacctgaaatcctttatggagacagaggtcaagcctctctggcctaaagggtggatgcaagcccgtatgctgtttaaggagagcaggtccgtgcataaccacctcacgtccgcacccgccaagaaaaaggtaatccccgcacccaagcctaaagtgaaagaggtgatggtaaaaacattgcccctccactcatttcctactatgctgaaggaatgctctcctaaaaaggatcagaaaacccctaccagcctcgtagcttctgttagcggaccccccacttcttcatctaccgcagccattgccgcagcttcttcgtcgagtgcaccagcccaggagacaatctgcctggacgattcgttggacgaagacttgtcgttccatagcccctctctggacctggtatctgaagctcttgctgtgatcaacaatggcaataagggcccaccagtgggctctaggatcagtatgcctaccaccaaaccaaggccaggcttgagggaagagaaattagccagcattatgtctaaacttccgttagcaacccccaagaaactcgatagcacacagacaacgcactcctcctccttgatcgccggccacacaggcccggtgcctaaaaagccacaggacctggctcatacagggatctccagcggtttgatcgcagggagctcaatccagaaccccaaggtgtccttggagcctttgcctgcaaggttgctccagcagggactgcaaagatcctcacagatacacacgagctcaagctctcaaacacatgtctcctcaagcagccaggcgcagattgccgcctcaagccatgcactggggacatccgaggctcaggacgcctcttccctcacacaggtgaccaaggtgcatcagcactccgcagtacagcagaattacgtgagtcccctgcaggccactatatctaaaagtcagacgaaccctgtggttaaattgtctaacaaccctcaattgagctgtagcagcagtctgataaaaacctccgacaaacctctcatgtaccgtctgcccctttccaccccaagtcccggaaacgggtcccaaggatcccatcctctcgtctctcgtactgtaccgtctaccaccactagtagcaattacctggcgaaggccatggtttcgcaaatatctacccagggattcaaaagccctttctcaatggctgcttcccctaaactggctgcgtcacctaaacccgctacaagccccaaaccgctcccatctcccaaaccgagcgcctcccctaagccttccctgagtgcaaagccctccgtctcaacgaagttgattagcaagagtaacccaaccccaaagcctaccgtgagtccttcctctagctcccccaatgcactggtggctcagggatcacattccagcacaaatagtccagtccacaaacagccgtccgggatgaacattagtagacagagcccaaccctcaatctactgcctagtagcaggaccagtggtcttccaccaactaaaaaccttcaggcgcccagcaaactgactaacagcagctccacagggaccgtggggaagaatagcttaagcggaatcgccatgaacgtccccgcctctcgcggtagtaacttgaatagctctggagccaatcgcaccagcttgagcggcgggaccggttcagggacgcagggggccaccaagccactttcaacaccccaccgcccaagcacagcgtccgggtcgagcgttgtaacagcctctgtgcaatctacagccggcgcctctctcttggcgaatgcatcaccgttaacactgatgacgagtccactgtccgtgaccaatcagaacgttacgccatttgggatgctggggggtttggtacctgtgacaatgccatttcagttccctctcgagatatttggctttggtaccgatacagccggtgtgacaacaacatctggctcaacctccgcagcattccaccactccctaacacaaaatctgctgaaggggctgcagcccggaggagctcagcacgcggccacactctctcacagccccctgcccgcgcacctccagcaggcttttcacgatggaggacagagcaaaggagatactaaactgcctcggaagtcacaatag

SEQ ID NO: 210443 - DNA, 1686 bp, Artificial Sequence
  Description of Artificial Sequence: Synthetic coding sequence
atggccgagagcggcgagagcggcggcccccccggcagccaggactctgcagcaggcgccgagggcgctggggcccctgcagctgctgcgtcggccgagccaaaaatcatgaaggtcacagtgaaaaccccaaaggagaaagaggaatttgctgtgccagagaacagctccgtccagcagtttaaggaagagattagtaaacgatttaagtcccatacagaccagctggtactgatctttgctgggaagatactcaaggatcaggacactctgagtcaacatgggatccatgacggtctaaccgtccacctcgtcattaagacacagaatcgaccgcaagatcatagcgcacagcaaacgaacactgccggatccaatgtaacaacatcatcgacacccaattccaactctacaagtggcagcgccacttccaaccctttcggccttggagggctggggggtctggctggtctgtcatcattaggactcaacactaccaattttagtgagctgcagagtcagatgcagaggcagctgttaagtaacccagagatgatggtgcaaatcatggaaaatccattcgttcagtcaatgctgagtaacccagatctgatgcgtcagcttattatggctaatccccagatgcaacagctcatccagcggaacccggaaattagccacatgcttaacaatcccgacatcatgagacagactctcgaattggctcgcaacccagcgatgatgcaggaaatgatgaggaatcaggatcgcgcattgtctaacctggagagcatcccaggtggatacaacgcattgagaagaatgtataccgatattcaggagcccatgctgtctgccgcgcaggagcaatttggaggaaacccattcgccagccttgtgtcgaacacttcctccggcgagggctcgcagccgtccagaactgagaaccgcgatccactgcccaatccatgggccccccagacatcacaatctagctctgcttcttcagggacagcaagtacagtgggcggcaccactggttcgaccgccagcggtacttccggacagagtacaacagcccccaacctcgtcccaggtgtgggagccagcatgttcaacactccaggcatgcagagtctgttgcagcaaataaccgagaatcctcagctcatgcaaaacatgctgtccgctccatatatgcgaagcatgatgcagagcttgtctcagaacccggatttggccgcacagatgcagaacccagacactctgtctgctatgtcaaaccccagagccatgcaggccctgctccagatccagcaggggcttcagaccttggcaacagaagcccccggcttaattcccggatttacccctgggctcggtgctcttggatcaactggtggttcctctggcacaaacggtagcaacgccaccccctcagagaacacaagcccgacagccggcactactgaacccggacaccaacagttcatccaacagatgctgcaggctcttgccggtgttaaccctcagctacagaacccagaggtccggttccaacaacagcttgagcaactcagcgctatggggtttctaaaccgtgaggctaacctacaggccttgattgcaacaggcggggatattaacgctgctattgagaggctgctgggatcacagccctcgtag

SEQ ID NO: 210444 - DNA, 1770 bp, Artificial Sequence
  Description of Artificial Sequence: Synthetic coding sequence
atggccgagagcggcgagagcggcggcccccccggcagccaggactcagcagccggagctgaaggtgcaggagctccggctgccgcggcgagcgcggaaccaaagatcatgaaggtgacagttaaaacacctaaagagaaagaggagtttgctgttccagaaaactctagcgtacagcagttcaaagaagagatcagcaagcgattcaagagtcatacagaccagctggtgttgatcttcgctggaaagattctcaaagatcaggatactttgagccagcacggaatccacgacggattgactgtacatctggtgatcaagactcagaaccgaccccaagaccacagtgcacagcagactaacacagcgggctctaacgtgaccaccagctctactcccaacagcaactcgacatccggtagcgccacatcaaatccctttggtcttggcggactaggcggactagcaggtctttcatccctgggcctcaacacaaccaatttctcagaactgcagagccagatgcagcgccaactgctgagtaatcccgagatgatggtgcagatcatggagaacccattcgtgcaatctatgcttagtaacccagatctgatgaggcagttaataatggcgaatcctcagatgcaacagctgatccaacggaatccagagatcagccatatgctgaataatcctgatatcatgcgtcagacactcgaactggccagaaacccggctatgatgcaggaaatgatgcgtaaccaggaccgggctttgagcaacttagaatccatacctggcggctataacgctcttaggcgaatgtacactgacatacaagaacccatgctgtcagccgcacaggagcagtttggggggaacccattcgcttcactggtgagtaacactagctcaggcgaggggtctcagccgtccaggacagagaatagggacccgctgcctaacccatgggcgccccaaacgagccagtcttcttctgccagtagtggcaccgcttctacagtgggaggaacaacaggttcaaccgcctccggaacatccggccagagtacaaccgccccgaacttggtgcccggcgtcggcgcctcaatgttcaataccccaggtatgcagtcactgctgcagcagatcacggagaacccacagttgatgcagaatatgctgagcgcaccttatatgaggtctatgatgcagtccttatcacagaaccctgacctcgctgctcagatgatgctaaataaccctctgttcgcaggcaacccacagttgcaggaacagatgagacagcaactgcctacctttctgcagcaaatgcagaaccccgacactctcagtgctatgagtaacccccgcgcaatgcaggctcttctgcagattcagcaagggctgcagacgctcgcaaccgaggcccccggattgatccccgggtttacccccggcctgggggccttgggctcaacagggggaagctcagggaccaacggtagtaatgctacaccaagcgaaaacacgagcccaactgccggcacaacggaacctggccaccagcagttcattcagcagatgctgcaggccctcgccggagtgaatcctcaattgcagaaccccgaggtgcgttttcagcagcaactggaacagctctcagccatgggcttcttaaatcgcgaagcaaacctgcaggccctgatcgctactggaggtgacatcaatgccgctatcgagcgcctcctgggctctcagccttcttag

SEQ ID NO: 210445 - DNA, 1875 bp, Artificial Sequence
  Description of Artificial Sequence: Synthetic coding sequence
atggccgagaacggcgagagcagcggccccccccggcccagccggggcccagccgccgcccagggtagcgcggccgctcccgccgagcctaagataatcaaggtaaccgtaaaaacgcccaaagagaaggaagagttcgcggtgccagaaaatagctcggtccaacagttcaaggaggccatctcaaaacgtttcaagtcacaaactgatcagcttgtgctgatattcgctggcaagatattaaaggaccaagataccctgatccagcacggcattcacgatgggttaaccgtccatctggtgataaagtctcagaaccggccccaaggccagtcaacacagcccagcaatgcggccgggactaatacaacgagtgcctctaccccaagatccaactccactcctatcagcaccaattccaacccttttggcctcggctccctggggggtttggcgggactgtcaagcttgggactaagctcgaccaacttttcggagcttcagtctcagatgcagcagcaactcatggcatccccagaaatgatgatccaaatcatggaaaaccctttcgtgcaatcaatgctctccaacccagatctgatgcgccagcttatcatggccaacccacaaatgcagcagctgattcaaaggaatcctgagatttctcatctcctgaacaatccagacatcatgaggcagactttggagatcgccaggaacccagcaatgatgcaggaaatgatgcgcaaccaggatcttgcactgtccaacttggaaagcatcccgggcggttacaacgccctgcgtaggatgtataccgacatccaggagccaatgctcaacgccgcccaggaacagtttgggggcaaccctttcgcatctgtgggcagtagctcctcatcaggagaaggcactcagccctctcggaccgagaacagggacccactcccaaacccatgggctccaccgccagccacacaatctagcgccacgacttcaacaactacttctactgggagcggatctggtaactcttcaagcaacgccacgggaaataccgttgccgctgccaactacgttgcatctattttttctaccccggggatgcagtctctgctgcagcagattaccgagaatccacagctcatccaaaacatgctttccgcaccttacatgaggagcatgatgcagagtctaagccagaatcctgatctagcggctcaaatgatgcttaacagcccactgttcacggctaacccacaactccaggagcagatgaggccacagcttcctgcgtttctacagcagatgcagaacccggacacattgtccgccatgagcaacccccgagctatgcaggccctgatgcagatccagcagggactgcagacgttggccaccgaagccccggggctgattccatctttcaccccaggcgttggtgttggagtgttgggaacagcgataggccccgtgggccctgtcactcccatagggccgatcggcccaattgttcctttcaccccaattggaccaattgggccaatcgggccaacgggccctgctgctccaccaggctcaacaggcagcgggggtcctacgggccctacagtgtctagcgccgctcccagcgagacaacctctcccacctctgagtcaggacctaaccagcagttcatccagcagatggtgcaagcgctggccggcgcgaacgccccccagcttccaaaccctgaagtgagatttcaacagcagttagaacagttgaatgccatgggtttcctcaatagggaggctaacctacaggcactcattgccacggggggggacatcaatgctgccatcgagcggttgctgggcagtcagccttcgtag

SEQ ID NO: 210446 - DNA, 1467 bp, Artificial Sequence
  Description of Artificial Sequence: Synthetic coding sequence
atggccgagaacggcgagagcagcggccccccccggcccagccggggacccgccgccgctcaaggttcggctgctgcccctgccgaacccaagataataaaagtcaccgtgaaaacaccaaaggaaaaggaggaatttgccgtcccagagaacagctccgtgcagcagttcaaggaagcaatttctaagcggttcaaaagccagacagatcagctcgtcttgatttttgcaggcaaaatattgaaagatcaggacacactcattcagcacggcattcatgacggcctcactgtacatctcgtcattaaatcccagaacaggccccagggacaatcaactcagcctagtaacgcagcggggacaaacactaccagtgcgagcactccaagaagcaattcaacacctatatcaactaacagcaaccctttcgggcttggcagtttagggggtcttgccggcttgtccagtctgggtctgtctagtactaacttcagcgaactgcagtcacagatgcagcaacagctgatggcctcccccgaaatgatgatccagatcatggagaacccttttgtgcaaagcatgctctctaaccctgacctcatgcgccagttgattatggctaacccccagatgcaacaactgatccagaggaatcctgagatcagccatcttcttaacaatcctgacatcatgcgtcagactctcgagattgctcgaaaccccgcaatgatgcaggagatgatgcgaaaccaggaccttgccctcagcaacctcgagtcgattcccggcgggtacaatgccctcagacgaatgtataccgacattcaggagcccatgcttaacgccgctcaggagcagtttggcggaaatccttttgcttccgtggggtcctcatcttccagcggggagggtacgcagccgtctcgaacagaaaaccgtgaccccctgccgaacccttgggctcccccacctgcgacgcaatcttcggccaccacgagcaccactaccagcacaggatccggctctggcaatagtagctccaatgctactggcaacaccgtagcggctgccaattatgtcgcaagcatcttcagcacccctggcatgcagtctctgctccagcagatcacagaaaatccacaattgattcagaatatgctgagcgcaccatatatgaggagcatgatgcagagcttgtcccaaaatccagacttggccgctcagatgatgctcaattctcccctatttacagcgaatccgcagttgcaggagcagatgcgccctcagctgccggcatttcttcaacagatgcagaacccggatacattaagtgcgatgtccaatccaacttcaagttctttttcaaagtggtgtcgcccttggcttgagcagatgcttcattcctgccggattcagaagtccgacttttctaacaactggaatagctccactcagtggggtagctag

SEQ ID NO: 210447 - DNA, 1968 bp, Artificial Sequence
  Description of Artificial Sequence: Synthetic coding sequence
atggccaagggcggcgaggccctgccccagggcagccccgcccccgtccaggatccacacctgatcaaggtcaccgtgaagacacccaaggacaaggaggacttttctgtgaccgatacatgcacaatccagcaactcaaggaagagatcagccagcgtttcaaggcccaccctgaccagctcgtgctcatcttcgccgggaaaatcttgaaagatccagattcgctcgctcaatgcggcgtgcgggatggcctgacagttcatctggtgattaaacgacagcacagggccatgggaaatgaatgtccagcagcctcggttcctacccaaggaccctcacccgggtccttaccccaaccctcctccatttacccggccgacggcccccctgccttctccctcggactcctaaccggcctgagtcgcctgggcctcgcctacagaggctttccagaccagcctagctcccttatgagacaacacgtgtcagtgcccgaattcgttacgcagctgatcgacgatcccttcatacctgggttgctgtctaatacgggattagtacgacaactcgtgctggataatccacacatgcagcagcttatccagcataaccctgagattgggcacattttgaacaaccctgaaataatgagacagactctggagttcctaaggaacccagcaatgatgcaagaaatgatcaggtcacaagaccgggtactgtctaacctggaaagcattccaggtggctataacgtgttgtgcactatgtatacggatattatggatccaatgctcaatgccgtacaggagcagttcgggggaaatccgtttgctaccgccacaaccgataacgccacaaccacgacctcccagccctctaggatggagaactgtgacccgctccctaatccctggacctcaacacacgggggatcaggttccaggcagggcaggcaggacggagatcaggatgcgcctgatattagaaatcgctttccaaattttctgggtatcatcaggctctacgattacctgcaacagttacacgagaatccacagtcgttgggaacctaccttcagggaacagcttctgcattgagccagagccaggagcctcctccgtccgtgaatcgagtgccaccctcatccccctcgagtcaggaaccaggctcaggtcaacctctgcctgaagaaagcgtggctattaaagggcgctctagctgcccggcgtttttgaggtatcctacggagaattctaccggccaaggcggtgaccaggacggtgccggcaagagctcaacaggtcactccactaacctgcctgaccttgttagtggcttgggggattcagcaaatagggtgccatttgccccattgagctttagcccaacagctgccatcccaggtattcccgagcctccctggctgccttcccctgcttatccaagaagtttgcgacctgatggaatgaaccctgctcctcagctacaggatgagatccaacctcaactgccattacttatgcacctgcaagctgctatggccaacccacgggcactgcaggctctgaggcagatcgaacaggggctccaggtgttggcaaccgaggccccccgtttgctgctgtggttcatgccatgtctggcaggcacaggctccgtggctggaggaatcgagtctcgggaagaccccctgatgtcagaagaccccctaccaaaccctccaccggaggtgtttcccgccctcgactctgctgagttgggattcctgtctcctccctttttgcacatgttacaggatctggttagtacaaacccccagcagcttcaaccagaggctcacttccaggtccagctcgagcagcttcggagcatgggattcttgaatagggaggctaaccttcaagctttgattgcaacaggcggcgacgtcgatgcggctgtagagaaactgaggcagtcttag

SEQ ID NO: 210448 - DNA, 666 bp, Artificial Sequence
  Description of Artificial Sequence: Synthetic coding sequence
atggccaagggcggcgaggccctgccccagggcagccccgcccccgttcaagatccacacctgattaaggtgaccgtgaagactccaaaggataaggaagacttttcggttacagacacatgtaccatccagcagttgaaagaagagatcagccagaggtttaaggcccatccggaccagctggtgcttatctttgccgggaagatactcaaagaccctgactccttggctcagtgcggcgtacgggacggcctgacagtgcacttagtgataaagcgccagcacagggctatgggcaatgagtgtcccgccgccagtgttcccacacaaggtcccagtccaggctctctacctcaaccctcatccatctatccagccgatggccctcctgccttctccctgggccttctcacaggactgagtcgtttgggcctggcctaccgcgggtttccagaccaaccctcatctttgatgagacagcatgtgagcgtccctgaatttgtgacgcagttaattgatgacccttttatccccggattactcagcaacacaggacttgtgcgccagcttgtcctggacaatccacacatgcaacagctcattcaacacaacccggaaattggacacatccttaacaaccccgaaatcatgagacaaaccctttag

SEQ ID NO: 210449 - DNA, 681 bp, Artificial Sequence
  Description of Artificial Sequence: Synthetic coding sequence
atggccgagcccagcggcgccgagacccggccccccatccgggtgacggtgaagactccaaaagataaggaagagatcgtaatctgtgaccgagccagcgtaaaagaattcaaggaagagatctcgagaaggtttaaggcccaacaagaccagctggtgctcatcttcgccggtaaaattctcaaggatggagataccttgaaccagcatggcattaaggacggccttactgtacacctggtgatcaagactccccagaaagcccaggaccctgccccccccgctgccccctctttaccagctgctgacgcagaacctagagtcacattgcacccttaccagagcccatcacatgctggaattgctgcggacccagctggaactacggacctggcagatcgtggcccttgggcggggacccagccatggcttctttgggacatacccgacccctcaacactctctcgacaacagcggcgggtgtacgctcgcggcccgcacttcctgacttcccacgccagccatattttcagtaacagggggttccaaagaccggcggcaacccacgctgccgatgatcctgcctttggatggaagtggaagctaaccggcgccgatgctcgctcggagatctcagctgccgccggcgccgcgcagctgcacggtctgcatcagagctag

SEQ ID NO: 210450 - DNA, 1806 bp, Artificial Sequence
  Description of Artificial Sequence: Synthetic coding sequence
atggccgagcccagcggcgccgagacccggccccccatccgggtgaccgttaaaactcccaaggataaggaagagatcgttatctgtgacagggccagcgtgaaggagtttaaagaggaaattagccgccgtttcaaggcacagcaggatcagctcgtgttgatttttgctggaaaaattctgaaagatggagacaccttaaaccagcatggaatcaaggatggtctcacagttcatctggtgatcaaaactccacagaaggctcaagatccggccgctgctacggccagtagcccatctaccccagatcctgcatccgcacctagcacaacgcctgcctcacctgctacaccggctcagcccagcacaagtggtagcgcatcctccgatgctggaagcggctccaggcggagcagtgggggcggaccaagccctggtgccggcgagggttctccatccgcaacagcttctattcttagcggttttgggggtatactgggtctgggttcgcttgggctgggtagcgccaacttcatggagctgcagcagcagatgcagagacagctgatgagcaatccagaaatgctgtcgcaaatcatggaaaacccactggttcaggacatgatgagcaaccctgatctgatgaggcacatgattatggccaacccccagatgcaacagctcatggaaaggaacccggagatttcccatatgttaaataacccagagctcatgaggcagacgatggagcttgcgaggaatcccgccatgatgcaggagatgatgcggaatcaggaccgggcgctgtctaacctggagtcaatacctgggggatataatgctctaaggcgcatgtacacagacatacaggagccaatgtttagtgctgctcgggaacagtttggaaacaacccattctcctccctcgccggcaattccgattcttccagttctcagcccctccgcacggagaatagagaaccactccctaatccttggagcccctctccacctacctcacaggcccctggctccggaggcgaaggaaccggcggatctgggaccagccaggtccatcctacagtgtccaatcctttcggtattaatgctgcctccctcggtagcggcatgtttaatagtccagagatgcaggctctgctgcagcagatttcggagaatccacagcttatgcagaacgtgatctccgcaccttatatgcgcagtatgatgcagactctcgcccagaatcccgactttgctgcccagatgatggtcaacgtgccgctgttcgctggcaaccctcagctccaggagcagctgcgcctgcagcttcctgtcttcctccagcagatgcagaacccagaaagcctctctatattaactaacccaagggcgatgcaagcacttttacaaatccagcaaggtttgcagacccttcaaacagaggcgcccggcctggtaccctctttgggatctttcggcatctcaaggacacctgccccgtctgctggctccaacgccggatcgaccccagaggcacccactagttccccagccactcctgcaacgtccagtcctaccggcgcgtcttctgcccagcagcagttgatgcaacagatgatccagcttcttgctgggtccggcaatagccaggtgcaaacccctgaagtgagatttcagcagcaattggaacagctcaatagcatgggcttcatcaaccgcgaggccaatttacaggctttgatcgccacagggggcgatattaacgctgccattgaacggctgctcggtagccaacttagttag

SEQ ID NO: 210451 - DNA, 336 bp, Artificial Sequence
  Description of Artificial Sequence: Synthetic coding sequence
atggccggcaagcaggccgtgagcgccagcggcaagtggctggacgggataaggaaatggtattacaacgctgctggctttaataagctcggacttatgcgtgatgacacgatctatgaggatgaagacgttaaagaggccattcgcagactgccagagaatctttacaacgataggatgtttaggatcaaacgcgccctcgacctgaacctgaagcaccagatccttcccaaggaacaatggaccaagtacgaagaagaaaatttttacctggaaccttatctgaaagaggtcataagggagagaaaagagagagaggagtgggcaaaaaagtag

SEQ ID NO: 210452 - DNA, 1443 bp, Artificial Sequence
  Description of Artificial Sequence: Synthetic coding sequence
atggccgccagcgtggtgtgccgggccgccaccgccggcgcccaggtacttctgcgtgcgaggaggtcgccagccctccttcggaccccggcccttaggagtacagctaccttcgcacaggccttgcaattcgtgccagaaactcaggtaagcttgctcgacaatggcctacgagtggccagcgagcaatccagtcagcccacatgcacggttggagtatggatcgacgtaggcagtcgatttgagacagagaaaaataatggcgccggatattttctggaacacctggcatttaaagggaccaagaaccggcctggctcagccctggaaaaggaagtcgagagtatgggcgctcatctgaacgcttattcgacgcgcgagcacaccgcttactatattaaggccctgtccaaggatcttccgaaagccgtggagctgctgggggatattgtacagaattgctcattagaagacagtcagattgagaaggagcgggacgtcattctgagggaaatgcaggagaacgacgcctctatgcgtgatgttgtcttcaattatctccacgcaacggcttttcaagggaccccgctggctcaggccgtcgagggtccaagcgaaaatgtccggaaactctcacgtgcagacctcacggagtatctgagcacccattataaggctcccagaatggtgttagcagcggccgggggggtggaacatcagcagctgctggatcttgcacaaaaacaccttggcggcatcccttggacctacgcagaggatgccgttccaaccctgaccccttgccgattcactgggagtgaaatcagacaccgggacgacgcgttacccttcgctcatgttgccatcgcagtcgaagggcccggatgggccagccctgataacgtcgccttgcaggtggctaatgctatcataggtcactatgactgcacttacggcgggggggtgcacctgtcctccccattagcgtcaggggccgtcgccaacaagctgtgccagagctttcagactttttcgatctgctatgctgaaactggactcttgggtgcccactttgtgtgcgatagaatgaagatagatgatatgatgttcgtgcttcaggggcagtggatgagactgtgtactagcgccaccgagtctgaggtcgcgaggggcaaaaatatcctgcgtaatgctttggtctctcatctcgacggaacaactcctgtatgcgaagatatcggacgaagtctgctaacttatggccgacgcatcccacttgccgagtgggagagcagaatcgccgaggtcgatgccagcgtggttagggagatctgctccaagtatatatatgaccagtgccctgccgtggctggatacggaccaatcgagcagctgcctgactacaatagaatcagatcaggaatgttctggctccgcttctag

SEQ ID NO: 210453 - DNA, 1362 bp, Artificial Sequence
  Description of Artificial Sequence: Synthetic coding sequence
atgaagctgctgacccgggccggcagcttcagccggttctacagccttaaagtcgccccgaaagtcaaggccactgcggcccctgctggagcgccaccccagccccaggacctggaattcacgaagctccccaacgggcttgttatcgcatctctagagaactactcacccgtgagccgcataggcctgtttataaaggctgggtctcggtatgaagatttcagtaatcttgggactacccatctcctgcgcttgacctccagcctgacaactaagggagcaagctcctttaaaataacccgcggaattgaggccgttggagggaagttaagtgtgactgccacaagggagaacatggcatatactgttgagtgtcttaggggcgatgtggatattctcatggagtttctactcaacgtgaccaccgcacccgaattccggcgctgggaggtggcagacctccagccgcaactgaagattgataaagcggtggctttccagaaccctcagacgcacgttatcgagaatctgcatgctgcagcctaccgaaacgctttggctaaccctctctactgtcctgattatcgcattggcaaggtgacctctgaggagctgcactacttcgtgcagaaccatttcacctcggccaggatggcactaattggccttggggtgtcccatcctgtgctgaagcaagtggcggagcagtttcttaacatgagaggcgggctgggactctcaggggccaaggccaattacagggggggagagatccgagaacagaacggcgattcactcgtccatgcagcgtttgtcgcggagtccgcggtcgccggcagcgccgaggctaacgcttttagtgtgctccaacatgtgctcggggccggacctcacgttaagcgcggaagtaatacaaccagccacctacatcaggcagtcgccaaagctacccaacaaccgtttgatgtgtctgcttttaacgccagttacagtgatagcgggctctttggaatttatactatctcacaagccaccgctgcgggtgacgtcattaaagctgcctacaatcaggtgaagaccatcgcacagggtaacctctcaaatacggacgtgcaggccgccaagaacaaattaaaagcaggatacctgatgtccgtagagtctagtgaatgttttcttgaggaggttggctcacaagctctggtggcaggaagctatatgcctccatcaacagtgttacaacagatagatagcgtcgctaacgctgacataattaacgcagccaaaaagttcgtttcaggacagaaatccatggccgcctccggcaatctggggcacacaccttttgtggacgagctatag

SEQ ID NO: 210454 - DNA, 276 bp, Artificial Sequence
  Description of Artificial Sequence: Synthetic coding sequence
atgggcctggaggacgagcagaagatgctgaccgagagcggcgacccagaagaggaagaggaggaggaagaggagctcgtcgatccactcacaactgtaagagagcagtgtgagcaactcgaaaaatgtgtgaaggcccgggagcgcctggagctgtgcgatgaaagagtctcatcacggagccatacagaggaggattgcaccgaagaacttttcgacttcctgcatgcacgtgaccactgcgtggcccacaaactgtttaataatcttaagtag

SEQ ID NO: 210455 - DNA, 249 bp, Artificial Sequence
  Description of Artificial Sequence: Synthetic coding sequence
atgggccgggagttcggcaacctgacccggatgcggcacgtgatcagctactccctttccccattcgagcaacgggcctacccgcacgtgttcaccaagggtatcccaaacgtcttacgcaggattagagagagcttcttcagagtggtgcctcagttcgtagtattttaccttatctacacttggggcaccgaggagttcgaacggtccaagcgcaagaaccctgctgcctatgaaaacgacaagtag

SEQ ID NO: 210456 - DNA, 249 bp, Artificial Sequence
  Description of Artificial Sequence: Synthetic coding sequence
atgggccgggagttcggcaacctgacccggatgcggcacgtgatctcgtattctctctcacctttcgagcagagagcctaccctcacgtgttcaccaaaggaattcctaatgtgctaagacgtatccgggagagcttcttcagggtcgtgccccagtttgtggtcttttacctgatttacacctggggcactgaagagttcgaacgcagcaagcgaaaaaatccggcagcctacgaaaatgataagtag

SEQ ID NO: 210457 - DNA, 249 bp, Artificial Sequence
  Description of Artificial Sequence: Synthetic coding sequence
atgggccgggagttcggcaacctgacccggatgcggcacgtgatctcatacagcctttccccttttgaacagagagcatacccacatgtgtttaccaaagggatacccaatgtgctaaggcgcattcgcgaaagtttttttcgcgttgttccacagttcgtggtcttctatctcatctatacttggggaactgaggagttcgagcggagcaaacggaaaaatcccgctgcctatgaaaacgacaagtag

SEQ ID NO: 210458 - DNA, 387 bp, Artificial Sequence
  Description of Artificial Sequence: Synthetic coding sequence
atgcagatcttcgtgaagaccctgaccggcaagaccatcaccctggaggttgagccgtcagatacgatcgagaacgtgaaggcgaagatccaagacaaggaaggcataccgcctgatcagcagcgcctcatcttcgccggtaaacaactggaagacggcagaacactgtcagattacaacattcagaaggaatccactctccacctcgtcctgaggctgaggggaggaataatcgagcccagcctgagacagttggctcagaagtacaactgtgacaagatgatctgcagaaaatgctacgctcggctgcacccccgcgccgtcaactgtagaaagaagaaatgcggccacaccaacaatctgcggccaaaaaaaaaagtcaagtag

SEQ ID NO: 210459 - DNA, 387 bp, Artificial Sequence
  Description of Artificial Sequence: Synthetic coding sequence
atgcagatcttcgtgaagaccctgaccggcaagaccatcaccctggaggtagaaccatcagacacaatcgagaacgttaaggctaagatccaggacaaagaagggattccgcctgatcagcagcgtctgatctttgctgggaaacagttggaggacgggaggaccttgagcgattacaatatccagaaggagagcactttacacctggtgttgagactgcgaggcggaataatcgagccatccctacggcagctcgcacagaagtacaattgcgacaagatgatttgtcggaagtgttacgctagactccacccaagggcagtcaattgccgaaaaaagaagtgcggtcacactaacaaccttcggccaaagaagaaggtgaagtag

SEQ ID NO: 210460 - DNA, 1872 bp, Artificial Sequence
  Description of Artificial Sequence: Synthetic coding sequence
atggccgccggcgagacccagctgtacgccaaggtgagcaacaagctgaagtctagaagtagtcctagcttgctggagccacttttagcaatggggttccccgtgcataccgcgctgaaggcgcttgctgccactggacgcaagactgcagaagaagccctggcatggctacatgaccactgtaacgatccatctcttgacgacccaatcccacaggagtatgctttattcctttgccccaccggccctctgctggaaaaattacaggagttttggcgtgagagtaagaggcagtgtgccaaaaaccgagcacatgaggtctttccccacgtgactctttgcgattttttcacatgtgaagaccagaaagtggagtgtctgtacgaggcactaaagcgcgctggggataggcttctgggcagctttccgacagccgtacctctggccctgcattcctccattagctatctgggatttttcgtgtccggttctcctgccgatgtgatccgagagttcgctatgacctttgctactgaagcatcactgctcgctgattgctctgtaaagccgtgtaccaaacagctccatctcaccctggctcacaagttttatcctcatcatcaaaggactttggaacagctggctcgggcaataccattgggacattcttgtcaatggactgcagcattatactcgagggacatgcggtttgtacattatcagaccctgagagccctcttccagtacaagccccaaaatgtggatgagctgacgttgtcaccgggggattacattttcgtggatcctacacaacaagatgaagctagcgaagggtgggtcatcgggattagtcaaagaactggatgtagaggatttctaccggagaactacaccgatagggctagtgaatctgacacatgggtaaaacatagaatgtacactttttctttggcaactgatctaaacagtcggaaagatggcgaggctagctccaggtgtagcggggagtttctgccccagacagcccgttcactttcaagtctgcaggctctgcaggccactgtcgctcggaagtccgtcctggtggtgcgtcatggagagcgagtcgatcagattttcggcaaagcctggcttcagcaatgctcaacacccgatggtaaatattaccgaccagacctcaactttccctgtagtctaccgcggagatctagggggataaaggatttcgagaacgatccacccctgagctcctgcgggatttttcagagccgcattgcgggggacgcgctgctcgattcaggaatccgcatctctagcgtgttcgcctcacctgctttacggtgcgtgcagacagccaagctgattctggaggaactgaagctagagaaaaaaatcaagatcagagtggagccagggattttcgagtggacaaagtgggaggctggaaaaaccactccaaccttgatgagcctggaagagctcaaagaggctaattttaatattgataccgactacaggcctgcctttcccctgagcgccctaatgcccgccgagagctaccaggagtatatggaccgctgcaccgcatctatggtccagatagtgaatacatgtccccaagacacaggggtgatcctgatcgttagtcacggatccaccctcgattcctgcactagacccctgctcggcctccctcctcgcgaatgtggtgacttcgcacagcttgtaaggaagattcccagccttgggatgtgtttctgcgaagaaaacaaagaggaagggaagtgggagctcgtgaacccccccgtcaaaactctcacccatggcgcaaacgccgcctttaattggcggaactggatctcaggcaactag

SEQ ID NO: 210461 - DNA, 1986 bp, Artificial Sequence
  Description of Artificial Sequence: Synthetic coding sequence
atggccgccggcgagacccagctgtacgccaaggtgagcaacaagctgaaatccaggtcaagcccatctttgcttgagcctctgctcgcaatgggatttcccgtgcatactgccctcaaggctctcgctgccaccggtagaaagaccgcagaagaggccctcgcctggcttcatgatcactgcaatgatccatctctggatgacccgatccctcaagagtacgcactgttcctctgtcctaccggtccattactcgaaaaacttcaggagttttggagagaatctaagcgccagtgtgccaagaatcgcgcacatgaagtgttcccacacgtgaccctgtgcgacttcttcacctgtgaggatcagaaggttgagtgcctttacgaagccttaaagcgggccggggatcgcttattaggcagctttcctaccgcggttcccttggctttgcacagcagcatcagctaccttgggttcttcgtcagtggctctcctgctgatgtgattcgagaatttgccatgacctttgcaaccgaggcttcactccttgccggaaccagtgtgtctcgcttttggatctttagccaagtcccgggtcacgggcctaacctaagattgagtaatctcacccgggccagctttgtgagccactacatcctccagaaatattgctctgtaaagccgtgtactaagcagctgcacctgaccttggcccataagttctatccccatcaccagcgcacactggagcagctggccagggcgatacctctcgggcacagttgtcagtggactgccgcactgtatagccgtgatatgcggtttgtccactatcagaccctgagagccctgtttcagtacaaacctcagaatgtagatgagctcactctgtctcccggcgactacattttcgtggatcctacccagcaggacgaggcatctgagggttgggtgattggaattagtcagagaaccgggtgcagaggctttctgcctgagaactacacagatagggctagcgaaagtgatacgtgggtgaagcaccggatgtatacgttttcattggctacagaccttaattcccgcaaagatggagaggctagctcccgctgcagcggagagttcctccctcaaaccgcccggagtctttcaagcctccaggctctgcaagccacagtcgcaaggaagtccgtgctcgtggtacgacacggagaacgggtggatcagatattcggaaaagcttggttgcagcaatgttctacaccagatggcaagtattatcggccagatctgaatttcccttgctcactcccaaggcgcagccgtggcatcaaagattttgagaacgacccaccactgagcagctgcggaatcttccagtctcgcattgcaggcgacgccctcctggacagcggcattagaatatccagcgtctttgctagccccgcactgcgctgcgtgcagaccgcaaagctgatcctagaagagttaaagctagagaaaaagatcaagatccgagtggagccgggaatcttcgagtggacgaagtgggaagccggcaagactacacctactttgatgtccctggaagaactaaaagaggcaaacttcaacatcgataccgattaccggcccgctttcccgttatctgcactgatgccagcagaatcgtatcaggaatacatggatagatgtacggcgagcatggtgcagatcgtgaacacatgccctcaagacacgggtgttatcctaatagtttcccacggctcaactctggacagttgtacccggccattgcttgggttgcccccgagggagtgcggcgacttcgcacagctcgtccgcaagatccccagcttgggtatgtgcttctgcgaggagaataaagaggaggggaagtgggaacttgtcaatcccccagtgaagacccttactcatggcgcgaacgccgcattcaactggagaaattggatcagtggtaattag

SEQ ID NO: 210462 - DNA, 369 bp, Artificial Sequence
  Description of Artificial Sequence: Synthetic coding sequence
atggccgccggcgagacccagctgtacgccaaggtgagcaacaagctcaaatctaggagtagcccaagtctgctcgagccactcctggcaatgggatttcccgtacatacggcccttaaagctttggcggcaacaggacgcaagactgccgaggaggccctggcctggctacacgaccactgtaacgacccctccctagacgatcccatcccccaggaatacgcactgtttctgtgtcctaccggacctctcctcgaaaagctgcaggaattctggagggagtcaaagagacaatgcgcaaaaaacagggctcacgaagttttcccacacgtgactctctgcgattttttcaccggccctgctgtgtag

SEQ ID NO: 210463 - DNA, 1581 bp, Artificial Sequence
  Description of Artificial Sequence: Synthetic coding sequence
atggccgccggcgagacccagctgtacgccaaggtgagcaacaagctgaaatctcgaagttccccttctctgctcgaacctctgttggctatgggttttccagtgcataccgccctcaaggcgttggcagcgacggggcgtaaaactgccgaggaggcactggcatggctccatgaccattgtaacgatccctccctggatgatccgatccctcaagaatatgcgctcttcctctgcccgacggggccgcttttggagaagttgcaggagttctggcgcgagagcaaacgccagtgtgccaaaaacagagcgcatgaagtctttccccacgtaacactctgtgacttttttacctgtgaagatcagaaggtcgaatgtctgtatgaggcactgaagcgggcaggggatcgactcctagggtcctttcccaccgccgttcctctcgctttgcattcctcaatttcctacttaggattctttgtgtcaggtagcccggccgatgttatcagagagttcgctatgacgttcgcaactgaagcctcactactggccgattgtagtgtcaaaccgtgtactaagcagttgcatctgacattggcccataagttttatccacaccatcagagaactcttgagcagctggcccgcgctatccctctaggccacagctgtcagtggaccgccgctctctacagcagagacatgcggtttgtccactaccagactctcagggccctgtttcagtataagccgcaaaatgttgacgaactgacactaagtcctggagactacatctttgtggatccgacacaacaagacgaagcgtccgaaggatgggtgatcgggatcagccagagaactggatgcagaggtttcctgcctgaaaactacacagatagagctagcgagagcgatacatgggtaaaacacagaatgtacaccttttcactggccactgatctgaactctcggaaggatggagaggccagcagtagatgcagcggggaattcctgccacagaccgccaggtcacttagcagccttcaggcgcttcaggcaacagtggcgcgaaagtccgtcctcgtcgtaaggcatggggagcgagtggatcagatctttgggaaggcttggctgcagcaatgtagtactccagacgggaagtactatagaccagatctgaacttcccatgctctctgccaagaaggtctcgcggcattaaggactttgagaacgacccgccactctcatcttgtggtatttttcagtcacggattgccggggacgccctgctggattcgggcattcgcatctcttcagtttttgcctctccagcactccgatgtgtgcaaacggctaagctcattctggaggaactgaaactggagaagaagataaagatacgcgtggagcccggtatttttgagtggacaaagtgggaggcgggaaagacaactccgacgctgatgtctttggaggagttgaaggaggctaattttaacatcgatacagattatcgcagtctgccttgggcctgtgcctctgtcaaaaaaattaagcggaaagagaacggatcctggtag

SEQ ID NO: 210464 - DNA, 1950 bp, Artificial Sequence
  Description of Artificial Sequence: Synthetic coding sequence
atggcccagtacggccaccccagccccctgggcatggccgcccgggaagagctctattccaaagtcaccccaagaaggaatagacagcagcgccccggaactattaaacacgggtctgcactggacgtgctgctgagtatgggtttcccccgggccagagcccagaaagccctagcttcaacagggggacgcagtgtgcaagccgcatgtgattggctgttctcacacgttggagatcctttcctcgatgacccactgccaagggagtatgtcctgtacctcaggccaactggacctctcgctcagaagcttagcgatttttggcaacagagcaaacaaatctgcgggaagaataaagctcacaacatatttccccatattacactgtgccaattttttatgtgtgaagacagcaaggtggacgctctaggggaagctctgcagacgaccgtcagtcgctggaaatgcaagtttagtgccccgcttcccctggaactttatacctcttcaaactttatcgggttgttcgtcaaggaggattccgcggaagttttgaagaaatttgccgctgacttcgccgcagaagccgccagcaagaccgaagtccacgtagaacctcataagaagcagttgcacgttactttagcatatcattttcaagcctcacatctgcctactcttgaaaaactcgcgcaaaatattgacgtcaaactcgggtgtgactgggtggcaacaatcttttctagagatataaggttcgctaaccatgaaacactgcaggtaatctacccatacacgccacagaatgatgacgagcttgaactggtgcctggcgatttcatttttatgagtcccatggagcaaacaagcacaagtgaaggctggatttatggcacttctttgacgaccgggtgtagtggcctcctgccagagaattatataaccaaagcagacgagtgctccacctggatattccacgggtcttacagtatactcaatacctcgtcttcaaattcactgacattcggcgatggagtattggaacgtcgaccttacgaggaccagggccttggggaaaccacgcccctgacaatcatatgtcagcctatgcagccactcagggtcaatagtcagcccggcccccaaaagcgttgcctctttgtgtgtcggcatggagaaaggatggacgttgtttttgggaaatactggctcagccagtgtttcgatgcaaaaggacgttacatccgcacaaatctaaatatgccgcattctctaccacagcggagcggagggtttagagactacgaaaaagatgcccctatcactgtctttgggtgcatgcaggctagactggtgggtgaagctttgctggaatcaaataccatcatagaccatgtgtattgctccccatcactccgttgcgtgcagacagcgcataacattttgaagggccttcagcaggagaatcatctcaagatacgcgtggagcccggcctgttcgagtggacgaaatgggtcgccggctccactctacccgcctggattcccccaagcgaattggccgccgccaacctgagtgtggatacgacttacagaccgcacatacctatctcgaagttggtggtcagcgaatcctatgatacatatatttcccgttcatttcaggtcaccaaggaaataatctcagaatgtaaaagcaaagggaacaatattctgatcgtagcccatgcttcttcactggaggcctgcacttgccagctgcagggcctctcgcctcaaaattccaaagactttgtccagatggtgcgaaagattccctatctgggcttctgttcttgcgaagagttgggggaaactggcatatggcaattgacggaccctcctatactaccactcacacacggcccaacaggaggatttaattggcgcgagaccctgctgcaggagtag

SEQ ID NO: 210465 - DNA, 1509 bp, Artificial Sequence
  Description of Artificial Sequence: Synthetic coding sequence
atggccagcaagaagctgggcgccgacttccacggcaccttcagctacctcgacgatgtccccttcaagaccggagacaaattcaagaccccagccaaggtcggcctgcccataggattcagtctccccgattgcttgcaggtggtccgcgaggtgcagtatgatttttctcttgaaaaaaagactattgaatgggcagaggaaattaaaaaaattgaggaagccgaaagggaggctgagtgtaaaatcgcagaagccgaagccaaagtaaactcgaagtccggccctgaaggagatagcaaaatgagcttttctaagacccacagcaccgccacaatgccacccccgattaaccctatcctagcctcactccagcataatagtattcttacacccactcgagtttccagcagcgccaccaagcaaaaggtactaagccccccccacataaaagctgactttaatttggcagactttgaatgtgaggaggaccctttcgataaccttgagctgaagactattgatgaaaaggaggagttacgtaatatcttagtcggaaccacaggacctatcatggcccagctcctggacaacaacttgcctcggggaggctccggatccgtcctccaagatgaggaagtcctggccagccttgaaagggccacactggatttcaagcccctgcacaagcccaacggttttatcacactgccccaactcggcaattgcgagaaaatgtctctctcctctaaggtgtccctcccacccatcccggcggtgtctaatatcaaatccctgtccttcccaaagttggatagcgacgacagcaaccagaaaactgccaaactggccagtacattccattcaacaagctgtctgagaaacggcactttccagaatagtctaaaacccagcacccagagttcagccagcgagctaaatgggcaccacacgttgggactgagcgccctgaatcttgactccggaacggagatgccagcgctcacatcttcgcagatgccttccctctctgttctcagcgtttgcactgaggagtcctcccctccaaataccggccccacagtcacacccccaaactttagtgtttctcaagttcccaacatgccgagctgcccacaggcctattctgagctccaaatgctgagcccgtccgagcggcaatgtgtggagacagtggttaatatgggctattcctatgaatgcgtcctgcgtgctatgaaaaaaaaaggagaaaacatcgaacagatattagattatttatttgcgcatggccagctgtgcgaaaaaggttttgacccactgttagtggaggaggcactggagatgcatcagtgttcagaggagaaaatgatggagttcttgcagctgatgagcaaatttaaagagatgggtttcgaattaaaagacattaaggaagtgttgctgcttcataataatgaccaagacaacgcgcttgaggatcttatggcccgcgccggagcatcttag

SEQ ID NO: 210466 - DNA, 1509 bp, Artificial Sequence
  Description of Artificial Sequence: Synthetic coding sequence
atggccagcaagaagctgggcgccgacttccacggcaccttcagctacctcgacgatgtcccgtttaaaactggcgataagtttaaaacgcctgcgaaggtgggcttgcctatcggtttttctcttcctgattgtttgcaggtggtcagagaggtgcagtacgacttctcgctggagaaaaaaacgattgaatgggccgaggagatcaagaaaatcgaggaggcggagagggaagccgaatgcaagattgccgaagctgaggctaaagtgaacagcaaatcaggtcccgaaggggactcgaagatgagtttcagtaaaacccatagtacggcaacaatgcccccccccataaatccgatcttagccagtctgcagcacaactcaatcctgacaccaacgagagtgagttcctccgccactaaacagaaggtgctgagccctccacacattaaggcagacttcaacctagcagatttcgagtgtgaagaggacccgtttgataatttggagctgaagacaatcgatgaaaaggaggaacttaggaacatcctcgttggaactaccggtccaattatggcgcaattactggacaacaacctcccaagaggggggagcggaagtgttctgcaagatgaagaggtgttagcatcactcgagagagccaccctggactttaagcctctgcataaacctaatgggtttataaccctgccacaactaggaaattgcgagaaaatgtccctgagctccaaggtctcgctgcctcccatacccgctgtgtccaacatcaagtccttgtccttcccgaagctggattctgatgactccaaccagaagacagctaaactggcctccacctttcacagcacaagctgcttgaggaacggcaccttccagaactcactgaagccctctacccaatcctcagcttccgagctgaacggtcatcacacactggggcttagcgccctcaatctcgatagcggcaccgagatgcctgccctgaccagcagccagatgccgtcactatcagtacttagtgtctgcaccgaagagagtagtcctcctaacacagggccaacggtaacacccccgaatttctcagtaagccaagtacctaatatgcccagctgtccgcaggcatatagcgaactccagatgttgtccccgtcggaaaggcagtgcgtggagaccgtcgtgaacatgggatacagctacgagtgtgtattacgagccatgaaaaagaaaggcgaaaacattgaacaaattttggattacctatttgcacacgggcagctctgcgagaagggattcgacccattattagtcgaagaggctctggaaatgcaccagtgcagcgaggagaagatgatggaatttttgcagctcatgtcaaaattcaaggaaatgggcttcgaactcaaagatattaaagaagtcctcctgttgcacaataatgaccaagacaatgccttggaggaccttatggctcgagctggagcctcgtag

SEQ ID NO: 210467 - DNA, 1326 bp, Artificial Sequence
  Description of Artificial Sequence: Synthetic coding sequence
atggccagcaagaagctgggcgccgacttccacggcaccttcagctacctagacgacgtgccatttaagaccggagacaaatttaaaacaccagccaaggtgggcttgcctattggcttttctctgcccgactgtctgcaggtggtacgggaagtacagtacgatttttccctcgaaaagaaaactattgaatgggcagaggagattaaaaagattgaggaagcagagcgcgaggccgagtgcaaaatcgctgaagccgaagccaaggtcaactcgaagtccggacccgagggcgattcaaagatgagcttcagcaaaacacattctaccgccaccatgccaccacctatcaatcccattcttgcctcactccagcacaattcaatactgactccaaccagagtaagcagttcagccactaagcaaaaggtcctgagcccgccccatatcaaggcagattttaacctcgccgattttgaatgtgaggaggatccatttgataatctggagttgaagactattgatgagaaggaagaactccggaacattctcgtcggcaccacgggcccaatcatggctcagctgctggacaacaaccttcctcgcggcggcagcgggagtgtactgcaggatgaggaagtgctagcttccttagagagagccactctcgacttcaagccgttgcataaacccaacggcttcatcaccctccctcagctaggtaactgtgaaaagatgtcattgtcaagcaaggttagcctgccaccaatcccagccgtttccaatattaaaagcttgtccttccccaagttagactcagacgacagcaatcaaaagactgccaagctggcgagtacattccactccactagttgcctccgcaacggcacgtttcagaatagtctcaagccatcaacccagagctcggcttccgagctcaacggtcaccatactcttgggctctctgcccttaatctcgattcagggaccgagatgcctgcgctaaccagctcacagatgccaagcttgagcgtgctgtccgtatgcactgaggaaagttcccccccaaatacggggcctactatactggactatctatttgcacacggccaactgtgtgagaagggctttgacccccttctcgttgaagaggccctcgaaatgcaccagtgtagtgaggaaaagatgatggagtttctgcagctgatgtcaaagttcaaggaaatggggtttgagctgaaagatatcaaggaggtcctgctgctccataataatgaccaggacaatgctttggaagatcttatggcaagagccggagcttcctag

SEQ ID NO: 210468 - DNA, 1509 bp, Artificial Sequence
  Description of Artificial Sequence: Synthetic coding sequence
atggccagcaagaagctgggcgccgacttccacggcaccttcagctacctggacgatgtacccttcaaaactggagataagttcaagaccccagccaaggtgggccttcctatcggattcagcctcccggactgcctgcaggtggtgagggaagttcaatacgatttctccctggagaaaaagaccatcgaatgggccgaggaaatcaagaagattgaggaagcggagcgcgaggctgagtgtaagattgccgaagcggaagcgaaggtgaatagcaaaagtggtcctgagggtgacagcaaaatgagtttcagcaaaacacactctacggccacaatgccgccccctatcaatccgattttagcttcgctgcagcataactcaatcctaactccaacacgtgtgtcttcgtccgcaaccaagcaaaaggttttatcacctcctcatattaaagcggactttaatctcgctgatttcgagtgcgaggaagacccttttgataacttggaactgaagaccatcgatgagaaggaagagctcagaaacattctagtaggaacaactggacctattatggctcaacttttggacaacaatctgccaaggggtgggtctggttcagtgctgcaggatgaagaagtacttgcaagtctcgaacgcgccacacttgattttaagccactgcacaaacccaatggattcatcaccctgccccagttagggaactgcgagaaaatgtctttaagctccaaggtctcgttacccccaatcccagctgtgtcgaacatcaagtccttatcctttccgaaactcgactcagacgacagtaaccagaagactgcaaagttagcatccacttttcattccacctcctgtctccgcaatggaacctttcaaaactctcttaagccctctacgcaaagctccgccagtgagctcaatggccaccacactctgggcttatcggctttgaacctggattctggaacggagatgcctgcactaacgtcaagccagatgccaagcttgagtgtgctttctgtgtgcactgaagagagctccccacctaacacggggccgacagtgacaccgcccaatttcagcgtcagccaggtccccaacatgccttcctgtccgcaggcttactccgagttacagatgctgagccctagcgagcgtcagtgcgtggagaccgtggtaaatatgggatatagttacgaatgcgtacttcgggccatgaagaagaaaggcgagaacatcgagcagatcttggattacctgtttgctcatggccagttgtgtgagaaaggattcgaccccctgcttgtagaggaagctctggagatgcatcagtgtagtgaagaaaagatgatggagttcctgcagctgatgtcaaagtttaaggaaatggggtttgaattgaaagatattaaagaagtgctgttgctacataacaacgaccaggataatgcactcgaagatctaatggctagagccggggcctcttag

SEQ ID NO: 210469 - DNA, 1509 bp, Artificial Sequence
  Description of Artificial Sequence: Synthetic coding sequence
atggccagcaagaagctgggcgccgacttccacggcaccttcagctacctcgacgacgtgcctttcaagaccggggacaaatttaagactccggccaaagttgggctccccattggattttctttgcctgactgcttgcaggtagtgcgtgaagtccagtatgattttagtctggagaaaaaaactatcgagtgggccgaagagattaagaagattgaggaagcagaacgcgaggcggagtgtaagattgctgaggctgaggccaaagtcaactctaagtccggcccggaaggggatagtaagatgagcttctctaagacacacagcacagctactatgcctcctcctattaatccaatcctcgcatcactgcagcataactctattcttactcctaccagagtcagctccagcgccactaagcagaaggtcctgtctccacctcacatcaaagcggatttcaacctcgctgacttcgagtgtgaggaggatcctttcgataatctggaacttaagactattgatgagaaggaggaactgagaaacatactggtggggacaaccggcccaatcatggcgcaactgctcgataataatctgcctaggggcggctccgggtctgtgcttcaagatgaagaagtcctggcctctctcgagcgggctaccctagatttcaagccactccataaacccaatgggtttattacacttcctcagctcggtaactgcgagaaaatgtcgctgtccagtaaggtgagccttcctcctattcctgcagtctcaaacattaaaagcctgtcatttcctaaactcgattccgacgatagcaatcagaagaccgctaaactcgctagcacttttcactctacaagttgccttcgtaacggtacgttccagaactccctcaagccctcgacacagtcctccgcttccgagttgaacgggcaccacacactcggccttagcgcactaaatctagactcaggcactgagatgcccgcgctgacgtcgtcccagatgcccagcctgtctgtgctctccgtttgcactgaagagtcatctccaccaaacactggacctaccgtaacacctcctaatttcagcgtgagccaagtgccaaatatgccatcctgccctcaggcctacagtgagctccagatgctgtcgcctagcgaacggcaatgtgttgagacagtcgtgaacatggggtattcctacgagtgcgttctgcgagcaatgaagaagaaaggagagaacatcgagcagattttggattacctgtttgctcacggacagctttgtgagaaaggattcgatccattgctcgtagaagaagctttggagatgcatcagtgtagcgaagaaaagatgatggagttcttgcaactgatgtccaaatttaaagagatgggctttgaactcaaggatattaaggaagttcttctgctgcataacaacgaccaggacaacgccctcgaggacctgatggctagagccggagcctcttag

SEQ ID NO: 210470 - DNA, 1617 bp, Artificial Sequence
  Description of Artificial Sequence: Synthetic coding sequence
atgagcggcgccgtgcggggccggcggcgggaggtgggcctgcagcacggtggatgtggcactggtggaggttatggcgacggcctagccaggtccggccaaagttggcggtggtggcgatccctttccctgggcgcggtgggaagtagcgccggtaccgagcctggtaggccagctggagctagtaccttccgtctcctgaggcgcagacagcagaggcactcaggcagtaaatggttgttgcggtcctgggtccagatttttatgtatgattttagtctagagaaaaagactatcgagtgggcagaagaaattaaaaaaatcgaggaggccgagcgcgaggcggagtgcaagatcgcagaggcagaagctaaggtgaatagtaaaagcggccccgaaggcgattcaaagatgagtttcagcaaaacccactctaccgccaccatgcccccacccataaaccccatactcgcatcgctgcagcacaatagcatactcactcccacacgcgtgagcagctcagccacaaaacagaaagtcttgtcccccccccacataaaagcagatttcaatctcgccgattttgagtgtgaggaggatccttttgataacttggagttaaaaactattgacgagaaagaggagctgagaaacatcctagtggggaccaccggtccaatcatggcacaactactggacaataatctgccacgcggaggctccggcagcgtgctccaggatgaagaagtgttggccagcctggagagggccactctggattttaaaccgctgcataagccaaatggttttataacactcccgcagctcggtaactgcgagaaaatgtcgcttagctcgaaggtttccttgccccctataccggcggtgtcgaacattaaatcactctcattcccaaagctggattcagacgactcaaatcagaagacagcgaaactggcctctacatttcactctacttcttgccttagaaatggtacctttcaaaactcactcaaaccatccacccagtcaagcgccagtgagctcaatggtcatcatactttgggtctttcagcactcaatctggactctggcactgagatgcccgccttgacttcatctcagatgcctagcttaagtgtgctgtctgtgtgcaccgaggaaagttcacctcctaacacaggtcctacggtgacgcctccaaatttcagcgtgtctcaggtaccaaacatgccttcttgtccccaggcctactcagaattgcaaatgctttcaccgagtgagcgacaatgtgtggagacggtggtgaacatggggtactcctatgaatgcgtcctgagagctatgaaaaagaagggcgagaatatcgaacagatactggattacctcttcgcgcacggccaactgtgtgagaagggattcgacccgttgctcgtagaggaagctttggagatgcaccagtgcagcgaggagaagatgatggaattcttacaactcatgtcaaagtttaaggaaatgggtttcgagctgaaggacattaaggaggttctgctcttgcacaataacgatcaggacaatgcactagaggacctgatggctcgcgccggcgcgtcttag

SEQ ID NO: 210471 - DNA, 1701 bp, Artificial Sequence
  Description of Artificial Sequence: Synthetic coding sequence
atgagcggcgccgtgcggggccggcggcgggaggtgggcctgcagcacggcggctgtggcactggcggagggtacggagatggactcgctagatccggacaaagttggcggtggtggaggtctctgtccctcggcgcagtaggatctagcgctggaactgaaccagggagaccagcaggtgccagcaccttccgtctgctgaggcggaggcagcagcgacacagcggcactttttcttacctcgatgatgtgccatttaagactggggacaagttcaaaaccccagcaaaggtcgggttacccatcggtttcagtctgcctgattgcttacaggtagtgagagaagtccaatacgatttttctctcgaaaagaaaacaattgaatgggccgaagagatcaaaaaaatcgaggaagctgaacgtgaagccgaatgtaagattgcagaggcagaggccaaagtgaattcaaaatctggccccgaaggagatagcaaaatgagtttttcgaagacacactccaccgccacgatgcccccacccataaatcccatcctcgcatctcttcagcacaacagcattctgaccccaacgagggtgtctagctcggccaccaaacagaaggtgcttagccccccccacattaaggccgatttcaacctggctgattttgagtgtgaggaggaccctttcgataacttggaactgaaaaccattgatgaaaaggaagaattgaggaatatcctcgttgggactaccgggccaattatggcacagctcctggataacaacctccctagggggggatcaggttccgtgctgcaggacgaggaggttctcgcaagcttggaacgggccactctagactttaagcctctccacaagcccaacgggttcatcactttacctcagttaggcaactgtgaaaagatgagtctttcctccaaagtgagcttgccccccatcccagccgtgagcaatatcaagagtctgagcttcccaaagctcgattccgacgatagcaatcagaagaccgccaaacttgcttctacattccattcaacctcctgcctgcgaaatggcacattccagaatagtctgaaaccctcaacgcagagctctgcctcggagttaaatggccaccatacattgggactcagcgccctgaacttagacagtggtaccgaaatgcccgctctgacaagctcccaaatgccaagcctatccgtattaagcgtgtgtaccgaagaaagctcgccaccaaatactgggccaacagtcaccccccctaattttagcgtttctcaggtcccaaatatgccttcatgcccacaggcctacagtgagttgcaaatgttgagtccgtcagagcgccaatgtgtggagactgttgtgaacatgggctattcatacgaatgcgttttgcgggccatgaagaagaagggcgaaaacatagaacagatccttgactatcttttcgcacatgggcaactatgcgagaagggttttgaccccctgctcgttgaagaagcgttggagatgcaccagtgttcagaagaaaaaatgatggagtttctccagctcatgtccaaatttaaggagatgggcttcgaactaaaggatatcaaggaggtcctgttacttcataataacgatcaggataacgctttggaagacctgatggcccgtgctggggctagttag

SEQ ID NO: 210472 - DNA, 690 bp, Artificial Sequence
  Description of Artificial Sequence: Synthetic coding sequence
atgcagatcttcgtgaagaccctgaccggcaagaccatcaccctggaggtagaaccatcggatacgattgaaaacgtaaaggcaaagattcaggacaaagaagggattcctcctgatcagcaacgcctgatatttgcgggcaagcagctcgaggatggccggactctcagcgactacaacatccagaaggagagcactctgcacctcgtgttaaggctcagagggggaatgcagattttcgtgaaaactttaactggcaaaactatcaccctggaggtggaaccttcagatacaattgaaaacgtgaaagcaaaaatccaggacaaggagggcatacctcccgaccagcagcgacttatttttgcgggcaaacagctcgaggacggcagaactctgagtgattacaatattcaaaaggagtctacccttcacctggtcttgaggctacgagggggaatgcagatctttgtgaagaccctgactgggaagacaatcacactggaggttgagccttccgacaccattgaaaatgtgaaagcaaaaatccaagacaaggagggaattccccctgatcagcagaggctgatttttgccggcaaacaactcgaggatgggaggacactcagcgattacaatattcagaaggagagtactctccatctagtgcttcgactccggggtggatgctag

SEQ ID NO: 210473 - DNA, 690 bp, Artificial Sequence
  Description of Artificial Sequence: Synthetic coding sequence
atgcagatcttcgtgaagaccctgaccggcaagaccatcaccctggaggtagaaccatccgatacaatcgaaaacgtgaaggctaaaatacaagataaggaggggattcctccagaccagcagagattaatcttcgccggcaagcagctggaagacggacgcactctgagtgattataatattcaaaaagagagtaccctgcacctcgtcctgagactgaggggaggaatgcagatcttcgtaaaaaccctgacaggcaagacgattacacttgaggtagaaccttcagacaccattgaaaacgtcaaagccaaaattcaggataaagagggcattcccccagaccagcaaaggctgatctttgctgggaaacagctagaagacggccgaactctttcagactataatatccagaaagagagcaccttacacctcgtactccggctaaggggtggtatgcagatctttgtgaaaaccctgacggggaagacaatcactctggaggtggaacctagcgacaccatcgagaacgttaaggcgaagatacaggacaaagagggaatcccacctgatcagcagcgcctgatctttgccggtaaacagttggaagatggccgtaccctgtccgattacaacattcagaaagaatctacacttcatttggtgctgcgtctccgaggaggatgttag

SEQ ID NO: 210474 - DNA, 690 bp, Artificial Sequence
  Description of Artificial Sequence: Synthetic coding sequence
atgcagatcttcgtgaagaccctgaccggcaagaccatcaccctggaggtggaaccctccgatactatcgaaaacgtaaaagcaaagatccaagacaaggaggggatcccgcccgaccagcagcggttaatctttgcaggcaagcagctggaggatggtcgaactctttccgactataacattcaaaaggaatcaaccctgcatcttgtcctaagattgagaggcggcatgcagatcttcgtgaagacccttaccggcaagaccattaccttggaggttgagccctctgacacgatagagaacgtaaaggcaaagattcaggacaaggagggcattcctccagaccaacaacggctgatcttcgcaggcaaacagctggaagatggcagaacattgagcgactacaacatccagaaggagtctacgttacacctggtgctacgattgaggggcggaatgcagatctttgttaagacattgactggcaagactattacccttgaggtcgagcctagtgatacaatcgagaacgtcaaggccaaaatccaggataaggaaggaatcccgcccgaccaacagaggctcattttcgcaggcaagcagcttgaagatggccgtactttgtccgactataacattcagaaagagtccaccctccatctcgtgttacggttgcgggggggttgttag

SEQ ID NO: 210475 - DNA, 462 bp, Artificial Sequence
  Description of Artificial Sequence: Synthetic coding sequence
atgcagatcttcgtgaagaccctgaccggcaagaccatcaccctggaagtcgaaccatctgacacgattgagaacgtgaaagccaagattcaggacaaggagggtattcccccggatcagcagagattgatatttgcaggaaagcagctggaagacgggaggacactgagcgactacaacattcagaaggagagtacgctgcacctcgtcctacgccttcggggtggcatgcagatatttgtgaagactttgaccggaaagactattactctggaagtggaacccagtgacaccatcgagaatgtaaaagcaaaaattcaagataaagaaggaatcccccccgaccagcagcggcttatcttcgccggcaagcagttggaggatggccgcactcttagcgattataatatccagaaggagtccacactgcacctggtgcttaggctacgagggggctgctag

SEQ ID NO: 210476 - DNA, 2058 bp, Artificial Sequence
  Description of Artificial Sequence: Synthetic coding sequence
atgcagatcttcgtgaagaccctgaccggcaagaccatcaccctggaggtcgaacctagcgacactatcgagaatgtcaaggcaaaaatacaggataaggagggcataccacccgatcagcagagacttatattcgcgggaaagcagttagaagatgggagaacactgagcgactacaatatccagaaagagtctacgcttcatctggtgttgagattgcgtggtggcatgcagatcttcgtgaagaccttgaccgggaaaacgatcacgttagaagtggaaccctctgataccattgagaacgtgaaggcgaaaatccaagacaaggaaggtattccccccgatcagcaaagactgatttttgcgggaaagcagctggaagacggcaggacactgtccgactacaatatccaaaaagaatcaactctgcacctggtgctacgattaagggggggcatgcagattttcgttaagacattaactggcaaaacaattactttggaagtggaaccttccgacaccatcgaaaacgtgaaggctaagatccaggataaggaggggatcccttcggaccaacagcgactgatcttcgcaggcaagcagctagaagatggcagaactctgtcagactataatatccagaaagagagtacattgcatttggtactccgcctgagaggcggcatgcaaattttcgtcaaaaccctgacagggaagaccattactttggaggtggagcccagcgatactattgaaaatgtgaaggccaagatccaggacaaagagggtataccgcccgaccagcagagactgatcttcgcagggaagcaactcgaggatggacgtactctgtctgattataatatacagaaggaatcaacgctgcacctggttctgagattacggggaggaatgcagatctttgtgaagaccctcaccggtaagactatcactttggaggtggagcccagcgataccatagagaacgtcaaagctaaaatccaggacaaggaaggaatacctcccgaccaacagcgcctcatatttgcaggaaaacagctggaagatgggagaacactgagcgactacaacattcagaaggagtctactctccatctggtgcttcgcttaaggggagggatgcaaatcttcgtgaagactctgacagggaagactatcacattagaagttgagcctagcgacacaatagagaatgtaaaagccaagatccaggacaaggaggggatccctcccgatcagcagcggcttatatttgcaggaaaacagcttgaggacgggcgtactctctcagactacaacattcagaaggaatctacattgcaccttgtgctacgccttcgcggagggatgcagatcttcgtcaagactctgacgggtaaaacaattacactggaagtcgaaccttctgacactattgaaaacgttaaggccaagatccaagacaaggagggtatccctccagatcagcagaggctgattttcgcaggaaagcagctggaggatggaagaactctgtcggactataatatccaaaaggaatcaacactccatcttgtgctacgcctgcgaggcggcatgcagatttttgtgaagacactgacaggtaagacgatcaccctcgaggttgagccctcagacactatcgagaatgtgaaagccaaaattcaggacaaggaaggcatcccacccgaccagcagcgtcttatcttcgcaggcaagcagctcgaggatgggagaactctctctgattataacatccagaaggagtccaccctgcaccttgtgttgcgcctgaggggggggatgcaaatattcgtaaagacattgaccggcaagaccattaccctggaagtggagccctcagacactatcgagaacgtcaaagccaaaatccaggataaggagggaattcctcctgaccagcaaagactgatcttcgcaggtaagcagctggaggatgggcgcacactctctgactataatattcagaaggaatctacccttcacttagtactgagacttcgcgggggggtctag

SEQ ID NO: 210477 - DNA, 450 bp, Artificial Sequence
  Description of Artificial Sequence: Synthetic coding sequence
atgcagatcttcgtgaagaccctgaccggcaagaccatcaccctggaggtggagcccagtgacacaattgagaacgttaaggcgaagatccaagataaggaaggcatcccaccagatcaacagagattgatatttgccggtaagcagctcgaagacgggcgcaccctgtctgactataatatccaaaaggaaagcaccttacacctggtgttaagactccgtggcggcatgcagatttttgtgaagacgttgaccggcaaaacaataactctagaggtggagccatccgatactatagaaaacgttaaggcgaagatccaagacaaagaaggcattcccccggaccaacagcgcctcatttttgccgggaagcagctggaggatgggagaacattgagtgactataacatacagaaggaatctaccctccacctggtgctgagattatag

SEQ ID NO: 210478 - DNA, 372 bp, Artificial Sequence
  Description of Artificial Sequence: Synthetic coding sequence
atgcagatcttcgtgaagaccctgaccggcaagaccatcaccctggaagtagagccttccgacactattgaaaatgtgaaggcaaaaattcaggacaaagaggggatcccgcccgatcagcagaggctgatttttgctggcaaacagctggaggatgggagaaccctatccgattataacatacagaaggaatcaaccctgcatttggtgctcagattgaggggtggaatgcagatctttgtgaagactttaaccggcaaaactattacactggaggtggagcccagcgacaccattgagaacgtcaaggcgaaaatccaggacaaggaaggcataccacccgatcaacagcgattgatatttgccggctag

SEQ ID NO: 210479 - DNA, 2058 bp, Artificial Sequence
  Description of Artificial Sequence: Synthetic coding sequence
atgcagatcttcgtgaagaccctgaccggcaagaccatcaccctggaagtggagcccagcgacacaatcgaaaatgtgaaagcgaaaatccaggacaaagaaggaatcccccccgatcagcaaaggcttatattcgcaggtaagcagctcgaggacggacggaccctgtcggattacaacattcaaaaggagagcaccctgcatctcgtgctacgcctcagaggcggcatgcagatctttgtcaagactcttacaggcaagacaatcaccttggaagtcgagccctccgacaccattgaaaacgttaaggccaagattcaggacaaggagggaattccgcccgatcagcagcgcttaatctttgccgggaaacaactggaggatgggcgtacactgagcgactacaacatccagaaggagagcacattgcatctcgtcctgcggcttaggggcggcatgcagattttcgtcaagacgctgacaggcaaaacaataacactggaggttgaacccagtgacacgatagagaatgttaaggcaaaaattcaggacaaagagggaattccttctgatcagcagcggttgatcttcgcgggcaaacagctcgaggatggcaggacactttctgactacaatatacagaaagagagcactctgcatctggtgttacgtcttcggggcggtatgcagatcttcgtgaaaacgctcaccggaaagacaatcacgctggaggtggaaccgtcagacaccattgaaaacgtcaaggcaaagatacaggataaagaaggcatcccaccagaccagcaacgcttaatcttcgccggcaagcagctggaggacgggagaacactgagtgactacaacattcagaaggagagtaccctgcatctggttctccggttgcgcggtggtatgcagattttcgtgaagacactgactgggaagacaattaccctggaagtggagccctctgatacgattgaaaacgtaaaagccaagatacaagacaaagaggggatccctcctgatcagcaacgcctcatctttgccgggaaacaactggaagatgggcgcaccctttctgattataatattcagaaggagagcaccctgcacctcgtgctgaggcttcgtgggggcatgcaaatattcgtgaaaacactgacgggcaaaactatcactttggaagtagagccttccgacactattgaaaatgtgaaagcaaagatacaggacaaagaaggtatccctccggatcagcagcgcctgatttttgccggcaagcagctagaagatggacggacgctaagcgattacaacattcagaaagaaagtacacttcatttagtgctgaggctcagggggggcatgcagatattcgttaagactctcaccggcaaaactatcaccttggaagtggagccatccgatactatagagaacgtgaaagccaaaatccaggacaaagaggggattcctcctgaccagcaaagacttatttttgctggaaaacagctggaggacggccgaaccctgagtgactataacatccagaaagaaagcactctgcatctcgtgctaaggttacgaggcggcatgcagatctttgtaaagaccctgacaggaaagactatcaccctcgaagttgagcccagcgatacgatcgaaaatgtgaaagccaagatacaggataaagaaggaatccctcctgatcagcagcggttgatatttgctgggaagcagttagaggatggaagaaccctgtcagattacaacattcagaaggagtccactttacatttggtcctgagactgagaggcggcatgcagatcttcgtgaagactctgactggcaagacaattacgctggaagtggaacccagcgataccatcgagaatgtgaaagccaaaatccaggacaaggaggggatcccaccggaccagcagcggttaatcttcgctggaaagcagcttgaagacggccgtactctgtccgattacaatatccaaaaagagagcaccttgcacttggtcctgcgccttcgcggtggagtctag

SEQ ID NO: 210480 - DNA, 486 bp, Artificial Sequence
  Description of Artificial Sequence: Synthetic coding sequence
atgcagatcttcgtgaagaccctgaccggcaagaccatcaccctggaagtggaaccgtccgacaccattgaaaacgtgaaggccaaaatccaagacaaggaagggattccccccgatcagcagaggctcattttcgccggtaagcagctggaagatgggcggacattgtccgattacaacattcaaaaggaatccactctacaccttgtcctccgcctgcgaggcgggatgcaaatcttcgtgaagacgttaaccggaaagacaatcactcttgaggtggagccttcggacacaattgagaatgtgaaagctaaaatccaggacaaggaaggcatcccccctgaccaacaaagactgatatttgctggaaaacaattggaagatgggcggactctgtcagattataatattcagaaggaatcaacactacatcttgtcctccggctgcgcggaggtatgcagattttcgttaagaccctgacctag

SEQ ID NO: 210481 - DNA, 405 bp, Artificial Sequence
  Description of Artificial Sequence: Synthetic coding sequence
atgcagatcttcgtgaagaccctgaccggcaagaccatcaccctggaggtggagccgtcagatactatcgagaatgtgaaggcaaagattcaggataaggagggaatccctcccgaccagcaaagactaattttcgccggcaagcagctggaggacgggagaaccttaagcgattacaatatccaaaaggagtccacactgcacctcgtgcttcggctgcgtgggggtatgcagattttcgtcaagacactcactggcaaaaccatcactctggaggtggaaccatctgataccattgaaaatgtgaaggctaaaatacaagataaagaagggatcccgccagatcagcaacgcttgatttttgccggaaagcaacttgaggatggccggacgctgtcagactag

SEQ ID NO: 210482 - DNA, 510 bp, Artificial Sequence
  Description of Artificial Sequence: Synthetic coding sequence
atgcagatcttcgtgaagaccctgaccggcaagaccatcaccctggaagtcgaaccaagcgacaccattgaaaatgtgaaggctaaaattcaggacaaggagggtatcccacccgatcagcaacggttgatatttgcagggaaacagctcgaagacggacgaactctgagtgactacaacattcagaaagagagtactctgcatctagtgcttaggttgcgcggtggcatgcagattttcgttaagactctcaccggaaaaacaataactctcgaggtggagcctagcgataccattgagaatgtcaaagcaaaaattcaggacaaagagggcattccctccgaccaacagagactgatttttgcgggaaagcagctcgaagatggacgaacactgtctgactacaatatccagaaggaatctacactacatctggtcctaaggctccggggggggatgcagattttcgttaaaactttgaccggaaaaacaatcaccctggaagtctag

SEQ ID NO: 210483 - DNA, 468 bp, Artificial Sequence
  Description of Artificial Sequence: Synthetic coding sequence
atgcagatcttcgtgaagaccctgaccggcaagaccatcaccctggaagtggagccttctgatacaatcgagaacgtgaaagctaaaatacaggacaaggagggtatcccacctgatcagcagcggctgattttcgctggaaagcagcttgaggacggccgaaccctgtcagactacaacattcagaaagagagcaccctacacctggtgcttcggttgcgtggggggatgcagatcttcgtgaaaaccctgactggcaagactatcaccctcgaagttgaaccctccgatactatcgagaatgtgaaagcaaagatccaggataaagaaggcattcctcccgaccagcaaagactgatatttgccgggaagcagctcgaagatggacgaacgctttccgattacaacatccaaaaggaatctaccttgcatttagttcttagactcagaggtggaatgcaaatatag

SEQ ID NO: 210484 - DNA, 186 bp, Artificial Sequence
  Description of Artificial Sequence: Synthetic coding sequence
atgcagatcttcgtgaagaccctgaccggcaagaccatcaccctggaggtggagccctcagatacgatcgagaatgtcaaggcaaagatccaagataaagagggcattccacccgaccagcaacgccttatatttgccggcaagcagctcgaggacgggaggactctctccgactataatatctag

SEQ ID NO: 210485 - DNA, 1830 bp, Artificial Sequence
  Description of Artificial Sequence: Synthetic coding sequence
atgcagatcttcgtgaagaccctgaccggcaagaccatcaccctggaggtggagccatcagataccattgaaaatgttaaggccaagatccaggataaggaaggcataccccctgaccagcagcggttaatattcgccggaaagcagcttgaggacggacggactcttagtgactacaatattcagaaagagagcaccttgcaccttgtcctcaggctgcggggcggcatgcagatattcgtaaaaactttgaccgggaagacaattactctggaagttgaaccaagcgataccattgaaaacgtaaaggccaagatccaggacaaggaaggaataccaagcgatcagcagcgcctgatctttgcgggcaagcagctggaggacgggcgaacactctcagactataatattcagaaagaatctaccctccacctggtgcttagacttcgggggggaatgcagatcttcgtgaaaactttgacgggcaaaaccatcacgctggaggtggagccatctgacacaattgaaaatgtgaaggcaaagatccaggacaaagaaggaataccacctgatcaacagcggctcatcttcgcaggaaagcagctggaagatggtcggactctctcagactacaatatccagaaggagtctacgctccacttagtgctgaggctaaggggtggtatgcagattttcgtaaaaactctgacgggcaagacaattacactggaagttgagccaagcgacaccattgagaacgtgaaggcaaaaattcaggataaagaagggataccccccgaccagcagagacttatttttgcgggtaagcagcttgaggatggccgcaccctgagcgactacaatatccagaaagagtctaccctgcacttggtcctgagactgcgcggcggtatgcagattttcgtgaagacactgaccggcaagaccattaccctggaggttgaaccatccgatacaattgagaatgtcaaagcgaagattcaggacaaggaaggtatacctcctgatcaacaaaggttgatcttcgctggaaaacagttagaagacgggcgtacccttagtgattacaatatccagaaggagagtactctccacctggtactgaggctgagaggtgggatgcagatattcgtgaaaacactaacagggaagaccattactctagaagttgagccatccgatactatcgagaatgttaaggccaaaattcaagacaaagaaggcattccgcctgaccagcagcgactcatttttgcaggcaagcagctcgaggatgggcggaccctgagcgattataatatccagaaagagtctaccttacatctcgtccttcggctaaggggaggcatgcagatctttgtcaagacccttaccgggaagacaataaccttggaggtggaacccagtgacacgatcgagaatgtaaaagcaaaaatccaggataaggagggcatcccacccgaccagcaacggctcattttcgcagggaaacagctggaagacggtcggacactgtccgattataatatacagaaggagtcaaccctgcacctagtgctgcggctgcggggcgggatgcagatctttgtcaagacactgactggcaaaaccatcacgctggaagttgagcccagtgacacaattgaaaacgtcaaggcgaagatccaagataaagaaggtatcccccctgatcagcagcgcctaattttcgccgggaagcaacttgaagacggaagaactctcagtgattataacatacagaaagaatctactttgcacctggtgctccgcttgaggggcggcgtgtag

SEQ ID NO: 210486 - DNA, 411 bp, Artificial Sequence
  Description of Artificial Sequence: Synthetic coding sequence
atgcagatcttcgtgaagaccctgaccggcaagaccatcaccctggaagtggaaccctccgacaccatagaaaatgtgaaagccaagatccaagataaggaaggaattccgccggatcaacaacggctgattttcgccgggaaacagttagaggacggacgaaccttgagtgactacaacatccaaaaggaatccaccctgcatctcgttctgagactaaggggaggaatgcagatatttgtcaaaaccttaacaggtaagaccattacactggaggtggagccttcagataccatcgagaacgtcaaggccaaaatccaggataaggaaggtatcccaccagatcagcagcgtctgattttcgctgggaagcagctggaggacggccggacgctgagtgactacaattag

SEQ ID NO: 210487 - DNA, 672 bp, Artificial Sequence
  Description of Artificial Sequence: Synthetic coding sequence
atgcagctgaagcccatggagatcaaccccgagatgctgaacaaggtgctctcccggttaggtgttgcaggccagtggcggttcgtggacgtgctcggcttggaagaagagtccctaggaagtgtccccgcccctgcttgcgcactgctcctgctgtttccactgaccgctcagcatgaaaatttccgtaagaagcaaatcgaggagctcaaggggcaggaagtaagcccgaaggtatacttcatgaagcagaccatcggaaattcctgtggcaccattggactcatccacgcagtagcaaataaccaggacaagctgggctttgaggatggctccgtgctcaaacagttcctgagtgagaccgagaagatgagtcccgaagacagagccaagtgtttcgagaagaatgaggccatccaggccgcacatgacgcagtagcacaggaaggccagtgtcgggtcgacgacaaagtgaattttcattttattctgtttaataatgtggatggacacctgtatgagctggatggtcgcatgccttttcccgtcaatcatggtgcctcctcggaggataccctgctgaaggacgccgcaaaggtgtgtagggagtttaccgagagagagcagggagaagtaagattctctgccgtggcactatgtaaagccgcatag

SEQ ID NO: 210488 - DNA, 642 bp, Artificial Sequence
  Description of Artificial Sequence: Synthetic coding sequence
atgcagctgaagcccatggagatcaaccccgagatgctgaacaaggtgctgtcacggctgggcgtggcaggccaatggagattcgtcgacgtgttggggctggaagaagagtccctcggatctgtacctgcccctgcatgtgcactgctgttgttgtttccattaacagcccagcacgaaaactttaggaagaaacaaatagaggaactgaaaggccaggaagtgtcccccaaggtgtattttatgaagcagacaatcggcaacagctgcggtactattgggctcatccacgccgtggctaacaatcaagacaagctgggtttcgaggatggctccgtcctcaaacagttcctctccgagaccgagaagatgtctccagaggaccgggccaaatgctttgagaagaacgaggctatacaggccgcacacgacgctgtggcccaagaggggcagtgtcgcgtggatgataaggtgaattttcactttatactgttcaacaacgtggatggtcacctctatgagctcgacgggcggatgccgtttcctgtgaaccatggggcgagttcagaggacacgctgctcaaggacgcagcaaaggtgtgcagagagttcactgagagggagcaaggcgaagttcgctag

SEQ ID NO: 210489 - DNA, 177 bp, Artificial Sequence
  Description of Artificial Sequence: Synthetic coding sequence
atgcagctgaagcccatggagatcaaccccgagatgctgaacaaggtgttatcccgccttggagtagccggtcagtggaggtttgtggacgtgctgggccttgaagaagagagcctgggatctgtgcccgctcctgcatgcgctcttttgctgctcttccctcttaccgcccagtag

SEQ ID NO: 210490 - DNA, 756 bp, Artificial Sequence
  Description of Artificial Sequence: Synthetic coding sequence
atggtgccccggcccgtgtgcgccgtgctgctgctgttccccatcaccgaaaaatatgaggtgtttagaactgaagaagaggagaaaataaagtcacagggacaggatgttacatcctcagtatacttcatgaaacagacgatttcaaatgcttgcggaacgataggcctcatccacgcaattgccaataataaagacaaaatgcactttgaatccggctcgaccctgaagaagtttttggaagaatctgtgtccatgagccccgaggaaagagccagatatttggagaattacgatgctattcgtgtcacccatgagacatccgcgcatgaaggccagactgagtccagttcccctagctcttcccagccccactcatcccactgcagaacaaaagcgagttctctatgccaccacgcctccttgccgtgggtcaagcggaatcatgtcgggcccgctaaagcaacttcgccatctctcaggttgagacggtggcgacccttcctgcgcttaccaagcctaggcctgcacagtgtcgcacctagcatcgatgaaaaggtcgacctccatttcattgccctggtgcacgttgacggtcatctatacgaactcgacggacgaaagcccttccccattaaccacggtgagacttctgacgaaaccctgcttgaggacgctattgaggtgtgcaaaaaatttatggaaagagatccggatgaactgaggttcaacgctattgccctttcagccgcgtag

SEQ ID NO: 210491 - DNA, 693 bp, Artificial Sequence
  Description of Artificial Sequence: Synthetic coding sequence
atggagggccagcggtggctgcccctggaggccaaccccgaggtgacgaatcaatttctgaagcagctcggactgcacccaaattggcaattcgtcgatgtgtatggcatggaccccgagcttctgtctatggtccctcgacctgtatgtgccgtccttcttctgtttccaatcacagagaagtatgaggtgttcaggaccgaggaagaagagaaaatcaagtcccagggccaggacgtaactagctccgtttatttcatgaaacagaccatttctaacgcatgcggtacaattggcctgatccatgcaattgcgaacaacaaagacaagatgcactttgagtccggtagtaccctcaagaaatttctggaagagtcagtgtcaatgagccctgaggaacgcgcgcgatatttggaaaactacgatgcaattcgagttacccatgagacatccgctcacgaaggccagactgaagctcctagtatcgacgaaaaagttgacctgcatttcattgcccttgtgcatgtagatggtcacctttacgagcttgacggacgcaaacccttccctataaaccacggggaaacatcagacgagaccctgctggaggacgcaatcgaggtgtgcaagaagttcatggagagggatcccgatgagctcagattcaatgctatcgcactgagtgctgcttag

SEQ ID NO: 210492 - DNA, 687 bp, Artificial Sequence
  Description of Artificial Sequence: Synthetic coding sequence
accgaggaggaggagaagatcaagagccagggccaggacgtgaccagctctgtgtatttcatgaagcagacgatatcaaacgcgtgtgggaccatagggcttatccacgcgattgcgaataacaaagacaagatgcatttcgaatccgggtcaacactgaaaaagttcctcgaggaatcagtgtccatgagtcctgaggaacgcgctaggtatctcgaaaattatgatgccatccgcgtcactcatgagaccagcgcacacgagggacagaccgagtcctcatctccttctagtagccaacctcactctagtcactgtcgaacaaaagcttctagcctctgtcatcacgcctcactaccatgggtcaagcgcaaccacgtggggccggcgaaagctacaagtccctctcttagactgaggcgctggagaccattcctccggctccccagcctcggcctgcactcagttgctccttccatcgatgaaaaggtcgatctgcactttattgccttagtgcatgtggacggccatctctacgagttggacggcaggaaaccttttcccatcaatcacggcgagaccagcgatgaaaccctgctggaggatgcaatcgaggtttgcaaaaagttcatggagcgtgaccccgacgagctcagattcaacgccatcgccctaagcgctgcatag

SEQ ID NO: 210493 - DNA, 981 bp, Artificial Sequence
  Description of Artificial Sequence: Synthetic coding sequence
atgaccggcaacgccggcgagtggtgcctgatggagagcgaccccggcgtgttcaccgaactgattaaaggttttggctgccggggggcgcaagtggaggagatctggagcctagagccagagaattttgaaaaactcaaacccgtacatgggttgatttttctctttaagtggcagcctggcgaggagcctgccggctccgtcgttcaggatagtcgccttgacacgatcttcttcgccaagcaggtaattaacaacgcctgtgctacccaggcaatcgtgagcgtcctgttgaattgtacccaccaggacgttcatttgggcgagacactctcagaatttaaggaattttcccagagttttgatgccgcgatgaaaggactggctctgtcaaatagcgacgtgatcaggcaggttcacaattcattcgcccggcaacagatgttcgaattcgacaccaagacttccgccaaagaggaagacgcattccacttcgtgagttatgtaccagtgaacggccggctctacgaattggatggactccgcgaagggcctattgacctcggcgcttgcaatcaagatgattggatctccgccgtccgccctgtgattgagaaacgcatacaaaagtacagcgagggcgagattcggttcaaccttatggcaatagtgtcagaccggaaaatgatatatgaacaaaagatcgcagaacttcagcggcagcttgctgaggagcctatggacactgaccagggtaattcaatgctttcagccatccagtctgaggtcgccaagaatcaaatgttaattgaagaagaggtccaaaaactcaaaagatataaaattgaaaacattcgtcgcaaacataattacctgccctttataatggagctcctcaagacattagcagagcatcagcagctaatcccactggtggaaaagtttgaaaagcatttcgaaaagaccctcctgggaaaatag

SEQ ID NO: 210494 - DNA, 951 bp, Artificial Sequence
  Description of Artificial Sequence: Synthetic coding sequence
atgaccggcaacgccggcgagtggtgcctgatggagagcgaccccggcgtgtttaccgagctgatcaagggatttggatgcagaggggctcaggtcgaagaaatttggtccctggaaccggaaaactttgaaaagttgaagccggtacacggtttaatctttctctttaaatggcagccgggagaggagccagccgggagcgtggttcaggatagccgtttagacacaatctttttcgccaagcaagtgatcaataatgcctgtgccacgcaggctatcgtcagcgtgttgctcaactgtactcaccaggatgtccacctaggagagacactctcagaattcaaagaattttcccagagcttcgacgccgccatgaagggtctggccctatctaattccgatgttatccggcaggtccataactcttttgctagacagcagatgtttgagttcgacaccaagactagcgccaaggaagaggacgcctttcactttgtcagctacgtgccagtcaatgggcgcttgtacgagctggatggtttgcgggagggacccattgatttgggagcctgtaatcaggacgactggatctcggccgtccgacctgtgattgagaaacgaatccagaaatattccgagggcgagatacggtttaatctcatggccattgtcagtgaccggaagatgatctacgaacagaagatcgcggagctacagaggcaattagcagaagaacctatggatacggaccaaggaaattcaatgctaagcgccatacagtccgaggtggctaagaaccagatgctaatagaggaggaggtccaaaagttgaaaagatataaaattgagaatatacggaggaagcataattacttgccgttcattatggaactgctgaaaaccctcgccgaacaccagcaactgattcctctcgtcgagaagggaaagtag

SEQ ID NO: 210495 - DNA, 1107 bp, Artificial Sequence
  Description of Artificial Sequence: Synthetic coding sequence
gcccggggcggcagcggccggtgcgtggcccgggccatgaccggcaatgccggcgaatggtgccttatggagagcgatcctggcgtttttacagagctgatcaagggttttggctgtcgtggcgcccaggtggaagagatctggtctctcgagccggaaaatttcgagaagcttaaacccgtgcacgggctcatcttcttgtttaagtggcagcccggggaggagcccgccggtagcgtagtgcaagattccaggttggacaccatcttctttgccaagcaggtcatcaataatgcctgcgccacccaggctatcgtgtctgtgctcctgaattgtacccaccaggatgtgcatcttggcgaaacactctctgagtttaaggagttcagccagtctttcgatgctgctatgaaagggttggccctttccaatagtgatgtaattagacaggtgcataatagctttgctaggcaacagatgttcgagtttgataccaagaccagcgccaaggaggaagatgccttccacttcgtgtcatacgttcccgtgaacggacgcttgtatgaactcgacggcctgagggaaggacccatcgatctgggtgcttgcaatcaagatgattggatctcggcagtaaggcccgtgatcgagaagcgcatccaaaaagatggcttttccccctgttgtcctggctggagtcagacccctgagctcaagccttcagcttgtttagatttacccaaatggtactcagaaggagaaatccggtttaatctcatggccatcgtgagcgaccgcaagatgatttacgaacaaaaaatcgccgagcttcagcgccagctcgcggaggaagagccgatggacaccgatcaaggcaacagtatgctctccgcgatacaaagtgaggtcgcaaaaaatcagatgctcattgaagaagaagttcagaagctaaagcgctacaaaatcgaaaacattcgaagaaagcataattaccttcccttcatcatggaactcctgaagactcttgccgaacaccagcaactgatccccctggttgagaaagcgaaggaaaagcaaaacgctaagaaagcacaggaaacaaagtag

SEQ ID NO: 210496 - DNA, 1068 bp, Artificial Sequence
  Description of Artificial Sequence: Synthetic coding sequence
atgaccggcaacgccggcgagtggtgcctgatggagagcgaccccggggtatttactgagcttatcaaaggctttggttgtcgtggtgcacaggtagaggaaatttggtcactggaaccagagaacttcgagaaactgaagcccgtccacggcctgatctttctgttcaagtggcaacctggtgaagaacctgccggctcagttgttcaggatagtcgattggatacaattttcttcgcaaagcaggtcatcaacaacgcttgcgccactcaggccattgtgtcagtgctgctcaactgcacgcatcaagatgtccatcttggggagacccttagtgagtttaaggaatttagccaatcatttgacgctgctatgaaggggctggcccttagcaattctgatgtgatcaggcaagtccataattcattcgcccgtcagcagatgtttgaatttgatacaaagaccagcgccaaggaagaagacgcatttcacttcgtatcttacgttcctgttaatggccgtctctatgagcttgacggtctgcgcgagggcccaatcgatctcggtgcctgcaaccaagatgactggattagcgcagtgcgtcctgttatcgaaaaaaggatccaaaaagacggcttctcaccatgttgtccaggttggagccagaccccggagctgaaaccttcggcgtgtctagatctgccaaagtggtactcagagggcgaaatccgcttcaacctgatggccattgtgtcggaccgcaagatgatttacgagcaaaagatcgccgaactgcagcggcagcttgccgaggagcccatggacaccgaccaaggaaacagtatgctgagcgcgattcagtccgaggtggcaaaaaatcagatgttgatagaggaagaagttcagaagctgaagaggtacaaaatcgaaaatatccgacgcaaacacaactacttaccctttattatggagctgctgaaaacactcgcggaacaccagcagctcatccctctggtggagaaagcgaaagaaaagcagaacgccaagaaggcccaggagaccaagtag

SEQ ID NO: 210497 - DNA, 579 bp, Artificial Sequence
  Description of Artificial Sequence: Synthetic coding sequence
atgaagggcctggccctgagcaacagcgacgtgatccggcaggtgcacaattccttcgcgcgacaacagatgttcgaattcgacaccaagacaagcgccaaagaagaggatgctttccacttcgtgtcttacgtgccagtgaatggccgcctctatgagctggacggccttcgggagggacccatagaccttggcgcctgtaatcaggatgactggatctcagctgttcggcctgtgatcgaaaagcggattcagaagtattcggagggggaaataagattcaacctgatggctatcgtgagtgaccgcaaaatgatctacgagcagaagatcgcagagctgcagcggcaactggctgaggaacccatggatactgaccagggaaattcgatgctgtccgccatacagagcgaggtcgccaaaaatcagatgctcattgaggaagaggtacagaaactgaagaggtataaaattgagaacattaggagaaaacacaactatctgccttttatcatggagcttctgaaaaccctcgcagagcaccagcagcttatcccccttgtggagaagattttttag

SEQ ID NO: 210498 - DNA, 987 bp, Artificial Sequence
  Description of Artificial Sequence: Synthetic coding sequence
atgaccggcaacgccggcgagtggtgcctgatggagagcgaccccggagtctttactgaactaattaaagggtttgggtgtcgcggcgcccaggtcgaagagatttggagtttggaacctgagaacttcgaaaagctgaagcccgtacatggattaatcttcctgttcaagtggcagcctggggaggaacctgccggtagtgtggtacaggatagtcgtttggatactatcttttttgccaagcaggtaatcaataacgcttgtgcaacccaggcgattgtctctgtgttgctgaactgcacccatcaagatgttcatctaggggagactctctcagagtttaaggagttttcacaatctttcgatgccgctatgaagggcctggctctctctaattccgacgtgatccgacaggttcacaactcttttgcacgtcaacagatgttcgaattcgatactaaaacctcggctaaggaagaggatgcttttcatttcgtatcatatgtcccagtgaatgggcgactgtacgagttggacgggctgcgcgaaggaccaattgatcttggtgcgtgcaaccaggacgattggattagcgcagtcagacctgtaatcgaaaaacggatacagaaatacagtgaaggcgaaattcgctttaatctcatggcaattgtgtcagatcgcaagatgatttacgagcagaaaatagcggaattacaaaggcagctcgctgaggagccaatggacacggatcaaggtaattcgatgctgtctgcaatacagagcgaagtagcaaagaaccagatgctgattgaagaggaggtccaaaaactcaagcgctataaaattgagaatatacgtcggaaacacaactatttaccgtttatcatggagttgttgaagacactcgccgagcaccaacagctgattcctctggtggaaaaggccaaagagaagcagaacgcgaagaaagcccaagagacgaaatag

SEQ ID NO: 210499 - DNA, 990 bp, Artificial Sequence
  Description of Artificial Sequence: Synthetic coding sequence
atgaccggcaacgccggcgagtggtgcctgatggagagcgaccccggcgttttcacggaactcatcaagggcttcggttgtcgtggcgctcaggtagaagaaatttggagcctggagcccgagaacttcgaaaaactgaaacctgtgcacgggttgatctttctgttcaagtggcagcccggcgaggaacccgctggatctgtggtccaggacagcagattggacaccatcttcttcgccaaacaagtaataaacaatgcatgtgcgactcaggctatcgtgtcagtcctacttaactgtactcatcaggacgtgcacctgggagagacactgtcagagttcaaggagttttcccagtcttttgatgcagccatgaaggggctggctctctccaactcggatgtaatcagacaggtgcataactccttcgcacgccagcaaatgtttgagttcgataccaagaccagtgcaaaagaagaggacgcttttcatttcgtgtcttatgtcccagtcaacggccgtctgtacgagctggatgggctgcgtgagggcccaattgaccttggagcttgcaaccaagatgactggattagtgccgtacgaccggtgatcgagaaacgcatacagaagtatagcgagggggaaatacgctttaacctgatggccatcgtgagtgaccgaaaaatgatctacgagcagaagattgctgagctccaacgccaacttgccgaggaagaacctatggataccgatcagggtaactccatgttgtcagcaatccagtctgaggtggcaaaaaatcaaatgctgatcgaagaggaagtgcagaaattaaaacggtataagatcgagaacattaggcgaaagcacaactatctgcccttcattatggagctgctcaagaccttggccgagcatcagcaactcattccgctggtcgaaaaggcgaaggagaagcagaacgccaagaaggcccaggagacaaagtag

SEQ ID NO: 210500 - DNA, 954 bp, Artificial Sequence
  Description of Artificial Sequence: Synthetic coding sequence
atggagagcgaccccggcgtgttcaccgagctgatcaagggcttcggctgccgcggcgctcaggtagaagaaatttggtcactggaaccagaaaactttgagaagctgaagccggttcacggccttatctttctgtttaaatggcagcctggggaggagccagcggggtctgtcgtgcaggattccagactcgacactattttcttcgcaaagcaggtgataaacaatgcatgcgccacccaagccattgtgtcagtacttctgaattgcacacatcaggacgtccacctgggggaaacgctgagcgaattcaaggaattttcccagtccttcgacgcggctatgaagggcctggcccttagcaactccgatgtcatccgacaggtgcacaacagttttgcccgccagcagatgttcgaattcgacacgaaaacatctgccaaagaggaggacgctttccacttcgtctcctacgtgcctgtgaatgggagattgtacgaattagatggtctgagagagggccccatcgatttaggagcgtgtaaccaggacgactggattagcgccgtgcggcctgtgattgagaagcggatacagaagtatagtgaaggagagatcagattcaacctgatggctatcgtctccgacaggaagatgatctacgaacagaagatagcggagttacagaggcagcttgccgaagaagagccgatggatacggaccaagggaacagcatgctgtctgcaatccagtcagaagtagccaagaaccagatgctgatcgaggaggaggtccagaaacttaagcggtacaagattgagaacatccgcagaaagcataactacctgcctttcataatggaattgctgaagaccttagcggagcatcaacagctcatcccgttggtagagaaattcgagaagcactttgagaagacacttctggggaaatag

SEQ ID NO: 210501 - DNA, 300 bp, Artificial Sequence
  Description of Artificial Sequence: Synthetic coding sequence
tgaaacctgatggccatcgtgagcgaccggaagatgatctacgagcagaagatcgcagagcttcaacgacaactcgctgaggagccaatggacacagatcagggcaactcaatgttgtcagccatccaatccgaggtggccaaaaatcagatgctgattgaggaggaggtacagaagctgaagcggtataaaattgagaacatccgcagaaagcacaattacctgccgttcattatggagcttctgaagaccctggctgagcaccagcagctgattcctctggttgaaaaaattttctag

SEQ ID NO: 210502 - DNA, 498 bp, Artificial Sequence
  Description of Artificial Sequence: Synthetic coding sequence
atggtgcggcccggcctggcccggatgagcctgccccggtgctggtttcgttaccccgggtggacaggcgctgaagcgggcagagggagggcgatcgtcagtcgacgccttccctccctgaatccttgggacgccggggagcgccacggaggcctggtgaggatctgcgcgtcactcggccctcacaaacgccttcccgccggcctgccccagtgtccccacctctatctggctgccgatcctcttgaccctcagcgtcgccaagagaagtcatgtgctgccctcggaaacgataagcgccgacagccagatggacagaggcagccccagcagcaacagcaacctcactgtcggcggggtttccaggctcccgccctccccaatcctctgagagttttacagggccttggtcgcgtgagcatgagcctggggtggctagaacgaccacctgcgctgagccgcgctgcaggctgtagaggagcccaggtcgaggagtag

SEQ ID NO: 210503 - DNA, 657 bp, Artificial Sequence
  Description of Artificial Sequence: Synthetic coding sequence
tgactgagcgagttcaaggagttcagccagagcttcgacgccgccatgaaggggctggctctatccaattcggacgtgatccgccaggttcataattcttttgcgaggcaacagatgttcgaatttgatacgaagacctcagctaaagaggaagacgccttccatttcgtcagctatgtacccgttaatggcagactgtacgaactggacggtttgcgagaggggcccatcgatctcggagcttgcaatcaggacgactggatctctgccgtcagacctgtaatagagaagaggattcagaagtactctgagggtgaaatccgcttcaatcttatggccatagtctccgataggaaaatgatttacgaacagaagattgccgagctgcagaggcaactggcagaggaagaacccatggacacagatcagggaaacagtatgctttctgcaatccagtcagaggttgctaaaaatcagatgttgattgaggaggaggttcagaagctgaagaggtacaaaatcgaaaatattcgccgaaaacacaactatctgccgttcatcatggagttgctgaaaacactggcggagcaccaacagctgattccactggttgagaagttcgaaaaacacttcgaaaaaacattgcttggcaaatag

SEQ ID NO: 210504 - DNA, 777 bp, Artificial Sequence
  Description of Artificial Sequence: Synthetic coding sequence
atgagcctgggctggctggagcggccccccgccctgagccgggccgctggctgtcgaggagcgcaggtggaagaaatatggtccctggaacctgagaatttcgaaaaactgaaaccagtgcatggtttgatcttcctcttcaaatggcagcctggtgaagagcccgccggtagtgttgttcaagatagcaggctggacaccattttcttcgcgaagcaagtcattaataatgcctgcgctacacaggccatcgtcagcgtgttgttgaactgcacccaccaggacgtccacctgggagagaccttgtcagaatttaaagagtttagtcaaagctttgacgctgcgatgaagggcctcgccctgtccaactcggatgtcatcagacaagtacataatagttttgcgagacagcagatgtttgaattcgatacaaaaacctccgccaaagaggaggatgcgtttcatttcgttagttatgtacctgtaaatggcagactgtatgagctggacggactgagagaaggacctatagacctgggggcatgcaaccaggatgactggatctccgccgtcaggcccgttatcgagaagagaattcaaaaatactccgaaggtgaaattcggtttaatctgatggcaatcgtgtcggaccggaagatgatatacgaacagaagatcgcggagctccagcgccagctggccgaagaacctatggacaccgaccagggcaactcaatgttgtccgccatacagagtgaggttgcaaaaaaccagtag

SEQ ID NO: 210505 - DNA, 552 bp, Artificial Sequence
  Description of Artificial Sequence: Synthetic coding sequence
tgacagcagatgttcgagttcgacaccaagaccagcgccaaggaggaggacgccttccactttgtgagctatgtcccagtcaacggccgcctgtatgaactcgacggtttacgcgagggtcctatcgatctgggagcctgcaaccaagacgactggatctcagctgtgcgccctgttattgagaagcgcattcagaagtacagtgaaggagagatcaggttcaatctgatggccatcgtatcggatcgcaagatgatttacgaacagaaaatcgctgaactacagaggcaactggcagaggaggaacccatggacacagaccagggtaatagcatgcttagcgcgattcagagcgaggtagcaaagaaccagatgctgattgaagaggaagtacagaaactgaaacgttacaagatcgagaatatcaggagaaagcacaattacctgccattcatcatggagctcctgaaaacattagctgagcatcagcagctgataccccttgtggaaaaattcgagaaacattttgagaaaactttattggggaagtag

SEQ ID NO: 210506 - DNA, 348 bp, Artificial Sequence
  Description of Artificial Sequence: Synthetic coding sequence
tgagagggcgagatccggttcaacctgatggccatcgtgagcgacagaaaaatgatctacgagcagaaaattgcagaacttcagagacagttggccgaggaacccatggatacggaccaaggaaacagtatgttgtctgccatacaatcagaggtggccaaaaatcagatgctaattgaagaagaagtgcagaagctcaagagatataaaattgagaacatcagaagaaagcacaactatttgccctttataatggaactgttaaaaaccctggccgagcatcagcaattgatcccactggtggagaaattcgaaaaacactttgagaaaacgttactaggaaagtag

SEQ ID NO: 210507 - DNA, 582 bp, Artificial Sequence
  Description of Artificial Sequence: Synthetic coding sequence
atgaagggcctggccctgagcaacagcgacgtgatccggcaggtgcacaacagctttgcgagacagcagatgtttgaatttgacacaaagacttctgcaaaagaagaagatgcctttcactttgtgagttatgtgccagttaatggcagactgtatgagctcgacggcctgcgggagggacctattgatctgggcgcttgtaaccaagatgattggattagcgcagtaagacccgtgattgaaaagcgcatacagaaatacagtgaaggtgagattagatttaatttgatggccatcgtgagcgatcggaagatgatttacgaacaaaagatcgcagagttgcagcggcagctagctgaggaggagcccatggacaccgatcaggggaacagcatgctttccgctatacaatccgaagtggcgaagaatcagatgcttattgaagaagaggtacaaaagctgaagcggtacaagattgaaaacatccgccggaagcacaattatcttccatttatcatggagctactcaaaacacttgctgagcatcaacaactgatcccacttgtagagaaaatcttttag

SEQ ID NO: 210508 - DNA, 498 bp, Artificial Sequence
  Description of Artificial Sequence: Synthetic coding sequence
atggcccccaacgccagctgcctgtgcgtgcacgtgcggagcgaggagtgggacctgatgactttcgacgcaaacccatatgatagcgtgaagaaaataaaggagcatgtacgttcaaagactaaagtaccagtgcaagatcaggtgctcttgctgggttccaagatccttaagcctcgtcgctccttgtcctcctacggaatcgacaaggaaaagacaattcatctgactttgaaagtcgtaaaaccatccgatgaagagctccctttgtttctagtcgagagcggcgatgaggccaagcgccacctcctgcaagttaggcggtcctctagcgtcgcccaggtgaaggctatgatcgaaacaaaaacaggcattatccctgagacccagatagtgacatgtaatggcaaaagactagaggatgggaaaatgatggccgactacgggattcgtaagggcaaccttctgttcctcgcatgttactgcattggcgggtag

SEQ ID NO: 210509 - DNA, 498 bp, Artificial Sequence
  Description of Artificial Sequence: Synthetic coding sequence
atggcccccaacgccagctgcctgtgcgtgcacgtgcggagcgaggagtgggacctgatgaccttcgatgcaaatccgtacgattcagttaagaagattaaagagcatgtgagaagcaaaacgaaagtgcccgtccaggatcaggtgttgctgctgggcagtaaaatcttgaagccacgccgctctctaagctcatacggaatcgacaaggagaagactatacaccttactttaaaagtcgtaaagcctagtgatgaagagctacccctgtttctagtggagtcaggagacgaggccaagcggcatttgctgcaggttagaagaagctcatctgtggcccaggtaaaggcaatgattgagactaaaacaggaattattccagagacccagatagtgacatgtaacgggaaaaggctagaagacggcaagatgatggccgactacggcatccggaagggtaacctgctctttctggcatcatactgcatcggcggctag

SEQ ID NO: 210510 - DNA, 498 bp, Artificial Sequence
  Description of Artificial Sequence: Synthetic coding sequence
atggcccccaacgccagctgcctgtgcgtgcacgtgcggagcgaggagtgggatttaatgacttttgatgctaatccttatgattctgtgaaaaaaatcaaagaacatgtacgttccaaaaccaaggtccctgtgcaggatcaggtactgctgctgggttcaaaaattctgaaacctcgaagaagtttaagctcatacggaaccgataaagagaagactatccatctaaccctcaaagtggtgaagcctagtgacgaggaactgccgctgttcctcgtggagtctggagatgaggccaaaaggcatctgttgcaggtccgccggtcctcctctgtggcgcaggtgaaagcgatgatcgaaacgaaaacaggaattatccccgagacgcaaattgtcacctgtaacggcaagcggttggaagacggcaagatgatggcagactacggcattcgcaaaggcaatctgctcttccttgcctcctattgtatcgggggttag

SEQ ID NO: 210511 - DNA, 498 bp, Artificial Sequence
  Description of Artificial Sequence: Synthetic coding sequence
atggcccccaacgccagctgcctgtgcgtgcacgtgcggagcgaggagtgggacctgatgaccttcgacgcaaacccatacgattctgtgaaaaagattaaagaacacgtgcgctcaaagactaaggtgccagtccaggaccaagtgttgctcttgggcagtaaaatcttaaagcctagacgctcattaagcagctacgggacagataaggaaaaaacaatccatctaacactaaaggtggtgaagccttcagatgaagagttgccactgttcctggtcgaaagtggcgatgaggctaagcggcatctgctacaggtgcggagatcatcttccgtggcccaggtgaaggcaatgattgagactaagactgggatcataccagagacccagattgttacctgtaatggcaaaaggctcgaggacgggaaaatgatggccgattatggaatcaggaagggaaacctgctgttccttgcctcctactgtattggagggtag

SEQ ID NO: 210512 - DNA, 498 bp, Artificial Sequence
  Description of Artificial Sequence: Synthetic coding sequence
atggcccccaacgccagctgcctgtgcgtgcacgtgcggagcgaggaatgggacttgatgacattcgacgcaaatccctacgattcagtgaagaagattaaagagcacgtccgctcaaaaactaaagtacccgtccaggatcaggttttgctgctcggctcaaaaatcttgaaaccccgaaggtcgttatcatcttacgggattgataaggagaagactatccatctgacactgaaggtagtaaagcccagtgatgaggagctgccccttttcctggttgaaagtggtgacgaagctaagagacaccttctccaggttaggagatcgtcaagcgtcgcgcaggtcaaggccatgatagagacaaagacaggtatcatccccgagacccagattgttacctgtaacggtaagcggctagaagatggcaaaatgatggcggattacggcataagaaagggcaatcttttattcctagcttgttactgcatcgggggctag

SEQ ID NO: 210513 - DNA, 498 bp, Artificial Sequence
  Description of Artificial Sequence: Synthetic coding sequence
atggcccccaacgccagctgcctgtgcgtgcacgtgcggagcgaggagtgggatcttatgacattcgatgccaacccatacgacagcgttaaaaagatcaaagaacacgtccgcagcaaaactaaggtccccgtccaggaccaagttttactgctaggttccaaaattcttaagccacggagaagcctgtcatcttacggaaccgataaggagaagactatccatttgaccctgaaggtggtcaaaccttccgatgaagagctgcccctgttcttggtggagtcgggggacgaagcgaagcggcacctgctccaggtgagacgatcatctagtgtggcccaggtgaaggcaatgatcgagaccaaaaccgggattatacctgaaactcagatcgtgacatgtaacggcaagagactcgaggacggcaaaatgatggcagactatggaatccgcaagggcaatctgctgtttctggcatcatactgcatcggtggctag

SEQ ID NO: 210514 - DNA, 498 bp, Artificial Sequence
  Description of Artificial Sequence: Synthetic coding sequence
atggcccccaacgccagctgcctgtgcgtgcacgtgcggagcgaggagtgggacctgatgaccttcgatgccaatccatacgactccgtgaagaaaattaaagaacacgtgcggagcaagacaaaggtaccggtccaggaccaagttctgctgctcgggagcaagatcctgaaaccacgccgaagtttgtcctcttatggcatcgataaggagaagaccatccacctgacacttaaggttgttaagcctagcgacgaagagctccccctctttctcgtggagtccggagacgaggctaaaaggcacttactccaggtgagaaggtcatccagtgtcgcgcaagttaaagcaatgattgagacgaaaactgggattatccccgagacacagatagtcacgtgcaacggtaagaggctggaagacggaaagatgatggccgactatggcataagaaagggcaacctgctcttccttgcatcatattgcatcggcggctag

SEQ ID NO: 210515 - DNA, 705 bp, Artificial Sequence
  Description of Artificial Sequence: Synthetic coding sequence
atgggcggctgcgtgggcgcccagcacgacagcagcggcagcctgaatgaaaactctgagggcaccggggtggcacttggcaggaatcagcccctgaaaaaggaaaaaccaaagtggaagtccgactaccccatgacagatggacaactgcgaagcaagagagacgagttttgggatactgcccctgcattcgagggaagaaaggagatctgggatgccctcaaggccgcagcccacgcatttgagtccaacgatcatgaactggcccaggccataatagatggcgcaaatatcaccctcccccatggcgccttgacagaatgttacgacgagttaggtaacaggtaccagcttcccgtgtactgtctcgcacctcccatcaacatgatcgaagaaaaaagcgatattgagaccctcgacattcccgagcctccccctaattccgggtacgagtgccagctgcggctacgattgtccactggtaaggacttgaaactcgtcgtcagaagcacggatacagtgttccatatgaagagaaggctgcacgctgccgaaggagtagaacccgggtcccagcgatggttcttcagcggcagaccccttacagacaagatgaagtttgaggagctcaaaatcccgaaagattacgtggtgcaggtcattgttagtcagcctgtgcagaatccaacacctgtggagaattag

SEQ ID NO: 210516 - DNA, 924 bp, Artificial Sequence
  Description of Artificial Sequence: Synthetic coding sequence
atgttcagcttcaacatgttcgaccaccccatcccccgggtgttccagaatcggttttccactcaatatagatgtttttctgtctctatgctggccggcccaaatgataggtctgatgttgagaaaggaggaaagattataatgccgccctctgcccttgatcaattatcacggctgaatattacataccctatgctttttaagcttacgaacaaaaactcagaccggatgactcactgtggagtcctcgagttcgttgccgacgagggaatctgttacttaccgcactggatgatgcagaaccttctgttggaagagggcgggctcgtccaggtggaaagcgtcaacttacaggtggccacctactctaagttccagccccaaagccctgacttcctggacatcactaaccccaaggctgtgttggagaatgcgttaagaaattttgcttgcctgacaaccggcgatgtcattgccatcaattacaacgaaaagatatatgaactacgggtcatggagactaaaccagacaaagcagtgtccattattgaatgtgatatgaacgtcgatttcgatgcccccctggggtacaaggagcctgaacggcaggtccaacacgaggagtcgacagaaggtgaggctgatcactctgggtacgcgggagagctggggtttcgtgcgttctctggatcgggcaatagactggacggcaagaagaagggtgttgagccctcccccagccccataaaaccgggagacatcaaacgcggaatcccaaattatgagtttaaacttggaaaaattacgttcatcaggaactcgaggccactggttaagaaggtggaggaagatgaagccggcgggcggttcgtcgcatttagcggcgaaggtcagtccctgaggaaaaaggggcgcaagccgtag

SEQ ID NO: 210517 - DNA, 891 bp, Artificial Sequence
  Description of Artificial Sequence: Synthetic coding sequence
atgttcagcttcaacatgttcgaccaccccatcccccgggtgttccagaaccgattctctacccagtacaggtgttttagcgtgagtatgctcgctggcccaaatgatcgaagcgacgttgaaaagggagggaaaagcagactgaatataacatatcctatgttgtttaagctgactaataaaaattctgacaggatgacacactgtggtgtgttagagttcgttgccgatgaggggatttgctatctcccccactggatgatgcagaatctgctcctggaagaggggggcctggttcaggtcgagagcgtcaacttgcaggtcgccacatacagtaagtttcaaccccaaagccccgacttcttggatattacaaacccaaaggctgtcctcgaaaatgctctacgaaatttcgcctgcctcaccacgggcgacgtgatcgcgattaactataatgaaaaaatttacgagttacgggttatggagacaaaaccagacaaggcagtgtcaattatcgagtgtgatatgaacgtggactttgatgcgcccctgggatacaaggagcctgagcggcaggtccagcacgaagagtcaacggagggcgaggccgaccactcaggctatgccggggagctcggatttcgggccttcagcggttccggaaaccgactggacgggaaaaagaaaggcgtcgagccgtcccctagcccaatcaagccaggagatatcaagagggggataccgaattatgagttcaagcttgggaaaattacctttatccggaacagccgccctctcgtgaagaaggtggaggaggatgaggcagggggaaggttcgtggcgttcagcggcgaaggtcagagccttagaaagaaagggcggaagccttag

SEQ ID NO: 210518 - DNA, 1032 bp, Artificial Sequence
  Description of Artificial Sequence: Synthetic coding sequence
atgttcagcttcaacatgttcgaccaccccatcccccgggtgttccagaataggttctcaactcagtatagatgtttttccgtgtccatgctggccggacctaatgaccgctccgatgtggaaaaaggagggaagattattatgccacccagtgcattagaccagctgtctcgattgaacatcacatacccaatgctattcaagcttactaacaagaattctgatcgaatgacgcattgcggtgtactggagttcgtcgctgatgagggcatttgttacctacctcattgggtggtttatagactcagtctggagcgagatggtctgaagtctctagaagtggccgaggtgagcggatccgattacttccctagccccttctgcggactggaagtctggatgatgcagaatctcctgctggaagaaggcggcctggtacaggtcgaaagcgtgaatcttcaggtcgctacgtacagtaaatttcagccccagtctccagatttcctggatatcaccaacccgaaggctgtgctagagaatgctttgagaaattttgcgtgccttacgaccggtgacgtcatagcaatcaactataacgagaagatttatgaactcagagttatggaaacaaagcctgataaagctgttagtattattgagtgcgatatgaatgtggacttcgatgcccccctgggatataaagagcctgaacgacaggtccagcacgaggaatcaactgaaggagaggcagatcactcagggtatgcaggggagttgggatttagagcattttctggatctgggaataggctcgatggcaagaagaaaggcgtcgaaccgtcccccagtcctattaaaccaggcgatatcaagcggggcattcctaactacgagtttaagttaggaaagattaccttcatccgcaactcacggccactagtgaagaaggtagaagaggacgaagccggtgggcgcttcgtggccttcagcggagaaggtcagagtctgagaaaaaaaggacggaaaccttag

SEQ ID NO: 210519 - DNA, 801 bp, Artificial Sequence
  Description of Artificial Sequence: Synthetic coding sequence
atgttcagcttcaacatgttcgaccaccccatcccccgggtgttccagaacagattcagtactcaatacaggtgcttcagtgtaagcatgctcgcgggaccgaatgacaggtctgacgtcgaaaagggcggcaagatcatcatgcctcccagcgccctcgatcagttgtccaggctgaacatcacctacccaatgcttttcaagttgaccaataagaattcagaccgtatgacccactgcggggtcctggagttcgtcgctgacgaaggaatctgctacttaccacactggatgatgcagaatctcttgttggaggaagggggcctcgtccaggtagagagtgtgaacctgcaggtcgctacatacagtaagtttcagccccagagccctgattttctggatatcactaatccaaaggcagttcttgaaaatgcactccggaacttcgcctgcctgaccaccggcgatgtcatcgccatcaactataatgaaaagatctatgaattgcgcgtcatggagactaaacctgataaggccgtctccataattgaatgtgatatgaacgtggacttcgatgcgccactgggctataaggaacccgagcgccaggtccagcatgaagaatccacagaaggggaggccgatcactccggctacgcaggagagctgggcttccgcgcattcagtgggtcaggaaaccgtctggatgggaaaaagaagggtgtggaaccaagtccatcgcctattaaacctggcgatatcaagcgcggcatacccaactacgaattcaaattgggttag

SEQ ID NO: 210520 - DNA, 1053 bp, Artificial Sequence
  Description of Artificial Sequence: Synthetic coding sequence
atgctgcccctgcccgacctggacctgtggcccctggaccggctgccgtctcctattaaaagaaagccacagacactgggctccctcaaatccagtcaaggtatcgtagaagagacctccgaggagggaaacagcgtgccggcctcccagtctgtcgcagcactgacatccaaaagatctttggtcttgatgccggagagttccgcagaagaaatcacagtttgtccggaaacccaattaagctcaagcgagaccttcgatctcgagcgggaagtctcacccggaagtcgagacattttagacggcgttaggattataatggccgacaaggaagtgggcaacaaggaagacgccgagaaagaagtcgccatctcaacctttagcagttcaaatcaagtctcttgtcctctttgcgaccagtgtttcccgcccacaaaaatcgagcggcacgcaatgtattgtaacggcctgatggaggaggataccgaagttctgactagacgccagaaagaagccaagacaaagtcagatagcggaacagccgcacagacctcgctggatattgataaaaatgagaagtgctatttgtgcaagtctcttgtccctttcagggagtatcagtgccatgtggatagctgtctgcagctggcaaaggccgaccaaggggacggaccagaaggatccgggcgagcctgttccacagtcgagggtaagtggcagcagaggctcaagaaccctaaggaaaaagggcacagcgaagggcgtttactcagtttccttgaacagagcgaacataagacgagtgacgctgacatcaaaagctctgaaacaggagcattcagggtgccatctccgggtatggaagaggccgggtgttctagggaaatgcagagctcctttacccgccgagatttaaacgagtcgccagtcaaatcttttgtgagcatctctgaggcaaccgattgtcttgtggatttcaagaagcaggtgactgttcagccaggctctaggaccagaacaaaagccggacgagggagacgccggaagttctag

SEQ ID NO: 210521 - DNA, 2163 bp, Artificial Sequence
  Description of Artificial Sequence: Synthetic coding sequence
atgccccggcggaagaagaaggtgaaggaggtgagcgagagccggaacttggaaaagaaagatgtggagaccacatccagcgtgtcagtaaaaagaaaaaggcgcttggaggatgcatttatcgtgatctcagacagcgacggagaagagccaaaggaagaaaatggcctgcagaagaccaagactaagcagtccaaccgcgcgaaatgcctagctaagcgaaagatagctcagatgacagaggaggaacagtttgctctggcacttaaaatgtctgagcaggaagcccgcgaggtgaactcccaggaagaagaggaagaggagttgcttcgtaaggccatcgcagagagcttgaattcatgccgcccatccgacgcctccgctacaaggtctcggcccctcgctactggtccatcttcgcagtcccaccaggaaaaaacaacagattccggcttaacagaagggatctggcagctcgttccaccttccttgtttaaggggagccacataagccagggtaatgaagcagaggagagggaggagccctgggatcatacggaaaagactgaagaggagccagtctcagggagttctgggagctgggaccagagttctcagcccgtttttgaaaatgtaaatgtgaaatcttttgaccggtgcaccggacattctgcagaacacacacagtgcggcaagccacaggagtctacaggtaggggatctgcctttcttaaggcagtacagggcagcggggacacatctcgacactgcctacctactctggcagatgctaaaggactgcaggataccgggggaacagtcaactatttttggggtatacccttctgtcccgatggcgttgatcccaaccagtatactaaagtcattctgtgtcagctggaggtgtaccagaaatcactgaaaatggcccagcgtcaacttttaaacaaaaagggtttcggtgaaccagtgttgcctcgccccccttccctgatacagaatgaatgcggtcagggggaacaggcatccgaaaagaatgagtgcattagcgaggacatgggggatgaggacaaggaagagcggcaggaatcccgcgctagtgattggcactccaaaacgaaagacttccaggaatcgtcaatcaagtctctgaaagagaaacttctgctcgaggaagaaccaacaacatcacacggtcaatcaagccaaggcatcgtggaggagactagcgaggaaggcaattccgttcccgcatcacagtcggtggcagctcttacctcaaaaaggtccttggttctgatgcccgaaagctccgccgaagaaatcaccgtgtgtcctgaaactcagctctccagctccgaaacatttgacttggaacgggaggtctcgcctggcagcagggacatacttgacggagtcagaatcatcatggcagacaaggaagttgggaataaagaggacgccgaaaaggaggtggctatttctacttttagcagctcaaaccaggtttcgtgtccgctttgcgaccaatgttttccccctaccaaaattgaaaggcatgccatgtattgcaatggtctgatggaggaagacaccgaggtgcttactagaagacaaaaagaggccaagacgaaatcagattccgggaccgccgcgcagacctccttggacatagacaagaacgagaagtgctacctttgcaaaagccttgtgcccttccgagagtaccagtgccacgtggacagttgtctgcagctcgcaaaagcggatcaaggagacggccctgagggttcaggaagagcgtgttcaaccgtcgaggggaagtggcagcagcgcctgaaaaacccaaaggaaaagggtcactctgaaggacgattgcttagctttctggaacagtccgaacacaagacctcggatgccgacatcaagtccagtgagaccggtgcgtttcgggtccccagccccggtatggaggaagccggatgctccagggagatgcagtccagcttcacccgccgcgatctgaatgaaagccctgtcaaaagttttgtcagcatcagtgaagctacagattgcctggtggattttaagaaacaagtgactgtgcagcctggcagtagaaccaggactaaagcaggaagaggccgacgaaggaaattctag

SEQ ID NO: 210522 - DNA, 1929 bp, Artificial Sequence
  Description of Artificial Sequence: Synthetic coding sequence
atgaccgaggaggagcagttcgccctggccctgaagatgagcgagcaggaggcacgagaggttaactctcaggaggaggaagaagaggagctgctgagaaaagcaatcgccgagagccttaatagctgcaggccttctgatgcctcggccactaggtcgcgccctcttgctacaggcccttcctcccagtcacaccaggaaaagactacagacagtgggcttactgaagggatttggcagctggtacctccaagtctgttcaagggctcgcatatttcacagggcaatgaggctgaggagcgcgaagagccgtgggaccatacagaaaagacagaggaggagcctgttagcggctcttccggcagttgggaccagtcctcccagcccgtatttgaaaacgtcaatgttaaaagcttcgacagatgtactggccattccgcggaacatactcagtgcggaaaaccacaggaatcgaccggacgtgggtccgccttccttaaagccgtgcagggatctggggatacctccaggcactgcctgcctactcttgccgatgcaaaaggtttgcaggatacaggcggaaccgttaactacttctgggggatcccgttctgtcccgacggcgtggaccctaatcagtatacaaaagtcatcctgtgtcagctggaggtgtaccagaaatctctgaaaatggcccagcgccagcttttgaacaagaaagggttcggagaacctgtgttgcctcgacccccatctctaatccagaatgaatgcgggcaaggtgagcaagccagtgagaagaacgagtgcatctcagaggacatgggcgatgaagacaaagaggaacggcaagagagtcgtgcttccgattggcatagcaaaacaaaggatttccaggagtcttccataaaaagcctcaaagagaagcttctattggaagaagaacctactaccagccacggccagtcttctcagggcatagtggaagagacatccgaggagggaaattcagtgcccgcttctcagagtgttgcggcactgacaagcaagcggtcattggttctgatgcctgaatcgtctgctgaagagattaccgtgtgccccgaaacacaattgtccagttcagaaactttcgacctagaaagggaggtctcaccaggaagtagggacatcttggatggcgttaggatcattatggccgacaaggaggtcgggaacaaagaggacgccgaaaaagaagtggccatttcaactttctctagttccaaccaagtatcatgcccactttgtgaccagtgttttccccccacaaaaatcgaaagacatgctatgtactgcaacggcctgatggaggaagacactgaggtcttgactcggcggcagaaggaggcaaagacaaagtcagattcggggacggccgcacaaacatccctggacatcgacaagaatgagaaatgctatctctgcaagagtctcgtccctttccgggaatatcagtgccacgtcgactcctgcctgcagctggcaaaagctgatcagggtgacgggcctgaaggctcagggagagcgtgttctaccgtggaaggaaagtggcagcagcgtctgaagaacccgaaggagaagggccattcagaggggcgtttgctgtcattcctcgaacaaagcgaacacaagacctcagatgcagatattaagagctcagagacaggcgcctttcgggtcccttctccaggcatggaagaagccggatgttcaagggaaatgcaatctagtttcacaagacgcgaccttaatgaatcccccgtcaagtccttcgtctcaatcagcgaagcgactgactgtctcgtggattttaaaaaacaggtgaccgtccagcctgggagtagaactagaacaaaagccgggaggggtaggcggcgtaagttctag

SEQ ID NO: 210523 - DNA, 2160 bp, Artificial Sequence
  Description of Artificial Sequence: Synthetic coding sequence
atgccccggcggaagaagaaggtgaaggaggtgagcgagagccggaatttggagaagaaggacgtagaaacaaccagtagtgtgagcgtgaaaaggaagagacgcctggaagacgcctttattgtgatctctgacagtgacggtgaggagccgaaagaagaaaacggactccaaaaaacaaaaacaaaacagagcaatagggccaaatgcctggccaagcggaaaatagctcaaatgacagaggaggaacagtttgctctggctctgaagatgagcgagcaggaagctagggaagtcaatagccaggaagaggaagaggaggaattgctccgaaaggccatagccgaatcacttaatagctgcaggcccagcgatgcttctgccactcggtctaggccgttggctactgggccatcatcccagagtcaccaggaaaaaactactgattcaggacttaccgagggaatttggcaactagtaccccctagcctgtttaaaggcagccacatctcccaggggaacgaagcggaagaacgggaagagccctgggatcacactgagaaaacggaggaggaacccgtaagcggcagcagcgggagttgggaccagagcagtcagccagtcttcgagaatgtgaatgtaaagagctttgatcggtgcacaggccacagcgcagaacatacgcaatgtggcaagccacaggagagtaccggaaggggctcagcattcctgaaagcagtgcagggtagtggcgatacctcccgacactgcctccctacactggcagatgcaaaaggacttcaggacactggcggtacggtcaactacttttgggggattcctttctgtcctgatggagtggacccaaaccaatacacaaaggttatcctgtgccagctagaagtgtatcagaagtcgctgaaaatggcccagaggcaacttctgaataaaaagggattcggagagccagtactgcctagacccccatcgctcatccagaatgaatgtggccaaggcgaacaggccagtgaaaagaacgaatgtatttcagaggatatgggggacgaggacaaggaggaacgacaggaatcacgcgcctccgattggcatagtaagaccaaggattttcaggaatcatccatcaaaagcttgaaagaaaaattgttgctggaagaggaacctacaacatctcacgggcagtcctcacagggtatcgttgaagagacgagtgaggaagggaattctgtccctgcttcgcaatctgttgcggcattgacctcaaaacgttctctcgtgctgatgcccgagtccagcgcggaggagatcactgtctgtcctgagactcagcttagctcttccgagaccttcgatcttgagcgagaggtttcacccggatctagggacatcctggatggcgtgcgtatcattatggctgataaggaagtgggcaataaggaggatgccgagaaagaggtagcaatcagcacctttagcagtagcaaccaggtaagttgtccattgtgtgatcagtgctttccacccacgaaaatcgaacgccacgccatgtactgcaatggactgatggaagaagatactgtattgacccgcagacagaaggaggcgaaaactaagtcagacagtggcacagctgcccagacttctctggacatcgacaagaatgagaagtgctacctgtgtaaatcccttgtccccttccgggagtaccaatgccacgtagactcatgtcttcagcttgcgaaagctgaccagggcgacggcccagaaggatccggacgggcttgcagtactgtagaaggcaagtggcagcagcgactaaaaaatcccaaagagaagggccatagtgaaggaagattgctctctttcttggagcaatcagagcacaaaactagtgatgcggatatcaaatcatcagagacaggagcctttcgtgttccatcaccaggaatggaggaggcgggatgctctcgggaaatgcagtcctcttttacccgcagagacctgaacgaatcccccgtgaagagctttgtgagcatcagtgaggccactgattgcttggtcgactttaaaaagcaggttaccgtacagcccgggagccgcacacggaccaaggctggtagaggacgaagacgaaaattttag

SEQ ID NO: 210524 - DNA, 96 bp, Artificial Sequence
  Description of Artificial Sequence: Synthetic coding sequence
atgccccggcggaagaagaaggtgaaggaggtgagcgagagccggaacttggagaagaaagacgtcgaaactacgtcttcagtgagtgtcaaatag

SEQ ID NO: 210525 - DNA, 270 bp, Artificial Sequence
  Description of Artificial Sequence: Synthetic coding sequence
atgccccggcggaagaagaaggtgaaggaggtgagcgagagccggaacctcgagaagaaagatgtcgaaactacttcaagcgtgagtgtgaagaggaagcggcggctggaagatgcctttatcgtgatatcagactcagatggcgaggaacctaaggaggagaatggcctacaaaaaaccaagacaaagcagagcaatagagccaaatgcctggcgaaaagaaagatcgcccaaatgacagaagaagagcagttcgcgctggccttgtag

SEQ ID NO: 210526 - DNA, 474 bp, Artificial Sequence
  Description of Artificial Sequence: Synthetic coding sequence
atgccccggcggaagaagaaggtgaaggaggtgagcgagagccggaatctggaaaagaaggacgtcgaaaccacatccagcgtgtccgtcaagcgaaagcggcgcctcgaagatgcctttatcgtcattagcgattccgacggggaagaacccaaggaggaaaacgggcttcaaaaaactaagacaaagcagtcaaaccgcgcaaagtgtctcgccaagcgcaaaatcgcccagatgactgaagaggagcagttcgctttggctttgaagatgtcagagcaggaagccagagaagttaattctcaagaggaggaagaagaagagttactgcgaaaagctatcgcggagagcctcaactcttgtaggcctagcgacgcctcagccacacgaagtaggcctctcgcgactgggccgagctctcagagccaccaagaaaagaccaccgactctggactcaccgagggcatctggtag

SEQ ID NO: 210527 - DNA, 2160 bp, Artificial Sequence
  Description of Artificial Sequence: Synthetic coding sequence
atgccccggcggaagaagaaggtgaaggaggtgagcgagagccggaacttggagaagaaggacgtagaaacaacctcttccgtcagcgtgaaacggaagaggcgcctggaggacgccttcattgtgatctccgactcggacggcgaggaacccaaagaggagaatggattgcagaagacaaaaaccaaacagtccaacagggctaagtgtttggccaaacgaaaaattgcacagatgactgaggaggagcagttcgctctcgccctgaaaatgtctgagcaggaagcccgcgaagtgaattcccaggaggaggaagaggaagaactgctccgtaaagctatcgcagaatcactcaattcatgcagacctagcgacgcttctgccaccaggtctcggcctctagccactggtccaagcagccagtctcatcaggaaaaaacaacggatagcgggttaacggagggcatctggcaactggtgccgccttcactctttaaggggtcccatatcagtcagggcaacgaggccgaagagcgtgaagagccctgggatcataccgagaagacggaagaggagccagttagcggatctagtggatcctgggatcagtctagtcaacctgttttcgagaacgtgaatgtgaagtcatttgatcggtgcacgggacattccgccgagcatacccaatgtggcaagcctcaggaaagtaccggccgtggcagcgccttcctgaaggctgtgcagggctctggcgacacctctagacactgcttaccaaccctggctgatgctaaaggtctgcaagataccggcggaaccgtgaattatttctggggaatcccattttgccctgacggtgtggacccaaatcaatatactaaggtcatcttgtgtcagctcgaggtgtatcaaaaatctctgaaaatggcacaaaggcagctgctcaataagaaaggttttggagagcccgttctcccccgtccgccatcgctgatccaaaacgagtgcggccaaggtgagcaagcatctgaaaagaatgagtgcatttccgaagacatgggggatgaggataaggaagagcgccaggagagcagagcatcagattggcactccaagacgaaggattttcaggaaagtagtatcaaatccctgaaagagaaactgctcctcgaggaggagccaacaacttcccacggccagtcctcccagggaattgtggaggaaacctccgaggagggcaactccgttccagcctcacagtccgtcgccgcgttgacctccaaacgctcactggtgcttatgcccgagtcctcagccgaggagatcaccgtctgtcccgaaactcaactgtcttcaagcgagacttttgatctcgagcgcgaagtctccccaggcagtcgtgacatcttggacggcgtgcgaattattatggctgataaggaagttgggaacaaagaggacgccgagaaggaggtggccatttcgactttctcatcgagcaatcaggtttcttgcccgctatgtgaccagtgttttccccccacaaagatcgagcggcacgccatgtattgcaacgggttgatggaagaagatactgttctgacgagacggcaaaaagaagccaagacaaaatccgatagcggaacagcagctcagactagcctagacattgataaaaacgaaaaatgctacctgtgtaaaagcctggtcccatttcgagaataccagtgccacgttgacagttgcctccagctggccaaagcagatcaaggcgatggcccggagggcagcgggagagcttgttctacagtcgagggcaagtggcagcaacggctgaagaatccaaaagagaagggccatagtgagggcaggctgctcagtttcttggagcagagcgaacataaaacgagcgacgcggacatcaagtcttcggagaccggggcatttagggttcctagccccgggatggaagaggccgggtgtagccgagagatgcagtcatctttcacaaggcgcgatctgaatgagtccccggttaagtcatttgtgagcatctctgaggctaccgactgtcttgtcgacttcaaaaagcaagtaactgtgcagccaggaagcaggactaggactaaagcggggcgggggaggagacggaaattctag

SEQ ID NO: 210528 - DNA, 5250 bp, Artificial Sequence
  Description of Artificial Sequence: Synthetic coding sequence
atggccgacgaggaggccggcggcaccgagcggatggagatcagcgctgaactgccgcagaccccacagagacttgcctcctggtgggaccaacaggttgacttttacacagccttcctgcaccatctggcccaactcgtcccggagatatattttgccgagatggacccagatctggaaaagcaagaggagtcagtacaaatgagcatcttcacccccttagagtggtatctatttggggaagacccagacatctgtcttgagaaactgaaacactctggagccttccagctctgcggccgggtgttcaaatcaggcgagacaacgtattcctgccgtgattgtgccatcgacccgacatgtgtcctgtgtatggattgcttccaagatagtgtccacaagaatcatcgctacaaaatgcacactagcacggggggggggttttgcgactgtggggatacagaagcctggaagaccggccccttttgcgtcaatcacgagccaggccgggctggaacgatcaaggaaaacagcagatgccccctgaacgaagaagtgatcgtgcaggcccggaagatcttcccctctgtcattaagtacgttgtggagatgacaatctgggaagaggagaaggaactgccaccagaacttcagatccgagagaagaacgaaaggtactactgcgtgctctttaatgatgagcaccacagttacgaccacgttatttacagcctgcaaagagctctggactgtgagcttgcagaggcgcagctgcacaccacggcaattgacaaggagggtcgtcgcgcagtcaaggcgggcgcctacgcagcatgccaagaggccaaagaggacatcaaaagccactcagaaaacgtcagtcagcacccacttcatgtagaggtactgcacagtgagatcatggcacatcaaaagtttgctctacgactgggcagttggatgaacaagataatgagttacagcagcgatttccgtcagatcttttgtcaggcctgtcttagagaggagcccgactcggagaacccctgcctcatatcgcgcctgatgctctgggatgcaaaactgtacaagggcgcaaggaagatcctacacgagttaatcttttcttctttcttcatggagatggagtacaagaagctgtttgccatggaattcgtgaaatactacaagcagctccaaaaagagtacatctctgatgatcacgatcgctccatctcaatcacagccctgagcgttcagatgttcaccgtcccgactctcgcaagacacctaattgaagagcagaacgtcatcagcgtaataaccgaaacattacttgaagtgctccctgagtatctggatcgcaacaacaagttcaattttcagggatattcccaagataagctgggcagagtgtatgccgtaatttgtgacttgaagtatatcctgatttcgaagccaaccatttggacagagagactacggatgcagttcctcgagggattccggagttttctgaaaatcttgacatgcatgcagggcatggaggagataaggaggcaggtcggtcaacatattgaggtcgacccagactgggaagcggccatcgcaatccagatgcagctgaaaaacattttacttatgttccaggaatggtgtgcttgcgatgaagaactgcttttagttgcctacaaggagtgccataaggctgtgatgcgatgctcaacatcttttattagtagtagtaaaaccgtcgtacaatcttgcggacattcacttgaaaccaaaagctatcgagtctctgaagatctggtttccattcatctgccactgtcacggactctcgcaggattgcacgttcgtttatccaggctgggtgcagtttcacgcctgcacgaattcgtgagctttgaagactttcaagttgaggtactggtcgagtaccctttgagatgcctggtgttagttgcacaggtggtcgctgagatgtggcgacggaatggcctgtcactaatatcccaggtgttctactaccaagatgtgaaatgcagggaagaaatgtacgataaggacattataatgctccagatcggcgcttcccttatggaccccaacaaatttctactgctggtccttcagcggtatgagctcgcagaggcatttaacaagaccataagcacaaaggatcaggatctcataaaacagtacaacaccctgatcgaagagatgctgcaggtgctcatttatatcgtcggagaaaggtacgtgcctggcgtgggcaatgtaacgaaggaggaggtcaccatgcgagaaatcatccatcttttgtgtatcgagcctatgcctcacagcgccattgctaaaaacctaccagaaaacgagaataacgagactggcctggaaaatgtgataaacaaagtggccacgttcaagaagccgggggttagtggccatggtgtctatgaattgaaggatgaatccctgaaggacttcaatatgtatttttatcattactccaagacccagcattctaaagccgagcatatgcaaaagaaacgaaggaagcaggaaaataaggacgaagcattgccacctccaccacctcccgagttttgccctgcctttagcaaggtgatcaacctgctgaactgcgatattatgatgtatatcctgagaacagtattcgaacgtgcaatcgacacagactccaatctgtggaccgagggaatgctgcaaatggccttccatatcttagcgctggggctgctcgaggaaaaacagcagctacagaaggcccccgaggaggaagtgacctttgatttctatcacaaggcctctcgacttggatcctcagctatgaatattcagatgctcctagaaaaactaaagggcatccctcagctggaaggccagaaagatatgattacttggattctgcagatgttcgatacagtgaagcgtctacgggaaaaaagctgcttgatcgtcgcaaccaccagcggctcggagagcatcaaaaacgatgaaattactcacgataaagagaaggctgagagaaagcgtaaagcggaggccgcccggttgcaccgccagaaaattatggcccaaatgagcgccctacagaagaatttcattgagacccacaaactcatgtatgataatacatcagagatgcctggaaaggaggattcaatcatggaggaggaatccacccctgccgtttccgattactctcgtattgcacttggtccaaagcgcgggccgtcagttaccgaaaaggaagttctgacatgtattctttgccaagaggagcaggaggttaagatcgagaacaacgccatggtcttgtcggcttgcgtccaaaaatctacagccctgactcagcacaggggcaagccaatcgagctcagcggtgaggcattggatcccctctttatggaccccgacctggcctatggaacctatacaggatcctgcggacatgtaatgcacgctgtgtgctggcagaaatactttgaggccgtgcagctgtcatcccagcaacgaattcacgtggacctgttcgacttagagagcggcgaatatctgtgcccactgtgtaagagtctctgtaacactgtgatccccataattccactccagccccagaaaattaactcagagaatgccgacgcactggcacagctgctaactttagctcgatggatccagaccgttttagccagaatctctggctataacattcgtcacgctaaaggagagaatcctatccccattttctttaaccagggaatgggtgattcgactctggagttccactctatcctgagcttcggcgtggaatcaagcattaaatattcgaattctatcaaagaaatggtgatcctcttcgctacgaccatctaccggatcggcttgaaagtgccccccgatgagagagatccgagagtgcccatgttaacctggagtacatgcgctttcaccattcaagccattgagaatctgcttggagatgagggtaagcctctgttcggagcccttcagaatcgccagcataacggcctgaaggcactcatgcagttcgccgtggcacagagaatcacttgcccccaagtgcttattcaaaagcatctcgtgagacttctgtctgtcgtactgccaaacatcaaatctgaggacacgccatgcctgctgagtatcgacctttttcacgtgctcgtgggcgccgtattagcattcccttccctgtactgggatgacccggtggacctgcagccatcctcagtgagtagcagctacaaccacctctacctttttcatctgattacaatggcccatatgctacagattctgttgacagtggacactggactgcccttagctcaggtgcaggaagactcagaggaagcacacagcgcctccagcttttttgcagagatctctcagtatactagtggatccattgggtgcgatatccctggctggtacctgtgggtgagtctcaaaaacggcatcactccttatctaagatgtgccgctctcttctttcactacctcttgggtgtgactcctcctgaggaattgcatacaaatagcgccgagggtgaatactctgccctgtgctcatacttaagcctccccaccaatctgttcctcctattccaagaatactgggatacagtacgtccgctactgcaaagatggtgtgccgaccccgccctgctgaattgcctcaagcaaaagaacaccgtggtccgctacccccgtaaaaggaactcattaattgagctgccagacgattattcctgcctgttaaatcaagcaagtcacttccggtgccctcgctccgccgacgatgagcgcaagcaccccgtactctgcctgttctgcggagctattctctgtagtcagaacatctgttgccaggagatagtgaacggagaagaggttggggcgtgtattttccacgcgctgcattgtggagctggagtttgtatcttcctgaagatcagggagtgtagagtggtgcttgtggagggtaaagcgcgcggatgtgcttacccagccccctatctggacgagtatggtgagacagacccaggactgaagcgggggaaccccctgcacttatcacgggaaaggtaccgcaagcttcatctcgtgtggcagcagcactgcatcatcgaagaaattgcaagaagtcaggagaccaaccagatgctgtttggattcaattggcagctgctgtag
